United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 25

SEQ ID NO: 925126 - RNA, 23 nt, Mycobacterium avium subsp. paratuberculosis
accagguagcgcugcauagucgg

SEQ ID NO: 925127 - RNA, 19 nt, Mycobacterium avium subsp. paratuberculosis
accagguagguggccgucg

SEQ ID NO: 925128 - RNA, 17 nt, Mycobacterium avium subsp. paratuberculosis
accagguccaccccgcc

SEQ ID NO: 925129 - RNA, 23 nt, Mycobacterium avium subsp. paratuberculosis
accaggguggucagcgucucggc

SEQ ID NO: 925130 - RNA, 22 nt, Mycobacterium avium subsp. paratuberculosis
accaggguuucaugcacggcgc

SEQ ID NO: 925131 - RNA, 12 nt, Mycobacterium avium subsp. paratuberculosis
accagggugcgc

SEQ ID NO: 925132 - RNA, 16 nt, Mycobacterium avium subsp. paratuberculosis
accagggugcgcacga

SEQ ID NO: 925133 - RNA, 17 nt, Mycobacterium avium subsp. paratuberculosis
accagggugcgcacgau

SEQ ID NO: 925134 - RNA, 23 nt, Mycobacterium avium subsp. paratuberculosis
accagggugcgcacgaucugcag

SEQ ID NO: 925135 - RNA, 18 nt, Mycobacterium avium subsp. paratuberculosis
accagggugcgcagcgcg

SEQ ID NO: 925136 - RNA, 19 nt, Mycobacterium avium subsp. paratuberculosis
accagggugcgcagcgcgu

SEQ ID NO: 925137 - RNA, 12 nt, Mycobacterium avium subsp. paratuberculosis
accaggguggcc

SEQ ID NO: 925138 - RNA, 14 nt, Mycobacterium avium subsp. paratuberculosis
accaggguggccgc

SEQ ID NO: 925139 - RNA, 18 nt, Mycobacterium avium subsp. paratuberculosis
accaggguggccgccacc

SEQ ID NO: 925140 - RNA, 19 nt, Mycobacterium avium subsp. paratuberculosis
accaggguggccgccacca

SEQ ID NO: 925141 - RNA, 19 nt, Mycobacterium avium subsp. paratuberculosis
accagggcgguggcggcga

SEQ ID NO: 925142 - RNA, 18 nt, Mycobacterium avium subsp. paratuberculosis
accagggcgucgagcgcg

SEQ ID NO: 925143 - RNA, 21 nt, Mycobacterium avium subsp. paratuberculosis
accagggcgucgagcgcgucg

SEQ ID NO: 925144 - RNA, 14 nt, Mycobacterium avium subsp. paratuberculosis
accagggcguguug

SEQ ID NO: 925145 - RNA, 14 nt, Mycobacterium avium subsp. paratuberculosis
accagggccgcgag

SEQ ID NO: 925146 - RNA, 18 nt, Mycobacterium avium subsp. paratuberculosis
accagggccucgucgucg

SEQ ID NO: 925147 - RNA, 19 nt, Mycobacterium avium subsp. paratuberculosis
accagggcgaggaacccga

SEQ ID NO: 925148 - RNA, 20 nt, Mycobacterium avium subsp. paratuberculosis
accagggcgaggaacccgac

SEQ ID NO: 925149 - RNA, 23 nt, Mycobacterium avium subsp. paratuberculosis
accagggcgaucaccgcggccac

SEQ ID NO: 925150 - RNA, 23 nt, Mycobacterium avium subsp. paratuberculosis
accagggucuucagcccgcgcau

SEQ ID NO: 925151 - RNA, 18 nt, Mycobacterium avium subsp. paratuberculosis
accagggugccccgcgac

SEQ ID NO: 925152 - RNA, 14 nt, Mycobacterium avium subsp. paratuberculosis
accagggugccgcc

SEQ ID NO: 925153 - RNA, 18 nt, Mycobacterium avium subsp. paratuberculosis
accagggugccgccgggc

SEQ ID NO: 925154 - RNA, 19 nt, Mycobacterium avium subsp. paratuberculosis
accagggugccgccgggca

SEQ ID NO: 925155 - RNA, 21 nt, Mycobacterium avium subsp. paratuberculosis
accagggugccgccgggcacc

SEQ ID NO: 925156 - RNA, 15 nt, Mycobacterium avium subsp. paratuberculosis
accaggucgccggcg

SEQ ID NO: 925157 - RNA, 19 nt, Mycobacterium avium subsp. paratuberculosis
accaggucgccggcggccg

SEQ ID NO: 925158 - RNA, 21 nt, Mycobacterium avium subsp. paratuberculosis
accaggucgccggcggccgac

SEQ ID NO: 925159 - RNA, 22 nt, Mycobacterium avium subsp. paratuberculosis
accaggucgccggcggccgaca

SEQ ID NO: 925160 - RNA, 17 nt, Mycobacterium avium subsp. paratuberculosis
accaggucgcggcgcug

SEQ ID NO: 925161 - RNA, 18 nt, Mycobacterium avium subsp. paratuberculosis
accaggucgcggcgcugc

SEQ ID NO: 925162 - RNA, 16 nt, Mycobacterium avium subsp. paratuberculosis
accagguucgcgcagc

SEQ ID NO: 925163 - RNA, 16 nt, Mycobacterium avium subsp. paratuberculosis
accagguugucgccgc

SEQ ID NO: 925164 - RNA, 17 nt, Mycobacterium avium subsp. paratuberculosis
accagguugucgccgcg

SEQ ID NO: 925165 - RNA, 18 nt, Mycobacterium avium subsp. paratuberculosis
accagguugucgccgcgc

SEQ ID NO: 925166 - RNA, 20 nt, Mycobacterium avium subsp. paratuberculosis
accagguugucgccgcgcca

SEQ ID NO: 925167 - RNA, 22 nt, Mycobacterium avium subsp. paratuberculosis
accaggucguugccggugccga

SEQ ID NO: 925168 - RNA, 15 nt, Mycobacterium avium subsp. paratuberculosis
accaggucuccgucg

SEQ ID NO: 925169 - RNA, 16 nt, Mycobacterium avium subsp. paratuberculosis
accaggucuccgucgg

SEQ ID NO: 925170 - RNA, 17 nt, Mycobacterium avium subsp. paratuberculosis
accaggucuccgucggc

SEQ ID NO: 925171 - RNA, 16 nt, Mycobacterium avium subsp. paratuberculosis
accaggugaccggccu

SEQ ID NO: 925172 - RNA, 16 nt, Mycobacterium avium subsp. paratuberculosis
accagucgcgcagcgu

SEQ ID NO: 925173 - RNA, 13 nt, Mycobacterium avium subsp. paratuberculosis
accagucggccau

SEQ ID NO: 925174 - RNA, 21 nt, Mycobacterium avium subsp. paratuberculosis
accagucggcgcguuggccga

SEQ ID NO: 925175 - RNA, 14 nt, Mycobacterium avium subsp. paratuberculosis
accaguaccgggcc

SEQ ID NO: 925176 - RNA, 20 nt, Mycobacterium avium subsp. paratuberculosis
accgaguugaacgcgucgaa

SEQ ID NO: 925177 - RNA, 13 nt, Mycobacterium avium subsp. paratuberculosis
accgagguggccc

SEQ ID NO: 925178 - RNA, 15 nt, Mycobacterium avium subsp. paratuberculosis
accgagguggcccag

SEQ ID NO: 925179 - RNA, 16 nt, Mycobacterium avium subsp. paratuberculosis
accgagguggcccagc

SEQ ID NO: 925180 - RNA, 19 nt, Mycobacterium avium subsp. paratuberculosis
accgagguggcccagccgc

SEQ ID NO: 925181 - RNA, 20 nt, Mycobacterium avium subsp. paratuberculosis
accgagguggcccagccgcu

SEQ ID NO: 925182 - RNA, 15 nt, Mycobacterium avium subsp. paratuberculosis
accgagugcggcgcg

SEQ ID NO: 925183 - RNA, 13 nt, Mycobacterium avium subsp. paratuberculosis
accgaucaccggc

SEQ ID NO: 925184 - RNA, 22 nt, Mycobacterium avium subsp. paratuberculosis
accgaucaccggcagcagcgcg

SEQ ID NO: 925185 - RNA, 19 nt, Mycobacterium avium subsp. paratuberculosis
accgaggaugaccgcggcg

SEQ ID NO: 925186 - RNA, 21 nt, Mycobacterium avium subsp. paratuberculosis
accgaggaugaccgcggcgaa

SEQ ID NO: 925187 - RNA, 22 nt, Mycobacterium avium subsp. paratuberculosis
accgagggcgcgggaucggugc

SEQ ID NO: 925188 - RNA, 18 nt, Mycobacterium avium subsp. paratuberculosis
accgagguagggccgggu

SEQ ID NO: 925189 - RNA, 17 nt, Mycobacterium avium subsp. paratuberculosis
accgaggugacgaggcc

SEQ ID NO: 925190 - RNA, 18 nt, Mycobacterium avium subsp. paratuberculosis
accgaggugacgucgcgc

SEQ ID NO: 925191 - RNA, 20 nt, Mycobacterium avium subsp. paratuberculosis
accgaggugacgucgcgccg

SEQ ID NO: 925192 - RNA, 21 nt, Mycobacterium avium subsp. paratuberculosis
accgaggugacgucgcgccgc

SEQ ID NO: 925193 - RNA, 22 nt, Mycobacterium avium subsp. paratuberculosis
accgaggugacgucgcgccgcu

SEQ ID NO: 925194 - RNA, 14 nt, Mycobacterium avium subsp. paratuberculosis
accgaggugccgcg

SEQ ID NO: 925195 - RNA, 15 nt, Mycobacterium avium subsp. paratuberculosis
accgagucgcgcgac

SEQ ID NO: 925196 - RNA, 16 nt, Mycobacterium avium subsp. paratuberculosis
accgagucgcgcgacc

SEQ ID NO: 925197 - RNA, 16 nt, Mycobacterium avium subsp. paratuberculosis
accgagucgcugcagc

SEQ ID NO: 925198 - RNA, 17 nt, Mycobacterium avium subsp. paratuberculosis
accgagucgcugcagca

SEQ ID NO: 925199 - RNA, 15 nt, Mycobacterium avium subsp. paratuberculosis
accgagucggugacc

SEQ ID NO: 925200 - RNA, 19 nt, Mycobacterium avium subsp. paratuberculosis
accgagucggugaccaccu

SEQ ID NO: 925201 - RNA, 12 nt, Mycobacterium avium subsp. paratuberculosis
accgagucgucg

SEQ ID NO: 925202 - RNA, 17 nt, Mycobacterium avium subsp. paratuberculosis
accgagucgucgcgcac

SEQ ID NO: 925203 - RNA, 19 nt, Mycobacterium avium subsp. paratuberculosis
accgagucgucgcgcacca

SEQ ID NO: 925204 - RNA, 18 nt, Mycobacterium avium subsp. paratuberculosis
accgacccggccagcggc

SEQ ID NO: 925205 - RNA, 13 nt, Mycobacterium avium subsp. paratuberculosis
accgaccagcggg

SEQ ID NO: 925206 - RNA, 14 nt, Mycobacterium avium subsp. paratuberculosis
accgaccagcggga

SEQ ID NO: 925207 - RNA, 17 nt, Mycobacterium avium subsp. paratuberculosis
accgaccccucggcggc

SEQ ID NO: 925208 - RNA, 18 nt, Mycobacterium avium subsp. paratuberculosis
accgaccccucggcggcc

SEQ ID NO: 925209 - RNA, 20 nt, Mycobacterium avium subsp. paratuberculosis
accgaccccucggcggccgu

SEQ ID NO: 925210 - RNA, 15 nt, Mycobacterium avium subsp. paratuberculosis
accgaccuguccgau

SEQ ID NO: 925211 - RNA, 23 nt, Mycobacterium avium subsp. paratuberculosis
accgacgaccaucagcgcccggg

SEQ ID NO: 925212 - RNA, 19 nt, Mycobacterium avium subsp. paratuberculosis
accgaccggcucucagccg

SEQ ID NO: 925213 - RNA, 12 nt, Mycobacterium avium subsp. paratuberculosis
accgacgccagc

SEQ ID NO: 925214 - RNA, 13 nt, Mycobacterium avium subsp. paratuberculosis
accgacgccagcg

SEQ ID NO: 925215 - RNA, 14 nt, Mycobacterium avium subsp. paratuberculosis
accgacgccagcgg

SEQ ID NO: 925216 - RNA, 15 nt, Mycobacterium avium subsp. paratuberculosis
accgacgccagcggg

SEQ ID NO: 925217 - RNA, 24 nt, Mycobacterium avium subsp. paratuberculosis
accgacgccagcgggccgugccgc

SEQ ID NO: 925218 - RNA, 14 nt, Mycobacterium avium subsp. paratuberculosis
accgacgcccggcu

SEQ ID NO: 925219 - RNA, 19 nt, Mycobacterium avium subsp. paratuberculosis
accgacgacgugacgaccu

SEQ ID NO: 925220 - RNA, 20 nt, Mycobacterium avium subsp. paratuberculosis
accgagcugggccggcgccg

SEQ ID NO: 925221 - RNA, 21 nt, Mycobacterium avium subsp. paratuberculosis
accgagcugggccggcgccga

SEQ ID NO: 925222 - RNA, 23 nt, Mycobacterium avium subsp. paratuberculosis
acccggaccgggugaccggcgcg

SEQ ID NO: 925223 - RNA, 11 nt, Mycobacterium avium subsp. paratuberculosis
acccggacgau

SEQ ID NO: 925224 - RNA, 23 nt, Mycobacterium avium subsp. paratuberculosis
acccggacgugaucgcgguggcc

SEQ ID NO: 925225 - RNA, 16 nt, Mycobacterium avium subsp. paratuberculosis
accgaacgucacggcg

SEQ ID NO: 925226 - RNA, 17 nt, Mycobacterium avium subsp. paratuberculosis
accgaacgucacggcga

SEQ ID NO: 925227 - RNA, 21 nt, Mycobacterium avium subsp. paratuberculosis
accgaagaaccccgagaucgc

SEQ ID NO: 925228 - RNA, 20 nt, Mycobacterium avium subsp. paratuberculosis
accgaacccggaucggccau

SEQ ID NO: 925229 - RNA, 17 nt, Mycobacterium avium subsp. paratuberculosis
acccgcugcaccagccc

SEQ ID NO: 925230 - RNA, 22 nt, Mycobacterium avium subsp. paratuberculosis
acccgcuggucaaugcccucgu

SEQ ID NO: 925231 - RNA, 16 nt, Mycobacterium avium subsp. paratuberculosis
acccgcugcagccggu

SEQ ID NO: 925232 - RNA, 15 nt, Mycobacterium avium subsp. paratuberculosis
acccgcugcucgacc

SEQ ID NO: 925233 - RNA, 19 nt, Mycobacterium avium subsp. paratuberculosis
acccgcugucaauccccgc

SEQ ID NO: 925234 - RNA, 19 nt, Mycobacterium avium subsp. paratuberculosis
acccgcuucgcccggcugc

SEQ ID NO: 925235 - RNA, 22 nt, Mycobacterium avium subsp. paratuberculosis
acccgcuucgcccggcugcgcc

SEQ ID NO: 925236 - RNA, 18 nt, Mycobacterium avium subsp. paratuberculosis
acccgcuuuugccgucgg

SEQ ID NO: 925237 - RNA, 22 nt, Mycobacterium avium subsp. paratuberculosis
acccgcuuuugccgucggugcg

SEQ ID NO: 925238 - RNA, 19 nt, Mycobacterium avium subsp. paratuberculosis
accgaaucacccacggcca

SEQ ID NO: 925239 - RNA, 16 nt, Mycobacterium avium subsp. paratuberculosis
accgaaucggucgacc

SEQ ID NO: 925240 - RNA, 18 nt, Mycobacterium avium subsp. paratuberculosis
accgaaucggucgaccag

SEQ ID NO: 925241 - RNA, 14 nt, Mycobacterium avium subsp. paratuberculosis
accgaaucgagccg

SEQ ID NO: 925242 - RNA, 17 nt, Mycobacterium avium subsp. paratuberculosis
accgacaagggccgggc

SEQ ID NO: 925243 - RNA, 21 nt, Mycobacterium avium subsp. paratuberculosis
accgacaagggccgggcgcug

SEQ ID NO: 925244 - RNA, 18 nt, Mycobacterium avium subsp. paratuberculosis
accgaagaucaccgcgac

SEQ ID NO: 925245 - RNA, 20 nt, Mycobacterium avium subsp. paratuberculosis
accgaagaucaccgcgacga

SEQ ID NO: 925246 - RNA, 14 nt, Mycobacterium avium subsp. paratuberculosis
accgaagccgacgu

SEQ ID NO: 925247 - RNA, 17 nt, Mycobacterium avium subsp. paratuberculosis
accgaagccgacgucga

SEQ ID NO: 925248 - RNA, 19 nt, Mycobacterium avium subsp. paratuberculosis
accgaagccgacgucgacc

SEQ ID NO: 925249 - RNA, 14 nt, Mycobacterium avium subsp. paratuberculosis
accgaagcggcccg

SEQ ID NO: 925250 - RNA, 15 nt, Mycobacterium avium subsp. paratuberculosis
accgaagcggcccga

SEQ ID NO: 925251 - RNA, 16 nt, Mycobacterium avium subsp. paratuberculosis
accgaagcggcccgag

SEQ ID NO: 925252 - RNA, 19 nt, Mycobacterium avium subsp. paratuberculosis
accgaagggaaaggcagca

SEQ ID NO: 925253 - RNA, 15 nt, Mycobacterium avium subsp. paratuberculosis
accgacauggccagc

SEQ ID NO: 925254 - RNA, 19 nt, Mycobacterium avium subsp. paratuberculosis
accgacaugucgccgggcg

SEQ ID NO: 925255 - RNA, 14 nt, Mycobacterium avium subsp. paratuberculosis
accgacagccggac

SEQ ID NO: 925256 - RNA, 15 nt, Mycobacterium avium subsp. paratuberculosis
accgacagccggacg

SEQ ID NO: 925257 - RNA, 12 nt, Mycobacterium avium subsp. paratuberculosis
accgacagcgcg

SEQ ID NO: 925258 - RNA, 17 nt, Mycobacterium avium subsp. paratuberculosis
accgacagggccagcgc

SEQ ID NO: 925259 - RNA, 18 nt, Mycobacterium avium subsp. paratuberculosis
accgacagggccagcgcc

SEQ ID NO: 925260 - RNA, 19 nt, Mycobacterium avium subsp. paratuberculosis
accgacagggccagcgcca

SEQ ID NO: 925261 - RNA, 17 nt, Mycobacterium avium subsp. paratuberculosis
accgacaguucggcgcg

SEQ ID NO: 925262 - RNA, 18 nt, Mycobacterium avium subsp. paratuberculosis
accgacaguucggcgcgc

SEQ ID NO: 925263 - RNA, 19 nt, Mycobacterium avium subsp. paratuberculosis
accgacaguucggcgcgca

SEQ ID NO: 925264 - RNA, 14 nt, Mycobacterium avium subsp. paratuberculosis
accgacaccaccgg

SEQ ID NO: 925265 - RNA, 16 nt, Mycobacterium avium subsp. paratuberculosis
accgacaccaccggcc

SEQ ID NO: 925266 - RNA, 18 nt, Mycobacterium avium subsp. paratuberculosis
accgacaccaccggccgc

SEQ ID NO: 925267 - RNA, 21 nt, Mycobacterium avium subsp. paratuberculosis
accgacaccaccggccgcccg

SEQ ID NO: 925268 - RNA, 15 nt, Mycobacterium avium subsp. paratuberculosis
accgacaccggccgg

SEQ ID NO: 925269 - RNA, 19 nt, Mycobacterium avium subsp. paratuberculosis
accgacagcaaaccgaccg

SEQ ID NO: 925270 - RNA, 20 nt, Mycobacterium avium subsp. paratuberculosis
accgacagcaaaccgaccgc

SEQ ID NO: 925271 - RNA, 22 nt, Mycobacterium avium subsp. paratuberculosis
accgacagcaaaccgaccgccg

SEQ ID NO: 925272 - RNA, 14 nt, Mycobacterium avium subsp. paratuberculosis
accgacagcacccg

SEQ ID NO: 925273 - RNA, 15 nt, Mycobacterium avium subsp. paratuberculosis
accgacagcacccgg

SEQ ID NO: 925274 - RNA, 16 nt, Mycobacterium avium subsp. paratuberculosis
accgcaaagcaccgcg

SEQ ID NO: 925275 - RNA, 17 nt, Mycobacterium avium subsp. paratuberculosis
accgcaaagcaccgcga

SEQ ID NO: 925276 - RNA, 18 nt, Mycobacterium avium subsp. paratuberculosis
accgcaaagcaccgcgaa

SEQ ID NO: 925277 - RNA, 15 nt, Mycobacterium avium subsp. paratuberculosis
accgauuucggccag

SEQ ID NO: 925278 - RNA, 16 nt, Mycobacterium avium subsp. paratuberculosis
accgauuucggccagc

SEQ ID NO: 925279 - RNA, 19 nt, Mycobacterium avium subsp. paratuberculosis
accgcaacaccagcacggu

SEQ ID NO: 925280 - RNA, 21 nt, Mycobacterium avium subsp. paratuberculosis
accgcaacaccgaaagccgac

SEQ ID NO: 925281 - RNA, 20 nt, Mycobacterium avium subsp. paratuberculosis
accgcaagugcggucagcuc

SEQ ID NO: 925282 - RNA, 20 nt, Mycobacterium avium subsp. paratuberculosis
accgcaccaccacguugcac

SEQ ID NO: 925283 - RNA, 12 nt, Mycobacterium avium subsp. paratuberculosis
accgcacccaga

SEQ ID NO: 925284 - RNA, 19 nt, Mycobacterium avium subsp. paratuberculosis
accgcacccccagcucgac

SEQ ID NO: 925285 - RNA, 20 nt, Mycobacterium avium subsp. paratuberculosis
accgcacccccagcucgacg

SEQ ID NO: 925286 - RNA, 13 nt, Mycobacterium avium subsp. paratuberculosis
accgcaccccguc

SEQ ID NO: 925287 - RNA, 18 nt, Mycobacterium avium subsp. paratuberculosis
accgcacaauccggucag

SEQ ID NO: 925288 - RNA, 19 nt, Mycobacterium avium subsp. paratuberculosis
accgcacaauccggucagc

SEQ ID NO: 925289 - RNA, 23 nt, Mycobacterium avium subsp. paratuberculosis
accgcacaugccgaggcacagca

SEQ ID NO: 925290 - RNA, 16 nt, Mycobacterium avium subsp. paratuberculosis
accgcaccuugcgccc

SEQ ID NO: 925291 - RNA, 18 nt, Mycobacterium avium subsp. paratuberculosis
accgcaccuugcgcccgu

SEQ ID NO: 925292 - RNA, 13 nt, Mycobacterium avium subsp. paratuberculosis
accgcacgccggg

SEQ ID NO: 925293 - RNA, 13 nt, Mycobacterium avium subsp. paratuberculosis
accgcacggccca

SEQ ID NO: 925294 - RNA, 16 nt, Mycobacterium avium subsp. paratuberculosis
accgauggcggcggcc

SEQ ID NO: 925295 - RNA, 18 nt, Mycobacterium avium subsp. paratuberculosis
accgauggcggcggcccg

SEQ ID NO: 925296 - RNA, 21 nt, Mycobacterium avium subsp. paratuberculosis
accgauggcggcggcccgccg

SEQ ID NO: 925297 - RNA, 22 nt, Mycobacterium avium subsp. paratuberculosis
accgauggcggcggcccgccgc

SEQ ID NO: 925298 - RNA, 14 nt, Mycobacterium avium subsp. paratuberculosis
accgaugcgggcca

SEQ ID NO: 925299 - RNA, 23 nt, Mycobacterium avium subsp. paratuberculosis
accgaugcgggccaggaugucgg

SEQ ID NO: 925300 - RNA, 15 nt, Mycobacterium avium subsp. paratuberculosis
accgauggccgcccg

SEQ ID NO: 925301 - RNA, 16 nt, Mycobacterium avium subsp. paratuberculosis
accgauggccgcccgc

SEQ ID NO: 925302 - RNA, 18 nt, Mycobacterium avium subsp. paratuberculosis
accgauggccgcccgcag

SEQ ID NO: 925303 - RNA, 20 nt, Mycobacterium avium subsp. paratuberculosis
accgauggccgcccgcaggu

SEQ ID NO: 925304 - RNA, 16 nt, Mycobacterium avium subsp. paratuberculosis
accgauccggcgcccg

SEQ ID NO: 925305 - RNA, 22 nt, Mycobacterium avium subsp. paratuberculosis
accgaucggauucggguggcgu

SEQ ID NO: 925306 - RNA, 14 nt, Mycobacterium avium subsp. paratuberculosis
accgaucggcacgu

SEQ ID NO: 925307 - RNA, 17 nt, Mycobacterium avium subsp. paratuberculosis
accgaucggcacgucga

SEQ ID NO: 925308 - RNA, 17 nt, Mycobacterium avium subsp. paratuberculosis
accgaucagcaugccgg

SEQ ID NO: 925309 - RNA, 18 nt, Mycobacterium avium subsp. paratuberculosis
accgaucagcaugccggu

SEQ ID NO: 925310 - RNA, 20 nt, Mycobacterium avium subsp. paratuberculosis
accgaugcccgacaccgccc

SEQ ID NO: 925311 - RNA, 13 nt, Mycobacterium avium subsp. paratuberculosis
accgaugccgcug

SEQ ID NO: 925312 - RNA, 20 nt, Mycobacterium avium subsp. paratuberculosis
accgauccgagcgcugcccg

SEQ ID NO: 925313 - RNA, 16 nt, Mycobacterium avium subsp. paratuberculosis
accgauccgcgggccg

SEQ ID NO: 925314 - RNA, 21 nt, Mycobacterium avium subsp. paratuberculosis
accgcaggaaaggaaggcgca

SEQ ID NO: 925315 - RNA, 16 nt, Mycobacterium avium subsp. paratuberculosis
accgcagcaggcggac

SEQ ID NO: 925316 - RNA, 17 nt, Mycobacterium avium subsp. paratuberculosis
accgcagcaggcggacg

SEQ ID NO: 925317 - RNA, 21 nt, Mycobacterium avium subsp. paratuberculosis
accgcagcaggcggacggcga

SEQ ID NO: 925318 - RNA, 20 nt, Mycobacterium avium subsp. paratuberculosis
accgcagccgggugcgggcc

SEQ ID NO: 925319 - RNA, 23 nt, Mycobacterium avium subsp. paratuberculosis
accgcagccgggugcgggccagc

SEQ ID NO: 925320 - RNA, 16 nt, Mycobacterium avium subsp. paratuberculosis
accgcagccuucuucg

SEQ ID NO: 925321 - RNA, 22 nt, Mycobacterium avium subsp. paratuberculosis
accgcagccuucuucgccgggg

SEQ ID NO: 925322 - RNA, 20 nt, Mycobacterium avium subsp. paratuberculosis
accgcauagcgggagccggc

SEQ ID NO: 925323 - RNA, 21 nt, Mycobacterium avium subsp. paratuberculosis
accgcauagcgggagccggcc

SEQ ID NO: 925324 - RNA, 14 nt, Mycobacterium avium subsp. paratuberculosis
accgcagucguucg

SEQ ID NO: 925325 - RNA, 19 nt, Mycobacterium avium subsp. paratuberculosis
accgcagucguucggccag

SEQ ID NO: 925326 - RNA, 20 nt, Mycobacterium avium subsp. paratuberculosis
accgcagucguucggccagc

SEQ ID NO: 925327 - RNA, 14 nt, Mycobacterium avium subsp. paratuberculosis
accgcaggucgaug

SEQ ID NO: 925328 - RNA, 15 nt, Mycobacterium avium subsp. paratuberculosis
accgcaucgaaccgc

SEQ ID NO: 925329 - RNA, 17 nt, Mycobacterium avium subsp. paratuberculosis
accgcaucgaaccgccg

SEQ ID NO: 925330 - RNA, 21 nt, Mycobacterium avium subsp. paratuberculosis
accgcaucgaaccgccgcgcu

SEQ ID NO: 925331 - RNA, 14 nt, Mycobacterium avium subsp. paratuberculosis
accgcaucgccgag

SEQ ID NO: 925332 - RNA, 15 nt, Mycobacterium avium subsp. paratuberculosis
accgcaucgccgagg

SEQ ID NO: 925333 - RNA, 19 nt, Mycobacterium avium subsp. paratuberculosis
accgcaucgccgagggcga

SEQ ID NO: 925334 - RNA, 14 nt, Mycobacterium avium subsp. paratuberculosis
accgcauggccggc

SEQ ID NO: 925335 - RNA, 22 nt, Mycobacterium avium subsp. paratuberculosis
accgccacggcgacgaccacca

SEQ ID NO: 925336 - RNA, 18 nt, Mycobacterium avium subsp. paratuberculosis
accgccacgucgaacccg

SEQ ID NO: 925337 - RNA, 19 nt, Mycobacterium avium subsp. paratuberculosis
accgccacgucgaacccga

SEQ ID NO: 925338 - RNA, 15 nt, Mycobacterium avium subsp. paratuberculosis
accgccagcauccgc

SEQ ID NO: 925339 - RNA, 15 nt, Mycobacterium avium subsp. paratuberculosis
accgccagcaccgcc

SEQ ID NO: 925340 - RNA, 17 nt, Mycobacterium avium subsp. paratuberculosis
accgccagcaccgccac

SEQ ID NO: 925341 - RNA, 18 nt, Mycobacterium avium subsp. paratuberculosis
accgccagcagcagccgc

SEQ ID NO: 925342 - RNA, 21 nt, Mycobacterium avium subsp. paratuberculosis
accgccagcagcagccgcgcc

SEQ ID NO: 925343 - RNA, 23 nt, Mycobacterium avium subsp. paratuberculosis
accgccagcagcagccgcgccgc

SEQ ID NO: 925344 - RNA, 16 nt, Mycobacterium avium subsp. paratuberculosis
accgccagcagcgccg

SEQ ID NO: 925345 - RNA, 18 nt, Mycobacterium avium subsp. paratuberculosis
accgccagcagcgccgcu

SEQ ID NO: 925346 - RNA, 20 nt, Mycobacterium avium subsp. paratuberculosis
accgccagcagcgccgcuuc

SEQ ID NO: 925347 - RNA, 22 nt, Mycobacterium avium subsp. paratuberculosis
accgccagcagcgccgcuucgu

SEQ ID NO: 925348 - RNA, 16 nt, Mycobacterium avium subsp. paratuberculosis
accgccccggucaccc

SEQ ID NO: 925349 - RNA, 20 nt, Mycobacterium avium subsp. paratuberculosis
accgccccggucaccccggc

SEQ ID NO: 925350 - RNA, 15 nt, Mycobacterium avium subsp. paratuberculosis
accgcccgaaccgcg

SEQ ID NO: 925351 - RNA, 20 nt, Mycobacterium avium subsp. paratuberculosis
accgcccgaaccgcguccac

SEQ ID NO: 925352 - RNA, 15 nt, Mycobacterium avium subsp. paratuberculosis
accgccaggcuggcc

SEQ ID NO: 925353 - RNA, 17 nt, Mycobacterium avium subsp. paratuberculosis
accgccaggcuggccag

SEQ ID NO: 925354 - RNA, 19 nt, Mycobacterium avium subsp. paratuberculosis
accgccaggcuggccaggc

SEQ ID NO: 925355 - RNA, 13 nt, Mycobacterium avium subsp. paratuberculosis
accgccagcgcgc

SEQ ID NO: 925356 - RNA, 16 nt, Mycobacterium avium subsp. paratuberculosis
accgccagcgcgccga

SEQ ID NO: 925357 - RNA, 14 nt, Mycobacterium avium subsp. paratuberculosis
accgccagcgcggc

SEQ ID NO: 925358 - RNA, 17 nt, Mycobacterium avium subsp. paratuberculosis
accgccagcgcggcggc

SEQ ID NO: 925359 - RNA, 21 nt, Mycobacterium avium subsp. paratuberculosis
accgccagcgcggcggcgccg

SEQ ID NO: 925360 - RNA, 23 nt, Mycobacterium avium subsp. paratuberculosis
accgccagcgcggcggcgccguc

SEQ ID NO: 925361 - RNA, 14 nt, Mycobacterium avium subsp. paratuberculosis
accgccggcggccu

SEQ ID NO: 925362 - RNA, 15 nt, Mycobacterium avium subsp. paratuberculosis
accgccggcggccuc

SEQ ID NO: 925363 - RNA, 13 nt, Mycobacterium avium subsp. paratuberculosis
accgccggcccgg

SEQ ID NO: 925364 - RNA, 14 nt, Mycobacterium avium subsp. paratuberculosis
accgccggccgcgc

SEQ ID NO: 925365 - RNA, 14 nt, Mycobacterium avium subsp. paratuberculosis
accgccggcgccgu

SEQ ID NO: 925366 - RNA, 17 nt, Mycobacterium avium subsp. paratuberculosis
accgccggcgccgucga

SEQ ID NO: 925367 - RNA, 17 nt, Mycobacterium avium subsp. paratuberculosis
accgccggcgcggacgg

SEQ ID NO: 925368 - RNA, 21 nt, Mycobacterium avium subsp. paratuberculosis
accgccgcuagaccgauggcg

SEQ ID NO: 925369 - RNA, 22 nt, Mycobacterium avium subsp. paratuberculosis
accgccgcuagguuuggccagc

SEQ ID NO: 925370 - RNA, 23 nt, Mycobacterium avium subsp. paratuberculosis
accgccgcucagcgauugcggcc

SEQ ID NO: 925371 - RNA, 13 nt, Mycobacterium avium subsp. paratuberculosis
accgccgcgcggc

SEQ ID NO: 925372 - RNA, 15 nt, Mycobacterium avium subsp. paratuberculosis
accgccgcgcggccg

SEQ ID NO: 925373 - RNA, 16 nt, Mycobacterium avium subsp. paratuberculosis
accgccgcggccgcga

SEQ ID NO: 925374 - RNA, 13 nt, Mycobacterium avium subsp. paratuberculosis
accgccgcggcga

SEQ ID NO: 925375 - RNA, 14 nt, Mycobacterium avium subsp. paratuberculosis
accgccgcggcgac

SEQ ID NO: 925376 - RNA, 15 nt, Mycobacterium avium subsp. paratuberculosis
accgccgcugcgcgc

SEQ ID NO: 925377 - RNA, 20 nt, Mycobacterium avium subsp. paratuberculosis
accgccgcugcgcgcgcgau

SEQ ID NO: 925378 - RNA, 16 nt, Mycobacterium avium subsp. paratuberculosis
accgccggcagcggcu

SEQ ID NO: 925379 - RNA, 14 nt, Mycobacterium avium subsp. paratuberculosis
accgccggccacgu

SEQ ID NO: 925380 - RNA, 16 nt, Mycobacterium avium subsp. paratuberculosis
accgccggccaggcga

SEQ ID NO: 925381 - RNA, 13 nt, Mycobacterium avium subsp. paratuberculosis
accgccggcccag

SEQ ID NO: 925382 - RNA, 20 nt, Mycobacterium avium subsp. paratuberculosis
accgccgacaccaccgcgcg

SEQ ID NO: 925383 - RNA, 18 nt, Mycobacterium avium subsp. paratuberculosis
accgccgaaacaccggcu

SEQ ID NO: 925384 - RNA, 19 nt, Mycobacterium avium subsp. paratuberculosis
accgccgacaucgcccggu

SEQ ID NO: 925385 - RNA, 17 nt, Mycobacterium avium subsp. paratuberculosis
accgcccuuccagcacc

SEQ ID NO: 925386 - RNA, 21 nt, Mycobacterium avium subsp. paratuberculosis
accgcccuuccagcaccccgu

SEQ ID NO: 925387 - RNA, 16 nt, Mycobacterium avium subsp. paratuberculosis
accgcccgcgcuggug

SEQ ID NO: 925388 - RNA, 12 nt, Mycobacterium avium subsp. paratuberculosis
accgcccgcggu

SEQ ID NO: 925389 - RNA, 22 nt, Mycobacterium avium subsp. paratuberculosis
accgcccgcugaccgccgcgcu

SEQ ID NO: 925390 - RNA, 16 nt, Mycobacterium avium subsp. paratuberculosis
accgcccgcuguucgu

SEQ ID NO: 925391 - RNA, 19 nt, Mycobacterium avium subsp. paratuberculosis
accgcccggaugccggcgc

SEQ ID NO: 925392 - RNA, 20 nt, Mycobacterium avium subsp. paratuberculosis
accgcccggaugccggcgcc

SEQ ID NO: 925393 - RNA, 16 nt, Mycobacterium avium subsp. paratuberculosis
accgcccggcgccgau

SEQ ID NO: 925394 - RNA, 18 nt, Mycobacterium avium subsp. paratuberculosis
accgcccggggcgcggac

SEQ ID NO: 925395 - RNA, 20 nt, Mycobacterium avium subsp. paratuberculosis
accgcccggggcgcggaccg

SEQ ID NO: 925396 - RNA, 15 nt, Mycobacterium avium subsp. paratuberculosis
accgcccgcccggca

SEQ ID NO: 925397 - RNA, 22 nt, Mycobacterium avium subsp. paratuberculosis
accgccgcgaacgggucggggg

SEQ ID NO: 925398 - RNA, 13 nt, Mycobacterium avium subsp. paratuberculosis
accgccgcggcgc

SEQ ID NO: 925399 - RNA, 16 nt, Mycobacterium avium subsp. paratuberculosis
accgccgcggcgcccg

SEQ ID NO: 925400 - RNA, 20 nt, Mycobacterium avium subsp. paratuberculosis
accgccgcggcgcccggcgc

SEQ ID NO: 925401 - RNA, 21 nt, Mycobacterium avium subsp. paratuberculosis
accgccgcggcgcccggcgcc

SEQ ID NO: 925402 - RNA, 17 nt, Mycobacterium avium subsp. paratuberculosis
accgccgcggcggccug

SEQ ID NO: 925403 - RNA, 18 nt, Mycobacterium avium subsp. paratuberculosis
accgccgcggcgguggcc

SEQ ID NO: 925404 - RNA, 13 nt, Mycobacterium avium subsp. paratuberculosis
accgccgcgggcu

SEQ ID NO: 925405 - RNA, 20 nt, Mycobacterium avium subsp. paratuberculosis
accgccgcgggcucccgcuc

SEQ ID NO: 925406 - RNA, 14 nt, Mycobacterium avium subsp. paratuberculosis
accgccgcgguggg

SEQ ID NO: 925407 - RNA, 15 nt, Mycobacterium avium subsp. paratuberculosis
accgccgcgcucggc

SEQ ID NO: 925408 - RNA, 21 nt, Mycobacterium avium subsp. paratuberculosis
accgccgcgcucggccauccg

SEQ ID NO: 925409 - RNA, 11 nt, Mycobacterium avium subsp. paratuberculosis
accgccgcggc

SEQ ID NO: 925410 - RNA, 14 nt, Mycobacterium avium subsp. paratuberculosis
accgccgcggccgc

SEQ ID NO: 925411 - RNA, 14 nt, Mycobacterium avium subsp. paratuberculosis
accgccugcgcgau

SEQ ID NO: 925412 - RNA, 17 nt, Mycobacterium avium subsp. paratuberculosis
accgccugcgcgaucgc

SEQ ID NO: 925413 - RNA, 19 nt, Mycobacterium avium subsp. paratuberculosis
accgccugcgcgaucgccg

SEQ ID NO: 925414 - RNA, 13 nt, Mycobacterium avium subsp. paratuberculosis
accgccucggcca

SEQ ID NO: 925415 - RNA, 16 nt, Mycobacterium avium subsp. paratuberculosis
accgccucgacgguga

SEQ ID NO: 925416 - RNA, 17 nt, Mycobacterium avium subsp. paratuberculosis
accgccucgauggcccg

SEQ ID NO: 925417 - RNA, 22 nt, Mycobacterium avium subsp. paratuberculosis
accgccucgauggcccgcucgg

SEQ ID NO: 925418 - RNA, 14 nt, Mycobacterium avium subsp. paratuberculosis
accgccucgccagc

SEQ ID NO: 925419 - RNA, 16 nt, Mycobacterium avium subsp. paratuberculosis
accgccucgccagccc

SEQ ID NO: 925420 - RNA, 20 nt, Mycobacterium avium subsp. paratuberculosis
accgccuccucgaugucggu

SEQ ID NO: 925421 - RNA, 13 nt, Mycobacterium avium subsp. paratuberculosis
accgccugcggca

SEQ ID NO: 925422 - RNA, 13 nt, Mycobacterium avium subsp. paratuberculosis
accgcgacgcugc

SEQ ID NO: 925423 - RNA, 14 nt, Mycobacterium avium subsp. paratuberculosis
accgcgacgcugcc

SEQ ID NO: 925424 - RNA, 17 nt, Mycobacterium avium subsp. paratuberculosis
accgcgacgcugccggu

SEQ ID NO: 925425 - RNA, 16 nt, Mycobacterium avium subsp. paratuberculosis
accgcgacggcgcccg

SEQ ID NO: 925426 - RNA, 13 nt, Mycobacterium avium subsp. paratuberculosis
accgcgacgggcu

SEQ ID NO: 925427 - RNA, 19 nt, Mycobacterium avium subsp. paratuberculosis
accgcgacgggcucggcgu

SEQ ID NO: 925428 - RNA, 20 nt, Mycobacterium avium subsp. paratuberculosis
accgcgacguggcgcaguua

SEQ ID NO: 925429 - RNA, 17 nt, Mycobacterium avium subsp. paratuberculosis
accgcgagacccggucc

SEQ ID NO: 925430 - RNA, 17 nt, Mycobacterium avium subsp. paratuberculosis
accgcgagaucagcgcc

SEQ ID NO: 925431 - RNA, 16 nt, Mycobacterium avium subsp. paratuberculosis
accgcgagcaccgcga

SEQ ID NO: 925432 - RNA, 17 nt, Mycobacterium avium subsp. paratuberculosis
accgcgagcagacgcga

SEQ ID NO: 925433 - RNA, 18 nt, Mycobacterium avium subsp. paratuberculosis
accgcgagcgcgcgguga

SEQ ID NO: 925434 - RNA, 14 nt, Mycobacterium avium subsp. paratuberculosis
accgcgagcgggug

SEQ ID NO: 925435 - RNA, 17 nt, Mycobacterium avium subsp. paratuberculosis
accgcgaguucgcgcac

SEQ ID NO: 925436 - RNA, 21 nt, Mycobacterium avium subsp. paratuberculosis
accgcgaguucgcgcacgcug

SEQ ID NO: 925437 - RNA, 14 nt, Mycobacterium avium subsp. paratuberculosis
accgcgaucaccac

SEQ ID NO: 925438 - RNA, 21 nt, Mycobacterium avium subsp. paratuberculosis
accgcgcacucgaacggcccg

SEQ ID NO: 925439 - RNA, 18 nt, Mycobacterium avium subsp. paratuberculosis
accgcgcaggcggcgacg

SEQ ID NO: 925440 - RNA, 19 nt, Mycobacterium avium subsp. paratuberculosis
accgcgcaggcggcgacgg

SEQ ID NO: 925441 - RNA, 23 nt, Mycobacterium avium subsp. paratuberculosis
accgcgcagucggcgucgcggcg

SEQ ID NO: 925442 - RNA, 12 nt, Mycobacterium avium subsp. paratuberculosis
accgcgcccagg

SEQ ID NO: 925443 - RNA, 22 nt, Mycobacterium avium subsp. paratuberculosis
accgcgcccaggggagcggcgg

SEQ ID NO: 925444 - RNA, 13 nt, Mycobacterium avium subsp. paratuberculosis
accgcgccccggc

SEQ ID NO: 925445 - RNA, 17 nt, Mycobacterium avium subsp. paratuberculosis
accgcgccccggcgcag

SEQ ID NO: 925446 - RNA, 13 nt, Mycobacterium avium subsp. paratuberculosis
accgcgcccgccc

SEQ ID NO: 925447 - RNA, 13 nt, Mycobacterium avium subsp. paratuberculosis
accgcgcgcggcg

SEQ ID NO: 925448 - RNA, 14 nt, Mycobacterium avium subsp. paratuberculosis
accgcgcgcggcgc

SEQ ID NO: 925449 - RNA, 15 nt, Mycobacterium avium subsp. paratuberculosis
accgcgcgcggcgcc

SEQ ID NO: 925450 - RNA, 17 nt, Mycobacterium avium subsp. paratuberculosis
accgcgcgcggcgccgc

SEQ ID NO: 925451 - RNA, 19 nt, Mycobacterium avium subsp. paratuberculosis
accgcgcgcggcgccgcgu

SEQ ID NO: 925452 - RNA, 12 nt, Mycobacterium avium subsp. paratuberculosis
accgcgcgcugc

SEQ ID NO: 925453 - RNA, 13 nt, Mycobacterium avium subsp. paratuberculosis
accgcgcgcugcc

SEQ ID NO: 925454 - RNA, 16 nt, Mycobacterium avium subsp. paratuberculosis
accgcgcgcugccgcg

SEQ ID NO: 925455 - RNA, 18 nt, Mycobacterium avium subsp. paratuberculosis
accgcgcgcugccgcgcc

SEQ ID NO: 925456 - RNA, 22 nt, Mycobacterium avium subsp. paratuberculosis
accgcgcggccagcggcgccga

SEQ ID NO: 925457 - RNA, 16 nt, Mycobacterium avium subsp. paratuberculosis
accgcgcaccggcgcu

SEQ ID NO: 925458 - RNA, 17 nt, Mycobacterium avium subsp. paratuberculosis
accgcgcaaccgggccg

SEQ ID NO: 925459 - RNA, 18 nt, Mycobacterium avium subsp. paratuberculosis
accgcgcaaccgggccgc

SEQ ID NO: 925460 - RNA, 19 nt, Mycobacterium avium subsp. paratuberculosis
accgcgcaaccgggccgca

SEQ ID NO: 925461 - RNA, 20 nt, Mycobacterium avium subsp. paratuberculosis
accgcgcaaccgggccgcac

SEQ ID NO: 925462 - RNA, 19 nt, Mycobacterium avium subsp. paratuberculosis
accgcgauggcccgcgcga

SEQ ID NO: 925463 - RNA, 14 nt, Mycobacterium avium subsp. paratuberculosis
accgcgaugguggc

SEQ ID NO: 925464 - RNA, 16 nt, Mycobacterium avium subsp. paratuberculosis
accgcgaugguggcgu

SEQ ID NO: 925465 - RNA, 17 nt, Mycobacterium avium subsp. paratuberculosis
accgcgaugguggcguc

SEQ ID NO: 925466 - RNA, 13 nt, Mycobacterium avium subsp. paratuberculosis
accgcgaucaccg

SEQ ID NO: 925467 - RNA, 14 nt, Mycobacterium avium subsp. paratuberculosis
accgcgaucaccga

SEQ ID NO: 925468 - RNA, 23 nt, Mycobacterium avium subsp. paratuberculosis
accgcgaucaccgagauggccac

SEQ ID NO: 925469 - RNA, 13 nt, Mycobacterium avium subsp. paratuberculosis
accgcgaucagcc

SEQ ID NO: 925470 - RNA, 17 nt, Mycobacterium avium subsp. paratuberculosis
accgcgaucagggccgc

SEQ ID NO: 925471 - RNA, 23 nt, Mycobacterium avium subsp. paratuberculosis
accgcgaucagggccgcggccgc

SEQ ID NO: 925472 - RNA, 13 nt, Mycobacterium avium subsp. paratuberculosis
accgcgaucgagu

SEQ ID NO: 925473 - RNA, 15 nt, Mycobacterium avium subsp. paratuberculosis
accgcgaucgccgac

SEQ ID NO: 925474 - RNA, 14 nt, Mycobacterium avium subsp. paratuberculosis
accgcgaucucgau

SEQ ID NO: 925475 - RNA, 15 nt, Mycobacterium avium subsp. paratuberculosis
accgcgaucugcucg

SEQ ID NO: 925476 - RNA, 19 nt, Mycobacterium avium subsp. paratuberculosis
accgcgaugauggcgucga

SEQ ID NO: 925477 - RNA, 20 nt, Mycobacterium avium subsp. paratuberculosis
accgcgaugauggcgucgac

SEQ ID NO: 925478 - RNA, 23 nt, Mycobacterium avium subsp. paratuberculosis
accgcgaugcagaacagccgguc

SEQ ID NO: 925479 - RNA, 17 nt, Mycobacterium avium subsp. paratuberculosis
accgcgaugcgacaccg

SEQ ID NO: 925480 - RNA, 21 nt, Mycobacterium avium subsp. paratuberculosis
accgcgaugcgacaccgcguc

SEQ ID NO: 925481 - RNA, 22 nt, Mycobacterium avium subsp. paratuberculosis
accgcgaugcgacaccgcgucc

SEQ ID NO: 925482 - RNA, 23 nt, Mycobacterium avium subsp. paratuberculosis
accgcgggcgcauaccagcgcug

SEQ ID NO: 925483 - RNA, 17 nt, Mycobacterium avium subsp. paratuberculosis
accgcgggcgcgccguc

SEQ ID NO: 925484 - RNA, 18 nt, Mycobacterium avium subsp. paratuberculosis
accgcgggcgcgccgucc

SEQ ID NO: 925485 - RNA, 16 nt, Mycobacterium avium subsp. paratuberculosis
accgcgcuugccgcga

SEQ ID NO: 925486 - RNA, 17 nt, Mycobacterium avium subsp. paratuberculosis
accgcgcuugccgcgac

SEQ ID NO: 925487 - RNA, 23 nt, Mycobacterium avium subsp. paratuberculosis
accgcgcuugccgcgacccgggc

SEQ ID NO: 925488 - RNA, 16 nt, Mycobacterium avium subsp. paratuberculosis
accgcgcuccugccag

SEQ ID NO: 925489 - RNA, 21 nt, Mycobacterium avium subsp. paratuberculosis
accgcgcuccugccagcggcg

SEQ ID NO: 925490 - RNA, 22 nt, Mycobacterium avium subsp. paratuberculosis
accgcgcuccugccagcggcgc

SEQ ID NO: 925491 - RNA, 15 nt, Mycobacterium avium subsp. paratuberculosis
accgcgcucggcgac

SEQ ID NO: 925492 - RNA, 18 nt, Mycobacterium avium subsp. paratuberculosis
accgcgcugcgcgcguug

SEQ ID NO: 925493 - RNA, 21 nt, Mycobacterium avium subsp. paratuberculosis
accgcgcgggccagcgccuuc

SEQ ID NO: 925494 - RNA, 11 nt, Mycobacterium avium subsp. paratuberculosis
accgcgcggcg

SEQ ID NO: 925495 - RNA, 12 nt, Mycobacterium avium subsp. paratuberculosis
accgcgcggcgc

SEQ ID NO: 925496 - RNA, 19 nt, Mycobacterium avium subsp. paratuberculosis
accgcgcguucgaguucgu

SEQ ID NO: 925497 - RNA, 14 nt, Mycobacterium avium subsp. paratuberculosis
accgcgcggcggug

SEQ ID NO: 925498 - RNA, 22 nt, Mycobacterium avium subsp. paratuberculosis
accgcgcggcggugcucgcgcc

SEQ ID NO: 925499 - RNA, 14 nt, Mycobacterium avium subsp. paratuberculosis
accgcgcggcgcag

SEQ ID NO: 925500 - RNA, 15 nt, Mycobacterium avium subsp. paratuberculosis
accgcgcggcgcagu

SEQ ID NO: 925501 - RNA, 16 nt, Mycobacterium avium subsp. paratuberculosis
accgcgcggcgcaguu

SEQ ID NO: 925502 - RNA, 13 nt, Mycobacterium avium subsp. paratuberculosis
accgcgcggcgcc

SEQ ID NO: 925503 - RNA, 21 nt, Mycobacterium avium subsp. paratuberculosis
accgcgcggcgcccccgcgac

SEQ ID NO: 925504 - RNA, 22 nt, Mycobacterium avium subsp. paratuberculosis
accgcgcggcgcccccgcgacg

SEQ ID NO: 925505 - RNA, 20 nt, Mycobacterium avium subsp. paratuberculosis
accgcggggcugggcgccau

SEQ ID NO: 925506 - RNA, 15 nt, Mycobacterium avium subsp. paratuberculosis
accgcgggggcggcc

SEQ ID NO: 925507 - RNA, 19 nt, Mycobacterium avium subsp. paratuberculosis
accgcggggugcccggcga

SEQ ID NO: 925508 - RNA, 20 nt, Mycobacterium avium subsp. paratuberculosis
accgcggggugcccggcgag

SEQ ID NO: 925509 - RNA, 21 nt, Mycobacterium avium subsp. paratuberculosis
accgcgggugaucugcgccgu

SEQ ID NO: 925510 - RNA, 22 nt, Mycobacterium avium subsp. paratuberculosis
accgcgggugaucugcgccgug

SEQ ID NO: 925511 - RNA, 16 nt, Mycobacterium avium subsp. paratuberculosis
accgcggucgcggcgc

SEQ ID NO: 925512 - RNA, 17 nt, Mycobacterium avium subsp. paratuberculosis
accgcggucgcggcgcc

SEQ ID NO: 925513 - RNA, 18 nt, Mycobacterium avium subsp. paratuberculosis
accgcggucgcggcgccg

SEQ ID NO: 925514 - RNA, 22 nt, Mycobacterium avium subsp. paratuberculosis
accgcggucgggucccggcaac

SEQ ID NO: 925515 - RNA, 18 nt, Mycobacterium avium subsp. paratuberculosis
accgcggucugcgccagc

SEQ ID NO: 925516 - RNA, 21 nt, Mycobacterium avium subsp. paratuberculosis
accgcggucugcgccagcucc

SEQ ID NO: 925517 - RNA, 13 nt, Mycobacterium avium subsp. paratuberculosis
accgcggucgacg

SEQ ID NO: 925518 - RNA, 16 nt, Mycobacterium avium subsp. paratuberculosis
accgcggucgacggga

SEQ ID NO: 925519 - RNA, 14 nt, Mycobacterium avium subsp. paratuberculosis
accgcguggcgcac

SEQ ID NO: 925520 - RNA, 17 nt, Mycobacterium avium subsp. paratuberculosis
accgcguggcgcacagc

SEQ ID NO: 925521 - RNA, 21 nt, Mycobacterium avium subsp. paratuberculosis
accgcgucuuggacgcccgcg

SEQ ID NO: 925522 - RNA, 22 nt, Mycobacterium avium subsp. paratuberculosis
accgcgucuuggacgcccgcga

SEQ ID NO: 925523 - RNA, 23 nt, Mycobacterium avium subsp. paratuberculosis
accgcgucuuggacgcccgcgac

SEQ ID NO: 925524 - RNA, 13 nt, Mycobacterium avium subsp. paratuberculosis
accgcgucggcgc

SEQ ID NO: 925525 - RNA, 15 nt, Mycobacterium avium subsp. paratuberculosis
accgcgucggcgccg

SEQ ID NO: 925526 - RNA, 15 nt, Mycobacterium avium subsp. paratuberculosis
accgcgucggcgcug

SEQ ID NO: 925527 - RNA, 16 nt, Mycobacterium avium subsp. paratuberculosis
accgcggugaccgccc

SEQ ID NO: 925528 - RNA, 17 nt, Mycobacterium avium subsp. paratuberculosis
accgcggugaccgcccg

SEQ ID NO: 925529 - RNA, 17 nt, Mycobacterium avium subsp. paratuberculosis
accgcgucgaugucguc

SEQ ID NO: 925530 - RNA, 19 nt, Mycobacterium avium subsp. paratuberculosis
accgcgucgaugucgucgu

SEQ ID NO: 925531 - RNA, 16 nt, Mycobacterium avium subsp. paratuberculosis
accgcgucgcagugcc

SEQ ID NO: 925532 - RNA, 14 nt, Mycobacterium avium subsp. paratuberculosis
accgcgucggccca

SEQ ID NO: 925533 - RNA, 15 nt, Mycobacterium avium subsp. paratuberculosis
accgcgucggcccag

SEQ ID NO: 925534 - RNA, 16 nt, Mycobacterium avium subsp. paratuberculosis
accgcguuggccgcca

SEQ ID NO: 925535 - RNA, 16 nt, Mycobacterium avium subsp. paratuberculosis
accgcguuggcgccga

SEQ ID NO: 925536 - RNA, 17 nt, Mycobacterium avium subsp. paratuberculosis
accgcguuggcgccgac

SEQ ID NO: 925537 - RNA, 18 nt, Mycobacterium avium subsp. paratuberculosis
accgcguuggcgccgacg

SEQ ID NO: 925538 - RNA, 19 nt, Mycobacterium avium subsp. paratuberculosis
accgcguuggcgccgacgu

SEQ ID NO: 925539 - RNA, 23 nt, Mycobacterium avium subsp. paratuberculosis
accgcguuguccggggugggcac

SEQ ID NO: 925540 - RNA, 17 nt, Mycobacterium avium subsp. paratuberculosis
accgcguugucggcgac

SEQ ID NO: 925541 - RNA, 18 nt, Mycobacterium avium subsp. paratuberculosis
accgcguugaucagcgcc

SEQ ID NO: 925542 - RNA, 19 nt, Mycobacterium avium subsp. paratuberculosis
accgcguugaucagcgcca

SEQ ID NO: 925543 - RNA, 20 nt, Mycobacterium avium subsp. paratuberculosis
accgcguugaucagcgccag

SEQ ID NO: 925544 - RNA, 16 nt, Mycobacterium avium subsp. paratuberculosis
accgcgugugcccgcc

SEQ ID NO: 925545 - RNA, 22 nt, Mycobacterium avium subsp. paratuberculosis
accgcgugugcccgccucgcag

SEQ ID NO: 925546 - RNA, 22 nt, Mycobacterium avium subsp. paratuberculosis
accgcguucucggcggacaucg

SEQ ID NO: 925547 - RNA, 15 nt, Mycobacterium avium subsp. paratuberculosis
accgcugcggcacac

SEQ ID NO: 925548 - RNA, 13 nt, Mycobacterium avium subsp. paratuberculosis
accgcugccggcc

SEQ ID NO: 925549 - RNA, 15 nt, Mycobacterium avium subsp. paratuberculosis
accgcugccggccga

SEQ ID NO: 925550 - RNA, 15 nt, Mycobacterium avium subsp. paratuberculosis
accgcugcaugccgu

SEQ ID NO: 925551 - RNA, 24 nt, Mycobacterium avium subsp. paratuberculosis
accgcugccacgguuucgccguac

SEQ ID NO: 925552 - RNA, 16 nt, Mycobacterium avium subsp. paratuberculosis
accgcugaugccgccg

SEQ ID NO: 925553 - RNA, 18 nt, Mycobacterium avium subsp. paratuberculosis
accgcugcaaccgguagc

SEQ ID NO: 925554 - RNA, 20 nt, Mycobacterium avium subsp. paratuberculosis
accgcugcaaccgguagcgg

SEQ ID NO: 925555 - RNA, 15 nt, Mycobacterium avium subsp. paratuberculosis
accgcuggccgaggc

SEQ ID NO: 925556 - RNA, 19 nt, Mycobacterium avium subsp. paratuberculosis
accgcuggccgaggccucc

SEQ ID NO: 925557 - RNA, 16 nt, Mycobacterium avium subsp. paratuberculosis
accgcugggcggcgcg

SEQ ID NO: 925558 - RNA, 23 nt, Mycobacterium avium subsp. paratuberculosis
accgcuggaaccgaaucggucga

SEQ ID NO: 925559 - RNA, 19 nt, Mycobacterium avium subsp. paratuberculosis
accgcugcugcucggccgc

SEQ ID NO: 925560 - RNA, 18 nt, Mycobacterium avium subsp. paratuberculosis
accgcugcugcugcccgc

SEQ ID NO: 925561 - RNA, 19 nt, Mycobacterium avium subsp. paratuberculosis
accgcugcugcugcccgcc

SEQ ID NO: 925562 - RNA, 20 nt, Mycobacterium avium subsp. paratuberculosis
accgcugcugcugcccgccc

SEQ ID NO: 925563 - RNA, 22 nt, Mycobacterium avium subsp. paratuberculosis
accgcugcugcugcccgcccga

SEQ ID NO: 925564 - RNA, 23 nt, Mycobacterium avium subsp. paratuberculosis
accgcugcuccggguccgcggug

SEQ ID NO: 925565 - RNA, 18 nt, Mycobacterium avium subsp. paratuberculosis
accggacgcagcgaucgg

SEQ ID NO: 925566 - RNA, 21 nt, Mycobacterium avium subsp. paratuberculosis
accggacgaacaucgagccca

SEQ ID NO: 925567 - RNA, 20 nt, Mycobacterium avium subsp. paratuberculosis
accggauggcgcccggcagc

SEQ ID NO: 925568 - RNA, 14 nt, Mycobacterium avium subsp. paratuberculosis
accggaugcucacc

SEQ ID NO: 925569 - RNA, 14 nt, Mycobacterium avium subsp. paratuberculosis
accggagcggcggu

SEQ ID NO: 925570 - RNA, 17 nt, Mycobacterium avium subsp. paratuberculosis
accggaucgaccaacuc

SEQ ID NO: 925571 - RNA, 14 nt, Mycobacterium avium subsp. paratuberculosis
accggaucggccag

SEQ ID NO: 925572 - RNA, 15 nt, Mycobacterium avium subsp. paratuberculosis
accggaucggccagc

SEQ ID NO: 925573 - RNA, 15 nt, Mycobacterium avium subsp. paratuberculosis
accucuugcggcgca

SEQ ID NO: 925574 - RNA, 22 nt, Mycobacterium avium subsp. paratuberculosis
accucugcgcgagcagcucgac

SEQ ID NO: 925575 - RNA, 20 nt, Mycobacterium avium subsp. paratuberculosis
accucuucgggcagcgcgug

SEQ ID NO: 925576 - RNA, 17 nt, Mycobacterium avium subsp. paratuberculosis
accugaacggccgcgca

SEQ ID NO: 925577 - RNA, 18 nt, Mycobacterium avium subsp. paratuberculosis
accugaacggccgcgcag

SEQ ID NO: 925578 - RNA, 18 nt, Mycobacterium avium subsp. paratuberculosis
accugaccagcggcgcgc

SEQ ID NO: 925579 - RNA, 20 nt, Mycobacterium avium subsp. paratuberculosis
accugaccagcggcgcgccg

SEQ ID NO: 925580 - RNA, 23 nt, Mycobacterium avium subsp. paratuberculosis
accugaccagcggcgcgccgggc

SEQ ID NO: 925581 - RNA, 19 nt, Mycobacterium avium subsp. paratuberculosis
accugagucugggucacgc

SEQ ID NO: 925582 - RNA, 20 nt, Mycobacterium avium subsp. paratuberculosis
accugaucgcggcgagcagc

SEQ ID NO: 925583 - RNA, 13 nt, Mycobacterium avium subsp. paratuberculosis
accugaucuucga

SEQ ID NO: 925584 - RNA, 20 nt, Mycobacterium avium subsp. paratuberculosis
accugacgcucggucgccac

SEQ ID NO: 925585 - RNA, 15 nt, Mycobacterium avium subsp. paratuberculosis
accugaccgucggcc

SEQ ID NO: 925586 - RNA, 17 nt, Mycobacterium avium subsp. paratuberculosis
accugaccgucggccag

SEQ ID NO: 925587 - RNA, 17 nt, Mycobacterium avium subsp. paratuberculosis
accugaccgcgggcccg

SEQ ID NO: 925588 - RNA, 20 nt, Mycobacterium avium subsp. paratuberculosis
accugaccgcgggcccgccg

SEQ ID NO: 925589 - RNA, 14 nt, Mycobacterium avium subsp. paratuberculosis
accucggucgggga

SEQ ID NO: 925590 - RNA, 16 nt, Mycobacterium avium subsp. paratuberculosis
accucgucgacggcgg

SEQ ID NO: 925591 - RNA, 23 nt, Mycobacterium avium subsp. paratuberculosis
accucggugaucucaccggcggc

SEQ ID NO: 925592 - RNA, 17 nt, Mycobacterium avium subsp. paratuberculosis
accucggugaugguccc

SEQ ID NO: 925593 - RNA, 17 nt, Mycobacterium avium subsp. paratuberculosis
accucgggcauuggcag

SEQ ID NO: 925594 - RNA, 16 nt, Mycobacterium avium subsp. paratuberculosis
accucgggccgggcgg

SEQ ID NO: 925595 - RNA, 21 nt, Mycobacterium avium subsp. paratuberculosis
accucgggccgggcgggcacc

SEQ ID NO: 925596 - RNA, 22 nt, Mycobacterium avium subsp. paratuberculosis
accucgggccgggcgggcaccc

SEQ ID NO: 925597 - RNA, 12 nt, Mycobacterium avium subsp. paratuberculosis
accucgggugua

SEQ ID NO: 925598 - RNA, 19 nt, Mycobacterium avium subsp. paratuberculosis
accucuucgaaagccaccc

SEQ ID NO: 925599 - RNA, 13 nt, Mycobacterium avium subsp. paratuberculosis
accucuucgcggu

SEQ ID NO: 925600 - RNA, 23 nt, Mycobacterium avium subsp. paratuberculosis
accucuucgcgguccaucuccag

SEQ ID NO: 925601 - RNA, 17 nt, Mycobacterium avium subsp. paratuberculosis
accucuucggcgccggc

SEQ ID NO: 925602 - RNA, 22 nt, Mycobacterium avium subsp. paratuberculosis
accucuucggcgccggcaucca

SEQ ID NO: 925603 - RNA, 22 nt, Mycobacterium avium subsp. paratuberculosis
accucgucgaucuucgcggcgu

SEQ ID NO: 925604 - RNA, 23 nt, Mycobacterium avium subsp. paratuberculosis
accucgucgaucuucgcggcgua

SEQ ID NO: 925605 - RNA, 16 nt, Mycobacterium avium subsp. paratuberculosis
accucgucggcggcga

SEQ ID NO: 925606 - RNA, 15 nt, Mycobacterium avium subsp. paratuberculosis
accucgucggcgguc

SEQ ID NO: 925607 - RNA, 19 nt, Mycobacterium avium subsp. paratuberculosis
accucgucggcggugccga

SEQ ID NO: 925608 - RNA, 18 nt, Mycobacterium avium subsp. paratuberculosis
accucgucgggcgccagc

SEQ ID NO: 925609 - RNA, 24 nt, Mycobacterium avium subsp. paratuberculosis
accucgucgggcgccagcccgccc

SEQ ID NO: 925610 - RNA, 20 nt, Mycobacterium avium subsp. paratuberculosis
accucgugcacaugcccguc

SEQ ID NO: 925611 - RNA, 14 nt, Mycobacterium avium subsp. paratuberculosis
accucggcgucggc

SEQ ID NO: 925612 - RNA, 15 nt, Mycobacterium avium subsp. paratuberculosis
accucggcggcaccg

SEQ ID NO: 925613 - RNA, 22 nt, Mycobacterium avium subsp. paratuberculosis
accucggcggcaccgcccgggu

SEQ ID NO: 925614 - RNA, 14 nt, Mycobacterium avium subsp. paratuberculosis
accucggcggccag

SEQ ID NO: 925615 - RNA, 22 nt, Mycobacterium avium subsp. paratuberculosis
accucggcggccagcgcgacgc

SEQ ID NO: 925616 - RNA, 19 nt, Mycobacterium avium subsp. paratuberculosis
accucggcggcggcgcgcc

SEQ ID NO: 925617 - RNA, 20 nt, Mycobacterium avium subsp. paratuberculosis
accucggcggcggcgcgccg

SEQ ID NO: 925618 - RNA, 21 nt, Mycobacterium avium subsp. paratuberculosis
accucggcggcggcgcgccgg

SEQ ID NO: 925619 - RNA, 17 nt, Mycobacterium avium subsp. paratuberculosis
accucggcgaccagcga

SEQ ID NO: 925620 - RNA, 19 nt, Mycobacterium avium subsp. paratuberculosis
accucggcgaccagcgacg

SEQ ID NO: 925621 - RNA, 12 nt, Mycobacterium avium subsp. paratuberculosis
accucggcgacg

SEQ ID NO: 925622 - RNA, 16 nt, Mycobacterium avium subsp. paratuberculosis
accucggccaccaccu

SEQ ID NO: 925623 - RNA, 15 nt, Mycobacterium avium subsp. paratuberculosis
accucggccagcgcc

SEQ ID NO: 925624 - RNA, 16 nt, Mycobacterium avium subsp. paratuberculosis
accucggccagcgccg

SEQ ID NO: 925625 - RNA, 17 nt, Mycobacterium avium subsp. paratuberculosis
accucggccagcgccgc

SEQ ID NO: 925626 - RNA, 21 nt, Mycobacterium avium subsp. paratuberculosis
accucggccagcgccgcgcgc

SEQ ID NO: 925627 - RNA, 22 nt, Mycobacterium avium subsp. paratuberculosis
accucggccagcgccgcgcgcg

SEQ ID NO: 925628 - RNA, 22 nt, Mycobacterium avium subsp. paratuberculosis
accucggagaugauggccgcgc

SEQ ID NO: 925629 - RNA, 15 nt, Mycobacterium avium subsp. paratuberculosis
accucggaucgucug

SEQ ID NO: 925630 - RNA, 16 nt, Mycobacterium avium subsp. paratuberculosis
accucgcuacgcgagc

SEQ ID NO: 925631 - RNA, 18 nt, Mycobacterium avium subsp. paratuberculosis
accucgcuacgcgagcug

SEQ ID NO: 925632 - RNA, 15 nt, Mycobacterium avium subsp. paratuberculosis
accucgcucagcccg

SEQ ID NO: 925633 - RNA, 14 nt, Mycobacterium avium subsp. paratuberculosis
accucgcuggcggc

SEQ ID NO: 925634 - RNA, 17 nt, Mycobacterium avium subsp. paratuberculosis
accucgcuggcggcgcg

SEQ ID NO: 925635 - RNA, 14 nt, Mycobacterium avium subsp. paratuberculosis
accucgcggcggcg

SEQ ID NO: 925636 - RNA, 15 nt, Mycobacterium avium subsp. paratuberculosis
accucgcggcggcgu

SEQ ID NO: 925637 - RNA, 19 nt, Mycobacterium avium subsp. paratuberculosis
accucgcggcggcgucggc

SEQ ID NO: 925638 - RNA, 21 nt, Mycobacterium avium subsp. paratuberculosis
accucgcggcggcgucggcgu

SEQ ID NO: 925639 - RNA, 18 nt, Mycobacterium avium subsp. paratuberculosis
accucgcgcaccggcugc

SEQ ID NO: 925640 - RNA, 13 nt, Mycobacterium avium subsp. paratuberculosis
accucgcgcgggg

SEQ ID NO: 925641 - RNA, 16 nt, Mycobacterium avium subsp. paratuberculosis
accucgcgcggggcgg

SEQ ID NO: 925642 - RNA, 19 nt, Mycobacterium avium subsp. paratuberculosis
accucgcgcggggcggccg

SEQ ID NO: 925643 - RNA, 21 nt, Mycobacterium avium subsp. paratuberculosis
accucgcgcggggcggccgcc

SEQ ID NO: 925644 - RNA, 19 nt, Mycobacterium avium subsp. paratuberculosis
accucgcgcgucacgcugg

SEQ ID NO: 925645 - RNA, 24 nt, Mycobacterium avium subsp. paratuberculosis
accucgcgcucuugggcggccggc

SEQ ID NO: 925646 - RNA, 13 nt, Mycobacterium avium subsp. paratuberculosis
accucgcgcagca

SEQ ID NO: 925647 - RNA, 14 nt, Mycobacterium avium subsp. paratuberculosis
accucgcgcagcac

SEQ ID NO: 925648 - RNA, 13 nt, Mycobacterium avium subsp. paratuberculosis
accucgcgcagcc

SEQ ID NO: 925649 - RNA, 14 nt, Mycobacterium avium subsp. paratuberculosis
accucgcgcagccc

SEQ ID NO: 925650 - RNA, 17 nt, Mycobacterium avium subsp. paratuberculosis
accucgcgcagcccccg

SEQ ID NO: 925651 - RNA, 16 nt, Mycobacterium avium subsp. paratuberculosis
accucgcgcccggcgc

SEQ ID NO: 925652 - RNA, 23 nt, Mycobacterium avium subsp. paratuberculosis
accucgcgccgcgaucucggcgg

SEQ ID NO: 925653 - RNA, 22 nt, Mycobacterium avium subsp. paratuberculosis
accucgauggguucuucgacca

SEQ ID NO: 925654 - RNA, 14 nt, Mycobacterium avium subsp. paratuberculosis
accucgcacagcuu

SEQ ID NO: 925655 - RNA, 16 nt, Mycobacterium avium subsp. paratuberculosis
accucgcccgccgcga

SEQ ID NO: 925656 - RNA, 19 nt, Mycobacterium avium subsp. paratuberculosis
accucgcccgccgcgacgg

SEQ ID NO: 925657 - RNA, 17 nt, Mycobacterium avium subsp. paratuberculosis
accucgccgacgguguc

SEQ ID NO: 925658 - RNA, 13 nt, Mycobacterium avium subsp. paratuberculosis
accucgccgacgu

SEQ ID NO: 925659 - RNA, 15 nt, Mycobacterium avium subsp. paratuberculosis
accucgccgagcagc

SEQ ID NO: 925660 - RNA, 14 nt, Mycobacterium avium subsp. paratuberculosis
accucgauggcgac

SEQ ID NO: 925661 - RNA, 18 nt, Mycobacterium avium subsp. paratuberculosis
accucgccggccgccgug

SEQ ID NO: 925662 - RNA, 14 nt, Mycobacterium avium subsp. paratuberculosis
accucgccggccgg

SEQ ID NO: 925663 - RNA, 18 nt, Mycobacterium avium subsp. paratuberculosis
accucgccggccgggcgg

SEQ ID NO: 925664 - RNA, 19 nt, Mycobacterium avium subsp. paratuberculosis
accucgagcgucacgcugg

SEQ ID NO: 925665 - RNA, 20 nt, Mycobacterium avium subsp. paratuberculosis
accucgagcgucacgcuggc

SEQ ID NO: 925666 - RNA, 16 nt, Mycobacterium avium subsp. paratuberculosis
accucgagcucaccga

SEQ ID NO: 925667 - RNA, 16 nt, Mycobacterium avium subsp. paratuberculosis
accucgaggccgaggu

SEQ ID NO: 925668 - RNA, 18 nt, Mycobacterium avium subsp. paratuberculosis
accucgaucaccgggcgg

SEQ ID NO: 925669 - RNA, 22 nt, Mycobacterium avium subsp. paratuberculosis
accucgaucaccgggcggccgu

SEQ ID NO: 925670 - RNA, 17 nt, Mycobacterium avium subsp. paratuberculosis
accucgacggcgugguc

SEQ ID NO: 925671 - RNA, 21 nt, Mycobacterium avium subsp. paratuberculosis
accucgacggcguggucggcg

SEQ ID NO: 925672 - RNA, 18 nt, Mycobacterium avium subsp. paratuberculosis
accucgagauucugcagc

SEQ ID NO: 925673 - RNA, 15 nt, Mycobacterium avium subsp. paratuberculosis
accucgagcaccggc

SEQ ID NO: 925674 - RNA, 15 nt, Mycobacterium avium subsp. paratuberculosis
accucgagcacgccc

SEQ ID NO: 925675 - RNA, 16 nt, Mycobacterium avium subsp. paratuberculosis
accucgagcagcgcgc

SEQ ID NO: 925676 - RNA, 21 nt, Mycobacterium avium subsp. paratuberculosis
accucgagcagcgcgcgcuug

SEQ ID NO: 925677 - RNA, 21 nt, Mycobacterium avium subsp. paratuberculosis
accuccugcaaggcccccgcc

SEQ ID NO: 925678 - RNA, 23 nt, Mycobacterium avium subsp. paratuberculosis
accuccugcuggcguucgccgag

SEQ ID NO: 925679 - RNA, 23 nt, Mycobacterium avium subsp. paratuberculosis
accuccuuggccaggcgggccac

SEQ ID NO: 925680 - RNA, 16 nt, Mycobacterium avium subsp. paratuberculosis
accucgaaacccagcu

SEQ ID NO: 925681 - RNA, 22 nt, Mycobacterium avium subsp. paratuberculosis
accucgaacacaucguggcgca

SEQ ID NO: 925682 - RNA, 23 nt, Mycobacterium avium subsp. paratuberculosis
accucgaagaagagggcgugacg

SEQ ID NO: 925683 - RNA, 22 nt, Mycobacterium avium subsp. paratuberculosis
accucgaagauggucgcgccgc

SEQ ID NO: 925684 - RNA, 14 nt, Mycobacterium avium subsp. paratuberculosis
accucgaagccgac

SEQ ID NO: 925685 - RNA, 18 nt, Mycobacterium avium subsp. paratuberculosis
accucgaagccgacgucc

SEQ ID NO: 925686 - RNA, 16 nt, Mycobacterium avium subsp. paratuberculosis
accucgaagccgaucg

SEQ ID NO: 925687 - RNA, 22 nt, Mycobacterium avium subsp. paratuberculosis
accucgaagccgaucgcggcga

SEQ ID NO: 925688 - RNA, 17 nt, Mycobacterium avium subsp. paratuberculosis
accucgaagggcgccag

SEQ ID NO: 925689 - RNA, 13 nt, Mycobacterium avium subsp. paratuberculosis
accucgacacggg

SEQ ID NO: 925690 - RNA, 20 nt, Mycobacterium avium subsp. paratuberculosis
accucgacacgggccgcgcc

SEQ ID NO: 925691 - RNA, 23 nt, Mycobacterium avium subsp. paratuberculosis
accucgacacgggccgcgccgag

SEQ ID NO: 925692 - RNA, 16 nt, Mycobacterium avium subsp. paratuberculosis
accucgaccagccggu

SEQ ID NO: 925693 - RNA, 22 nt, Mycobacterium avium subsp. paratuberculosis
accucgaacuugaccgggcucc

SEQ ID NO: 925694 - RNA, 23 nt, Mycobacterium avium subsp. paratuberculosis
accucgaccgugaggcccggcgu

SEQ ID NO: 925695 - RNA, 17 nt, Mycobacterium avium subsp. paratuberculosis
accucaccugcguugcg

SEQ ID NO: 925696 - RNA, 20 nt, Mycobacterium avium subsp. paratuberculosis
accucacggucggcguccag

SEQ ID NO: 925697 - RNA, 17 nt, Mycobacterium avium subsp. paratuberculosis
accucaucgcccagccg

SEQ ID NO: 925698 - RNA, 19 nt, Mycobacterium avium subsp. paratuberculosis
accucacacugaaagccga

SEQ ID NO: 925699 - RNA, 17 nt, Mycobacterium avium subsp. paratuberculosis
accuaggcgucgucggc

SEQ ID NO: 925700 - RNA, 21 nt, Mycobacterium avium subsp. paratuberculosis
accuaggcgucgucggcccag

SEQ ID NO: 925701 - RNA, 20 nt, Mycobacterium avium subsp. paratuberculosis
accuccggagaucgccccgg

SEQ ID NO: 925702 - RNA, 18 nt, Mycobacterium avium subsp. paratuberculosis
accucccggcgccacgcc

SEQ ID NO: 925703 - RNA, 19 nt, Mycobacterium avium subsp. paratuberculosis
accuccgugccgauggcca

SEQ ID NO: 925704 - RNA, 20 nt, Mycobacterium avium subsp. paratuberculosis
accuccgugccgauggccac

SEQ ID NO: 925705 - RNA, 17 nt, Mycobacterium avium subsp. paratuberculosis
accuccacgagccgguc

SEQ ID NO: 925706 - RNA, 18 nt, Mycobacterium avium subsp. paratuberculosis
accucccccgacgccgac

SEQ ID NO: 925707 - RNA, 19 nt, Mycobacterium avium subsp. paratuberculosis
accuccccgcggugccgca

SEQ ID NO: 925708 - RNA, 22 nt, Mycobacterium avium subsp. paratuberculosis
accuccgacagcccccgcagcc

SEQ ID NO: 925709 - RNA, 19 nt, Mycobacterium avium subsp. paratuberculosis
accguugcgccccagacgu

SEQ ID NO: 925710 - RNA, 21 nt, Mycobacterium avium subsp. paratuberculosis
accguuggccugcgcgaccuc

SEQ ID NO: 925711 - RNA, 22 nt, Mycobacterium avium subsp. paratuberculosis
accguugggcaacgcggcauga

SEQ ID NO: 925712 - RNA, 17 nt, Mycobacterium avium subsp. paratuberculosis
accguuggugcgguguc

SEQ ID NO: 925713 - RNA, 20 nt, Mycobacterium avium subsp. paratuberculosis
accguugucucggcgccguc

SEQ ID NO: 925714 - RNA, 22 nt, Mycobacterium avium subsp. paratuberculosis
accguugucucggcgccgucgc

SEQ ID NO: 925715 - RNA, 16 nt, Mycobacterium avium subsp. paratuberculosis
accguugugacccgcu

SEQ ID NO: 925716 - RNA, 17 nt, Mycobacterium avium subsp. paratuberculosis
accguugugacccgcuc

SEQ ID NO: 925717 - RNA, 20 nt, Mycobacterium avium subsp. paratuberculosis
accguugugacccgcucggg

SEQ ID NO: 925718 - RNA, 18 nt, Mycobacterium avium subsp. paratuberculosis
accgugccuuacgccggg

SEQ ID NO: 925719 - RNA, 18 nt, Mycobacterium avium subsp. paratuberculosis
accgugcgacuugguggc

SEQ ID NO: 925720 - RNA, 13 nt, Mycobacterium avium subsp. paratuberculosis
accgugcgcgcgc

SEQ ID NO: 925721 - RNA, 14 nt, Mycobacterium avium subsp. paratuberculosis
accgugcgcgcgca

SEQ ID NO: 925722 - RNA, 18 nt, Mycobacterium avium subsp. paratuberculosis
accgugcgggucgcgcug

SEQ ID NO: 925723 - RNA, 13 nt, Mycobacterium avium subsp. paratuberculosis
accgugcccacca

SEQ ID NO: 925724 - RNA, 12 nt, Mycobacterium avium subsp. paratuberculosis
accgugcccgag

SEQ ID NO: 925725 - RNA, 13 nt, Mycobacterium avium subsp. paratuberculosis
accgugccgcccg

SEQ ID NO: 925726 - RNA, 14 nt, Mycobacterium avium subsp. paratuberculosis
accgugccgcgcgg

SEQ ID NO: 925727 - RNA, 22 nt, Mycobacterium avium subsp. paratuberculosis
accgugccgcgcggcggugacc

SEQ ID NO: 925728 - RNA, 17 nt, Mycobacterium avium subsp. paratuberculosis
accguggaagucgccgu

SEQ ID NO: 925729 - RNA, 20 nt, Mycobacterium avium subsp. paratuberculosis
accguggaagucgccguccg

SEQ ID NO: 925730 - RNA, 23 nt, Mycobacterium avium subsp. paratuberculosis
accguggaggacgaggcccgcaa

SEQ ID NO: 925731 - RNA, 15 nt, Mycobacterium avium subsp. paratuberculosis
accguggcaggcgau

SEQ ID NO: 925732 - RNA, 17 nt, Mycobacterium avium subsp. paratuberculosis
accguggcgggggagcc

SEQ ID NO: 925733 - RNA, 15 nt, Mycobacterium avium subsp. paratuberculosis
accgugggcggcgcg

SEQ ID NO: 925734 - RNA, 16 nt, Mycobacterium avium subsp. paratuberculosis
accgugggcggcgcga

SEQ ID NO: 925735 - RNA, 20 nt, Mycobacterium avium subsp. paratuberculosis
accgugggcggcgcgaucgu

SEQ ID NO: 925736 - RNA, 23 nt, Mycobacterium avium subsp. paratuberculosis
accgugggcggcgcgaucgucga

SEQ ID NO: 925737 - RNA, 15 nt, Mycobacterium avium subsp. paratuberculosis
accguggucggcagc

SEQ ID NO: 925738 - RNA, 18 nt, Mycobacterium avium subsp. paratuberculosis
accguggucggcagcacc

SEQ ID NO: 925739 - RNA, 21 nt, Mycobacterium avium subsp. paratuberculosis
accguggucggcagcaccggc

SEQ ID NO: 925740 - RNA, 20 nt, Mycobacterium avium subsp. paratuberculosis
accguggugacccggaccgg

SEQ ID NO: 925741 - RNA, 16 nt, Mycobacterium avium subsp. paratuberculosis
accguguagccgaccg

SEQ ID NO: 925742 - RNA, 16 nt, Mycobacterium avium subsp. paratuberculosis
accgugguggcggcga

SEQ ID NO: 925743 - RNA, 22 nt, Mycobacterium avium subsp. paratuberculosis
accguggugucggagaucggcg

SEQ ID NO: 925744 - RNA, 23 nt, Mycobacterium avium subsp. paratuberculosis
accguggugucggagaucggcga

SEQ ID NO: 925745 - RNA, 23 nt, Mycobacterium avium subsp. paratuberculosis
accguggugugcccgcgggccag

SEQ ID NO: 925746 - RNA, 19 nt, Mycobacterium avium subsp. paratuberculosis
accguguugaucucgucga

SEQ ID NO: 925747 - RNA, 14 nt, Mycobacterium avium subsp. paratuberculosis
accguguuggugac

SEQ ID NO: 925748 - RNA, 20 nt, Mycobacterium avium subsp. paratuberculosis
accguucaacggccaaccgc

SEQ ID NO: 925749 - RNA, 15 nt, Mycobacterium avium subsp. paratuberculosis
accguucaccucuuc

SEQ ID NO: 925750 - RNA, 16 nt, Mycobacterium avium subsp. paratuberculosis
accguucaccucuucg

SEQ ID NO: 925751 - RNA, 22 nt, Mycobacterium avium subsp. paratuberculosis
accguucauuaucccgcaccgc

SEQ ID NO: 925752 - RNA, 20 nt, Mycobacterium avium subsp. paratuberculosis
accguucgucgucgcgcagg

SEQ ID NO: 925753 - RNA, 15 nt, Mycobacterium avium subsp. paratuberculosis
accguugaccgacgc

SEQ ID NO: 925754 - RNA, 14 nt, Mycobacterium avium subsp. paratuberculosis
accguugacgaccu

SEQ ID NO: 925755 - RNA, 18 nt, Mycobacterium avium subsp. paratuberculosis
accguugacgaccuuguc

SEQ ID NO: 925756 - RNA, 14 nt, Mycobacterium avium subsp. paratuberculosis
accguugaggcgag

SEQ ID NO: 925757 - RNA, 23 nt, Mycobacterium avium subsp. paratuberculosis
accgucaucgugugggcgcccgc

SEQ ID NO: 925758 - RNA, 21 nt, Mycobacterium avium subsp. paratuberculosis
accgucaguucguagaucacg

SEQ ID NO: 925759 - RNA, 23 nt, Mycobacterium avium subsp. paratuberculosis
accgucaguucguagaucacggc

SEQ ID NO: 925760 - RNA, 16 nt, Mycobacterium avium subsp. paratuberculosis
accgucaucgcggcga

SEQ ID NO: 925761 - RNA, 17 nt, Mycobacterium avium subsp. paratuberculosis
accguccagcucagcgc

SEQ ID NO: 925762 - RNA, 19 nt, Mycobacterium avium subsp. paratuberculosis
accguccagcucagcgcgc

SEQ ID NO: 925763 - RNA, 20 nt, Mycobacterium avium subsp. paratuberculosis
accguccagcucagcgcgca

SEQ ID NO: 925764 - RNA, 21 nt, Mycobacterium avium subsp. paratuberculosis
accguccagcucagcgcgcac

SEQ ID NO: 925765 - RNA, 19 nt, Mycobacterium avium subsp. paratuberculosis
accgucccggugucgccgu

SEQ ID NO: 925766 - RNA, 21 nt, Mycobacterium avium subsp. paratuberculosis
accgucccggugucgccgucg

SEQ ID NO: 925767 - RNA, 13 nt, Mycobacterium avium subsp. paratuberculosis
accguccgaccgu

SEQ ID NO: 925768 - RNA, 17 nt, Mycobacterium avium subsp. paratuberculosis
accgucacgcuggcgug

SEQ ID NO: 925769 - RNA, 21 nt, Mycobacterium avium subsp. paratuberculosis
accgucacgcuggcgugacac

SEQ ID NO: 925770 - RNA, 17 nt, Mycobacterium avium subsp. paratuberculosis
accgucagcgucagcac

SEQ ID NO: 925771 - RNA, 19 nt, Mycobacterium avium subsp. paratuberculosis
accgucagcgucagcacgu

SEQ ID NO: 925772 - RNA, 14 nt, Mycobacterium avium subsp. paratuberculosis
accgucagggugac

SEQ ID NO: 925773 - RNA, 15 nt, Mycobacterium avium subsp. paratuberculosis
accgucagggugacg

SEQ ID NO: 925774 - RNA, 20 nt, Mycobacterium avium subsp. paratuberculosis
accgucagggugacguggcg

SEQ ID NO: 925775 - RNA, 21 nt, Mycobacterium avium subsp. paratuberculosis
accgucagggugacguggcgg

SEQ ID NO: 925776 - RNA, 22 nt, Mycobacterium avium subsp. paratuberculosis
accgucaggguggugcccccgc

SEQ ID NO: 925777 - RNA, 21 nt, Mycobacterium avium subsp. paratuberculosis
accgucacccccggcgcgacg

SEQ ID NO: 925778 - RNA, 13 nt, Mycobacterium avium subsp. paratuberculosis
accgucaccgccg

SEQ ID NO: 925779 - RNA, 14 nt, Mycobacterium avium subsp. paratuberculosis
accgucaccgccgc

SEQ ID NO: 925780 - RNA, 15 nt, Mycobacterium avium subsp. paratuberculosis
accgucaccguggcg

SEQ ID NO: 925781 - RNA, 13 nt, Mycobacterium avium subsp. paratuberculosis
accguagccgguc

SEQ ID NO: 925782 - RNA, 19 nt, Mycobacterium avium subsp. paratuberculosis
accguagccggucggcccg

SEQ ID NO: 925783 - RNA, 13 nt, Mycobacterium avium subsp. paratuberculosis
accguacggcccg

SEQ ID NO: 925784 - RNA, 13 nt, Mycobacterium avium subsp. paratuberculosis
accggugucacgc

SEQ ID NO: 925785 - RNA, 19 nt, Mycobacterium avium subsp. paratuberculosis
accguaccgaggaugaccg

SEQ ID NO: 925786 - RNA, 12 nt, Mycobacterium avium subsp. paratuberculosis
accgucgccgac

SEQ ID NO: 925787 - RNA, 14 nt, Mycobacterium avium subsp. paratuberculosis
accgucgccgacca

SEQ ID NO: 925788 - RNA, 16 nt, Mycobacterium avium subsp. paratuberculosis
accgucgccgaccagc

SEQ ID NO: 925789 - RNA, 17 nt, Mycobacterium avium subsp. paratuberculosis
accgucagcagggccuc

SEQ ID NO: 925790 - RNA, 14 nt, Mycobacterium avium subsp. paratuberculosis
accgucgccggcgg

SEQ ID NO: 925791 - RNA, 17 nt, Mycobacterium avium subsp. paratuberculosis
accgucgccggcggggc

SEQ ID NO: 925792 - RNA, 13 nt, Mycobacterium avium subsp. paratuberculosis
accgucgcgcagc

SEQ ID NO: 925793 - RNA, 17 nt, Mycobacterium avium subsp. paratuberculosis
accgucgcgcagcccga

SEQ ID NO: 925794 - RNA, 14 nt, Mycobacterium avium subsp. paratuberculosis
accgucggcccgcc

SEQ ID NO: 925795 - RNA, 13 nt, Mycobacterium avium subsp. paratuberculosis
accgucggcgauc

SEQ ID NO: 925796 - RNA, 15 nt, Mycobacterium avium subsp. paratuberculosis
accgucggcgaucgc

SEQ ID NO: 925797 - RNA, 19 nt, Mycobacterium avium subsp. paratuberculosis
accgucggcgaucgccggg

SEQ ID NO: 925798 - RNA, 12 nt, Mycobacterium avium subsp. paratuberculosis
accgucgggacg

SEQ ID NO: 925799 - RNA, 16 nt, Mycobacterium avium subsp. paratuberculosis
accgucgggacggcca

SEQ ID NO: 925800 - RNA, 18 nt, Mycobacterium avium subsp. paratuberculosis
accgucgggacggccagc

SEQ ID NO: 925801 - RNA, 19 nt, Mycobacterium avium subsp. paratuberculosis
accgucgggacggccagca

SEQ ID NO: 925802 - RNA, 12 nt, Mycobacterium avium subsp. paratuberculosis
accgucgaccaa

SEQ ID NO: 925803 - RNA, 16 nt, Mycobacterium avium subsp. paratuberculosis
accgucgaccaacugc

SEQ ID NO: 925804 - RNA, 18 nt, Mycobacterium avium subsp. paratuberculosis
accgucgaagagugcgau

SEQ ID NO: 925805 - RNA, 13 nt, Mycobacterium avium subsp. paratuberculosis
accguccgcgccc

SEQ ID NO: 925806 - RNA, 15 nt, Mycobacterium avium subsp. paratuberculosis
accguccgcgcccac

SEQ ID NO: 925807 - RNA, 16 nt, Mycobacterium avium subsp. paratuberculosis
accguccacagccggc

SEQ ID NO: 925808 - RNA, 18 nt, Mycobacterium avium subsp. paratuberculosis
accguccacagccggcgg

SEQ ID NO: 925809 - RNA, 20 nt, Mycobacterium avium subsp. paratuberculosis
accguccacagccggcggcu

SEQ ID NO: 925810 - RNA, 21 nt, Mycobacterium avium subsp. paratuberculosis
accgucguccacgcccagcgc

SEQ ID NO: 925811 - RNA, 15 nt, Mycobacterium avium subsp. paratuberculosis
accgucuccggcgcg

SEQ ID NO: 925812 - RNA, 18 nt, Mycobacterium avium subsp. paratuberculosis
accgucuccggcgcgguu

SEQ ID NO: 925813 - RNA, 16 nt, Mycobacterium avium subsp. paratuberculosis
accgucgugccagcgc

SEQ ID NO: 925814 - RNA, 17 nt, Mycobacterium avium subsp. paratuberculosis
accgucgugccagcgca

SEQ ID NO: 925815 - RNA, 16 nt, Mycobacterium avium subsp. paratuberculosis
accgucugcgccguca

SEQ ID NO: 925816 - RNA, 18 nt, Mycobacterium avium subsp. paratuberculosis
accgucugcgccgucacc

SEQ ID NO: 925817 - RNA, 13 nt, Mycobacterium avium subsp. paratuberculosis
accgucgucgagc

SEQ ID NO: 925818 - RNA, 17 nt, Mycobacterium avium subsp. paratuberculosis
accgucgucgcaccggc

SEQ ID NO: 925819 - RNA, 18 nt, Mycobacterium avium subsp. paratuberculosis
accgucggugcggggcgg

SEQ ID NO: 925820 - RNA, 20 nt, Mycobacterium avium subsp. paratuberculosis
accgucguacucgaccgcga

SEQ ID NO: 925821 - RNA, 22 nt, Mycobacterium avium subsp. paratuberculosis
accgucuucggggccgccgucg

SEQ ID NO: 925822 - RNA, 20 nt, Mycobacterium avium subsp. paratuberculosis
accgugacggcaucggcgcc

SEQ ID NO: 925823 - RNA, 23 nt, Mycobacterium avium subsp. paratuberculosis
accgugacggcaucggcgcccuc

SEQ ID NO: 925824 - RNA, 16 nt, Mycobacterium avium subsp. paratuberculosis
accgugaucgccacca

SEQ ID NO: 925825 - RNA, 19 nt, Mycobacterium avium subsp. paratuberculosis
accgugaucgccaccacca

SEQ ID NO: 925826 - RNA, 23 nt, Mycobacterium avium subsp. paratuberculosis
accggucaacggcucggucaagc

SEQ ID NO: 925827 - RNA, 17 nt, Mycobacterium avium subsp. paratuberculosis
accgguccaguccggcc

SEQ ID NO: 925828 - RNA, 19 nt, Mycobacterium avium subsp. paratuberculosis
accgguccaguccggccgu

SEQ ID NO: 925829 - RNA, 21 nt, Mycobacterium avium subsp. paratuberculosis
accgguccaguccggccguga

SEQ ID NO: 925830 - RNA, 13 nt, Mycobacterium avium subsp. paratuberculosis
accgguccgccgc

SEQ ID NO: 925831 - RNA, 13 nt, Mycobacterium avium subsp. paratuberculosis
accgguccggccg

SEQ ID NO: 925832 - RNA, 17 nt, Mycobacterium avium subsp. paratuberculosis
accgguccggccgugcc

SEQ ID NO: 925833 - RNA, 18 nt, Mycobacterium avium subsp. paratuberculosis
accgguccggccgugccg

SEQ ID NO: 925834 - RNA, 14 nt, Mycobacterium avium subsp. paratuberculosis
accgguccgugcca

SEQ ID NO: 925835 - RNA, 20 nt, Mycobacterium avium subsp. paratuberculosis
accgguccuccccgcuggcg

SEQ ID NO: 925836 - RNA, 22 nt, Mycobacterium avium subsp. paratuberculosis
accggucgcguugaaagccgcg

SEQ ID NO: 925837 - RNA, 23 nt, Mycobacterium avium subsp. paratuberculosis
accggucgcguugaaagccgcga

SEQ ID NO: 925838 - RNA, 23 nt, Mycobacterium avium subsp. paratuberculosis
accggucggaaaagugggucagc

SEQ ID NO: 925839 - RNA, 16 nt, Mycobacterium avium subsp. paratuberculosis
accgggugggccgacc

SEQ ID NO: 925840 - RNA, 17 nt, Mycobacterium avium subsp. paratuberculosis
accgggugggccgaccu

SEQ ID NO: 925841 - RNA, 16 nt, Mycobacterium avium subsp. paratuberculosis
accggguggugggcga

SEQ ID NO: 925842 - RNA, 16 nt, Mycobacterium avium subsp. paratuberculosis
accgggucguccgcga

SEQ ID NO: 925843 - RNA, 15 nt, Mycobacterium avium subsp. paratuberculosis
accggguuggcgcgc

SEQ ID NO: 925844 - RNA, 17 nt, Mycobacterium avium subsp. paratuberculosis
accgguacagcgacucc

SEQ ID NO: 925845 - RNA, 20 nt, Mycobacterium avium subsp. paratuberculosis
accgguacagcgacuccagc

SEQ ID NO: 925846 - RNA, 20 nt, Mycobacterium avium subsp. paratuberculosis
accgguagaagaugcgccgg

SEQ ID NO: 925847 - RNA, 21 nt, Mycobacterium avium subsp. paratuberculosis
accgguagaagaugcgccggg

SEQ ID NO: 925848 - RNA, 19 nt, Mycobacterium avium subsp. paratuberculosis
accgguagcgguccucgaa

SEQ ID NO: 925849 - RNA, 21 nt, Mycobacterium avium subsp. paratuberculosis
accgguagcgguccucgaacc

SEQ ID NO: 925850 - RNA, 13 nt, Mycobacterium avium subsp. paratuberculosis
accgguaggcgca

SEQ ID NO: 925851 - RNA, 19 nt, Mycobacterium avium subsp. paratuberculosis
accgguaggcgcaccgccg

SEQ ID NO: 925852 - RNA, 15 nt, Mycobacterium avium subsp. paratuberculosis
accgguuccgggcga

SEQ ID NO: 925853 - RNA, 17 nt, Mycobacterium avium subsp. paratuberculosis
accgguuccgggcgacc

SEQ ID NO: 925854 - RNA, 15 nt, Mycobacterium avium subsp. paratuberculosis
accgguucggacacg

SEQ ID NO: 925855 - RNA, 22 nt, Mycobacterium avium subsp. paratuberculosis
accgguucggacacggcgccgu

SEQ ID NO: 925856 - RNA, 22 nt, Mycobacterium avium subsp. paratuberculosis
accgguugcccgguuccgcgac

SEQ ID NO: 925857 - RNA, 15 nt, Mycobacterium avium subsp. paratuberculosis
accgguugcgccgag

SEQ ID NO: 925858 - RNA, 14 nt, Mycobacterium avium subsp. paratuberculosis
accgguugcggcga

SEQ ID NO: 925859 - RNA, 22 nt, Mycobacterium avium subsp. paratuberculosis
accgguugcggcgaacgcgucc

SEQ ID NO: 925860 - RNA, 20 nt, Mycobacterium avium subsp. paratuberculosis
accgguggccgcgucgacca

SEQ ID NO: 925861 - RNA, 14 nt, Mycobacterium avium subsp. paratuberculosis
accgguggccggga

SEQ ID NO: 925862 - RNA, 18 nt, Mycobacterium avium subsp. paratuberculosis
accggucucgaccgcggc

SEQ ID NO: 925863 - RNA, 21 nt, Mycobacterium avium subsp. paratuberculosis
accggucucgaccgcggcgcc

SEQ ID NO: 925864 - RNA, 23 nt, Mycobacterium avium subsp. paratuberculosis
accggucggugcccagcaccgcc

SEQ ID NO: 925865 - RNA, 17 nt, Mycobacterium avium subsp. paratuberculosis
accggugaacgggucaa

SEQ ID NO: 925866 - RNA, 22 nt, Mycobacterium avium subsp. paratuberculosis
accggugacaugauggacuucg

SEQ ID NO: 925867 - RNA, 18 nt, Mycobacterium avium subsp. paratuberculosis
accggugacgaccggcag

SEQ ID NO: 925868 - RNA, 19 nt, Mycobacterium avium subsp. paratuberculosis
accggugacgaccggcagc

SEQ ID NO: 925869 - RNA, 14 nt, Mycobacterium avium subsp. paratuberculosis
accggugcaccgcg

SEQ ID NO: 925870 - RNA, 15 nt, Mycobacterium avium subsp. paratuberculosis
accggugcaccgcgc

SEQ ID NO: 925871 - RNA, 16 nt, Mycobacterium avium subsp. paratuberculosis
accggugcaccgcgcg

SEQ ID NO: 925872 - RNA, 17 nt, Mycobacterium avium subsp. paratuberculosis
accggugcaccgcgcgc

SEQ ID NO: 925873 - RNA, 18 nt, Mycobacterium avium subsp. paratuberculosis
accggugcaccgcgcgca

SEQ ID NO: 925874 - RNA, 16 nt, Mycobacterium avium subsp. paratuberculosis
accggugcgcccgcga

SEQ ID NO: 925875 - RNA, 18 nt, Mycobacterium avium subsp. paratuberculosis
accggugcggucccgguc

SEQ ID NO: 925876 - RNA, 22 nt, Mycobacterium avium subsp. paratuberculosis
accggugcggucccggucgaac

SEQ ID NO: 925877 - RNA, 14 nt, Mycobacterium avium subsp. paratuberculosis
accgggccugcgcg

SEQ ID NO: 925878 - RNA, 15 nt, Mycobacterium avium subsp. paratuberculosis
accgggccugcgcgc

SEQ ID NO: 925879 - RNA, 17 nt, Mycobacterium avium subsp. paratuberculosis
accgggccugcgcgccg

SEQ ID NO: 925880 - RNA, 21 nt, Mycobacterium avium subsp. paratuberculosis
accgggcgacaccccgcgagu

SEQ ID NO: 925881 - RNA, 14 nt, Mycobacterium avium subsp. paratuberculosis
accgggccgcuggc

SEQ ID NO: 925882 - RNA, 23 nt, Mycobacterium avium subsp. paratuberculosis
accgggccgcuggccgccccgaa

SEQ ID NO: 925883 - RNA, 17 nt, Mycobacterium avium subsp. paratuberculosis
accgggccgcuggugag

SEQ ID NO: 925884 - RNA, 18 nt, Mycobacterium avium subsp. paratuberculosis
accgggccgccaucaccg

SEQ ID NO: 925885 - RNA, 20 nt, Mycobacterium avium subsp. paratuberculosis
accgggccgccaucaccgcg

SEQ ID NO: 925886 - RNA, 13 nt, Mycobacterium avium subsp. paratuberculosis
accggcaccgcgg

SEQ ID NO: 925887 - RNA, 14 nt, Mycobacterium avium subsp. paratuberculosis
accggcaccgcggu

SEQ ID NO: 925888 - RNA, 12 nt, Mycobacterium avium subsp. paratuberculosis
accggcaccgcc

SEQ ID NO: 925889 - RNA, 17 nt, Mycobacterium avium subsp. paratuberculosis
accggcacgaucgucgc

SEQ ID NO: 925890 - RNA, 15 nt, Mycobacterium avium subsp. paratuberculosis
accggcaaccgccac

SEQ ID NO: 925891 - RNA, 20 nt, Mycobacterium avium subsp. paratuberculosis
accggcaaucgggacgccac

SEQ ID NO: 925892 - RNA, 14 nt, Mycobacterium avium subsp. paratuberculosis
accggcaccacgau

SEQ ID NO: 925893 - RNA, 17 nt, Mycobacterium avium subsp. paratuberculosis
accggcaccagcagcca

SEQ ID NO: 925894 - RNA, 14 nt, Mycobacterium avium subsp. paratuberculosis
accggcaccgccag

SEQ ID NO: 925895 - RNA, 15 nt, Mycobacterium avium subsp. paratuberculosis
accggcaccgccagc

SEQ ID NO: 925896 - RNA, 13 nt, Mycobacterium avium subsp. paratuberculosis
accggcaccgccc

SEQ ID NO: 925897 - RNA, 23 nt, Mycobacterium avium subsp. paratuberculosis
accggcaccgcccccgcggcggc

SEQ ID NO: 925898 - RNA, 19 nt, Mycobacterium avium subsp. paratuberculosis
accgggucucgcgccacca

SEQ ID NO: 925899 - RNA, 22 nt, Mycobacterium avium subsp. paratuberculosis
accgggugaacgaggccgcgcc

SEQ ID NO: 925900 - RNA, 23 nt, Mycobacterium avium subsp. paratuberculosis
accgggugaacgaggccgcgccg

SEQ ID NO: 925901 - RNA, 16 nt, Mycobacterium avium subsp. paratuberculosis
accgggugaccggcgc

SEQ ID NO: 925902 - RNA, 17 nt, Mycobacterium avium subsp. paratuberculosis
accgggugaccggcgcg

SEQ ID NO: 925903 - RNA, 20 nt, Mycobacterium avium subsp. paratuberculosis
accgggugaccggcgcgcag

SEQ ID NO: 925904 - RNA, 20 nt, Mycobacterium avium subsp. paratuberculosis
accgggugauaccggcccag

SEQ ID NO: 925905 - RNA, 18 nt, Mycobacterium avium subsp. paratuberculosis
accgggugaugucgccga

SEQ ID NO: 925906 - RNA, 22 nt, Mycobacterium avium subsp. paratuberculosis
accgggugaugucgccgaccag

SEQ ID NO: 925907 - RNA, 16 nt, Mycobacterium avium subsp. paratuberculosis
accgggucgccaaggu

SEQ ID NO: 925908 - RNA, 14 nt, Mycobacterium avium subsp. paratuberculosis
accgggucgccgau

SEQ ID NO: 925909 - RNA, 21 nt, Mycobacterium avium subsp. paratuberculosis
accgggugcguccagaccggc

SEQ ID NO: 925910 - RNA, 15 nt, Mycobacterium avium subsp. paratuberculosis
accggguggccagca

SEQ ID NO: 925911 - RNA, 18 nt, Mycobacterium avium subsp. paratuberculosis
accggguggccagcacca

SEQ ID NO: 925912 - RNA, 23 nt, Mycobacterium avium subsp. paratuberculosis
accggguggccagcaccagcccg

SEQ ID NO: 925913 - RNA, 20 nt, Mycobacterium avium subsp. paratuberculosis
accgggcugucgggcaggcc

SEQ ID NO: 925914 - RNA, 21 nt, Mycobacterium avium subsp. paratuberculosis
accggggucaccuuggccgga

SEQ ID NO: 925915 - RNA, 21 nt, Mycobacterium avium subsp. paratuberculosis
accggguacaccggcucgcug

SEQ ID NO: 925916 - RNA, 20 nt, Mycobacterium avium subsp. paratuberculosis
accgggucccccgccgaccg

SEQ ID NO: 925917 - RNA, 15 nt, Mycobacterium avium subsp. paratuberculosis
accggguagcccgcg

SEQ ID NO: 925918 - RNA, 14 nt, Mycobacterium avium subsp. paratuberculosis
accgggcgggcugc

SEQ ID NO: 925919 - RNA, 18 nt, Mycobacterium avium subsp. paratuberculosis
accgggcgggcugcgggc

SEQ ID NO: 925920 - RNA, 13 nt, Mycobacterium avium subsp. paratuberculosis
accgggcgcgcag

SEQ ID NO: 925921 - RNA, 15 nt, Mycobacterium avium subsp. paratuberculosis
accgggcgcgcagau

SEQ ID NO: 925922 - RNA, 21 nt, Mycobacterium avium subsp. paratuberculosis
accgggcgcgcagaucgucga

SEQ ID NO: 925923 - RNA, 22 nt, Mycobacterium avium subsp. paratuberculosis
accgggcgcgcagaucgucgac

SEQ ID NO: 925924 - RNA, 15 nt, Mycobacterium avium subsp. paratuberculosis
accgggcuccagcgg

SEQ ID NO: 925925 - RNA, 21 nt, Mycobacterium avium subsp. paratuberculosis
accgggcucggucaccccgga

SEQ ID NO: 925926 - RNA, 15 nt, Mycobacterium avium subsp. paratuberculosis
accggggccagcacg

SEQ ID NO: 925927 - RNA, 17 nt, Mycobacterium avium subsp. paratuberculosis
accggggccagcacgcc

SEQ ID NO: 925928 - RNA, 18 nt, Mycobacterium avium subsp. paratuberculosis
acgaaauaaccgcgcggc

SEQ ID NO: 925929 - RNA, 14 nt, Mycobacterium avium subsp. paratuberculosis
acgaacagcaccgc

SEQ ID NO: 925930 - RNA, 16 nt, Mycobacterium avium subsp. paratuberculosis
acgaacaccggcgcga

SEQ ID NO: 925931 - RNA, 23 nt, Mycobacterium avium subsp. paratuberculosis
acgaaauugggcugggucaccac

SEQ ID NO: 925932 - RNA, 16 nt, Mycobacterium avium subsp. paratuberculosis
acgaacaccaccggca

SEQ ID NO: 925933 - RNA, 18 nt, Mycobacterium avium subsp. paratuberculosis
acgaacccgccgcggccg

SEQ ID NO: 925934 - RNA, 13 nt, Mycobacterium avium subsp. paratuberculosis
acgaacccggcgg

SEQ ID NO: 925935 - RNA, 17 nt, Mycobacterium avium subsp. paratuberculosis
acgaacccggcggcccc

SEQ ID NO: 925936 - RNA, 23 nt, Mycobacterium avium subsp. paratuberculosis
acgaaccgcucgaacacccggcu

SEQ ID NO: 925937 - RNA, 16 nt, Mycobacterium avium subsp. paratuberculosis
acgaacaugcugccgc

SEQ ID NO: 925938 - RNA, 16 nt, Mycobacterium avium subsp. paratuberculosis
acgaaccgguugcggg

SEQ ID NO: 925939 - RNA, 20 nt, Mycobacterium avium subsp. paratuberculosis
acgaaccgguugcgggccga

SEQ ID NO: 925940 - RNA, 13 nt, Mycobacterium avium subsp. paratuberculosis
acgaaccuggcug

SEQ ID NO: 925941 - RNA, 12 nt, Mycobacterium avium subsp. paratuberculosis
acgaacgccggc

SEQ ID NO: 925942 - RNA, 15 nt, Mycobacterium avium subsp. paratuberculosis
acgaacgucaggccg

SEQ ID NO: 925943 - RNA, 17 nt, Mycobacterium avium subsp. paratuberculosis
acgaacuccgagccggu

SEQ ID NO: 925944 - RNA, 21 nt, Mycobacterium avium subsp. paratuberculosis
acgaacuccgcgcgcggcacg

SEQ ID NO: 925945 - RNA, 14 nt, Mycobacterium avium subsp. paratuberculosis
acgaacgcgccgcc

SEQ ID NO: 925946 - RNA, 12 nt, Mycobacterium avium subsp. paratuberculosis
acgaacgcggcc

SEQ ID NO: 925947 - RNA, 22 nt, Mycobacterium avium subsp. paratuberculosis
acgaacgcguucgucggcgcgu

SEQ ID NO: 925948 - RNA, 13 nt, Mycobacterium avium subsp. paratuberculosis
acgaacggcacgu

SEQ ID NO: 925949 - RNA, 22 nt, Mycobacterium avium subsp. paratuberculosis
acgaacggcacguugcccagga

SEQ ID NO: 925950 - RNA, 22 nt, Mycobacterium avium subsp. paratuberculosis
acgaacgggccaagcaccggga

SEQ ID NO: 925951 - RNA, 21 nt, Mycobacterium avium subsp. paratuberculosis
acgaacggguccuugccggcg

SEQ ID NO: 925952 - RNA, 17 nt, Mycobacterium avium subsp. paratuberculosis
acgaacucguuggcgug

SEQ ID NO: 925953 - RNA, 21 nt, Mycobacterium avium subsp. paratuberculosis
acgaagaacuugucgucgucg

SEQ ID NO: 925954 - RNA, 17 nt, Mycobacterium avium subsp. paratuberculosis
accugcaucucgacccg

SEQ ID NO: 925955 - RNA, 16 nt, Mycobacterium avium subsp. paratuberculosis
accugcagccggucgg

SEQ ID NO: 925956 - RNA, 17 nt, Mycobacterium avium subsp. paratuberculosis
accugcagccggucgga

SEQ ID NO: 925957 - RNA, 16 nt, Mycobacterium avium subsp. paratuberculosis
accugauuucaucgcg

SEQ ID NO: 925958 - RNA, 21 nt, Mycobacterium avium subsp. paratuberculosis
accugcacgcuguccgcguga

SEQ ID NO: 925959 - RNA, 22 nt, Mycobacterium avium subsp. paratuberculosis
accugcaccugcggcaggucgg

SEQ ID NO: 925960 - RNA, 13 nt, Mycobacterium avium subsp. paratuberculosis
accuuucggccgc

SEQ ID NO: 925961 - RNA, 15 nt, Mycobacterium avium subsp. paratuberculosis
accuuucggccgcgg

SEQ ID NO: 925962 - RNA, 16 nt, Mycobacterium avium subsp. paratuberculosis
accuugggcauccgcu

SEQ ID NO: 925963 - RNA, 17 nt, Mycobacterium avium subsp. paratuberculosis
accuuggugucggcgag

SEQ ID NO: 925964 - RNA, 22 nt, Mycobacterium avium subsp. paratuberculosis
accuugucgcgcacccgcacgu

SEQ ID NO: 925965 - RNA, 15 nt, Mycobacterium avium subsp. paratuberculosis
accuugucgggccgc

SEQ ID NO: 925966 - RNA, 19 nt, Mycobacterium avium subsp. paratuberculosis
accuuggugagcaccgcga

SEQ ID NO: 925967 - RNA, 19 nt, Mycobacterium avium subsp. paratuberculosis
accuuggggucaccguccu

SEQ ID NO: 925968 - RNA, 21 nt, Mycobacterium avium subsp. paratuberculosis
accuuggucagcucccggcag

SEQ ID NO: 925969 - RNA, 16 nt, Mycobacterium avium subsp. paratuberculosis
accuuggcgucgauca

SEQ ID NO: 925970 - RNA, 15 nt, Mycobacterium avium subsp. paratuberculosis
accuugcgcccguag

SEQ ID NO: 925971 - RNA, 20 nt, Mycobacterium avium subsp. paratuberculosis
accuuggccggugcgccgac

SEQ ID NO: 925972 - RNA, 22 nt, Mycobacterium avium subsp. paratuberculosis
accuuggccggugcgccgaccg

SEQ ID NO: 925973 - RNA, 14 nt, Mycobacterium avium subsp. paratuberculosis
accuugcggccggc

SEQ ID NO: 925974 - RNA, 15 nt, Mycobacterium avium subsp. paratuberculosis
accuugcggccggcg

SEQ ID NO: 925975 - RNA, 18 nt, Mycobacterium avium subsp. paratuberculosis
accuugcggccggcggcg

SEQ ID NO: 925976 - RNA, 13 nt, Mycobacterium avium subsp. paratuberculosis
accuugcggcgcg

SEQ ID NO: 925977 - RNA, 18 nt, Mycobacterium avium subsp. paratuberculosis
acgaaguugaucgcggcg

SEQ ID NO: 925978 - RNA, 13 nt, Mycobacterium avium subsp. paratuberculosis
acgaagucgacgg

SEQ ID NO: 925979 - RNA, 21 nt, Mycobacterium avium subsp. paratuberculosis
acgaaucccgccucggugagc

SEQ ID NO: 925980 - RNA, 20 nt, Mycobacterium avium subsp. paratuberculosis
acgaauccggugaccgccuc

SEQ ID NO: 925981 - RNA, 17 nt, Mycobacterium avium subsp. paratuberculosis
acgaaguccgagccggc

SEQ ID NO: 925982 - RNA, 17 nt, Mycobacterium avium subsp. paratuberculosis
acgaagucgaccgcggc

SEQ ID NO: 925983 - RNA, 15 nt, Mycobacterium avium subsp. paratuberculosis
acgaagcggccgggg

SEQ ID NO: 925984 - RNA, 14 nt, Mycobacterium avium subsp. paratuberculosis
acgaagcgggcggc

SEQ ID NO: 925985 - RNA, 18 nt, Mycobacterium avium subsp. paratuberculosis
acgaagaugaucagcgcg

SEQ ID NO: 925986 - RNA, 19 nt, Mycobacterium avium subsp. paratuberculosis
acgaagaugaucagcgcgc

SEQ ID NO: 925987 - RNA, 22 nt, Mycobacterium avium subsp. paratuberculosis
acgaagaugaucagcgcgccca

SEQ ID NO: 925988 - RNA, 15 nt, Mycobacterium avium subsp. paratuberculosis
acgaagcagcucgcg

SEQ ID NO: 925989 - RNA, 11 nt, Mycobacterium avium subsp. paratuberculosis
acgaagccgaa

SEQ ID NO: 925990 - RNA, 16 nt, Mycobacterium avium subsp. paratuberculosis
acgaagugcccggcgc

SEQ ID NO: 925991 - RNA, 21 nt, Mycobacterium avium subsp. paratuberculosis
acgaauucggagaccaggucg

SEQ ID NO: 925992 - RNA, 14 nt, Mycobacterium avium subsp. paratuberculosis
acgaauucgguggc

SEQ ID NO: 925993 - RNA, 14 nt, Mycobacterium avium subsp. paratuberculosis
acgaauuccgcacc

SEQ ID NO: 925994 - RNA, 21 nt, Mycobacterium avium subsp. paratuberculosis
acgacagcacccaggugcugc

SEQ ID NO: 925995 - RNA, 22 nt, Mycobacterium avium subsp. paratuberculosis
acgacagcaggaucuccggccg

SEQ ID NO: 925996 - RNA, 18 nt, Mycobacterium avium subsp. paratuberculosis
acgacagcgacgggccgg

SEQ ID NO: 925997 - RNA, 20 nt, Mycobacterium avium subsp. paratuberculosis
acgacauccuggguugacgc

SEQ ID NO: 925998 - RNA, 19 nt, Mycobacterium avium subsp. paratuberculosis
acgacaccaccgugcuggc

SEQ ID NO: 925999 - RNA, 15 nt, Mycobacterium avium subsp. paratuberculosis
acgacaccacggucg

SEQ ID NO: 926000 - RNA, 15 nt, Mycobacterium avium subsp. paratuberculosis
acgacaccagcgucg

SEQ ID NO: 926001 - RNA, 22 nt, Mycobacterium avium subsp. paratuberculosis
acgacacguggaccgagcgcgc

SEQ ID NO: 926002 - RNA, 20 nt, Mycobacterium avium subsp. paratuberculosis
acgacacccuucaucagcac

SEQ ID NO: 926003 - RNA, 18 nt, Mycobacterium avium subsp. paratuberculosis
acgaccgcgacggcgccc

SEQ ID NO: 926004 - RNA, 20 nt, Mycobacterium avium subsp. paratuberculosis
acgaccgcgacggcgcccgc

SEQ ID NO: 926005 - RNA, 22 nt, Mycobacterium avium subsp. paratuberculosis
acgaccgcgacggcgcccgccc

SEQ ID NO: 926006 - RNA, 12 nt, Mycobacterium avium subsp. paratuberculosis
acgaccggcagc

SEQ ID NO: 926007 - RNA, 19 nt, Mycobacterium avium subsp. paratuberculosis
acgaccggcagcaccggcc

SEQ ID NO: 926008 - RNA, 15 nt, Mycobacterium avium subsp. paratuberculosis
acgaccguagccggu

SEQ ID NO: 926009 - RNA, 19 nt, Mycobacterium avium subsp. paratuberculosis
acgaccguagccggucggc

SEQ ID NO: 926010 - RNA, 22 nt, Mycobacterium avium subsp. paratuberculosis
acgaccguagccggucggcccg

SEQ ID NO: 926011 - RNA, 17 nt, Mycobacterium avium subsp. paratuberculosis
acgaccgcaccgaccag

SEQ ID NO: 926012 - RNA, 23 nt, Mycobacterium avium subsp. paratuberculosis
acgaccgccagcagcagccgcgc

SEQ ID NO: 926013 - RNA, 15 nt, Mycobacterium avium subsp. paratuberculosis
acgacccgucggggu

SEQ ID NO: 926014 - RNA, 14 nt, Mycobacterium avium subsp. paratuberculosis
acgaccccggcggc

SEQ ID NO: 926015 - RNA, 14 nt, Mycobacterium avium subsp. paratuberculosis
acgacccggccacc

SEQ ID NO: 926016 - RNA, 22 nt, Mycobacterium avium subsp. paratuberculosis
acgacccggccaccgccgccag

SEQ ID NO: 926017 - RNA, 12 nt, Mycobacterium avium subsp. paratuberculosis
acgaccaucagc

SEQ ID NO: 926018 - RNA, 18 nt, Mycobacterium avium subsp. paratuberculosis
acgaccaucagcgcccgg

SEQ ID NO: 926019 - RNA, 14 nt, Mycobacterium avium subsp. paratuberculosis
acgaccaugucggc

SEQ ID NO: 926020 - RNA, 23 nt, Mycobacterium avium subsp. paratuberculosis
acgaccaugucggcgacccgcac

SEQ ID NO: 926021 - RNA, 21 nt, Mycobacterium avium subsp. paratuberculosis
acgaccaggaaguacaccacc

SEQ ID NO: 926022 - RNA, 15 nt, Mycobacterium avium subsp. paratuberculosis
acgaccaggaugccc

SEQ ID NO: 926023 - RNA, 19 nt, Mycobacterium avium subsp. paratuberculosis
acgaccagguccaccccgc

SEQ ID NO: 926024 - RNA, 20 nt, Mycobacterium avium subsp. paratuberculosis
acgaccagguccaccccgcc

SEQ ID NO: 926025 - RNA, 21 nt, Mycobacterium avium subsp. paratuberculosis
acgaccagguccaccccgcca

SEQ ID NO: 926026 - RNA, 19 nt, Mycobacterium avium subsp. paratuberculosis
acgaccagugcccggccaa

SEQ ID NO: 926027 - RNA, 20 nt, Mycobacterium avium subsp. paratuberculosis
acgaccaccaggagcaccug

SEQ ID NO: 926028 - RNA, 17 nt, Mycobacterium avium subsp. paratuberculosis
acgacaucucgacggug

SEQ ID NO: 926029 - RNA, 20 nt, Mycobacterium avium subsp. paratuberculosis
acgacaucucgacggugacc

SEQ ID NO: 926030 - RNA, 14 nt, Mycobacterium avium subsp. paratuberculosis
acgacgccaccgcg

SEQ ID NO: 926031 - RNA, 15 nt, Mycobacterium avium subsp. paratuberculosis
acgacgagccgacgu

SEQ ID NO: 926032 - RNA, 15 nt, Mycobacterium avium subsp. paratuberculosis
acgacgagccgucga

SEQ ID NO: 926033 - RNA, 15 nt, Mycobacterium avium subsp. paratuberculosis
acgacgacgucgacg

SEQ ID NO: 926034 - RNA, 17 nt, Mycobacterium avium subsp. paratuberculosis
acgacgacaggucgagc

SEQ ID NO: 926035 - RNA, 18 nt, Mycobacterium avium subsp. paratuberculosis
acgacgacaggucgagca

SEQ ID NO: 926036 - RNA, 14 nt, Mycobacterium avium subsp. paratuberculosis
acgacgaccgcgac

SEQ ID NO: 926037 - RNA, 15 nt, Mycobacterium avium subsp. paratuberculosis
acgacgaccgcgacg

SEQ ID NO: 926038 - RNA, 14 nt, Mycobacterium avium subsp. paratuberculosis
acgacgaccgcguc

SEQ ID NO: 926039 - RNA, 16 nt, Mycobacterium avium subsp. paratuberculosis
acgacgaccgcguccg

SEQ ID NO: 926040 - RNA, 16 nt, Mycobacterium avium subsp. paratuberculosis
acgaccuccgugccga

SEQ ID NO: 926041 - RNA, 23 nt, Mycobacterium avium subsp. paratuberculosis
acgaccucggugucgaggucguc

SEQ ID NO: 926042 - RNA, 16 nt, Mycobacterium avium subsp. paratuberculosis
acgaccucgucgucga

SEQ ID NO: 926043 - RNA, 18 nt, Mycobacterium avium subsp. paratuberculosis
acgaccucgcccgccgcg

SEQ ID NO: 926044 - RNA, 21 nt, Mycobacterium avium subsp. paratuberculosis
acgaccucgcccgccgcgacg

SEQ ID NO: 926045 - RNA, 13 nt, Mycobacterium avium subsp. paratuberculosis
acgaccucgccga

SEQ ID NO: 926046 - RNA, 16 nt, Mycobacterium avium subsp. paratuberculosis
acgaccucgccgacgu

SEQ ID NO: 926047 - RNA, 18 nt, Mycobacterium avium subsp. paratuberculosis
acgacgaaucccgccucg

SEQ ID NO: 926048 - RNA, 12 nt, Mycobacterium avium subsp. paratuberculosis
acgaccuugucg

SEQ ID NO: 926049 - RNA, 15 nt, Mycobacterium avium subsp. paratuberculosis
acgaccuugucgcgc

SEQ ID NO: 926050 - RNA, 20 nt, Mycobacterium avium subsp. paratuberculosis
acgacgaaaaugaugccgac

SEQ ID NO: 926051 - RNA, 17 nt, Mycobacterium avium subsp. paratuberculosis
acgaccuggcgggccag

SEQ ID NO: 926052 - RNA, 18 nt, Mycobacterium avium subsp. paratuberculosis
acgaccuggcgggccagc

SEQ ID NO: 926053 - RNA, 17 nt, Mycobacterium avium subsp. paratuberculosis
acgaccugggcgccguc

SEQ ID NO: 926054 - RNA, 19 nt, Mycobacterium avium subsp. paratuberculosis
acgaccugguugacaccac

SEQ ID NO: 926055 - RNA, 16 nt, Mycobacterium avium subsp. paratuberculosis
acgacgucgaccgcgc

SEQ ID NO: 926056 - RNA, 20 nt, Mycobacterium avium subsp. paratuberculosis
acgacgucgaccgcgccggg

SEQ ID NO: 926057 - RNA, 13 nt, Mycobacterium avium subsp. paratuberculosis
acgacgucgacgu

SEQ ID NO: 926058 - RNA, 13 nt, Mycobacterium avium subsp. paratuberculosis
acgacgucgccac

SEQ ID NO: 926059 - RNA, 13 nt, Mycobacterium avium subsp. paratuberculosis
acgacguccgggc

SEQ ID NO: 926060 - RNA, 16 nt, Mycobacterium avium subsp. paratuberculosis
acgacguccgggccgc

SEQ ID NO: 926061 - RNA, 19 nt, Mycobacterium avium subsp. paratuberculosis
acgacguccgggccgccuc

SEQ ID NO: 926062 - RNA, 16 nt, Mycobacterium avium subsp. paratuberculosis
acgacguccucgacga

SEQ ID NO: 926063 - RNA, 19 nt, Mycobacterium avium subsp. paratuberculosis
acgacgggcagggugaccg

SEQ ID NO: 926064 - RNA, 23 nt, Mycobacterium avium subsp. paratuberculosis
acgacgggcagggugaccgaggc

SEQ ID NO: 926065 - RNA, 17 nt, Mycobacterium avium subsp. paratuberculosis
acgacggucaccggcag

SEQ ID NO: 926066 - RNA, 14 nt, Mycobacterium avium subsp. paratuberculosis
acgacggucacggc

SEQ ID NO: 926067 - RNA, 18 nt, Mycobacterium avium subsp. paratuberculosis
acgacggucacggccgcc

SEQ ID NO: 926068 - RNA, 14 nt, Mycobacterium avium subsp. paratuberculosis
acgacggugcgccc

SEQ ID NO: 926069 - RNA, 16 nt, Mycobacterium avium subsp. paratuberculosis
acgacggugcgcccgu

SEQ ID NO: 926070 - RNA, 17 nt, Mycobacterium avium subsp. paratuberculosis
acgacggugcgcccguc

SEQ ID NO: 926071 - RNA, 19 nt, Mycobacterium avium subsp. paratuberculosis
acgacggccaccgcgacgc

SEQ ID NO: 926072 - RNA, 12 nt, Mycobacterium avium subsp. paratuberculosis
acgacggccagc

SEQ ID NO: 926073 - RNA, 13 nt, Mycobacterium avium subsp. paratuberculosis
acgacggcgccgc

SEQ ID NO: 926074 - RNA, 14 nt, Mycobacterium avium subsp. paratuberculosis
acgacggcgccgcc

SEQ ID NO: 926075 - RNA, 16 nt, Mycobacterium avium subsp. paratuberculosis
acgacggcgccgcccg

SEQ ID NO: 926076 - RNA, 19 nt, Mycobacterium avium subsp. paratuberculosis
acgacggcgccgcgucgga

SEQ ID NO: 926077 - RNA, 14 nt, Mycobacterium avium subsp. paratuberculosis
acgacggcgcuggc

SEQ ID NO: 926078 - RNA, 20 nt, Mycobacterium avium subsp. paratuberculosis
acgacggcgcuggccgcggc

SEQ ID NO: 926079 - RNA, 23 nt, Mycobacterium avium subsp. paratuberculosis
acgacggcgcuggccgcggccag

SEQ ID NO: 926080 - RNA, 23 nt, Mycobacterium avium subsp. paratuberculosis
acgacgccgucacggaucgccca

SEQ ID NO: 926081 - RNA, 13 nt, Mycobacterium avium subsp. paratuberculosis
acgacgcgccacg

SEQ ID NO: 926082 - RNA, 14 nt, Mycobacterium avium subsp. paratuberculosis
acgacgcgcucagc

SEQ ID NO: 926083 - RNA, 13 nt, Mycobacterium avium subsp. paratuberculosis
acgacgcggcacg

SEQ ID NO: 926084 - RNA, 14 nt, Mycobacterium avium subsp. paratuberculosis
acgacgcggcgcgc

SEQ ID NO: 926085 - RNA, 15 nt, Mycobacterium avium subsp. paratuberculosis
acgacgcggcgcgcg

SEQ ID NO: 926086 - RNA, 16 nt, Mycobacterium avium subsp. paratuberculosis
acgacgcggucgucgu

SEQ ID NO: 926087 - RNA, 23 nt, Mycobacterium avium subsp. paratuberculosis
acgacgcggucgucgucgucggu

SEQ ID NO: 926088 - RNA, 17 nt, Mycobacterium avium subsp. paratuberculosis
acgacgcggucugcggu

SEQ ID NO: 926089 - RNA, 18 nt, Mycobacterium avium subsp. paratuberculosis
acgacgcggucugcggug

SEQ ID NO: 926090 - RNA, 22 nt, Mycobacterium avium subsp. paratuberculosis
acgacgcggucugcggugcgcc

SEQ ID NO: 926091 - RNA, 12 nt, Mycobacterium avium subsp. paratuberculosis
acgacgccgaac

SEQ ID NO: 926092 - RNA, 13 nt, Mycobacterium avium subsp. paratuberculosis
acgacgccaccgc

SEQ ID NO: 926093 - RNA, 19 nt, Mycobacterium avium subsp. paratuberculosis
acgacgccagcugccgcga

SEQ ID NO: 926094 - RNA, 21 nt, Mycobacterium avium subsp. paratuberculosis
acgacgccaguucgucggccg

SEQ ID NO: 926095 - RNA, 22 nt, Mycobacterium avium subsp. paratuberculosis
acgacgccaguucgucggccgu

SEQ ID NO: 926096 - RNA, 13 nt, Mycobacterium avium subsp. paratuberculosis
acgacgccgaucc

SEQ ID NO: 926097 - RNA, 18 nt, Mycobacterium avium subsp. paratuberculosis
acgacgccgauccgcagc

SEQ ID NO: 926098 - RNA, 20 nt, Mycobacterium avium subsp. paratuberculosis
acgacgccgauccgcagccg

SEQ ID NO: 926099 - RNA, 15 nt, Mycobacterium avium subsp. paratuberculosis
acgacgccgccgagg

SEQ ID NO: 926100 - RNA, 16 nt, Mycobacterium avium subsp. paratuberculosis
acgacgccgccgaggg

SEQ ID NO: 926101 - RNA, 19 nt, Mycobacterium avium subsp. paratuberculosis
acgacgccgccgaggggga

SEQ ID NO: 926102 - RNA, 15 nt, Mycobacterium avium subsp. paratuberculosis
acgacgccgcugggc

SEQ ID NO: 926103 - RNA, 18 nt, Mycobacterium avium subsp. paratuberculosis
acgacgccgcugggcgug

SEQ ID NO: 926104 - RNA, 15 nt, Mycobacterium avium subsp. paratuberculosis
acgaguaaccggugc

SEQ ID NO: 926105 - RNA, 13 nt, Mycobacterium avium subsp. paratuberculosis
acgaggugaccgg

SEQ ID NO: 926106 - RNA, 19 nt, Mycobacterium avium subsp. paratuberculosis
acgaguaggcggcuccgau

SEQ ID NO: 926107 - RNA, 14 nt, Mycobacterium avium subsp. paratuberculosis
acgaggcgugcagc

SEQ ID NO: 926108 - RNA, 17 nt, Mycobacterium avium subsp. paratuberculosis
acgaggcgugcagcccg

SEQ ID NO: 926109 - RNA, 22 nt, Mycobacterium avium subsp. paratuberculosis
acgaggcgaguaaggccgaggc

SEQ ID NO: 926110 - RNA, 19 nt, Mycobacterium avium subsp. paratuberculosis
acgagagcggaucggcggc

SEQ ID NO: 926111 - RNA, 20 nt, Mycobacterium avium subsp. paratuberculosis
acgagagcggaucggcggcg

SEQ ID NO: 926112 - RNA, 13 nt, Mycobacterium avium subsp. paratuberculosis
acgagcucgccgc

SEQ ID NO: 926113 - RNA, 18 nt, Mycobacterium avium subsp. paratuberculosis
acgagcugacgaacgcgc

SEQ ID NO: 926114 - RNA, 21 nt, Mycobacterium avium subsp. paratuberculosis
acgagcugacgaacgcgccgc

SEQ ID NO: 926115 - RNA, 19 nt, Mycobacterium avium subsp. paratuberculosis
acgaggagggugucggcgg

SEQ ID NO: 926116 - RNA, 20 nt, Mycobacterium avium subsp. paratuberculosis
acgaggagggugucggcggg

SEQ ID NO: 926117 - RNA, 19 nt, Mycobacterium avium subsp. paratuberculosis
acgaggcacggcccgcucg

SEQ ID NO: 926118 - RNA, 17 nt, Mycobacterium avium subsp. paratuberculosis
acgaggccagggcccgc

SEQ ID NO: 926119 - RNA, 18 nt, Mycobacterium avium subsp. paratuberculosis
acgaggcccacgaaccgg

SEQ ID NO: 926120 - RNA, 13 nt, Mycobacterium avium subsp. paratuberculosis
acgaggccgggcu

SEQ ID NO: 926121 - RNA, 14 nt, Mycobacterium avium subsp. paratuberculosis
acgacuucggccuc

SEQ ID NO: 926122 - RNA, 17 nt, Mycobacterium avium subsp. paratuberculosis
acgagaaggcggcgucg

SEQ ID NO: 926123 - RNA, 15 nt, Mycobacterium avium subsp. paratuberculosis
acgacugcgcggccg

SEQ ID NO: 926124 - RNA, 20 nt, Mycobacterium avium subsp. paratuberculosis
acgacugcgcggccggcgug

SEQ ID NO: 926125 - RNA, 22 nt, Mycobacterium avium subsp. paratuberculosis
acgacugcgcggccggcgugua

SEQ ID NO: 926126 - RNA, 13 nt, Mycobacterium avium subsp. paratuberculosis
acgacuggcggcg

SEQ ID NO: 926127 - RNA, 14 nt, Mycobacterium avium subsp. paratuberculosis
acgacuggcggcgg

SEQ ID NO: 926128 - RNA, 16 nt, Mycobacterium avium subsp. paratuberculosis
acgacuggcggcggcg

SEQ ID NO: 926129 - RNA, 23 nt, Mycobacterium avium subsp. paratuberculosis
acgacugggugcgcgggcgcccg

SEQ ID NO: 926130 - RNA, 15 nt, Mycobacterium avium subsp. paratuberculosis
acgacgucugggccg

SEQ ID NO: 926131 - RNA, 19 nt, Mycobacterium avium subsp. paratuberculosis
acgacgucugggccgccga

SEQ ID NO: 926132 - RNA, 19 nt, Mycobacterium avium subsp. paratuberculosis
acgacgugauaguggucgu

SEQ ID NO: 926133 - RNA, 22 nt, Mycobacterium avium subsp. paratuberculosis
acgacgugauaguggucgucgu

SEQ ID NO: 926134 - RNA, 18 nt, Mycobacterium avium subsp. paratuberculosis
acgacucggccuccgcgc

SEQ ID NO: 926135 - RNA, 22 nt, Mycobacterium avium subsp. paratuberculosis
acgacucggccuccgcgcgcgg

SEQ ID NO: 926136 - RNA, 23 nt, Mycobacterium avium subsp. paratuberculosis
acgacucggccuccgcgcgcggc

SEQ ID NO: 926137 - RNA, 20 nt, Mycobacterium avium subsp. paratuberculosis
acgacucguucgacgccggu

SEQ ID NO: 926138 - RNA, 22 nt, Mycobacterium avium subsp. paratuberculosis
acgacucguucgacgccgguga

SEQ ID NO: 926139 - RNA, 23 nt, Mycobacterium avium subsp. paratuberculosis
acgacgugguggaugaugccggc

SEQ ID NO: 926140 - RNA, 21 nt, Mycobacterium avium subsp. paratuberculosis
acgacguguucaacgcgccga

SEQ ID NO: 926141 - RNA, 17 nt, Mycobacterium avium subsp. paratuberculosis
acgacguugcgggccag

SEQ ID NO: 926142 - RNA, 15 nt, Mycobacterium avium subsp. paratuberculosis
acgacguuggccagc

SEQ ID NO: 926143 - RNA, 21 nt, Mycobacterium avium subsp. paratuberculosis
acgacguuggccagcaccgcg

SEQ ID NO: 926144 - RNA, 23 nt, Mycobacterium avium subsp. paratuberculosis
acgacguuggccagcaccgcggc

SEQ ID NO: 926145 - RNA, 14 nt, Mycobacterium avium subsp. paratuberculosis
acgauccgggccgg

SEQ ID NO: 926146 - RNA, 13 nt, Mycobacterium avium subsp. paratuberculosis
acgauccgggcgc

SEQ ID NO: 926147 - RNA, 13 nt, Mycobacterium avium subsp. paratuberculosis
acgaucccggcga

SEQ ID NO: 926148 - RNA, 22 nt, Mycobacterium avium subsp. paratuberculosis
acgaucccggcgagcacgccgc

SEQ ID NO: 926149 - RNA, 21 nt, Mycobacterium avium subsp. paratuberculosis
acgauacgcuguggggcccac

SEQ ID NO: 926150 - RNA, 18 nt, Mycobacterium avium subsp. paratuberculosis
acgagucccaugggcugc

SEQ ID NO: 926151 - RNA, 17 nt, Mycobacterium avium subsp. paratuberculosis
acgaucgcgaucgccga

SEQ ID NO: 926152 - RNA, 18 nt, Mycobacterium avium subsp. paratuberculosis
acgaucgcgaucgccgau

SEQ ID NO: 926153 - RNA, 22 nt, Mycobacterium avium subsp. paratuberculosis
acgaucgcggugacgcgccggc

SEQ ID NO: 926154 - RNA, 12 nt, Mycobacterium avium subsp. paratuberculosis
acgaucgcggcc

SEQ ID NO: 926155 - RNA, 14 nt, Mycobacterium avium subsp. paratuberculosis
acgaugggccgccc

SEQ ID NO: 926156 - RNA, 15 nt, Mycobacterium avium subsp. paratuberculosis
acgaugggccgcccg

SEQ ID NO: 926157 - RNA, 19 nt, Mycobacterium avium subsp. paratuberculosis
acgauggggacgucgacgu

SEQ ID NO: 926158 - RNA, 22 nt, Mycobacterium avium subsp. paratuberculosis
acgauggcgcggcgcaccgccc

SEQ ID NO: 926159 - RNA, 21 nt, Mycobacterium avium subsp. paratuberculosis
acgaucggcuccagcgcccgc

SEQ ID NO: 926160 - RNA, 11 nt, Mycobacterium avium subsp. paratuberculosis
acgaucgggcg

SEQ ID NO: 926161 - RNA, 22 nt, Mycobacterium avium subsp. paratuberculosis
acgaugucgacccgcggcgccg

SEQ ID NO: 926162 - RNA, 19 nt, Mycobacterium avium subsp. paratuberculosis
acgaugucgaugacggcgg

SEQ ID NO: 926163 - RNA, 15 nt, Mycobacterium avium subsp. paratuberculosis
acgaucggcagcgcc

SEQ ID NO: 926164 - RNA, 21 nt, Mycobacterium avium subsp. paratuberculosis
acgaugucgucgccgguggcc

SEQ ID NO: 926165 - RNA, 22 nt, Mycobacterium avium subsp. paratuberculosis
acgauguguaacaacucgccgg

SEQ ID NO: 926166 - RNA, 18 nt, Mycobacterium avium subsp. paratuberculosis
acgauguugaugucgcgc

SEQ ID NO: 926167 - RNA, 21 nt, Mycobacterium avium subsp. paratuberculosis
acgauguugaugucgcgcggc

SEQ ID NO: 926168 - RNA, 22 nt, Mycobacterium avium subsp. paratuberculosis
acgauguugaugucgcgcggcu

SEQ ID NO: 926169 - RNA, 21 nt, Mycobacterium avium subsp. paratuberculosis
acgcaaaacggugcggccucg

SEQ ID NO: 926170 - RNA, 17 nt, Mycobacterium avium subsp. paratuberculosis
acgauuugggcgguccg

SEQ ID NO: 926171 - RNA, 19 nt, Mycobacterium avium subsp. paratuberculosis
acgauucacccagcgagcu

SEQ ID NO: 926172 - RNA, 15 nt, Mycobacterium avium subsp. paratuberculosis
acgcaaugcgucgcg

SEQ ID NO: 926173 - RNA, 19 nt, Mycobacterium avium subsp. paratuberculosis
acgcaaugcgucgcggcgg

SEQ ID NO: 926174 - RNA, 20 nt, Mycobacterium avium subsp. paratuberculosis
acgcaaugcgucgcggcggc

SEQ ID NO: 926175 - RNA, 23 nt, Mycobacterium avium subsp. paratuberculosis
acgcacaccaccgacgcgucgcg

SEQ ID NO: 926176 - RNA, 14 nt, Mycobacterium avium subsp. paratuberculosis
acgcacaccgcgcg

SEQ ID NO: 926177 - RNA, 16 nt, Mycobacterium avium subsp. paratuberculosis
acgcaccaccgcggug

SEQ ID NO: 926178 - RNA, 16 nt, Mycobacterium avium subsp. paratuberculosis
acgcaccacgagcagc

SEQ ID NO: 926179 - RNA, 12 nt, Mycobacterium avium subsp. paratuberculosis
acgcacgccggc

SEQ ID NO: 926180 - RNA, 14 nt, Mycobacterium avium subsp. paratuberculosis
acgcacgccggcgg

SEQ ID NO: 926181 - RNA, 24 nt, Mycobacterium avium subsp. paratuberculosis
acgcacgccggcggggguucgacg

SEQ ID NO: 926182 - RNA, 19 nt, Mycobacterium avium subsp. paratuberculosis
acgcacggcgaacggccgc

SEQ ID NO: 926183 - RNA, 13 nt, Mycobacterium avium subsp. paratuberculosis
acgcacgggcggc

SEQ ID NO: 926184 - RNA, 23 nt, Mycobacterium avium subsp. paratuberculosis
acgcacgggcggcgggggcgaga

SEQ ID NO: 926185 - RNA, 16 nt, Mycobacterium avium subsp. paratuberculosis
acgcaccucgcucagc

SEQ ID NO: 926186 - RNA, 20 nt, Mycobacterium avium subsp. paratuberculosis
acgcacgaaaccgcguggcg

SEQ ID NO: 926187 - RNA, 13 nt, Mycobacterium avium subsp. paratuberculosis
acgcacccgacac

SEQ ID NO: 926188 - RNA, 17 nt, Mycobacterium avium subsp. paratuberculosis
cucaggcgcgcacguug

SEQ ID NO: 926189 - RNA, 16 nt, Mycobacterium avium subsp. paratuberculosis
cucaggcguccagcac

SEQ ID NO: 926190 - RNA, 23 nt, Mycobacterium avium subsp. paratuberculosis
cucaggcguggguuccgccgucg

SEQ ID NO: 926191 - RNA, 13 nt, Mycobacterium avium subsp. paratuberculosis
cucagcugcugcg

SEQ ID NO: 926192 - RNA, 17 nt, Mycobacterium avium subsp. paratuberculosis
cucagcugcugcgcggc

SEQ ID NO: 926193 - RNA, 20 nt, Mycobacterium avium subsp. paratuberculosis
cucagcugcugcgcggcggc

SEQ ID NO: 926194 - RNA, 20 nt, Mycobacterium avium subsp. paratuberculosis
cucaggaauuugcggcccgg

SEQ ID NO: 926195 - RNA, 21 nt, Mycobacterium avium subsp. paratuberculosis
cucaggccgguggcgacaaca

SEQ ID NO: 926196 - RNA, 23 nt, Mycobacterium avium subsp. paratuberculosis
cucaggagugguagggcuccgcg

SEQ ID NO: 926197 - RNA, 16 nt, Mycobacterium avium subsp. paratuberculosis
cucaggaucagcagcc

SEQ ID NO: 926198 - RNA, 20 nt, Mycobacterium avium subsp. paratuberculosis
cucaggaugauuucggcgug

SEQ ID NO: 926199 - RNA, 22 nt, Mycobacterium avium subsp. paratuberculosis
cucaggaugauuucggcguggc

SEQ ID NO: 926200 - RNA, 15 nt, Mycobacterium avium subsp. paratuberculosis
cuccaccucgggcau

SEQ ID NO: 926201 - RNA, 14 nt, Mycobacterium avium subsp. paratuberculosis
cuccacaaccagcg

SEQ ID NO: 926202 - RNA, 14 nt, Mycobacterium avium subsp. paratuberculosis
cuccaacggccgca

SEQ ID NO: 926203 - RNA, 15 nt, Mycobacterium avium subsp. paratuberculosis
cuccaacggccgcac

SEQ ID NO: 926204 - RNA, 13 nt, Mycobacterium avium subsp. paratuberculosis
cuccaaugcggcc

SEQ ID NO: 926205 - RNA, 14 nt, Mycobacterium avium subsp. paratuberculosis
cuccaaugcggccg

SEQ ID NO: 926206 - RNA, 16 nt, Mycobacterium avium subsp. paratuberculosis
cuccaaugcggccgac

SEQ ID NO: 926207 - RNA, 16 nt, Mycobacterium avium subsp. paratuberculosis
cuccacgucaccgacg

SEQ ID NO: 926208 - RNA, 17 nt, Mycobacterium avium subsp. paratuberculosis
cuccacgucaccgacgc

SEQ ID NO: 926209 - RNA, 20 nt, Mycobacterium avium subsp. paratuberculosis
cuccacggugcgcaccgaca

SEQ ID NO: 926210 - RNA, 14 nt, Mycobacterium avium subsp. paratuberculosis
cuccacgccgacga

SEQ ID NO: 926211 - RNA, 14 nt, Mycobacterium avium subsp. paratuberculosis
cuccacgucgucgg

SEQ ID NO: 926212 - RNA, 13 nt, Mycobacterium avium subsp. paratuberculosis
cuccacgcucgga

SEQ ID NO: 926213 - RNA, 14 nt, Mycobacterium avium subsp. paratuberculosis
cuccacgcucggaa

SEQ ID NO: 926214 - RNA, 13 nt, Mycobacterium avium subsp. paratuberculosis
cuccacgccgccg

SEQ ID NO: 926215 - RNA, 16 nt, Mycobacterium avium subsp. paratuberculosis
cuccacgagccggucg

SEQ ID NO: 926216 - RNA, 17 nt, Mycobacterium avium subsp. paratuberculosis
cuccacgcguagccgac

SEQ ID NO: 926217 - RNA, 18 nt, Mycobacterium avium subsp. paratuberculosis
cuccacgcguagccgacc

SEQ ID NO: 926218 - RNA, 19 nt, Mycobacterium avium subsp. paratuberculosis
cuccacgcguagccgacca

SEQ ID NO: 926219 - RNA, 17 nt, Mycobacterium avium subsp. paratuberculosis
cuccagcgcggucucga

SEQ ID NO: 926220 - RNA, 23 nt, Mycobacterium avium subsp. paratuberculosis
cuccagcgcgaucaacgggucga

SEQ ID NO: 926221 - RNA, 20 nt, Mycobacterium avium subsp. paratuberculosis
cuccagcggguccagccgcc

SEQ ID NO: 926222 - RNA, 23 nt, Mycobacterium avium subsp. paratuberculosis
cuccagcggguccagccgccggc

SEQ ID NO: 926223 - RNA, 12 nt, Mycobacterium avium subsp. paratuberculosis
cuccagcggccg

SEQ ID NO: 926224 - RNA, 14 nt, Mycobacterium avium subsp. paratuberculosis
cuccagcggccgca

SEQ ID NO: 926225 - RNA, 16 nt, Mycobacterium avium subsp. paratuberculosis
cuccagcggccgcagc

SEQ ID NO: 926226 - RNA, 22 nt, Mycobacterium avium subsp. paratuberculosis
cuccagcggccgcagcgcgacg

SEQ ID NO: 926227 - RNA, 14 nt, Mycobacterium avium subsp. paratuberculosis
cuccagcggccggg

SEQ ID NO: 926228 - RNA, 18 nt, Mycobacterium avium subsp. paratuberculosis
cuccagcggccgggcgau

SEQ ID NO: 926229 - RNA, 14 nt, Mycobacterium avium subsp. paratuberculosis
cuccagcggcggcc

SEQ ID NO: 926230 - RNA, 21 nt, Mycobacterium avium subsp. paratuberculosis
cuccaggaugucgacgacacc

SEQ ID NO: 926231 - RNA, 19 nt, Mycobacterium avium subsp. paratuberculosis
cuccaggaagaacccggcg

SEQ ID NO: 926232 - RNA, 16 nt, Mycobacterium avium subsp. paratuberculosis
cuccagcuccgcggcc

SEQ ID NO: 926233 - RNA, 16 nt, Mycobacterium avium subsp. paratuberculosis
cuccagcuccucgguc

SEQ ID NO: 926234 - RNA, 13 nt, Mycobacterium avium subsp. paratuberculosis
cuccaucacgacc

SEQ ID NO: 926235 - RNA, 16 nt, Mycobacterium avium subsp. paratuberculosis
cuccaguugcgacccc

SEQ ID NO: 926236 - RNA, 17 nt, Mycobacterium avium subsp. paratuberculosis
cuccaguugcgaccccg

SEQ ID NO: 926237 - RNA, 15 nt, Mycobacterium avium subsp. paratuberculosis
cuccaggcucgacaa

SEQ ID NO: 926238 - RNA, 22 nt, Mycobacterium avium subsp. paratuberculosis
cuccaggguucucgcggcggcc

SEQ ID NO: 926239 - RNA, 23 nt, Mycobacterium avium subsp. paratuberculosis
cuccaggugaaugcucagcggga

SEQ ID NO: 926240 - RNA, 16 nt, Mycobacterium avium subsp. paratuberculosis
cuccagguucgccgcc

SEQ ID NO: 926241 - RNA, 17 nt, Mycobacterium avium subsp. paratuberculosis
cuccagguucgccgccc

SEQ ID NO: 926242 - RNA, 22 nt, Mycobacterium avium subsp. paratuberculosis
cucacaaauccagcagcgcggu

SEQ ID NO: 926243 - RNA, 22 nt, Mycobacterium avium subsp. paratuberculosis
cucacagcgacaacgggccgcc

SEQ ID NO: 926244 - RNA, 15 nt, Mycobacterium avium subsp. paratuberculosis
cucacagcgcggcgg

SEQ ID NO: 926245 - RNA, 19 nt, Mycobacterium avium subsp. paratuberculosis
cucaaucuucuccgcggcc

SEQ ID NO: 926246 - RNA, 21 nt, Mycobacterium avium subsp. paratuberculosis
cucaaucuucuccgcggccgc

SEQ ID NO: 926247 - RNA, 14 nt, Mycobacterium avium subsp. paratuberculosis
cucaccccgcuugc

SEQ ID NO: 926248 - RNA, 20 nt, Mycobacterium avium subsp. paratuberculosis
cucacccaaaaaggcgcggg

SEQ ID NO: 926249 - RNA, 15 nt, Mycobacterium avium subsp. paratuberculosis
cucaccccagcgcga

SEQ ID NO: 926250 - RNA, 16 nt, Mycobacterium avium subsp. paratuberculosis
cucaccccagcgcgac

SEQ ID NO: 926251 - RNA, 18 nt, Mycobacterium avium subsp. paratuberculosis
cucaccccagcgcgacca

SEQ ID NO: 926252 - RNA, 13 nt, Mycobacterium avium subsp. paratuberculosis
cucacgcagggcc

SEQ ID NO: 926253 - RNA, 16 nt, Mycobacterium avium subsp. paratuberculosis
cucaccgguggccgcg

SEQ ID NO: 926254 - RNA, 17 nt, Mycobacterium avium subsp. paratuberculosis
cucaccgguggccgcgu

SEQ ID NO: 926255 - RNA, 18 nt, Mycobacterium avium subsp. paratuberculosis
cucaccgguggugagacc

SEQ ID NO: 926256 - RNA, 14 nt, Mycobacterium avium subsp. paratuberculosis
cucaccugcggccc

SEQ ID NO: 926257 - RNA, 16 nt, Mycobacterium avium subsp. paratuberculosis
cucaccugcggcccgu

SEQ ID NO: 926258 - RNA, 14 nt, Mycobacterium avium subsp. paratuberculosis
cucaccgucgcggu

SEQ ID NO: 926259 - RNA, 20 nt, Mycobacterium avium subsp. paratuberculosis
cucacgacgcggucugcggu

SEQ ID NO: 926260 - RNA, 23 nt, Mycobacterium avium subsp. paratuberculosis
cucacgacgcggucugcggugcg

SEQ ID NO: 926261 - RNA, 15 nt, Mycobacterium avium subsp. paratuberculosis
cucacgacuccuggc

SEQ ID NO: 926262 - RNA, 20 nt, Mycobacterium avium subsp. paratuberculosis
cucacgacuccuggccgaac

SEQ ID NO: 926263 - RNA, 12 nt, Mycobacterium avium subsp. paratuberculosis
cucaccgcgggg

SEQ ID NO: 926264 - RNA, 16 nt, Mycobacterium avium subsp. paratuberculosis
cucaccgcggggugcc

SEQ ID NO: 926265 - RNA, 17 nt, Mycobacterium avium subsp. paratuberculosis
cucaccggccagggccg

SEQ ID NO: 926266 - RNA, 22 nt, Mycobacterium avium subsp. paratuberculosis
cucaccggccagggccgccgca

SEQ ID NO: 926267 - RNA, 13 nt, Mycobacterium avium subsp. paratuberculosis
cucaccggcggcg

SEQ ID NO: 926268 - RNA, 14 nt, Mycobacterium avium subsp. paratuberculosis
cucaccggcggcgg

SEQ ID NO: 926269 - RNA, 15 nt, Mycobacterium avium subsp. paratuberculosis
cucaccggcggcggc

SEQ ID NO: 926270 - RNA, 14 nt, Mycobacterium avium subsp. paratuberculosis
cucaccgggcucgg

SEQ ID NO: 926271 - RNA, 23 nt, Mycobacterium avium subsp. paratuberculosis
cucaccgggcucggucaccccgg

SEQ ID NO: 926272 - RNA, 16 nt, Mycobacterium avium subsp. paratuberculosis
cucacccggcccaccg

SEQ ID NO: 926273 - RNA, 19 nt, Mycobacterium avium subsp. paratuberculosis
cucacccggcccaccggcc

SEQ ID NO: 926274 - RNA, 17 nt, Mycobacterium avium subsp. paratuberculosis
cucaccgagcugggccg

SEQ ID NO: 926275 - RNA, 13 nt, Mycobacterium avium subsp. paratuberculosis
cucaccgccgagc

SEQ ID NO: 926276 - RNA, 12 nt, Mycobacterium avium subsp. paratuberculosis
cucagaaggcgu

SEQ ID NO: 926277 - RNA, 16 nt, Mycobacterium avium subsp. paratuberculosis
cucacuccagcggcgg

SEQ ID NO: 926278 - RNA, 18 nt, Mycobacterium avium subsp. paratuberculosis
cucacuccagcggcggcc

SEQ ID NO: 926279 - RNA, 13 nt, Mycobacterium avium subsp. paratuberculosis
cucacggugucgg

SEQ ID NO: 926280 - RNA, 14 nt, Mycobacterium avium subsp. paratuberculosis
cucacggugucggc

SEQ ID NO: 926281 - RNA, 19 nt, Mycobacterium avium subsp. paratuberculosis
cucacggcggcagcgcggc

SEQ ID NO: 926282 - RNA, 17 nt, Mycobacterium avium subsp. paratuberculosis
cucacgccucgucgagc

SEQ ID NO: 926283 - RNA, 18 nt, Mycobacterium avium subsp. paratuberculosis
cucacgccucgucgagca

SEQ ID NO: 926284 - RNA, 16 nt, Mycobacterium avium subsp. paratuberculosis
cucagagcugcaccgg

SEQ ID NO: 926285 - RNA, 15 nt, Mycobacterium avium subsp. paratuberculosis
cucagaacaggugcg

SEQ ID NO: 926286 - RNA, 23 nt, Mycobacterium avium subsp. paratuberculosis
cucagaccauggcgcggcggccg

SEQ ID NO: 926287 - RNA, 18 nt, Mycobacterium avium subsp. paratuberculosis
cucagcaacccgccgagc

SEQ ID NO: 926288 - RNA, 15 nt, Mycobacterium avium subsp. paratuberculosis
cucagcagcgggccg

SEQ ID NO: 926289 - RNA, 21 nt, Mycobacterium avium subsp. paratuberculosis
cucagcagcugcuggcgugaa

SEQ ID NO: 926290 - RNA, 14 nt, Mycobacterium avium subsp. paratuberculosis
cucagcagggcggc

SEQ ID NO: 926291 - RNA, 16 nt, Mycobacterium avium subsp. paratuberculosis
cucagcagggcggcac

SEQ ID NO: 926292 - RNA, 18 nt, Mycobacterium avium subsp. paratuberculosis
cucagcagggcggcaccg

SEQ ID NO: 926293 - RNA, 17 nt, Mycobacterium avium subsp. paratuberculosis
cucagcacggccgcggc

SEQ ID NO: 926294 - RNA, 20 nt, Mycobacterium avium subsp. paratuberculosis
cucagcacggccgcggccag

SEQ ID NO: 926295 - RNA, 14 nt, Mycobacterium avium subsp. paratuberculosis
cucagcagcaccgc

SEQ ID NO: 926296 - RNA, 18 nt, Mycobacterium avium subsp. paratuberculosis
cucagccgaagccggcgc

SEQ ID NO: 926297 - RNA, 20 nt, Mycobacterium avium subsp. paratuberculosis
cucagccgaagccggcgcag

SEQ ID NO: 926298 - RNA, 20 nt, Mycobacterium avium subsp. paratuberculosis
cucagcguucacgucgauca

SEQ ID NO: 926299 - RNA, 22 nt, Mycobacterium avium subsp. paratuberculosis
cucagcccggcgcucaccgcga

SEQ ID NO: 926300 - RNA, 22 nt, Mycobacterium avium subsp. paratuberculosis
cucagcccgauucagccggcgg

SEQ ID NO: 926301 - RNA, 18 nt, Mycobacterium avium subsp. paratuberculosis
cuagccuuggccgcaggc

SEQ ID NO: 926302 - RNA, 13 nt, Mycobacterium avium subsp. paratuberculosis
cuagcgacggccg

SEQ ID NO: 926303 - RNA, 21 nt, Mycobacterium avium subsp. paratuberculosis
cuagaucuccaggcucgacaa

SEQ ID NO: 926304 - RNA, 18 nt, Mycobacterium avium subsp. paratuberculosis
cuagcagcuccggucggc

SEQ ID NO: 926305 - RNA, 13 nt, Mycobacterium avium subsp. paratuberculosis
cuacuccaccaag

SEQ ID NO: 926306 - RNA, 14 nt, Mycobacterium avium subsp. paratuberculosis
cuacucggacgccg

SEQ ID NO: 926307 - RNA, 18 nt, Mycobacterium avium subsp. paratuberculosis
cuacucggacgccggcag

SEQ ID NO: 926308 - RNA, 13 nt, Mycobacterium avium subsp. paratuberculosis
cuacgucggcugg

SEQ ID NO: 926309 - RNA, 12 nt, Mycobacterium avium subsp. paratuberculosis
cuacgucgucgc

SEQ ID NO: 926310 - RNA, 15 nt, Mycobacterium avium subsp. paratuberculosis
cguugcgccagcagg

SEQ ID NO: 926311 - RNA, 15 nt, Mycobacterium avium subsp. paratuberculosis
cuacggcgggccggc

SEQ ID NO: 926312 - RNA, 16 nt, Mycobacterium avium subsp. paratuberculosis
cuacggcgggccggcg

SEQ ID NO: 926313 - RNA, 17 nt, Mycobacterium avium subsp. paratuberculosis
cuacggcgggccggcgc

SEQ ID NO: 926314 - RNA, 20 nt, Mycobacterium avium subsp. paratuberculosis
cuacggcgggccggcgccgg

SEQ ID NO: 926315 - RNA, 20 nt, Mycobacterium avium subsp. paratuberculosis
cuacggcgggugcgacggca

SEQ ID NO: 926316 - RNA, 16 nt, Mycobacterium avium subsp. paratuberculosis
cguugcgcaucagcgc

SEQ ID NO: 926317 - RNA, 19 nt, Mycobacterium avium subsp. paratuberculosis
cguugcgcaucagcgccac

SEQ ID NO: 926318 - RNA, 21 nt, Mycobacterium avium subsp. paratuberculosis
cguugcgcaucagcgccacca

SEQ ID NO: 926319 - RNA, 21 nt, Mycobacterium avium subsp. paratuberculosis
cguugccgugggggucgaccc

SEQ ID NO: 926320 - RNA, 17 nt, Mycobacterium avium subsp. paratuberculosis
cguugccgcgcgcccgc

SEQ ID NO: 926321 - RNA, 20 nt, Mycobacterium avium subsp. paratuberculosis
cguugccggucccguugauc

SEQ ID NO: 926322 - RNA, 16 nt, Mycobacterium avium subsp. paratuberculosis
cguugccgccgcgcgc

SEQ ID NO: 926323 - RNA, 14 nt, Mycobacterium avium subsp. paratuberculosis
cguugccgccggcg

SEQ ID NO: 926324 - RNA, 15 nt, Mycobacterium avium subsp. paratuberculosis
cguugccgcacaccg

SEQ ID NO: 926325 - RNA, 17 nt, Mycobacterium avium subsp. paratuberculosis
cguugccgcacaccgcg

SEQ ID NO: 926326 - RNA, 19 nt, Mycobacterium avium subsp. paratuberculosis
cguugccgcacaccgcgca

SEQ ID NO: 926327 - RNA, 15 nt, Mycobacterium avium subsp. paratuberculosis
cucaacgguugucgc

SEQ ID NO: 926328 - RNA, 13 nt, Mycobacterium avium subsp. paratuberculosis
cucaacggccggc

SEQ ID NO: 926329 - RNA, 18 nt, Mycobacterium avium subsp. paratuberculosis
cucaacggccggcgccgc

SEQ ID NO: 926330 - RNA, 12 nt, Mycobacterium avium subsp. paratuberculosis
cucaacggcucc

SEQ ID NO: 926331 - RNA, 17 nt, Mycobacterium avium subsp. paratuberculosis
cucaaccgcccagcggc

SEQ ID NO: 926332 - RNA, 13 nt, Mycobacterium avium subsp. paratuberculosis
cuauucgggccag

SEQ ID NO: 926333 - RNA, 16 nt, Mycobacterium avium subsp. paratuberculosis
cuaugcgcccgggaag

SEQ ID NO: 926334 - RNA, 19 nt, Mycobacterium avium subsp. paratuberculosis
cuaucgcccggcgcccggc

SEQ ID NO: 926335 - RNA, 15 nt, Mycobacterium avium subsp. paratuberculosis
cuccuccucggccag

SEQ ID NO: 926336 - RNA, 16 nt, Mycobacterium avium subsp. paratuberculosis
cuccucgaacaccgca

SEQ ID NO: 926337 - RNA, 18 nt, Mycobacterium avium subsp. paratuberculosis
cuccucgaccagcgcgcc

SEQ ID NO: 926338 - RNA, 14 nt, Mycobacterium avium subsp. paratuberculosis
cuccuccucgucgc

SEQ ID NO: 926339 - RNA, 23 nt, Mycobacterium avium subsp. paratuberculosis
cuccucgacguaggugagcaacg

SEQ ID NO: 926340 - RNA, 14 nt, Mycobacterium avium subsp. paratuberculosis
cuccugcgccggca

SEQ ID NO: 926341 - RNA, 17 nt, Mycobacterium avium subsp. paratuberculosis
cuccuugagccgccgcg

SEQ ID NO: 926342 - RNA, 13 nt, Mycobacterium avium subsp. paratuberculosis
cuccuggccgccg

SEQ ID NO: 926343 - RNA, 23 nt, Mycobacterium avium subsp. paratuberculosis
cuccugggugagcggcgcgucca

SEQ ID NO: 926344 - RNA, 23 nt, Mycobacterium avium subsp. paratuberculosis
cuccugggugaguucgucggcga

SEQ ID NO: 926345 - RNA, 16 nt, Mycobacterium avium subsp. paratuberculosis
cuccuggggcagaucg

SEQ ID NO: 926346 - RNA, 21 nt, Mycobacterium avium subsp. paratuberculosis
cuccuggggcagaucgucggc

SEQ ID NO: 926347 - RNA, 15 nt, Mycobacterium avium subsp. paratuberculosis
cuccgggcccaccag

SEQ ID NO: 926348 - RNA, 18 nt, Mycobacterium avium subsp. paratuberculosis
cuccggguaggacaccgu

SEQ ID NO: 926349 - RNA, 16 nt, Mycobacterium avium subsp. paratuberculosis
cuccggguccccgccg

SEQ ID NO: 926350 - RNA, 19 nt, Mycobacterium avium subsp. paratuberculosis
cuccggguccccgccgccg

SEQ ID NO: 926351 - RNA, 23 nt, Mycobacterium avium subsp. paratuberculosis
cuccggguccccgccgccgugca

SEQ ID NO: 926352 - RNA, 22 nt, Mycobacterium avium subsp. paratuberculosis
cuccucauaggcguacaccagg

SEQ ID NO: 926353 - RNA, 21 nt, Mycobacterium avium subsp. paratuberculosis
cuccuccgggcugaccucgcg

SEQ ID NO: 926354 - RNA, 17 nt, Mycobacterium avium subsp. paratuberculosis
cuccgguaccacgccgu

SEQ ID NO: 926355 - RNA, 13 nt, Mycobacterium avium subsp. paratuberculosis
cuccauccgggcg

SEQ ID NO: 926356 - RNA, 20 nt, Mycobacterium avium subsp. paratuberculosis
cuccauccgggcggccagcc

SEQ ID NO: 926357 - RNA, 13 nt, Mycobacterium avium subsp. paratuberculosis
cuccauccgccgu

SEQ ID NO: 926358 - RNA, 14 nt, Mycobacterium avium subsp. paratuberculosis
cuccauccgccguc

SEQ ID NO: 926359 - RNA, 14 nt, Mycobacterium avium subsp. paratuberculosis
cuccaugucgucgg

SEQ ID NO: 926360 - RNA, 16 nt, Mycobacterium avium subsp. paratuberculosis
cuccauggcggcgacc

SEQ ID NO: 926361 - RNA, 14 nt, Mycobacterium avium subsp. paratuberculosis
cucccagacgucga

SEQ ID NO: 926362 - RNA, 13 nt, Mycobacterium avium subsp. paratuberculosis
cucccagccgccg

SEQ ID NO: 926363 - RNA, 17 nt, Mycobacterium avium subsp. paratuberculosis
cucccagccgccggcca

SEQ ID NO: 926364 - RNA, 19 nt, Mycobacterium avium subsp. paratuberculosis
cucccagccgccggccacc

SEQ ID NO: 926365 - RNA, 16 nt, Mycobacterium avium subsp. paratuberculosis
cucccaggacgcggug

SEQ ID NO: 926366 - RNA, 16 nt, Mycobacterium avium subsp. paratuberculosis
cucccaggacggcgcg

SEQ ID NO: 926367 - RNA, 17 nt, Mycobacterium avium subsp. paratuberculosis
cucccaggacggcgcgg

SEQ ID NO: 926368 - RNA, 23 nt, Mycobacterium avium subsp. paratuberculosis
cucccaccguguuugcugcaugc

SEQ ID NO: 926369 - RNA, 20 nt, Mycobacterium avium subsp. paratuberculosis
cuccauucgggccagcgccg

SEQ ID NO: 926370 - RNA, 17 nt, Mycobacterium avium subsp. paratuberculosis
cucccaggccgcggcca

SEQ ID NO: 926371 - RNA, 15 nt, Mycobacterium avium subsp. paratuberculosis
cucccagucccagca

SEQ ID NO: 926372 - RNA, 19 nt, Mycobacterium avium subsp. paratuberculosis
cuccgggaacgcggcgaag

SEQ ID NO: 926373 - RNA, 20 nt, Mycobacterium avium subsp. paratuberculosis
cuccgggaaggcggccgcga

SEQ ID NO: 926374 - RNA, 16 nt, Mycobacterium avium subsp. paratuberculosis
cuccggauggcggucg

SEQ ID NO: 926375 - RNA, 17 nt, Mycobacterium avium subsp. paratuberculosis
cuccgcucgggcccgcg

SEQ ID NO: 926376 - RNA, 14 nt, Mycobacterium avium subsp. paratuberculosis
cucgaagcgcagca

SEQ ID NO: 926377 - RNA, 16 nt, Mycobacterium avium subsp. paratuberculosis
cucgaagcugcgccac

SEQ ID NO: 926378 - RNA, 20 nt, Mycobacterium avium subsp. paratuberculosis
cucgaaguggacaugcagcc

SEQ ID NO: 926379 - RNA, 23 nt, Mycobacterium avium subsp. paratuberculosis
cucgaaguggacaugcagccgcc

SEQ ID NO: 926380 - RNA, 16 nt, Mycobacterium avium subsp. paratuberculosis
cucgaaguggcagcgc

SEQ ID NO: 926381 - RNA, 20 nt, Mycobacterium avium subsp. paratuberculosis
cucgaaguucuccucgccgu

SEQ ID NO: 926382 - RNA, 21 nt, Mycobacterium avium subsp. paratuberculosis
cucgaaguucuccucgccgua

SEQ ID NO: 926383 - RNA, 13 nt, Mycobacterium avium subsp. paratuberculosis
cucgacccgggcc

SEQ ID NO: 926384 - RNA, 14 nt, Mycobacterium avium subsp. paratuberculosis
cucgacccgggcca

SEQ ID NO: 926385 - RNA, 17 nt, Mycobacterium avium subsp. paratuberculosis
cucgacccgggccagca

SEQ ID NO: 926386 - RNA, 15 nt, Mycobacterium avium subsp. paratuberculosis
cucgaauccgcgggc

SEQ ID NO: 926387 - RNA, 21 nt, Mycobacterium avium subsp. paratuberculosis
cucgaaugcggcugccggcca

SEQ ID NO: 926388 - RNA, 17 nt, Mycobacterium avium subsp. paratuberculosis
cucgaccccgaaggcgu

SEQ ID NO: 926389 - RNA, 20 nt, Mycobacterium avium subsp. paratuberculosis
cucgaccccgaaggcguugg

SEQ ID NO: 926390 - RNA, 17 nt, Mycobacterium avium subsp. paratuberculosis
cucgaagggcgccagcc

SEQ ID NO: 926391 - RNA, 19 nt, Mycobacterium avium subsp. paratuberculosis
cucgaagggcgccagccgu

SEQ ID NO: 926392 - RNA, 13 nt, Mycobacterium avium subsp. paratuberculosis
cucgaaggugccc

SEQ ID NO: 926393 - RNA, 23 nt, Mycobacterium avium subsp. paratuberculosis
cucgaaggugcccgcaucgccga

SEQ ID NO: 926394 - RNA, 19 nt, Mycobacterium avium subsp. paratuberculosis
cucgaaguagagccgcugc

SEQ ID NO: 926395 - RNA, 19 nt, Mycobacterium avium subsp. paratuberculosis
cucgaacggcccggacgga

SEQ ID NO: 926396 - RNA, 20 nt, Mycobacterium avium subsp. paratuberculosis
cucgaagccgaucgcggcga

SEQ ID NO: 926397 - RNA, 18 nt, Mycobacterium avium subsp. paratuberculosis
cucgaaggcaacucgcga

SEQ ID NO: 926398 - RNA, 17 nt, Mycobacterium avium subsp. paratuberculosis
cucgaagauggucgcgc

SEQ ID NO: 926399 - RNA, 14 nt, Mycobacterium avium subsp. paratuberculosis
cucgaacgggucga

SEQ ID NO: 926400 - RNA, 21 nt, Mycobacterium avium subsp. paratuberculosis
cucgaacucaccgguggccgc

SEQ ID NO: 926401 - RNA, 20 nt, Mycobacterium avium subsp. paratuberculosis
cucgacgguggagcggccca

SEQ ID NO: 926402 - RNA, 22 nt, Mycobacterium avium subsp. paratuberculosis
cucgacgguggagcggcccagc

SEQ ID NO: 926403 - RNA, 13 nt, Mycobacterium avium subsp. paratuberculosis
cucgacggugacc

SEQ ID NO: 926404 - RNA, 14 nt, Mycobacterium avium subsp. paratuberculosis
cucgacggugaccg

SEQ ID NO: 926405 - RNA, 14 nt, Mycobacterium avium subsp. paratuberculosis
cucgacggccugca

SEQ ID NO: 926406 - RNA, 11 nt, Mycobacterium avium subsp. paratuberculosis
cucgacggcga

SEQ ID NO: 926407 - RNA, 14 nt, Mycobacterium avium subsp. paratuberculosis
cucgacggcgccga

SEQ ID NO: 926408 - RNA, 15 nt, Mycobacterium avium subsp. paratuberculosis
cucgacggcgccgac

SEQ ID NO: 926409 - RNA, 17 nt, Mycobacterium avium subsp. paratuberculosis
cucgacggcgccgacga

SEQ ID NO: 926410 - RNA, 13 nt, Mycobacterium avium subsp. paratuberculosis
cucgacggcgugg

SEQ ID NO: 926411 - RNA, 13 nt, Mycobacterium avium subsp. paratuberculosis
cucgacgccgggc

SEQ ID NO: 926412 - RNA, 15 nt, Mycobacterium avium subsp. paratuberculosis
cucgacgccgggcag

SEQ ID NO: 926413 - RNA, 20 nt, Mycobacterium avium subsp. paratuberculosis
cucgacgccgggcagcgcgc

SEQ ID NO: 926414 - RNA, 16 nt, Mycobacterium avium subsp. paratuberculosis
cucgacgcgcacccgg

SEQ ID NO: 926415 - RNA, 14 nt, Mycobacterium avium subsp. paratuberculosis
cucgacgcucggcg

SEQ ID NO: 926416 - RNA, 14 nt, Mycobacterium avium subsp. paratuberculosis
cucgacggcacccg

SEQ ID NO: 926417 - RNA, 17 nt, Mycobacterium avium subsp. paratuberculosis
cucgacggcacccggcc

SEQ ID NO: 926418 - RNA, 17 nt, Mycobacterium avium subsp. paratuberculosis
cucgacggccggcguca

SEQ ID NO: 926419 - RNA, 13 nt, Mycobacterium avium subsp. paratuberculosis
cucgaccgcggcg

SEQ ID NO: 926420 - RNA, 15 nt, Mycobacterium avium subsp. paratuberculosis
cucgaccgcgguggc

SEQ ID NO: 926421 - RNA, 14 nt, Mycobacterium avium subsp. paratuberculosis
cucgaccucggcgg

SEQ ID NO: 926422 - RNA, 15 nt, Mycobacterium avium subsp. paratuberculosis
cucgaccucggcggc

SEQ ID NO: 926423 - RNA, 17 nt, Mycobacterium avium subsp. paratuberculosis
cucgaccucggcggcca

SEQ ID NO: 926424 - RNA, 20 nt, Mycobacterium avium subsp. paratuberculosis
cucgaccucgucggcggcga

SEQ ID NO: 926425 - RNA, 22 nt, Mycobacterium avium subsp. paratuberculosis
cucgaccucgucggcggcgacg

SEQ ID NO: 926426 - RNA, 19 nt, Mycobacterium avium subsp. paratuberculosis
cucgaccucuucggcgccg

SEQ ID NO: 926427 - RNA, 23 nt, Mycobacterium avium subsp. paratuberculosis
cucgaccucuucggcgccggcau

SEQ ID NO: 926428 - RNA, 23 nt, Mycobacterium avium subsp. paratuberculosis
cucgaccgugaggcccggcgugg

SEQ ID NO: 926429 - RNA, 16 nt, Mycobacterium avium subsp. paratuberculosis
cucgaccucaccccgc

SEQ ID NO: 926430 - RNA, 17 nt, Mycobacterium avium subsp. paratuberculosis
cucgaucgacgacgcca

SEQ ID NO: 926431 - RNA, 14 nt, Mycobacterium avium subsp. paratuberculosis
cucgaucgccaccg

SEQ ID NO: 926432 - RNA, 15 nt, Mycobacterium avium subsp. paratuberculosis
cucgaucgccaccga

SEQ ID NO: 926433 - RNA, 18 nt, Mycobacterium avium subsp. paratuberculosis
cucgagggccuccaccac

SEQ ID NO: 926434 - RNA, 22 nt, Mycobacterium avium subsp. paratuberculosis
cucgaggggcuuggcgacgaag

SEQ ID NO: 926435 - RNA, 16 nt, Mycobacterium avium subsp. paratuberculosis
cucgaggaucgcggcc

SEQ ID NO: 926436 - RNA, 18 nt, Mycobacterium avium subsp. paratuberculosis
cucgaggaucgcggccac

SEQ ID NO: 926437 - RNA, 20 nt, Mycobacterium avium subsp. paratuberculosis
cucgaggaucgcggccacgc

SEQ ID NO: 926438 - RNA, 20 nt, Mycobacterium avium subsp. paratuberculosis
cucgacguagucgcgcacca

SEQ ID NO: 926439 - RNA, 13 nt, Mycobacterium avium subsp. paratuberculosis
cucgaggccgcgg

SEQ ID NO: 926440 - RNA, 13 nt, Mycobacterium avium subsp. paratuberculosis
cucgaggccccgc

SEQ ID NO: 926441 - RNA, 23 nt, Mycobacterium avium subsp. paratuberculosis
cucgaggccccgcgugacggccg

SEQ ID NO: 926442 - RNA, 12 nt, Mycobacterium avium subsp. paratuberculosis
cucgaggccgac

SEQ ID NO: 926443 - RNA, 16 nt, Mycobacterium avium subsp. paratuberculosis
cucgaggccgacgugc

SEQ ID NO: 926444 - RNA, 20 nt, Mycobacterium avium subsp. paratuberculosis
cucgagcgcgcucaaccgcc

SEQ ID NO: 926445 - RNA, 15 nt, Mycobacterium avium subsp. paratuberculosis
cucgagcgcgucgac

SEQ ID NO: 926446 - RNA, 16 nt, Mycobacterium avium subsp. paratuberculosis
cucgacguacaucagc

SEQ ID NO: 926447 - RNA, 20 nt, Mycobacterium avium subsp. paratuberculosis
cucgacguacaucagcucgu

SEQ ID NO: 926448 - RNA, 16 nt, Mycobacterium avium subsp. paratuberculosis
cucgacguaggccaga

SEQ ID NO: 926449 - RNA, 23 nt, Mycobacterium avium subsp. paratuberculosis
cucgacguaggugagcaacgcca

SEQ ID NO: 926450 - RNA, 15 nt, Mycobacterium avium subsp. paratuberculosis
cucgagcgucacgcu

SEQ ID NO: 926451 - RNA, 15 nt, Mycobacterium avium subsp. paratuberculosis
cucgagcgugcccgc

SEQ ID NO: 926452 - RNA, 16 nt, Mycobacterium avium subsp. paratuberculosis
cucgagcgugcccgcg

SEQ ID NO: 926453 - RNA, 17 nt, Mycobacterium avium subsp. paratuberculosis
cucgagcgugcccgcgc

SEQ ID NO: 926454 - RNA, 16 nt, Mycobacterium avium subsp. paratuberculosis
cucgagcucaccgaca

SEQ ID NO: 926455 - RNA, 13 nt, Mycobacterium avium subsp. paratuberculosis
cucgagcucggcg

SEQ ID NO: 926456 - RNA, 14 nt, Mycobacterium avium subsp. paratuberculosis
cucgagcucggcga

SEQ ID NO: 926457 - RNA, 15 nt, Mycobacterium avium subsp. paratuberculosis
cucgagcucggcgag

SEQ ID NO: 926458 - RNA, 17 nt, Mycobacterium avium subsp. paratuberculosis
cucgaucucggccaccg

SEQ ID NO: 926459 - RNA, 17 nt, Mycobacterium avium subsp. paratuberculosis
cucgaucugcaccagcg

SEQ ID NO: 926460 - RNA, 16 nt, Mycobacterium avium subsp. paratuberculosis
cucgaucuggcggacc

SEQ ID NO: 926461 - RNA, 21 nt, Mycobacterium avium subsp. paratuberculosis
cucgaucuggcggacccgcuc

SEQ ID NO: 926462 - RNA, 19 nt, Mycobacterium avium subsp. paratuberculosis
cucgaucugguucaccgcc

SEQ ID NO: 926463 - RNA, 20 nt, Mycobacterium avium subsp. paratuberculosis
cucgaucugguucaccgcca

SEQ ID NO: 926464 - RNA, 22 nt, Mycobacterium avium subsp. paratuberculosis
cucgaucugguucaccgccacc

SEQ ID NO: 926465 - RNA, 23 nt, Mycobacterium avium subsp. paratuberculosis
cucgaucgugggcaacacgucgu

SEQ ID NO: 926466 - RNA, 18 nt, Mycobacterium avium subsp. paratuberculosis
cucgaucgccgcgcccag

SEQ ID NO: 926467 - RNA, 19 nt, Mycobacterium avium subsp. paratuberculosis
cucgaucgcgaccaccggc

SEQ ID NO: 926468 - RNA, 14 nt, Mycobacterium avium subsp. paratuberculosis
cucgaucgcgguca

SEQ ID NO: 926469 - RNA, 14 nt, Mycobacterium avium subsp. paratuberculosis
cucgaucggcgcgc

SEQ ID NO: 926470 - RNA, 16 nt, Mycobacterium avium subsp. paratuberculosis
cucgaucggcgcgccg

SEQ ID NO: 926471 - RNA, 21 nt, Mycobacterium avium subsp. paratuberculosis
cucgaucggcgcgccgaagau

SEQ ID NO: 926472 - RNA, 23 nt, Mycobacterium avium subsp. paratuberculosis
cucgaucggggaauccuggccga

SEQ ID NO: 926473 - RNA, 23 nt, Mycobacterium avium subsp. paratuberculosis
cucgaucgucaggaaugcgacga

SEQ ID NO: 926474 - RNA, 22 nt, Mycobacterium avium subsp. paratuberculosis
cucgaucguccgaggccccgcc

SEQ ID NO: 926475 - RNA, 17 nt, Mycobacterium avium subsp. paratuberculosis
cucgcaggcgagccgac

SEQ ID NO: 926476 - RNA, 19 nt, Mycobacterium avium subsp. paratuberculosis
cucgcaggcgagccgacag

SEQ ID NO: 926477 - RNA, 17 nt, Mycobacterium avium subsp. paratuberculosis
cucgcacagcaccaguu

SEQ ID NO: 926478 - RNA, 18 nt, Mycobacterium avium subsp. paratuberculosis
cucgcacagccggcgcgc

SEQ ID NO: 926479 - RNA, 21 nt, Mycobacterium avium subsp. paratuberculosis
cucgcacagccggcgcgcggu

SEQ ID NO: 926480 - RNA, 13 nt, Mycobacterium avium subsp. paratuberculosis
cucgcaccugccg

SEQ ID NO: 926481 - RNA, 19 nt, Mycobacterium avium subsp. paratuberculosis
cucgcaccugccgucgacg

SEQ ID NO: 926482 - RNA, 20 nt, Mycobacterium avium subsp. paratuberculosis
cucgcaccugccgucgacga

SEQ ID NO: 926483 - RNA, 23 nt, Mycobacterium avium subsp. paratuberculosis
cucgcaccugccgucgacgacca

SEQ ID NO: 926484 - RNA, 16 nt, Mycobacterium avium subsp. paratuberculosis
cucgccgaucgggacc

SEQ ID NO: 926485 - RNA, 21 nt, Mycobacterium avium subsp. paratuberculosis
cucgccgaucgggaccgucac

SEQ ID NO: 926486 - RNA, 18 nt, Mycobacterium avium subsp. paratuberculosis
cucgccgaucucgaccag

SEQ ID NO: 926487 - RNA, 22 nt, Mycobacterium avium subsp. paratuberculosis
cucgccgaucucgaccagcgcc

SEQ ID NO: 926488 - RNA, 14 nt, Mycobacterium avium subsp. paratuberculosis
cucgcccugcagcg

SEQ ID NO: 926489 - RNA, 17 nt, Mycobacterium avium subsp. paratuberculosis
cucgcccugcagcgcga

SEQ ID NO: 926490 - RNA, 13 nt, Mycobacterium avium subsp. paratuberculosis
cucgccgaaccgg

SEQ ID NO: 926491 - RNA, 21 nt, Mycobacterium avium subsp. paratuberculosis
cucgccgaaccggggccgcac

SEQ ID NO: 926492 - RNA, 16 nt, Mycobacterium avium subsp. paratuberculosis
cucgccgaaggccggg

SEQ ID NO: 926493 - RNA, 15 nt, Mycobacterium avium subsp. paratuberculosis
cucgcccucgguguu

SEQ ID NO: 926494 - RNA, 13 nt, Mycobacterium avium subsp. paratuberculosis
cucgcccgggcua

SEQ ID NO: 926495 - RNA, 14 nt, Mycobacterium avium subsp. paratuberculosis
cucgcaggugccgg

SEQ ID NO: 926496 - RNA, 18 nt, Mycobacterium avium subsp. paratuberculosis
cucgcaggugccggugac

SEQ ID NO: 926497 - RNA, 15 nt, Mycobacterium avium subsp. paratuberculosis
cucgccggccgcggg

SEQ ID NO: 926498 - RNA, 14 nt, Mycobacterium avium subsp. paratuberculosis
cucgccggcgccgg

SEQ ID NO: 926499 - RNA, 15 nt, Mycobacterium avium subsp. paratuberculosis
cucgccggcgccggg

SEQ ID NO: 926500 - RNA, 16 nt, Mycobacterium avium subsp. paratuberculosis
cucgccggcgccgggc

SEQ ID NO: 926501 - RNA, 18 nt, Mycobacterium avium subsp. paratuberculosis
cucgccggcgccgggcgg

SEQ ID NO: 926502 - RNA, 13 nt, Mycobacterium avium subsp. paratuberculosis
cucgccggcgcgc

SEQ ID NO: 926503 - RNA, 17 nt, Mycobacterium avium subsp. paratuberculosis
cucgccgcgaacgacga

SEQ ID NO: 926504 - RNA, 18 nt, Mycobacterium avium subsp. paratuberculosis
cucgccggccgccguggc

SEQ ID NO: 926505 - RNA, 22 nt, Mycobacterium avium subsp. paratuberculosis
cucgccggccgccguggcccac

SEQ ID NO: 926506 - RNA, 17 nt, Mycobacterium avium subsp. paratuberculosis
cucgccgcugucgucga

SEQ ID NO: 926507 - RNA, 17 nt, Mycobacterium avium subsp. paratuberculosis
cucgccggagagcccgu

SEQ ID NO: 926508 - RNA, 17 nt, Mycobacterium avium subsp. paratuberculosis
cucgccggagcgcccca

SEQ ID NO: 926509 - RNA, 22 nt, Mycobacterium avium subsp. paratuberculosis
cucgccggagcgccccagggcc

SEQ ID NO: 926510 - RNA, 21 nt, Mycobacterium avium subsp. paratuberculosis
cucgccgcucguaacgccacg

SEQ ID NO: 926511 - RNA, 13 nt, Mycobacterium avium subsp. paratuberculosis
cucgccgcggcca

SEQ ID NO: 926512 - RNA, 14 nt, Mycobacterium avium subsp. paratuberculosis
cucgccgcggccac

SEQ ID NO: 926513 - RNA, 14 nt, Mycobacterium avium subsp. paratuberculosis
cucgccgcgggcca

SEQ ID NO: 926514 - RNA, 17 nt, Mycobacterium avium subsp. paratuberculosis
cucgccgcgggccagcc

SEQ ID NO: 926515 - RNA, 13 nt, Mycobacterium avium subsp. paratuberculosis
cucgccgcgggug

SEQ ID NO: 926516 - RNA, 14 nt, Mycobacterium avium subsp. paratuberculosis
cucgccgcggucau

SEQ ID NO: 926517 - RNA, 16 nt, Mycobacterium avium subsp. paratuberculosis
cucgccgcggucaucg

SEQ ID NO: 926518 - RNA, 13 nt, Mycobacterium avium subsp. paratuberculosis
cucgccgcggugg

SEQ ID NO: 926519 - RNA, 14 nt, Mycobacterium avium subsp. paratuberculosis
cucgccgcgguggu

SEQ ID NO: 926520 - RNA, 18 nt, Mycobacterium avium subsp. paratuberculosis
cucgccgcgguggugggc

SEQ ID NO: 926521 - RNA, 18 nt, Mycobacterium avium subsp. paratuberculosis
cucgccgcguacgccgcc

SEQ ID NO: 926522 - RNA, 12 nt, Mycobacterium avium subsp. paratuberculosis
cucgccgcgcca

SEQ ID NO: 926523 - RNA, 14 nt, Mycobacterium avium subsp. paratuberculosis
cucgccgcgccagc

SEQ ID NO: 926524 - RNA, 15 nt, Mycobacterium avium subsp. paratuberculosis
cucgccgcgccagca

SEQ ID NO: 926525 - RNA, 17 nt, Mycobacterium avium subsp. paratuberculosis
cucgccgcgccagcacc

SEQ ID NO: 926526 - RNA, 20 nt, Mycobacterium avium subsp. paratuberculosis
cucgccgcgccagcaccucg

SEQ ID NO: 926527 - RNA, 13 nt, Mycobacterium avium subsp. paratuberculosis
cucgccgccgccg

SEQ ID NO: 926528 - RNA, 17 nt, Mycobacterium avium subsp. paratuberculosis
cucgccgccgccgaucu

SEQ ID NO: 926529 - RNA, 15 nt, Mycobacterium avium subsp. paratuberculosis
cucgccgccgacgaa

SEQ ID NO: 926530 - RNA, 18 nt, Mycobacterium avium subsp. paratuberculosis
cucgccgaugucggccgg

SEQ ID NO: 926531 - RNA, 12 nt, Mycobacterium avium subsp. paratuberculosis
cucgcgccacca

SEQ ID NO: 926532 - RNA, 16 nt, Mycobacterium avium subsp. paratuberculosis
cucgcgcagcuggccg

SEQ ID NO: 926533 - RNA, 19 nt, Mycobacterium avium subsp. paratuberculosis
cucgcgcagcuggccgugc

SEQ ID NO: 926534 - RNA, 23 nt, Mycobacterium avium subsp. paratuberculosis
cucgcgcaggaacagcgacccga

SEQ ID NO: 926535 - RNA, 18 nt, Mycobacterium avium subsp. paratuberculosis
cucgcgcagggccagcgc

SEQ ID NO: 926536 - RNA, 19 nt, Mycobacterium avium subsp. paratuberculosis
cucgcgcagggccagcgcc

SEQ ID NO: 926537 - RNA, 19 nt, Mycobacterium avium subsp. paratuberculosis
cucgcgcaucagcggagug

SEQ ID NO: 926538 - RNA, 15 nt, Mycobacterium avium subsp. paratuberculosis
cucgcgcagcaccga

SEQ ID NO: 926539 - RNA, 12 nt, Mycobacterium avium subsp. paratuberculosis
cucgcgcagccc

SEQ ID NO: 926540 - RNA, 13 nt, Mycobacterium avium subsp. paratuberculosis
cucgcgcagcccc

SEQ ID NO: 926541 - RNA, 15 nt, Mycobacterium avium subsp. paratuberculosis
cucgcgcagccggcc

SEQ ID NO: 926542 - RNA, 19 nt, Mycobacterium avium subsp. paratuberculosis
cucgcgcagccggccgacc

SEQ ID NO: 926543 - RNA, 14 nt, Mycobacterium avium subsp. paratuberculosis
cucgcgcagcgcgu

SEQ ID NO: 926544 - RNA, 16 nt, Mycobacterium avium subsp. paratuberculosis
cucgcggccugcgggc

SEQ ID NO: 926545 - RNA, 12 nt, Mycobacterium avium subsp. paratuberculosis
cucgcggcgcag

SEQ ID NO: 926546 - RNA, 11 nt, Mycobacterium avium subsp. paratuberculosis
cucgcgccgga

SEQ ID NO: 926547 - RNA, 12 nt, Mycobacterium avium subsp. paratuberculosis
cucgcgcccggc

SEQ ID NO: 926548 - RNA, 18 nt, Mycobacterium avium subsp. paratuberculosis
cucgcgcccggcgccggc

SEQ ID NO: 926549 - RNA, 20 nt, Mycobacterium avium subsp. paratuberculosis
cucgcgcccuaacgugcccg

SEQ ID NO: 926550 - RNA, 12 nt, Mycobacterium avium subsp. paratuberculosis
cucgcgccgcca

SEQ ID NO: 926551 - RNA, 22 nt, Mycobacterium avium subsp. paratuberculosis
cucgcgccgccacgcggcgcgc

SEQ ID NO: 926552 - RNA, 21 nt, Mycobacterium avium subsp. paratuberculosis
cucgcggccguagccggaccg

SEQ ID NO: 926553 - RNA, 23 nt, Mycobacterium avium subsp. paratuberculosis
cucgcggccguagccggaccgcu

SEQ ID NO: 926554 - RNA, 13 nt, Mycobacterium avium subsp. paratuberculosis
cucgcggcggccg

SEQ ID NO: 926555 - RNA, 19 nt, Mycobacterium avium subsp. paratuberculosis
cucgcggcggccgacgcgc

SEQ ID NO: 926556 - RNA, 16 nt, Mycobacterium avium subsp. paratuberculosis
cucgcggcgggucagc

SEQ ID NO: 926557 - RNA, 20 nt, Mycobacterium avium subsp. paratuberculosis
cucgcggcguaggcggccau

SEQ ID NO: 926558 - RNA, 14 nt, Mycobacterium avium subsp. paratuberculosis
cucgcgggacggcg

SEQ ID NO: 926559 - RNA, 18 nt, Mycobacterium avium subsp. paratuberculosis
cucgcgggacggcggcga

SEQ ID NO: 926560 - RNA, 17 nt, Mycobacterium avium subsp. paratuberculosis
cucgcgggaguggccgg

SEQ ID NO: 926561 - RNA, 21 nt, Mycobacterium avium subsp. paratuberculosis
cucgccucggaggccaccgcg

SEQ ID NO: 926562 - RNA, 19 nt, Mycobacterium avium subsp. paratuberculosis
cucgccucggggaucgcca

SEQ ID NO: 926563 - RNA, 17 nt, Mycobacterium avium subsp. paratuberculosis
cucgccuacacagcccc

SEQ ID NO: 926564 - RNA, 16 nt, Mycobacterium avium subsp. paratuberculosis
cucgcgcaccgcgggc

SEQ ID NO: 926565 - RNA, 18 nt, Mycobacterium avium subsp. paratuberculosis
cucgcgcaccgcgggcuc

SEQ ID NO: 926566 - RNA, 14 nt, Mycobacterium avium subsp. paratuberculosis
cucgcgcaccggcu

SEQ ID NO: 926567 - RNA, 17 nt, Mycobacterium avium subsp. paratuberculosis
cucgccgugcagcaccu

SEQ ID NO: 926568 - RNA, 19 nt, Mycobacterium avium subsp. paratuberculosis
cucgccgugcagcaccucg

SEQ ID NO: 926569 - RNA, 19 nt, Mycobacterium avium subsp. paratuberculosis
cucgccguugccggcccgc

SEQ ID NO: 926570 - RNA, 20 nt, Mycobacterium avium subsp. paratuberculosis
cucgccguugccggcccgca

SEQ ID NO: 926571 - RNA, 19 nt, Mycobacterium avium subsp. paratuberculosis
cucgccguugcgggucggc

SEQ ID NO: 926572 - RNA, 22 nt, Mycobacterium avium subsp. paratuberculosis
cucgccgucacaccgcggccag

SEQ ID NO: 926573 - RNA, 14 nt, Mycobacterium avium subsp. paratuberculosis
cucgccguccccac

SEQ ID NO: 926574 - RNA, 14 nt, Mycobacterium avium subsp. paratuberculosis
cucgccguccucgc

SEQ ID NO: 926575 - RNA, 17 nt, Mycobacterium avium subsp. paratuberculosis
cucgccgucgaaggccg

SEQ ID NO: 926576 - RNA, 19 nt, Mycobacterium avium subsp. paratuberculosis
cucgccgucgaaggccggg

SEQ ID NO: 926577 - RNA, 13 nt, Mycobacterium avium subsp. paratuberculosis
cucgccgucgcga

SEQ ID NO: 926578 - RNA, 14 nt, Mycobacterium avium subsp. paratuberculosis
cucgccgucggcca

SEQ ID NO: 926579 - RNA, 16 nt, Mycobacterium avium subsp. paratuberculosis
cucgccgguggcggcg

SEQ ID NO: 926580 - RNA, 18 nt, Mycobacterium avium subsp. paratuberculosis
cucgccgguggcggcgac

SEQ ID NO: 926581 - RNA, 17 nt, Mycobacterium avium subsp. paratuberculosis
cucgccguacgcgccgg

SEQ ID NO: 926582 - RNA, 18 nt, Mycobacterium avium subsp. paratuberculosis
cucgccguacgcgccggc

SEQ ID NO: 926583 - RNA, 20 nt, Mycobacterium avium subsp. paratuberculosis
cucgccguacgcgccggcca

SEQ ID NO: 926584 - RNA, 21 nt, Mycobacterium avium subsp. paratuberculosis
cucgccguacgcgccggccag

SEQ ID NO: 926585 - RNA, 23 nt, Mycobacterium avium subsp. paratuberculosis
cucgccguacgcgccggccagcc

SEQ ID NO: 926586 - RNA, 19 nt, Mycobacterium avium subsp. paratuberculosis
cucgccguacuugacgugc

SEQ ID NO: 926587 - RNA, 21 nt, Mycobacterium avium subsp. paratuberculosis
cucgccguagaauccgccguu

SEQ ID NO: 926588 - RNA, 14 nt, Mycobacterium avium subsp. paratuberculosis
cucgccggcggccg

SEQ ID NO: 926589 - RNA, 16 nt, Mycobacterium avium subsp. paratuberculosis
cucgccggcggccgcc

SEQ ID NO: 926590 - RNA, 14 nt, Mycobacterium avium subsp. paratuberculosis
cucgccggcggcgc

SEQ ID NO: 926591 - RNA, 22 nt, Mycobacterium avium subsp. paratuberculosis
cucgccggcggcgcccgcggcc

SEQ ID NO: 926592 - RNA, 20 nt, Mycobacterium avium subsp. paratuberculosis
cucgccgggcccgcucaccu

SEQ ID NO: 926593 - RNA, 20 nt, Mycobacterium avium subsp. paratuberculosis
cucgccggggaacaccggcg

SEQ ID NO: 926594 - RNA, 17 nt, Mycobacterium avium subsp. paratuberculosis
cucgccggucagcacgu

SEQ ID NO: 926595 - RNA, 23 nt, Mycobacterium avium subsp. paratuberculosis
cucgcgggugcgcugcagcgaga

SEQ ID NO: 926596 - RNA, 16 nt, Mycobacterium avium subsp. paratuberculosis
cucgcuguccugccgg

SEQ ID NO: 926597 - RNA, 16 nt, Mycobacterium avium subsp. paratuberculosis
cucgcgggccacagcg

SEQ ID NO: 926598 - RNA, 20 nt, Mycobacterium avium subsp. paratuberculosis
cucgcgggccacagcggcga

SEQ ID NO: 926599 - RNA, 13 nt, Mycobacterium avium subsp. paratuberculosis
cucgcgggccacc

SEQ ID NO: 926600 - RNA, 18 nt, Mycobacterium avium subsp. paratuberculosis
cucgcgggccaccgcggc

SEQ ID NO: 926601 - RNA, 18 nt, Mycobacterium avium subsp. paratuberculosis
cucgcgggcccgcgccgc

SEQ ID NO: 926602 - RNA, 14 nt, Mycobacterium avium subsp. paratuberculosis
cucgcgggcgagca

SEQ ID NO: 926603 - RNA, 22 nt, Mycobacterium avium subsp. paratuberculosis
cucgcgggcgaucuccagcggc

SEQ ID NO: 926604 - RNA, 23 nt, Mycobacterium avium subsp. paratuberculosis
cucgcgggcgaucuccagcggcc

SEQ ID NO: 926605 - RNA, 17 nt, Mycobacterium avium subsp. paratuberculosis
cucgcgggcgaugcggc

SEQ ID NO: 926606 - RNA, 19 nt, Mycobacterium avium subsp. paratuberculosis
cucgcgggcgaugcggccc

SEQ ID NO: 926607 - RNA, 21 nt, Mycobacterium avium subsp. paratuberculosis
cucgcgggcgaugcggcccgg

SEQ ID NO: 926608 - RNA, 22 nt, Mycobacterium avium subsp. paratuberculosis
cucgcgggcgaugcggcccggc

SEQ ID NO: 926609 - RNA, 19 nt, Mycobacterium avium subsp. paratuberculosis
cucgcuugccagccgggcc

SEQ ID NO: 926610 - RNA, 16 nt, Mycobacterium avium subsp. paratuberculosis
cucggagcggugucgc

SEQ ID NO: 926611 - RNA, 19 nt, Mycobacterium avium subsp. paratuberculosis
cucggaaugaacugccgcg

SEQ ID NO: 926612 - RNA, 21 nt, Mycobacterium avium subsp. paratuberculosis
cucggaaugaacugccgcggc

SEQ ID NO: 926613 - RNA, 23 nt, Mycobacterium avium subsp. paratuberculosis
cucggaaugaacugccgcggcac

SEQ ID NO: 926614 - RNA, 22 nt, Mycobacterium avium subsp. paratuberculosis
cucggaccgguaggcgcaccgc

SEQ ID NO: 926615 - RNA, 22 nt, Mycobacterium avium subsp. paratuberculosis
cucggacgacucguucgacgcc

SEQ ID NO: 926616 - RNA, 18 nt, Mycobacterium avium subsp. paratuberculosis
cucggaucccggggcgcg

SEQ ID NO: 926617 - RNA, 22 nt, Mycobacterium avium subsp. paratuberculosis
cucggaucccggggcgcgcugg

SEQ ID NO: 926618 - RNA, 14 nt, Mycobacterium avium subsp. paratuberculosis
cucggaggugccgc

SEQ ID NO: 926619 - RNA, 20 nt, Mycobacterium avium subsp. paratuberculosis
cucggaguaguccagcaccg

SEQ ID NO: 926620 - RNA, 22 nt, Mycobacterium avium subsp. paratuberculosis
cucggaguaguccagcaccgcc

SEQ ID NO: 926621 - RNA, 19 nt, Mycobacterium avium subsp. paratuberculosis
cucggaguaguuccggcgg

SEQ ID NO: 926622 - RNA, 20 nt, Mycobacterium avium subsp. paratuberculosis
cucggagaugauggccgcgc

SEQ ID NO: 926623 - RNA, 22 nt, Mycobacterium avium subsp. paratuberculosis
cucggaguugcgcagccgggcg

SEQ ID NO: 926624 - RNA, 15 nt, Mycobacterium avium subsp. paratuberculosis
cucggauuccgcgga

SEQ ID NO: 926625 - RNA, 21 nt, Mycobacterium avium subsp. paratuberculosis
cucggcaccagagcgccggac

SEQ ID NO: 926626 - RNA, 12 nt, Mycobacterium avium subsp. paratuberculosis
cucggcaccgug

SEQ ID NO: 926627 - RNA, 21 nt, Mycobacterium avium subsp. paratuberculosis
cucggcaccgugccgcgcggc

SEQ ID NO: 926628 - RNA, 22 nt, Mycobacterium avium subsp. paratuberculosis
cucggcaccgugccgcgcggcg

SEQ ID NO: 926629 - RNA, 13 nt, Mycobacterium avium subsp. paratuberculosis
cucggccagcgcg

SEQ ID NO: 926630 - RNA, 15 nt, Mycobacterium avium subsp. paratuberculosis
cucggccagcgcgcc

SEQ ID NO: 926631 - RNA, 12 nt, Mycobacterium avium subsp. paratuberculosis
cucggccagcgg

SEQ ID NO: 926632 - RNA, 14 nt, Mycobacterium avium subsp. paratuberculosis
cucggccagcgggc

SEQ ID NO: 926633 - RNA, 17 nt, Mycobacterium avium subsp. paratuberculosis
cucggccagggugacgg

SEQ ID NO: 926634 - RNA, 14 nt, Mycobacterium avium subsp. paratuberculosis
cucggcagccccgu

SEQ ID NO: 926635 - RNA, 16 nt, Mycobacterium avium subsp. paratuberculosis
cucggcagccccgucg

SEQ ID NO: 926636 - RNA, 13 nt, Mycobacterium avium subsp. paratuberculosis
cucggcagccggc

SEQ ID NO: 926637 - RNA, 14 nt, Mycobacterium avium subsp. paratuberculosis
cucggccgaugagc

SEQ ID NO: 926638 - RNA, 16 nt, Mycobacterium avium subsp. paratuberculosis
cucggccgccaccgcc

SEQ ID NO: 926639 - RNA, 22 nt, Mycobacterium avium subsp. paratuberculosis
cucggccgccaccgccaucucg

SEQ ID NO: 926640 - RNA, 20 nt, Mycobacterium avium subsp. paratuberculosis
cucggccgccgacaccacca

SEQ ID NO: 926641 - RNA, 14 nt, Mycobacterium avium subsp. paratuberculosis
cucggccgcggugc

SEQ ID NO: 926642 - RNA, 16 nt, Mycobacterium avium subsp. paratuberculosis
cucggcccgccacccg

SEQ ID NO: 926643 - RNA, 20 nt, Mycobacterium avium subsp. paratuberculosis
cucggcccgccgggcgccac

SEQ ID NO: 926644 - RNA, 20 nt, Mycobacterium avium subsp. paratuberculosis
cucggcccgcuucaggcagc

SEQ ID NO: 926645 - RNA, 20 nt, Mycobacterium avium subsp. paratuberculosis
cucggccaucccggugccgc

SEQ ID NO: 926646 - RNA, 20 nt, Mycobacterium avium subsp. paratuberculosis
cucggccauccgggcggcau

SEQ ID NO: 926647 - RNA, 20 nt, Mycobacterium avium subsp. paratuberculosis
cucggccuccgcgcgcggcc

SEQ ID NO: 926648 - RNA, 19 nt, Mycobacterium avium subsp. paratuberculosis
cucggccucccgguaggcg

SEQ ID NO: 926649 - RNA, 23 nt, Mycobacterium avium subsp. paratuberculosis
cucggccucccgguaggcggcga

SEQ ID NO: 926650 - RNA, 20 nt, Mycobacterium avium subsp. paratuberculosis
cucggccucgucgacgucgg

SEQ ID NO: 926651 - RNA, 16 nt, Mycobacterium avium subsp. paratuberculosis
cucggccggggcgacc

SEQ ID NO: 926652 - RNA, 17 nt, Mycobacterium avium subsp. paratuberculosis
cucggccggguccugga

SEQ ID NO: 926653 - RNA, 16 nt, Mycobacterium avium subsp. paratuberculosis
cucggccguaccggcg

SEQ ID NO: 926654 - RNA, 15 nt, Mycobacterium avium subsp. paratuberculosis
cucggcggccagcgc

SEQ ID NO: 926655 - RNA, 17 nt, Mycobacterium avium subsp. paratuberculosis
cucggcggccagcgcga

SEQ ID NO: 926656 - RNA, 14 nt, Mycobacterium avium subsp. paratuberculosis
cucggcggccagcg

SEQ ID NO: 926657 - RNA, 14 nt, Mycobacterium avium subsp. paratuberculosis
cucggcggcaccgc

SEQ ID NO: 926658 - RNA, 19 nt, Mycobacterium avium subsp. paratuberculosis
cucggcggcaccgcccggg

SEQ ID NO: 926659 - RNA, 20 nt, Mycobacterium avium subsp. paratuberculosis
cucggcggccgagcgcaccg

SEQ ID NO: 926660 - RNA, 22 nt, Mycobacterium avium subsp. paratuberculosis
cucggcggccgagcgcaccgcg

SEQ ID NO: 926661 - RNA, 13 nt, Mycobacterium avium subsp. paratuberculosis
cucggcggccgcc

SEQ ID NO: 926662 - RNA, 20 nt, Mycobacterium avium subsp. paratuberculosis
cucggcggccgccagcgucc

SEQ ID NO: 926663 - RNA, 15 nt, Mycobacterium avium subsp. paratuberculosis
cucggcggccgccuu

SEQ ID NO: 926664 - RNA, 15 nt, Mycobacterium avium subsp. paratuberculosis
cucggcggccgcguc

SEQ ID NO: 926665 - RNA, 20 nt, Mycobacterium avium subsp. paratuberculosis
cucggcggccgcguccucgc

SEQ ID NO: 926666 - RNA, 14 nt, Mycobacterium avium subsp. paratuberculosis
cucggcggccccuu

SEQ ID NO: 926667 - RNA, 15 nt, Mycobacterium avium subsp. paratuberculosis
cucggcggcccgcag

SEQ ID NO: 926668 - RNA, 23 nt, Mycobacterium avium subsp. paratuberculosis
cucggccuuacgcugcgcgaccu

SEQ ID NO: 926669 - RNA, 18 nt, Mycobacterium avium subsp. paratuberculosis
cucggccuugagccgguc

SEQ ID NO: 926670 - RNA, 18 nt, Mycobacterium avium subsp. paratuberculosis
cucggccuugccgcugug

SEQ ID NO: 926671 - RNA, 19 nt, Mycobacterium avium subsp. paratuberculosis
cucggccuuggccaccgcc

SEQ ID NO: 926672 - RNA, 19 nt, Mycobacterium avium subsp. paratuberculosis
cucggcgaagucaucaccg

SEQ ID NO: 926673 - RNA, 18 nt, Mycobacterium avium subsp. paratuberculosis
cucggcgacaacagcgcc

SEQ ID NO: 926674 - RNA, 20 nt, Mycobacterium avium subsp. paratuberculosis
cucggcgcucgccgcgcggc

SEQ ID NO: 926675 - RNA, 20 nt, Mycobacterium avium subsp. paratuberculosis
cucggcgcugcccgccgcgg

SEQ ID NO: 926676 - RNA, 18 nt, Mycobacterium avium subsp. paratuberculosis
cucggcgcugucggcggg

SEQ ID NO: 926677 - RNA, 22 nt, Mycobacterium avium subsp. paratuberculosis
cucggcggacaucgccucggcg

SEQ ID NO: 926678 - RNA, 22 nt, Mycobacterium avium subsp. paratuberculosis
cugaaucccuccggcaggccgc

SEQ ID NO: 926679 - RNA, 16 nt, Mycobacterium avium subsp. paratuberculosis
cugacacagcaccggc

SEQ ID NO: 926680 - RNA, 13 nt, Mycobacterium avium subsp. paratuberculosis
cugaauucggcca

SEQ ID NO: 926681 - RNA, 21 nt, Mycobacterium avium subsp. paratuberculosis
cugaauucuguugucggcucg

SEQ ID NO: 926682 - RNA, 16 nt, Mycobacterium avium subsp. paratuberculosis
cugacagacccgaucg

SEQ ID NO: 926683 - RNA, 16 nt, Mycobacterium avium subsp. paratuberculosis
cugacacgaccgccug

SEQ ID NO: 926684 - RNA, 13 nt, Mycobacterium avium subsp. paratuberculosis
cugaccaccgagg

SEQ ID NO: 926685 - RNA, 16 nt, Mycobacterium avium subsp. paratuberculosis
cugaccaccgagguga

SEQ ID NO: 926686 - RNA, 14 nt, Mycobacterium avium subsp. paratuberculosis
cugaccaaggccga

SEQ ID NO: 926687 - RNA, 16 nt, Mycobacterium avium subsp. paratuberculosis
cugaccaaggccgaca

SEQ ID NO: 926688 - RNA, 23 nt, Mycobacterium avium subsp. paratuberculosis
cugaccaaggccgacagguagca

SEQ ID NO: 926689 - RNA, 16 nt, Mycobacterium avium subsp. paratuberculosis
cugaccagcggcgcgc

SEQ ID NO: 926690 - RNA, 20 nt, Mycobacterium avium subsp. paratuberculosis
cugaccagcggcgcgccggg

SEQ ID NO: 926691 - RNA, 15 nt, Mycobacterium avium subsp. paratuberculosis
cugaccagcgccucg

SEQ ID NO: 926692 - RNA, 17 nt, Mycobacterium avium subsp. paratuberculosis
cugaccagcgccucgcg

SEQ ID NO: 926693 - RNA, 13 nt, Mycobacterium avium subsp. paratuberculosis
cugacccagcgcg

SEQ ID NO: 926694 - RNA, 16 nt, Mycobacterium avium subsp. paratuberculosis
cugacccagcgcgggg

SEQ ID NO: 926695 - RNA, 15 nt, Mycobacterium avium subsp. paratuberculosis
cugaccccccgacgc

SEQ ID NO: 926696 - RNA, 19 nt, Mycobacterium avium subsp. paratuberculosis
cugaccccccgacgccgac

SEQ ID NO: 926697 - RNA, 22 nt, Mycobacterium avium subsp. paratuberculosis
cugaccccccgacgccgacggc

SEQ ID NO: 926698 - RNA, 16 nt, Mycobacterium avium subsp. paratuberculosis
cugaccccgcucggcg

SEQ ID NO: 926699 - RNA, 20 nt, Mycobacterium avium subsp. paratuberculosis
cugaccccgcucggcguggc

SEQ ID NO: 926700 - RNA, 18 nt, Mycobacterium avium subsp. paratuberculosis
cugaagcccaccgccguu

SEQ ID NO: 926701 - RNA, 21 nt, Mycobacterium avium subsp. paratuberculosis
cugaagcggcccuguucgccg

SEQ ID NO: 926702 - RNA, 19 nt, Mycobacterium avium subsp. paratuberculosis
cugaagccgaacgcgcugu

SEQ ID NO: 926703 - RNA, 21 nt, Mycobacterium avium subsp. paratuberculosis
cugaagaagaugggcgccgag

SEQ ID NO: 926704 - RNA, 19 nt, Mycobacterium avium subsp. paratuberculosis
cugaaccgguagucgucga

SEQ ID NO: 926705 - RNA, 20 nt, Mycobacterium avium subsp. paratuberculosis
cugaacugcucgaccagcgc

SEQ ID NO: 926706 - RNA, 14 nt, Mycobacterium avium subsp. paratuberculosis
cugaacggccgcgc

SEQ ID NO: 926707 - RNA, 13 nt, Mycobacterium avium subsp. paratuberculosis
cugaacgggcagc

SEQ ID NO: 926708 - RNA, 17 nt, Mycobacterium avium subsp. paratuberculosis
cugaacggugcccgccg

SEQ ID NO: 926709 - RNA, 21 nt, Mycobacterium avium subsp. paratuberculosis
cugaacgccugccggcgccgg

SEQ ID NO: 926710 - RNA, 14 nt, Mycobacterium avium subsp. paratuberculosis
cugaacgcgucguu

SEQ ID NO: 926711 - RNA, 21 nt, Mycobacterium avium subsp. paratuberculosis
cugaacgccagcagccgcagc

SEQ ID NO: 926712 - RNA, 22 nt, Mycobacterium avium subsp. paratuberculosis
cugaacgccagcagccgcagca

SEQ ID NO: 926713 - RNA, 20 nt, Mycobacterium avium subsp. paratuberculosis
cucuggcgugacgcucgacg

SEQ ID NO: 926714 - RNA, 20 nt, Mycobacterium avium subsp. paratuberculosis
cucuggcgugacgcucggcg

SEQ ID NO: 926715 - RNA, 22 nt, Mycobacterium avium subsp. paratuberculosis
cucuggccugauugacggccca

SEQ ID NO: 926716 - RNA, 18 nt, Mycobacterium avium subsp. paratuberculosis
cugaacagcagcagcagc

SEQ ID NO: 926717 - RNA, 20 nt, Mycobacterium avium subsp. paratuberculosis
cucuuggugguggucgucga

SEQ ID NO: 926718 - RNA, 14 nt, Mycobacterium avium subsp. paratuberculosis
cucuacucagccga

SEQ ID NO: 926719 - RNA, 22 nt, Mycobacterium avium subsp. paratuberculosis
cucugccuacuugcggccgcga

SEQ ID NO: 926720 - RNA, 14 nt, Mycobacterium avium subsp. paratuberculosis
cucugccugcagga

SEQ ID NO: 926721 - RNA, 15 nt, Mycobacterium avium subsp. paratuberculosis
cucugcgcgagcagc

SEQ ID NO: 926722 - RNA, 14 nt, Mycobacterium avium subsp. paratuberculosis
cucugccgggccgc

SEQ ID NO: 926723 - RNA, 16 nt, Mycobacterium avium subsp. paratuberculosis
cucggcgugcucggcc

SEQ ID NO: 926724 - RNA, 21 nt, Mycobacterium avium subsp. paratuberculosis
cucggcguggcgcucagcggc

SEQ ID NO: 926725 - RNA, 16 nt, Mycobacterium avium subsp. paratuberculosis
cucggcguggucgagg

SEQ ID NO: 926726 - RNA, 14 nt, Mycobacterium avium subsp. paratuberculosis
cucggcgucgccga

SEQ ID NO: 926727 - RNA, 14 nt, Mycobacterium avium subsp. paratuberculosis
cucggcgucucggc

SEQ ID NO: 926728 - RNA, 15 nt, Mycobacterium avium subsp. paratuberculosis
cucggcgucucggcg

SEQ ID NO: 926729 - RNA, 16 nt, Mycobacterium avium subsp. paratuberculosis
cucggcguggcaggcg

SEQ ID NO: 926730 - RNA, 17 nt, Mycobacterium avium subsp. paratuberculosis
cucggcguggcaggcga

SEQ ID NO: 926731 - RNA, 21 nt, Mycobacterium avium subsp. paratuberculosis
cucggcguggcaggcgauggc

SEQ ID NO: 926732 - RNA, 17 nt, Mycobacterium avium subsp. paratuberculosis
cucggcguccccggcgg

SEQ ID NO: 926733 - RNA, 14 nt, Mycobacterium avium subsp. paratuberculosis
cucggcgucccgcg

SEQ ID NO: 926734 - RNA, 18 nt, Mycobacterium avium subsp. paratuberculosis
cucggcgucccgcgccac

SEQ ID NO: 926735 - RNA, 14 nt, Mycobacterium avium subsp. paratuberculosis
cucggcgucccggc

SEQ ID NO: 926736 - RNA, 15 nt, Mycobacterium avium subsp. paratuberculosis
cucggcgucccggcg

SEQ ID NO: 926737 - RNA, 20 nt, Mycobacterium avium subsp. paratuberculosis
cucggcguauucgucgucgg

SEQ ID NO: 926738 - RNA, 15 nt, Mycobacterium avium subsp. paratuberculosis
cucggcgucaccgcg

SEQ ID NO: 926739 - RNA, 16 nt, Mycobacterium avium subsp. paratuberculosis
cucggcgucaccgcgg

SEQ ID NO: 926740 - RNA, 13 nt, Mycobacterium avium subsp. paratuberculosis
cucggcguccagc

SEQ ID NO: 926741 - RNA, 13 nt, Mycobacterium avium subsp. paratuberculosis
cucggcguccgcg

SEQ ID NO: 926742 - RNA, 15 nt, Mycobacterium avium subsp. paratuberculosis
cucggcguccgcggc

SEQ ID NO: 926743 - RNA, 14 nt, Mycobacterium avium subsp. paratuberculosis
cucggcgucggcgc

SEQ ID NO: 926744 - RNA, 15 nt, Mycobacterium avium subsp. paratuberculosis
cucggcgucggcgcg

SEQ ID NO: 926745 - RNA, 15 nt, Mycobacterium avium subsp. paratuberculosis
cugacgucgaugccg

SEQ ID NO: 926746 - RNA, 13 nt, Mycobacterium avium subsp. paratuberculosis
cugacgucgucgc

SEQ ID NO: 926747 - RNA, 14 nt, Mycobacterium avium subsp. paratuberculosis
cugacgucgucgcc

SEQ ID NO: 926748 - RNA, 21 nt, Mycobacterium avium subsp. paratuberculosis
cugacggcucuucggcgccga

SEQ ID NO: 926749 - RNA, 22 nt, Mycobacterium avium subsp. paratuberculosis
cugacggcucuucggcgccgag

SEQ ID NO: 926750 - RNA, 23 nt, Mycobacterium avium subsp. paratuberculosis
cugacggcucuucggcgccgagc

SEQ ID NO: 926751 - RNA, 18 nt, Mycobacterium avium subsp. paratuberculosis
cugacggcgucguugagc

SEQ ID NO: 926752 - RNA, 22 nt, Mycobacterium avium subsp. paratuberculosis
cugacggcgucguugagcaggc

SEQ ID NO: 926753 - RNA, 14 nt, Mycobacterium avium subsp. paratuberculosis
cugacgggaccgca

SEQ ID NO: 926754 - RNA, 19 nt, Mycobacterium avium subsp. paratuberculosis
cugacgggaccgcacgccg

SEQ ID NO: 926755 - RNA, 22 nt, Mycobacterium avium subsp. paratuberculosis
cugacgggagucgggcccgccc

SEQ ID NO: 926756 - RNA, 20 nt, Mycobacterium avium subsp. paratuberculosis
cugacgggccggcggggugg

SEQ ID NO: 926757 - RNA, 15 nt, Mycobacterium avium subsp. paratuberculosis
cugacgcgaccgcgc

SEQ ID NO: 926758 - RNA, 19 nt, Mycobacterium avium subsp. paratuberculosis
cugacgcgaccgcgcggcg

SEQ ID NO: 926759 - RNA, 15 nt, Mycobacterium avium subsp. paratuberculosis
cugacgccgcggugc

SEQ ID NO: 926760 - RNA, 16 nt, Mycobacterium avium subsp. paratuberculosis
cugacgccgcggugca

SEQ ID NO: 926761 - RNA, 17 nt, Mycobacterium avium subsp. paratuberculosis
cugacgccgcggugcag

SEQ ID NO: 926762 - RNA, 17 nt, Mycobacterium avium subsp. paratuberculosis
cugacgccggucgcugc

SEQ ID NO: 926763 - RNA, 21 nt, Mycobacterium avium subsp. paratuberculosis
cugacgcucggucgccacggc

SEQ ID NO: 926764 - RNA, 12 nt, Mycobacterium avium subsp. paratuberculosis
cugacugccggc

SEQ ID NO: 926765 - RNA, 16 nt, Mycobacterium avium subsp. paratuberculosis
cugacugccggcgacg

SEQ ID NO: 926766 - RNA, 12 nt, Mycobacterium avium subsp. paratuberculosis
cugacugcgauc

SEQ ID NO: 926767 - RNA, 16 nt, Mycobacterium avium subsp. paratuberculosis
cugacugcgaucgccg

SEQ ID NO: 926768 - RNA, 23 nt, Mycobacterium avium subsp. paratuberculosis
cugacuuucuugcugagcugcgc

SEQ ID NO: 926769 - RNA, 21 nt, Mycobacterium avium subsp. paratuberculosis
cugaccgugcuuggcggcgca

SEQ ID NO: 926770 - RNA, 13 nt, Mycobacterium avium subsp. paratuberculosis
cugaccgucggcc

SEQ ID NO: 926771 - RNA, 12 nt, Mycobacterium avium subsp. paratuberculosis
cugaccggcgau

SEQ ID NO: 926772 - RNA, 12 nt, Mycobacterium avium subsp. paratuberculosis
cugaccggcggu

SEQ ID NO: 926773 - RNA, 20 nt, Mycobacterium avium subsp. paratuberculosis
cugaccggcggugccggcca

SEQ ID NO: 926774 - RNA, 16 nt, Mycobacterium avium subsp. paratuberculosis
cugaccggccaccucg

SEQ ID NO: 926775 - RNA, 22 nt, Mycobacterium avium subsp. paratuberculosis
cugacccgggcggccugcugca

SEQ ID NO: 926776 - RNA, 13 nt, Mycobacterium avium subsp. paratuberculosis
cugaccgacggcg

SEQ ID NO: 926777 - RNA, 16 nt, Mycobacterium avium subsp. paratuberculosis
cugaccgacggcgacc

SEQ ID NO: 926778 - RNA, 16 nt, Mycobacterium avium subsp. paratuberculosis
cugacccgcccgggug

SEQ ID NO: 926779 - RNA, 13 nt, Mycobacterium avium subsp. paratuberculosis
cugacccgccgca

SEQ ID NO: 926780 - RNA, 16 nt, Mycobacterium avium subsp. paratuberculosis
cugacccgccgcaaca

SEQ ID NO: 926781 - RNA, 13 nt, Mycobacterium avium subsp. paratuberculosis
cugaccccgguuu

SEQ ID NO: 926782 - RNA, 18 nt, Mycobacterium avium subsp. paratuberculosis
cugaccgagcggcgcugc

SEQ ID NO: 926783 - RNA, 16 nt, Mycobacterium avium subsp. paratuberculosis
cugaccgauggccgcc

SEQ ID NO: 926784 - RNA, 22 nt, Mycobacterium avium subsp. paratuberculosis
cugaccgauggccgcccgcagg

SEQ ID NO: 926785 - RNA, 13 nt, Mycobacterium avium subsp. paratuberculosis
cugaccgccgcgc

SEQ ID NO: 926786 - RNA, 19 nt, Mycobacterium avium subsp. paratuberculosis
cugaccgccgcgcucggcc

SEQ ID NO: 926787 - RNA, 21 nt, Mycobacterium avium subsp. paratuberculosis
cugaccgccgcgcucggccau

SEQ ID NO: 926788 - RNA, 24 nt, Mycobacterium avium subsp. paratuberculosis
cugaccgccgcgcucggccauccg

SEQ ID NO: 926789 - RNA, 14 nt, Mycobacterium avium subsp. paratuberculosis
cugaccgcgggccc

SEQ ID NO: 926790 - RNA, 15 nt, Mycobacterium avium subsp. paratuberculosis
cugaccgcgggcccg

SEQ ID NO: 926791 - RNA, 18 nt, Mycobacterium avium subsp. paratuberculosis
cugaccgcgggcccgccg

SEQ ID NO: 926792 - RNA, 19 nt, Mycobacterium avium subsp. paratuberculosis
cugaccgcgggcccgccgu

SEQ ID NO: 926793 - RNA, 23 nt, Mycobacterium avium subsp. paratuberculosis
cugaccgcgggcccgccguagcg

SEQ ID NO: 926794 - RNA, 19 nt, Mycobacterium avium subsp. paratuberculosis
cugaccuggcugacggcgu

SEQ ID NO: 926795 - RNA, 21 nt, Mycobacterium avium subsp. paratuberculosis
cugaccuggcugacggcgucg

SEQ ID NO: 926796 - RNA, 14 nt, Mycobacterium avium subsp. paratuberculosis
cugaccucgccgcc

SEQ ID NO: 926797 - RNA, 15 nt, Mycobacterium avium subsp. paratuberculosis
cugaccucgccgccc

SEQ ID NO: 926798 - RNA, 16 nt, Mycobacterium avium subsp. paratuberculosis
cugaccucgcgccgcg

SEQ ID NO: 926799 - RNA, 18 nt, Mycobacterium avium subsp. paratuberculosis
cugaccuucucccgcggc

SEQ ID NO: 926800 - RNA, 15 nt, Mycobacterium avium subsp. paratuberculosis
cugacgaacgcgccg

SEQ ID NO: 926801 - RNA, 16 nt, Mycobacterium avium subsp. paratuberculosis
cugacgaacgcgccgc

SEQ ID NO: 926802 - RNA, 14 nt, Mycobacterium avium subsp. paratuberculosis
cugacgaucgucga

SEQ ID NO: 926803 - RNA, 16 nt, Mycobacterium avium subsp. paratuberculosis
cugacgaucgucgacg

SEQ ID NO: 926804 - RNA, 17 nt, Mycobacterium avium subsp. paratuberculosis
cugacgaucgucgacgu

SEQ ID NO: 926805 - RNA, 17 nt, Mycobacterium avium subsp. paratuberculosis
cugacgaugauccuggc

SEQ ID NO: 926806 - RNA, 21 nt, Mycobacterium avium subsp. paratuberculosis
cugacgaugcggccggcgggc

SEQ ID NO: 926807 - RNA, 21 nt, Mycobacterium avium subsp. paratuberculosis
cugacgauggcgaccgcgcag

SEQ ID NO: 926808 - RNA, 19 nt, Mycobacterium avium subsp. paratuberculosis
cugacgcaccucgcucagc

SEQ ID NO: 926809 - RNA, 16 nt, Mycobacterium avium subsp. paratuberculosis
cugagggugucggcga

SEQ ID NO: 926810 - RNA, 16 nt, Mycobacterium avium subsp. paratuberculosis
cugauaggggucggcg

SEQ ID NO: 926811 - RNA, 18 nt, Mycobacterium avium subsp. paratuberculosis
cugauagcccgccgcggc

SEQ ID NO: 926812 - RNA, 20 nt, Mycobacterium avium subsp. paratuberculosis
cugauagcccgccgcggcga

SEQ ID NO: 926813 - RNA, 21 nt, Mycobacterium avium subsp. paratuberculosis
cugauagcccgccgcggcgac

SEQ ID NO: 926814 - RNA, 15 nt, Mycobacterium avium subsp. paratuberculosis
cugaucaccgcgcuc

SEQ ID NO: 926815 - RNA, 19 nt, Mycobacterium avium subsp. paratuberculosis
cugaucaccgcgcucggcg

SEQ ID NO: 926816 - RNA, 19 nt, Mycobacterium avium subsp. paratuberculosis
cugaucaugaagucgcgga

SEQ ID NO: 926817 - RNA, 22 nt, Mycobacterium avium subsp. paratuberculosis
cugaucaugaagucgcggaugc

SEQ ID NO: 926818 - RNA, 18 nt, Mycobacterium avium subsp. paratuberculosis
cugauccccagcggcacg

SEQ ID NO: 926819 - RNA, 18 nt, Mycobacterium avium subsp. paratuberculosis
cugauccgcaggaugccg

SEQ ID NO: 926820 - RNA, 17 nt, Mycobacterium avium subsp. paratuberculosis
cugaucagccggcgagc

SEQ ID NO: 926821 - RNA, 13 nt, Mycobacterium avium subsp. paratuberculosis
cugagcaaccgcc

SEQ ID NO: 926822 - RNA, 18 nt, Mycobacterium avium subsp. paratuberculosis
cugagcaauucggugacg

SEQ ID NO: 926823 - RNA, 24 nt, Mycobacterium avium subsp. paratuberculosis
cugagcaauucggugacggcgucg

SEQ ID NO: 926824 - RNA, 13 nt, Mycobacterium avium subsp. paratuberculosis
cugagcagcucgc

SEQ ID NO: 926825 - RNA, 12 nt, Mycobacterium avium subsp. paratuberculosis
cugagcaggucc

SEQ ID NO: 926826 - RNA, 14 nt, Mycobacterium avium subsp. paratuberculosis
cugagcagcacccg

SEQ ID NO: 926827 - RNA, 21 nt, Mycobacterium avium subsp. paratuberculosis
cugagcagcaggucggcgugc

SEQ ID NO: 926828 - RNA, 16 nt, Mycobacterium avium subsp. paratuberculosis
cugagcagccagucgg

SEQ ID NO: 926829 - RNA, 13 nt, Mycobacterium avium subsp. paratuberculosis
cugagcaccgggg

SEQ ID NO: 926830 - RNA, 18 nt, Mycobacterium avium subsp. paratuberculosis
cugagcccggauuucguc

SEQ ID NO: 926831 - RNA, 11 nt, Mycobacterium avium subsp. paratuberculosis
cugagccgccg

SEQ ID NO: 926832 - RNA, 17 nt, Mycobacterium avium subsp. paratuberculosis
cugagccgccgagccgg

SEQ ID NO: 926833 - RNA, 16 nt, Mycobacterium avium subsp. paratuberculosis
cugagccgccggggcg

SEQ ID NO: 926834 - RNA, 19 nt, Mycobacterium avium subsp. paratuberculosis
cugagccgccggggcgccg

SEQ ID NO: 926835 - RNA, 16 nt, Mycobacterium avium subsp. paratuberculosis
cugagccgcucgucga

SEQ ID NO: 926836 - RNA, 21 nt, Mycobacterium avium subsp. paratuberculosis
cugagccggcccugcggccag

SEQ ID NO: 926837 - RNA, 22 nt, Mycobacterium avium subsp. paratuberculosis
cugaggagacgaucucgccguc

SEQ ID NO: 926838 - RNA, 21 nt, Mycobacterium avium subsp. paratuberculosis
cugaggccgccccggccgcgc

SEQ ID NO: 926839 - RNA, 13 nt, Mycobacterium avium subsp. paratuberculosis
cugagcugcgccc

SEQ ID NO: 926840 - RNA, 15 nt, Mycobacterium avium subsp. paratuberculosis
cugagcugcgcccac

SEQ ID NO: 926841 - RNA, 21 nt, Mycobacterium avium subsp. paratuberculosis
cugagcgucggucucgacguu

SEQ ID NO: 926842 - RNA, 22 nt, Mycobacterium avium subsp. paratuberculosis
cugagcugugccgcggugcggc

SEQ ID NO: 926843 - RNA, 16 nt, Mycobacterium avium subsp. paratuberculosis
cugagcuuuucgucgg

SEQ ID NO: 926844 - RNA, 18 nt, Mycobacterium avium subsp. paratuberculosis
cugagcgggucggccggc

SEQ ID NO: 926845 - RNA, 15 nt, Mycobacterium avium subsp. paratuberculosis
cugagcgggacgcgc

SEQ ID NO: 926846 - RNA, 17 nt, Mycobacterium avium subsp. paratuberculosis
cugagcgggacgcgcag

SEQ ID NO: 926847 - RNA, 13 nt, Mycobacterium avium subsp. paratuberculosis
cugagcgcccggu

SEQ ID NO: 926848 - RNA, 14 nt, Mycobacterium avium subsp. paratuberculosis
cugccaaccgaggc

SEQ ID NO: 926849 - RNA, 19 nt, Mycobacterium avium subsp. paratuberculosis
cugccaagacguccgcguc

SEQ ID NO: 926850 - RNA, 20 nt, Mycobacterium avium subsp. paratuberculosis
cugccaagauugggccacag

SEQ ID NO: 926851 - RNA, 17 nt, Mycobacterium avium subsp. paratuberculosis
cugcauuucggacggcg

SEQ ID NO: 926852 - RNA, 20 nt, Mycobacterium avium subsp. paratuberculosis
cugcauuucggacggcgacg

SEQ ID NO: 926853 - RNA, 15 nt, Mycobacterium avium subsp. paratuberculosis
cugccacgcccaccg

SEQ ID NO: 926854 - RNA, 15 nt, Mycobacterium avium subsp. paratuberculosis
cugccacguacaccg

SEQ ID NO: 926855 - RNA, 15 nt, Mycobacterium avium subsp. paratuberculosis
cugcaugccgggcag

SEQ ID NO: 926856 - RNA, 13 nt, Mycobacterium avium subsp. paratuberculosis
cugcaugccggug

SEQ ID NO: 926857 - RNA, 17 nt, Mycobacterium avium subsp. paratuberculosis
cugcaugccggugucgg

SEQ ID NO: 926858 - RNA, 17 nt, Mycobacterium avium subsp. paratuberculosis
cugcaugccgucgaucu

SEQ ID NO: 926859 - RNA, 17 nt, Mycobacterium avium subsp. paratuberculosis
cugcaucauguccaggu

SEQ ID NO: 926860 - RNA, 12 nt, Mycobacterium avium subsp. paratuberculosis
cugcauccgcag

SEQ ID NO: 926861 - RNA, 13 nt, Mycobacterium avium subsp. paratuberculosis
cugcauccgcagc

SEQ ID NO: 926862 - RNA, 16 nt, Mycobacterium avium subsp. paratuberculosis
cugcaucucgacccgg

SEQ ID NO: 926863 - RNA, 19 nt, Mycobacterium avium subsp. paratuberculosis
cugcaucucgaccuggguc

SEQ ID NO: 926864 - RNA, 22 nt, Mycobacterium avium subsp. paratuberculosis
cugcagugucggaaucggcgcc

SEQ ID NO: 926865 - RNA, 22 nt, Mycobacterium avium subsp. paratuberculosis
cugcaguagccggccagcucga

SEQ ID NO: 926866 - RNA, 21 nt, Mycobacterium avium subsp. paratuberculosis
cugcagguggcccacacgcga

SEQ ID NO: 926867 - RNA, 21 nt, Mycobacterium avium subsp. paratuberculosis
cugcagguagguggccagccg

SEQ ID NO: 926868 - RNA, 23 nt, Mycobacterium avium subsp. paratuberculosis
cugcaggucguaguaggcgccga

SEQ ID NO: 926869 - RNA, 14 nt, Mycobacterium avium subsp. paratuberculosis
cugcagggccgggu

SEQ ID NO: 926870 - RNA, 19 nt, Mycobacterium avium subsp. paratuberculosis
cugcagcuccucggcggcc

SEQ ID NO: 926871 - RNA, 14 nt, Mycobacterium avium subsp. paratuberculosis
cugcagcucgccgg

SEQ ID NO: 926872 - RNA, 17 nt, Mycobacterium avium subsp. paratuberculosis
cugcagcucgcugagcg

SEQ ID NO: 926873 - RNA, 22 nt, Mycobacterium avium subsp. paratuberculosis
cugcagcucgcugagcgggacg

SEQ ID NO: 926874 - RNA, 22 nt, Mycobacterium avium subsp. paratuberculosis
cugcaggaacgccuugaccgcc

SEQ ID NO: 926875 - RNA, 18 nt, Mycobacterium avium subsp. paratuberculosis
cugcagcuucgugucacc

SEQ ID NO: 926876 - RNA, 12 nt, Mycobacterium avium subsp. paratuberculosis
cugcagcgccuu

SEQ ID NO: 926877 - RNA, 18 nt, Mycobacterium avium subsp. paratuberculosis
cugcagcgcgaggcgcag

SEQ ID NO: 926878 - RNA, 14 nt, Mycobacterium avium subsp. paratuberculosis
cugcagcgcggcga

SEQ ID NO: 926879 - RNA, 23 nt, Mycobacterium avium subsp. paratuberculosis
cugcagcgcggcgaucagcugcu

SEQ ID NO: 926880 - RNA, 15 nt, Mycobacterium avium subsp. paratuberculosis
cugcagcgcggucau

SEQ ID NO: 926881 - RNA, 20 nt, Mycobacterium avium subsp. paratuberculosis
cugcagcgcggucaucguca

SEQ ID NO: 926882 - RNA, 13 nt, Mycobacterium avium subsp. paratuberculosis
cugcagcgcggug

SEQ ID NO: 926883 - RNA, 21 nt, Mycobacterium avium subsp. paratuberculosis
cugcagcggaaacgacgucgc

SEQ ID NO: 926884 - RNA, 17 nt, Mycobacterium avium subsp. paratuberculosis
cugcaggcuggucuggu

SEQ ID NO: 926885 - RNA, 16 nt, Mycobacterium avium subsp. paratuberculosis
cugcaggccgagccgc

SEQ ID NO: 926886 - RNA, 18 nt, Mycobacterium avium subsp. paratuberculosis
cugcaggccgagccgccg

SEQ ID NO: 926887 - RNA, 22 nt, Mycobacterium avium subsp. paratuberculosis
cugcaggcccggguagcgcagc

SEQ ID NO: 926888 - RNA, 21 nt, Mycobacterium avium subsp. paratuberculosis
cugcaggcaggccggcagccg

SEQ ID NO: 926889 - RNA, 17 nt, Mycobacterium avium subsp. paratuberculosis
cugccagcgcccgcugc

SEQ ID NO: 926890 - RNA, 15 nt, Mycobacterium avium subsp. paratuberculosis
cugccagcggcgcaa

SEQ ID NO: 926891 - RNA, 17 nt, Mycobacterium avium subsp. paratuberculosis
cugccaguugucgaucu

SEQ ID NO: 926892 - RNA, 16 nt, Mycobacterium avium subsp. paratuberculosis
cugccagggccgggcg

SEQ ID NO: 926893 - RNA, 14 nt, Mycobacterium avium subsp. paratuberculosis
cugccaggcggugg

SEQ ID NO: 926894 - RNA, 23 nt, Mycobacterium avium subsp. paratuberculosis
cugccaggcgguggccgaaccgc

SEQ ID NO: 926895 - RNA, 22 nt, Mycobacterium avium subsp. paratuberculosis
cugcccaaccguuggugcggug

SEQ ID NO: 926896 - RNA, 14 nt, Mycobacterium avium subsp. paratuberculosis
cugcccaacgucga

SEQ ID NO: 926897 - RNA, 16 nt, Mycobacterium avium subsp. paratuberculosis
cugcccaacgucgacu

SEQ ID NO: 926898 - RNA, 14 nt, Mycobacterium avium subsp. paratuberculosis
cugcccaccaccag

SEQ ID NO: 926899 - RNA, 13 nt, Mycobacterium avium subsp. paratuberculosis
cugcccaccagca

SEQ ID NO: 926900 - RNA, 14 nt, Mycobacterium avium subsp. paratuberculosis
cugcccagcgcggu

SEQ ID NO: 926901 - RNA, 18 nt, Mycobacterium avium subsp. paratuberculosis
cugcccagcgcggucgcc

SEQ ID NO: 926902 - RNA, 22 nt, Mycobacterium avium subsp. paratuberculosis
cugcccagcgcggucgccacca

SEQ ID NO: 926903 - RNA, 15 nt, Mycobacterium avium subsp. paratuberculosis
cugcccagcggcacg

SEQ ID NO: 926904 - RNA, 20 nt, Mycobacterium avium subsp. paratuberculosis
cugcccagccaucugcugac

SEQ ID NO: 926905 - RNA, 19 nt, Mycobacterium avium subsp. paratuberculosis
cugcccaggaucaccggga

SEQ ID NO: 926906 - RNA, 19 nt, Mycobacterium avium subsp. paratuberculosis
cugccccacacgcucggcg

SEQ ID NO: 926907 - RNA, 15 nt, Mycobacterium avium subsp. paratuberculosis
cugcccgcgaucgcc

SEQ ID NO: 926908 - RNA, 20 nt, Mycobacterium avium subsp. paratuberculosis
cugcccgcgcaggccccggg

SEQ ID NO: 926909 - RNA, 18 nt, Mycobacterium avium subsp. paratuberculosis
cugcccggaguccggcuc

SEQ ID NO: 926910 - RNA, 14 nt, Mycobacterium avium subsp. paratuberculosis
cugcccggcaaccg

SEQ ID NO: 926911 - RNA, 16 nt, Mycobacterium avium subsp. paratuberculosis
cugcccggccagcagg

SEQ ID NO: 926912 - RNA, 17 nt, Mycobacterium avium subsp. paratuberculosis
cugcccggccagcaggu

SEQ ID NO: 926913 - RNA, 14 nt, Mycobacterium avium subsp. paratuberculosis
cugcccggcgccgg

SEQ ID NO: 926914 - RNA, 17 nt, Mycobacterium avium subsp. paratuberculosis
cugcccgcgacggcgag

SEQ ID NO: 926915 - RNA, 20 nt, Mycobacterium avium subsp. paratuberculosis
cugcccgcgacggcgagccg

SEQ ID NO: 926916 - RNA, 20 nt, Mycobacterium avium subsp. paratuberculosis
cugcccgcgacugucggcgc

SEQ ID NO: 926917 - RNA, 14 nt, Mycobacterium avium subsp. paratuberculosis
cugcccgcccgaga

SEQ ID NO: 926918 - RNA, 14 nt, Mycobacterium avium subsp. paratuberculosis
cugcccgccgccga

SEQ ID NO: 926919 - RNA, 16 nt, Mycobacterium avium subsp. paratuberculosis
cugcccgccgcggccg

SEQ ID NO: 926920 - RNA, 16 nt, Mycobacterium avium subsp. paratuberculosis
cugcccgccgcggugc

SEQ ID NO: 926921 - RNA, 15 nt, Mycobacterium avium subsp. paratuberculosis
cugcccgccgcguac

SEQ ID NO: 926922 - RNA, 14 nt, Mycobacterium avium subsp. paratuberculosis
cugcccgcggccgc

SEQ ID NO: 926923 - RNA, 15 nt, Mycobacterium avium subsp. paratuberculosis
cugcccgcggccgcc

SEQ ID NO: 926924 - RNA, 17 nt, Mycobacterium avium subsp. paratuberculosis
cugcccgcggccgccgc

SEQ ID NO: 926925 - RNA, 19 nt, Mycobacterium avium subsp. paratuberculosis
cugcccgcggccgccgccg

SEQ ID NO: 926926 - RNA, 20 nt, Mycobacterium avium subsp. paratuberculosis
cugcccgcggguggccuuca

SEQ ID NO: 926927 - RNA, 20 nt, Mycobacterium avium subsp. paratuberculosis
cugccccagccacagccgca

SEQ ID NO: 926928 - RNA, 14 nt, Mycobacterium avium subsp. paratuberculosis
cugccccuucgcga

SEQ ID NO: 926929 - RNA, 16 nt, Mycobacterium avium subsp. paratuberculosis
cugccccuucgcgaca

SEQ ID NO: 926930 - RNA, 15 nt, Mycobacterium avium subsp. paratuberculosis
cugcccgauggugaa

SEQ ID NO: 926931 - RNA, 23 nt, Mycobacterium avium subsp. paratuberculosis
cugcccgacccgcaccaccgccc

SEQ ID NO: 926932 - RNA, 24 nt, Mycobacterium avium subsp. paratuberculosis
cugcccgacccgcaccaccgcccg

SEQ ID NO: 926933 - RNA, 16 nt, Mycobacterium avium subsp. paratuberculosis
cugcccgaccgcgccg

SEQ ID NO: 926934 - RNA, 12 nt, Mycobacterium avium subsp. paratuberculosis
cugcccgaccug

SEQ ID NO: 926935 - RNA, 13 nt, Mycobacterium avium subsp. paratuberculosis
cugcccgaccuga

SEQ ID NO: 926936 - RNA, 13 nt, Mycobacterium avium subsp. paratuberculosis
cugccccggcgaa

SEQ ID NO: 926937 - RNA, 17 nt, Mycobacterium avium subsp. paratuberculosis
cugccccggcgaacgcc

SEQ ID NO: 926938 - RNA, 22 nt, Mycobacterium avium subsp. paratuberculosis
cugauugcccuuggacaccugc

SEQ ID NO: 926939 - RNA, 20 nt, Mycobacterium avium subsp. paratuberculosis
cugauucgcgguggcgaacu

SEQ ID NO: 926940 - RNA, 20 nt, Mycobacterium avium subsp. paratuberculosis
cugcaacaacuucgggguga

SEQ ID NO: 926941 - RNA, 16 nt, Mycobacterium avium subsp. paratuberculosis
cugcaacggcuggcgc

SEQ ID NO: 926942 - RNA, 16 nt, Mycobacterium avium subsp. paratuberculosis
cugcaacgcgucggcg

SEQ ID NO: 926943 - RNA, 18 nt, Mycobacterium avium subsp. paratuberculosis
cugcaacgcgucggcgcc

SEQ ID NO: 926944 - RNA, 21 nt, Mycobacterium avium subsp. paratuberculosis
cugcaaccgguccgccgucgg

SEQ ID NO: 926945 - RNA, 22 nt, Mycobacterium avium subsp. paratuberculosis
cugcaacuggucgugcagcacc

SEQ ID NO: 926946 - RNA, 17 nt, Mycobacterium avium subsp. paratuberculosis
cugcaagaacccgaacg

SEQ ID NO: 926947 - RNA, 17 nt, Mycobacterium avium subsp. paratuberculosis
cugaucaccacggucag

SEQ ID NO: 926948 - RNA, 20 nt, Mycobacterium avium subsp. paratuberculosis
cugaucgcccagcaccgcga

SEQ ID NO: 926949 - RNA, 16 nt, Mycobacterium avium subsp. paratuberculosis
cugaucgccgcuugca

SEQ ID NO: 926950 - RNA, 23 nt, Mycobacterium avium subsp. paratuberculosis
cugaucgcgauccgggcgccggc

SEQ ID NO: 926951 - RNA, 13 nt, Mycobacterium avium subsp. paratuberculosis
cugaucgcggccg

SEQ ID NO: 926952 - RNA, 14 nt, Mycobacterium avium subsp. paratuberculosis
cugaucgcggccgg

SEQ ID NO: 926953 - RNA, 17 nt, Mycobacterium avium subsp. paratuberculosis
cugaucgcggccggcga

SEQ ID NO: 926954 - RNA, 22 nt, Mycobacterium avium subsp. paratuberculosis
cugaucgcggccggcgagucgc

SEQ ID NO: 926955 - RNA, 20 nt, Mycobacterium avium subsp. paratuberculosis
cugaucgcggcgagcagcgc

SEQ ID NO: 926956 - RNA, 19 nt, Mycobacterium avium subsp. paratuberculosis
cugaucgcgucgacggcgc

SEQ ID NO: 926957 - RNA, 21 nt, Mycobacterium avium subsp. paratuberculosis
cugaucgcgucgacggcgccg

SEQ ID NO: 926958 - RNA, 14 nt, Mycobacterium avium subsp. paratuberculosis
cugaucggcguugg

SEQ ID NO: 926959 - RNA, 21 nt, Mycobacterium avium subsp. paratuberculosis
cugaucggggcccaccccgga

SEQ ID NO: 926960 - RNA, 20 nt, Mycobacterium avium subsp. paratuberculosis
cugaucgggugagacggcca

SEQ ID NO: 926961 - RNA, 14 nt, Mycobacterium avium subsp. paratuberculosis
cugaucucggcggu

SEQ ID NO: 926962 - RNA, 21 nt, Mycobacterium avium subsp. paratuberculosis
cugaucucggcggucugucgc

SEQ ID NO: 926963 - RNA, 22 nt, Mycobacterium avium subsp. paratuberculosis
cugaucuucgagacacgcgccg

SEQ ID NO: 926964 - RNA, 14 nt, Mycobacterium avium subsp. paratuberculosis
cugaugaagccgcc

SEQ ID NO: 926965 - RNA, 15 nt, Mycobacterium avium subsp. paratuberculosis
cugaugaagccgccg

SEQ ID NO: 926966 - RNA, 15 nt, Mycobacterium avium subsp. paratuberculosis
cugaugcggacacca

SEQ ID NO: 926967 - RNA, 15 nt, Mycobacterium avium subsp. paratuberculosis
cugaugguggcgcgc

SEQ ID NO: 926968 - RNA, 18 nt, Mycobacterium avium subsp. paratuberculosis
cugaugcccucgccgguc

SEQ ID NO: 926969 - RNA, 12 nt, Mycobacterium avium subsp. paratuberculosis
cugaugccgccg

SEQ ID NO: 926970 - RNA, 17 nt, Mycobacterium avium subsp. paratuberculosis
cugaugccgccgaagcg

SEQ ID NO: 926971 - RNA, 17 nt, Mycobacterium avium subsp. paratuberculosis
cugaugcgcaacagcau

SEQ ID NO: 926972 - RNA, 17 nt, Mycobacterium avium subsp. paratuberculosis
cugcacuaccccgucga

SEQ ID NO: 926973 - RNA, 15 nt, Mycobacterium avium subsp. paratuberculosis
cugcacggccucggu

SEQ ID NO: 926974 - RNA, 20 nt, Mycobacterium avium subsp. paratuberculosis
cugcacguccucgucggucc

SEQ ID NO: 926975 - RNA, 22 nt, Mycobacterium avium subsp. paratuberculosis
cugcacguccuugggcuccucg

SEQ ID NO: 926976 - RNA, 17 nt, Mycobacterium avium subsp. paratuberculosis
cugcacgucgccggcga

SEQ ID NO: 926977 - RNA, 18 nt, Mycobacterium avium subsp. paratuberculosis
cugcacgucgccggcgac

SEQ ID NO: 926978 - RNA, 14 nt, Mycobacterium avium subsp. paratuberculosis
cugcacgucggcgg

SEQ ID NO: 926979 - RNA, 15 nt, Mycobacterium avium subsp. paratuberculosis
cugcacgucggcggc

SEQ ID NO: 926980 - RNA, 15 nt, Mycobacterium avium subsp. paratuberculosis
cugcacgucacgggc

SEQ ID NO: 926981 - RNA, 23 nt, Mycobacterium avium subsp. paratuberculosis
cugcacgggcguguaguccaggu

SEQ ID NO: 926982 - RNA, 23 nt, Mycobacterium avium subsp. paratuberculosis
cugcacggggugcgugacgggcu

SEQ ID NO: 926983 - RNA, 14 nt, Mycobacterium avium subsp. paratuberculosis
cugcacggugccgc

SEQ ID NO: 926984 - RNA, 15 nt, Mycobacterium avium subsp. paratuberculosis
cugcacggugcgccg

SEQ ID NO: 926985 - RNA, 17 nt, Mycobacterium avium subsp. paratuberculosis
cugcacggugcgccggc

SEQ ID NO: 926986 - RNA, 13 nt, Mycobacterium avium subsp. paratuberculosis
cugcacgcuguug

SEQ ID NO: 926987 - RNA, 18 nt, Mycobacterium avium subsp. paratuberculosis
cugcacgcacggcgaacg

SEQ ID NO: 926988 - RNA, 22 nt, Mycobacterium avium subsp. paratuberculosis
cugcacgcacggcgaacggccg

SEQ ID NO: 926989 - RNA, 22 nt, Mycobacterium avium subsp. paratuberculosis
cugcacgcugcgcacccggucc

SEQ ID NO: 926990 - RNA, 13 nt, Mycobacterium avium subsp. paratuberculosis
cugcacgcgcggg

SEQ ID NO: 926991 - RNA, 22 nt, Mycobacterium avium subsp. paratuberculosis
cugcacgcgcgggucgucggcc

SEQ ID NO: 926992 - RNA, 17 nt, Mycobacterium avium subsp. paratuberculosis
cugcagauaggacccgg

SEQ ID NO: 926993 - RNA, 18 nt, Mycobacterium avium subsp. paratuberculosis
cugcagauaggacccggc

SEQ ID NO: 926994 - RNA, 21 nt, Mycobacterium avium subsp. paratuberculosis
cugcagcaccgaaccggcggg

SEQ ID NO: 926995 - RNA, 17 nt, Mycobacterium avium subsp. paratuberculosis
cugcagauccgcucgcc

SEQ ID NO: 926996 - RNA, 18 nt, Mycobacterium avium subsp. paratuberculosis
cugcagauccgcucgccg

SEQ ID NO: 926997 - RNA, 14 nt, Mycobacterium avium subsp. paratuberculosis
cugcagcagcccga

SEQ ID NO: 926998 - RNA, 12 nt, Mycobacterium avium subsp. paratuberculosis
cugcagcagccg

SEQ ID NO: 926999 - RNA, 14 nt, Mycobacterium avium subsp. paratuberculosis
cugcagcagcgacu

SEQ ID NO: 927000 - RNA, 19 nt, Mycobacterium avium subsp. paratuberculosis
cugcagcauuuccgagcga

SEQ ID NO: 927001 - RNA, 14 nt, Mycobacterium avium subsp. paratuberculosis
cugcagccggccgg

SEQ ID NO: 927002 - RNA, 12 nt, Mycobacterium avium subsp. paratuberculosis
cugcagccgggc

SEQ ID NO: 927003 - RNA, 14 nt, Mycobacterium avium subsp. paratuberculosis
cugcagccgggugg

SEQ ID NO: 927004 - RNA, 23 nt, Mycobacterium avium subsp. paratuberculosis
cugcagcccgaucucgcggucga

SEQ ID NO: 927005 - RNA, 13 nt, Mycobacterium avium subsp. paratuberculosis
cugcagcgacugg

SEQ ID NO: 927006 - RNA, 17 nt, Mycobacterium avium subsp. paratuberculosis
cugcagcgcccgggcca

SEQ ID NO: 927007 - RNA, 19 nt, Mycobacterium avium subsp. paratuberculosis
cugcagcgccgaggccagc

SEQ ID NO: 927008 - RNA, 20 nt, Mycobacterium avium subsp. paratuberculosis
cugcagcgccgaggccagca

SEQ ID NO: 927009 - RNA, 17 nt, Mycobacterium avium subsp. paratuberculosis
cugcacccgggucaggu

SEQ ID NO: 927010 - RNA, 20 nt, Mycobacterium avium subsp. paratuberculosis
cugcacccucugccacggcg

SEQ ID NO: 927011 - RNA, 22 nt, Mycobacterium avium subsp. paratuberculosis
cugcacccucugccacggcgga

SEQ ID NO: 927012 - RNA, 17 nt, Mycobacterium avium subsp. paratuberculosis
cugcaccagggcgucga

SEQ ID NO: 927013 - RNA, 14 nt, Mycobacterium avium subsp. paratuberculosis
cugcacccaccggc

SEQ ID NO: 927014 - RNA, 18 nt, Mycobacterium avium subsp. paratuberculosis
cugcacccaccggcccag

SEQ ID NO: 927015 - RNA, 15 nt, Mycobacterium avium subsp. paratuberculosis
cugcacccaccggcg

SEQ ID NO: 927016 - RNA, 19 nt, Mycobacterium avium subsp. paratuberculosis
cugcaccggggccggcggg

SEQ ID NO: 927017 - RNA, 20 nt, Mycobacterium avium subsp. paratuberculosis
cugcaccgacuccuugggca

SEQ ID NO: 927018 - RNA, 13 nt, Mycobacterium avium subsp. paratuberculosis
cugcaccggcgac

SEQ ID NO: 927019 - RNA, 14 nt, Mycobacterium avium subsp. paratuberculosis
cugcaccggcgacg

SEQ ID NO: 927020 - RNA, 16 nt, Mycobacterium avium subsp. paratuberculosis
cugcaccggcgacggc

SEQ ID NO: 927021 - RNA, 17 nt, Mycobacterium avium subsp. paratuberculosis
cugcaccggcgacggcg

SEQ ID NO: 927022 - RNA, 14 nt, Mycobacterium avium subsp. paratuberculosis
cugcacgaugccga

SEQ ID NO: 927023 - RNA, 17 nt, Mycobacterium avium subsp. paratuberculosis
cugcacgaugccgacca

SEQ ID NO: 927024 - RNA, 19 nt, Mycobacterium avium subsp. paratuberculosis
cugcacgaugccgaccaac

SEQ ID NO: 927025 - RNA, 18 nt, Mycobacterium avium subsp. paratuberculosis
cugcacgaagucgaccgc

SEQ ID NO: 927026 - RNA, 21 nt, Mycobacterium avium subsp. paratuberculosis
cugcacgacgaacaccaccgg

SEQ ID NO: 927027 - RNA, 22 nt, Mycobacterium avium subsp. paratuberculosis
cugcacgacgaacaccaccggc

SEQ ID NO: 927028 - RNA, 17 nt, Mycobacterium avium subsp. paratuberculosis
cugcacgacgaccgcga

SEQ ID NO: 927029 - RNA, 22 nt, Mycobacterium avium subsp. paratuberculosis
cugcacgacgaccgcgacggcg

SEQ ID NO: 927030 - RNA, 20 nt, Mycobacterium avium subsp. paratuberculosis
cugcacgaaauaaccgcgcg

SEQ ID NO: 927031 - RNA, 23 nt, Mycobacterium avium subsp. paratuberculosis
cugcacgaaauaaccgcgcggcg

SEQ ID NO: 927032 - RNA, 17 nt, Mycobacterium avium subsp. paratuberculosis
cugcaccuugcccgucg

SEQ ID NO: 927033 - RNA, 18 nt, Mycobacterium avium subsp. paratuberculosis
cugcaccguuuccggugc

SEQ ID NO: 927034 - RNA, 16 nt, Mycobacterium avium subsp. paratuberculosis
cugcaccagcacgaca

SEQ ID NO: 927035 - RNA, 16 nt, Mycobacterium avium subsp. paratuberculosis
cugcaccagcccgucg

SEQ ID NO: 927036 - RNA, 19 nt, Mycobacterium avium subsp. paratuberculosis
cugcaccagcggcgcccac

SEQ ID NO: 927037 - RNA, 16 nt, Mycobacterium avium subsp. paratuberculosis
cugcaccagcguggug

SEQ ID NO: 927038 - RNA, 17 nt, Mycobacterium avium subsp. paratuberculosis
cugcaccagcguggugc

SEQ ID NO: 927039 - RNA, 12 nt, Mycobacterium avium subsp. paratuberculosis
cugcaccagcuc

SEQ ID NO: 927040 - RNA, 19 nt, Mycobacterium avium subsp. paratuberculosis
cugcaccagcucggugauc

SEQ ID NO: 927041 - RNA, 23 nt, Mycobacterium avium subsp. paratuberculosis
cugcacagcuucggcgccgagca

SEQ ID NO: 927042 - RNA, 19 nt, Mycobacterium avium subsp. paratuberculosis
cugcacacgggcccguccg

SEQ ID NO: 927043 - RNA, 23 nt, Mycobacterium avium subsp. paratuberculosis
cugcaaggcccccgccucgccgg

SEQ ID NO: 927044 - RNA, 17 nt, Mycobacterium avium subsp. paratuberculosis
aaccgaccgccgcggcc

SEQ ID NO: 927045 - RNA, 16 nt, Mycobacterium avium subsp. paratuberculosis
cgugaccccggcgacc

SEQ ID NO: 927046 - RNA, 19 nt, Mycobacterium avium subsp. paratuberculosis
cgugaccccggcgaccagc

SEQ ID NO: 927047 - RNA, 14 nt, Mycobacterium avium subsp. paratuberculosis
cgugacccgccgug

SEQ ID NO: 927048 - RNA, 20 nt, Mycobacterium avium subsp. paratuberculosis
aaccgaagggaaaggcagca

SEQ ID NO: 927049 - RNA, 19 nt, Mycobacterium avium subsp. paratuberculosis
cgugaaguuaguuucacgc

SEQ ID NO: 927050 - RNA, 22 nt, Mycobacterium avium subsp. paratuberculosis
cgugaauccucagcacggccgc

SEQ ID NO: 927051 - RNA, 20 nt, Mycobacterium avium subsp. paratuberculosis
cgugaagcuagcuucacgcu

SEQ ID NO: 927052 - RNA, 21 nt, Mycobacterium avium subsp. paratuberculosis
cgugaagcuagcuucacgcuc

SEQ ID NO: 927053 - RNA, 19 nt, Mycobacterium avium subsp. paratuberculosis
cgugaagcuaguuucacgc

SEQ ID NO: 927054 - RNA, 19 nt, Mycobacterium avium subsp. paratuberculosis
cgugaagcuaguuucacgu

SEQ ID NO: 927055 - RNA, 20 nt, Mycobacterium avium subsp. paratuberculosis
cgugaagcuaguuucacguu

SEQ ID NO: 927056 - RNA, 15 nt, Mycobacterium avium subsp. paratuberculosis
cgugaagggcccgcc

SEQ ID NO: 927057 - RNA, 19 nt, Mycobacterium avium subsp. paratuberculosis
cgugaagggcccgccggug

SEQ ID NO: 927058 - RNA, 22 nt, Mycobacterium avium subsp. paratuberculosis
cgugaagggguccggaagcccu

SEQ ID NO: 927059 - RNA, 22 nt, Mycobacterium avium subsp. paratuberculosis
cgugaacugugcggugcggcuu

SEQ ID NO: 927060 - RNA, 21 nt, Mycobacterium avium subsp. paratuberculosis
cgugaacuuaacuucacgcuc

SEQ ID NO: 927061 - RNA, 15 nt, Mycobacterium avium subsp. paratuberculosis
cgugaagaucagcga

SEQ ID NO: 927062 - RNA, 18 nt, Mycobacterium avium subsp. paratuberculosis
cgugaaucuuggccagca

SEQ ID NO: 927063 - RNA, 21 nt, Mycobacterium avium subsp. paratuberculosis
cgugaaucuuggccagcagcg

SEQ ID NO: 927064 - RNA, 23 nt, Mycobacterium avium subsp. paratuberculosis
cgugaauggguguaacgcgucga

SEQ ID NO: 927065 - RNA, 19 nt, Mycobacterium avium subsp. paratuberculosis
cgugaauucggccgggucc

SEQ ID NO: 927066 - RNA, 22 nt, Mycobacterium avium subsp. paratuberculosis
cgugaccaaugcggugaacgcg

SEQ ID NO: 927067 - RNA, 22 nt, Mycobacterium avium subsp. paratuberculosis
cgugacaggguaacccgggacc

SEQ ID NO: 927068 - RNA, 18 nt, Mycobacterium avium subsp. paratuberculosis
cgugacagucgaccucgc

SEQ ID NO: 927069 - RNA, 19 nt, Mycobacterium avium subsp. paratuberculosis
cgugacagucgaccucgcg

SEQ ID NO: 927070 - RNA, 15 nt, Mycobacterium avium subsp. paratuberculosis
cgucuuggacgcccg

SEQ ID NO: 927071 - RNA, 17 nt, Mycobacterium avium subsp. paratuberculosis
cgucuuggacgcccgcg

SEQ ID NO: 927072 - RNA, 21 nt, Mycobacterium avium subsp. paratuberculosis
cgucuuggacgcccgcgaccc

SEQ ID NO: 927073 - RNA, 17 nt, Mycobacterium avium subsp. paratuberculosis
cgucuugcccggcgagc

SEQ ID NO: 927074 - RNA, 20 nt, Mycobacterium avium subsp. paratuberculosis
cgucuugaucucggcggcga

SEQ ID NO: 927075 - RNA, 15 nt, Mycobacterium avium subsp. paratuberculosis
cgucuugcagccggg

SEQ ID NO: 927076 - RNA, 13 nt, Mycobacterium avium subsp. paratuberculosis
cgucuugcggccc

SEQ ID NO: 927077 - RNA, 19 nt, Mycobacterium avium subsp. paratuberculosis
cgucuuggucucgccgauc

SEQ ID NO: 927078 - RNA, 22 nt, Mycobacterium avium subsp. paratuberculosis
cgucuuggugugugcgucggca

SEQ ID NO: 927079 - RNA, 14 nt, Mycobacterium avium subsp. paratuberculosis
cgucuugucgggga

SEQ ID NO: 927080 - RNA, 19 nt, Mycobacterium avium subsp. paratuberculosis
cgucuugugcccguugccc

SEQ ID NO: 927081 - RNA, 20 nt, Mycobacterium avium subsp. paratuberculosis
cgugaaacuaacuucacgcu

SEQ ID NO: 927082 - RNA, 23 nt, Mycobacterium avium subsp. paratuberculosis
cgugaaacuaacuucacgcucgc

SEQ ID NO: 927083 - RNA, 19 nt, Mycobacterium avium subsp. paratuberculosis
cgugaaacuagcuucacgc

SEQ ID NO: 927084 - RNA, 19 nt, Mycobacterium avium subsp. paratuberculosis
cgucuuuucccacacgcuc

SEQ ID NO: 927085 - RNA, 22 nt, Mycobacterium avium subsp. paratuberculosis
cgucuuuucccacacgcucggc

SEQ ID NO: 927086 - RNA, 21 nt, Mycobacterium avium subsp. paratuberculosis
cgugaacgacgccguucaggu

SEQ ID NO: 927087 - RNA, 17 nt, Mycobacterium avium subsp. paratuberculosis
cgucugggccgccgagc

SEQ ID NO: 927088 - RNA, 17 nt, Mycobacterium avium subsp. paratuberculosis
cgucugguuggccggcg

SEQ ID NO: 927089 - RNA, 20 nt, Mycobacterium avium subsp. paratuberculosis
cgucuucuucucgccguccc

SEQ ID NO: 927090 - RNA, 19 nt, Mycobacterium avium subsp. paratuberculosis
cgucuucuuggccgcggcc

SEQ ID NO: 927091 - RNA, 20 nt, Mycobacterium avium subsp. paratuberculosis
cgucuucuuggccgcggccu

SEQ ID NO: 927092 - RNA, 18 nt, Mycobacterium avium subsp. paratuberculosis
cgucuucuucagccgcag

SEQ ID NO: 927093 - RNA, 16 nt, Mycobacterium avium subsp. paratuberculosis
cgucuucggggccgcc

SEQ ID NO: 927094 - RNA, 17 nt, Mycobacterium avium subsp. paratuberculosis
cgucuucggggccgccg

SEQ ID NO: 927095 - RNA, 14 nt, Mycobacterium avium subsp. paratuberculosis
cgucugcggcucgg

SEQ ID NO: 927096 - RNA, 16 nt, Mycobacterium avium subsp. paratuberculosis
cgucugcggcucggcg

SEQ ID NO: 927097 - RNA, 22 nt, Mycobacterium avium subsp. paratuberculosis
cgucugcgggaagcccaccgcg

SEQ ID NO: 927098 - RNA, 23 nt, Mycobacterium avium subsp. paratuberculosis
cgucugcgggaagcccaccgcgg

SEQ ID NO: 927099 - RNA, 15 nt, Mycobacterium avium subsp. paratuberculosis
cgucugcgccccggc

SEQ ID NO: 927100 - RNA, 14 nt, Mycobacterium avium subsp. paratuberculosis
cgucugcgccguca

SEQ ID NO: 927101 - RNA, 20 nt, Mycobacterium avium subsp. paratuberculosis
cgucugcgccgucaccggcu

SEQ ID NO: 927102 - RNA, 23 nt, Mycobacterium avium subsp. paratuberculosis
cgucugccuugcugacgccgcgg

SEQ ID NO: 927103 - RNA, 18 nt, Mycobacterium avium subsp. paratuberculosis
cgucugccaaggugcggu

SEQ ID NO: 927104 - RNA, 22 nt, Mycobacterium avium subsp. paratuberculosis
cgucugcucgccgucacaccgc

SEQ ID NO: 927105 - RNA, 14 nt, Mycobacterium avium subsp. paratuberculosis
cgucugcucgcgcc

SEQ ID NO: 927106 - RNA, 13 nt, Mycobacterium avium subsp. paratuberculosis
cgucugcucggcg

SEQ ID NO: 927107 - RNA, 15 nt, Mycobacterium avium subsp. paratuberculosis
cgucugcucggcggg

SEQ ID NO: 927108 - RNA, 17 nt, Mycobacterium avium subsp. paratuberculosis
cgucugcugcgccaucu

SEQ ID NO: 927109 - RNA, 13 nt, Mycobacterium avium subsp. paratuberculosis
cgucuggccaccg

SEQ ID NO: 927110 - RNA, 22 nt, Mycobacterium avium subsp. paratuberculosis
cgucuggccaccgaagccgacg

SEQ ID NO: 927111 - RNA, 16 nt, Mycobacterium avium subsp. paratuberculosis
cgucuggccggagcgg

SEQ ID NO: 927112 - RNA, 18 nt, Mycobacterium avium subsp. paratuberculosis
cgucuggccggagcggug

SEQ ID NO: 927113 - RNA, 13 nt, Mycobacterium avium subsp. paratuberculosis
cgucuggccguug

SEQ ID NO: 927114 - RNA, 21 nt, Mycobacterium avium subsp. paratuberculosis
cgucgugucguguucgccgag

SEQ ID NO: 927115 - RNA, 13 nt, Mycobacterium avium subsp. paratuberculosis
cgucguugcgggc

SEQ ID NO: 927116 - RNA, 17 nt, Mycobacterium avium subsp. paratuberculosis
cgucguugcgggcggcg

SEQ ID NO: 927117 - RNA, 16 nt, Mycobacterium avium subsp. paratuberculosis
cgucguucucgggggc

SEQ ID NO: 927118 - RNA, 14 nt, Mycobacterium avium subsp. paratuberculosis
cgucguugaacgcg

SEQ ID NO: 927119 - RNA, 17 nt, Mycobacterium avium subsp. paratuberculosis
cgucguugaacgcgcgg

SEQ ID NO: 927120 - RNA, 14 nt, Mycobacterium avium subsp. paratuberculosis
cgucguugaccgag

SEQ ID NO: 927121 - RNA, 22 nt, Mycobacterium avium subsp. paratuberculosis
cgucguugaccgaggcgaucgc

SEQ ID NO: 927122 - RNA, 23 nt, Mycobacterium avium subsp. paratuberculosis
cgucguugaccgaggcgaucgcg

SEQ ID NO: 927123 - RNA, 15 nt, Mycobacterium avium subsp. paratuberculosis
cgucguugaccugcu

SEQ ID NO: 927124 - RNA, 22 nt, Mycobacterium avium subsp. paratuberculosis
cgucguugagcaggcuggagua

SEQ ID NO: 927125 - RNA, 15 nt, Mycobacterium avium subsp. paratuberculosis
cgucguugagcauca

SEQ ID NO: 927126 - RNA, 15 nt, Mycobacterium avium subsp. paratuberculosis
cgucucugucgucga

SEQ ID NO: 927127 - RNA, 16 nt, Mycobacterium avium subsp. paratuberculosis
cgucucugucgucgac

SEQ ID NO: 927128 - RNA, 17 nt, Mycobacterium avium subsp. paratuberculosis
cgucucugucgucgacc

SEQ ID NO: 927129 - RNA, 18 nt, Mycobacterium avium subsp. paratuberculosis
cgucucuuccucgggcag

SEQ ID NO: 927130 - RNA, 16 nt, Mycobacterium avium subsp. paratuberculosis
cgucguuggcgccguc

SEQ ID NO: 927131 - RNA, 13 nt, Mycobacterium avium subsp. paratuberculosis
cgucguuggcccg

SEQ ID NO: 927132 - RNA, 16 nt, Mycobacterium avium subsp. paratuberculosis
cgucguuggcccgccg

SEQ ID NO: 927133 - RNA, 17 nt, Mycobacterium avium subsp. paratuberculosis
cgucguuggcccgccgc

SEQ ID NO: 927134 - RNA, 20 nt, Mycobacterium avium subsp. paratuberculosis
cgucguuggcccgccgcggc

SEQ ID NO: 927135 - RNA, 22 nt, Mycobacterium avium subsp. paratuberculosis
cgucguugucgucgccggccgc

SEQ ID NO: 927136 - RNA, 23 nt, Mycobacterium avium subsp. paratuberculosis
cgucguugugggccagcgcggug

SEQ ID NO: 927137 - RNA, 18 nt, Mycobacterium avium subsp. paratuberculosis
cgucguuguuggcggcgg

SEQ ID NO: 927138 - RNA, 19 nt, Mycobacterium avium subsp. paratuberculosis
cgucucgucggccgcgacg

SEQ ID NO: 927139 - RNA, 16 nt, Mycobacterium avium subsp. paratuberculosis
cgucggcaacgccggg

SEQ ID NO: 927140 - RNA, 19 nt, Mycobacterium avium subsp. paratuberculosis
cgucggcaacgccgggucc

SEQ ID NO: 927141 - RNA, 18 nt, Mycobacterium avium subsp. paratuberculosis
cgucggcaaugaccggca

SEQ ID NO: 927142 - RNA, 20 nt, Mycobacterium avium subsp. paratuberculosis
cgucggcaaugaccggcacc

SEQ ID NO: 927143 - RNA, 21 nt, Mycobacterium avium subsp. paratuberculosis
cgucggcaaugaccggcacca

SEQ ID NO: 927144 - RNA, 16 nt, Mycobacterium avium subsp. paratuberculosis
cgucggcaccagcggc

SEQ ID NO: 927145 - RNA, 23 nt, Mycobacterium avium subsp. paratuberculosis
cgucggcaccagcggcaucgccg

SEQ ID NO: 927146 - RNA, 18 nt, Mycobacterium avium subsp. paratuberculosis
cgucggcagcgacgcggu

SEQ ID NO: 927147 - RNA, 20 nt, Mycobacterium avium subsp. paratuberculosis
cgucggcaguugcacuuucg

SEQ ID NO: 927148 - RNA, 16 nt, Mycobacterium avium subsp. paratuberculosis
cgucggcauccacccg

SEQ ID NO: 927149 - RNA, 18 nt, Mycobacterium avium subsp. paratuberculosis
cgucggcauccacccguu

SEQ ID NO: 927150 - RNA, 15 nt, Mycobacterium avium subsp. paratuberculosis
cgucgucgacccgcu

SEQ ID NO: 927151 - RNA, 14 nt, Mycobacterium avium subsp. paratuberculosis
cgucgucgaccguc

SEQ ID NO: 927152 - RNA, 13 nt, Mycobacterium avium subsp. paratuberculosis
cgucgucgccgau

SEQ ID NO: 927153 - RNA, 14 nt, Mycobacterium avium subsp. paratuberculosis
cgucgucgccgaug

SEQ ID NO: 927154 - RNA, 22 nt, Mycobacterium avium subsp. paratuberculosis
cgucgucgccgaugcgccgcac

SEQ ID NO: 927155 - RNA, 15 nt, Mycobacterium avium subsp. paratuberculosis
cgucgucgccgccgg

SEQ ID NO: 927156 - RNA, 13 nt, Mycobacterium avium subsp. paratuberculosis
cgucgucgccggg

SEQ ID NO: 927157 - RNA, 12 nt, Mycobacterium avium subsp. paratuberculosis
cgucgucgccgu

SEQ ID NO: 927158 - RNA, 13 nt, Mycobacterium avium subsp. paratuberculosis
cgucgucgaugcg

SEQ ID NO: 927159 - RNA, 20 nt, Mycobacterium avium subsp. paratuberculosis
cgucgucgaugcgcagcagc

SEQ ID NO: 927160 - RNA, 15 nt, Mycobacterium avium subsp. paratuberculosis
cgucgucgcaccggc

SEQ ID NO: 927161 - RNA, 12 nt, Mycobacterium avium subsp. paratuberculosis
cgucgucgacgu

SEQ ID NO: 927162 - RNA, 12 nt, Mycobacterium avium subsp. paratuberculosis
cgucgucgagca

SEQ ID NO: 927163 - RNA, 13 nt, Mycobacterium avium subsp. paratuberculosis
cgucgucgagccg

SEQ ID NO: 927164 - RNA, 17 nt, Mycobacterium avium subsp. paratuberculosis
cgucgucgagccgcucg

SEQ ID NO: 927165 - RNA, 17 nt, Mycobacterium avium subsp. paratuberculosis
cgucgucgaggcggauc

SEQ ID NO: 927166 - RNA, 21 nt, Mycobacterium avium subsp. paratuberculosis
cgucgucgaugaacaucgccg

SEQ ID NO: 927167 - RNA, 23 nt, Mycobacterium avium subsp. paratuberculosis
cgucgucgaaggccuggaacacc

SEQ ID NO: 927168 - RNA, 22 nt, Mycobacterium avium subsp. paratuberculosis
cgucguggguauccgccgccag

SEQ ID NO: 927169 - RNA, 21 nt, Mycobacterium avium subsp. paratuberculosis
cgucgugggugacccggccgu

SEQ ID NO: 927170 - RNA, 15 nt, Mycobacterium avium subsp. paratuberculosis
cgucguggucgacgc

SEQ ID NO: 927171 - RNA, 16 nt, Mycobacterium avium subsp. paratuberculosis
cgucguggucgacgcc

SEQ ID NO: 927172 - RNA, 18 nt, Mycobacterium avium subsp. paratuberculosis
cgucguggucgacgccgu

SEQ ID NO: 927173 - RNA, 23 nt, Mycobacterium avium subsp. paratuberculosis
cgucguggcggugcucuuggugg

SEQ ID NO: 927174 - RNA, 17 nt, Mycobacterium avium subsp. paratuberculosis
cgucguguagggcaaca

SEQ ID NO: 927175 - RNA, 18 nt, Mycobacterium avium subsp. paratuberculosis
cgucgugcgcgggcgaaa

SEQ ID NO: 927176 - RNA, 14 nt, Mycobacterium avium subsp. paratuberculosis
cgucgugcggccgg

SEQ ID NO: 927177 - RNA, 19 nt, Mycobacterium avium subsp. paratuberculosis
cgucgugcggccggcgccg

SEQ ID NO: 927178 - RNA, 19 nt, Mycobacterium avium subsp. paratuberculosis
cgucgugcgggcuccgcac

SEQ ID NO: 927179 - RNA, 14 nt, Mycobacterium avium subsp. paratuberculosis
cgucguggccgacg

SEQ ID NO: 927180 - RNA, 17 nt, Mycobacterium avium subsp. paratuberculosis
cgucgugccgagcguga

SEQ ID NO: 927181 - RNA, 14 nt, Mycobacterium avium subsp. paratuberculosis
cgucgugauggcga

SEQ ID NO: 927182 - RNA, 23 nt, Mycobacterium avium subsp. paratuberculosis
cgucgugauggcgaaccagcgcc

SEQ ID NO: 927183 - RNA, 19 nt, Mycobacterium avium subsp. paratuberculosis
cgucgugcaacucccgcgc

SEQ ID NO: 927184 - RNA, 20 nt, Mycobacterium avium subsp. paratuberculosis
cgucgugcaacucccgcgcc

SEQ ID NO: 927185 - RNA, 23 nt, Mycobacterium avium subsp. paratuberculosis
cgucgugcaccacgacgucgagc

SEQ ID NO: 927186 - RNA, 17 nt, Mycobacterium avium subsp. paratuberculosis
cgucgugcacgccgugg

SEQ ID NO: 927187 - RNA, 19 nt, Mycobacterium avium subsp. paratuberculosis
cgucgugcacgccguggcg

SEQ ID NO: 927188 - RNA, 21 nt, Mycobacterium avium subsp. paratuberculosis
cgucgugcacgccguggcggc

SEQ ID NO: 927189 - RNA, 21 nt, Mycobacterium avium subsp. paratuberculosis
cgucgucgccguggcggcccg

SEQ ID NO: 927190 - RNA, 14 nt, Mycobacterium avium subsp. paratuberculosis
cgucgucgcggcgc

SEQ ID NO: 927191 - RNA, 16 nt, Mycobacterium avium subsp. paratuberculosis
cgucgucgcggcgcug

SEQ ID NO: 927192 - RNA, 13 nt, Mycobacterium avium subsp. paratuberculosis
cgucgucgcugca

SEQ ID NO: 927193 - RNA, 18 nt, Mycobacterium avium subsp. paratuberculosis
cgugauaucccuugccgc

SEQ ID NO: 927194 - RNA, 20 nt, Mycobacterium avium subsp. paratuberculosis
cgugauaucccuugccgccg

SEQ ID NO: 927195 - RNA, 14 nt, Mycobacterium avium subsp. paratuberculosis
cgugauacgccgac

SEQ ID NO: 927196 - RNA, 15 nt, Mycobacterium avium subsp. paratuberculosis
cgugauagcggccgc

SEQ ID NO: 927197 - RNA, 16 nt, Mycobacterium avium subsp. paratuberculosis
cgugauagcggccgcg

SEQ ID NO: 927198 - RNA, 17 nt, Mycobacterium avium subsp. paratuberculosis
cgugauagcggccgcgg

SEQ ID NO: 927199 - RNA, 14 nt, Mycobacterium avium subsp. paratuberculosis
cgugaucggcggcc

SEQ ID NO: 927200 - RNA, 21 nt, Mycobacterium avium subsp. paratuberculosis
cgugaucggcggccugcggcg

SEQ ID NO: 927201 - RNA, 22 nt, Mycobacterium avium subsp. paratuberculosis
cgugaucggcggccugcggcgg

SEQ ID NO: 927202 - RNA, 23 nt, Mycobacterium avium subsp. paratuberculosis
cgugaucuggucggccagcgcgc

SEQ ID NO: 927203 - RNA, 18 nt, Mycobacterium avium subsp. paratuberculosis
cgugaucuggugggcggg

SEQ ID NO: 927204 - RNA, 19 nt, Mycobacterium avium subsp. paratuberculosis
cgugaucuguucggcggcg

SEQ ID NO: 927205 - RNA, 12 nt, Mycobacterium avium subsp. paratuberculosis
cgugaucgccac

SEQ ID NO: 927206 - RNA, 14 nt, Mycobacterium avium subsp. paratuberculosis
cgugaucgccacca

SEQ ID NO: 927207 - RNA, 19 nt, Mycobacterium avium subsp. paratuberculosis
cgugaucgccaccaccagc

SEQ ID NO: 927208 - RNA, 20 nt, Mycobacterium avium subsp. paratuberculosis
cgugauccggaaugcggugc

SEQ ID NO: 927209 - RNA, 12 nt, Mycobacterium avium subsp. paratuberculosis
cgugauccggca

SEQ ID NO: 927210 - RNA, 18 nt, Mycobacterium avium subsp. paratuberculosis
cgugauccggcacugaag

SEQ ID NO: 927211 - RNA, 21 nt, Mycobacterium avium subsp. paratuberculosis
cgugaucgaaacgccgcgcuc

SEQ ID NO: 927212 - RNA, 17 nt, Mycobacterium avium subsp. paratuberculosis
cgugaugcgccggcggu

SEQ ID NO: 927213 - RNA, 20 nt, Mycobacterium avium subsp. paratuberculosis
cgugaugguccagcaccggc

SEQ ID NO: 927214 - RNA, 19 nt, Mycobacterium avium subsp. paratuberculosis
cgugauggucgucguggug

SEQ ID NO: 927215 - RNA, 17 nt, Mycobacterium avium subsp. paratuberculosis
cgugaugccguggucgg

SEQ ID NO: 927216 - RNA, 20 nt, Mycobacterium avium subsp. paratuberculosis
cgugaugccguggucggcga

SEQ ID NO: 927217 - RNA, 24 nt, Mycobacterium avium subsp. paratuberculosis
cgugaugcgcaagcaccggcuggc

SEQ ID NO: 927218 - RNA, 15 nt, Mycobacterium avium subsp. paratuberculosis
cgugaugccgggcaa

SEQ ID NO: 927219 - RNA, 14 nt, Mycobacterium avium subsp. paratuberculosis
cgugaugacggcgg

SEQ ID NO: 927220 - RNA, 15 nt, Mycobacterium avium subsp. paratuberculosis
cgugaugacggcggc

SEQ ID NO: 927221 - RNA, 16 nt, Mycobacterium avium subsp. paratuberculosis
cgugaugacggcggcg

SEQ ID NO: 927222 - RNA, 17 nt, Mycobacterium avium subsp. paratuberculosis
cgugaugcacccggacg

SEQ ID NO: 927223 - RNA, 21 nt, Mycobacterium avium subsp. paratuberculosis
cgugaugcagcagguugcggu

SEQ ID NO: 927224 - RNA, 17 nt, Mycobacterium avium subsp. paratuberculosis
cgugcaaaccggaccgc

SEQ ID NO: 927225 - RNA, 18 nt, Mycobacterium avium subsp. paratuberculosis
cgugcaaaccggaccgcc

SEQ ID NO: 927226 - RNA, 21 nt, Mycobacterium avium subsp. paratuberculosis
cgugcaacugcguggccgugu

SEQ ID NO: 927227 - RNA, 15 nt, Mycobacterium avium subsp. paratuberculosis
cgugcacaccggccu

SEQ ID NO: 927228 - RNA, 17 nt, Mycobacterium avium subsp. paratuberculosis
cgugcacaccggccuuc

SEQ ID NO: 927229 - RNA, 15 nt, Mycobacterium avium subsp. paratuberculosis
cgugcacaggccgcc

SEQ ID NO: 927230 - RNA, 17 nt, Mycobacterium avium subsp. paratuberculosis
cgugcacaggccgccgc

SEQ ID NO: 927231 - RNA, 18 nt, Mycobacterium avium subsp. paratuberculosis
cgugcacaggccgccgca

SEQ ID NO: 927232 - RNA, 23 nt, Mycobacterium avium subsp. paratuberculosis
cgugcacaugcccgucgggcggg

SEQ ID NO: 927233 - RNA, 19 nt, Mycobacterium avium subsp. paratuberculosis
cgugcaccacgacgucgag

SEQ ID NO: 927234 - RNA, 16 nt, Mycobacterium avium subsp. paratuberculosis
cgugacggcggggcgg

SEQ ID NO: 927235 - RNA, 15 nt, Mycobacterium avium subsp. paratuberculosis
cgugacguucggcca

SEQ ID NO: 927236 - RNA, 16 nt, Mycobacterium avium subsp. paratuberculosis
cgugacguucggccaa

SEQ ID NO: 927237 - RNA, 18 nt, Mycobacterium avium subsp. paratuberculosis
cgugacuugucgggccgc

SEQ ID NO: 927238 - RNA, 14 nt, Mycobacterium avium subsp. paratuberculosis
cgugacgcccggcg

SEQ ID NO: 927239 - RNA, 19 nt, Mycobacterium avium subsp. paratuberculosis
cgugacgcccggcgccggc

SEQ ID NO: 927240 - RNA, 20 nt, Mycobacterium avium subsp. paratuberculosis
cgugacgcccggcgccggcg

SEQ ID NO: 927241 - RNA, 14 nt, Mycobacterium avium subsp. paratuberculosis
cgugacgccgaucc

SEQ ID NO: 927242 - RNA, 22 nt, Mycobacterium avium subsp. paratuberculosis
cgugacgccgauccgcugcgga

SEQ ID NO: 927243 - RNA, 15 nt, Mycobacterium avium subsp. paratuberculosis
cgugacgccgcugcg

SEQ ID NO: 927244 - RNA, 17 nt, Mycobacterium avium subsp. paratuberculosis
cgugacgccgcugcgug

SEQ ID NO: 927245 - RNA, 17 nt, Mycobacterium avium subsp. paratuberculosis
cgugacgaccuggucgc

SEQ ID NO: 927246 - RNA, 19 nt, Mycobacterium avium subsp. paratuberculosis
cgugacgaccuggucgccg

SEQ ID NO: 927247 - RNA, 20 nt, Mycobacterium avium subsp. paratuberculosis
cgugacgaccuggucgccgc

SEQ ID NO: 927248 - RNA, 20 nt, Mycobacterium avium subsp. paratuberculosis
cgugaccugcugggcgggca

SEQ ID NO: 927249 - RNA, 22 nt, Mycobacterium avium subsp. paratuberculosis
cgugaccugcugggcgggcagc

SEQ ID NO: 927250 - RNA, 15 nt, Mycobacterium avium subsp. paratuberculosis
cgugaccggcgaucc

SEQ ID NO: 927251 - RNA, 13 nt, Mycobacterium avium subsp. paratuberculosis
cgugaccggcggu

SEQ ID NO: 927252 - RNA, 14 nt, Mycobacterium avium subsp. paratuberculosis
cgugaccggcggug

SEQ ID NO: 927253 - RNA, 18 nt, Mycobacterium avium subsp. paratuberculosis
cgugaccggcggugucgg

SEQ ID NO: 927254 - RNA, 22 nt, Mycobacterium avium subsp. paratuberculosis
cgugaccggcugcucgcgcugc

SEQ ID NO: 927255 - RNA, 15 nt, Mycobacterium avium subsp. paratuberculosis
cgugaccucgacggu

SEQ ID NO: 927256 - RNA, 12 nt, Mycobacterium avium subsp. paratuberculosis
cgugacgccggg

SEQ ID NO: 927257 - RNA, 15 nt, Mycobacterium avium subsp. paratuberculosis
cgugacgccgggccg

SEQ ID NO: 927258 - RNA, 19 nt, Mycobacterium avium subsp. paratuberculosis
cgugacgccgggccgccgc

SEQ ID NO: 927259 - RNA, 21 nt, Mycobacterium avium subsp. paratuberculosis
cgugacgccgggccgccgcgg

SEQ ID NO: 927260 - RNA, 13 nt, Mycobacterium avium subsp. paratuberculosis
cgugacgccgucc

SEQ ID NO: 927261 - RNA, 19 nt, Mycobacterium avium subsp. paratuberculosis
cgugacgcgaagucgccgc

SEQ ID NO: 927262 - RNA, 13 nt, Mycobacterium avium subsp. paratuberculosis
cgugacggccgcg

SEQ ID NO: 927263 - RNA, 15 nt, Mycobacterium avium subsp. paratuberculosis
cgugacggccgcggc

SEQ ID NO: 927264 - RNA, 20 nt, Mycobacterium avium subsp. paratuberculosis
cgugacggaugugacgcggg

SEQ ID NO: 927265 - RNA, 21 nt, Mycobacterium avium subsp. paratuberculosis
cgugacggaugugacgcggga

SEQ ID NO: 927266 - RNA, 13 nt, Mycobacterium avium subsp. paratuberculosis
cgugacggcaucg

SEQ ID NO: 927267 - RNA, 20 nt, Mycobacterium avium subsp. paratuberculosis
cgugacgcgcgugacggcgg

SEQ ID NO: 927268 - RNA, 21 nt, Mycobacterium avium subsp. paratuberculosis
cgugacgcgcgugacggcggg

SEQ ID NO: 927269 - RNA, 12 nt, Mycobacterium avium subsp. paratuberculosis
cgugacgcggcg

SEQ ID NO: 927270 - RNA, 13 nt, Mycobacterium avium subsp. paratuberculosis
cgugacgcggcgu

SEQ ID NO: 927271 - RNA, 15 nt, Mycobacterium avium subsp. paratuberculosis
cgugacgcggcgucg

SEQ ID NO: 927272 - RNA, 16 nt, Mycobacterium avium subsp. paratuberculosis
cgugacgcucgacggc

SEQ ID NO: 927273 - RNA, 20 nt, Mycobacterium avium subsp. paratuberculosis
cgugacgcucgacggccggc

SEQ ID NO: 927274 - RNA, 21 nt, Mycobacterium avium subsp. paratuberculosis
cgugacgcucgacggccggcg

SEQ ID NO: 927275 - RNA, 15 nt, Mycobacterium avium subsp. paratuberculosis
cgugacgcucgaggc

SEQ ID NO: 927276 - RNA, 17 nt, Mycobacterium avium subsp. paratuberculosis
cgugacgcucgccggcg

SEQ ID NO: 927277 - RNA, 18 nt, Mycobacterium avium subsp. paratuberculosis
cgugacgcucgccggcgg

SEQ ID NO: 927278 - RNA, 19 nt, Mycobacterium avium subsp. paratuberculosis
cgugacgcucgccggcggc

SEQ ID NO: 927279 - RNA, 14 nt, Mycobacterium avium subsp. paratuberculosis
cgugacgcucggcc

SEQ ID NO: 927280 - RNA, 17 nt, Mycobacterium avium subsp. paratuberculosis
cgugacgcucggccgug

SEQ ID NO: 927281 - RNA, 23 nt, Mycobacterium avium subsp. paratuberculosis
cgugacgcucggccguggccguc

SEQ ID NO: 927282 - RNA, 15 nt, Mycobacterium avium subsp. paratuberculosis
cgugacgcucggcgc

SEQ ID NO: 927283 - RNA, 18 nt, Mycobacterium avium subsp. paratuberculosis
cgugacgcucggcgccgc

SEQ ID NO: 927284 - RNA, 23 nt, Mycobacterium avium subsp. paratuberculosis
cgugacgcucggcgccgcggggc

SEQ ID NO: 927285 - RNA, 21 nt, Mycobacterium avium subsp. paratuberculosis
cgugacgcucggcgccggccg

SEQ ID NO: 927286 - RNA, 18 nt, Mycobacterium avium subsp. paratuberculosis
cgugacgcucggcgcguc

SEQ ID NO: 927287 - RNA, 14 nt, Mycobacterium avium subsp. paratuberculosis
cgugacgcucgggc

SEQ ID NO: 927288 - RNA, 22 nt, Mycobacterium avium subsp. paratuberculosis
cgugacgcucgggcuucggcgu

SEQ ID NO: 927289 - RNA, 19 nt, Mycobacterium avium subsp. paratuberculosis
cgugacgcucggggccggu

SEQ ID NO: 927290 - RNA, 20 nt, Mycobacterium avium subsp. paratuberculosis
cgugcagacaaccggugugc

SEQ ID NO: 927291 - RNA, 16 nt, Mycobacterium avium subsp. paratuberculosis
cgugcacgccguggcg

SEQ ID NO: 927292 - RNA, 15 nt, Mycobacterium avium subsp. paratuberculosis
cgugcacgugcaggu

SEQ ID NO: 927293 - RNA, 20 nt, Mycobacterium avium subsp. paratuberculosis
cgugcacgugcaggugcggc

SEQ ID NO: 927294 - RNA, 19 nt, Mycobacterium avium subsp. paratuberculosis
cgugcagcaguuccggagc

SEQ ID NO: 927295 - RNA, 13 nt, Mycobacterium avium subsp. paratuberculosis
cgugcagcaccgc

SEQ ID NO: 927296 - RNA, 14 nt, Mycobacterium avium subsp. paratuberculosis
cgugcagcaccgcc

SEQ ID NO: 927297 - RNA, 23 nt, Mycobacterium avium subsp. paratuberculosis
cgugcagcaccucgaagccgacg

SEQ ID NO: 927298 - RNA, 19 nt, Mycobacterium avium subsp. paratuberculosis
cgugcagcacgcccucggc

SEQ ID NO: 927299 - RNA, 15 nt, Mycobacterium avium subsp. paratuberculosis
cgugcagcacgccgc

SEQ ID NO: 927300 - RNA, 17 nt, Mycobacterium avium subsp. paratuberculosis
cgugcagcacgccgcgg

SEQ ID NO: 927301 - RNA, 18 nt, Mycobacterium avium subsp. paratuberculosis
cgugcagcacgccgcgga

SEQ ID NO: 927302 - RNA, 20 nt, Mycobacterium avium subsp. paratuberculosis
cgugcagcacggggacgcug

SEQ ID NO: 927303 - RNA, 13 nt, Mycobacterium avium subsp. paratuberculosis
cgugcacgaucgc

SEQ ID NO: 927304 - RNA, 14 nt, Mycobacterium avium subsp. paratuberculosis
cgugcacggcgccg

SEQ ID NO: 927305 - RNA, 14 nt, Mycobacterium avium subsp. paratuberculosis
cgugcacgccgucg

SEQ ID NO: 927306 - RNA, 15 nt, Mycobacterium avium subsp. paratuberculosis
cgugcacgccgucgu

SEQ ID NO: 927307 - RNA, 14 nt, Mycobacterium avium subsp. paratuberculosis
cgugcaccugcagc

SEQ ID NO: 927308 - RNA, 17 nt, Mycobacterium avium subsp. paratuberculosis
cgugcacgaacgcggcc

SEQ ID NO: 927309 - RNA, 14 nt, Mycobacterium avium subsp. paratuberculosis
cgugcaccgcccgc

SEQ ID NO: 927310 - RNA, 17 nt, Mycobacterium avium subsp. paratuberculosis
cgugcaccgcccgcgcg

SEQ ID NO: 927311 - RNA, 18 nt, Mycobacterium avium subsp. paratuberculosis
cgugcaccgcccgcgcga

SEQ ID NO: 927312 - RNA, 14 nt, Mycobacterium avium subsp. paratuberculosis
cgugcaccggcgag

SEQ ID NO: 927313 - RNA, 15 nt, Mycobacterium avium subsp. paratuberculosis
cgugcaccgucgccg

SEQ ID NO: 927314 - RNA, 17 nt, Mycobacterium avium subsp. paratuberculosis
cgugcaccgucgccggc

SEQ ID NO: 927315 - RNA, 18 nt, Mycobacterium avium subsp. paratuberculosis
cgugcaccgucgccggcg

SEQ ID NO: 927316 - RNA, 19 nt, Mycobacterium avium subsp. paratuberculosis
cgugcaccgucgccggcgg

SEQ ID NO: 927317 - RNA, 20 nt, Mycobacterium avium subsp. paratuberculosis
cgugcauagcuggcgccgaa

SEQ ID NO: 927318 - RNA, 14 nt, Mycobacterium avium subsp. paratuberculosis
cgugcaggccgcgg

SEQ ID NO: 927319 - RNA, 19 nt, Mycobacterium avium subsp. paratuberculosis
cgugcaggccgcggguggc

SEQ ID NO: 927320 - RNA, 20 nt, Mycobacterium avium subsp. paratuberculosis
cgugcagggggcgcagccga

SEQ ID NO: 927321 - RNA, 23 nt, Mycobacterium avium subsp. paratuberculosis
cgugcagcgcccagccgagccgg

SEQ ID NO: 927322 - RNA, 18 nt, Mycobacterium avium subsp. paratuberculosis
cgugcagcucggugcaga

SEQ ID NO: 927323 - RNA, 17 nt, Mycobacterium avium subsp. paratuberculosis
cgugcaggauccgcucg

SEQ ID NO: 927324 - RNA, 21 nt, Mycobacterium avium subsp. paratuberculosis
cgugcaggaugaccgcgucgg

SEQ ID NO: 927325 - RNA, 23 nt, Mycobacterium avium subsp. paratuberculosis
cgugcaggaugaccgcgucggcg

SEQ ID NO: 927326 - RNA, 18 nt, Mycobacterium avium subsp. paratuberculosis
cgugcagcgcggcgauga

SEQ ID NO: 927327 - RNA, 13 nt, Mycobacterium avium subsp. paratuberculosis
cgugcagccggcg

SEQ ID NO: 927328 - RNA, 13 nt, Mycobacterium avium subsp. paratuberculosis
cgugcagccgggc

SEQ ID NO: 927329 - RNA, 14 nt, Mycobacterium avium subsp. paratuberculosis
cgugcagccgggcc

SEQ ID NO: 927330 - RNA, 16 nt, Mycobacterium avium subsp. paratuberculosis
cgugcagccgggccug

SEQ ID NO: 927331 - RNA, 15 nt, Mycobacterium avium subsp. paratuberculosis
cgugcagccgggcgg

SEQ ID NO: 927332 - RNA, 17 nt, Mycobacterium avium subsp. paratuberculosis
cgugcagccgggcggcg

SEQ ID NO: 927333 - RNA, 23 nt, Mycobacterium avium subsp. paratuberculosis
cgugcagccgggcggcgccgaac

SEQ ID NO: 927334 - RNA, 23 nt, Mycobacterium avium subsp. paratuberculosis
cgugcauguagguggcgaccacc

SEQ ID NO: 927335 - RNA, 18 nt, Mycobacterium avium subsp. paratuberculosis
cgugcaugugcucggcga

SEQ ID NO: 927336 - RNA, 20 nt, Mycobacterium avium subsp. paratuberculosis
cgugcaugugcucggcgagg

SEQ ID NO: 927337 - RNA, 14 nt, Mycobacterium avium subsp. paratuberculosis
cgugcaucggcgcc

SEQ ID NO: 927338 - RNA, 15 nt, Mycobacterium avium subsp. paratuberculosis
cgugcaucggcgccu

SEQ ID NO: 927339 - RNA, 17 nt, Mycobacterium avium subsp. paratuberculosis
cgugcaucggcgccugc

SEQ ID NO: 927340 - RNA, 14 nt, Mycobacterium avium subsp. paratuberculosis
cgugcaucgggcgc

SEQ ID NO: 927341 - RNA, 20 nt, Mycobacterium avium subsp. paratuberculosis
cgugccacaggccgaacagc

SEQ ID NO: 927342 - RNA, 21 nt, Mycobacterium avium subsp. paratuberculosis
cgugccacaggccgaacagca

SEQ ID NO: 927343 - RNA, 15 nt, Mycobacterium avium subsp. paratuberculosis
cgugccaccgcuggg

SEQ ID NO: 927344 - RNA, 14 nt, Mycobacterium avium subsp. paratuberculosis
cgugccacggccgc

SEQ ID NO: 927345 - RNA, 15 nt, Mycobacterium avium subsp. paratuberculosis
cgugccacggccgcg

SEQ ID NO: 927346 - RNA, 17 nt, Mycobacterium avium subsp. paratuberculosis
cgugccacggccgcggc

SEQ ID NO: 927347 - RNA, 22 nt, Mycobacterium avium subsp. paratuberculosis
cgugccacggccgcggcccggc

SEQ ID NO: 927348 - RNA, 24 nt, Mycobacterium avium subsp. paratuberculosis
cgugcauucaggucaccgcgcgaa

SEQ ID NO: 927349 - RNA, 16 nt, Mycobacterium avium subsp. paratuberculosis
cgugcauucagugcga

SEQ ID NO: 927350 - RNA, 22 nt, Mycobacterium avium subsp. paratuberculosis
cgugccacuggcgccaccuccg

SEQ ID NO: 927351 - RNA, 16 nt, Mycobacterium avium subsp. paratuberculosis
cgugcccaacacgccc

SEQ ID NO: 927352 - RNA, 20 nt, Mycobacterium avium subsp. paratuberculosis
cgugcccaacacgccccgac

SEQ ID NO: 927353 - RNA, 16 nt, Mycobacterium avium subsp. paratuberculosis
cgugcccagcccgcgc

SEQ ID NO: 927354 - RNA, 18 nt, Mycobacterium avium subsp. paratuberculosis
cgugcccagcccgcgcga

SEQ ID NO: 927355 - RNA, 15 nt, Mycobacterium avium subsp. paratuberculosis
cgugcccaccagccg

SEQ ID NO: 927356 - RNA, 18 nt, Mycobacterium avium subsp. paratuberculosis
cgugcccaccagccggcc

SEQ ID NO: 927357 - RNA, 21 nt, Mycobacterium avium subsp. paratuberculosis
cgugcccaccagccggccggc

SEQ ID NO: 927358 - RNA, 18 nt, Mycobacterium avium subsp. paratuberculosis
cgugccagggcagcgcga

SEQ ID NO: 927359 - RNA, 13 nt, Mycobacterium avium subsp. paratuberculosis
cgugccagcagcu

SEQ ID NO: 927360 - RNA, 19 nt, Mycobacterium avium subsp. paratuberculosis
cgugccagcagcucguggu

SEQ ID NO: 927361 - RNA, 14 nt, Mycobacterium avium subsp. paratuberculosis
cgugccagccggcc

SEQ ID NO: 927362 - RNA, 15 nt, Mycobacterium avium subsp. paratuberculosis
cgugccagccggccg

SEQ ID NO: 927363 - RNA, 16 nt, Mycobacterium avium subsp. paratuberculosis
cgugccagccggccgc

SEQ ID NO: 927364 - RNA, 20 nt, Mycobacterium avium subsp. paratuberculosis
cgugccagcgcaguucaccg

SEQ ID NO: 927365 - RNA, 21 nt, Mycobacterium avium subsp. paratuberculosis
cgugccagcgcaguucaccga

SEQ ID NO: 927366 - RNA, 17 nt, Mycobacterium avium subsp. paratuberculosis
cgugccgauggccaccg

SEQ ID NO: 927367 - RNA, 18 nt, Mycobacterium avium subsp. paratuberculosis
cgugccgauggccaccgg

SEQ ID NO: 927368 - RNA, 15 nt, Mycobacterium avium subsp. paratuberculosis
cgugccgaccagccg

SEQ ID NO: 927369 - RNA, 14 nt, Mycobacterium avium subsp. paratuberculosis
cgugccgaacggcg

SEQ ID NO: 927370 - RNA, 16 nt, Mycobacterium avium subsp. paratuberculosis
cgugccgaacggcgcu

SEQ ID NO: 927371 - RNA, 20 nt, Mycobacterium avium subsp. paratuberculosis
cgugcccgcgggacacggcg

SEQ ID NO: 927372 - RNA, 18 nt, Mycobacterium avium subsp. paratuberculosis
cgugcccuuccccggcgg

SEQ ID NO: 927373 - RNA, 19 nt, Mycobacterium avium subsp. paratuberculosis
cgugcccuuccccggcggc

SEQ ID NO: 927374 - RNA, 13 nt, Mycobacterium avium subsp. paratuberculosis
cgugcccggccag

SEQ ID NO: 927375 - RNA, 12 nt, Mycobacterium avium subsp. paratuberculosis
cgugcccggcgc

SEQ ID NO: 927376 - RNA, 13 nt, Mycobacterium avium subsp. paratuberculosis
cgugcccggcgca

SEQ ID NO: 927377 - RNA, 14 nt, Mycobacterium avium subsp. paratuberculosis
cgugcccggcgccc

SEQ ID NO: 927378 - RNA, 15 nt, Mycobacterium avium subsp. paratuberculosis
cgugcccggcgccga

SEQ ID NO: 927379 - RNA, 18 nt, Mycobacterium avium subsp. paratuberculosis
cgugcccggcgccgacca

SEQ ID NO: 927380 - RNA, 11 nt, Mycobacterium avium subsp. paratuberculosis
cgugcccgcuc

SEQ ID NO: 927381 - RNA, 17 nt, Mycobacterium avium subsp. paratuberculosis
cgugcccggaucgccga

SEQ ID NO: 927382 - RNA, 19 nt, Mycobacterium avium subsp. paratuberculosis
cgugcccggaucgccgaac

SEQ ID NO: 927383 - RNA, 19 nt, Mycobacterium avium subsp. paratuberculosis
cgugccccaggucggggug

SEQ ID NO: 927384 - RNA, 14 nt, Mycobacterium avium subsp. paratuberculosis
cgugcccgcgccca

SEQ ID NO: 927385 - RNA, 16 nt, Mycobacterium avium subsp. paratuberculosis
cgugcccgcgcccacc

SEQ ID NO: 927386 - RNA, 14 nt, Mycobacterium avium subsp. paratuberculosis
cgugcccgagccga

SEQ ID NO: 927387 - RNA, 17 nt, Mycobacterium avium subsp. paratuberculosis
cgugcccgagccgaugg

SEQ ID NO: 927388 - RNA, 18 nt, Mycobacterium avium subsp. paratuberculosis
cgugcccgaucucgucgg

SEQ ID NO: 927389 - RNA, 12 nt, Mycobacterium avium subsp. paratuberculosis
cgugcccgccga

SEQ ID NO: 927390 - RNA, 13 nt, Mycobacterium avium subsp. paratuberculosis
cgugcccgccgaa

SEQ ID NO: 927391 - RNA, 16 nt, Mycobacterium avium subsp. paratuberculosis
cgugcccgccgugcgc

SEQ ID NO: 927392 - RNA, 18 nt, Mycobacterium avium subsp. paratuberculosis
cgugcccgccgugcgccc

SEQ ID NO: 927393 - RNA, 21 nt, Mycobacterium avium subsp. paratuberculosis
cgugcccgccgugcgccccgc

SEQ ID NO: 927394 - RNA, 19 nt, Mycobacterium avium subsp. paratuberculosis
cguguuugcugcaugcgcu

SEQ ID NO: 927395 - RNA, 16 nt, Mycobacterium avium subsp. paratuberculosis
cguguuggacgcccgc

SEQ ID NO: 927396 - RNA, 21 nt, Mycobacterium avium subsp. paratuberculosis
cguguugagcucgcggcgcag

SEQ ID NO: 927397 - RNA, 18 nt, Mycobacterium avium subsp. paratuberculosis
cguguuccuugcggccgc

SEQ ID NO: 927398 - RNA, 14 nt, Mycobacterium avium subsp. paratuberculosis
cguguucgggaucg

SEQ ID NO: 927399 - RNA, 16 nt, Mycobacterium avium subsp. paratuberculosis
cguguucucacggcga

SEQ ID NO: 927400 - RNA, 18 nt, Mycobacterium avium subsp. paratuberculosis
cguguucucacggcgaau

SEQ ID NO: 927401 - RNA, 14 nt, Mycobacterium avium subsp. paratuberculosis
cgugguugccccag

SEQ ID NO: 927402 - RNA, 20 nt, Mycobacterium avium subsp. paratuberculosis
cguguugaucucgucgauga

SEQ ID NO: 927403 - RNA, 21 nt, Mycobacterium avium subsp. paratuberculosis
cgugguggaaggugacgucgc

SEQ ID NO: 927404 - RNA, 13 nt, Mycobacterium avium subsp. paratuberculosis
cgugguggacggu

SEQ ID NO: 927405 - RNA, 18 nt, Mycobacterium avium subsp. paratuberculosis
cguggugcggugcaccgc

SEQ ID NO: 927406 - RNA, 15 nt, Mycobacterium avium subsp. paratuberculosis
cguggugcaccgcca

SEQ ID NO: 927407 - RNA, 21 nt, Mycobacterium avium subsp. paratuberculosis
cguggugcaccgccagcgcgg

SEQ ID NO: 927408 - RNA, 23 nt, Mycobacterium avium subsp. paratuberculosis
cguggugcaccgccagcgcggcg

SEQ ID NO: 927409 - RNA, 14 nt, Mycobacterium avium subsp. paratuberculosis
cguggugacccgga

SEQ ID NO: 927410 - RNA, 19 nt, Mycobacterium avium subsp. paratuberculosis
cguggugacccggaccggg

SEQ ID NO: 927411 - RNA, 16 nt, Mycobacterium avium subsp. paratuberculosis
cguggugacgggcguc

SEQ ID NO: 927412 - RNA, 20 nt, Mycobacterium avium subsp. paratuberculosis
cguggugacgggcgucggcg

SEQ ID NO: 927413 - RNA, 15 nt, Mycobacterium avium subsp. paratuberculosis
cgugguggugcggac

SEQ ID NO: 927414 - RNA, 14 nt, Mycobacterium avium subsp. paratuberculosis
cgugguggggccga

SEQ ID NO: 927415 - RNA, 20 nt, Mycobacterium avium subsp. paratuberculosis
cguggugggcagaugcccgc

SEQ ID NO: 927416 - RNA, 22 nt, Mycobacterium avium subsp. paratuberculosis
cguggugggcagaugcccgcug

SEQ ID NO: 927417 - RNA, 17 nt, Mycobacterium avium subsp. paratuberculosis
cgugguggaugaugccg

SEQ ID NO: 927418 - RNA, 22 nt, Mycobacterium avium subsp. paratuberculosis
cgugguggaugaugccggcggu

SEQ ID NO: 927419 - RNA, 23 nt, Mycobacterium avium subsp. paratuberculosis
cgugguggaugaugccggcggug

SEQ ID NO: 927420 - RNA, 23 nt, Mycobacterium avium subsp. paratuberculosis
cgugguguugaucauccggcggg

SEQ ID NO: 927421 - RNA, 20 nt, Mycobacterium avium subsp. paratuberculosis
cguggugucggagaucggcg

SEQ ID NO: 927422 - RNA, 16 nt, Mycobacterium avium subsp. paratuberculosis
cguggugugcaccagc

SEQ ID NO: 927423 - RNA, 17 nt, Mycobacterium avium subsp. paratuberculosis
cguucacgucgaucacg

SEQ ID NO: 927424 - RNA, 20 nt, Mycobacterium avium subsp. paratuberculosis
cguucacgucgaucacgccg

SEQ ID NO: 927425 - RNA, 18 nt, Mycobacterium avium subsp. paratuberculosis
cguucaccucuucgggca

SEQ ID NO: 927426 - RNA, 13 nt, Mycobacterium avium subsp. paratuberculosis
cguucaagccgcc

SEQ ID NO: 927427 - RNA, 22 nt, Mycobacterium avium subsp. paratuberculosis
cguucagggugcaggcccgggc

SEQ ID NO: 927428 - RNA, 23 nt, Mycobacterium avium subsp. paratuberculosis
cguucaggucgaucagcggucca

SEQ ID NO: 927429 - RNA, 15 nt, Mycobacterium avium subsp. paratuberculosis
cguucagcgggcggu

SEQ ID NO: 927430 - RNA, 20 nt, Mycobacterium avium subsp. paratuberculosis
cguucagcgacuugccgccg

SEQ ID NO: 927431 - RNA, 23 nt, Mycobacterium avium subsp. paratuberculosis
cguucagcgacuugccgccggcg

SEQ ID NO: 927432 - RNA, 16 nt, Mycobacterium avium subsp. paratuberculosis
cguucagcgcggccac

SEQ ID NO: 927433 - RNA, 17 nt, Mycobacterium avium subsp. paratuberculosis
cguucagcgcggccacc

SEQ ID NO: 927434 - RNA, 20 nt, Mycobacterium avium subsp. paratuberculosis
cguucagcggcaccgucacc

SEQ ID NO: 927435 - RNA, 18 nt, Mycobacterium avium subsp. paratuberculosis
cguuacacccgcggaacg

SEQ ID NO: 927436 - RNA, 20 nt, Mycobacterium avium subsp. paratuberculosis
cguucaacggccaaccgccc

SEQ ID NO: 927437 - RNA, 18 nt, Mycobacterium avium subsp. paratuberculosis
cguucuggcccgccaucg

SEQ ID NO: 927438 - RNA, 21 nt, Mycobacterium avium subsp. paratuberculosis
cguucuggcccgccaucgccc

SEQ ID NO: 927439 - RNA, 15 nt, Mycobacterium avium subsp. paratuberculosis
cguucgucggcgcgu

SEQ ID NO: 927440 - RNA, 16 nt, Mycobacterium avium subsp. paratuberculosis
cguucgucggcgcguc

SEQ ID NO: 927441 - RNA, 20 nt, Mycobacterium avium subsp. paratuberculosis
cguucguagggacugcgccg

SEQ ID NO: 927442 - RNA, 19 nt, Mycobacterium avium subsp. paratuberculosis
cguucggcggcgcgcugca

SEQ ID NO: 927443 - RNA, 23 nt, Mycobacterium avium subsp. paratuberculosis
cguucggcggcgcgcugcaggcc

SEQ ID NO: 927444 - RNA, 11 nt, Mycobacterium avium subsp. paratuberculosis
cguucggcggg

SEQ ID NO: 927445 - RNA, 12 nt, Mycobacterium avium subsp. paratuberculosis
cguucggcgggc

SEQ ID NO: 927446 - RNA, 16 nt, Mycobacterium avium subsp. paratuberculosis
cguucggcgguucgga

SEQ ID NO: 927447 - RNA, 20 nt, Mycobacterium avium subsp. paratuberculosis
cguucgggauccucgccgcg

SEQ ID NO: 927448 - RNA, 15 nt, Mycobacterium avium subsp. paratuberculosis
cguucggcgccaccc

SEQ ID NO: 927449 - RNA, 17 nt, Mycobacterium avium subsp. paratuberculosis
cguucggcgccaccccg

SEQ ID NO: 927450 - RNA, 16 nt, Mycobacterium avium subsp. paratuberculosis
cguucggcgcggaucg

SEQ ID NO: 927451 - RNA, 18 nt, Mycobacterium avium subsp. paratuberculosis
cguucggucagcacgaca

SEQ ID NO: 927452 - RNA, 13 nt, Mycobacterium avium subsp. paratuberculosis
cguucgguccgga

SEQ ID NO: 927453 - RNA, 13 nt, Mycobacterium avium subsp. paratuberculosis
cguucgggugcga

SEQ ID NO: 927454 - RNA, 23 nt, Mycobacterium avium subsp. paratuberculosis
cguucggguuacguggacgcgcg

SEQ ID NO: 927455 - RNA, 13 nt, Mycobacterium avium subsp. paratuberculosis
cguucgucgccgg

SEQ ID NO: 927456 - RNA, 15 nt, Mycobacterium avium subsp. paratuberculosis
cguucccagcccggc

SEQ ID NO: 927457 - RNA, 17 nt, Mycobacterium avium subsp. paratuberculosis
cguuccccggccgacgu

SEQ ID NO: 927458 - RNA, 19 nt, Mycobacterium avium subsp. paratuberculosis
cguuccccggcgugggugu

SEQ ID NO: 927459 - RNA, 13 nt, Mycobacterium avium subsp. paratuberculosis
cguucccgggccc

SEQ ID NO: 927460 - RNA, 17 nt, Mycobacterium avium subsp. paratuberculosis
cguucccugcgcggcga

SEQ ID NO: 927461 - RNA, 12 nt, Mycobacterium avium subsp. paratuberculosis
cguucccgcgcg

SEQ ID NO: 927462 - RNA, 12 nt, Mycobacterium avium subsp. paratuberculosis
cguuccggcggc

SEQ ID NO: 927463 - RNA, 13 nt, Mycobacterium avium subsp. paratuberculosis
cguuccggcggcc

SEQ ID NO: 927464 - RNA, 14 nt, Mycobacterium avium subsp. paratuberculosis
cguuccggcggccg

SEQ ID NO: 927465 - RNA, 19 nt, Mycobacterium avium subsp. paratuberculosis
cguuccggcggccggcggc

SEQ ID NO: 927466 - RNA, 16 nt, Mycobacterium avium subsp. paratuberculosis
cguuccgccacggcgg

SEQ ID NO: 927467 - RNA, 21 nt, Mycobacterium avium subsp. paratuberculosis
cguuccgccacggcgggguca

SEQ ID NO: 927468 - RNA, 12 nt, Mycobacterium avium subsp. paratuberculosis
cguuccgcgaca

SEQ ID NO: 927469 - RNA, 16 nt, Mycobacterium avium subsp. paratuberculosis
cguuccgcgacaaggu

SEQ ID NO: 927470 - RNA, 13 nt, Mycobacterium avium subsp. paratuberculosis
cguucggcgauca

SEQ ID NO: 927471 - RNA, 15 nt, Mycobacterium avium subsp. paratuberculosis
cguucggcgaucagc

SEQ ID NO: 927472 - RNA, 16 nt, Mycobacterium avium subsp. paratuberculosis
cguucggccagcgccg

SEQ ID NO: 927473 - RNA, 17 nt, Mycobacterium avium subsp. paratuberculosis
cguucggccagcgccgc

SEQ ID NO: 927474 - RNA, 22 nt, Mycobacterium avium subsp. paratuberculosis
cguucggccaguucggguccgc

SEQ ID NO: 927475 - RNA, 20 nt, Mycobacterium avium subsp. paratuberculosis
cguugauugaccauccgguc

SEQ ID NO: 927476 - RNA, 21 nt, Mycobacterium avium subsp. paratuberculosis
cguugauugaccauccggucc

SEQ ID NO: 927477 - RNA, 18 nt, Mycobacterium avium subsp. paratuberculosis
cguugauugcgcccgccg

SEQ ID NO: 927478 - RNA, 17 nt, Mycobacterium avium subsp. paratuberculosis
cguugcacaccaccagc

SEQ ID NO: 927479 - RNA, 16 nt, Mycobacterium avium subsp. paratuberculosis
cguugcacacccggug

SEQ ID NO: 927480 - RNA, 19 nt, Mycobacterium avium subsp. paratuberculosis
cguugcacacccggugcgc

SEQ ID NO: 927481 - RNA, 16 nt, Mycobacterium avium subsp. paratuberculosis
cguugcccgccagcau

SEQ ID NO: 927482 - RNA, 16 nt, Mycobacterium avium subsp. paratuberculosis
cguugcccgccgcggc

SEQ ID NO: 927483 - RNA, 18 nt, Mycobacterium avium subsp. paratuberculosis
cguugcacaggcacacga

SEQ ID NO: 927484 - RNA, 20 nt, Mycobacterium avium subsp. paratuberculosis
cguugcacaggcacacgaac

SEQ ID NO: 927485 - RNA, 17 nt, Mycobacterium avium subsp. paratuberculosis
cguugaugccgcccagc

SEQ ID NO: 927486 - RNA, 16 nt, Mycobacterium avium subsp. paratuberculosis
cguugaugucggccag

SEQ ID NO: 927487 - RNA, 14 nt, Mycobacterium avium subsp. paratuberculosis
cguugaugucggcc

SEQ ID NO: 927488 - RNA, 21 nt, Mycobacterium avium subsp. paratuberculosis
cguugaugaagaccuggccgg

SEQ ID NO: 927489 - RNA, 17 nt, Mycobacterium avium subsp. paratuberculosis
cguugaugccgucgauc

SEQ ID NO: 927490 - RNA, 18 nt, Mycobacterium avium subsp. paratuberculosis
cguugaugccgucgauca

SEQ ID NO: 927491 - RNA, 20 nt, Mycobacterium avium subsp. paratuberculosis
cguugaugccgucgaucacc

SEQ ID NO: 927492 - RNA, 17 nt, Mycobacterium avium subsp. paratuberculosis
cguugaugcgcaccgcg

SEQ ID NO: 927493 - RNA, 20 nt, Mycobacterium avium subsp. paratuberculosis
cguugaugcgcaccgcggcg

SEQ ID NO: 927494 - RNA, 21 nt, Mycobacterium avium subsp. paratuberculosis
cguugaugcgcaccgcggcgu

SEQ ID NO: 927495 - RNA, 23 nt, Mycobacterium avium subsp. paratuberculosis
cguugagcacacccagcgagccg

SEQ ID NO: 927496 - RNA, 15 nt, Mycobacterium avium subsp. paratuberculosis
cguugagcacccgga

SEQ ID NO: 927497 - RNA, 18 nt, Mycobacterium avium subsp. paratuberculosis
cguugagcaccgcgaaga

SEQ ID NO: 927498 - RNA, 13 nt, Mycobacterium avium subsp. paratuberculosis
cguugacgcccuc

SEQ ID NO: 927499 - RNA, 19 nt, Mycobacterium avium subsp. paratuberculosis
cguugacgcccuccuggcg

SEQ ID NO: 927500 - RNA, 20 nt, Mycobacterium avium subsp. paratuberculosis
cguugacgcugggcggcgac

SEQ ID NO: 927501 - RNA, 13 nt, Mycobacterium avium subsp. paratuberculosis
cguugacgguguu

SEQ ID NO: 927502 - RNA, 20 nt, Mycobacterium avium subsp. paratuberculosis
cguugaccgggucgccgauc

SEQ ID NO: 927503 - RNA, 15 nt, Mycobacterium avium subsp. paratuberculosis
cguugaccgcggcga

SEQ ID NO: 927504 - RNA, 17 nt, Mycobacterium avium subsp. paratuberculosis
cguugaccgggucgccg

SEQ ID NO: 927505 - RNA, 19 nt, Mycobacterium avium subsp. paratuberculosis
cguugaccgggccgcuggu

SEQ ID NO: 927506 - RNA, 14 nt, Mycobacterium avium subsp. paratuberculosis
cguugaccgggucg

SEQ ID NO: 927507 - RNA, 17 nt, Mycobacterium avium subsp. paratuberculosis
cguugaccaacgccgcc

SEQ ID NO: 927508 - RNA, 18 nt, Mycobacterium avium subsp. paratuberculosis
cguugaccaacgccgccu

SEQ ID NO: 927509 - RNA, 14 nt, Mycobacterium avium subsp. paratuberculosis
cguugaccaccagg

SEQ ID NO: 927510 - RNA, 18 nt, Mycobacterium avium subsp. paratuberculosis
cguugaccaccagguagg

SEQ ID NO: 927511 - RNA, 21 nt, Mycobacterium avium subsp. paratuberculosis
cguugaccccgacggcgccgc

SEQ ID NO: 927512 - RNA, 22 nt, Mycobacterium avium subsp. paratuberculosis
cguugaccccgacggcgccgcg

SEQ ID NO: 927513 - RNA, 19 nt, Mycobacterium avium subsp. paratuberculosis
cguugaacaguucggugca

SEQ ID NO: 927514 - RNA, 17 nt, Mycobacterium avium subsp. paratuberculosis
cguugaacgcgcgggug

SEQ ID NO: 927515 - RNA, 12 nt, Mycobacterium avium subsp. paratuberculosis
cgugccgcuggg

SEQ ID NO: 927516 - RNA, 13 nt, Mycobacterium avium subsp. paratuberculosis
cgugccgcgcggc

SEQ ID NO: 927517 - RNA, 14 nt, Mycobacterium avium subsp. paratuberculosis
cgugccgcgcggcg

SEQ ID NO: 927518 - RNA, 16 nt, Mycobacterium avium subsp. paratuberculosis
cgugccgcgcggcgau

SEQ ID NO: 927519 - RNA, 15 nt, Mycobacterium avium subsp. paratuberculosis
cgugccgcgcggcgg

SEQ ID NO: 927520 - RNA, 20 nt, Mycobacterium avium subsp. paratuberculosis
cgugccgcgcggcggugacc

SEQ ID NO: 927521 - RNA, 14 nt, Mycobacterium avium subsp. paratuberculosis
cgugccgcccgucg

SEQ ID NO: 927522 - RNA, 15 nt, Mycobacterium avium subsp. paratuberculosis
cgugccgcccgucgc

SEQ ID NO: 927523 - RNA, 17 nt, Mycobacterium avium subsp. paratuberculosis
cgugccgcccgucgccu

SEQ ID NO: 927524 - RNA, 19 nt, Mycobacterium avium subsp. paratuberculosis
cgugccgcccgucgccucc

SEQ ID NO: 927525 - RNA, 16 nt, Mycobacterium avium subsp. paratuberculosis
cgugccgcccggaccg

SEQ ID NO: 927526 - RNA, 22 nt, Mycobacterium avium subsp. paratuberculosis
cgugccgcccggaccgcggucg

SEQ ID NO: 927527 - RNA, 15 nt, Mycobacterium avium subsp. paratuberculosis
cgugccgccauaccc

SEQ ID NO: 927528 - RNA, 13 nt, Mycobacterium avium subsp. paratuberculosis
cgugccggcucgg

SEQ ID NO: 927529 - RNA, 18 nt, Mycobacterium avium subsp. paratuberculosis
cgugccggcucggcggcu

SEQ ID NO: 927530 - RNA, 20 nt, Mycobacterium avium subsp. paratuberculosis
cgugccggcucggcggcuca

SEQ ID NO: 927531 - RNA, 12 nt, Mycobacterium avium subsp. paratuberculosis
cgugccggcgcu

SEQ ID NO: 927532 - RNA, 13 nt, Mycobacterium avium subsp. paratuberculosis
cgugccggcccgg

SEQ ID NO: 927533 - RNA, 15 nt, Mycobacterium avium subsp. paratuberculosis
cgugccggcccggcg

SEQ ID NO: 927534 - RNA, 17 nt, Mycobacterium avium subsp. paratuberculosis
cgugccggcccggcggg

SEQ ID NO: 927535 - RNA, 19 nt, Mycobacterium avium subsp. paratuberculosis
cgugccggaauugaagaag

SEQ ID NO: 927536 - RNA, 18 nt, Mycobacterium avium subsp. paratuberculosis
cgugccggacaccggcac

SEQ ID NO: 927537 - RNA, 22 nt, Mycobacterium avium subsp. paratuberculosis
cgugccggacaccggcacgucg

SEQ ID NO: 927538 - RNA, 14 nt, Mycobacterium avium subsp. paratuberculosis
cgugccggaccgcg

SEQ ID NO: 927539 - RNA, 17 nt, Mycobacterium avium subsp. paratuberculosis
cgugccggaccgcgcgg

SEQ ID NO: 927540 - RNA, 16 nt, Mycobacterium avium subsp. paratuberculosis
cgugccgguggaacag

SEQ ID NO: 927541 - RNA, 16 nt, Mycobacterium avium subsp. paratuberculosis
cgugccgggcgguacg

SEQ ID NO: 927542 - RNA, 16 nt, Mycobacterium avium subsp. paratuberculosis
cgugccguccagcucc

SEQ ID NO: 927543 - RNA, 23 nt, Mycobacterium avium subsp. paratuberculosis
cgugccgucgcuguuggcgacgg

SEQ ID NO: 927544 - RNA, 13 nt, Mycobacterium avium subsp. paratuberculosis
cgugccgucggcg

SEQ ID NO: 927545 - RNA, 16 nt, Mycobacterium avium subsp. paratuberculosis
cgugccguccggccgg

SEQ ID NO: 927546 - RNA, 19 nt, Mycobacterium avium subsp. paratuberculosis
cgugccguccggccgguug

SEQ ID NO: 927547 - RNA, 22 nt, Mycobacterium avium subsp. paratuberculosis
cgugcgacuugguggccagcac

SEQ ID NO: 927548 - RNA, 23 nt, Mycobacterium avium subsp. paratuberculosis
cgugcgacuugguggccagcacc

SEQ ID NO: 927549 - RNA, 16 nt, Mycobacterium avium subsp. paratuberculosis
cgugcgaaugacgcgc

SEQ ID NO: 927550 - RNA, 17 nt, Mycobacterium avium subsp. paratuberculosis
cgugcgaaugacgcgca

SEQ ID NO: 927551 - RNA, 17 nt, Mycobacterium avium subsp. paratuberculosis
cgugcgacaccggcgug

SEQ ID NO: 927552 - RNA, 18 nt, Mycobacterium avium subsp. paratuberculosis
cgugcgacaccggcguga

SEQ ID NO: 927553 - RNA, 18 nt, Mycobacterium avium subsp. paratuberculosis
aaccgcauucggccgcca

SEQ ID NO: 927554 - RNA, 21 nt, Mycobacterium avium subsp. paratuberculosis
cgugcuggagcggaucccggu

SEQ ID NO: 927555 - RNA, 17 nt, Mycobacterium avium subsp. paratuberculosis
cgugcugcgcagcagcg

SEQ ID NO: 927556 - RNA, 15 nt, Mycobacterium avium subsp. paratuberculosis
cgugcugacgucguc

SEQ ID NO: 927557 - RNA, 16 nt, Mycobacterium avium subsp. paratuberculosis
cgugcugacgucgucg

SEQ ID NO: 927558 - RNA, 18 nt, Mycobacterium avium subsp. paratuberculosis
cgugcugacgucgucgcc

SEQ ID NO: 927559 - RNA, 19 nt, Mycobacterium avium subsp. paratuberculosis
cgugcugccggacaccccg

SEQ ID NO: 927560 - RNA, 14 nt, Mycobacterium avium subsp. paratuberculosis
cgugcugccggccg

SEQ ID NO: 927561 - RNA, 15 nt, Mycobacterium avium subsp. paratuberculosis
cgugcugccggccgg

SEQ ID NO: 927562 - RNA, 19 nt, Mycobacterium avium subsp. paratuberculosis
cgugcggguggccgggucg

SEQ ID NO: 927563 - RNA, 20 nt, Mycobacterium avium subsp. paratuberculosis
cgugcggguggccgggucgc

SEQ ID NO: 927564 - RNA, 23 nt, Mycobacterium avium subsp. paratuberculosis
cgugcggguggccgggucgccgu

SEQ ID NO: 927565 - RNA, 17 nt, Mycobacterium avium subsp. paratuberculosis
cgugcgggugguccacc

SEQ ID NO: 927566 - RNA, 18 nt, Mycobacterium avium subsp. paratuberculosis
cgugcggguuggcgccgg

SEQ ID NO: 927567 - RNA, 20 nt, Mycobacterium avium subsp. paratuberculosis
cgugcggguuggcgccggug

SEQ ID NO: 927568 - RNA, 21 nt, Mycobacterium avium subsp. paratuberculosis
cgugcucgagcaucucggugc

SEQ ID NO: 927569 - RNA, 15 nt, Mycobacterium avium subsp. paratuberculosis
cgugcgggucgcgcu

SEQ ID NO: 927570 - RNA, 13 nt, Mycobacterium avium subsp. paratuberculosis
cgugcucggccac

SEQ ID NO: 927571 - RNA, 14 nt, Mycobacterium avium subsp. paratuberculosis
cgugcucggccacg

SEQ ID NO: 927572 - RNA, 20 nt, Mycobacterium avium subsp. paratuberculosis
cgugcucggccacgacgcgc

SEQ ID NO: 927573 - RNA, 19 nt, Mycobacterium avium subsp. paratuberculosis
cgugcgggcuccgcacgac

SEQ ID NO: 927574 - RNA, 14 nt, Mycobacterium avium subsp. paratuberculosis
cgugcucggcggcc

SEQ ID NO: 927575 - RNA, 17 nt, Mycobacterium avium subsp. paratuberculosis
cgugcucggcggccgcc

SEQ ID NO: 927576 - RNA, 15 nt, Mycobacterium avium subsp. paratuberculosis
cgugcucggcggcgg

SEQ ID NO: 927577 - RNA, 13 nt, Mycobacterium avium subsp. paratuberculosis
cgugcucgucgcg

SEQ ID NO: 927578 - RNA, 16 nt, Mycobacterium avium subsp. paratuberculosis
cgugcucgucggcggg

SEQ ID NO: 927579 - RNA, 23 nt, Mycobacterium avium subsp. paratuberculosis
cgugcucggcgagcaccgugccg

SEQ ID NO: 927580 - RNA, 14 nt, Mycobacterium avium subsp. paratuberculosis
cgugcggccgcagc

SEQ ID NO: 927581 - RNA, 17 nt, Mycobacterium avium subsp. paratuberculosis
cgugcgcaaguagcgcu

SEQ ID NO: 927582 - RNA, 22 nt, Mycobacterium avium subsp. paratuberculosis
cgugcggcgcccuucccggucg

SEQ ID NO: 927583 - RNA, 13 nt, Mycobacterium avium subsp. paratuberculosis
cgugcggcgccgc

SEQ ID NO: 927584 - RNA, 14 nt, Mycobacterium avium subsp. paratuberculosis
cgugcggcgccgcc

SEQ ID NO: 927585 - RNA, 16 nt, Mycobacterium avium subsp. paratuberculosis
cgugcggcgccgcccg

SEQ ID NO: 927586 - RNA, 19 nt, Mycobacterium avium subsp. paratuberculosis
cgugcgggaugccgagcag

SEQ ID NO: 927587 - RNA, 20 nt, Mycobacterium avium subsp. paratuberculosis
cgugcgggaugccgagcagc

SEQ ID NO: 927588 - RNA, 15 nt, Mycobacterium avium subsp. paratuberculosis
cgugcggcugcccag

SEQ ID NO: 927589 - RNA, 19 nt, Mycobacterium avium subsp. paratuberculosis
cgugcggcggcggcggucc

SEQ ID NO: 927590 - RNA, 15 nt, Mycobacterium avium subsp. paratuberculosis
cgugcggccgcagcg

SEQ ID NO: 927591 - RNA, 14 nt, Mycobacterium avium subsp. paratuberculosis
cgugcggccggcgc

SEQ ID NO: 927592 - RNA, 16 nt, Mycobacterium avium subsp. paratuberculosis
cgugcggccggcgccg

SEQ ID NO: 927593 - RNA, 18 nt, Mycobacterium avium subsp. paratuberculosis
cgugcggccggcgccggc

SEQ ID NO: 927594 - RNA, 19 nt, Mycobacterium avium subsp. paratuberculosis
cgugcggccggcgccggcg

SEQ ID NO: 927595 - RNA, 22 nt, Mycobacterium avium subsp. paratuberculosis
cgugcggccggcgccggcgguc

SEQ ID NO: 927596 - RNA, 14 nt, Mycobacterium avium subsp. paratuberculosis
cgugcggccucggc

SEQ ID NO: 927597 - RNA, 16 nt, Mycobacterium avium subsp. paratuberculosis
cgugcggccucggcac

SEQ ID NO: 927598 - RNA, 16 nt, Mycobacterium avium subsp. paratuberculosis
cgugcgcgccgaccgc

SEQ ID NO: 927599 - RNA, 18 nt, Mycobacterium avium subsp. paratuberculosis
cgugcgccucgaucaacg

SEQ ID NO: 927600 - RNA, 20 nt, Mycobacterium avium subsp. paratuberculosis
cgugcgccucgaucaacgcc

SEQ ID NO: 927601 - RNA, 14 nt, Mycobacterium avium subsp. paratuberculosis
cgugcgcgaagcug

SEQ ID NO: 927602 - RNA, 15 nt, Mycobacterium avium subsp. paratuberculosis
cgugcgcgaagcugg

SEQ ID NO: 927603 - RNA, 12 nt, Mycobacterium avium subsp. paratuberculosis
cgugcgccggcc

SEQ ID NO: 927604 - RNA, 14 nt, Mycobacterium avium subsp. paratuberculosis
cgugcgccggcggu

SEQ ID NO: 927605 - RNA, 15 nt, Mycobacterium avium subsp. paratuberculosis
cgugcgccggcggug

SEQ ID NO: 927606 - RNA, 18 nt, Mycobacterium avium subsp. paratuberculosis
cgugcgccggcggugcgg

SEQ ID NO: 927607 - RNA, 21 nt, Mycobacterium avium subsp. paratuberculosis
cgugcgccggcggugcggcgg

SEQ ID NO: 927608 - RNA, 14 nt, Mycobacterium avium subsp. paratuberculosis
cgugcgccgcccac

SEQ ID NO: 927609 - RNA, 18 nt, Mycobacterium avium subsp. paratuberculosis
cgugcgccgcccacaccg

SEQ ID NO: 927610 - RNA, 21 nt, Mycobacterium avium subsp. paratuberculosis
cgugcgccgcccacaccgaca

SEQ ID NO: 927611 - RNA, 13 nt, Mycobacterium avium subsp. paratuberculosis
cgugcgccgcggc

SEQ ID NO: 927612 - RNA, 14 nt, Mycobacterium avium subsp. paratuberculosis
cgugcgccgcggcg

SEQ ID NO: 927613 - RNA, 15 nt, Mycobacterium avium subsp. paratuberculosis
cgugcgccgcggcgg

SEQ ID NO: 927614 - RNA, 18 nt, Mycobacterium avium subsp. paratuberculosis
cgugcgcccauccggcgc

SEQ ID NO: 927615 - RNA, 21 nt, Mycobacterium avium subsp. paratuberculosis
cgugcgcccauccggcgccgc

SEQ ID NO: 927616 - RNA, 14 nt, Mycobacterium avium subsp. paratuberculosis
cgugcgccccgccc

SEQ ID NO: 927617 - RNA, 20 nt, Mycobacterium avium subsp. paratuberculosis
cgugcgcccgacgccggacc

SEQ ID NO: 927618 - RNA, 22 nt, Mycobacterium avium subsp. paratuberculosis
aaccgccagcagcgcaagcuga

SEQ ID NO: 927619 - RNA, 17 nt, Mycobacterium avium subsp. paratuberculosis
aaccgcccggcgccgau

SEQ ID NO: 927620 - RNA, 11 nt, Mycobacterium avium subsp. paratuberculosis
aaccgccgcgc

SEQ ID NO: 927621 - RNA, 12 nt, Mycobacterium avium subsp. paratuberculosis
aaccgcgcggcg

SEQ ID NO: 927622 - RNA, 17 nt, Mycobacterium avium subsp. paratuberculosis
aaccgcgagcagacgcg

SEQ ID NO: 927623 - RNA, 20 nt, Mycobacterium avium subsp. paratuberculosis
aaccgcggacuggccaccgc

SEQ ID NO: 927624 - RNA, 21 nt, Mycobacterium avium subsp. paratuberculosis
aaccgcggcggcagcagcccg

SEQ ID NO: 927625 - RNA, 19 nt, Mycobacterium avium subsp. paratuberculosis
aaccgcggcggcggcccgu

SEQ ID NO: 927626 - RNA, 16 nt, Mycobacterium avium subsp. paratuberculosis
cguggaaaucgagcgc

SEQ ID NO: 927627 - RNA, 20 nt, Mycobacterium avium subsp. paratuberculosis
cguggaaaucgagcgcgcug

SEQ ID NO: 927628 - RNA, 22 nt, Mycobacterium avium subsp. paratuberculosis
cguggaaaucgagcgcgcugug

SEQ ID NO: 927629 - RNA, 15 nt, Mycobacterium avium subsp. paratuberculosis
cguggaacaccgcgc

SEQ ID NO: 927630 - RNA, 15 nt, Mycobacterium avium subsp. paratuberculosis
cguggaacacgccca

SEQ ID NO: 927631 - RNA, 20 nt, Mycobacterium avium subsp. paratuberculosis
cguggaacacgcccagcgcc

SEQ ID NO: 927632 - RNA, 16 nt, Mycobacterium avium subsp. paratuberculosis
aaccgcccuuccagca

SEQ ID NO: 927633 - RNA, 17 nt, Mycobacterium avium subsp. paratuberculosis
cgugcuuuugcgucugc

SEQ ID NO: 927634 - RNA, 16 nt, Mycobacterium avium subsp. paratuberculosis
cguggaacgacgccag

SEQ ID NO: 927635 - RNA, 21 nt, Mycobacterium avium subsp. paratuberculosis
cguggaacgcgucgcgccagc

SEQ ID NO: 927636 - RNA, 20 nt, Mycobacterium avium subsp. paratuberculosis
cguggaagauguugccgcca

SEQ ID NO: 927637 - RNA, 17 nt, Mycobacterium avium subsp. paratuberculosis
cguggaagucgccgucc

SEQ ID NO: 927638 - RNA, 22 nt, Mycobacterium avium subsp. paratuberculosis
cguggaagucgccguccggggc

SEQ ID NO: 927639 - RNA, 12 nt, Mycobacterium avium subsp. paratuberculosis
cguggacaccgc

SEQ ID NO: 927640 - RNA, 15 nt, Mycobacterium avium subsp. paratuberculosis
cguggacaccgcacc

SEQ ID NO: 927641 - RNA, 20 nt, Mycobacterium avium subsp. paratuberculosis
cguggacccgccccgacagc

SEQ ID NO: 927642 - RNA, 18 nt, Mycobacterium avium subsp. paratuberculosis
cguggaccgagcgcgcga

SEQ ID NO: 927643 - RNA, 18 nt, Mycobacterium avium subsp. paratuberculosis
cguggacgaacgcggcga

SEQ ID NO: 927644 - RNA, 17 nt, Mycobacterium avium subsp. paratuberculosis
cguggacgcgcgcggcg

SEQ ID NO: 927645 - RNA, 18 nt, Mycobacterium avium subsp. paratuberculosis
cguggacgcgcgcggcgu

SEQ ID NO: 927646 - RNA, 13 nt, Mycobacterium avium subsp. paratuberculosis
cguggacggcgag

SEQ ID NO: 927647 - RNA, 15 nt, Mycobacterium avium subsp. paratuberculosis
cguggacggcgagcg

SEQ ID NO: 927648 - RNA, 19 nt, Mycobacterium avium subsp. paratuberculosis
cguggcgacaucgccgcgg

SEQ ID NO: 927649 - RNA, 20 nt, Mycobacterium avium subsp. paratuberculosis
cguggcgacaucgccgcggc

SEQ ID NO: 927650 - RNA, 15 nt, Mycobacterium avium subsp. paratuberculosis
cguggcgacgacgcc

SEQ ID NO: 927651 - RNA, 20 nt, Mycobacterium avium subsp. paratuberculosis
cguggcgacgacgccgaucc

SEQ ID NO: 927652 - RNA, 13 nt, Mycobacterium avium subsp. paratuberculosis
cguggcgccggcg

SEQ ID NO: 927653 - RNA, 14 nt, Mycobacterium avium subsp. paratuberculosis
cguggcgccggcgc

SEQ ID NO: 927654 - RNA, 17 nt, Mycobacterium avium subsp. paratuberculosis
cguggcgccggcgcgcg

SEQ ID NO: 927655 - RNA, 13 nt, Mycobacterium avium subsp. paratuberculosis
cguggcgcgacgc

SEQ ID NO: 927656 - RNA, 15 nt, Mycobacterium avium subsp. paratuberculosis
cguggcgcgacgcgg

SEQ ID NO: 927657 - RNA, 15 nt, Mycobacterium avium subsp. paratuberculosis
cguggcgcaucaccu

SEQ ID NO: 927658 - RNA, 17 nt, Mycobacterium avium subsp. paratuberculosis
cgugggcccgugcgggu

SEQ ID NO: 927659 - RNA, 18 nt, Mycobacterium avium subsp. paratuberculosis
cgugggccgaccggccgg

SEQ ID NO: 927660 - RNA, 20 nt, Mycobacterium avium subsp. paratuberculosis
cgugggccgcagcgcggcga

SEQ ID NO: 927661 - RNA, 16 nt, Mycobacterium avium subsp. paratuberculosis
cgugggccaggaagaa

SEQ ID NO: 927662 - RNA, 15 nt, Mycobacterium avium subsp. paratuberculosis
cgugggccaccacgu

SEQ ID NO: 927663 - RNA, 22 nt, Mycobacterium avium subsp. paratuberculosis
cgugggcaacacgucguccggc

SEQ ID NO: 927664 - RNA, 22 nt, Mycobacterium avium subsp. paratuberculosis
cguggucuccuggccgccgugc

SEQ ID NO: 927665 - RNA, 17 nt, Mycobacterium avium subsp. paratuberculosis
cguggucucgcaccugc

SEQ ID NO: 927666 - RNA, 15 nt, Mycobacterium avium subsp. paratuberculosis
cguggucggcgaugc

SEQ ID NO: 927667 - RNA, 15 nt, Mycobacterium avium subsp. paratuberculosis
cguggucggcgcggu

SEQ ID NO: 927668 - RNA, 16 nt, Mycobacterium avium subsp. paratuberculosis
cguggucggcgcgguc

SEQ ID NO: 927669 - RNA, 17 nt, Mycobacterium avium subsp. paratuberculosis
cguggucggcgcggucc

SEQ ID NO: 927670 - RNA, 17 nt, Mycobacterium avium subsp. paratuberculosis
cguggucggcgaacgcc

SEQ ID NO: 927671 - RNA, 16 nt, Mycobacterium avium subsp. paratuberculosis
cguggucggcgaagcg

SEQ ID NO: 927672 - RNA, 22 nt, Mycobacterium avium subsp. paratuberculosis
cguggucgggcaugccggccgg

SEQ ID NO: 927673 - RNA, 23 nt, Mycobacterium avium subsp. paratuberculosis
cguggucggugcccugugaggcg

SEQ ID NO: 927674 - RNA, 14 nt, Mycobacterium avium subsp. paratuberculosis
cguggucgccguug

SEQ ID NO: 927675 - RNA, 19 nt, Mycobacterium avium subsp. paratuberculosis
cguggucggcagcaccggc

SEQ ID NO: 927676 - RNA, 21 nt, Mycobacterium avium subsp. paratuberculosis
cguggucggcagcaccggcag

SEQ ID NO: 927677 - RNA, 12 nt, Mycobacterium avium subsp. paratuberculosis
cguggucggcga

SEQ ID NO: 927678 - RNA, 15 nt, Mycobacterium avium subsp. paratuberculosis
cguggcuuucggcgc

SEQ ID NO: 927679 - RNA, 18 nt, Mycobacterium avium subsp. paratuberculosis
cguggcuuucggcgccaa

SEQ ID NO: 927680 - RNA, 19 nt, Mycobacterium avium subsp. paratuberculosis
cguggcuuucggcgccaac

SEQ ID NO: 927681 - RNA, 19 nt, Mycobacterium avium subsp. paratuberculosis
cguggcuugaucgcaccca

SEQ ID NO: 927682 - RNA, 15 nt, Mycobacterium avium subsp. paratuberculosis
cguggcggccgucgc

SEQ ID NO: 927683 - RNA, 17 nt, Mycobacterium avium subsp. paratuberculosis
cguggcggccgucgcgc

SEQ ID NO: 927684 - RNA, 14 nt, Mycobacterium avium subsp. paratuberculosis
cguggcgggccagg

SEQ ID NO: 927685 - RNA, 13 nt, Mycobacterium avium subsp. paratuberculosis
cguggcgggcccg

SEQ ID NO: 927686 - RNA, 13 nt, Mycobacterium avium subsp. paratuberculosis
cguggcggcgggc

SEQ ID NO: 927687 - RNA, 15 nt, Mycobacterium avium subsp. paratuberculosis
cguggcggcgggcca

SEQ ID NO: 927688 - RNA, 16 nt, Mycobacterium avium subsp. paratuberculosis
cguggcggcgggccag

SEQ ID NO: 927689 - RNA, 21 nt, Mycobacterium avium subsp. paratuberculosis
cguggcggcgggccagcucgu

SEQ ID NO: 927690 - RNA, 22 nt, Mycobacterium avium subsp. paratuberculosis
cguggcggcgggccagcucguc

SEQ ID NO: 927691 - RNA, 23 nt, Mycobacterium avium subsp. paratuberculosis
cguggcggcgggccagcucgucg

SEQ ID NO: 927692 - RNA, 16 nt, Mycobacterium avium subsp. paratuberculosis
cguggcggcgguggcg

SEQ ID NO: 927693 - RNA, 20 nt, Mycobacterium avium subsp. paratuberculosis
cguggcggcgguggcgauga

SEQ ID NO: 927694 - RNA, 21 nt, Mycobacterium avium subsp. paratuberculosis
cguggcggcggugucgcccag

SEQ ID NO: 927695 - RNA, 22 nt, Mycobacterium avium subsp. paratuberculosis
cguggcggcggugucgcccagc

SEQ ID NO: 927696 - RNA, 14 nt, Mycobacterium avium subsp. paratuberculosis
cguggcggcccgac

SEQ ID NO: 927697 - RNA, 18 nt, Mycobacterium avium subsp. paratuberculosis
cguggcggcccgaccagc

SEQ ID NO: 927698 - RNA, 19 nt, Mycobacterium avium subsp. paratuberculosis
cguggcggaagcgcguuca

SEQ ID NO: 927699 - RNA, 13 nt, Mycobacterium avium subsp. paratuberculosis
cguggcgcucagc

SEQ ID NO: 927700 - RNA, 18 nt, Mycobacterium avium subsp. paratuberculosis
cguggcgcucagcggcag

SEQ ID NO: 927701 - RNA, 21 nt, Mycobacterium avium subsp. paratuberculosis
aacccgccgcggccgaaccgc

SEQ ID NO: 927702 - RNA, 13 nt, Mycobacterium avium subsp. paratuberculosis
cgucaccaaugcg

SEQ ID NO: 927703 - RNA, 18 nt, Mycobacterium avium subsp. paratuberculosis
cgucaccaaugcgccggc

SEQ ID NO: 927704 - RNA, 19 nt, Mycobacterium avium subsp. paratuberculosis
cgucaccaaugcgccggcg

SEQ ID NO: 927705 - RNA, 16 nt, Mycobacterium avium subsp. paratuberculosis
cgucaccaccgggucg

SEQ ID NO: 927706 - RNA, 14 nt, Mycobacterium avium subsp. paratuberculosis
cgucacccagaucg

SEQ ID NO: 927707 - RNA, 17 nt, Mycobacterium avium subsp. paratuberculosis
cgucaccgaccccucgg

SEQ ID NO: 927708 - RNA, 21 nt, Mycobacterium avium subsp. paratuberculosis
cgucaccgaccccucggcggc

SEQ ID NO: 927709 - RNA, 22 nt, Mycobacterium avium subsp. paratuberculosis
cgucaccgaccccucggcggcc

SEQ ID NO: 927710 - RNA, 19 nt, Mycobacterium avium subsp. paratuberculosis
cgucaccgccgcaccgucg

SEQ ID NO: 927711 - RNA, 22 nt, Mycobacterium avium subsp. paratuberculosis
cgucaccgccgcaccgucgugc

SEQ ID NO: 927712 - RNA, 16 nt, Mycobacterium avium subsp. paratuberculosis
cgucacccccggcgcg

SEQ ID NO: 927713 - RNA, 17 nt, Mycobacterium avium subsp. paratuberculosis
cgucacccccggcgcga

SEQ ID NO: 927714 - RNA, 18 nt, Mycobacterium avium subsp. paratuberculosis
cgucacccccggcgcgac

SEQ ID NO: 927715 - RNA, 21 nt, Mycobacterium avium subsp. paratuberculosis
cgucacccccggcgcgacggc

SEQ ID NO: 927716 - RNA, 21 nt, Mycobacterium avium subsp. paratuberculosis
cgucaccaggcugcucggcgg

SEQ ID NO: 927717 - RNA, 22 nt, Mycobacterium avium subsp. paratuberculosis
cgucaccaggcugcucggcggg

SEQ ID NO: 927718 - RNA, 23 nt, Mycobacterium avium subsp. paratuberculosis
cgucaccaggcugcucggcgggc

SEQ ID NO: 927719 - RNA, 12 nt, Mycobacterium avium subsp. paratuberculosis
cgucaccggcug

SEQ ID NO: 927720 - RNA, 15 nt, Mycobacterium avium subsp. paratuberculosis
cgucaccggcugccc

SEQ ID NO: 927721 - RNA, 22 nt, Mycobacterium avium subsp. paratuberculosis
cgucaccggcugcccgacccgc

SEQ ID NO: 927722 - RNA, 16 nt, Mycobacterium avium subsp. paratuberculosis
cgucaccgugccgucg

SEQ ID NO: 927723 - RNA, 18 nt, Mycobacterium avium subsp. paratuberculosis
cgucaccgugggcggcgc

SEQ ID NO: 927724 - RNA, 19 nt, Mycobacterium avium subsp. paratuberculosis
cgucaccgugggcggcgcg

SEQ ID NO: 927725 - RNA, 20 nt, Mycobacterium avium subsp. paratuberculosis
cgucaccgugggcggcgcga

SEQ ID NO: 927726 - RNA, 21 nt, Mycobacterium avium subsp. paratuberculosis
cgucaccguggugugcccgcg

SEQ ID NO: 927727 - RNA, 22 nt, Mycobacterium avium subsp. paratuberculosis
cgucaccguggugugcccgcgg

SEQ ID NO: 927728 - RNA, 19 nt, Mycobacterium avium subsp. paratuberculosis
cgucaccgcugaugccgcc

SEQ ID NO: 927729 - RNA, 20 nt, Mycobacterium avium subsp. paratuberculosis
cguaucaacugagcgcccgg

SEQ ID NO: 927730 - RNA, 18 nt, Mycobacterium avium subsp. paratuberculosis
cguaggcgaggaccgaga

SEQ ID NO: 927731 - RNA, 16 nt, Mycobacterium avium subsp. paratuberculosis
cguaucccaccacgaa

SEQ ID NO: 927732 - RNA, 13 nt, Mycobacterium avium subsp. paratuberculosis
cguauccgcgguc

SEQ ID NO: 927733 - RNA, 15 nt, Mycobacterium avium subsp. paratuberculosis
cguauccgcggucga

SEQ ID NO: 927734 - RNA, 17 nt, Mycobacterium avium subsp. paratuberculosis
cguauccgcggucgacc

SEQ ID NO: 927735 - RNA, 19 nt, Mycobacterium avium subsp. paratuberculosis
cguagucgauggccucguc

SEQ ID NO: 927736 - RNA, 22 nt, Mycobacterium avium subsp. paratuberculosis
cguagucgauggccucgucgcg

SEQ ID NO: 927737 - RNA, 14 nt, Mycobacterium avium subsp. paratuberculosis
cguagucgccgaug

SEQ ID NO: 927738 - RNA, 19 nt, Mycobacterium avium subsp. paratuberculosis
cguagucgcgcaccauccg

SEQ ID NO: 927739 - RNA, 19 nt, Mycobacterium avium subsp. paratuberculosis
cguagucgcucggcggcga

SEQ ID NO: 927740 - RNA, 19 nt, Mycobacterium avium subsp. paratuberculosis
cguagucgcugagcgggaa

SEQ ID NO: 927741 - RNA, 17 nt, Mycobacterium avium subsp. paratuberculosis
cguagucggcccgccgg

SEQ ID NO: 927742 - RNA, 19 nt, Mycobacterium avium subsp. paratuberculosis
cguagucggcccgccgggc

SEQ ID NO: 927743 - RNA, 21 nt, Mycobacterium avium subsp. paratuberculosis
cguagucggcccgccgggccg

SEQ ID NO: 927744 - RNA, 12 nt, Mycobacterium avium subsp. paratuberculosis
cguagucggcgg

SEQ ID NO: 927745 - RNA, 15 nt, Mycobacterium avium subsp. paratuberculosis
cguagucggcggcga

SEQ ID NO: 927746 - RNA, 16 nt, Mycobacterium avium subsp. paratuberculosis
cguagucggcgucggc

SEQ ID NO: 927747 - RNA, 13 nt, Mycobacterium avium subsp. paratuberculosis
cguagucgucgau

SEQ ID NO: 927748 - RNA, 19 nt, Mycobacterium avium subsp. paratuberculosis
cguagucguugucggcggu

SEQ ID NO: 927749 - RNA, 14 nt, Mycobacterium avium subsp. paratuberculosis
cguauccggccagc

SEQ ID NO: 927750 - RNA, 18 nt, Mycobacterium avium subsp. paratuberculosis
cguaucgcgccugcaccg

SEQ ID NO: 927751 - RNA, 16 nt, Mycobacterium avium subsp. paratuberculosis
cguaucuccaccgucg

SEQ ID NO: 927752 - RNA, 20 nt, Mycobacterium avium subsp. paratuberculosis
cguaucuccaccgucgaugg

SEQ ID NO: 927753 - RNA, 19 nt, Mycobacterium avium subsp. paratuberculosis
cguaguaggugcgcgagga

SEQ ID NO: 927754 - RNA, 22 nt, Mycobacterium avium subsp. paratuberculosis
cguaguaggugcgcgaggaggg

SEQ ID NO: 927755 - RNA, 16 nt, Mycobacterium avium subsp. paratuberculosis
cguaguaggcgccgaa

SEQ ID NO: 927756 - RNA, 12 nt, Mycobacterium avium subsp. paratuberculosis
cguaggcgauca

SEQ ID NO: 927757 - RNA, 19 nt, Mycobacterium avium subsp. paratuberculosis
cguaggccuugcugagccg

SEQ ID NO: 927758 - RNA, 18 nt, Mycobacterium avium subsp. paratuberculosis
cguaggcgaugucgacgu

SEQ ID NO: 927759 - RNA, 16 nt, Mycobacterium avium subsp. paratuberculosis
cguaggugggcagcgc

SEQ ID NO: 927760 - RNA, 23 nt, Mycobacterium avium subsp. paratuberculosis
cguaggugggcagcgcggccagc

SEQ ID NO: 927761 - RNA, 18 nt, Mycobacterium avium subsp. paratuberculosis
cguagaucacggcguuga

SEQ ID NO: 927762 - RNA, 15 nt, Mycobacterium avium subsp. paratuberculosis
cguagaucaucuggc

SEQ ID NO: 927763 - RNA, 17 nt, Mycobacterium avium subsp. paratuberculosis
cguagaucaucuggcug

SEQ ID NO: 927764 - RNA, 15 nt, Mycobacterium avium subsp. paratuberculosis
cguagacggugucgc

SEQ ID NO: 927765 - RNA, 22 nt, Mycobacterium avium subsp. paratuberculosis
cguagagccguuuggcgccgcc

SEQ ID NO: 927766 - RNA, 13 nt, Mycobacterium avium subsp. paratuberculosis
cguagagcgcgaa

SEQ ID NO: 927767 - RNA, 13 nt, Mycobacterium avium subsp. paratuberculosis
cguagaucgucga

SEQ ID NO: 927768 - RNA, 18 nt, Mycobacterium avium subsp. paratuberculosis
cguagaucucgcgccgcg

SEQ ID NO: 927769 - RNA, 15 nt, Mycobacterium avium subsp. paratuberculosis
cguagaugccgguac

SEQ ID NO: 927770 - RNA, 17 nt, Mycobacterium avium subsp. paratuberculosis
cguagaacucgccgugg

SEQ ID NO: 927771 - RNA, 18 nt, Mycobacterium avium subsp. paratuberculosis
cguagaaggcgccgucgg

SEQ ID NO: 927772 - RNA, 20 nt, Mycobacterium avium subsp. paratuberculosis
cguagaaggcgccgucggug

SEQ ID NO: 927773 - RNA, 14 nt, Mycobacterium avium subsp. paratuberculosis
cguagaauccgccg

SEQ ID NO: 927774 - RNA, 18 nt, Mycobacterium avium subsp. paratuberculosis
cguagaauccgccguuga

SEQ ID NO: 927775 - RNA, 22 nt, Mycobacterium avium subsp. paratuberculosis
cguagacccacagcugccggcc

SEQ ID NO: 927776 - RNA, 21 nt, Mycobacterium avium subsp. paratuberculosis
cguagacgaagcggccgggga

SEQ ID NO: 927777 - RNA, 17 nt, Mycobacterium avium subsp. paratuberculosis
cguagacgacgucgacc

SEQ ID NO: 927778 - RNA, 18 nt, Mycobacterium avium subsp. paratuberculosis
cguagacgacgucgaccg

SEQ ID NO: 927779 - RNA, 23 nt, Mycobacterium avium subsp. paratuberculosis
cguagacgacgucgaccgcgccg

SEQ ID NO: 927780 - RNA, 14 nt, Mycobacterium avium subsp. paratuberculosis
cguagacgagccgg

SEQ ID NO: 927781 - RNA, 21 nt, Mycobacterium avium subsp. paratuberculosis
cguagacgagccgguugaccc

SEQ ID NO: 927782 - RNA, 16 nt, Mycobacterium avium subsp. paratuberculosis
cguagcgagcgcuggc

SEQ ID NO: 927783 - RNA, 15 nt, Mycobacterium avium subsp. paratuberculosis
cguagcgcaacaccg

SEQ ID NO: 927784 - RNA, 18 nt, Mycobacterium avium subsp. paratuberculosis
cguagccguagaucgucg

SEQ ID NO: 927785 - RNA, 20 nt, Mycobacterium avium subsp. paratuberculosis
cguagccguagaucgucgag

SEQ ID NO: 927786 - RNA, 17 nt, Mycobacterium avium subsp. paratuberculosis
cguagccggcgguggcc

SEQ ID NO: 927787 - RNA, 14 nt, Mycobacterium avium subsp. paratuberculosis
cguagccggcggug

SEQ ID NO: 927788 - RNA, 14 nt, Mycobacterium avium subsp. paratuberculosis
cguagccgccgguu

SEQ ID NO: 927789 - RNA, 22 nt, Mycobacterium avium subsp. paratuberculosis
cguagccggaccgcuugacgcc

SEQ ID NO: 927790 - RNA, 16 nt, Mycobacterium avium subsp. paratuberculosis
cguagccggcacgcac

SEQ ID NO: 927791 - RNA, 15 nt, Mycobacterium avium subsp. paratuberculosis
cguagcccuaccggc

SEQ ID NO: 927792 - RNA, 17 nt, Mycobacterium avium subsp. paratuberculosis
cguagcccaccucgagc

SEQ ID NO: 927793 - RNA, 14 nt, Mycobacterium avium subsp. paratuberculosis
cguagcccagcgcg

SEQ ID NO: 927794 - RNA, 17 nt, Mycobacterium avium subsp. paratuberculosis
cguagcccagcgcguug

SEQ ID NO: 927795 - RNA, 14 nt, Mycobacterium avium subsp. paratuberculosis
aacccagcaccccg

SEQ ID NO: 927796 - RNA, 16 nt, Mycobacterium avium subsp. paratuberculosis
cguagcgcggccgccc

SEQ ID NO: 927797 - RNA, 23 nt, Mycobacterium avium subsp. paratuberculosis
aacccagcgccucgagcaccacg

SEQ ID NO: 927798 - RNA, 14 nt, Mycobacterium avium subsp. paratuberculosis
aaccccacggccgc

SEQ ID NO: 927799 - RNA, 15 nt, Mycobacterium avium subsp. paratuberculosis
cguagcgcuggguga

SEQ ID NO: 927800 - RNA, 13 nt, Mycobacterium avium subsp. paratuberculosis
cguagcggaagcu

SEQ ID NO: 927801 - RNA, 16 nt, Mycobacterium avium subsp. paratuberculosis
cguagcggacgacggc

SEQ ID NO: 927802 - RNA, 12 nt, Mycobacterium avium subsp. paratuberculosis
cguagcggccgc

SEQ ID NO: 927803 - RNA, 14 nt, Mycobacterium avium subsp. paratuberculosis
cguagcggccgcac

SEQ ID NO: 927804 - RNA, 12 nt, Mycobacterium avium subsp. paratuberculosis
cguagcgccgcc

SEQ ID NO: 927805 - RNA, 17 nt, Mycobacterium avium subsp. paratuberculosis
cguagcgccgcccgucc

SEQ ID NO: 927806 - RNA, 17 nt, Mycobacterium avium subsp. paratuberculosis
cguagcgccagucgcgg

SEQ ID NO: 927807 - RNA, 15 nt, Mycobacterium avium subsp. paratuberculosis
cguagcgcagcucca

SEQ ID NO: 927808 - RNA, 15 nt, Mycobacterium avium subsp. paratuberculosis
cguagcuuccgccuu

SEQ ID NO: 927809 - RNA, 15 nt, Mycobacterium avium subsp. paratuberculosis
cguagcucgccgcgg

SEQ ID NO: 927810 - RNA, 23 nt, Mycobacterium avium subsp. paratuberculosis
cguagcucgccgcggccacgcuc

SEQ ID NO: 927811 - RNA, 15 nt, Mycobacterium avium subsp. paratuberculosis
cguagcucgcgccga

SEQ ID NO: 927812 - RNA, 16 nt, Mycobacterium avium subsp. paratuberculosis
cguagcucgcgccgac

SEQ ID NO: 927813 - RNA, 17 nt, Mycobacterium avium subsp. paratuberculosis
cguagcucgcgccgacc

SEQ ID NO: 927814 - RNA, 17 nt, Mycobacterium avium subsp. paratuberculosis
cguagcugcaggcgacg

SEQ ID NO: 927815 - RNA, 18 nt, Mycobacterium avium subsp. paratuberculosis
cguaggacaccacggugg

SEQ ID NO: 927816 - RNA, 16 nt, Mycobacterium avium subsp. paratuberculosis
cguaggacagcaccac

SEQ ID NO: 927817 - RNA, 17 nt, Mycobacterium avium subsp. paratuberculosis
cguaggacagcagccgc

SEQ ID NO: 927818 - RNA, 22 nt, Mycobacterium avium subsp. paratuberculosis
cguaggacccuucgaacgcgac

SEQ ID NO: 927819 - RNA, 13 nt, Mycobacterium avium subsp. paratuberculosis
aacccgaucggcc

SEQ ID NO: 927820 - RNA, 20 nt, Mycobacterium avium subsp. paratuberculosis
aacccgaucggcccggccaa

SEQ ID NO: 927821 - RNA, 18 nt, Mycobacterium avium subsp. paratuberculosis
cguagcggccgcacgcga

SEQ ID NO: 927822 - RNA, 14 nt, Mycobacterium avium subsp. paratuberculosis
aacccgaccccggc

SEQ ID NO: 927823 - RNA, 17 nt, Mycobacterium avium subsp. paratuberculosis
aacccgaccucgucgac

SEQ ID NO: 927824 - RNA, 15 nt, Mycobacterium avium subsp. paratuberculosis
aacccgagcaccccg

SEQ ID NO: 927825 - RNA, 22 nt, Mycobacterium avium subsp. paratuberculosis
aacccgagcaccccggcggccg

SEQ ID NO: 927826 - RNA, 13 nt, Mycobacterium avium subsp. paratuberculosis
cguagcggcgcca

SEQ ID NO: 927827 - RNA, 15 nt, Mycobacterium avium subsp. paratuberculosis
cguagcggcgccacc

SEQ ID NO: 927828 - RNA, 18 nt, Mycobacterium avium subsp. paratuberculosis
cguagcgggucagcucca

SEQ ID NO: 927829 - RNA, 16 nt, Mycobacterium avium subsp. paratuberculosis
cguagcgguccagcgu

SEQ ID NO: 927830 - RNA, 19 nt, Mycobacterium avium subsp. paratuberculosis
cguacggguugccgucgac

SEQ ID NO: 927831 - RNA, 20 nt, Mycobacterium avium subsp. paratuberculosis
cguacggguugggcggggcg

SEQ ID NO: 927832 - RNA, 23 nt, Mycobacterium avium subsp. paratuberculosis
cguacggguugggcggggcgucg

SEQ ID NO: 927833 - RNA, 20 nt, Mycobacterium avium subsp. paratuberculosis
cguacucgcacagccggcgc

SEQ ID NO: 927834 - RNA, 23 nt, Mycobacterium avium subsp. paratuberculosis
cguacucccaggauuccgucggc

SEQ ID NO: 927835 - RNA, 14 nt, Mycobacterium avium subsp. paratuberculosis
cguacugcgcgacc

SEQ ID NO: 927836 - RNA, 16 nt, Mycobacterium avium subsp. paratuberculosis
cguacugcucggcgcg

SEQ ID NO: 927837 - RNA, 17 nt, Mycobacterium avium subsp. paratuberculosis
cguagaacauccacggc

SEQ ID NO: 927838 - RNA, 20 nt, Mycobacterium avium subsp. paratuberculosis
cguacgacaucucgacggug

SEQ ID NO: 927839 - RNA, 20 nt, Mycobacterium avium subsp. paratuberculosis
cguacgccgccuugacgccg

SEQ ID NO: 927840 - RNA, 22 nt, Mycobacterium avium subsp. paratuberculosis
cguacggcccgggaagccgcag

SEQ ID NO: 927841 - RNA, 12 nt, Mycobacterium avium subsp. paratuberculosis
cguacgggcgca

SEQ ID NO: 927842 - RNA, 20 nt, Mycobacterium avium subsp. paratuberculosis
cguacgggcgcagcgccguc

SEQ ID NO: 927843 - RNA, 12 nt, Mycobacterium avium subsp. paratuberculosis
cguacgggcggg

SEQ ID NO: 927844 - RNA, 14 nt, Mycobacterium avium subsp. paratuberculosis
cguacgggcgggca

SEQ ID NO: 927845 - RNA, 14 nt, Mycobacterium avium subsp. paratuberculosis
cguacgcgauggcg

SEQ ID NO: 927846 - RNA, 14 nt, Mycobacterium avium subsp. paratuberculosis
cguacgcgccggcc

SEQ ID NO: 927847 - RNA, 14 nt, Mycobacterium avium subsp. paratuberculosis
cguacgcgcugccg

SEQ ID NO: 927848 - RNA, 17 nt, Mycobacterium avium subsp. paratuberculosis
cguacccgggcaaugau

SEQ ID NO: 927849 - RNA, 23 nt, Mycobacterium avium subsp. paratuberculosis
cguacccgcgcggcgucggccug

SEQ ID NO: 927850 - RNA, 22 nt, Mycobacterium avium subsp. paratuberculosis
cguaccgaggaugaccgcggcg

SEQ ID NO: 927851 - RNA, 14 nt, Mycobacterium avium subsp. paratuberculosis
cguaccgcaacacc

SEQ ID NO: 927852 - RNA, 15 nt, Mycobacterium avium subsp. paratuberculosis
cguaccgcggcggcg

SEQ ID NO: 927853 - RNA, 19 nt, Mycobacterium avium subsp. paratuberculosis
cguaccgcggcggcgucga

SEQ ID NO: 927854 - RNA, 20 nt, Mycobacterium avium subsp. paratuberculosis
cguaccgcggcggcgucgac

SEQ ID NO: 927855 - RNA, 20 nt, Mycobacterium avium subsp. paratuberculosis
cguaccuagggcccacgcuc

SEQ ID NO: 927856 - RNA, 12 nt, Mycobacterium avium subsp. paratuberculosis
cguaccggcgua

SEQ ID NO: 927857 - RNA, 18 nt, Mycobacterium avium subsp. paratuberculosis
cguacagcgggucguugg

SEQ ID NO: 927858 - RNA, 14 nt, Mycobacterium avium subsp. paratuberculosis
cguacagcuggucc

SEQ ID NO: 927859 - RNA, 18 nt, Mycobacterium avium subsp. paratuberculosis
cguacagcugguccggcc

SEQ ID NO: 927860 - RNA, 19 nt, Mycobacterium avium subsp. paratuberculosis
cguacagcugguccggccg

SEQ ID NO: 927861 - RNA, 20 nt, Mycobacterium avium subsp. paratuberculosis
cguacagcugguccggccgg

SEQ ID NO: 927862 - RNA, 21 nt, Mycobacterium avium subsp. paratuberculosis
cguacagcugguccggccggc

SEQ ID NO: 927863 - RNA, 18 nt, Mycobacterium avium subsp. paratuberculosis
cguacagcgagccgucga

SEQ ID NO: 927864 - RNA, 19 nt, Mycobacterium avium subsp. paratuberculosis
cguacagcgagccgucgac

SEQ ID NO: 927865 - RNA, 21 nt, Mycobacterium avium subsp. paratuberculosis
cguacagcgagccgucgaccg

SEQ ID NO: 927866 - RNA, 12 nt, Mycobacterium avium subsp. paratuberculosis
cguacagcgccc

SEQ ID NO: 927867 - RNA, 15 nt, Mycobacterium avium subsp. paratuberculosis
cguacagcggcgcca

SEQ ID NO: 927868 - RNA, 20 nt, Mycobacterium avium subsp. paratuberculosis
cguacagcaauccgcugaac

SEQ ID NO: 927869 - RNA, 23 nt, Mycobacterium avium subsp. paratuberculosis
cguacaccggcugaccggcggug

SEQ ID NO: 927870 - RNA, 16 nt, Mycobacterium avium subsp. paratuberculosis
cguacagccagcccgu

SEQ ID NO: 927871 - RNA, 13 nt, Mycobacterium avium subsp. paratuberculosis
cguacauggugac

SEQ ID NO: 927872 - RNA, 18 nt, Mycobacterium avium subsp. paratuberculosis
cguacauggugaccagcg

SEQ ID NO: 927873 - RNA, 21 nt, Mycobacterium avium subsp. paratuberculosis
cguacauggugaccagcguga

SEQ ID NO: 927874 - RNA, 16 nt, Mycobacterium avium subsp. paratuberculosis
cguacccaggucggcg

SEQ ID NO: 927875 - RNA, 18 nt, Mycobacterium avium subsp. paratuberculosis
cguacccaggucggcgug

SEQ ID NO: 927876 - RNA, 15 nt, Mycobacterium avium subsp. paratuberculosis
cguaccagcgcucga

SEQ ID NO: 927877 - RNA, 23 nt, Mycobacterium avium subsp. paratuberculosis
cguaccagcgcucgacgaggcgg

SEQ ID NO: 927878 - RNA, 21 nt, Mycobacterium avium subsp. paratuberculosis
cguaacgguaggcgcggucgg

SEQ ID NO: 927879 - RNA, 15 nt, Mycobacterium avium subsp. paratuberculosis
cguaacgccacggcg

SEQ ID NO: 927880 - RNA, 20 nt, Mycobacterium avium subsp. paratuberculosis
cguaacgccacggcggccga

SEQ ID NO: 927881 - RNA, 13 nt, Mycobacterium avium subsp. paratuberculosis
cguaaccggcggc

SEQ ID NO: 927882 - RNA, 15 nt, Mycobacterium avium subsp. paratuberculosis
cguaaccggcggcgg

SEQ ID NO: 927883 - RNA, 15 nt, Mycobacterium avium subsp. paratuberculosis
cguaaccgccguugg

SEQ ID NO: 927884 - RNA, 23 nt, Mycobacterium avium subsp. paratuberculosis
cguacaaggugauggcccgcuug

SEQ ID NO: 927885 - RNA, 21 nt, Mycobacterium avium subsp. paratuberculosis
cguacaccagggugccgccgg

SEQ ID NO: 927886 - RNA, 15 nt, Mycobacterium avium subsp. paratuberculosis
cguacacggcccgcg

SEQ ID NO: 927887 - RNA, 17 nt, Mycobacterium avium subsp. paratuberculosis
cguacacggcccgcggc

SEQ ID NO: 927888 - RNA, 19 nt, Mycobacterium avium subsp. paratuberculosis
cguacacggcccgcggcac

SEQ ID NO: 927889 - RNA, 14 nt, Mycobacterium avium subsp. paratuberculosis
cguacacggcggcg

SEQ ID NO: 927890 - RNA, 19 nt, Mycobacterium avium subsp. paratuberculosis
cgguucggacacggcgccg

SEQ ID NO: 927891 - RNA, 23 nt, Mycobacterium avium subsp. paratuberculosis
cgguugaucacaccgucggcgau

SEQ ID NO: 927892 - RNA, 22 nt, Mycobacterium avium subsp. paratuberculosis
cgguugcaccgcgauggcccgc

SEQ ID NO: 927893 - RNA, 22 nt, Mycobacterium avium subsp. paratuberculosis
cgguugccccaccccggacggc

SEQ ID NO: 927894 - RNA, 19 nt, Mycobacterium avium subsp. paratuberculosis
cgguugccucggccagcac

SEQ ID NO: 927895 - RNA, 15 nt, Mycobacterium avium subsp. paratuberculosis
cgguugagugcgccg

SEQ ID NO: 927896 - RNA, 13 nt, Mycobacterium avium subsp. paratuberculosis
cgguugagcacca

SEQ ID NO: 927897 - RNA, 18 nt, Mycobacterium avium subsp. paratuberculosis
cgguugagcaccagcccg

SEQ ID NO: 927898 - RNA, 14 nt, Mycobacterium avium subsp. paratuberculosis
cgguucggcgucgg

SEQ ID NO: 927899 - RNA, 14 nt, Mycobacterium avium subsp. paratuberculosis
cgguucgggcccca

SEQ ID NO: 927900 - RNA, 19 nt, Mycobacterium avium subsp. paratuberculosis
cgguucggaguccaccggc

SEQ ID NO: 927901 - RNA, 21 nt, Mycobacterium avium subsp. paratuberculosis
cgguucggaguccaccggcgg

SEQ ID NO: 927902 - RNA, 13 nt, Mycobacterium avium subsp. paratuberculosis
cgguucggccaga

SEQ ID NO: 927903 - RNA, 20 nt, Mycobacterium avium subsp. paratuberculosis
cguaacacccucggucgggc

SEQ ID NO: 927904 - RNA, 20 nt, Mycobacterium avium subsp. paratuberculosis
cgguuugcgccggcuccacc

SEQ ID NO: 927905 - RNA, 14 nt, Mycobacterium avium subsp. paratuberculosis
cgguuuuggucggc

SEQ ID NO: 927906 - RNA, 23 nt, Mycobacterium avium subsp. paratuberculosis
cgguuuuggucugcgccggcggu

SEQ ID NO: 927907 - RNA, 20 nt, Mycobacterium avium subsp. paratuberculosis
cgguuuuucccagcggccga

SEQ ID NO: 927908 - RNA, 22 nt, Mycobacterium avium subsp. paratuberculosis
cgguuuuucccagcggccgagg

SEQ ID NO: 927909 - RNA, 23 nt, Mycobacterium avium subsp. paratuberculosis
cgguuuuucccagcggccgaggg

SEQ ID NO: 927910 - RNA, 15 nt, Mycobacterium avium subsp. paratuberculosis
cgguuugcgggucgg

SEQ ID NO: 927911 - RNA, 16 nt, Mycobacterium avium subsp. paratuberculosis
cgguuugucggcgccc

SEQ ID NO: 927912 - RNA, 20 nt, Mycobacterium avium subsp. paratuberculosis
cgguugccuuuccgcgcggc

SEQ ID NO: 927913 - RNA, 21 nt, Mycobacterium avium subsp. paratuberculosis
cgguugcgccgaggucaccgc

SEQ ID NO: 927914 - RNA, 22 nt, Mycobacterium avium subsp. paratuberculosis
cgguugcgcgaaucgcaagcag

SEQ ID NO: 927915 - RNA, 14 nt, Mycobacterium avium subsp. paratuberculosis
cgguuucgaacugg

SEQ ID NO: 927916 - RNA, 20 nt, Mycobacterium avium subsp. paratuberculosis
cgguuucgaccugcgggugc

SEQ ID NO: 927917 - RNA, 15 nt, Mycobacterium avium subsp. paratuberculosis
cgguuugcccggcga

SEQ ID NO: 927918 - RNA, 15 nt, Mycobacterium avium subsp. paratuberculosis
cgguucacgcggcug

SEQ ID NO: 927919 - RNA, 20 nt, Mycobacterium avium subsp. paratuberculosis
cgguucacgcggcuggcccg

SEQ ID NO: 927920 - RNA, 22 nt, Mycobacterium avium subsp. paratuberculosis
cgguucgaggugcucgcgcagg

SEQ ID NO: 927921 - RNA, 22 nt, Mycobacterium avium subsp. paratuberculosis
cgguucgauaccguccgcgccc

SEQ ID NO: 927922 - RNA, 23 nt, Mycobacterium avium subsp. paratuberculosis
cgguucgauaccguccgcgccca

SEQ ID NO: 927923 - RNA, 17 nt, Mycobacterium avium subsp. paratuberculosis
cgguucgaucuccucgg

SEQ ID NO: 927924 - RNA, 21 nt, Mycobacterium avium subsp. paratuberculosis
cgguucgaucuccucggcgua

SEQ ID NO: 927925 - RNA, 17 nt, Mycobacterium avium subsp. paratuberculosis
cgguucgaucucgucgg

SEQ ID NO: 927926 - RNA, 18 nt, Mycobacterium avium subsp. paratuberculosis
cggucgccaccaccagcg

SEQ ID NO: 927927 - RNA, 19 nt, Mycobacterium avium subsp. paratuberculosis
cggucgccacggccggcag

SEQ ID NO: 927928 - RNA, 22 nt, Mycobacterium avium subsp. paratuberculosis
cggucgccacucgggcggccgc

SEQ ID NO: 927929 - RNA, 13 nt, Mycobacterium avium subsp. paratuberculosis
cggucgccagcac

SEQ ID NO: 927930 - RNA, 14 nt, Mycobacterium avium subsp. paratuberculosis
cggucgccagcgcc

SEQ ID NO: 927931 - RNA, 15 nt, Mycobacterium avium subsp. paratuberculosis
cggucgccagcgcca

SEQ ID NO: 927932 - RNA, 18 nt, Mycobacterium avium subsp. paratuberculosis
cggucgaugugcgcgcug

SEQ ID NO: 927933 - RNA, 19 nt, Mycobacterium avium subsp. paratuberculosis
cggucgaugugcgcgcugg

SEQ ID NO: 927934 - RNA, 22 nt, Mycobacterium avium subsp. paratuberculosis
cggucgaugugcgcgcuggccg

SEQ ID NO: 927935 - RNA, 22 nt, Mycobacterium avium subsp. paratuberculosis
cggucgauuugaugaacacggu

SEQ ID NO: 927936 - RNA, 13 nt, Mycobacterium avium subsp. paratuberculosis
cggucgcaccgcg

SEQ ID NO: 927937 - RNA, 16 nt, Mycobacterium avium subsp. paratuberculosis
cggucgcaccgcggcg

SEQ ID NO: 927938 - RNA, 19 nt, Mycobacterium avium subsp. paratuberculosis
cggucgcaccgcggcgugg

SEQ ID NO: 927939 - RNA, 19 nt, Mycobacterium avium subsp. paratuberculosis
cggucgcaggccgcccggc

SEQ ID NO: 927940 - RNA, 18 nt, Mycobacterium avium subsp. paratuberculosis
cggucgcaggcgagccgg

SEQ ID NO: 927941 - RNA, 12 nt, Mycobacterium avium subsp. paratuberculosis
cggucgccccag

SEQ ID NO: 927942 - RNA, 15 nt, Mycobacterium avium subsp. paratuberculosis
cggucgcccccucgg

SEQ ID NO: 927943 - RNA, 19 nt, Mycobacterium avium subsp. paratuberculosis
cggucgcccccucggccgg

SEQ ID NO: 927944 - RNA, 20 nt, Mycobacterium avium subsp. paratuberculosis
cggucgcccccucggccggu

SEQ ID NO: 927945 - RNA, 15 nt, Mycobacterium avium subsp. paratuberculosis
cggucgccccggccg

SEQ ID NO: 927946 - RNA, 21 nt, Mycobacterium avium subsp. paratuberculosis
cggucgccccggccgcgguga

SEQ ID NO: 927947 - RNA, 12 nt, Mycobacterium avium subsp. paratuberculosis
cggucgccgaau

SEQ ID NO: 927948 - RNA, 21 nt, Mycobacterium avium subsp. paratuberculosis
cggucgccgaauccggcgggg

SEQ ID NO: 927949 - RNA, 13 nt, Mycobacterium avium subsp. paratuberculosis
cggucgccgacgu

SEQ ID NO: 927950 - RNA, 21 nt, Mycobacterium avium subsp. paratuberculosis
cggucgccgacucgcaggugc

SEQ ID NO: 927951 - RNA, 15 nt, Mycobacterium avium subsp. paratuberculosis
cgguuaccggugcac

SEQ ID NO: 927952 - RNA, 19 nt, Mycobacterium avium subsp. paratuberculosis
cgguuaccggugcacgagc

SEQ ID NO: 927953 - RNA, 23 nt, Mycobacterium avium subsp. paratuberculosis
cguccgcgguuucaccgugcgcg

SEQ ID NO: 927954 - RNA, 17 nt, Mycobacterium avium subsp. paratuberculosis
cguccgcgucggcgccg

SEQ ID NO: 927955 - RNA, 13 nt, Mycobacterium avium subsp. paratuberculosis
cguccgcgucguc

SEQ ID NO: 927956 - RNA, 14 nt, Mycobacterium avium subsp. paratuberculosis
cguccgcgucgucg

SEQ ID NO: 927957 - RNA, 17 nt, Mycobacterium avium subsp. paratuberculosis
cguccgcgucgucgagg

SEQ ID NO: 927958 - RNA, 18 nt, Mycobacterium avium subsp. paratuberculosis
cguccgcgucgucgaggc

SEQ ID NO: 927959 - RNA, 20 nt, Mycobacterium avium subsp. paratuberculosis
cguccgcgucgucgaggcgg

SEQ ID NO: 927960 - RNA, 14 nt, Mycobacterium avium subsp. paratuberculosis
cguccgcgggcggg

SEQ ID NO: 927961 - RNA, 23 nt, Mycobacterium avium subsp. paratuberculosis
cguccgcggugagcaccggaucg

SEQ ID NO: 927962 - RNA, 13 nt, Mycobacterium avium subsp. paratuberculosis
cguccgcgcuggc

SEQ ID NO: 927963 - RNA, 14 nt, Mycobacterium avium subsp. paratuberculosis
cguccgcgcuggcg

SEQ ID NO: 927964 - RNA, 20 nt, Mycobacterium avium subsp. paratuberculosis
cguccgcgcuggcguugagc

SEQ ID NO: 927965 - RNA, 13 nt, Mycobacterium avium subsp. paratuberculosis
cguccgcggccgc

SEQ ID NO: 927966 - RNA, 19 nt, Mycobacterium avium subsp. paratuberculosis
cguccgcggccgcggcgcg

SEQ ID NO: 927967 - RNA, 22 nt, Mycobacterium avium subsp. paratuberculosis
cguccgcggcggagggguacuc

SEQ ID NO: 927968 - RNA, 15 nt, Mycobacterium avium subsp. paratuberculosis
cguccgcggcggcca

SEQ ID NO: 927969 - RNA, 14 nt, Mycobacterium avium subsp. paratuberculosis
cguccgcggcggcg

SEQ ID NO: 927970 - RNA, 16 nt, Mycobacterium avium subsp. paratuberculosis
cguccgcggcggcgug

SEQ ID NO: 927971 - RNA, 21 nt, Mycobacterium avium subsp. paratuberculosis
cguccgcgggaauuggcaccg

SEQ ID NO: 927972 - RNA, 22 nt, Mycobacterium avium subsp. paratuberculosis
cguccgcgggaauuggcaccgg

SEQ ID NO: 927973 - RNA, 21 nt, Mycobacterium avium subsp. paratuberculosis
cguccgcgaucgucucgucga

SEQ ID NO: 927974 - RNA, 23 nt, Mycobacterium avium subsp. paratuberculosis
cguccgcgaucgucucgucgaga

SEQ ID NO: 927975 - RNA, 21 nt, Mycobacterium avium subsp. paratuberculosis
cguccgcgacgcugagcgcca

SEQ ID NO: 927976 - RNA, 14 nt, Mycobacterium avium subsp. paratuberculosis
cguccgcgcccacc

SEQ ID NO: 927977 - RNA, 15 nt, Mycobacterium avium subsp. paratuberculosis
cguccgcgcccaccc

SEQ ID NO: 927978 - RNA, 12 nt, Mycobacterium avium subsp. paratuberculosis
cgucccagcgca

SEQ ID NO: 927979 - RNA, 20 nt, Mycobacterium avium subsp. paratuberculosis
cgucccagcgcaacggcguc

SEQ ID NO: 927980 - RNA, 22 nt, Mycobacterium avium subsp. paratuberculosis
cgucccagcgcaacggcgucga

SEQ ID NO: 927981 - RNA, 14 nt, Mycobacterium avium subsp. paratuberculosis
cgucccaccggcga

SEQ ID NO: 927982 - RNA, 16 nt, Mycobacterium avium subsp. paratuberculosis
cgucccaccggcgaug

SEQ ID NO: 927983 - RNA, 17 nt, Mycobacterium avium subsp. paratuberculosis
cgucccagccggacagc

SEQ ID NO: 927984 - RNA, 17 nt, Mycobacterium avium subsp. paratuberculosis
cgucccacggcgggguc

SEQ ID NO: 927985 - RNA, 12 nt, Mycobacterium avium subsp. paratuberculosis
cgucccagcaca

SEQ ID NO: 927986 - RNA, 17 nt, Mycobacterium avium subsp. paratuberculosis
cgucccagcacaacgcc

SEQ ID NO: 927987 - RNA, 13 nt, Mycobacterium avium subsp. paratuberculosis
cguccggcgccac

SEQ ID NO: 927988 - RNA, 19 nt, Mycobacterium avium subsp. paratuberculosis
cguccggcgccagcccggu

SEQ ID NO: 927989 - RNA, 11 nt, Mycobacterium avium subsp. paratuberculosis
cguccggcggc

SEQ ID NO: 927990 - RNA, 13 nt, Mycobacterium avium subsp. paratuberculosis
cguccggcggcaa

SEQ ID NO: 927991 - RNA, 19 nt, Mycobacterium avium subsp. paratuberculosis
cguccgggauaguucgccg

SEQ ID NO: 927992 - RNA, 22 nt, Mycobacterium avium subsp. paratuberculosis
cguccgggauaguucgccgccg

SEQ ID NO: 927993 - RNA, 15 nt, Mycobacterium avium subsp. paratuberculosis
cguccgggcacccga

SEQ ID NO: 927994 - RNA, 21 nt, Mycobacterium avium subsp. paratuberculosis
cguccgggcgcugcgcggugg

SEQ ID NO: 927995 - RNA, 14 nt, Mycobacterium avium subsp. paratuberculosis
cguccgggccgccu

SEQ ID NO: 927996 - RNA, 12 nt, Mycobacterium avium subsp. paratuberculosis
cguccgggccgg

SEQ ID NO: 927997 - RNA, 14 nt, Mycobacterium avium subsp. paratuberculosis
cguccucccggccg

SEQ ID NO: 927998 - RNA, 21 nt, Mycobacterium avium subsp. paratuberculosis
cguccucccggccgacgauga

SEQ ID NO: 927999 - RNA, 14 nt, Mycobacterium avium subsp. paratuberculosis
cguccggcgcgcag

SEQ ID NO: 928000 - RNA, 12 nt, Mycobacterium avium subsp. paratuberculosis
cguccggcgcca

SEQ ID NO: 928001 - RNA, 15 nt, Mycobacterium avium subsp. paratuberculosis
cguccggcccggcgu

SEQ ID NO: 928002 - RNA, 19 nt, Mycobacterium avium subsp. paratuberculosis
cguccggaggugccggccg

SEQ ID NO: 928003 - RNA, 20 nt, Mycobacterium avium subsp. paratuberculosis
cguccggaggugccggccgg

SEQ ID NO: 928004 - RNA, 21 nt, Mycobacterium avium subsp. paratuberculosis
cguccggaggugccggccggu

SEQ ID NO: 928005 - RNA, 15 nt, Mycobacterium avium subsp. paratuberculosis
cguccggaugcggcg

SEQ ID NO: 928006 - RNA, 18 nt, Mycobacterium avium subsp. paratuberculosis
cguccggaugcggcgccc

SEQ ID NO: 928007 - RNA, 17 nt, Mycobacterium avium subsp. paratuberculosis
cguccggauagccgucg

SEQ ID NO: 928008 - RNA, 18 nt, Mycobacterium avium subsp. paratuberculosis
cguccggauagccgucgg

SEQ ID NO: 928009 - RNA, 15 nt, Mycobacterium avium subsp. paratuberculosis
cgucgaaugcgcuca

SEQ ID NO: 928010 - RNA, 13 nt, Mycobacterium avium subsp. paratuberculosis
cgucgacaccccg

SEQ ID NO: 928011 - RNA, 20 nt, Mycobacterium avium subsp. paratuberculosis
cgucgacaccccgcucggcc

SEQ ID NO: 928012 - RNA, 14 nt, Mycobacterium avium subsp. paratuberculosis
cgucgacacgccgg

SEQ ID NO: 928013 - RNA, 15 nt, Mycobacterium avium subsp. paratuberculosis
cgucgacacgccggc

SEQ ID NO: 928014 - RNA, 19 nt, Mycobacterium avium subsp. paratuberculosis
cgucgacacgccggccguu

SEQ ID NO: 928015 - RNA, 23 nt, Mycobacterium avium subsp. paratuberculosis
cgucgacacgccggccguucgcc

SEQ ID NO: 928016 - RNA, 16 nt, Mycobacterium avium subsp. paratuberculosis
cgucgacagccggucg

SEQ ID NO: 928017 - RNA, 20 nt, Mycobacterium avium subsp. paratuberculosis
cgucgacagccggucgcgca

SEQ ID NO: 928018 - RNA, 23 nt, Mycobacterium avium subsp. paratuberculosis
cgucgacagccggucgcgcaucg

SEQ ID NO: 928019 - RNA, 21 nt, Mycobacterium avium subsp. paratuberculosis
cgucgacccguuccccggccg

SEQ ID NO: 928020 - RNA, 15 nt, Mycobacterium avium subsp. paratuberculosis
cgucgaccgccacca

SEQ ID NO: 928021 - RNA, 17 nt, Mycobacterium avium subsp. paratuberculosis
cgucgaccgccaccaga

SEQ ID NO: 928022 - RNA, 20 nt, Mycobacterium avium subsp. paratuberculosis
cgucgaccgccccgccggug

SEQ ID NO: 928023 - RNA, 15 nt, Mycobacterium avium subsp. paratuberculosis
cgucgaccgccgcga

SEQ ID NO: 928024 - RNA, 15 nt, Mycobacterium avium subsp. paratuberculosis
cgucgaauucggaca

SEQ ID NO: 928025 - RNA, 18 nt, Mycobacterium avium subsp. paratuberculosis
cgucgaauaggugauguc

SEQ ID NO: 928026 - RNA, 14 nt, Mycobacterium avium subsp. paratuberculosis
cgucgaagggucgg

SEQ ID NO: 928027 - RNA, 19 nt, Mycobacterium avium subsp. paratuberculosis
cgucgaagggucggucgag

SEQ ID NO: 928028 - RNA, 20 nt, Mycobacterium avium subsp. paratuberculosis
cgucgaaggucugcagcagc

SEQ ID NO: 928029 - RNA, 17 nt, Mycobacterium avium subsp. paratuberculosis
cgucgaaguagggccgc

SEQ ID NO: 928030 - RNA, 22 nt, Mycobacterium avium subsp. paratuberculosis
cgucgaacugcagccggccaac

SEQ ID NO: 928031 - RNA, 14 nt, Mycobacterium avium subsp. paratuberculosis
cgucgaaggccggg

SEQ ID NO: 928032 - RNA, 17 nt, Mycobacterium avium subsp. paratuberculosis
cgucgaaggccgggcug

SEQ ID NO: 928033 - RNA, 21 nt, Mycobacterium avium subsp. paratuberculosis
cgucgaaggccgggcuggucc

SEQ ID NO: 928034 - RNA, 18 nt, Mycobacterium avium subsp. paratuberculosis
cgucgaagagcuggucgc

SEQ ID NO: 928035 - RNA, 14 nt, Mycobacterium avium subsp. paratuberculosis
cgucgaacggcguc

SEQ ID NO: 928036 - RNA, 21 nt, Mycobacterium avium subsp. paratuberculosis
cgucgaacggcgucuggccgg

SEQ ID NO: 928037 - RNA, 15 nt, Mycobacterium avium subsp. paratuberculosis
cgucgaacgggccgg

SEQ ID NO: 928038 - RNA, 19 nt, Mycobacterium avium subsp. paratuberculosis
cgucgaacgggccgggcac

SEQ ID NO: 928039 - RNA, 22 nt, Mycobacterium avium subsp. paratuberculosis
cgucgaacgggccgggcaccgc

SEQ ID NO: 928040 - RNA, 19 nt, Mycobacterium avium subsp. paratuberculosis
cgucgaacuccauccgccg

SEQ ID NO: 928041 - RNA, 14 nt, Mycobacterium avium subsp. paratuberculosis
cgucgaacgcggcg

SEQ ID NO: 928042 - RNA, 16 nt, Mycobacterium avium subsp. paratuberculosis
cgucgaacgcggcgaa

SEQ ID NO: 928043 - RNA, 17 nt, Mycobacterium avium subsp. paratuberculosis
cgucgaacgcggcgaag

SEQ ID NO: 928044 - RNA, 23 nt, Mycobacterium avium subsp. paratuberculosis
cgucgaacgcguacacggcccgc

SEQ ID NO: 928045 - RNA, 15 nt, Mycobacterium avium subsp. paratuberculosis
cgucgaacagccggg

SEQ ID NO: 928046 - RNA, 22 nt, Mycobacterium avium subsp. paratuberculosis
cgucgaacgagaaggcggcguc

SEQ ID NO: 928047 - RNA, 23 nt, Mycobacterium avium subsp. paratuberculosis
cgucgaacgagaaggcggcgucg

SEQ ID NO: 928048 - RNA, 20 nt, Mycobacterium avium subsp. paratuberculosis
cgucgaacaggaugcagccg

SEQ ID NO: 928049 - RNA, 17 nt, Mycobacterium avium subsp. paratuberculosis
cgucgaacccgaccccg

SEQ ID NO: 928050 - RNA, 22 nt, Mycobacterium avium subsp. paratuberculosis
cgucgaacccgaccccggcgag

SEQ ID NO: 928051 - RNA, 15 nt, Mycobacterium avium subsp. paratuberculosis
cguccucgucggcga

SEQ ID NO: 928052 - RNA, 21 nt, Mycobacterium avium subsp. paratuberculosis
cgucgaacacguugcgcauca

SEQ ID NO: 928053 - RNA, 14 nt, Mycobacterium avium subsp. paratuberculosis
cguccucgucggcg

SEQ ID NO: 928054 - RNA, 22 nt, Mycobacterium avium subsp. paratuberculosis
cguccucgccguacgcgccggc

SEQ ID NO: 928055 - RNA, 15 nt, Mycobacterium avium subsp. paratuberculosis
cguccucgaccaccc

SEQ ID NO: 928056 - RNA, 16 nt, Mycobacterium avium subsp. paratuberculosis
cguccucgcgucgcgc

SEQ ID NO: 928057 - RNA, 16 nt, Mycobacterium avium subsp. paratuberculosis
cguccucgaugacgcc

SEQ ID NO: 928058 - RNA, 17 nt, Mycobacterium avium subsp. paratuberculosis
cguccucgaugccgacc

SEQ ID NO: 928059 - RNA, 23 nt, Mycobacterium avium subsp. paratuberculosis
cguccucgaugccgaccgacagc

SEQ ID NO: 928060 - RNA, 15 nt, Mycobacterium avium subsp. paratuberculosis
cguccuccucguccg

SEQ ID NO: 928061 - RNA, 19 nt, Mycobacterium avium subsp. paratuberculosis
cguccuccucguccgcggc

SEQ ID NO: 928062 - RNA, 20 nt, Mycobacterium avium subsp. paratuberculosis
cguccuccucguccgcggcg

SEQ ID NO: 928063 - RNA, 16 nt, Mycobacterium avium subsp. paratuberculosis
cguccuccucgucggc

SEQ ID NO: 928064 - RNA, 16 nt, Mycobacterium avium subsp. paratuberculosis
cguccucgacgccgcg

SEQ ID NO: 928065 - RNA, 15 nt, Mycobacterium avium subsp. paratuberculosis
cguccucgacggugg

SEQ ID NO: 928066 - RNA, 17 nt, Mycobacterium avium subsp. paratuberculosis
cguccucgacgguggag

SEQ ID NO: 928067 - RNA, 12 nt, Mycobacterium avium subsp. paratuberculosis
cguccucgaggg

SEQ ID NO: 928068 - RNA, 20 nt, Mycobacterium avium subsp. paratuberculosis
cguccagcugcgcgccggcg

SEQ ID NO: 928069 - RNA, 21 nt, Mycobacterium avium subsp. paratuberculosis
cguccagcugcgcgccggcgg

SEQ ID NO: 928070 - RNA, 22 nt, Mycobacterium avium subsp. paratuberculosis
cguccagcugcgcgccggcggc

SEQ ID NO: 928071 - RNA, 23 nt, Mycobacterium avium subsp. paratuberculosis
cguccagcugcgcgccggcggcc

SEQ ID NO: 928072 - RNA, 15 nt, Mycobacterium avium subsp. paratuberculosis
cguccagcugggcug

SEQ ID NO: 928073 - RNA, 18 nt, Mycobacterium avium subsp. paratuberculosis
cguccagcuucucggcgu

SEQ ID NO: 928074 - RNA, 14 nt, Mycobacterium avium subsp. paratuberculosis
cguccaggccgcug

SEQ ID NO: 928075 - RNA, 17 nt, Mycobacterium avium subsp. paratuberculosis
cguccaggccggcgccg

SEQ ID NO: 928076 - RNA, 23 nt, Mycobacterium avium subsp. paratuberculosis
cguccaggccggcgccgcgggug

SEQ ID NO: 928077 - RNA, 18 nt, Mycobacterium avium subsp. paratuberculosis
cguccaggcgcaccgcca

SEQ ID NO: 928078 - RNA, 20 nt, Mycobacterium avium subsp. paratuberculosis
cguccaggcgcaccgccacc

SEQ ID NO: 928079 - RNA, 21 nt, Mycobacterium avium subsp. paratuberculosis
cguccaggcgcaccgccaccg

SEQ ID NO: 928080 - RNA, 21 nt, Mycobacterium avium subsp. paratuberculosis
cguccagcgucgacugcaccg

SEQ ID NO: 928081 - RNA, 16 nt, Mycobacterium avium subsp. paratuberculosis
cguccagcgucgcggc

SEQ ID NO: 928082 - RNA, 17 nt, Mycobacterium avium subsp. paratuberculosis
cguccagcgucgcggcc

SEQ ID NO: 928083 - RNA, 18 nt, Mycobacterium avium subsp. paratuberculosis
cguccagcgucgcggccg

SEQ ID NO: 928084 - RNA, 19 nt, Mycobacterium avium subsp. paratuberculosis
cguccagcgucgcggccgg

SEQ ID NO: 928085 - RNA, 20 nt, Mycobacterium avium subsp. paratuberculosis
cguccagcgucgcggccggg

SEQ ID NO: 928086 - RNA, 20 nt, Mycobacterium avium subsp. paratuberculosis
cguccagcgucuggcagccg

SEQ ID NO: 928087 - RNA, 21 nt, Mycobacterium avium subsp. paratuberculosis
cguccagcgugccgcgcacca

SEQ ID NO: 928088 - RNA, 23 nt, Mycobacterium avium subsp. paratuberculosis
cguccagcgugccgcgcaccacc

SEQ ID NO: 928089 - RNA, 17 nt, Mycobacterium avium subsp. paratuberculosis
cguccagcucagcgcgc

SEQ ID NO: 928090 - RNA, 16 nt, Mycobacterium avium subsp. paratuberculosis
cguccagcuccgccga

SEQ ID NO: 928091 - RNA, 20 nt, Mycobacterium avium subsp. paratuberculosis
cguccagcuccgccgacacc

SEQ ID NO: 928092 - RNA, 17 nt, Mycobacterium avium subsp. paratuberculosis
cguccaugcccgcccac

SEQ ID NO: 928093 - RNA, 14 nt, Mycobacterium avium subsp. paratuberculosis
cguccauggucgag

SEQ ID NO: 928094 - RNA, 15 nt, Mycobacterium avium subsp. paratuberculosis
cguccauggucgagc

SEQ ID NO: 928095 - RNA, 20 nt, Mycobacterium avium subsp. paratuberculosis
cguccauggucgagccgcag

SEQ ID NO: 928096 - RNA, 21 nt, Mycobacterium avium subsp. paratuberculosis
cguccauguaguucagcagcc

SEQ ID NO: 928097 - RNA, 21 nt, Mycobacterium avium subsp. paratuberculosis
cguccaugaaccacugcggca

SEQ ID NO: 928098 - RNA, 20 nt, Mycobacterium avium subsp. paratuberculosis
cguccaugcucuugcgggcg

SEQ ID NO: 928099 - RNA, 14 nt, Mycobacterium avium subsp. paratuberculosis
cguccaugcuggug

SEQ ID NO: 928100 - RNA, 20 nt, Mycobacterium avium subsp. paratuberculosis
cguccaugcuggugccgccg

SEQ ID NO: 928101 - RNA, 16 nt, Mycobacterium avium subsp. paratuberculosis
cguccaucgcgucguc

SEQ ID NO: 928102 - RNA, 15 nt, Mycobacterium avium subsp. paratuberculosis
cguccaucgggaccg

SEQ ID NO: 928103 - RNA, 17 nt, Mycobacterium avium subsp. paratuberculosis
cguccaucgggaccgcg

SEQ ID NO: 928104 - RNA, 21 nt, Mycobacterium avium subsp. paratuberculosis
cguccaucguccucgcgccgu

SEQ ID NO: 928105 - RNA, 15 nt, Mycobacterium avium subsp. paratuberculosis
cguccaucgccgcgc

SEQ ID NO: 928106 - RNA, 16 nt, Mycobacterium avium subsp. paratuberculosis
cguccaucgccgcgca

SEQ ID NO: 928107 - RNA, 15 nt, Mycobacterium avium subsp. paratuberculosis
cgucauuccgccgcg

SEQ ID NO: 928108 - RNA, 16 nt, Mycobacterium avium subsp. paratuberculosis
cgucaugccuuggccg

SEQ ID NO: 928109 - RNA, 13 nt, Mycobacterium avium subsp. paratuberculosis
cguccagcccgcg

SEQ ID NO: 928110 - RNA, 16 nt, Mycobacterium avium subsp. paratuberculosis
cguccagcccgcgcca

SEQ ID NO: 928111 - RNA, 17 nt, Mycobacterium avium subsp. paratuberculosis
cguccagcaugcccacg

SEQ ID NO: 928112 - RNA, 20 nt, Mycobacterium avium subsp. paratuberculosis
cguccagcaugcccacgccg

SEQ ID NO: 928113 - RNA, 17 nt, Mycobacterium avium subsp. paratuberculosis
cguccagcagcaugucg

SEQ ID NO: 928114 - RNA, 18 nt, Mycobacterium avium subsp. paratuberculosis
cguccaaaaugcguuccg

SEQ ID NO: 928115 - RNA, 22 nt, Mycobacterium avium subsp. paratuberculosis
cguccaaaaugcguuccgcgac

SEQ ID NO: 928116 - RNA, 14 nt, Mycobacterium avium subsp. paratuberculosis
cguccaaccgcgga

SEQ ID NO: 928117 - RNA, 14 nt, Mycobacterium avium subsp. paratuberculosis
cguccagcgccgcc

SEQ ID NO: 928118 - RNA, 15 nt, Mycobacterium avium subsp. paratuberculosis
cguccagcgccgcca

SEQ ID NO: 928119 - RNA, 16 nt, Mycobacterium avium subsp. paratuberculosis
cguccagcgccgccac

SEQ ID NO: 928120 - RNA, 17 nt, Mycobacterium avium subsp. paratuberculosis
cguccagcgccgccacg

SEQ ID NO: 928121 - RNA, 22 nt, Mycobacterium avium subsp. paratuberculosis
cguccagcgccgccacggccac

SEQ ID NO: 928122 - RNA, 16 nt, Mycobacterium avium subsp. paratuberculosis
cguccagcgccgccau

SEQ ID NO: 928123 - RNA, 17 nt, Mycobacterium avium subsp. paratuberculosis
cguccagcgccgccauc

SEQ ID NO: 928124 - RNA, 15 nt, Mycobacterium avium subsp. paratuberculosis
cguccagcggcccuc

SEQ ID NO: 928125 - RNA, 20 nt, Mycobacterium avium subsp. paratuberculosis
cguccagcggguugccgcug

SEQ ID NO: 928126 - RNA, 23 nt, Mycobacterium avium subsp. paratuberculosis
cguccagcggguugccgcuggcg

SEQ ID NO: 928127 - RNA, 14 nt, Mycobacterium avium subsp. paratuberculosis
cguccagcgcggug

SEQ ID NO: 928128 - RNA, 15 nt, Mycobacterium avium subsp. paratuberculosis
cguccagcgcgguga

SEQ ID NO: 928129 - RNA, 15 nt, Mycobacterium avium subsp. paratuberculosis
cguccagcgcgucgc

SEQ ID NO: 928130 - RNA, 18 nt, Mycobacterium avium subsp. paratuberculosis
cguccagcgagggggugg

SEQ ID NO: 928131 - RNA, 15 nt, Mycobacterium avium subsp. paratuberculosis
cgucacgacggucac

SEQ ID NO: 928132 - RNA, 16 nt, Mycobacterium avium subsp. paratuberculosis
cgucacgacggucacg

SEQ ID NO: 928133 - RNA, 23 nt, Mycobacterium avium subsp. paratuberculosis
cgucacgacggucacggccgcca

SEQ ID NO: 928134 - RNA, 14 nt, Mycobacterium avium subsp. paratuberculosis
cgucacgcaucagg

SEQ ID NO: 928135 - RNA, 22 nt, Mycobacterium avium subsp. paratuberculosis
cgucacgcaucagggccagccg

SEQ ID NO: 928136 - RNA, 23 nt, Mycobacterium avium subsp. paratuberculosis
cgucacgcaucagggccagccga

SEQ ID NO: 928137 - RNA, 15 nt, Mycobacterium avium subsp. paratuberculosis
cgucacgccagcgug

SEQ ID NO: 928138 - RNA, 16 nt, Mycobacterium avium subsp. paratuberculosis
cgucacgccagcguga

SEQ ID NO: 928139 - RNA, 19 nt, Mycobacterium avium subsp. paratuberculosis
cgucacgccagcgugacgc

SEQ ID NO: 928140 - RNA, 20 nt, Mycobacterium avium subsp. paratuberculosis
cgucacgccagcgugacgcc

SEQ ID NO: 928141 - RNA, 22 nt, Mycobacterium avium subsp. paratuberculosis
cgucacgccaguguggccgcgg

SEQ ID NO: 928142 - RNA, 18 nt, Mycobacterium avium subsp. paratuberculosis
cgucacgcccguugacgc

SEQ ID NO: 928143 - RNA, 13 nt, Mycobacterium avium subsp. paratuberculosis
cgucaccucgagc

SEQ ID NO: 928144 - RNA, 14 nt, Mycobacterium avium subsp. paratuberculosis
cgucaccucgagga

SEQ ID NO: 928145 - RNA, 23 nt, Mycobacterium avium subsp. paratuberculosis
cgucaccggccauccgcugcgcg

SEQ ID NO: 928146 - RNA, 13 nt, Mycobacterium avium subsp. paratuberculosis
cgucaucgcggcg

SEQ ID NO: 928147 - RNA, 14 nt, Mycobacterium avium subsp. paratuberculosis
cgucaucgcguagu

SEQ ID NO: 928148 - RNA, 13 nt, Mycobacterium avium subsp. paratuberculosis
cgucaucggcgga

SEQ ID NO: 928149 - RNA, 16 nt, Mycobacterium avium subsp. paratuberculosis
cgucaucggcucgauc

SEQ ID NO: 928150 - RNA, 15 nt, Mycobacterium avium subsp. paratuberculosis
cgucacgccgcgccc

SEQ ID NO: 928151 - RNA, 21 nt, Mycobacterium avium subsp. paratuberculosis
cgucacgccguauucgccgac

SEQ ID NO: 928152 - RNA, 14 nt, Mycobacterium avium subsp. paratuberculosis
cgucaucgccgacg

SEQ ID NO: 928153 - RNA, 17 nt, Mycobacterium avium subsp. paratuberculosis
cgucaucgccgacggug

SEQ ID NO: 928154 - RNA, 18 nt, Mycobacterium avium subsp. paratuberculosis
cgucaucgccgacgguga

SEQ ID NO: 928155 - RNA, 19 nt, Mycobacterium avium subsp. paratuberculosis
cgucacgcuagcgugacag

SEQ ID NO: 928156 - RNA, 13 nt, Mycobacterium avium subsp. paratuberculosis
cgucacgcuggcg

SEQ ID NO: 928157 - RNA, 15 nt, Mycobacterium avium subsp. paratuberculosis
cgucacgcuggcgug

SEQ ID NO: 928158 - RNA, 19 nt, Mycobacterium avium subsp. paratuberculosis
cgucacgcuggcgugacac

SEQ ID NO: 928159 - RNA, 22 nt, Mycobacterium avium subsp. paratuberculosis
cgucacgcuggcgugacagucg

SEQ ID NO: 928160 - RNA, 18 nt, Mycobacterium avium subsp. paratuberculosis
cgucacgcuggcgugacg

SEQ ID NO: 928161 - RNA, 23 nt, Mycobacterium avium subsp. paratuberculosis
cgucacgcuggcgugacggucga

SEQ ID NO: 928162 - RNA, 16 nt, Mycobacterium avium subsp. paratuberculosis
cgucacgcuggcgugg

SEQ ID NO: 928163 - RNA, 19 nt, Mycobacterium avium subsp. paratuberculosis
cgucacgcuggcguggcac

SEQ ID NO: 928164 - RNA, 20 nt, Mycobacterium avium subsp. paratuberculosis
cgucacgcuggcguggcacc

SEQ ID NO: 928165 - RNA, 22 nt, Mycobacterium avium subsp. paratuberculosis
cgucacgcuggcguggcacccg

SEQ ID NO: 928166 - RNA, 23 nt, Mycobacterium avium subsp. paratuberculosis
cgucacgcuggcguggcacccgg

SEQ ID NO: 928167 - RNA, 22 nt, Mycobacterium avium subsp. paratuberculosis
cgucacgcuggugacgugcacc

SEQ ID NO: 928168 - RNA, 22 nt, Mycobacterium avium subsp. paratuberculosis
cgucaugacgaacaugcugccg

SEQ ID NO: 928169 - RNA, 14 nt, Mycobacterium avium subsp. paratuberculosis
cgucauggacagcc

SEQ ID NO: 928170 - RNA, 19 nt, Mycobacterium avium subsp. paratuberculosis
cgucauggacagccaccgu

SEQ ID NO: 928171 - RNA, 17 nt, Mycobacterium avium subsp. paratuberculosis
cgucauggagaucaccg

SEQ ID NO: 928172 - RNA, 19 nt, Mycobacterium avium subsp. paratuberculosis
cgucauggagaucaccgcg

SEQ ID NO: 928173 - RNA, 14 nt, Mycobacterium avium subsp. paratuberculosis
cgucauggccgucg

SEQ ID NO: 928174 - RNA, 15 nt, Mycobacterium avium subsp. paratuberculosis
cgucauggccgucgg

SEQ ID NO: 928175 - RNA, 22 nt, Mycobacterium avium subsp. paratuberculosis
cgucauggccgucgggucggcg

SEQ ID NO: 928176 - RNA, 23 nt, Mycobacterium avium subsp. paratuberculosis
cgucauggccgucgggucggcga

SEQ ID NO: 928177 - RNA, 19 nt, Mycobacterium avium subsp. paratuberculosis
cgucaucgugugggcgccc

SEQ ID NO: 928178 - RNA, 21 nt, Mycobacterium avium subsp. paratuberculosis
cgucaucgggcccgacgacga

SEQ ID NO: 928179 - RNA, 13 nt, Mycobacterium avium subsp. paratuberculosis
cgucgcugacgcc

SEQ ID NO: 928180 - RNA, 15 nt, Mycobacterium avium subsp. paratuberculosis
cgucgcugacgccga

SEQ ID NO: 928181 - RNA, 16 nt, Mycobacterium avium subsp. paratuberculosis
cgucgcggcccuggau

SEQ ID NO: 928182 - RNA, 13 nt, Mycobacterium avium subsp. paratuberculosis
cgucgcggcgauc

SEQ ID NO: 928183 - RNA, 16 nt, Mycobacterium avium subsp. paratuberculosis
cgucgcggcgcacccg

SEQ ID NO: 928184 - RNA, 14 nt, Mycobacterium avium subsp. paratuberculosis
cgucgcggcgcgga

SEQ ID NO: 928185 - RNA, 15 nt, Mycobacterium avium subsp. paratuberculosis
cgucgcggcgcggac

SEQ ID NO: 928186 - RNA, 15 nt, Mycobacterium avium subsp. paratuberculosis
cgucgcggcgcgggu

SEQ ID NO: 928187 - RNA, 20 nt, Mycobacterium avium subsp. paratuberculosis
cgucgcggcgcgggucgcug

SEQ ID NO: 928188 - RNA, 16 nt, Mycobacterium avium subsp. paratuberculosis
cgucgcggcgcugccg

SEQ ID NO: 928189 - RNA, 19 nt, Mycobacterium avium subsp. paratuberculosis
cgucgcggcgcugccggug

SEQ ID NO: 928190 - RNA, 13 nt, Mycobacterium avium subsp. paratuberculosis
cgucgcggcggcc

SEQ ID NO: 928191 - RNA, 15 nt, Mycobacterium avium subsp. paratuberculosis
cgucgcggcggcccg

SEQ ID NO: 928192 - RNA, 17 nt, Mycobacterium avium subsp. paratuberculosis
cgucgcggcggcccguc

SEQ ID NO: 928193 - RNA, 21 nt, Mycobacterium avium subsp. paratuberculosis
cgucgcggcggcccgucgcca

SEQ ID NO: 928194 - RNA, 16 nt, Mycobacterium avium subsp. paratuberculosis
cgucgcggcggcgcug

SEQ ID NO: 928195 - RNA, 17 nt, Mycobacterium avium subsp. paratuberculosis
cgucgcggcgggggucg

SEQ ID NO: 928196 - RNA, 19 nt, Mycobacterium avium subsp. paratuberculosis
cgucgcuaccucaccacgu

SEQ ID NO: 928197 - RNA, 19 nt, Mycobacterium avium subsp. paratuberculosis
cgucgcuaguugcacuuuc

SEQ ID NO: 928198 - RNA, 12 nt, Mycobacterium avium subsp. paratuberculosis
cgucggaggcgu

SEQ ID NO: 928199 - RNA, 21 nt, Mycobacterium avium subsp. paratuberculosis
cgucggaggcgucgacgcgcu

SEQ ID NO: 928200 - RNA, 15 nt, Mycobacterium avium subsp. paratuberculosis
cgucggagucgcugu

SEQ ID NO: 928201 - RNA, 20 nt, Mycobacterium avium subsp. paratuberculosis
cgucgcugcaguagccggcc

SEQ ID NO: 928202 - RNA, 21 nt, Mycobacterium avium subsp. paratuberculosis
cgucgcugcaguagccggcca

SEQ ID NO: 928203 - RNA, 22 nt, Mycobacterium avium subsp. paratuberculosis
cgucgcugcaguagccggccag

SEQ ID NO: 928204 - RNA, 13 nt, Mycobacterium avium subsp. paratuberculosis
cgucgcugcccag

SEQ ID NO: 928205 - RNA, 14 nt, Mycobacterium avium subsp. paratuberculosis
cgucgcgcucgacg

SEQ ID NO: 928206 - RNA, 15 nt, Mycobacterium avium subsp. paratuberculosis
cgucgcgcggggucg

SEQ ID NO: 928207 - RNA, 19 nt, Mycobacterium avium subsp. paratuberculosis
cgucgcgcugccggcccga

SEQ ID NO: 928208 - RNA, 17 nt, Mycobacterium avium subsp. paratuberculosis
cgucgcggaacagccgg

SEQ ID NO: 928209 - RNA, 21 nt, Mycobacterium avium subsp. paratuberculosis
cgucgcggaaccguugcagca

SEQ ID NO: 928210 - RNA, 23 nt, Mycobacterium avium subsp. paratuberculosis
cgucgcggaaccguugcagcaca

SEQ ID NO: 928211 - RNA, 12 nt, Mycobacterium avium subsp. paratuberculosis
cgucgcggccgg

SEQ ID NO: 928212 - RNA, 16 nt, Mycobacterium avium subsp. paratuberculosis
cgucgcggaggaugcc

SEQ ID NO: 928213 - RNA, 14 nt, Mycobacterium avium subsp. paratuberculosis
cgucgcgcaggucg

SEQ ID NO: 928214 - RNA, 22 nt, Mycobacterium avium subsp. paratuberculosis
cgucgcgcaggucgggccggcc

SEQ ID NO: 928215 - RNA, 14 nt, Mycobacterium avium subsp. paratuberculosis
cgucgcgcagcagc

SEQ ID NO: 928216 - RNA, 22 nt, Mycobacterium avium subsp. paratuberculosis
cgucgcgcagcgaagcgaggcg

SEQ ID NO: 928217 - RNA, 12 nt, Mycobacterium avium subsp. paratuberculosis
cgucgcgcagcu

SEQ ID NO: 928218 - RNA, 12 nt, Mycobacterium avium subsp. paratuberculosis
cgucgcgccgcu

SEQ ID NO: 928219 - RNA, 14 nt, Mycobacterium avium subsp. paratuberculosis
cgucgcgcgacugg

SEQ ID NO: 928220 - RNA, 13 nt, Mycobacterium avium subsp. paratuberculosis
cgucgcgcccggc

SEQ ID NO: 928221 - RNA, 14 nt, Mycobacterium avium subsp. paratuberculosis
cgucgcgcccggcg

SEQ ID NO: 928222 - RNA, 22 nt, Mycobacterium avium subsp. paratuberculosis
cgucgcgccgauguacugggcc

SEQ ID NO: 928223 - RNA, 13 nt, Mycobacterium avium subsp. paratuberculosis
cgucgcgccgcca

SEQ ID NO: 928224 - RNA, 15 nt, Mycobacterium avium subsp. paratuberculosis
cgucgcgccgccacc

SEQ ID NO: 928225 - RNA, 16 nt, Mycobacterium avium subsp. paratuberculosis
cgucgcgccgccgcgu

SEQ ID NO: 928226 - RNA, 21 nt, Mycobacterium avium subsp. paratuberculosis
cgucgcgccgccgcgucgugc

SEQ ID NO: 928227 - RNA, 23 nt, Mycobacterium avium subsp. paratuberculosis
cgucgcgccgccgcgucgugccg

SEQ ID NO: 928228 - RNA, 13 nt, Mycobacterium avium subsp. paratuberculosis
cgucgccgcggua

SEQ ID NO: 928229 - RNA, 17 nt, Mycobacterium avium subsp. paratuberculosis
cgucgccgcgcgcgucg

SEQ ID NO: 928230 - RNA, 13 nt, Mycobacterium avium subsp. paratuberculosis
cgucgccgcgugg

SEQ ID NO: 928231 - RNA, 18 nt, Mycobacterium avium subsp. paratuberculosis
cgucgccgcucuucgacg

SEQ ID NO: 928232 - RNA, 17 nt, Mycobacterium avium subsp. paratuberculosis
cgucgccggacucgauc

SEQ ID NO: 928233 - RNA, 18 nt, Mycobacterium avium subsp. paratuberculosis
cgucgccggaggcgauca

SEQ ID NO: 928234 - RNA, 20 nt, Mycobacterium avium subsp. paratuberculosis
cgucgccggaggcgaucagg

SEQ ID NO: 928235 - RNA, 14 nt, Mycobacterium avium subsp. paratuberculosis
cgucgccgccguga

SEQ ID NO: 928236 - RNA, 16 nt, Mycobacterium avium subsp. paratuberculosis
cgucgccgccgugauc

SEQ ID NO: 928237 - RNA, 20 nt, Mycobacterium avium subsp. paratuberculosis
cgucgcccacccgccagccc

SEQ ID NO: 928238 - RNA, 22 nt, Mycobacterium avium subsp. paratuberculosis
cgucgcccacccgccagcccgc

SEQ ID NO: 928239 - RNA, 21 nt, Mycobacterium avium subsp. paratuberculosis
cgucgcccacccggggccguc

SEQ ID NO: 928240 - RNA, 22 nt, Mycobacterium avium subsp. paratuberculosis
cgucgcccacccggggccgucc

SEQ ID NO: 928241 - RNA, 14 nt, Mycobacterium avium subsp. paratuberculosis
cgucgcccaccgac

SEQ ID NO: 928242 - RNA, 15 nt, Mycobacterium avium subsp. paratuberculosis
cgucgcccaccgacg

SEQ ID NO: 928243 - RNA, 21 nt, Mycobacterium avium subsp. paratuberculosis
cgucgcccaccgacgcggcgg

SEQ ID NO: 928244 - RNA, 15 nt, Mycobacterium avium subsp. paratuberculosis
cgucgcccaccgugu

SEQ ID NO: 928245 - RNA, 15 nt, Mycobacterium avium subsp. paratuberculosis
cgucgcccacgccgg

SEQ ID NO: 928246 - RNA, 12 nt, Mycobacterium avium subsp. paratuberculosis
cgucgcgcagca

SEQ ID NO: 928247 - RNA, 13 nt, Mycobacterium avium subsp. paratuberculosis
cgucgcgcaccac

SEQ ID NO: 928248 - RNA, 14 nt, Mycobacterium avium subsp. paratuberculosis
cgucgcgcaccagc

SEQ ID NO: 928249 - RNA, 15 nt, Mycobacterium avium subsp. paratuberculosis
cgucgcgcaccagcu

SEQ ID NO: 928250 - RNA, 20 nt, Mycobacterium avium subsp. paratuberculosis
cgucgcgcaccagcucgagg

SEQ ID NO: 928251 - RNA, 18 nt, Mycobacterium avium subsp. paratuberculosis
cgucgcgcacccagccgc

SEQ ID NO: 928252 - RNA, 17 nt, Mycobacterium avium subsp. paratuberculosis
cgucgccgggcggggug

SEQ ID NO: 928253 - RNA, 20 nt, Mycobacterium avium subsp. paratuberculosis
cgucgcgaucgcgguccagg

SEQ ID NO: 928254 - RNA, 22 nt, Mycobacterium avium subsp. paratuberculosis
cgucgcgaugcccaagccggcc

SEQ ID NO: 928255 - RNA, 17 nt, Mycobacterium avium subsp. paratuberculosis
cgucgcgaugugcucga

SEQ ID NO: 928256 - RNA, 13 nt, Mycobacterium avium subsp. paratuberculosis
cgucgccgggcgg

SEQ ID NO: 928257 - RNA, 19 nt, Mycobacterium avium subsp. paratuberculosis
cgucgccggcggggcgucg

SEQ ID NO: 928258 - RNA, 19 nt, Mycobacterium avium subsp. paratuberculosis
cgucgccggcugacugccg

SEQ ID NO: 928259 - RNA, 14 nt, Mycobacterium avium subsp. paratuberculosis
cgucgccggcgacc

SEQ ID NO: 928260 - RNA, 22 nt, Mycobacterium avium subsp. paratuberculosis
cgucgccggcgcgggccgcagc

SEQ ID NO: 928261 - RNA, 23 nt, Mycobacterium avium subsp. paratuberculosis
cgucgccggcgcgggccgcagcg

SEQ ID NO: 928262 - RNA, 15 nt, Mycobacterium avium subsp. paratuberculosis
cgucgccggccgcca

SEQ ID NO: 928263 - RNA, 23 nt, Mycobacterium avium subsp. paratuberculosis
cgucgccggccugcccgccgcgg

SEQ ID NO: 928264 - RNA, 17 nt, Mycobacterium avium subsp. paratuberculosis
cgucgccaccagaccgg

SEQ ID NO: 928265 - RNA, 22 nt, Mycobacterium avium subsp. paratuberculosis
cgucgccaccgagucgcgcgac

SEQ ID NO: 928266 - RNA, 17 nt, Mycobacterium avium subsp. paratuberculosis
cgucgaugucggcggcc

SEQ ID NO: 928267 - RNA, 21 nt, Mycobacterium avium subsp. paratuberculosis
cgucgaugucggcggcccggu

SEQ ID NO: 928268 - RNA, 20 nt, Mycobacterium avium subsp. paratuberculosis
cgucgaugugcucggggcag

SEQ ID NO: 928269 - RNA, 15 nt, Mycobacterium avium subsp. paratuberculosis
cgucgaugugggccg

SEQ ID NO: 928270 - RNA, 17 nt, Mycobacterium avium subsp. paratuberculosis
cgucgaugugggccgca

SEQ ID NO: 928271 - RNA, 15 nt, Mycobacterium avium subsp. paratuberculosis
cgucgccaugccguc

SEQ ID NO: 928272 - RNA, 18 nt, Mycobacterium avium subsp. paratuberculosis
cgucgccaugccgucgcg

SEQ ID NO: 928273 - RNA, 21 nt, Mycobacterium avium subsp. paratuberculosis
cgucgccacgaucaccaccac

SEQ ID NO: 928274 - RNA, 22 nt, Mycobacterium avium subsp. paratuberculosis
cgucgccacgaucaccaccacc

SEQ ID NO: 928275 - RNA, 16 nt, Mycobacterium avium subsp. paratuberculosis
cgucgagcgcggcccg

SEQ ID NO: 928276 - RNA, 19 nt, Mycobacterium avium subsp. paratuberculosis
cgucgagcgcggcccgccg

SEQ ID NO: 928277 - RNA, 21 nt, Mycobacterium avium subsp. paratuberculosis
cgucgaggccgaaccgcagcc

SEQ ID NO: 928278 - RNA, 15 nt, Mycobacterium avium subsp. paratuberculosis
cgucgaggcgcugca

SEQ ID NO: 928279 - RNA, 16 nt, Mycobacterium avium subsp. paratuberculosis
cgucgaggcgcugcag

SEQ ID NO: 928280 - RNA, 14 nt, Mycobacterium avium subsp. paratuberculosis
cgucgagcgcgucg

SEQ ID NO: 928281 - RNA, 18 nt, Mycobacterium avium subsp. paratuberculosis
cgucgagcgcgucguugc

SEQ ID NO: 928282 - RNA, 14 nt, Mycobacterium avium subsp. paratuberculosis
cgucgagcgcucgc

SEQ ID NO: 928283 - RNA, 15 nt, Mycobacterium avium subsp. paratuberculosis
cgucgagcggcccgu

SEQ ID NO: 928284 - RNA, 17 nt, Mycobacterium avium subsp. paratuberculosis
cgucgagcggcgccugg

SEQ ID NO: 928285 - RNA, 18 nt, Mycobacterium avium subsp. paratuberculosis
cgucgagcggcgccuggu

SEQ ID NO: 928286 - RNA, 23 nt, Mycobacterium avium subsp. paratuberculosis
cgucgagcggcgccuggucaagg

SEQ ID NO: 928287 - RNA, 22 nt, Mycobacterium avium subsp. paratuberculosis
cgucgagcggcuugccgccgca

SEQ ID NO: 928288 - RNA, 12 nt, Mycobacterium avium subsp. paratuberculosis
cgucgagcguca

SEQ ID NO: 928289 - RNA, 18 nt, Mycobacterium avium subsp. paratuberculosis
cgucgagcgucacgccgc

SEQ ID NO: 928290 - RNA, 20 nt, Mycobacterium avium subsp. paratuberculosis
cgucgagcgucauuccgccg

SEQ ID NO: 928291 - RNA, 16 nt, Mycobacterium avium subsp. paratuberculosis
cgucgagcuccucggc

SEQ ID NO: 928292 - RNA, 18 nt, Mycobacterium avium subsp. paratuberculosis
cgucgagcuccucggcca

SEQ ID NO: 928293 - RNA, 19 nt, Mycobacterium avium subsp. paratuberculosis
cgucgagcuccucggccag

SEQ ID NO: 928294 - RNA, 16 nt, Mycobacterium avium subsp. paratuberculosis
cgucgagcucgaagcc

SEQ ID NO: 928295 - RNA, 16 nt, Mycobacterium avium subsp. paratuberculosis
cgucgagggcgccguu

SEQ ID NO: 928296 - RNA, 18 nt, Mycobacterium avium subsp. paratuberculosis
cgucgagggcgccguugu

SEQ ID NO: 928297 - RNA, 21 nt, Mycobacterium avium subsp. paratuberculosis
cgucgagggugaugucgcugc

SEQ ID NO: 928298 - RNA, 23 nt, Mycobacterium avium subsp. paratuberculosis
cgucgagggugaugucgcugccg

SEQ ID NO: 928299 - RNA, 18 nt, Mycobacterium avium subsp. paratuberculosis
cgucgagguacugcagca

SEQ ID NO: 928300 - RNA, 20 nt, Mycobacterium avium subsp. paratuberculosis
cgucgaggucggacgccucc

SEQ ID NO: 928301 - RNA, 15 nt, Mycobacterium avium subsp. paratuberculosis
cgucgaggucgucgg

SEQ ID NO: 928302 - RNA, 22 nt, Mycobacterium avium subsp. paratuberculosis
cgucgaggucgucgggcgccgg

SEQ ID NO: 928303 - RNA, 19 nt, Mycobacterium avium subsp. paratuberculosis
cgucgagguguugucgugc

SEQ ID NO: 928304 - RNA, 18 nt, Mycobacterium avium subsp. paratuberculosis
cgucgagguucucgaacg

SEQ ID NO: 928305 - RNA, 23 nt, Mycobacterium avium subsp. paratuberculosis
cgucgagguucucgaacgggucg

SEQ ID NO: 928306 - RNA, 22 nt, Mycobacterium avium subsp. paratuberculosis
cgucgagguugaaucgccuacu

SEQ ID NO: 928307 - RNA, 14 nt, Mycobacterium avium subsp. paratuberculosis
cgucgaugaccucg

SEQ ID NO: 928308 - RNA, 19 nt, Mycobacterium avium subsp. paratuberculosis
cgucgaugaccucgcgcag

SEQ ID NO: 928309 - RNA, 17 nt, Mycobacterium avium subsp. paratuberculosis
cgucgaucuucgcggcg

SEQ ID NO: 928310 - RNA, 19 nt, Mycobacterium avium subsp. paratuberculosis
cgucgaucuucgcggcgua

SEQ ID NO: 928311 - RNA, 16 nt, Mycobacterium avium subsp. paratuberculosis
cgucgaugacgaugcc

SEQ ID NO: 928312 - RNA, 19 nt, Mycobacterium avium subsp. paratuberculosis
cgucgaugggcucgagcaa

SEQ ID NO: 928313 - RNA, 16 nt, Mycobacterium avium subsp. paratuberculosis
cgucgaucucggugag

SEQ ID NO: 928314 - RNA, 20 nt, Mycobacterium avium subsp. paratuberculosis
cgucgaucucggugagccgc

SEQ ID NO: 928315 - RNA, 18 nt, Mycobacterium avium subsp. paratuberculosis
cgucgaucuugucgucca

SEQ ID NO: 928316 - RNA, 20 nt, Mycobacterium avium subsp. paratuberculosis
cgucgaugaaccgcugcugc

SEQ ID NO: 928317 - RNA, 19 nt, Mycobacterium avium subsp. paratuberculosis
cgucgaugaagucggugag

SEQ ID NO: 928318 - RNA, 16 nt, Mycobacterium avium subsp. paratuberculosis
cgucgaugucacguug

SEQ ID NO: 928319 - RNA, 14 nt, Mycobacterium avium subsp. paratuberculosis
cgucgaugucgucg

SEQ ID NO: 928320 - RNA, 15 nt, Mycobacterium avium subsp. paratuberculosis
cgucgaugucgucgu

SEQ ID NO: 928321 - RNA, 19 nt, Mycobacterium avium subsp. paratuberculosis
cgucgaugucgucgucgac

SEQ ID NO: 928322 - RNA, 19 nt, Mycobacterium avium subsp. paratuberculosis
cgucgauccccacgucgcc

SEQ ID NO: 928323 - RNA, 21 nt, Mycobacterium avium subsp. paratuberculosis
cgucgaucccggacuccucgg

SEQ ID NO: 928324 - RNA, 21 nt, Mycobacterium avium subsp. paratuberculosis
cgucgaucagcgcgccgccca

SEQ ID NO: 928325 - RNA, 14 nt, Mycobacterium avium subsp. paratuberculosis
cgucgaucgacgcc

SEQ ID NO: 928326 - RNA, 17 nt, Mycobacterium avium subsp. paratuberculosis
cgucgaucgacgccgac

SEQ ID NO: 928327 - RNA, 15 nt, Mycobacterium avium subsp. paratuberculosis
cgucgaucgccguca

SEQ ID NO: 928328 - RNA, 18 nt, Mycobacterium avium subsp. paratuberculosis
cgucgaucgcgucgaugc

SEQ ID NO: 928329 - RNA, 19 nt, Mycobacterium avium subsp. paratuberculosis
cgucgaucgcgucgaugcc

SEQ ID NO: 928330 - RNA, 14 nt, Mycobacterium avium subsp. paratuberculosis
cgucgagccuggug

SEQ ID NO: 928331 - RNA, 13 nt, Mycobacterium avium subsp. paratuberculosis
cgucgagccgggc

SEQ ID NO: 928332 - RNA, 14 nt, Mycobacterium avium subsp. paratuberculosis
cgucgagccgggcc

SEQ ID NO: 928333 - RNA, 15 nt, Mycobacterium avium subsp. paratuberculosis
cgucgagccgggccc

SEQ ID NO: 928334 - RNA, 20 nt, Mycobacterium avium subsp. paratuberculosis
cgucgagccgggcccgggug

SEQ ID NO: 928335 - RNA, 15 nt, Mycobacterium avium subsp. paratuberculosis
cgucgagcaggguga

SEQ ID NO: 928336 - RNA, 17 nt, Mycobacterium avium subsp. paratuberculosis
cgucgagcagggugacg

SEQ ID NO: 928337 - RNA, 18 nt, Mycobacterium avium subsp. paratuberculosis
cgucgagccagcgggccg

SEQ ID NO: 928338 - RNA, 19 nt, Mycobacterium avium subsp. paratuberculosis
cgucgagccgcucgcgcac

SEQ ID NO: 928339 - RNA, 22 nt, Mycobacterium avium subsp. paratuberculosis
cgucgagccgcucgcgcaccgg

SEQ ID NO: 928340 - RNA, 23 nt, Mycobacterium avium subsp. paratuberculosis
cgucgagccgcucgcgcaccggg

SEQ ID NO: 928341 - RNA, 14 nt, Mycobacterium avium subsp. paratuberculosis
cgucgagccggccg

SEQ ID NO: 928342 - RNA, 20 nt, Mycobacterium avium subsp. paratuberculosis
cgucgagccggccggacacc

SEQ ID NO: 928343 - RNA, 22 nt, Mycobacterium avium subsp. paratuberculosis
cgucgagccggccggacaccga

SEQ ID NO: 928344 - RNA, 15 nt, Mycobacterium avium subsp. paratuberculosis
cgucgagcagcacca

SEQ ID NO: 928345 - RNA, 16 nt, Mycobacterium avium subsp. paratuberculosis
cgucgagcagcaccac

SEQ ID NO: 928346 - RNA, 19 nt, Mycobacterium avium subsp. paratuberculosis
cgucgagcagcaccacccg

SEQ ID NO: 928347 - RNA, 14 nt, Mycobacterium avium subsp. paratuberculosis
cgucgagcagccgc

SEQ ID NO: 928348 - RNA, 15 nt, Mycobacterium avium subsp. paratuberculosis
cgucgagcagcgccc

SEQ ID NO: 928349 - RNA, 17 nt, Mycobacterium avium subsp. paratuberculosis
cgucgagcagcgcccgg

SEQ ID NO: 928350 - RNA, 18 nt, Mycobacterium avium subsp. paratuberculosis
cgucgagcagcgcccggc

SEQ ID NO: 928351 - RNA, 20 nt, Mycobacterium avium subsp. paratuberculosis
cgucgagcagcgcccggcga

SEQ ID NO: 928352 - RNA, 21 nt, Mycobacterium avium subsp. paratuberculosis
cgucgagcagcgcccggcgau

SEQ ID NO: 928353 - RNA, 13 nt, Mycobacterium avium subsp. paratuberculosis
cgucgagcaccuc

SEQ ID NO: 928354 - RNA, 22 nt, Mycobacterium avium subsp. paratuberculosis
cgucgagcaccuggagcggguc

SEQ ID NO: 928355 - RNA, 19 nt, Mycobacterium avium subsp. paratuberculosis
cgucgagcaccacccgggu

SEQ ID NO: 928356 - RNA, 13 nt, Mycobacterium avium subsp. paratuberculosis
cgucgagcaccgc

SEQ ID NO: 928357 - RNA, 19 nt, Mycobacterium avium subsp. paratuberculosis
cgucgagcaccggcagccg

SEQ ID NO: 928358 - RNA, 19 nt, Mycobacterium avium subsp. paratuberculosis
cgucgagcaccggcuggug

SEQ ID NO: 928359 - RNA, 17 nt, Mycobacterium avium subsp. paratuberculosis
cgucgagaaaagcggcg

SEQ ID NO: 928360 - RNA, 19 nt, Mycobacterium avium subsp. paratuberculosis
cgucgagaaaagcggcgaa

SEQ ID NO: 928361 - RNA, 20 nt, Mycobacterium avium subsp. paratuberculosis
cgucgagaaaagcggcgaaa

SEQ ID NO: 928362 - RNA, 17 nt, Mycobacterium avium subsp. paratuberculosis
cgucgagaagaccuggu

SEQ ID NO: 928363 - RNA, 20 nt, Mycobacterium avium subsp. paratuberculosis
cgucgacgucggacgcggcc

SEQ ID NO: 928364 - RNA, 14 nt, Mycobacterium avium subsp. paratuberculosis
cgucgacgucggga

SEQ ID NO: 928365 - RNA, 14 nt, Mycobacterium avium subsp. paratuberculosis
cgucgacucggcgg

SEQ ID NO: 928366 - RNA, 16 nt, Mycobacterium avium subsp. paratuberculosis
cgucgacucggcggug

SEQ ID NO: 928367 - RNA, 19 nt, Mycobacterium avium subsp. paratuberculosis
cgucgacucggcggugccg

SEQ ID NO: 928368 - RNA, 15 nt, Mycobacterium avium subsp. paratuberculosis
cgucgacugcaccga

SEQ ID NO: 928369 - RNA, 19 nt, Mycobacterium avium subsp. paratuberculosis
cgucgacgugcgcggcguu

SEQ ID NO: 928370 - RNA, 18 nt, Mycobacterium avium subsp. paratuberculosis
cgucgacgugggcggcca

SEQ ID NO: 928371 - RNA, 19 nt, Mycobacterium avium subsp. paratuberculosis
cgucgacgugggcggccac

SEQ ID NO: 928372 - RNA, 21 nt, Mycobacterium avium subsp. paratuberculosis
cgucgacgugggcggccacca

SEQ ID NO: 928373 - RNA, 14 nt, Mycobacterium avium subsp. paratuberculosis
cgucgacguucgcc

SEQ ID NO: 928374 - RNA, 18 nt, Mycobacterium avium subsp. paratuberculosis
cgucgacguucgccgcca

SEQ ID NO: 928375 - RNA, 21 nt, Mycobacterium avium subsp. paratuberculosis
cgucgacguucgccgccagca

SEQ ID NO: 928376 - RNA, 23 nt, Mycobacterium avium subsp. paratuberculosis
cgucgacguucgccgccagcacg

SEQ ID NO: 928377 - RNA, 14 nt, Mycobacterium avium subsp. paratuberculosis
cgucgacgucgaga

SEQ ID NO: 928378 - RNA, 22 nt, Mycobacterium avium subsp. paratuberculosis
cgucgacgucgagggcgccguu

SEQ ID NO: 928379 - RNA, 19 nt, Mycobacterium avium subsp. paratuberculosis
cgucgacgucaacaccgug

SEQ ID NO: 928380 - RNA, 20 nt, Mycobacterium avium subsp. paratuberculosis
cgucgacgucaacaccgugg

SEQ ID NO: 928381 - RNA, 13 nt, Mycobacterium avium subsp. paratuberculosis
cgucgacguccac

SEQ ID NO: 928382 - RNA, 19 nt, Mycobacterium avium subsp. paratuberculosis
cgucgacguccucgcccgg

SEQ ID NO: 928383 - RNA, 18 nt, Mycobacterium avium subsp. paratuberculosis
cgucgacgauggcccgga

SEQ ID NO: 928384 - RNA, 19 nt, Mycobacterium avium subsp. paratuberculosis
cgucgacgauggcccggac

SEQ ID NO: 928385 - RNA, 20 nt, Mycobacterium avium subsp. paratuberculosis
cgucgacgauggcccggacc

SEQ ID NO: 928386 - RNA, 21 nt, Mycobacterium avium subsp. paratuberculosis
cgucgacgggccaccagcgca

SEQ ID NO: 928387 - RNA, 16 nt, Mycobacterium avium subsp. paratuberculosis
cgucgaccugcucguc

SEQ ID NO: 928388 - RNA, 21 nt, Mycobacterium avium subsp. paratuberculosis
cgucgaccugcucgucgguga

SEQ ID NO: 928389 - RNA, 22 nt, Mycobacterium avium subsp. paratuberculosis
cgucgaccugcucgucggugac

SEQ ID NO: 928390 - RNA, 20 nt, Mycobacterium avium subsp. paratuberculosis
cgucgaccuugcagcccgcg

SEQ ID NO: 928391 - RNA, 21 nt, Mycobacterium avium subsp. paratuberculosis
cgucgaccuugcagcccgcgu

SEQ ID NO: 928392 - RNA, 15 nt, Mycobacterium avium subsp. paratuberculosis
cgucgacgaccacca

SEQ ID NO: 928393 - RNA, 18 nt, Mycobacterium avium subsp. paratuberculosis
cgucgacgacgaaucccg

SEQ ID NO: 928394 - RNA, 16 nt, Mycobacterium avium subsp. paratuberculosis
cgucgacgacggcgcc

SEQ ID NO: 928395 - RNA, 18 nt, Mycobacterium avium subsp. paratuberculosis
cgucgacgacggcgccgc

SEQ ID NO: 928396 - RNA, 23 nt, Mycobacterium avium subsp. paratuberculosis
cgucgacgacggcgccgcgucgg

SEQ ID NO: 928397 - RNA, 14 nt, Mycobacterium avium subsp. paratuberculosis
cgucgacgacgguc

SEQ ID NO: 928398 - RNA, 19 nt, Mycobacterium avium subsp. paratuberculosis
cgucgacgagcccgccggc

SEQ ID NO: 928399 - RNA, 18 nt, Mycobacterium avium subsp. paratuberculosis
cgucgaccgucacgcugg

SEQ ID NO: 928400 - RNA, 17 nt, Mycobacterium avium subsp. paratuberculosis
cgucgaccgcgacgacc

SEQ ID NO: 928401 - RNA, 14 nt, Mycobacterium avium subsp. paratuberculosis
cgucgaccgcgccg

SEQ ID NO: 928402 - RNA, 18 nt, Mycobacterium avium subsp. paratuberculosis
cgucgaccgcgccggggu

SEQ ID NO: 928403 - RNA, 15 nt, Mycobacterium avium subsp. paratuberculosis
cgucgaccgcggccu

SEQ ID NO: 928404 - RNA, 17 nt, Mycobacterium avium subsp. paratuberculosis
cgucgaccucgaucagu

SEQ ID NO: 928405 - RNA, 21 nt, Mycobacterium avium subsp. paratuberculosis
gacaucaccaaccgcucggcg

SEQ ID NO: 928406 - RNA, 23 nt, Mycobacterium avium subsp. paratuberculosis
gacaucaccaaccgcucggcgau

SEQ ID NO: 928407 - RNA, 13 nt, Mycobacterium avium subsp. paratuberculosis
gacaucaccgcgg

SEQ ID NO: 928408 - RNA, 21 nt, Mycobacterium avium subsp. paratuberculosis
gacaucaccgcgggcgcgccg

SEQ ID NO: 928409 - RNA, 22 nt, Mycobacterium avium subsp. paratuberculosis
gacaucaccgcgggcgcgccgu

SEQ ID NO: 928410 - RNA, 16 nt, Mycobacterium avium subsp. paratuberculosis
gacaucacgaacgcgu

SEQ ID NO: 928411 - RNA, 22 nt, Mycobacterium avium subsp. paratuberculosis
gacauccugcgcaucgagcugc

SEQ ID NO: 928412 - RNA, 17 nt, Mycobacterium avium subsp. paratuberculosis
gacaucgccaccuggaa

SEQ ID NO: 928413 - RNA, 17 nt, Mycobacterium avium subsp. paratuberculosis
gacaucagaucgccgac

SEQ ID NO: 928414 - RNA, 19 nt, Mycobacterium avium subsp. paratuberculosis
gacauccagaugcccagca

SEQ ID NO: 928415 - RNA, 23 nt, Mycobacterium avium subsp. paratuberculosis
gacauccaggaccgcgcgccggc

SEQ ID NO: 928416 - RNA, 20 nt, Mycobacterium avium subsp. paratuberculosis
gacaucaggcccuugcccca

SEQ ID NO: 928417 - RNA, 17 nt, Mycobacterium avium subsp. paratuberculosis
gacauccauugggccgc

SEQ ID NO: 928418 - RNA, 19 nt, Mycobacterium avium subsp. paratuberculosis
gacauccauugggccgcgg

SEQ ID NO: 928419 - RNA, 21 nt, Mycobacterium avium subsp. paratuberculosis
gacauccauugggccgcggcg

SEQ ID NO: 928420 - RNA, 14 nt, Mycobacterium avium subsp. paratuberculosis
gacaggccggccgc

SEQ ID NO: 928421 - RNA, 13 nt, Mycobacterium avium subsp. paratuberculosis
gacaggccggcga

SEQ ID NO: 928422 - RNA, 16 nt, Mycobacterium avium subsp. paratuberculosis
gacaggccggcgacgg

SEQ ID NO: 928423 - RNA, 23 nt, Mycobacterium avium subsp. paratuberculosis
aacgacgaagucggucagcgucg

SEQ ID NO: 928424 - RNA, 16 nt, Mycobacterium avium subsp. paratuberculosis
aacgacccggccaccg

SEQ ID NO: 928425 - RNA, 15 nt, Mycobacterium avium subsp. paratuberculosis
aacgacccgucgggg

SEQ ID NO: 928426 - RNA, 13 nt, Mycobacterium avium subsp. paratuberculosis
aacgacgccaccg

SEQ ID NO: 928427 - RNA, 18 nt, Mycobacterium avium subsp. paratuberculosis
aacgacgaccucccccga

SEQ ID NO: 928428 - RNA, 22 nt, Mycobacterium avium subsp. paratuberculosis
gacagcagcucauacagcggcg

SEQ ID NO: 928429 - RNA, 23 nt, Mycobacterium avium subsp. paratuberculosis
gacagcggccuaugcgcccggga

SEQ ID NO: 928430 - RNA, 13 nt, Mycobacterium avium subsp. paratuberculosis
gacagcagccgcu

SEQ ID NO: 928431 - RNA, 12 nt, Mycobacterium avium subsp. paratuberculosis
gacagcacgccg

SEQ ID NO: 928432 - RNA, 16 nt, Mycobacterium avium subsp. paratuberculosis
gacagcacgccgggca

SEQ ID NO: 928433 - RNA, 14 nt, Mycobacterium avium subsp. paratuberculosis
gacagcaccucgcc

SEQ ID NO: 928434 - RNA, 23 nt, Mycobacterium avium subsp. paratuberculosis
gacagcacguuguucaggucgau

SEQ ID NO: 928435 - RNA, 13 nt, Mycobacterium avium subsp. paratuberculosis
gacagcagcaccg

SEQ ID NO: 928436 - RNA, 16 nt, Mycobacterium avium subsp. paratuberculosis
gacagcagcagcuccc

SEQ ID NO: 928437 - RNA, 13 nt, Mycobacterium avium subsp. paratuberculosis
gacagcuccaaca

SEQ ID NO: 928438 - RNA, 14 nt, Mycobacterium avium subsp. paratuberculosis
gacagcuccaacag

SEQ ID NO: 928439 - RNA, 16 nt, Mycobacterium avium subsp. paratuberculosis
gacagcuccaacagcc

SEQ ID NO: 928440 - RNA, 18 nt, Mycobacterium avium subsp. paratuberculosis
gacagcuccaacagccgg

SEQ ID NO: 928441 - RNA, 13 nt, Mycobacterium avium subsp. paratuberculosis
gacagcucgccgg

SEQ ID NO: 928442 - RNA, 14 nt, Mycobacterium avium subsp. paratuberculosis
gacagcucgccggc

SEQ ID NO: 928443 - RNA, 15 nt, Mycobacterium avium subsp. paratuberculosis
gacagcucgccggcc

SEQ ID NO: 928444 - RNA, 18 nt, Mycobacterium avium subsp. paratuberculosis
gacagcucgccggccgcg

SEQ ID NO: 928445 - RNA, 22 nt, Mycobacterium avium subsp. paratuberculosis
gacagcucgccggccgcgggcg

SEQ ID NO: 928446 - RNA, 15 nt, Mycobacterium avium subsp. paratuberculosis
gacagcgggccgacc

SEQ ID NO: 928447 - RNA, 20 nt, Mycobacterium avium subsp. paratuberculosis
gacagcgggccgacccggcc

SEQ ID NO: 928448 - RNA, 22 nt, Mycobacterium avium subsp. paratuberculosis
gacagcaggaucuccggccggu

SEQ ID NO: 928449 - RNA, 13 nt, Mycobacterium avium subsp. paratuberculosis
gacagcgucacca

SEQ ID NO: 928450 - RNA, 17 nt, Mycobacterium avium subsp. paratuberculosis
gacagcgucagccccga

SEQ ID NO: 928451 - RNA, 22 nt, Mycobacterium avium subsp. paratuberculosis
gacagcugggcguacugcucgg

SEQ ID NO: 928452 - RNA, 16 nt, Mycobacterium avium subsp. paratuberculosis
gacagcguggucgcgc

SEQ ID NO: 928453 - RNA, 14 nt, Mycobacterium avium subsp. paratuberculosis
gacagcugagcagc

SEQ ID NO: 928454 - RNA, 16 nt, Mycobacterium avium subsp. paratuberculosis
gacagcugagcagccc

SEQ ID NO: 928455 - RNA, 17 nt, Mycobacterium avium subsp. paratuberculosis
gacagcugagcagcccg

SEQ ID NO: 928456 - RNA, 18 nt, Mycobacterium avium subsp. paratuberculosis
gacagcugagcagcccga

SEQ ID NO: 928457 - RNA, 23 nt, Mycobacterium avium subsp. paratuberculosis
gacagaucgcccaucaccgcacc

SEQ ID NO: 928458 - RNA, 18 nt, Mycobacterium avium subsp. paratuberculosis
gacagaugcggcaccagc

SEQ ID NO: 928459 - RNA, 17 nt, Mycobacterium avium subsp. paratuberculosis
gacagcaaaccgaccgc

SEQ ID NO: 928460 - RNA, 12 nt, Mycobacterium avium subsp. paratuberculosis
gacagcaccgcc

SEQ ID NO: 928461 - RNA, 18 nt, Mycobacterium avium subsp. paratuberculosis
gacagcaccgccaucgcg

SEQ ID NO: 928462 - RNA, 15 nt, Mycobacterium avium subsp. paratuberculosis
gacagcacccggccc

SEQ ID NO: 928463 - RNA, 13 nt, Mycobacterium avium subsp. paratuberculosis
gacagcaccacca

SEQ ID NO: 928464 - RNA, 17 nt, Mycobacterium avium subsp. paratuberculosis
gacagcaccaccagguc

SEQ ID NO: 928465 - RNA, 14 nt, Mycobacterium avium subsp. paratuberculosis
gacagacccgacag

SEQ ID NO: 928466 - RNA, 14 nt, Mycobacterium avium subsp. paratuberculosis
gacagacccgaucg

SEQ ID NO: 928467 - RNA, 19 nt, Mycobacterium avium subsp. paratuberculosis
gacacugcaacuacgcacc

SEQ ID NO: 928468 - RNA, 14 nt, Mycobacterium avium subsp. paratuberculosis
gacacgaucggcau

SEQ ID NO: 928469 - RNA, 18 nt, Mycobacterium avium subsp. paratuberculosis
gacaccugcucaccgagc

SEQ ID NO: 928470 - RNA, 22 nt, Mycobacterium avium subsp. paratuberculosis
gacaccugcucaccgagcuggg

SEQ ID NO: 928471 - RNA, 16 nt, Mycobacterium avium subsp. paratuberculosis
gacaccuuggcggcca

SEQ ID NO: 928472 - RNA, 19 nt, Mycobacterium avium subsp. paratuberculosis
gacacgaauacccuucggc

SEQ ID NO: 928473 - RNA, 23 nt, Mycobacterium avium subsp. paratuberculosis
gacacgaauacccuucggccggc

SEQ ID NO: 928474 - RNA, 13 nt, Mycobacterium avium subsp. paratuberculosis
gacacgcgccggc

SEQ ID NO: 928475 - RNA, 17 nt, Mycobacterium avium subsp. paratuberculosis
gacacgcgccggcgcgg

SEQ ID NO: 928476 - RNA, 19 nt, Mycobacterium avium subsp. paratuberculosis
gacacgcgccggcgcgggc

SEQ ID NO: 928477 - RNA, 16 nt, Mycobacterium avium subsp. paratuberculosis
gacacgccccgauggu

SEQ ID NO: 928478 - RNA, 13 nt, Mycobacterium avium subsp. paratuberculosis
gacacgccgaucg

SEQ ID NO: 928479 - RNA, 13 nt, Mycobacterium avium subsp. paratuberculosis
gacacgcugccga

SEQ ID NO: 928480 - RNA, 14 nt, Mycobacterium avium subsp. paratuberculosis
gacacgcugccgag

SEQ ID NO: 928481 - RNA, 17 nt, Mycobacterium avium subsp. paratuberculosis
gacacgcucacgcucgg

SEQ ID NO: 928482 - RNA, 12 nt, Mycobacterium avium subsp. paratuberculosis
gacacggccagc

SEQ ID NO: 928483 - RNA, 14 nt, Mycobacterium avium subsp. paratuberculosis
gacacggccagcgc

SEQ ID NO: 928484 - RNA, 16 nt, Mycobacterium avium subsp. paratuberculosis
gacacggccagcgccg

SEQ ID NO: 928485 - RNA, 19 nt, Mycobacterium avium subsp. paratuberculosis
gacacggccagcgccguca

SEQ ID NO: 928486 - RNA, 17 nt, Mycobacterium avium subsp. paratuberculosis
gacacggcgccgugcgc

SEQ ID NO: 928487 - RNA, 13 nt, Mycobacterium avium subsp. paratuberculosis
gacacggcggcgc

SEQ ID NO: 928488 - RNA, 20 nt, Mycobacterium avium subsp. paratuberculosis
gacacggcggcgcgggcggc

SEQ ID NO: 928489 - RNA, 17 nt, Mycobacterium avium subsp. paratuberculosis
gacacggugaacgucga

SEQ ID NO: 928490 - RNA, 17 nt, Mycobacterium avium subsp. paratuberculosis
gacacgucgacacgccg

SEQ ID NO: 928491 - RNA, 20 nt, Mycobacterium avium subsp. paratuberculosis
gacacgucgacacgccggcc

SEQ ID NO: 928492 - RNA, 15 nt, Mycobacterium avium subsp. paratuberculosis
gacacguuggccaga

SEQ ID NO: 928493 - RNA, 23 nt, Mycobacterium avium subsp. paratuberculosis
gacacguggaccgagcgcgcgau

SEQ ID NO: 928494 - RNA, 20 nt, Mycobacterium avium subsp. paratuberculosis
gacaccucgucgaucuucgc

SEQ ID NO: 928495 - RNA, 23 nt, Mycobacterium avium subsp. paratuberculosis
gacaccuccuuggguucggcggc

SEQ ID NO: 928496 - RNA, 16 nt, Mycobacterium avium subsp. paratuberculosis
gacaccucggccagcg

SEQ ID NO: 928497 - RNA, 18 nt, Mycobacterium avium subsp. paratuberculosis
gacaccucggccagcgcc

SEQ ID NO: 928498 - RNA, 19 nt, Mycobacterium avium subsp. paratuberculosis
gacaccucggccagcgccg

SEQ ID NO: 928499 - RNA, 20 nt, Mycobacterium avium subsp. paratuberculosis
gacaccucggccagcgccgc

SEQ ID NO: 928500 - RNA, 16 nt, Mycobacterium avium subsp. paratuberculosis
gacaccgucgcgcacc

SEQ ID NO: 928501 - RNA, 17 nt, Mycobacterium avium subsp. paratuberculosis
gacaccgucgcgcaccc

SEQ ID NO: 928502 - RNA, 14 nt, Mycobacterium avium subsp. paratuberculosis
gacaccgcggcgac

SEQ ID NO: 928503 - RNA, 16 nt, Mycobacterium avium subsp. paratuberculosis
gacaccgcggcgacgu

SEQ ID NO: 928504 - RNA, 18 nt, Mycobacterium avium subsp. paratuberculosis
gacaccgcggcgacgucg

SEQ ID NO: 928505 - RNA, 16 nt, Mycobacterium avium subsp. paratuberculosis
gacaccggcacgucgg

SEQ ID NO: 928506 - RNA, 18 nt, Mycobacterium avium subsp. paratuberculosis
gacaccggcacgucggcc

SEQ ID NO: 928507 - RNA, 18 nt, Mycobacterium avium subsp. paratuberculosis
gacaccgggcaccgacau

SEQ ID NO: 928508 - RNA, 20 nt, Mycobacterium avium subsp. paratuberculosis
gacaccgggcaccgacauca

SEQ ID NO: 928509 - RNA, 20 nt, Mycobacterium avium subsp. paratuberculosis
gacaccgggucccccgccga

SEQ ID NO: 928510 - RNA, 21 nt, Mycobacterium avium subsp. paratuberculosis
gacaccgggucccccgccgac

SEQ ID NO: 928511 - RNA, 19 nt, Mycobacterium avium subsp. paratuberculosis
gacaccgcuggccgaggcc

SEQ ID NO: 928512 - RNA, 20 nt, Mycobacterium avium subsp. paratuberculosis
gacaccgcuggccgaggccu

SEQ ID NO: 928513 - RNA, 13 nt, Mycobacterium avium subsp. paratuberculosis
gacaccgcauggc

SEQ ID NO: 928514 - RNA, 17 nt, Mycobacterium avium subsp. paratuberculosis
gacaccgcauggccggc

SEQ ID NO: 928515 - RNA, 18 nt, Mycobacterium avium subsp. paratuberculosis
gacaccgcauggccggcg

SEQ ID NO: 928516 - RNA, 19 nt, Mycobacterium avium subsp. paratuberculosis
gacaccgcauggccggcga

SEQ ID NO: 928517 - RNA, 12 nt, Mycobacterium avium subsp. paratuberculosis
gacaccgcacgg

SEQ ID NO: 928518 - RNA, 13 nt, Mycobacterium avium subsp. paratuberculosis
gacaccgccagca

SEQ ID NO: 928519 - RNA, 14 nt, Mycobacterium avium subsp. paratuberculosis
gacaccgccagcag

SEQ ID NO: 928520 - RNA, 20 nt, Mycobacterium avium subsp. paratuberculosis
gacaccgccagcagcgccgc

SEQ ID NO: 928521 - RNA, 21 nt, Mycobacterium avium subsp. paratuberculosis
gacaccgccagcagcgccgcu

SEQ ID NO: 928522 - RNA, 20 nt, Mycobacterium avium subsp. paratuberculosis
gacaccgccccgccgcgccg

SEQ ID NO: 928523 - RNA, 21 nt, Mycobacterium avium subsp. paratuberculosis
gacaccgccccgccgcgccgg

SEQ ID NO: 928524 - RNA, 12 nt, Mycobacterium avium subsp. paratuberculosis
gacaccgccguu

SEQ ID NO: 928525 - RNA, 22 nt, Mycobacterium avium subsp. paratuberculosis
gacaccgccuucgacggccggc

SEQ ID NO: 928526 - RNA, 16 nt, Mycobacterium avium subsp. paratuberculosis
gacaccagcgucgcga

SEQ ID NO: 928527 - RNA, 19 nt, Mycobacterium avium subsp. paratuberculosis
gacaccagggugcgcacga

SEQ ID NO: 928528 - RNA, 17 nt, Mycobacterium avium subsp. paratuberculosis
gacaccccgaugcggug

SEQ ID NO: 928529 - RNA, 23 nt, Mycobacterium avium subsp. paratuberculosis
gacaccccgaugcggugccgggc

SEQ ID NO: 928530 - RNA, 20 nt, Mycobacterium avium subsp. paratuberculosis
gacaccccgcgagucaccgg

SEQ ID NO: 928531 - RNA, 14 nt, Mycobacterium avium subsp. paratuberculosis
gacaccccgcucgg

SEQ ID NO: 928532 - RNA, 14 nt, Mycobacterium avium subsp. paratuberculosis
gacacccagcggcg

SEQ ID NO: 928533 - RNA, 18 nt, Mycobacterium avium subsp. paratuberculosis
gacacccagcggcgcggc

SEQ ID NO: 928534 - RNA, 14 nt, Mycobacterium avium subsp. paratuberculosis
gacaccccacaccg

SEQ ID NO: 928535 - RNA, 15 nt, Mycobacterium avium subsp. paratuberculosis
gacaccccacaccgu

SEQ ID NO: 928536 - RNA, 14 nt, Mycobacterium avium subsp. paratuberculosis
gacacccgcgcggu

SEQ ID NO: 928537 - RNA, 17 nt, Mycobacterium avium subsp. paratuberculosis
gacacccgcgcggugcc

SEQ ID NO: 928538 - RNA, 18 nt, Mycobacterium avium subsp. paratuberculosis
gacacccgcgcggugccc

SEQ ID NO: 928539 - RNA, 15 nt, Mycobacterium avium subsp. paratuberculosis
gacacccucggggua

SEQ ID NO: 928540 - RNA, 16 nt, Mycobacterium avium subsp. paratuberculosis
gacacccucgggguag

SEQ ID NO: 928541 - RNA, 18 nt, Mycobacterium avium subsp. paratuberculosis
gacaccgaacccaccagc

SEQ ID NO: 928542 - RNA, 20 nt, Mycobacterium avium subsp. paratuberculosis
gacaccgaacccaccagcgc

SEQ ID NO: 928543 - RNA, 22 nt, Mycobacterium avium subsp. paratuberculosis
gacaccgaacccaccagcgccu

SEQ ID NO: 928544 - RNA, 20 nt, Mycobacterium avium subsp. paratuberculosis
gacaccgaaccgccccgcgc

SEQ ID NO: 928545 - RNA, 20 nt, Mycobacterium avium subsp. paratuberculosis
gacacccuucaucagcaccg

SEQ ID NO: 928546 - RNA, 23 nt, Mycobacterium avium subsp. paratuberculosis
gacacccuucaucagcaccgcga

SEQ ID NO: 928547 - RNA, 13 nt, Mycobacterium avium subsp. paratuberculosis
gacaccgacgacc

SEQ ID NO: 928548 - RNA, 17 nt, Mycobacterium avium subsp. paratuberculosis
gacaccgacgaccauca

SEQ ID NO: 928549 - RNA, 22 nt, Mycobacterium avium subsp. paratuberculosis
gacaccgacgaccaucagcgcc

SEQ ID NO: 928550 - RNA, 23 nt, Mycobacterium avium subsp. paratuberculosis
gacaccgacgaccaucagcgccc

SEQ ID NO: 928551 - RNA, 12 nt, Mycobacterium avium subsp. paratuberculosis
gacaccaccgcg

SEQ ID NO: 928552 - RNA, 15 nt, Mycobacterium avium subsp. paratuberculosis
gacaccaccgcgcgc

SEQ ID NO: 928553 - RNA, 16 nt, Mycobacterium avium subsp. paratuberculosis
gacaccaccgcggugg

SEQ ID NO: 928554 - RNA, 12 nt, Mycobacterium avium subsp. paratuberculosis
gacaccaccggc

SEQ ID NO: 928555 - RNA, 13 nt, Mycobacterium avium subsp. paratuberculosis
gacaccaccacga

SEQ ID NO: 928556 - RNA, 14 nt, Mycobacterium avium subsp. paratuberculosis
gacaccaccacgaa

SEQ ID NO: 928557 - RNA, 13 nt, Mycobacterium avium subsp. paratuberculosis
gacaccaccgugc

SEQ ID NO: 928558 - RNA, 22 nt, Mycobacterium avium subsp. paratuberculosis
gacaccaccgugcuggccacca

SEQ ID NO: 928559 - RNA, 13 nt, Mycobacterium avium subsp. paratuberculosis
gacaccaccugca

SEQ ID NO: 928560 - RNA, 18 nt, Mycobacterium avium subsp. paratuberculosis
gacaccacgaucagcgcg

SEQ ID NO: 928561 - RNA, 17 nt, Mycobacterium avium subsp. paratuberculosis
gacaccacggucgccgc

SEQ ID NO: 928562 - RNA, 18 nt, Mycobacterium avium subsp. paratuberculosis
gacaccacggucgccgcg

SEQ ID NO: 928563 - RNA, 21 nt, Mycobacterium avium subsp. paratuberculosis
gacaccacggucgccgcgccg

SEQ ID NO: 928564 - RNA, 21 nt, Mycobacterium avium subsp. paratuberculosis
gacaccacggugaacgggccg

SEQ ID NO: 928565 - RNA, 23 nt, Mycobacterium avium subsp. paratuberculosis
gacaccacggugaacgggccgca

SEQ ID NO: 928566 - RNA, 15 nt, Mycobacterium avium subsp. paratuberculosis
gacaccacgucgucg

SEQ ID NO: 928567 - RNA, 17 nt, Mycobacterium avium subsp. paratuberculosis
gacaccacgucgucggc

SEQ ID NO: 928568 - RNA, 18 nt, Mycobacterium avium subsp. paratuberculosis
gacaccacgucgucggcc

SEQ ID NO: 928569 - RNA, 12 nt, Mycobacterium avium subsp. paratuberculosis
gacaccagcgcg

SEQ ID NO: 928570 - RNA, 13 nt, Mycobacterium avium subsp. paratuberculosis
gacaccagcgcgc

SEQ ID NO: 928571 - RNA, 14 nt, Mycobacterium avium subsp. paratuberculosis
gacaccagcgcgca

SEQ ID NO: 928572 - RNA, 19 nt, Mycobacterium avium subsp. paratuberculosis
gacacagcaccggcgucga

SEQ ID NO: 928573 - RNA, 14 nt, Mycobacterium avium subsp. paratuberculosis
gacacaaaagcgcc

SEQ ID NO: 928574 - RNA, 15 nt, Mycobacterium avium subsp. paratuberculosis
gacacaaaagcgccc

SEQ ID NO: 928575 - RNA, 17 nt, Mycobacterium avium subsp. paratuberculosis
gacacaaaagcgcccga

SEQ ID NO: 928576 - RNA, 17 nt, Mycobacterium avium subsp. paratuberculosis
gaaguuggucaccacca

SEQ ID NO: 928577 - RNA, 23 nt, Mycobacterium avium subsp. paratuberculosis
gaaguuguagacguagugcagcc

SEQ ID NO: 928578 - RNA, 17 nt, Mycobacterium avium subsp. paratuberculosis
gaaguucucgccgugca

SEQ ID NO: 928579 - RNA, 17 nt, Mycobacterium avium subsp. paratuberculosis
gaaguugaagacgcgaa

SEQ ID NO: 928580 - RNA, 17 nt, Mycobacterium avium subsp. paratuberculosis
gaaguggcagcgcuccu

SEQ ID NO: 928581 - RNA, 15 nt, Mycobacterium avium subsp. paratuberculosis
gaaguggcuggucac

SEQ ID NO: 928582 - RNA, 14 nt, Mycobacterium avium subsp. paratuberculosis
gaagugggccauca

SEQ ID NO: 928583 - RNA, 23 nt, Mycobacterium avium subsp. paratuberculosis
gaacugcaccagcacgacaccga

SEQ ID NO: 928584 - RNA, 15 nt, Mycobacterium avium subsp. paratuberculosis
gaacucgacggagug

SEQ ID NO: 928585 - RNA, 15 nt, Mycobacterium avium subsp. paratuberculosis
gaacugccgaugcug

SEQ ID NO: 928586 - RNA, 12 nt, Mycobacterium avium subsp. paratuberculosis
gaacugccgcgg

SEQ ID NO: 928587 - RNA, 13 nt, Mycobacterium avium subsp. paratuberculosis
gaacugcagcccg

SEQ ID NO: 928588 - RNA, 13 nt, Mycobacterium avium subsp. paratuberculosis
gaacugcagccgg

SEQ ID NO: 928589 - RNA, 14 nt, Mycobacterium avium subsp. paratuberculosis
gaacugcagccggc

SEQ ID NO: 928590 - RNA, 20 nt, Mycobacterium avium subsp. paratuberculosis
gaacugcucgaccagcgccg

SEQ ID NO: 928591 - RNA, 23 nt, Mycobacterium avium subsp. paratuberculosis
gaauccggugggguuagggcguc

SEQ ID NO: 928592 - RNA, 21 nt, Mycobacterium avium subsp. paratuberculosis
gaauccucagcacggccgcgg

SEQ ID NO: 928593 - RNA, 13 nt, Mycobacterium avium subsp. paratuberculosis
gaauccggccgga

SEQ ID NO: 928594 - RNA, 18 nt, Mycobacterium avium subsp. paratuberculosis
gaauccggcggcgcucag

SEQ ID NO: 928595 - RNA, 19 nt, Mycobacterium avium subsp. paratuberculosis
gaauccgggugucgacgcc

SEQ ID NO: 928596 - RNA, 19 nt, Mycobacterium avium subsp. paratuberculosis
gaauccgguccacucgucg

SEQ ID NO: 928597 - RNA, 18 nt, Mycobacterium avium subsp. paratuberculosis
gaaucacacugccgguca

SEQ ID NO: 928598 - RNA, 12 nt, Mycobacterium avium subsp. paratuberculosis
gaauccgcgcag

SEQ ID NO: 928599 - RNA, 13 nt, Mycobacterium avium subsp. paratuberculosis
gaauccgcgcagc

SEQ ID NO: 928600 - RNA, 23 nt, Mycobacterium avium subsp. paratuberculosis
gaauccgcgggcguggcggucgg

SEQ ID NO: 928601 - RNA, 22 nt, Mycobacterium avium subsp. paratuberculosis
gaauccuguugguagcccagga

SEQ ID NO: 928602 - RNA, 13 nt, Mycobacterium avium subsp. paratuberculosis
gaaucgacaccgc

SEQ ID NO: 928603 - RNA, 16 nt, Mycobacterium avium subsp. paratuberculosis
gaaucgcaagcagagc

SEQ ID NO: 928604 - RNA, 22 nt, Mycobacterium avium subsp. paratuberculosis
gaaucgagccgccugcgcgccg

SEQ ID NO: 928605 - RNA, 22 nt, Mycobacterium avium subsp. paratuberculosis
gaaucgauaacgcgcgcgccgu

SEQ ID NO: 928606 - RNA, 17 nt, Mycobacterium avium subsp. paratuberculosis
gacaacggugguggcga

SEQ ID NO: 928607 - RNA, 17 nt, Mycobacterium avium subsp. paratuberculosis
gacaacggaucgagcgc

SEQ ID NO: 928608 - RNA, 22 nt, Mycobacterium avium subsp. paratuberculosis
gacaacggaucgagcgcaccgc

SEQ ID NO: 928609 - RNA, 15 nt, Mycobacterium avium subsp. paratuberculosis
gacaacggcccccac

SEQ ID NO: 928610 - RNA, 22 nt, Mycobacterium avium subsp. paratuberculosis
gacaagggccgggcgcuggccg

SEQ ID NO: 928611 - RNA, 23 nt, Mycobacterium avium subsp. paratuberculosis
gacaagggccgggcgcuggccgu

SEQ ID NO: 928612 - RNA, 17 nt, Mycobacterium avium subsp. paratuberculosis
gacaaggucgaccgcgc

SEQ ID NO: 928613 - RNA, 22 nt, Mycobacterium avium subsp. paratuberculosis
gacaacauccgcgacgacacca

SEQ ID NO: 928614 - RNA, 20 nt, Mycobacterium avium subsp. paratuberculosis
gacaaccaucgaggcgauca

SEQ ID NO: 928615 - RNA, 21 nt, Mycobacterium avium subsp. paratuberculosis
gacaacgcgucgaacagccgg

SEQ ID NO: 928616 - RNA, 18 nt, Mycobacterium avium subsp. paratuberculosis
gacaacaggcgaccucgg

SEQ ID NO: 928617 - RNA, 22 nt, Mycobacterium avium subsp. paratuberculosis
gacaacacgaucgucaccgugc

SEQ ID NO: 928618 - RNA, 16 nt, Mycobacterium avium subsp. paratuberculosis
gacaacagcacgaaca

SEQ ID NO: 928619 - RNA, 23 nt, Mycobacterium avium subsp. paratuberculosis
gacaacagcacgaacagcagcgg

SEQ ID NO: 928620 - RNA, 17 nt, Mycobacterium avium subsp. paratuberculosis
gaauggcaaggccagca

SEQ ID NO: 928621 - RNA, 19 nt, Mycobacterium avium subsp. paratuberculosis
gaauucgguggcgauggug

SEQ ID NO: 928622 - RNA, 16 nt, Mycobacterium avium subsp. paratuberculosis
gaaugcggcugggugg

SEQ ID NO: 928623 - RNA, 14 nt, Mycobacterium avium subsp. paratuberculosis
gaauuguggcggcc

SEQ ID NO: 928624 - RNA, 19 nt, Mycobacterium avium subsp. paratuberculosis
gaauugggcgaguacaccu

SEQ ID NO: 928625 - RNA, 13 nt, Mycobacterium avium subsp. paratuberculosis
gaccaugccgcgg

SEQ ID NO: 928626 - RNA, 21 nt, Mycobacterium avium subsp. paratuberculosis
gaccaugccgcgggccagcag

SEQ ID NO: 928627 - RNA, 24 nt, Mycobacterium avium subsp. paratuberculosis
gaccaugccgcgggccagcagccg

SEQ ID NO: 928628 - RNA, 22 nt, Mycobacterium avium subsp. paratuberculosis
gaccaugucgacgcugagccgc

SEQ ID NO: 928629 - RNA, 18 nt, Mycobacterium avium subsp. paratuberculosis
gaccaugucggcgacccg

SEQ ID NO: 928630 - RNA, 21 nt, Mycobacterium avium subsp. paratuberculosis
gaccaugucggcgacccgcac

SEQ ID NO: 928631 - RNA, 21 nt, Mycobacterium avium subsp. paratuberculosis
gacccaacucaugggcccggc

SEQ ID NO: 928632 - RNA, 16 nt, Mycobacterium avium subsp. paratuberculosis
gaccauggcgcggcgg

SEQ ID NO: 928633 - RNA, 21 nt, Mycobacterium avium subsp. paratuberculosis
gaccauggcgcggcggccggc

SEQ ID NO: 928634 - RNA, 12 nt, Mycobacterium avium subsp. paratuberculosis
gaccaugaccca

SEQ ID NO: 928635 - RNA, 23 nt, Mycobacterium avium subsp. paratuberculosis
gacccacggguuggggccgcgga

SEQ ID NO: 928636 - RNA, 18 nt, Mycobacterium avium subsp. paratuberculosis
gacccacaccucgcaggu

SEQ ID NO: 928637 - RNA, 15 nt, Mycobacterium avium subsp. paratuberculosis
gacccacagcugccg

SEQ ID NO: 928638 - RNA, 19 nt, Mycobacterium avium subsp. paratuberculosis
gacccacagcugccggccg

SEQ ID NO: 928639 - RNA, 16 nt, Mycobacterium avium subsp. paratuberculosis
gacccagcagcggccg

SEQ ID NO: 928640 - RNA, 18 nt, Mycobacterium avium subsp. paratuberculosis
gacccagcagcggccggc

SEQ ID NO: 928641 - RNA, 19 nt, Mycobacterium avium subsp. paratuberculosis
gacccagcagcggccggcg

SEQ ID NO: 928642 - RNA, 21 nt, Mycobacterium avium subsp. paratuberculosis
gacccagcagcggccggcgca

SEQ ID NO: 928643 - RNA, 15 nt, Mycobacterium avium subsp. paratuberculosis
gacccagcaucgccg

SEQ ID NO: 928644 - RNA, 19 nt, Mycobacterium avium subsp. paratuberculosis
gacccagcccagcugcucg

SEQ ID NO: 928645 - RNA, 16 nt, Mycobacterium avium subsp. paratuberculosis
gacccagcccggcgac

SEQ ID NO: 928646 - RNA, 12 nt, Mycobacterium avium subsp. paratuberculosis
gacccagcgcgg

SEQ ID NO: 928647 - RNA, 15 nt, Mycobacterium avium subsp. paratuberculosis
gacccaggccgccgc

SEQ ID NO: 928648 - RNA, 15 nt, Mycobacterium avium subsp. paratuberculosis
gacccagcgcggggg

SEQ ID NO: 928649 - RNA, 15 nt, Mycobacterium avium subsp. paratuberculosis
gacccagcuccucgg

SEQ ID NO: 928650 - RNA, 17 nt, Mycobacterium avium subsp. paratuberculosis
gacccagcuccucggcc

SEQ ID NO: 928651 - RNA, 20 nt, Mycobacterium avium subsp. paratuberculosis
gacccagcuccucggccagc

SEQ ID NO: 928652 - RNA, 14 nt, Mycobacterium avium subsp. paratuberculosis
gacccgcaccaccg

SEQ ID NO: 928653 - RNA, 16 nt, Mycobacterium avium subsp. paratuberculosis
gacccgcaccaccgcc

SEQ ID NO: 928654 - RNA, 17 nt, Mycobacterium avium subsp. paratuberculosis
gacccgcaccaccgccc

SEQ ID NO: 928655 - RNA, 20 nt, Mycobacterium avium subsp. paratuberculosis
gacccgcaccaccgcccgga

SEQ ID NO: 928656 - RNA, 20 nt, Mycobacterium avium subsp. paratuberculosis
gacccgcacgaugccgcgcu

SEQ ID NO: 928657 - RNA, 19 nt, Mycobacterium avium subsp. paratuberculosis
gacccgcauccgccgggcg

SEQ ID NO: 928658 - RNA, 14 nt, Mycobacterium avium subsp. paratuberculosis
gacccgccgcaaca

SEQ ID NO: 928659 - RNA, 16 nt, Mycobacterium avium subsp. paratuberculosis
gacccgccgcaacagc

SEQ ID NO: 928660 - RNA, 19 nt, Mycobacterium avium subsp. paratuberculosis
gacccgccgcaacagccgg

SEQ ID NO: 928661 - RNA, 20 nt, Mycobacterium avium subsp. paratuberculosis
gacccgccgcaacagccggc

SEQ ID NO: 928662 - RNA, 16 nt, Mycobacterium avium subsp. paratuberculosis
gacccgccgcagcccg

SEQ ID NO: 928663 - RNA, 22 nt, Mycobacterium avium subsp. paratuberculosis
gacccgccgcagcccgccagga

SEQ ID NO: 928664 - RNA, 15 nt, Mycobacterium avium subsp. paratuberculosis
gacccgccgcggcaa

SEQ ID NO: 928665 - RNA, 22 nt, Mycobacterium avium subsp. paratuberculosis
gacccgccgcggcaacgccagc

SEQ ID NO: 928666 - RNA, 19 nt, Mycobacterium avium subsp. paratuberculosis
gacccgccgugaccggcga

SEQ ID NO: 928667 - RNA, 21 nt, Mycobacterium avium subsp. paratuberculosis
aacgccuccgaauccagcgcg

SEQ ID NO: 928668 - RNA, 15 nt, Mycobacterium avium subsp. paratuberculosis
aacgccuccgccgcc

SEQ ID NO: 928669 - RNA, 14 nt, Mycobacterium avium subsp. paratuberculosis
aacgccucgggccg

SEQ ID NO: 928670 - RNA, 19 nt, Mycobacterium avium subsp. paratuberculosis
aacgccucgggccggcagc

SEQ ID NO: 928671 - RNA, 15 nt, Mycobacterium avium subsp. paratuberculosis
gaccagccgaggcgc

SEQ ID NO: 928672 - RNA, 21 nt, Mycobacterium avium subsp. paratuberculosis
gaccagcaggacgcgcccggc

SEQ ID NO: 928673 - RNA, 13 nt, Mycobacterium avium subsp. paratuberculosis
gaccagcaccgcg

SEQ ID NO: 928674 - RNA, 14 nt, Mycobacterium avium subsp. paratuberculosis
gaccagcaccgcgg

SEQ ID NO: 928675 - RNA, 22 nt, Mycobacterium avium subsp. paratuberculosis
gaccagcaugugcucccagcuc

SEQ ID NO: 928676 - RNA, 12 nt, Mycobacterium avium subsp. paratuberculosis
gaccagcgacgc

SEQ ID NO: 928677 - RNA, 14 nt, Mycobacterium avium subsp. paratuberculosis
gaccagcgacgcca

SEQ ID NO: 928678 - RNA, 15 nt, Mycobacterium avium subsp. paratuberculosis
gaccagccggguccg

SEQ ID NO: 928679 - RNA, 13 nt, Mycobacterium avium subsp. paratuberculosis
gaccagccggucu

SEQ ID NO: 928680 - RNA, 16 nt, Mycobacterium avium subsp. paratuberculosis
gaccagcgccucgcgg

SEQ ID NO: 928681 - RNA, 19 nt, Mycobacterium avium subsp. paratuberculosis
gaccagcgccucgcgggug

SEQ ID NO: 928682 - RNA, 12 nt, Mycobacterium avium subsp. paratuberculosis
gaccagcgccga

SEQ ID NO: 928683 - RNA, 14 nt, Mycobacterium avium subsp. paratuberculosis
gaccagcgccgagg

SEQ ID NO: 928684 - RNA, 15 nt, Mycobacterium avium subsp. paratuberculosis
gaccagcgcgccgcc

SEQ ID NO: 928685 - RNA, 17 nt, Mycobacterium avium subsp. paratuberculosis
gaccagcgcgccgccca

SEQ ID NO: 928686 - RNA, 15 nt, Mycobacterium avium subsp. paratuberculosis
gaccagcgcgccggc

SEQ ID NO: 928687 - RNA, 16 nt, Mycobacterium avium subsp. paratuberculosis
gaccagcgcgccggcc

SEQ ID NO: 928688 - RNA, 18 nt, Mycobacterium avium subsp. paratuberculosis
gaccagcgcgccggccag

SEQ ID NO: 928689 - RNA, 15 nt, Mycobacterium avium subsp. paratuberculosis
gaccagcgcaaccgc

SEQ ID NO: 928690 - RNA, 16 nt, Mycobacterium avium subsp. paratuberculosis
gaccaggcccagcgga

SEQ ID NO: 928691 - RNA, 20 nt, Mycobacterium avium subsp. paratuberculosis
gaccagcgcgaacagcgcgg

SEQ ID NO: 928692 - RNA, 11 nt, Mycobacterium avium subsp. paratuberculosis
gaccagcgcgc

SEQ ID NO: 928693 - RNA, 12 nt, Mycobacterium avium subsp. paratuberculosis
gaccagcgcgcc

SEQ ID NO: 928694 - RNA, 13 nt, Mycobacterium avium subsp. paratuberculosis
gaccagcgcggug

SEQ ID NO: 928695 - RNA, 14 nt, Mycobacterium avium subsp. paratuberculosis
gaccagcgcggugc

SEQ ID NO: 928696 - RNA, 14 nt, Mycobacterium avium subsp. paratuberculosis
gaccaggcucacgc

SEQ ID NO: 928697 - RNA, 19 nt, Mycobacterium avium subsp. paratuberculosis
gaccaggccguccaccaga

SEQ ID NO: 928698 - RNA, 13 nt, Mycobacterium avium subsp. paratuberculosis
gaccaggccgaug

SEQ ID NO: 928699 - RNA, 17 nt, Mycobacterium avium subsp. paratuberculosis
gaccagggccucgucgu

SEQ ID NO: 928700 - RNA, 19 nt, Mycobacterium avium subsp. paratuberculosis
gaccagggccucgucgucg

SEQ ID NO: 928701 - RNA, 13 nt, Mycobacterium avium subsp. paratuberculosis
gaccagggcgauc

SEQ ID NO: 928702 - RNA, 15 nt, Mycobacterium avium subsp. paratuberculosis
gaccaggguggcccc

SEQ ID NO: 928703 - RNA, 19 nt, Mycobacterium avium subsp. paratuberculosis
gaccaggguggccccagcc

SEQ ID NO: 928704 - RNA, 21 nt, Mycobacterium avium subsp. paratuberculosis
gaccaggguggccccagcccg

SEQ ID NO: 928705 - RNA, 14 nt, Mycobacterium avium subsp. paratuberculosis
gaccagggcggugg

SEQ ID NO: 928706 - RNA, 15 nt, Mycobacterium avium subsp. paratuberculosis
gaccagggcgguggc

SEQ ID NO: 928707 - RNA, 19 nt, Mycobacterium avium subsp. paratuberculosis
gaccagggcgguggcggcg

SEQ ID NO: 928708 - RNA, 16 nt, Mycobacterium avium subsp. paratuberculosis
gaccaggcuuggcccg

SEQ ID NO: 928709 - RNA, 18 nt, Mycobacterium avium subsp. paratuberculosis
gaccaggcuuggcccgcc

SEQ ID NO: 928710 - RNA, 22 nt, Mycobacterium avium subsp. paratuberculosis
gaccaggcuuggcccgccgccg

SEQ ID NO: 928711 - RNA, 22 nt, Mycobacterium avium subsp. paratuberculosis
aacgaucggcuccagcgcccgc

SEQ ID NO: 928712 - RNA, 18 nt, Mycobacterium avium subsp. paratuberculosis
aacgccagcagccgcagc

SEQ ID NO: 928713 - RNA, 16 nt, Mycobacterium avium subsp. paratuberculosis
aacgccacggcggccg

SEQ ID NO: 928714 - RNA, 23 nt, Mycobacterium avium subsp. paratuberculosis
aacgccaccuucaccgcgccggu

SEQ ID NO: 928715 - RNA, 16 nt, Mycobacterium avium subsp. paratuberculosis
aacgccagcagcugcg

SEQ ID NO: 928716 - RNA, 12 nt, Mycobacterium avium subsp. paratuberculosis
aacgccagcgcg

SEQ ID NO: 928717 - RNA, 18 nt, Mycobacterium avium subsp. paratuberculosis
aacgccagcgcgacccgc

SEQ ID NO: 928718 - RNA, 15 nt, Mycobacterium avium subsp. paratuberculosis
aacgccaucaccagc

SEQ ID NO: 928719 - RNA, 18 nt, Mycobacterium avium subsp. paratuberculosis
aacgccaucaccagcgcg

SEQ ID NO: 928720 - RNA, 15 nt, Mycobacterium avium subsp. paratuberculosis
gaccagcacccgggc

SEQ ID NO: 928721 - RNA, 15 nt, Mycobacterium avium subsp. paratuberculosis
gaccagcaccgcauc

SEQ ID NO: 928722 - RNA, 14 nt, Mycobacterium avium subsp. paratuberculosis
gaccagcacguugu

SEQ ID NO: 928723 - RNA, 13 nt, Mycobacterium avium subsp. paratuberculosis
aacgccgccuccg

SEQ ID NO: 928724 - RNA, 21 nt, Mycobacterium avium subsp. paratuberculosis
aacgccgccuccgacagccgc

SEQ ID NO: 928725 - RNA, 23 nt, Mycobacterium avium subsp. paratuberculosis
gaccagaccgaagaucaccgcga

SEQ ID NO: 928726 - RNA, 17 nt, Mycobacterium avium subsp. paratuberculosis
aacgccgcccccgccca

SEQ ID NO: 928727 - RNA, 12 nt, Mycobacterium avium subsp. paratuberculosis
aacgccgccgac

SEQ ID NO: 928728 - RNA, 13 nt, Mycobacterium avium subsp. paratuberculosis
aacgccgccgaca

SEQ ID NO: 928729 - RNA, 13 nt, Mycobacterium avium subsp. paratuberculosis
gacaucggugacc

SEQ ID NO: 928730 - RNA, 18 nt, Mycobacterium avium subsp. paratuberculosis
gacaucggugaccgucgc

SEQ ID NO: 928731 - RNA, 19 nt, Mycobacterium avium subsp. paratuberculosis
gacaucggugaccgucgcc

SEQ ID NO: 928732 - RNA, 16 nt, Mycobacterium avium subsp. paratuberculosis
gacaucgccggcgacc

SEQ ID NO: 928733 - RNA, 19 nt, Mycobacterium avium subsp. paratuberculosis
gacaucgccaucagcagcg

SEQ ID NO: 928734 - RNA, 14 nt, Mycobacterium avium subsp. paratuberculosis
gacaucggcacacg

SEQ ID NO: 928735 - RNA, 22 nt, Mycobacterium avium subsp. paratuberculosis
gacaucggcagcagggugccgc

SEQ ID NO: 928736 - RNA, 13 nt, Mycobacterium avium subsp. paratuberculosis
gacaucggccgcc

SEQ ID NO: 928737 - RNA, 15 nt, Mycobacterium avium subsp. paratuberculosis
gacaugaccaccgcg

SEQ ID NO: 928738 - RNA, 17 nt, Mycobacterium avium subsp. paratuberculosis
gacaugaccaccgcguc

SEQ ID NO: 928739 - RNA, 14 nt, Mycobacterium avium subsp. paratuberculosis
gacaucgucgcgcc

SEQ ID NO: 928740 - RNA, 21 nt, Mycobacterium avium subsp. paratuberculosis
gacaucuccggcacguugacg

SEQ ID NO: 928741 - RNA, 18 nt, Mycobacterium avium subsp. paratuberculosis
gacaucucgacggugacc

SEQ ID NO: 928742 - RNA, 18 nt, Mycobacterium avium subsp. paratuberculosis
gacaucugccgggcggcg

SEQ ID NO: 928743 - RNA, 22 nt, Mycobacterium avium subsp. paratuberculosis
gacaucugccgggcggcgacgu

SEQ ID NO: 928744 - RNA, 13 nt, Mycobacterium avium subsp. paratuberculosis
gacaugcccgcgg

SEQ ID NO: 928745 - RNA, 18 nt, Mycobacterium avium subsp. paratuberculosis
gacaugcccgcggugcag

SEQ ID NO: 928746 - RNA, 21 nt, Mycobacterium avium subsp. paratuberculosis
gacaugcccggcgacggcgcc

SEQ ID NO: 928747 - RNA, 15 nt, Mycobacterium avium subsp. paratuberculosis
gacaugccgagcagc

SEQ ID NO: 928748 - RNA, 12 nt, Mycobacterium avium subsp. paratuberculosis
gacaugccggcg

SEQ ID NO: 928749 - RNA, 15 nt, Mycobacterium avium subsp. paratuberculosis
gaccacccgcagcga

SEQ ID NO: 928750 - RNA, 16 nt, Mycobacterium avium subsp. paratuberculosis
gaccacccgcagcgcg

SEQ ID NO: 928751 - RNA, 17 nt, Mycobacterium avium subsp. paratuberculosis
gaccacccgcagcgcgg

SEQ ID NO: 928752 - RNA, 15 nt, Mycobacterium avium subsp. paratuberculosis
gaccacccgcagcuc

SEQ ID NO: 928753 - RNA, 17 nt, Mycobacterium avium subsp. paratuberculosis
gaccacccgcagcucgc

SEQ ID NO: 928754 - RNA, 14 nt, Mycobacterium avium subsp. paratuberculosis
gacaugcagccgcc

SEQ ID NO: 928755 - RNA, 15 nt, Mycobacterium avium subsp. paratuberculosis
gacaugcagccgccg

SEQ ID NO: 928756 - RNA, 16 nt, Mycobacterium avium subsp. paratuberculosis
gacaugaagcccccgu

SEQ ID NO: 928757 - RNA, 17 nt, Mycobacterium avium subsp. paratuberculosis
gaccaccgagccgggca

SEQ ID NO: 928758 - RNA, 16 nt, Mycobacterium avium subsp. paratuberculosis
gaccacccggcgggcc

SEQ ID NO: 928759 - RNA, 14 nt, Mycobacterium avium subsp. paratuberculosis
gaccaccgccggcc

SEQ ID NO: 928760 - RNA, 16 nt, Mycobacterium avium subsp. paratuberculosis
gaccaccgccggcccg

SEQ ID NO: 928761 - RNA, 14 nt, Mycobacterium avium subsp. paratuberculosis
gaccaccgcgucgg

SEQ ID NO: 928762 - RNA, 12 nt, Mycobacterium avium subsp. paratuberculosis
gaccaccggcac

SEQ ID NO: 928763 - RNA, 16 nt, Mycobacterium avium subsp. paratuberculosis
gaccaccggcaccacg

SEQ ID NO: 928764 - RNA, 17 nt, Mycobacterium avium subsp. paratuberculosis
gaccaccggcaccacga

SEQ ID NO: 928765 - RNA, 15 nt, Mycobacterium avium subsp. paratuberculosis
gaccaccggccgacc

SEQ ID NO: 928766 - RNA, 20 nt, Mycobacterium avium subsp. paratuberculosis
gaccacgccguacaccgugc

SEQ ID NO: 928767 - RNA, 19 nt, Mycobacterium avium subsp. paratuberculosis
gaccaccuccccgcggugc

SEQ ID NO: 928768 - RNA, 23 nt, Mycobacterium avium subsp. paratuberculosis
gaccaccuccccgcggugccgca

SEQ ID NO: 928769 - RNA, 14 nt, Mycobacterium avium subsp. paratuberculosis
gaccacgccgcgcu

SEQ ID NO: 928770 - RNA, 13 nt, Mycobacterium avium subsp. paratuberculosis
gaccacgccgcgg

SEQ ID NO: 928771 - RNA, 23 nt, Mycobacterium avium subsp. paratuberculosis
aacgcgguguuggcggcgucguc

SEQ ID NO: 928772 - RNA, 22 nt, Mycobacterium avium subsp. paratuberculosis
aacgcgguuuugaugccgccgg

SEQ ID NO: 928773 - RNA, 21 nt, Mycobacterium avium subsp. paratuberculosis
aacgcguacacggcccgcggc

SEQ ID NO: 928774 - RNA, 15 nt, Mycobacterium avium subsp. paratuberculosis
aacgcguccgacggc

SEQ ID NO: 928775 - RNA, 19 nt, Mycobacterium avium subsp. paratuberculosis
aacgcgucgaccgccgcga

SEQ ID NO: 928776 - RNA, 15 nt, Mycobacterium avium subsp. paratuberculosis
aacgcgucggucagc

SEQ ID NO: 928777 - RNA, 19 nt, Mycobacterium avium subsp. paratuberculosis
aacgcgucggucagcggcg

SEQ ID NO: 928778 - RNA, 18 nt, Mycobacterium avium subsp. paratuberculosis
gacccggccgugcgcagc

SEQ ID NO: 928779 - RNA, 19 nt, Mycobacterium avium subsp. paratuberculosis
gacccggcgagcggcaccu

SEQ ID NO: 928780 - RNA, 19 nt, Mycobacterium avium subsp. paratuberculosis
gacccgggccagcaggauc

SEQ ID NO: 928781 - RNA, 14 nt, Mycobacterium avium subsp. paratuberculosis
gacccgggccaggu

SEQ ID NO: 928782 - RNA, 13 nt, Mycobacterium avium subsp. paratuberculosis
gacccgggccgcc

SEQ ID NO: 928783 - RNA, 20 nt, Mycobacterium avium subsp. paratuberculosis
gacccgggccgccacggcgc

SEQ ID NO: 928784 - RNA, 19 nt, Mycobacterium avium subsp. paratuberculosis
aacgcggcaugaccggcca

SEQ ID NO: 928785 - RNA, 13 nt, Mycobacterium avium subsp. paratuberculosis
aacgcggccgcca

SEQ ID NO: 928786 - RNA, 20 nt, Mycobacterium avium subsp. paratuberculosis
gacccggccgagcgcgccga

SEQ ID NO: 928787 - RNA, 11 nt, Mycobacterium avium subsp. paratuberculosis
aacgcgcgucg

SEQ ID NO: 928788 - RNA, 20 nt, Mycobacterium avium subsp. paratuberculosis
aacgcggacagcucgccggc

SEQ ID NO: 928789 - RNA, 22 nt, Mycobacterium avium subsp. paratuberculosis
aacgcggugggcaccagcagcg

SEQ ID NO: 928790 - RNA, 14 nt, Mycobacterium avium subsp. paratuberculosis
aacgcggcgccgac

SEQ ID NO: 928791 - RNA, 16 nt, Mycobacterium avium subsp. paratuberculosis
gacccggccaccgccg

SEQ ID NO: 928792 - RNA, 17 nt, Mycobacterium avium subsp. paratuberculosis
gacccggccaccgccgc

SEQ ID NO: 928793 - RNA, 22 nt, Mycobacterium avium subsp. paratuberculosis
gacccggccaccgccgccagca

SEQ ID NO: 928794 - RNA, 22 nt, Mycobacterium avium subsp. paratuberculosis
gacccggccagcggcagcggcg

SEQ ID NO: 928795 - RNA, 12 nt, Mycobacterium avium subsp. paratuberculosis
gacccggccgca

SEQ ID NO: 928796 - RNA, 23 nt, Mycobacterium avium subsp. paratuberculosis
gacccggccgcacaccaccacgu

SEQ ID NO: 928797 - RNA, 13 nt, Mycobacterium avium subsp. paratuberculosis
gacccggccgcgc

SEQ ID NO: 928798 - RNA, 14 nt, Mycobacterium avium subsp. paratuberculosis
gacccggccgcgcc

SEQ ID NO: 928799 - RNA, 13 nt, Mycobacterium avium subsp. paratuberculosis
gacccggccgguc

SEQ ID NO: 928800 - RNA, 19 nt, Mycobacterium avium subsp. paratuberculosis
gacccggaccgggugaccg

SEQ ID NO: 928801 - RNA, 13 nt, Mycobacterium avium subsp. paratuberculosis
gacccggaacccg

SEQ ID NO: 928802 - RNA, 15 nt, Mycobacterium avium subsp. paratuberculosis
gacccggauacacgg

SEQ ID NO: 928803 - RNA, 17 nt, Mycobacterium avium subsp. paratuberculosis
gacccgcucgacgcgca

SEQ ID NO: 928804 - RNA, 20 nt, Mycobacterium avium subsp. paratuberculosis
gacccgcucgacgcgcaccc

SEQ ID NO: 928805 - RNA, 13 nt, Mycobacterium avium subsp. paratuberculosis
gacccgcucgggc

SEQ ID NO: 928806 - RNA, 14 nt, Mycobacterium avium subsp. paratuberculosis
gacccgcucgggcg

SEQ ID NO: 928807 - RNA, 16 nt, Mycobacterium avium subsp. paratuberculosis
gacccgcugcagcuuc

SEQ ID NO: 928808 - RNA, 22 nt, Mycobacterium avium subsp. paratuberculosis
gacccgcuggaacagcgggccg

SEQ ID NO: 928809 - RNA, 14 nt, Mycobacterium avium subsp. paratuberculosis
gacccgcggcgccg

SEQ ID NO: 928810 - RNA, 14 nt, Mycobacterium avium subsp. paratuberculosis
gacccgcuccagcg

SEQ ID NO: 928811 - RNA, 17 nt, Mycobacterium avium subsp. paratuberculosis
gacccgcuccagcggcc

SEQ ID NO: 928812 - RNA, 17 nt, Mycobacterium avium subsp. paratuberculosis
gacccgcuccccgaucc

SEQ ID NO: 928813 - RNA, 22 nt, Mycobacterium avium subsp. paratuberculosis
gacccgccuacuugaccagcgu

SEQ ID NO: 928814 - RNA, 15 nt, Mycobacterium avium subsp. paratuberculosis
gacccgccuggccac

SEQ ID NO: 928815 - RNA, 17 nt, Mycobacterium avium subsp. paratuberculosis
gacccucagcagggcgg

SEQ ID NO: 928816 - RNA, 22 nt, Mycobacterium avium subsp. paratuberculosis
gacccucagcagggcggcaccg

SEQ ID NO: 928817 - RNA, 16 nt, Mycobacterium avium subsp. paratuberculosis
gacccguugggccaga

SEQ ID NO: 928818 - RNA, 21 nt, Mycobacterium avium subsp. paratuberculosis
gacccugccgucaccggccau

SEQ ID NO: 928819 - RNA, 18 nt, Mycobacterium avium subsp. paratuberculosis
gacccugcguccggcccg

SEQ ID NO: 928820 - RNA, 21 nt, Mycobacterium avium subsp. paratuberculosis
gacccugcguccggcccggcg

SEQ ID NO: 928821 - RNA, 22 nt, Mycobacterium avium subsp. paratuberculosis
gacccuggaugaucucgaugca

SEQ ID NO: 928822 - RNA, 14 nt, Mycobacterium avium subsp. paratuberculosis
gacccuggccagca

SEQ ID NO: 928823 - RNA, 21 nt, Mycobacterium avium subsp. paratuberculosis
gacccuggccagcaccgcggu

SEQ ID NO: 928824 - RNA, 22 nt, Mycobacterium avium subsp. paratuberculosis
aacgcguucuccucgaacaccg

SEQ ID NO: 928825 - RNA, 23 nt, Mycobacterium avium subsp. paratuberculosis
aacgcguuucccgaguggcgccg

SEQ ID NO: 928826 - RNA, 13 nt, Mycobacterium avium subsp. paratuberculosis
gacccggucggcc

SEQ ID NO: 928827 - RNA, 17 nt, Mycobacterium avium subsp. paratuberculosis
gacccggucggccgcgu

SEQ ID NO: 928828 - RNA, 16 nt, Mycobacterium avium subsp. paratuberculosis
gacccggugcccaccg

SEQ ID NO: 928829 - RNA, 18 nt, Mycobacterium avium subsp. paratuberculosis
gacccgguggcccggucg

SEQ ID NO: 928830 - RNA, 19 nt, Mycobacterium avium subsp. paratuberculosis
gacccgggcgauggugccg

SEQ ID NO: 928831 - RNA, 23 nt, Mycobacterium avium subsp. paratuberculosis
gacccgggcgauggugccgccgg

SEQ ID NO: 928832 - RNA, 15 nt, Mycobacterium avium subsp. paratuberculosis
gacccgggcggccug

SEQ ID NO: 928833 - RNA, 20 nt, Mycobacterium avium subsp. paratuberculosis
gacccgggcggccugcugca

SEQ ID NO: 928834 - RNA, 12 nt, Mycobacterium avium subsp. paratuberculosis
gacccggggguc

SEQ ID NO: 928835 - RNA, 23 nt, Mycobacterium avium subsp. paratuberculosis
gacccggggguccagggugccga

SEQ ID NO: 928836 - RNA, 21 nt, Mycobacterium avium subsp. paratuberculosis
gacccggucagcucgccgucc

SEQ ID NO: 928837 - RNA, 18 nt, Mycobacterium avium subsp. paratuberculosis
gacccggucgcggccgua

SEQ ID NO: 928838 - RNA, 22 nt, Mycobacterium avium subsp. paratuberculosis
gaccgacagcaaaccgaccgcc

SEQ ID NO: 928839 - RNA, 23 nt, Mycobacterium avium subsp. paratuberculosis
gaccgacagcaaaccgaccgccg

SEQ ID NO: 928840 - RNA, 12 nt, Mycobacterium avium subsp. paratuberculosis
gaccgagccgcg

SEQ ID NO: 928841 - RNA, 17 nt, Mycobacterium avium subsp. paratuberculosis
gaccgagccgcgcgccg

SEQ ID NO: 928842 - RNA, 20 nt, Mycobacterium avium subsp. paratuberculosis
aacggaucgagcgcaccgcc

SEQ ID NO: 928843 - RNA, 15 nt, Mycobacterium avium subsp. paratuberculosis
gaccgaggcgaucgc

SEQ ID NO: 928844 - RNA, 14 nt, Mycobacterium avium subsp. paratuberculosis
gaccgagcgcgcga

SEQ ID NO: 928845 - RNA, 18 nt, Mycobacterium avium subsp. paratuberculosis
gaccgagcgcgcgaucuc

SEQ ID NO: 928846 - RNA, 13 nt, Mycobacterium avium subsp. paratuberculosis
gaccgagcggcgc

SEQ ID NO: 928847 - RNA, 20 nt, Mycobacterium avium subsp. paratuberculosis
gaccgagcggcgcugcagca

SEQ ID NO: 928848 - RNA, 15 nt, Mycobacterium avium subsp. paratuberculosis
gaccgagucgucgcg

SEQ ID NO: 928849 - RNA, 13 nt, Mycobacterium avium subsp. paratuberculosis
gaccgaggugccg

SEQ ID NO: 928850 - RNA, 15 nt, Mycobacterium avium subsp. paratuberculosis
gaccgaggugccgcg

SEQ ID NO: 928851 - RNA, 16 nt, Mycobacterium avium subsp. paratuberculosis
gaccgaggugccgcgg

SEQ ID NO: 928852 - RNA, 19 nt, Mycobacterium avium subsp. paratuberculosis
gaccgaggugccgcggguc

SEQ ID NO: 928853 - RNA, 17 nt, Mycobacterium avium subsp. paratuberculosis
gaccgacaguucggcgc

SEQ ID NO: 928854 - RNA, 21 nt, Mycobacterium avium subsp. paratuberculosis
gaccgagcagcggggugagca

SEQ ID NO: 928855 - RNA, 14 nt, Mycobacterium avium subsp. paratuberculosis
aacggcaccagcgg

SEQ ID NO: 928856 - RNA, 23 nt, Mycobacterium avium subsp. paratuberculosis
aacggcaccccgcggucggcggc

SEQ ID NO: 928857 - RNA, 12 nt, Mycobacterium avium subsp. paratuberculosis
aacggcacccgc

SEQ ID NO: 928858 - RNA, 21 nt, Mycobacterium avium subsp. paratuberculosis
aacggcaccucgaucaccggg

SEQ ID NO: 928859 - RNA, 21 nt, Mycobacterium avium subsp. paratuberculosis
aacggcaaccugggcggcggc

SEQ ID NO: 928860 - RNA, 17 nt, Mycobacterium avium subsp. paratuberculosis
aacggcaacggcggcgg

SEQ ID NO: 928861 - RNA, 17 nt, Mycobacterium avium subsp. paratuberculosis
gaccgcgacgaccucgc

SEQ ID NO: 928862 - RNA, 20 nt, Mycobacterium avium subsp. paratuberculosis
gaccgcgacgaccucgcccg

SEQ ID NO: 928863 - RNA, 23 nt, Mycobacterium avium subsp. paratuberculosis
gaccgcgacgaccucgcccgccg

SEQ ID NO: 928864 - RNA, 18 nt, Mycobacterium avium subsp. paratuberculosis
gaccgccgcgcucggcca

SEQ ID NO: 928865 - RNA, 14 nt, Mycobacterium avium subsp. paratuberculosis
gaccgccgcggccg

SEQ ID NO: 928866 - RNA, 21 nt, Mycobacterium avium subsp. paratuberculosis
gaccgcgaagguggcacgcca

SEQ ID NO: 928867 - RNA, 17 nt, Mycobacterium avium subsp. paratuberculosis
gaccgccgccauccgcg

SEQ ID NO: 928868 - RNA, 18 nt, Mycobacterium avium subsp. paratuberculosis
gaccgccgccauccgcgc

SEQ ID NO: 928869 - RNA, 20 nt, Mycobacterium avium subsp. paratuberculosis
gaccgccgccauccgcgccg

SEQ ID NO: 928870 - RNA, 21 nt, Mycobacterium avium subsp. paratuberculosis
gaccgccgccauccgcgccga

SEQ ID NO: 928871 - RNA, 22 nt, Mycobacterium avium subsp. paratuberculosis
gaccgccgccauccgcgccgaa

SEQ ID NO: 928872 - RNA, 19 nt, Mycobacterium avium subsp. paratuberculosis
gaccgccgccauccguucg

SEQ ID NO: 928873 - RNA, 20 nt, Mycobacterium avium subsp. paratuberculosis
gaccgccgccauccguucgg

SEQ ID NO: 928874 - RNA, 13 nt, Mycobacterium avium subsp. paratuberculosis
gaccgccgccgcg

SEQ ID NO: 928875 - RNA, 15 nt, Mycobacterium avium subsp. paratuberculosis
gaccgccgccgcgac

SEQ ID NO: 928876 - RNA, 14 nt, Mycobacterium avium subsp. paratuberculosis
gaccgauccgccgg

SEQ ID NO: 928877 - RNA, 18 nt, Mycobacterium avium subsp. paratuberculosis
gaccgaucuggcgaucga

SEQ ID NO: 928878 - RNA, 15 nt, Mycobacterium avium subsp. paratuberculosis
gaccgaugccgcuga

SEQ ID NO: 928879 - RNA, 14 nt, Mycobacterium avium subsp. paratuberculosis
gaccgauggccgcc

SEQ ID NO: 928880 - RNA, 15 nt, Mycobacterium avium subsp. paratuberculosis
gaccgauggccgccc

SEQ ID NO: 928881 - RNA, 15 nt, Mycobacterium avium subsp. paratuberculosis
gaccgcccggggcgc

SEQ ID NO: 928882 - RNA, 18 nt, Mycobacterium avium subsp. paratuberculosis
gaccgcccggggcgcgga

SEQ ID NO: 928883 - RNA, 20 nt, Mycobacterium avium subsp. paratuberculosis
gaccgcccggggcgcggacc

SEQ ID NO: 928884 - RNA, 13 nt, Mycobacterium avium subsp. paratuberculosis
gaccgcccgggug

SEQ ID NO: 928885 - RNA, 14 nt, Mycobacterium avium subsp. paratuberculosis
gaccgcccggguga

SEQ ID NO: 928886 - RNA, 12 nt, Mycobacterium avium subsp. paratuberculosis
gaccgccgacac

SEQ ID NO: 928887 - RNA, 13 nt, Mycobacterium avium subsp. paratuberculosis
gaccgccgacacc

SEQ ID NO: 928888 - RNA, 14 nt, Mycobacterium avium subsp. paratuberculosis
gaccgccgacacca

SEQ ID NO: 928889 - RNA, 15 nt, Mycobacterium avium subsp. paratuberculosis
gaccgccgacaccac

SEQ ID NO: 928890 - RNA, 19 nt, Mycobacterium avium subsp. paratuberculosis
gaccgccgacaccaccgcg

SEQ ID NO: 928891 - RNA, 17 nt, Mycobacterium avium subsp. paratuberculosis
gaccgccgagcgggcga

SEQ ID NO: 928892 - RNA, 20 nt, Mycobacterium avium subsp. paratuberculosis
gaccgccgagcgggcgaucu

SEQ ID NO: 928893 - RNA, 16 nt, Mycobacterium avium subsp. paratuberculosis
gaccgcguuggcgccg

SEQ ID NO: 928894 - RNA, 17 nt, Mycobacterium avium subsp. paratuberculosis
gaccgcguuggcgccga

SEQ ID NO: 928895 - RNA, 15 nt, Mycobacterium avium subsp. paratuberculosis
gaccgcgugugcccg

SEQ ID NO: 928896 - RNA, 16 nt, Mycobacterium avium subsp. paratuberculosis
gaccgcgugugcccgc

SEQ ID NO: 928897 - RNA, 23 nt, Mycobacterium avium subsp. paratuberculosis
gaccgcgugugcccgccucgcag

SEQ ID NO: 928898 - RNA, 17 nt, Mycobacterium avium subsp. paratuberculosis
gaccggcgaggugcgcc

SEQ ID NO: 928899 - RNA, 12 nt, Mycobacterium avium subsp. paratuberculosis
gaccggcgaucc

SEQ ID NO: 928900 - RNA, 15 nt, Mycobacterium avium subsp. paratuberculosis
gaccggcgaucguca

SEQ ID NO: 928901 - RNA, 17 nt, Mycobacterium avium subsp. paratuberculosis
gaccgcguccgaggcgg

SEQ ID NO: 928902 - RNA, 15 nt, Mycobacterium avium subsp. paratuberculosis
gaccgcgucgacggc

SEQ ID NO: 928903 - RNA, 16 nt, Mycobacterium avium subsp. paratuberculosis
gaccgcggucgggucc

SEQ ID NO: 928904 - RNA, 17 nt, Mycobacterium avium subsp. paratuberculosis
gaccgcguacagggcgu

SEQ ID NO: 928905 - RNA, 24 nt, Mycobacterium avium subsp. paratuberculosis
gaccgcguacagggcgucggacau

SEQ ID NO: 928906 - RNA, 23 nt, Mycobacterium avium subsp. paratuberculosis
gaccgcguagucguugucggcgg

SEQ ID NO: 928907 - RNA, 15 nt, Mycobacterium avium subsp. paratuberculosis
gaccgcggcgauggc

SEQ ID NO: 928908 - RNA, 20 nt, Mycobacterium avium subsp. paratuberculosis
gaccgcggcgauggcccgcu

SEQ ID NO: 928909 - RNA, 23 nt, Mycobacterium avium subsp. paratuberculosis
gaccgcggcgauggcccgcugcg

SEQ ID NO: 928910 - RNA, 15 nt, Mycobacterium avium subsp. paratuberculosis
gaccgcggcgauggu

SEQ ID NO: 928911 - RNA, 13 nt, Mycobacterium avium subsp. paratuberculosis
gaccgcggcgccg

SEQ ID NO: 928912 - RNA, 14 nt, Mycobacterium avium subsp. paratuberculosis
gaccgcggcgccga

SEQ ID NO: 928913 - RNA, 14 nt, Mycobacterium avium subsp. paratuberculosis
gaccgcggccgcga

SEQ ID NO: 928914 - RNA, 16 nt, Mycobacterium avium subsp. paratuberculosis
gaccgcggccucgucg

SEQ ID NO: 928915 - RNA, 17 nt, Mycobacterium avium subsp. paratuberculosis
gaccgcggccucgucga

SEQ ID NO: 928916 - RNA, 13 nt, Mycobacterium avium subsp. paratuberculosis
gaccgcggcgggc

SEQ ID NO: 928917 - RNA, 14 nt, Mycobacterium avium subsp. paratuberculosis
gaccgcggcgggca

SEQ ID NO: 928918 - RNA, 13 nt, Mycobacterium avium subsp. paratuberculosis
gaccgcggcgguc

SEQ ID NO: 928919 - RNA, 13 nt, Mycobacterium avium subsp. paratuberculosis
gaccgcggcuccg

SEQ ID NO: 928920 - RNA, 18 nt, Mycobacterium avium subsp. paratuberculosis
gaccgcggcuccggccgc

SEQ ID NO: 928921 - RNA, 13 nt, Mycobacterium avium subsp. paratuberculosis
gaccgcgggcccg

SEQ ID NO: 928922 - RNA, 15 nt, Mycobacterium avium subsp. paratuberculosis
gaccgcgggcccgcc

SEQ ID NO: 928923 - RNA, 16 nt, Mycobacterium avium subsp. paratuberculosis
gaccgcgggcccgccg

SEQ ID NO: 928924 - RNA, 22 nt, Mycobacterium avium subsp. paratuberculosis
gaccgcgggcgcauaccagcgc

SEQ ID NO: 928925 - RNA, 14 nt, Mycobacterium avium subsp. paratuberculosis
gaccgcgggugagg

SEQ ID NO: 928926 - RNA, 19 nt, Mycobacterium avium subsp. paratuberculosis
gaccgcggucaccggucgg

SEQ ID NO: 928927 - RNA, 20 nt, Mycobacterium avium subsp. paratuberculosis
gaccgcggucaccggucggu

SEQ ID NO: 928928 - RNA, 22 nt, Mycobacterium avium subsp. paratuberculosis
gaccgcggucaccggucggugc

SEQ ID NO: 928929 - RNA, 19 nt, Mycobacterium avium subsp. paratuberculosis
gaccgcggucgcggcgccg

SEQ ID NO: 928930 - RNA, 18 nt, Mycobacterium avium subsp. paratuberculosis
gaccgcggauaaggcgaa

SEQ ID NO: 928931 - RNA, 22 nt, Mycobacterium avium subsp. paratuberculosis
gaccgcggaugacgggugcuca

SEQ ID NO: 928932 - RNA, 22 nt, Mycobacterium avium subsp. paratuberculosis
gaccgcggaaccguagaccacc

SEQ ID NO: 928933 - RNA, 16 nt, Mycobacterium avium subsp. paratuberculosis
gaccgcggacacgcgg

SEQ ID NO: 928934 - RNA, 17 nt, Mycobacterium avium subsp. paratuberculosis
gaccgcgcgcggcgccg

SEQ ID NO: 928935 - RNA, 19 nt, Mycobacterium avium subsp. paratuberculosis
gaccgcgcgcggcgccgcg

SEQ ID NO: 928936 - RNA, 15 nt, Mycobacterium avium subsp. paratuberculosis
gaccgcgcgccggcc

SEQ ID NO: 928937 - RNA, 12 nt, Mycobacterium avium subsp. paratuberculosis
gaccgcgccgcg

SEQ ID NO: 928938 - RNA, 16 nt, Mycobacterium avium subsp. paratuberculosis
gaccgcgccgcgggug

SEQ ID NO: 928939 - RNA, 21 nt, Mycobacterium avium subsp. paratuberculosis
gaccgcgaugguggcgucacg

SEQ ID NO: 928940 - RNA, 19 nt, Mycobacterium avium subsp. paratuberculosis
gaccgcgacgcugccggug

SEQ ID NO: 928941 - RNA, 22 nt, Mycobacterium avium subsp. paratuberculosis
gaccgcgacgcugccggugguc

SEQ ID NO: 928942 - RNA, 13 nt, Mycobacterium avium subsp. paratuberculosis
gaccgcgacgggc

SEQ ID NO: 928943 - RNA, 20 nt, Mycobacterium avium subsp. paratuberculosis
gaccgcgacgggcucggcgu

SEQ ID NO: 928944 - RNA, 13 nt, Mycobacterium avium subsp. paratuberculosis
gaccgcgacggcg

SEQ ID NO: 928945 - RNA, 15 nt, Mycobacterium avium subsp. paratuberculosis
gaccgcgacggcgcc

SEQ ID NO: 928946 - RNA, 17 nt, Mycobacterium avium subsp. paratuberculosis
gaccgcgaucagggccg

SEQ ID NO: 928947 - RNA, 19 nt, Mycobacterium avium subsp. paratuberculosis
gaccgcgaugcagaacagc

SEQ ID NO: 928948 - RNA, 22 nt, Mycobacterium avium subsp. paratuberculosis
gaccgcgaugcagaacagccgg

SEQ ID NO: 928949 - RNA, 23 nt, Mycobacterium avium subsp. paratuberculosis
gaccgcgaugcagaacagccggu

SEQ ID NO: 928950 - RNA, 18 nt, Mycobacterium avium subsp. paratuberculosis
gaccgcgaugcgacaccg

SEQ ID NO: 928951 - RNA, 20 nt, Mycobacterium avium subsp. paratuberculosis
gaccgcgaugcgacaccgcg

SEQ ID NO: 928952 - RNA, 21 nt, Mycobacterium avium subsp. paratuberculosis
gaccgcgcaggcggcgacggc

SEQ ID NO: 928953 - RNA, 20 nt, Mycobacterium avium subsp. paratuberculosis
gaccgcgcagucggcgucgc

SEQ ID NO: 928954 - RNA, 20 nt, Mycobacterium avium subsp. paratuberculosis
aacgugauagcggccgcgga

SEQ ID NO: 928955 - RNA, 17 nt, Mycobacterium avium subsp. paratuberculosis
aacgugccacaggccga

SEQ ID NO: 928956 - RNA, 14 nt, Mycobacterium avium subsp. paratuberculosis
aacgugcgccggcc

SEQ ID NO: 928957 - RNA, 18 nt, Mycobacterium avium subsp. paratuberculosis
gacggcgacggcguugcu

SEQ ID NO: 928958 - RNA, 16 nt, Mycobacterium avium subsp. paratuberculosis
gacggcgagccgggcc

SEQ ID NO: 928959 - RNA, 17 nt, Mycobacterium avium subsp. paratuberculosis
gacggcgagcggcccug

SEQ ID NO: 928960 - RNA, 23 nt, Mycobacterium avium subsp. paratuberculosis
gacggcgaggaucgcgaugucga

SEQ ID NO: 928961 - RNA, 22 nt, Mycobacterium avium subsp. paratuberculosis
gacggcgagguaauggugggcg

SEQ ID NO: 928962 - RNA, 13 nt, Mycobacterium avium subsp. paratuberculosis
aacgucuugggcg

SEQ ID NO: 928963 - RNA, 16 nt, Mycobacterium avium subsp. paratuberculosis
aacgucucggugucgg

SEQ ID NO: 928964 - RNA, 18 nt, Mycobacterium avium subsp. paratuberculosis
aacgucucugucgucgac

SEQ ID NO: 928965 - RNA, 22 nt, Mycobacterium avium subsp. paratuberculosis
aacgucugcgggaagcccaccg

SEQ ID NO: 928966 - RNA, 14 nt, Mycobacterium avium subsp. paratuberculosis
gacggcgccgcccg

SEQ ID NO: 928967 - RNA, 16 nt, Mycobacterium avium subsp. paratuberculosis
gacggcgccgcccggg

SEQ ID NO: 928968 - RNA, 13 nt, Mycobacterium avium subsp. paratuberculosis
gacggcgccgcgu

SEQ ID NO: 928969 - RNA, 15 nt, Mycobacterium avium subsp. paratuberculosis
gacggcgccgcgucg

SEQ ID NO: 928970 - RNA, 16 nt, Mycobacterium avium subsp. paratuberculosis
gacggcgccgcgucgg

SEQ ID NO: 928971 - RNA, 20 nt, Mycobacterium avium subsp. paratuberculosis
gacggcgccugauccgcggu

SEQ ID NO: 928972 - RNA, 12 nt, Mycobacterium avium subsp. paratuberculosis
gacggcgcguga

SEQ ID NO: 928973 - RNA, 13 nt, Mycobacterium avium subsp. paratuberculosis
gacggcgcucacc

SEQ ID NO: 928974 - RNA, 17 nt, Mycobacterium avium subsp. paratuberculosis
aacgucgacuuguugcg

SEQ ID NO: 928975 - RNA, 17 nt, Mycobacterium avium subsp. paratuberculosis
aacgucgagcgcggccc

SEQ ID NO: 928976 - RNA, 22 nt, Mycobacterium avium subsp. paratuberculosis
aacgucgagcgcggcccgccga

SEQ ID NO: 928977 - RNA, 13 nt, Mycobacterium avium subsp. paratuberculosis
gacggcgacggca

SEQ ID NO: 928978 - RNA, 15 nt, Mycobacterium avium subsp. paratuberculosis
gacggcgacggcagc

SEQ ID NO: 928979 - RNA, 17 nt, Mycobacterium avium subsp. paratuberculosis
gacggcgacggcagcgc

SEQ ID NO: 928980 - RNA, 18 nt, Mycobacterium avium subsp. paratuberculosis
gacggcgacggcagcgcg

SEQ ID NO: 928981 - RNA, 16 nt, Mycobacterium avium subsp. paratuberculosis
gacggcgacggccaga

SEQ ID NO: 928982 - RNA, 17 nt, Mycobacterium avium subsp. paratuberculosis
gacggcgacggccagac

SEQ ID NO: 928983 - RNA, 19 nt, Mycobacterium avium subsp. paratuberculosis
gacggcgaacuuggccgac

SEQ ID NO: 928984 - RNA, 19 nt, Mycobacterium avium subsp. paratuberculosis
gacggcgaagccggcguca

SEQ ID NO: 928985 - RNA, 20 nt, Mycobacterium avium subsp. paratuberculosis
gacggcgaccacaccgucga

SEQ ID NO: 928986 - RNA, 17 nt, Mycobacterium avium subsp. paratuberculosis
gacggcgacgaccguca

SEQ ID NO: 928987 - RNA, 18 nt, Mycobacterium avium subsp. paratuberculosis
gacggcgacgaccgucau

SEQ ID NO: 928988 - RNA, 12 nt, Mycobacterium avium subsp. paratuberculosis
gacggccugggc

SEQ ID NO: 928989 - RNA, 17 nt, Mycobacterium avium subsp. paratuberculosis
gacggccugggcgacca

SEQ ID NO: 928990 - RNA, 13 nt, Mycobacterium avium subsp. paratuberculosis
gacggccucgugg

SEQ ID NO: 928991 - RNA, 17 nt, Mycobacterium avium subsp. paratuberculosis
gacggccugcaccacca

SEQ ID NO: 928992 - RNA, 22 nt, Mycobacterium avium subsp. paratuberculosis
gacggccugcaccaccacaccc

SEQ ID NO: 928993 - RNA, 13 nt, Mycobacterium avium subsp. paratuberculosis
gacggccucgccg

SEQ ID NO: 928994 - RNA, 14 nt, Mycobacterium avium subsp. paratuberculosis
gacggccucgccgu

SEQ ID NO: 928995 - RNA, 19 nt, Mycobacterium avium subsp. paratuberculosis
gacggccggggccagcacc

SEQ ID NO: 928996 - RNA, 14 nt, Mycobacterium avium subsp. paratuberculosis
gacggccgugaugc

SEQ ID NO: 928997 - RNA, 19 nt, Mycobacterium avium subsp. paratuberculosis
gacggccgaaacgcccggc

SEQ ID NO: 928998 - RNA, 21 nt, Mycobacterium avium subsp. paratuberculosis
gacggccucccacucgucgau

SEQ ID NO: 928999 - RNA, 18 nt, Mycobacterium avium subsp. paratuberculosis
gacggcguggucggcgaa

SEQ ID NO: 929000 - RNA, 20 nt, Mycobacterium avium subsp. paratuberculosis
gacggcguggucggcgaagc

SEQ ID NO: 929001 - RNA, 22 nt, Mycobacterium avium subsp. paratuberculosis
gacggcguggaacacgcccagc

SEQ ID NO: 929002 - RNA, 20 nt, Mycobacterium avium subsp. paratuberculosis
gacggcguccagcugcgcgc

SEQ ID NO: 929003 - RNA, 23 nt, Mycobacterium avium subsp. paratuberculosis
gacggcguccagcugcgcgccgg

SEQ ID NO: 929004 - RNA, 15 nt, Mycobacterium avium subsp. paratuberculosis
gacggcguccgggcg

SEQ ID NO: 929005 - RNA, 22 nt, Mycobacterium avium subsp. paratuberculosis
gacggcuaccugaccagcggcg

SEQ ID NO: 929006 - RNA, 15 nt, Mycobacterium avium subsp. paratuberculosis
gacggcguugcuggc

SEQ ID NO: 929007 - RNA, 17 nt, Mycobacterium avium subsp. paratuberculosis
gacggcguugcuggcgc

SEQ ID NO: 929008 - RNA, 20 nt, Mycobacterium avium subsp. paratuberculosis
gacggcguugcuggcgcgau

SEQ ID NO: 929009 - RNA, 20 nt, Mycobacterium avium subsp. paratuberculosis
gacggcuggguggcgaaacc

SEQ ID NO: 929010 - RNA, 16 nt, Mycobacterium avium subsp. paratuberculosis
gacggcugcgguuggc

SEQ ID NO: 929011 - RNA, 20 nt, Mycobacterium avium subsp. paratuberculosis
gacggcugcgguuggccggc

SEQ ID NO: 929012 - RNA, 21 nt, Mycobacterium avium subsp. paratuberculosis
gacggcugcgguuggccggcc

SEQ ID NO: 929013 - RNA, 22 nt, Mycobacterium avium subsp. paratuberculosis
gacggcuggaaucccgccucgg

SEQ ID NO: 929014 - RNA, 17 nt, Mycobacterium avium subsp. paratuberculosis
gacggcuuccgcggacg

SEQ ID NO: 929015 - RNA, 16 nt, Mycobacterium avium subsp. paratuberculosis
gacggcucuucggcgc

SEQ ID NO: 929016 - RNA, 17 nt, Mycobacterium avium subsp. paratuberculosis
gacggcucuucggcgcc

SEQ ID NO: 929017 - RNA, 18 nt, Mycobacterium avium subsp. paratuberculosis
gacggcucuucggcgccg

SEQ ID NO: 929018 - RNA, 19 nt, Mycobacterium avium subsp. paratuberculosis
gacggcucuucggcgccga

SEQ ID NO: 929019 - RNA, 14 nt, Mycobacterium avium subsp. paratuberculosis
gacggcugcccggc

SEQ ID NO: 929020 - RNA, 16 nt, Mycobacterium avium subsp. paratuberculosis
gacggcugcccggccc

SEQ ID NO: 929021 - RNA, 18 nt, Mycobacterium avium subsp. paratuberculosis
gacggcugcccggcccgc

SEQ ID NO: 929022 - RNA, 13 nt, Mycobacterium avium subsp. paratuberculosis
gacggcggggcgg

SEQ ID NO: 929023 - RNA, 22 nt, Mycobacterium avium subsp. paratuberculosis
gacggcggugacguuccagccg

SEQ ID NO: 929024 - RNA, 20 nt, Mycobacterium avium subsp. paratuberculosis
gacggcggugggcucggcca

SEQ ID NO: 929025 - RNA, 21 nt, Mycobacterium avium subsp. paratuberculosis
gacggcgguucgaagcgcagc

SEQ ID NO: 929026 - RNA, 15 nt, Mycobacterium avium subsp. paratuberculosis
gacggcgucggcgag

SEQ ID NO: 929027 - RNA, 15 nt, Mycobacterium avium subsp. paratuberculosis
gacggcgucggcgau

SEQ ID NO: 929028 - RNA, 15 nt, Mycobacterium avium subsp. paratuberculosis
gacggcgucggcggc

SEQ ID NO: 929029 - RNA, 18 nt, Mycobacterium avium subsp. paratuberculosis
gacggcgucggcggccug

SEQ ID NO: 929030 - RNA, 19 nt, Mycobacterium avium subsp. paratuberculosis
gacggcgucggcggccugc

SEQ ID NO: 929031 - RNA, 23 nt, Mycobacterium avium subsp. paratuberculosis
gacggcgucggcggccugcucca

SEQ ID NO: 929032 - RNA, 13 nt, Mycobacterium avium subsp. paratuberculosis
gacggcggcggug

SEQ ID NO: 929033 - RNA, 17 nt, Mycobacterium avium subsp. paratuberculosis
gacggcggcggugccgc

SEQ ID NO: 929034 - RNA, 18 nt, Mycobacterium avium subsp. paratuberculosis
gacggcggcggugccgca

SEQ ID NO: 929035 - RNA, 21 nt, Mycobacterium avium subsp. paratuberculosis
gacggcggcggugccgcaggc

SEQ ID NO: 929036 - RNA, 21 nt, Mycobacterium avium subsp. paratuberculosis
gacggcggcgaguucggcggc

SEQ ID NO: 929037 - RNA, 22 nt, Mycobacterium avium subsp. paratuberculosis
gacggcggcgaguucggcggcc

SEQ ID NO: 929038 - RNA, 15 nt, Mycobacterium avium subsp. paratuberculosis
gacggcggcgaagac

SEQ ID NO: 929039 - RNA, 14 nt, Mycobacterium avium subsp. paratuberculosis
gacggcgcuggccg

SEQ ID NO: 929040 - RNA, 15 nt, Mycobacterium avium subsp. paratuberculosis
gacggcgcuggccgc

SEQ ID NO: 929041 - RNA, 17 nt, Mycobacterium avium subsp. paratuberculosis
gacggcgcuggccgcgg

SEQ ID NO: 929042 - RNA, 16 nt, Mycobacterium avium subsp. paratuberculosis
gacggcgcuguggccg

SEQ ID NO: 929043 - RNA, 17 nt, Mycobacterium avium subsp. paratuberculosis
gacgguugccucggcca

SEQ ID NO: 929044 - RNA, 17 nt, Mycobacterium avium subsp. paratuberculosis
gacgguuguucagcccg

SEQ ID NO: 929045 - RNA, 20 nt, Mycobacterium avium subsp. paratuberculosis
gacgguuucaccgccguccc

SEQ ID NO: 929046 - RNA, 14 nt, Mycobacterium avium subsp. paratuberculosis
gacggugguggccu

SEQ ID NO: 929047 - RNA, 17 nt, Mycobacterium avium subsp. paratuberculosis
gacgguuccaccggucg

SEQ ID NO: 929048 - RNA, 21 nt, Mycobacterium avium subsp. paratuberculosis
gacgguguaggacgccgugca

SEQ ID NO: 929049 - RNA, 14 nt, Mycobacterium avium subsp. paratuberculosis
gacgguguccgcgg

SEQ ID NO: 929050 - RNA, 18 nt, Mycobacterium avium subsp. paratuberculosis
gacgguguccgcggcguc

SEQ ID NO: 929051 - RNA, 23 nt, Mycobacterium avium subsp. paratuberculosis
gacggugucguagacgacgucga

SEQ ID NO: 929052 - RNA, 14 nt, Mycobacterium avium subsp. paratuberculosis
gacggugugcgggu

SEQ ID NO: 929053 - RNA, 17 nt, Mycobacterium avium subsp. paratuberculosis
gacggugugcgggucgg

SEQ ID NO: 929054 - RNA, 18 nt, Mycobacterium avium subsp. paratuberculosis
gacgguggggcuggccgc

SEQ ID NO: 929055 - RNA, 19 nt, Mycobacterium avium subsp. paratuberculosis
gacgguggggcuggccgca

SEQ ID NO: 929056 - RNA, 20 nt, Mycobacterium avium subsp. paratuberculosis
gacgguggggcuggccgcac

SEQ ID NO: 929057 - RNA, 13 nt, Mycobacterium avium subsp. paratuberculosis
gacgguggcggcg

SEQ ID NO: 929058 - RNA, 15 nt, Mycobacterium avium subsp. paratuberculosis
gacgguggcggcgau

SEQ ID NO: 929059 - RNA, 23 nt, Mycobacterium avium subsp. paratuberculosis
gacgguggcggcgaugucgucga

SEQ ID NO: 929060 - RNA, 21 nt, Mycobacterium avium subsp. paratuberculosis
gacgguggcguccucgacggu

SEQ ID NO: 929061 - RNA, 16 nt, Mycobacterium avium subsp. paratuberculosis
gacggugggcccgccg

SEQ ID NO: 929062 - RNA, 22 nt, Mycobacterium avium subsp. paratuberculosis
gacggugggcccgccgucgacc

SEQ ID NO: 929063 - RNA, 23 nt, Mycobacterium avium subsp. paratuberculosis
gacggugggcccgccgucgacca

SEQ ID NO: 929064 - RNA, 20 nt, Mycobacterium avium subsp. paratuberculosis
gacgguggcgaagcacgacc

SEQ ID NO: 929065 - RNA, 18 nt, Mycobacterium avium subsp. paratuberculosis
gacggugcgugccagcag

SEQ ID NO: 929066 - RNA, 15 nt, Mycobacterium avium subsp. paratuberculosis
gacggugcuggcgau

SEQ ID NO: 929067 - RNA, 17 nt, Mycobacterium avium subsp. paratuberculosis
gacggugcuggcgaugu

SEQ ID NO: 929068 - RNA, 13 nt, Mycobacterium avium subsp. paratuberculosis
gacgguggacccg

SEQ ID NO: 929069 - RNA, 20 nt, Mycobacterium avium subsp. paratuberculosis
gacgguggcccccaccacga

SEQ ID NO: 929070 - RNA, 15 nt, Mycobacterium avium subsp. paratuberculosis
gacggugcgcccguc

SEQ ID NO: 929071 - RNA, 17 nt, Mycobacterium avium subsp. paratuberculosis
gacggugcgcccgucgu

SEQ ID NO: 929072 - RNA, 21 nt, Mycobacterium avium subsp. paratuberculosis
gacggugcgcccgucgucgcc

SEQ ID NO: 929073 - RNA, 23 nt, Mycobacterium avium subsp. paratuberculosis
gacggugcgcccgucgucgccga

SEQ ID NO: 929074 - RNA, 21 nt, Mycobacterium avium subsp. paratuberculosis
gacggugcaugcgcuggcgaa

SEQ ID NO: 929075 - RNA, 13 nt, Mycobacterium avium subsp. paratuberculosis
gacggucgccgac

SEQ ID NO: 929076 - RNA, 14 nt, Mycobacterium avium subsp. paratuberculosis
gacggucgccgacg

SEQ ID NO: 929077 - RNA, 15 nt, Mycobacterium avium subsp. paratuberculosis
gacggucgccgacgu

SEQ ID NO: 929078 - RNA, 14 nt, Mycobacterium avium subsp. paratuberculosis
gacggucgccgacu

SEQ ID NO: 929079 - RNA, 18 nt, Mycobacterium avium subsp. paratuberculosis
gacggucgugcugggccg

SEQ ID NO: 929080 - RNA, 13 nt, Mycobacterium avium subsp. paratuberculosis
gacggucugcacc

SEQ ID NO: 929081 - RNA, 17 nt, Mycobacterium avium subsp. paratuberculosis
gacggucugcaccggga

SEQ ID NO: 929082 - RNA, 21 nt, Mycobacterium avium subsp. paratuberculosis
gacggucugcaccgggaugac

SEQ ID NO: 929083 - RNA, 21 nt, Mycobacterium avium subsp. paratuberculosis
gacggucagcgcgccgucgga

SEQ ID NO: 929084 - RNA, 18 nt, Mycobacterium avium subsp. paratuberculosis
gacggucagguucuucug

SEQ ID NO: 929085 - RNA, 13 nt, Mycobacterium avium subsp. paratuberculosis
gacggucaugccg

SEQ ID NO: 929086 - RNA, 13 nt, Mycobacterium avium subsp. paratuberculosis
gacggucccgacg

SEQ ID NO: 929087 - RNA, 19 nt, Mycobacterium avium subsp. paratuberculosis
gacggucccgacgcugacg

SEQ ID NO: 929088 - RNA, 20 nt, Mycobacterium avium subsp. paratuberculosis
gacgguccgcucaucgucgu

SEQ ID NO: 929089 - RNA, 18 nt, Mycobacterium avium subsp. paratuberculosis
gacgguccucucgaagcg

SEQ ID NO: 929090 - RNA, 19 nt, Mycobacterium avium subsp. paratuberculosis
gacgguccucucgaagcga

SEQ ID NO: 929091 - RNA, 13 nt, Mycobacterium avium subsp. paratuberculosis
gacggugccgccg

SEQ ID NO: 929092 - RNA, 19 nt, Mycobacterium avium subsp. paratuberculosis
gacggugaugucgccggcg

SEQ ID NO: 929093 - RNA, 23 nt, Mycobacterium avium subsp. paratuberculosis
gacggugaugucgccggcggcga

SEQ ID NO: 929094 - RNA, 14 nt, Mycobacterium avium subsp. paratuberculosis
gacggugcagccgg

SEQ ID NO: 929095 - RNA, 15 nt, Mycobacterium avium subsp. paratuberculosis
gacggugacgccgga

SEQ ID NO: 929096 - RNA, 21 nt, Mycobacterium avium subsp. paratuberculosis
gacggugagcaccgccguccc

SEQ ID NO: 929097 - RNA, 18 nt, Mycobacterium avium subsp. paratuberculosis
gacggucuucccgccgcc

SEQ ID NO: 929098 - RNA, 20 nt, Mycobacterium avium subsp. paratuberculosis
gacggucuucccgccgccgu

SEQ ID NO: 929099 - RNA, 16 nt, Mycobacterium avium subsp. paratuberculosis
gacggucuugcggccg

SEQ ID NO: 929100 - RNA, 19 nt, Mycobacterium avium subsp. paratuberculosis
gacggucuugcggccguca

SEQ ID NO: 929101 - RNA, 22 nt, Mycobacterium avium subsp. paratuberculosis
gacggucugcggugugggcagc

SEQ ID NO: 929102 - RNA, 20 nt, Mycobacterium avium subsp. paratuberculosis
gacggucugggaggcggcgg

SEQ ID NO: 929103 - RNA, 21 nt, Mycobacterium avium subsp. paratuberculosis
gacggucugggaggcggcggu

SEQ ID NO: 929104 - RNA, 15 nt, Mycobacterium avium subsp. paratuberculosis
gacggugaacuucac

SEQ ID NO: 929105 - RNA, 15 nt, Mycobacterium avium subsp. paratuberculosis
gacggugaccggcgc

SEQ ID NO: 929106 - RNA, 16 nt, Mycobacterium avium subsp. paratuberculosis
gacggugaccggcgcg

SEQ ID NO: 929107 - RNA, 21 nt, Mycobacterium avium subsp. paratuberculosis
gacggugaccggcgcgcccga

SEQ ID NO: 929108 - RNA, 15 nt, Mycobacterium avium subsp. paratuberculosis
gacggugaccucguc

SEQ ID NO: 929109 - RNA, 16 nt, Mycobacterium avium subsp. paratuberculosis
gacggugaccucgucg

SEQ ID NO: 929110 - RNA, 17 nt, Mycobacterium avium subsp. paratuberculosis
gacggugaccucgucgg

SEQ ID NO: 929111 - RNA, 22 nt, Mycobacterium avium subsp. paratuberculosis
gacgggucguaggacaccacgg

SEQ ID NO: 929112 - RNA, 19 nt, Mycobacterium avium subsp. paratuberculosis
gacggguugcaggccacgc

SEQ ID NO: 929113 - RNA, 16 nt, Mycobacterium avium subsp. paratuberculosis
gacggguugcggaucg

SEQ ID NO: 929114 - RNA, 19 nt, Mycobacterium avium subsp. paratuberculosis
gacggguugcgguccacgu

SEQ ID NO: 929115 - RNA, 16 nt, Mycobacterium avium subsp. paratuberculosis
gacggguuggucggcg

SEQ ID NO: 929116 - RNA, 20 nt, Mycobacterium avium subsp. paratuberculosis
gacgggugcucagguugcgc

SEQ ID NO: 929117 - RNA, 18 nt, Mycobacterium avium subsp. paratuberculosis
gacggucaccggcaggcg

SEQ ID NO: 929118 - RNA, 20 nt, Mycobacterium avium subsp. paratuberculosis
gacggucaccggcaggcggu

SEQ ID NO: 929119 - RNA, 12 nt, Mycobacterium avium subsp. paratuberculosis
gacggucacgcu

SEQ ID NO: 929120 - RNA, 21 nt, Mycobacterium avium subsp. paratuberculosis
gacggucacgcuggcgugacg

SEQ ID NO: 929121 - RNA, 15 nt, Mycobacterium avium subsp. paratuberculosis
gacggucacggccgc

SEQ ID NO: 929122 - RNA, 22 nt, Mycobacterium avium subsp. paratuberculosis
gacggucacggccgccagcagc

SEQ ID NO: 929123 - RNA, 14 nt, Mycobacterium avium subsp. paratuberculosis
gacggucagcacgc

SEQ ID NO: 929124 - RNA, 22 nt, Mycobacterium avium subsp. paratuberculosis
gacgggguucaguagcagcguc

SEQ ID NO: 929125 - RNA, 16 nt, Mycobacterium avium subsp. paratuberculosis
gacgggucgaccgccg

SEQ ID NO: 929126 - RNA, 17 nt, Mycobacterium avium subsp. paratuberculosis
gacgggucgaccgccgc

SEQ ID NO: 929127 - RNA, 18 nt, Mycobacterium avium subsp. paratuberculosis
gacgggucgaccgccgcg

SEQ ID NO: 929128 - RNA, 13 nt, Mycobacterium avium subsp. paratuberculosis
gacgggucggcgg

SEQ ID NO: 929129 - RNA, 17 nt, Mycobacterium avium subsp. paratuberculosis
gacgggucggcggcgaa

SEQ ID NO: 929130 - RNA, 18 nt, Mycobacterium avium subsp. paratuberculosis
gacgggucggcggcgaac

SEQ ID NO: 929131 - RNA, 22 nt, Mycobacterium avium subsp. paratuberculosis
gacgggucggugguucgcgcga

SEQ ID NO: 929132 - RNA, 23 nt, Mycobacterium avium subsp. paratuberculosis
gacgggucggugguucgcgcgau

SEQ ID NO: 929133 - RNA, 13 nt, Mycobacterium avium subsp. paratuberculosis
gacgggcucggcg

SEQ ID NO: 929134 - RNA, 17 nt, Mycobacterium avium subsp. paratuberculosis
gacgggcugcugcacgu

SEQ ID NO: 929135 - RNA, 23 nt, Mycobacterium avium subsp. paratuberculosis
gacgggcggggggcgagccggcc

SEQ ID NO: 929136 - RNA, 14 nt, Mycobacterium avium subsp. paratuberculosis
gacgggccaccagc

SEQ ID NO: 929137 - RNA, 17 nt, Mycobacterium avium subsp. paratuberculosis
gacgggccaccagcgca

SEQ ID NO: 929138 - RNA, 18 nt, Mycobacterium avium subsp. paratuberculosis
gacgggcccagcgcgacg

SEQ ID NO: 929139 - RNA, 12 nt, Mycobacterium avium subsp. paratuberculosis
gacgggccgcgg

SEQ ID NO: 929140 - RNA, 15 nt, Mycobacterium avium subsp. paratuberculosis
gacgggccgcggcca

SEQ ID NO: 929141 - RNA, 17 nt, Mycobacterium avium subsp. paratuberculosis
gacgggccgcggccagc

SEQ ID NO: 929142 - RNA, 13 nt, Mycobacterium avium subsp. paratuberculosis
gacgggccggcgg

SEQ ID NO: 929143 - RNA, 21 nt, Mycobacterium avium subsp. paratuberculosis
gacgggccgggcacgucgacg

SEQ ID NO: 929144 - RNA, 23 nt, Mycobacterium avium subsp. paratuberculosis
gacgggccgggcacgucgacgcc

SEQ ID NO: 929145 - RNA, 13 nt, Mycobacterium avium subsp. paratuberculosis
gacgggccgcauc

SEQ ID NO: 929146 - RNA, 22 nt, Mycobacterium avium subsp. paratuberculosis
gacgggccgaucacgcggaucg

SEQ ID NO: 929147 - RNA, 14 nt, Mycobacterium avium subsp. paratuberculosis
gacgggcgucggcg

SEQ ID NO: 929148 - RNA, 15 nt, Mycobacterium avium subsp. paratuberculosis
gacgggcgucggcgg

SEQ ID NO: 929149 - RNA, 18 nt, Mycobacterium avium subsp. paratuberculosis
gacgggcgucggcgggcg

SEQ ID NO: 929150 - RNA, 13 nt, Mycobacterium avium subsp. paratuberculosis
gacgggcgugaca

SEQ ID NO: 929151 - RNA, 21 nt, Mycobacterium avium subsp. paratuberculosis
gacgggcgugacggaugugac

SEQ ID NO: 929152 - RNA, 16 nt, Mycobacterium avium subsp. paratuberculosis
gacgggcgugccggcg

SEQ ID NO: 929153 - RNA, 22 nt, Mycobacterium avium subsp. paratuberculosis
gacgggcguguagccugcggcc

SEQ ID NO: 929154 - RNA, 20 nt, Mycobacterium avium subsp. paratuberculosis
gacgggcaugccgucggcgc

SEQ ID NO: 929155 - RNA, 21 nt, Mycobacterium avium subsp. paratuberculosis
gacgggcaugccgucggcgcc

SEQ ID NO: 929156 - RNA, 22 nt, Mycobacterium avium subsp. paratuberculosis
gacgggcaugccgucggcgccc

SEQ ID NO: 929157 - RNA, 15 nt, Mycobacterium avium subsp. paratuberculosis
gacgggcagggugac

SEQ ID NO: 929158 - RNA, 16 nt, Mycobacterium avium subsp. paratuberculosis
gacgggagucgggccc

SEQ ID NO: 929159 - RNA, 16 nt, Mycobacterium avium subsp. paratuberculosis
gacgggauccggauug

SEQ ID NO: 929160 - RNA, 14 nt, Mycobacterium avium subsp. paratuberculosis
gacgggaucggcgc

SEQ ID NO: 929161 - RNA, 15 nt, Mycobacterium avium subsp. paratuberculosis
gacgggaucggcgcg

SEQ ID NO: 929162 - RNA, 18 nt, Mycobacterium avium subsp. paratuberculosis
gacgggaucggcgcgucg

SEQ ID NO: 929163 - RNA, 14 nt, Mycobacterium avium subsp. paratuberculosis
gacgggacguuggc

SEQ ID NO: 929164 - RNA, 18 nt, Mycobacterium avium subsp. paratuberculosis
gacgggacguuggcggac

SEQ ID NO: 929165 - RNA, 22 nt, Mycobacterium avium subsp. paratuberculosis
gacgggaccacccgcagcgcgg

SEQ ID NO: 929166 - RNA, 15 nt, Mycobacterium avium subsp. paratuberculosis
gacgggaccgcacgc

SEQ ID NO: 929167 - RNA, 17 nt, Mycobacterium avium subsp. paratuberculosis
gacgggaccgcacgccg

SEQ ID NO: 929168 - RNA, 18 nt, Mycobacterium avium subsp. paratuberculosis
gacgggaccgcacgccgg

SEQ ID NO: 929169 - RNA, 16 nt, Mycobacterium avium subsp. paratuberculosis
gacgggaacucggcca

SEQ ID NO: 929170 - RNA, 17 nt, Mycobacterium avium subsp. paratuberculosis
gacggagucgucggcgc

SEQ ID NO: 929171 - RNA, 23 nt, Mycobacterium avium subsp. paratuberculosis
gacggauaacucuacugcugcgg

SEQ ID NO: 929172 - RNA, 15 nt, Mycobacterium avium subsp. paratuberculosis
gacggauguggucgg

SEQ ID NO: 929173 - RNA, 18 nt, Mycobacterium avium subsp. paratuberculosis
gacggauguggucggcca

SEQ ID NO: 929174 - RNA, 15 nt, Mycobacterium avium subsp. paratuberculosis
gacggcaccgccggc

SEQ ID NO: 929175 - RNA, 16 nt, Mycobacterium avium subsp. paratuberculosis
gacggcaccgccggcg

SEQ ID NO: 929176 - RNA, 17 nt, Mycobacterium avium subsp. paratuberculosis
gacggcaccgccggcgg

SEQ ID NO: 929177 - RNA, 19 nt, Mycobacterium avium subsp. paratuberculosis
gacggcaccgccggcggcc

SEQ ID NO: 929178 - RNA, 16 nt, Mycobacterium avium subsp. paratuberculosis
gacggcaauacggggc

SEQ ID NO: 929179 - RNA, 15 nt, Mycobacterium avium subsp. paratuberculosis
gacggcaauccggcc

SEQ ID NO: 929180 - RNA, 16 nt, Mycobacterium avium subsp. paratuberculosis
gacggcaauccggccc

SEQ ID NO: 929181 - RNA, 19 nt, Mycobacterium avium subsp. paratuberculosis
gacggcaauccggccccgc

SEQ ID NO: 929182 - RNA, 12 nt, Mycobacterium avium subsp. paratuberculosis
gacggcagcgcg

SEQ ID NO: 929183 - RNA, 13 nt, Mycobacterium avium subsp. paratuberculosis
gacggcagcgcga

SEQ ID NO: 929184 - RNA, 14 nt, Mycobacterium avium subsp. paratuberculosis
gacggcagcgcgau

SEQ ID NO: 929185 - RNA, 15 nt, Mycobacterium avium subsp. paratuberculosis
gacggcagcgcgauc

SEQ ID NO: 929186 - RNA, 13 nt, Mycobacterium avium subsp. paratuberculosis
gacggcagcgcua

SEQ ID NO: 929187 - RNA, 16 nt, Mycobacterium avium subsp. paratuberculosis
gacggcagcaccgccg

SEQ ID NO: 929188 - RNA, 17 nt, Mycobacterium avium subsp. paratuberculosis
gacggcagcaccgccga

SEQ ID NO: 929189 - RNA, 19 nt, Mycobacterium avium subsp. paratuberculosis
gacggcagcaccgccgaca

SEQ ID NO: 929190 - RNA, 20 nt, Mycobacterium avium subsp. paratuberculosis
gacggcagcaccgccgacau

SEQ ID NO: 929191 - RNA, 18 nt, Mycobacterium avium subsp. paratuberculosis
gacggcagcaccucgcgc

SEQ ID NO: 929192 - RNA, 21 nt, Mycobacterium avium subsp. paratuberculosis
gacggcagcaccucgcgcagc

SEQ ID NO: 929193 - RNA, 15 nt, Mycobacterium avium subsp. paratuberculosis
gacggcaccucucgg

SEQ ID NO: 929194 - RNA, 13 nt, Mycobacterium avium subsp. paratuberculosis
gacggccaccgcg

SEQ ID NO: 929195 - RNA, 16 nt, Mycobacterium avium subsp. paratuberculosis
gacggccaccgcgacg

SEQ ID NO: 929196 - RNA, 15 nt, Mycobacterium avium subsp. paratuberculosis
gacggcaucggcgcc

SEQ ID NO: 929197 - RNA, 12 nt, Mycobacterium avium subsp. paratuberculosis
gacggcaugccg

SEQ ID NO: 929198 - RNA, 13 nt, Mycobacterium avium subsp. paratuberculosis
gacggcaugccgg

SEQ ID NO: 929199 - RNA, 20 nt, Mycobacterium avium subsp. paratuberculosis
gacggcaugccgggccagcc

SEQ ID NO: 929200 - RNA, 13 nt, Mycobacterium avium subsp. paratuberculosis
gacggccagcagg

SEQ ID NO: 929201 - RNA, 17 nt, Mycobacterium avium subsp. paratuberculosis
gacggccagcccgucgg

SEQ ID NO: 929202 - RNA, 14 nt, Mycobacterium avium subsp. paratuberculosis
gacggccagcgcgg

SEQ ID NO: 929203 - RNA, 20 nt, Mycobacterium avium subsp. paratuberculosis
gacggccagcagggcgccga

SEQ ID NO: 929204 - RNA, 21 nt, Mycobacterium avium subsp. paratuberculosis
gacggccagcagggcgccgac

SEQ ID NO: 929205 - RNA, 24 nt, Mycobacterium avium subsp. paratuberculosis
gacggccagcagggcgccgacgau

SEQ ID NO: 929206 - RNA, 14 nt, Mycobacterium avium subsp. paratuberculosis
gacggccggcguca

SEQ ID NO: 929207 - RNA, 16 nt, Mycobacterium avium subsp. paratuberculosis
gacggccggcccugca

SEQ ID NO: 929208 - RNA, 20 nt, Mycobacterium avium subsp. paratuberculosis
gacggccggcccugcacgca

SEQ ID NO: 929209 - RNA, 21 nt, Mycobacterium avium subsp. paratuberculosis
gacggccgccgauuccggccg

SEQ ID NO: 929210 - RNA, 23 nt, Mycobacterium avium subsp. paratuberculosis
gacggccgccgauuccggccggc

SEQ ID NO: 929211 - RNA, 15 nt, Mycobacterium avium subsp. paratuberculosis
gacggccgccgcgac

SEQ ID NO: 929212 - RNA, 16 nt, Mycobacterium avium subsp. paratuberculosis
gacggccgccgcgacg

SEQ ID NO: 929213 - RNA, 21 nt, Mycobacterium avium subsp. paratuberculosis
gacggccgcgccgaacaccac

SEQ ID NO: 929214 - RNA, 17 nt, Mycobacterium avium subsp. paratuberculosis
gacggccgcggcgcggc

SEQ ID NO: 929215 - RNA, 20 nt, Mycobacterium avium subsp. paratuberculosis
gacggccgcggcgcggcccg

SEQ ID NO: 929216 - RNA, 14 nt, Mycobacterium avium subsp. paratuberculosis
gacggccgcggcgg

SEQ ID NO: 929217 - RNA, 17 nt, Mycobacterium avium subsp. paratuberculosis
gacggccgcaccccacc

SEQ ID NO: 929218 - RNA, 15 nt, Mycobacterium avium subsp. paratuberculosis
gacggccccccgggc

SEQ ID NO: 929219 - RNA, 23 nt, Mycobacterium avium subsp. paratuberculosis
gacggccccccgggcaccagcgc

SEQ ID NO: 929220 - RNA, 19 nt, Mycobacterium avium subsp. paratuberculosis
gacggcccacgucgcgccg

SEQ ID NO: 929221 - RNA, 12 nt, Mycobacterium avium subsp. paratuberculosis
gacggcccgacg

SEQ ID NO: 929222 - RNA, 18 nt, Mycobacterium avium subsp. paratuberculosis
gacggcccgacgacgccg

SEQ ID NO: 929223 - RNA, 18 nt, Mycobacterium avium subsp. paratuberculosis
gacggcccgccggagccg

SEQ ID NO: 929224 - RNA, 19 nt, Mycobacterium avium subsp. paratuberculosis
gacggcccgccggagccga

SEQ ID NO: 929225 - RNA, 15 nt, Mycobacterium avium subsp. paratuberculosis
gacgcugggcggcga

SEQ ID NO: 929226 - RNA, 16 nt, Mycobacterium avium subsp. paratuberculosis
gacgcugggcggcgac

SEQ ID NO: 929227 - RNA, 20 nt, Mycobacterium avium subsp. paratuberculosis
gacgcuugggguuuggcgac

SEQ ID NO: 929228 - RNA, 14 nt, Mycobacterium avium subsp. paratuberculosis
gacgcugugcucgg

SEQ ID NO: 929229 - RNA, 16 nt, Mycobacterium avium subsp. paratuberculosis
gacggacacccgcgcg

SEQ ID NO: 929230 - RNA, 21 nt, Mycobacterium avium subsp. paratuberculosis
gacggacacccgcgcggugcc

SEQ ID NO: 929231 - RNA, 23 nt, Mycobacterium avium subsp. paratuberculosis
gacggacuugggcgucucgauga

SEQ ID NO: 929232 - RNA, 14 nt, Mycobacterium avium subsp. paratuberculosis
gacggagccgugcc

SEQ ID NO: 929233 - RNA, 16 nt, Mycobacterium avium subsp. paratuberculosis
gacggauccgggcgcc

SEQ ID NO: 929234 - RNA, 17 nt, Mycobacterium avium subsp. paratuberculosis
gacggauccgggcgccg

SEQ ID NO: 929235 - RNA, 21 nt, Mycobacterium avium subsp. paratuberculosis
gacggaucgagucccgcgcgg

SEQ ID NO: 929236 - RNA, 14 nt, Mycobacterium avium subsp. paratuberculosis
gacggaucggccgc

SEQ ID NO: 929237 - RNA, 16 nt, Mycobacterium avium subsp. paratuberculosis
gacggaucggccgcgu

SEQ ID NO: 929238 - RNA, 19 nt, Mycobacterium avium subsp. paratuberculosis
gacggaucggccgcgucgg

SEQ ID NO: 929239 - RNA, 21 nt, Mycobacterium avium subsp. paratuberculosis
gacggaucgguguagcccggu

SEQ ID NO: 929240 - RNA, 22 nt, Mycobacterium avium subsp. paratuberculosis
gacggaucgguguagcccggug

SEQ ID NO: 929241 - RNA, 14 nt, Mycobacterium avium subsp. paratuberculosis
gacggaucugcucg

SEQ ID NO: 929242 - RNA, 14 nt, Mycobacterium avium subsp. paratuberculosis
gacgcuggccgaga

SEQ ID NO: 929243 - RNA, 17 nt, Mycobacterium avium subsp. paratuberculosis
gacgcugcagguggccc

SEQ ID NO: 929244 - RNA, 14 nt, Mycobacterium avium subsp. paratuberculosis
gacgcugccgcgcc

SEQ ID NO: 929245 - RNA, 18 nt, Mycobacterium avium subsp. paratuberculosis
gacgcugccgcgccgcca

SEQ ID NO: 929246 - RNA, 19 nt, Mycobacterium avium subsp. paratuberculosis
gacgcugccgcuggcgucg

SEQ ID NO: 929247 - RNA, 16 nt, Mycobacterium avium subsp. paratuberculosis
gacgcugccggggcgc

SEQ ID NO: 929248 - RNA, 21 nt, Mycobacterium avium subsp. paratuberculosis
gacgcugacgaugcggccggc

SEQ ID NO: 929249 - RNA, 22 nt, Mycobacterium avium subsp. paratuberculosis
gacgcugacgaugcggccggcg

SEQ ID NO: 929250 - RNA, 19 nt, Mycobacterium avium subsp. paratuberculosis
gacgcugaucuacgucggc

SEQ ID NO: 929251 - RNA, 14 nt, Mycobacterium avium subsp. paratuberculosis
gacgcugagcaccc

SEQ ID NO: 929252 - RNA, 15 nt, Mycobacterium avium subsp. paratuberculosis
gacgcugagcgccag

SEQ ID NO: 929253 - RNA, 20 nt, Mycobacterium avium subsp. paratuberculosis
gacgcugagcgccaggccau

SEQ ID NO: 929254 - RNA, 19 nt, Mycobacterium avium subsp. paratuberculosis
gacgcugaacagcagcagc

SEQ ID NO: 929255 - RNA, 14 nt, Mycobacterium avium subsp. paratuberculosis
gacgcugaacagcc

SEQ ID NO: 929256 - RNA, 16 nt, Mycobacterium avium subsp. paratuberculosis
gacgcugaacagcccg

SEQ ID NO: 929257 - RNA, 19 nt, Mycobacterium avium subsp. paratuberculosis
gacgcugaacagcccgagc

SEQ ID NO: 929258 - RNA, 20 nt, Mycobacterium avium subsp. paratuberculosis
gacgcugaacagcccgagca

SEQ ID NO: 929259 - RNA, 21 nt, Mycobacterium avium subsp. paratuberculosis
gacgcucggucgccacggccg

SEQ ID NO: 929260 - RNA, 16 nt, Mycobacterium avium subsp. paratuberculosis
gacgcucaggcgucca

SEQ ID NO: 929261 - RNA, 23 nt, Mycobacterium avium subsp. paratuberculosis
gacgcucaggcguccagccagcg

SEQ ID NO: 929262 - RNA, 24 nt, Mycobacterium avium subsp. paratuberculosis
gacgcucaggcguccagccagcgu

SEQ ID NO: 929263 - RNA, 15 nt, Mycobacterium avium subsp. paratuberculosis
gacgcucggucgcca

SEQ ID NO: 929264 - RNA, 20 nt, Mycobacterium avium subsp. paratuberculosis
gacgcucgggcuucggcguc

SEQ ID NO: 929265 - RNA, 22 nt, Mycobacterium avium subsp. paratuberculosis
gacgcucgggcuucggcgucac

SEQ ID NO: 929266 - RNA, 19 nt, Mycobacterium avium subsp. paratuberculosis
gacgcucggggccgguugg

SEQ ID NO: 929267 - RNA, 14 nt, Mycobacterium avium subsp. paratuberculosis
gacgcucggucgcc

SEQ ID NO: 929268 - RNA, 17 nt, Mycobacterium avium subsp. paratuberculosis
gacgcgcaccagggccg

SEQ ID NO: 929269 - RNA, 20 nt, Mycobacterium avium subsp. paratuberculosis
gacgcgcaccagggccgcga

SEQ ID NO: 929270 - RNA, 13 nt, Mycobacterium avium subsp. paratuberculosis
gacgcgcgcggcg

SEQ ID NO: 929271 - RNA, 14 nt, Mycobacterium avium subsp. paratuberculosis
gacgcgccgucggc

SEQ ID NO: 929272 - RNA, 18 nt, Mycobacterium avium subsp. paratuberculosis
gacgcgccgucggcccac

SEQ ID NO: 929273 - RNA, 19 nt, Mycobacterium avium subsp. paratuberculosis
gacgcgccacgccccggcg

SEQ ID NO: 929274 - RNA, 19 nt, Mycobacterium avium subsp. paratuberculosis
gacgcgccgcacugcacgg

SEQ ID NO: 929275 - RNA, 20 nt, Mycobacterium avium subsp. paratuberculosis
gacgcgaacgcgccccgccg

SEQ ID NO: 929276 - RNA, 23 nt, Mycobacterium avium subsp. paratuberculosis
gacgcgauggcgcuggccgcgaa

SEQ ID NO: 929277 - RNA, 14 nt, Mycobacterium avium subsp. paratuberculosis
gacgcgcaccgcca

SEQ ID NO: 929278 - RNA, 15 nt, Mycobacterium avium subsp. paratuberculosis
gacgcgcaccgccac

SEQ ID NO: 929279 - RNA, 16 nt, Mycobacterium avium subsp. paratuberculosis
gacgcgcaccgccacc

SEQ ID NO: 929280 - RNA, 19 nt, Mycobacterium avium subsp. paratuberculosis
gacgcgcaccgccaccgcc

SEQ ID NO: 929281 - RNA, 12 nt, Mycobacterium avium subsp. paratuberculosis
gacgcgcagauc

SEQ ID NO: 929282 - RNA, 14 nt, Mycobacterium avium subsp. paratuberculosis
gacgcgcagcacgg

SEQ ID NO: 929283 - RNA, 17 nt, Mycobacterium avium subsp. paratuberculosis
gacgcgacgcgcucggc

SEQ ID NO: 929284 - RNA, 20 nt, Mycobacterium avium subsp. paratuberculosis
gacgcgacgcgcucggcgac

SEQ ID NO: 929285 - RNA, 17 nt, Mycobacterium avium subsp. paratuberculosis
gacgcgacggucgugcu

SEQ ID NO: 929286 - RNA, 23 nt, Mycobacterium avium subsp. paratuberculosis
gacgcgacggucgugcugggccg

SEQ ID NO: 929287 - RNA, 13 nt, Mycobacterium avium subsp. paratuberculosis
gacgcgaccgcgc

SEQ ID NO: 929288 - RNA, 16 nt, Mycobacterium avium subsp. paratuberculosis
gacgcgaccgcgcggc

SEQ ID NO: 929289 - RNA, 14 nt, Mycobacterium avium subsp. paratuberculosis
gacgcgaccggccc

SEQ ID NO: 929290 - RNA, 15 nt, Mycobacterium avium subsp. paratuberculosis
gacgcgaccggcccg

SEQ ID NO: 929291 - RNA, 16 nt, Mycobacterium avium subsp. paratuberculosis
gacgcgcucagcccca

SEQ ID NO: 929292 - RNA, 14 nt, Mycobacterium avium subsp. paratuberculosis
gacgcggccgagcc

SEQ ID NO: 929293 - RNA, 16 nt, Mycobacterium avium subsp. paratuberculosis
gacgcggccgagccga

SEQ ID NO: 929294 - RNA, 17 nt, Mycobacterium avium subsp. paratuberculosis
gacgcggccucaccgcg

SEQ ID NO: 929295 - RNA, 18 nt, Mycobacterium avium subsp. paratuberculosis
gacgcggccucaccgcgg

SEQ ID NO: 929296 - RNA, 20 nt, Mycobacterium avium subsp. paratuberculosis
gacgcggccucaccgcgggc

SEQ ID NO: 929297 - RNA, 15 nt, Mycobacterium avium subsp. paratuberculosis
gacgcggcacgccgc

SEQ ID NO: 929298 - RNA, 12 nt, Mycobacterium avium subsp. paratuberculosis
gacgcggccagc

SEQ ID NO: 929299 - RNA, 15 nt, Mycobacterium avium subsp. paratuberculosis
gacgcggccagcgcc

SEQ ID NO: 929300 - RNA, 18 nt, Mycobacterium avium subsp. paratuberculosis
gacgcggccagcgcccgc

SEQ ID NO: 929301 - RNA, 22 nt, Mycobacterium avium subsp. paratuberculosis
gacgcggccagcgcccgcgcga

SEQ ID NO: 929302 - RNA, 16 nt, Mycobacterium avium subsp. paratuberculosis
gacgcgcugcgcgccg

SEQ ID NO: 929303 - RNA, 22 nt, Mycobacterium avium subsp. paratuberculosis
gacgcgcuuguacaggucgacc

SEQ ID NO: 929304 - RNA, 23 nt, Mycobacterium avium subsp. paratuberculosis
gacgcgcuuguacaggucgacca

SEQ ID NO: 929305 - RNA, 14 nt, Mycobacterium avium subsp. paratuberculosis
gacgcgcucggcga

SEQ ID NO: 929306 - RNA, 22 nt, Mycobacterium avium subsp. paratuberculosis
gacgcgcucggcgaccgccggu

SEQ ID NO: 929307 - RNA, 23 nt, Mycobacterium avium subsp. paratuberculosis
gacgcgcucggcgaccgccggug

SEQ ID NO: 929308 - RNA, 15 nt, Mycobacterium avium subsp. paratuberculosis
gacgcgcgugacggc

SEQ ID NO: 929309 - RNA, 22 nt, Mycobacterium avium subsp. paratuberculosis
gacgcgcgugacggcggggcgg

SEQ ID NO: 929310 - RNA, 14 nt, Mycobacterium avium subsp. paratuberculosis
gacgcgucgcggcg

SEQ ID NO: 929311 - RNA, 15 nt, Mycobacterium avium subsp. paratuberculosis
gacgcgucgcggcgg

SEQ ID NO: 929312 - RNA, 17 nt, Mycobacterium avium subsp. paratuberculosis
gacgcgugcgucaucgc

SEQ ID NO: 929313 - RNA, 22 nt, Mycobacterium avium subsp. paratuberculosis
gacgcgugcgucaucgcgcugg

SEQ ID NO: 929314 - RNA, 22 nt, Mycobacterium avium subsp. paratuberculosis
gacgcguuguugcucggcggcc

SEQ ID NO: 929315 - RNA, 22 nt, Mycobacterium avium subsp. paratuberculosis
gacgcuaagcgcugaaccggua

SEQ ID NO: 929316 - RNA, 14 nt, Mycobacterium avium subsp. paratuberculosis
gacgcucacccggc

SEQ ID NO: 929317 - RNA, 15 nt, Mycobacterium avium subsp. paratuberculosis
gacgcucacccggcc

SEQ ID NO: 929318 - RNA, 18 nt, Mycobacterium avium subsp. paratuberculosis
gacgcucgacggccggcg

SEQ ID NO: 929319 - RNA, 17 nt, Mycobacterium avium subsp. paratuberculosis
gacgcucgaggccccgc

SEQ ID NO: 929320 - RNA, 17 nt, Mycobacterium avium subsp. paratuberculosis
gacgcucgccaccccgc

SEQ ID NO: 929321 - RNA, 21 nt, Mycobacterium avium subsp. paratuberculosis
gacgcucgccaccccgcgcca

SEQ ID NO: 929322 - RNA, 14 nt, Mycobacterium avium subsp. paratuberculosis
gacgcucgccggcg

SEQ ID NO: 929323 - RNA, 17 nt, Mycobacterium avium subsp. paratuberculosis
gacgcucgccggcggcc

SEQ ID NO: 929324 - RNA, 20 nt, Mycobacterium avium subsp. paratuberculosis
gacgcucgccggcggccgcc

SEQ ID NO: 929325 - RNA, 21 nt, Mycobacterium avium subsp. paratuberculosis
gacgcucgccggcggccgcca

SEQ ID NO: 929326 - RNA, 22 nt, Mycobacterium avium subsp. paratuberculosis
gacgcucgcgguugggccgccg

SEQ ID NO: 929327 - RNA, 12 nt, Mycobacterium avium subsp. paratuberculosis
gacgcucggccg

SEQ ID NO: 929328 - RNA, 18 nt, Mycobacterium avium subsp. paratuberculosis
gacgcucggccguggccg

SEQ ID NO: 929329 - RNA, 12 nt, Mycobacterium avium subsp. paratuberculosis
gacgcucggccu

SEQ ID NO: 929330 - RNA, 16 nt, Mycobacterium avium subsp. paratuberculosis
gacgcucggcgauggu

SEQ ID NO: 929331 - RNA, 12 nt, Mycobacterium avium subsp. paratuberculosis
gacgcucggcgc

SEQ ID NO: 929332 - RNA, 13 nt, Mycobacterium avium subsp. paratuberculosis
gacgcucggcgcc

SEQ ID NO: 929333 - RNA, 16 nt, Mycobacterium avium subsp. paratuberculosis
gacgcucggcgccgcg

SEQ ID NO: 929334 - RNA, 17 nt, Mycobacterium avium subsp. paratuberculosis
gacgcucggcgccggcc

SEQ ID NO: 929335 - RNA, 18 nt, Mycobacterium avium subsp. paratuberculosis
gacgcucggcgccggccg

SEQ ID NO: 929336 - RNA, 17 nt, Mycobacterium avium subsp. paratuberculosis
gacgcucggcggccgag

SEQ ID NO: 929337 - RNA, 20 nt, Mycobacterium avium subsp. paratuberculosis
gacgcguccguagugcucgg

SEQ ID NO: 929338 - RNA, 23 nt, Mycobacterium avium subsp. paratuberculosis
gacgcguccguagugcucggcgu

SEQ ID NO: 929339 - RNA, 14 nt, Mycobacterium avium subsp. paratuberculosis
gacgcggucgccgc

SEQ ID NO: 929340 - RNA, 22 nt, Mycobacterium avium subsp. paratuberculosis
gacgcggucgccgcccacgccg

SEQ ID NO: 929341 - RNA, 22 nt, Mycobacterium avium subsp. paratuberculosis
gacgcggucgaacaacgcggug

SEQ ID NO: 929342 - RNA, 16 nt, Mycobacterium avium subsp. paratuberculosis
gacgcggugacaugcc

SEQ ID NO: 929343 - RNA, 19 nt, Mycobacterium avium subsp. paratuberculosis
gacgcggugacaugcccgg

SEQ ID NO: 929344 - RNA, 17 nt, Mycobacterium avium subsp. paratuberculosis
gacgcggugacggugaa

SEQ ID NO: 929345 - RNA, 21 nt, Mycobacterium avium subsp. paratuberculosis
gacgcggugagcgcgccggcc

SEQ ID NO: 929346 - RNA, 16 nt, Mycobacterium avium subsp. paratuberculosis
gacgcgguggcgugcu

SEQ ID NO: 929347 - RNA, 18 nt, Mycobacterium avium subsp. paratuberculosis
gacgcgguggugcucgcc

SEQ ID NO: 929348 - RNA, 21 nt, Mycobacterium avium subsp. paratuberculosis
gacgcgguggugcucgccccg

SEQ ID NO: 929349 - RNA, 13 nt, Mycobacterium avium subsp. paratuberculosis
gacgcgggccggc

SEQ ID NO: 929350 - RNA, 23 nt, Mycobacterium avium subsp. paratuberculosis
gacgcgggccggcacccgggccu

SEQ ID NO: 929351 - RNA, 15 nt, Mycobacterium avium subsp. paratuberculosis
gacgcgggcgcccag

SEQ ID NO: 929352 - RNA, 17 nt, Mycobacterium avium subsp. paratuberculosis
gacgcgggcgcccagca

SEQ ID NO: 929353 - RNA, 14 nt, Mycobacterium avium subsp. paratuberculosis
gacgcggggcggcg

SEQ ID NO: 929354 - RNA, 16 nt, Mycobacterium avium subsp. paratuberculosis
gacgcggggcggcggc

SEQ ID NO: 929355 - RNA, 20 nt, Mycobacterium avium subsp. paratuberculosis
gacgcggggcggcggcgccg

SEQ ID NO: 929356 - RNA, 21 nt, Mycobacterium avium subsp. paratuberculosis
gacgcggggcggcggcgccgg

SEQ ID NO: 929357 - RNA, 15 nt, Mycobacterium avium subsp. paratuberculosis
gacgcggucaccggc

SEQ ID NO: 929358 - RNA, 16 nt, Mycobacterium avium subsp. paratuberculosis
gacgcggucaccggcu

SEQ ID NO: 929359 - RNA, 15 nt, Mycobacterium avium subsp. paratuberculosis
gacgcgggaccgggc

SEQ ID NO: 929360 - RNA, 16 nt, Mycobacterium avium subsp. paratuberculosis
gacgcgggaccgggcc

SEQ ID NO: 929361 - RNA, 14 nt, Mycobacterium avium subsp. paratuberculosis
gacgcggcucgcgc

SEQ ID NO: 929362 - RNA, 15 nt, Mycobacterium avium subsp. paratuberculosis
gacgcggcgucgggc

SEQ ID NO: 929363 - RNA, 21 nt, Mycobacterium avium subsp. paratuberculosis
gacgcggcgucgggcgggugg

SEQ ID NO: 929364 - RNA, 15 nt, Mycobacterium avium subsp. paratuberculosis
gacgcggcgcgacac

SEQ ID NO: 929365 - RNA, 18 nt, Mycobacterium avium subsp. paratuberculosis
gacgcggcgcgacaccgc

SEQ ID NO: 929366 - RNA, 14 nt, Mycobacterium avium subsp. paratuberculosis
gacgcggcgcgcga

SEQ ID NO: 929367 - RNA, 12 nt, Mycobacterium avium subsp. paratuberculosis
gacgcggcggcc

SEQ ID NO: 929368 - RNA, 20 nt, Mycobacterium avium subsp. paratuberculosis
gaccuguuugaacaccucga

SEQ ID NO: 929369 - RNA, 23 nt, Mycobacterium avium subsp. paratuberculosis
gaccuguuuggccagccaguugg

SEQ ID NO: 929370 - RNA, 14 nt, Mycobacterium avium subsp. paratuberculosis
gaccuucgagccgc

SEQ ID NO: 929371 - RNA, 16 nt, Mycobacterium avium subsp. paratuberculosis
gaccuucuuggucagc

SEQ ID NO: 929372 - RNA, 19 nt, Mycobacterium avium subsp. paratuberculosis
gaccuucuuggucagcggc

SEQ ID NO: 929373 - RNA, 19 nt, Mycobacterium avium subsp. paratuberculosis
gaccuucucccgcggcagc

SEQ ID NO: 929374 - RNA, 18 nt, Mycobacterium avium subsp. paratuberculosis
gaccuuggugucggcgag

SEQ ID NO: 929375 - RNA, 23 nt, Mycobacterium avium subsp. paratuberculosis
gaccuuggugucggcgagcuugg

SEQ ID NO: 929376 - RNA, 17 nt, Mycobacterium avium subsp. paratuberculosis
gaccuugggcauccgcu

SEQ ID NO: 929377 - RNA, 15 nt, Mycobacterium avium subsp. paratuberculosis
gaccuugcgggcggu

SEQ ID NO: 929378 - RNA, 20 nt, Mycobacterium avium subsp. paratuberculosis
gaccuugcgggcggucagca

SEQ ID NO: 929379 - RNA, 20 nt, Mycobacterium avium subsp. paratuberculosis
gacgacgaaaaugaugccga

SEQ ID NO: 929380 - RNA, 17 nt, Mycobacterium avium subsp. paratuberculosis
gacgaccuugucgcgca

SEQ ID NO: 929381 - RNA, 18 nt, Mycobacterium avium subsp. paratuberculosis
gacgaccuugucgcgcac

SEQ ID NO: 929382 - RNA, 14 nt, Mycobacterium avium subsp. paratuberculosis
gacgaaugucucga

SEQ ID NO: 929383 - RNA, 23 nt, Mycobacterium avium subsp. paratuberculosis
gacgaaugucucgaugacaugga

SEQ ID NO: 929384 - RNA, 15 nt, Mycobacterium avium subsp. paratuberculosis
gacgaauucggagac

SEQ ID NO: 929385 - RNA, 15 nt, Mycobacterium avium subsp. paratuberculosis
gacgaauagccuucg

SEQ ID NO: 929386 - RNA, 15 nt, Mycobacterium avium subsp. paratuberculosis
gacgaaucccgccuc

SEQ ID NO: 929387 - RNA, 19 nt, Mycobacterium avium subsp. paratuberculosis
gacgaccucgcccgccgcg

SEQ ID NO: 929388 - RNA, 14 nt, Mycobacterium avium subsp. paratuberculosis
gacgaccucgccga

SEQ ID NO: 929389 - RNA, 16 nt, Mycobacterium avium subsp. paratuberculosis
gacgaccucgccgacg

SEQ ID NO: 929390 - RNA, 15 nt, Mycobacterium avium subsp. paratuberculosis
gacgaccucgucguc

SEQ ID NO: 929391 - RNA, 18 nt, Mycobacterium avium subsp. paratuberculosis
gacgaccucgucgucgau

SEQ ID NO: 929392 - RNA, 14 nt, Mycobacterium avium subsp. paratuberculosis
gacgaccugggcgc

SEQ ID NO: 929393 - RNA, 16 nt, Mycobacterium avium subsp. paratuberculosis
gacgaccugggcgccg

SEQ ID NO: 929394 - RNA, 18 nt, Mycobacterium avium subsp. paratuberculosis
gacgaccugggcgccguc

SEQ ID NO: 929395 - RNA, 23 nt, Mycobacterium avium subsp. paratuberculosis
gacgaccugggcgccgucgccga

SEQ ID NO: 929396 - RNA, 13 nt, Mycobacterium avium subsp. paratuberculosis
gacgaccuggucg

SEQ ID NO: 929397 - RNA, 15 nt, Mycobacterium avium subsp. paratuberculosis
gacgaccuggucgcc

SEQ ID NO: 929398 - RNA, 19 nt, Mycobacterium avium subsp. paratuberculosis
gacgaccuucuggccuugc

SEQ ID NO: 929399 - RNA, 17 nt, Mycobacterium avium subsp. paratuberculosis
gacgaaggugcgcacga

SEQ ID NO: 929400 - RNA, 19 nt, Mycobacterium avium subsp. paratuberculosis
gacgaagucgacggcggug

SEQ ID NO: 929401 - RNA, 15 nt, Mycobacterium avium subsp. paratuberculosis
gacgaagucggucag

SEQ ID NO: 929402 - RNA, 21 nt, Mycobacterium avium subsp. paratuberculosis
gacgaagucggucagcgucgc

SEQ ID NO: 929403 - RNA, 16 nt, Mycobacterium avium subsp. paratuberculosis
gacgaagaaggacgcc

SEQ ID NO: 929404 - RNA, 18 nt, Mycobacterium avium subsp. paratuberculosis
gacgaagaugcgcccggu

SEQ ID NO: 929405 - RNA, 16 nt, Mycobacterium avium subsp. paratuberculosis
gacgaagcagcucgcg

SEQ ID NO: 929406 - RNA, 21 nt, Mycobacterium avium subsp. paratuberculosis
gaccuugcgcagccggcagca

SEQ ID NO: 929407 - RNA, 15 nt, Mycobacterium avium subsp. paratuberculosis
gacgaacuuggacgg

SEQ ID NO: 929408 - RNA, 14 nt, Mycobacterium avium subsp. paratuberculosis
gacgaagccgccgc

SEQ ID NO: 929409 - RNA, 19 nt, Mycobacterium avium subsp. paratuberculosis
gacgaagccgccgcccucg

SEQ ID NO: 929410 - RNA, 18 nt, Mycobacterium avium subsp. paratuberculosis
aacggcccaucacgucgg

SEQ ID NO: 929411 - RNA, 17 nt, Mycobacterium avium subsp. paratuberculosis
aacggcccgccgccggc

SEQ ID NO: 929412 - RNA, 18 nt, Mycobacterium avium subsp. paratuberculosis
aacggcccgccgccggcg

SEQ ID NO: 929413 - RNA, 19 nt, Mycobacterium avium subsp. paratuberculosis
aacggccaguccaggccgc

SEQ ID NO: 929414 - RNA, 14 nt, Mycobacterium avium subsp. paratuberculosis
gaccugcaucucga

SEQ ID NO: 929415 - RNA, 23 nt, Mycobacterium avium subsp. paratuberculosis
gaccugcaucucgacccgggcca

SEQ ID NO: 929416 - RNA, 13 nt, Mycobacterium avium subsp. paratuberculosis
gaccugcagcgcc

SEQ ID NO: 929417 - RNA, 17 nt, Mycobacterium avium subsp. paratuberculosis
aacggcagcucgucgac

SEQ ID NO: 929418 - RNA, 22 nt, Mycobacterium avium subsp. paratuberculosis
aacggcagcucgucgacguccu

SEQ ID NO: 929419 - RNA, 15 nt, Mycobacterium avium subsp. paratuberculosis
gaccggcgcgcagca

SEQ ID NO: 929420 - RNA, 15 nt, Mycobacterium avium subsp. paratuberculosis
gaccggcgcgcccga

SEQ ID NO: 929421 - RNA, 17 nt, Mycobacterium avium subsp. paratuberculosis
gaccggcgcgcccgagu

SEQ ID NO: 929422 - RNA, 17 nt, Mycobacterium avium subsp. paratuberculosis
gaccggcgccgggucgc

SEQ ID NO: 929423 - RNA, 14 nt, Mycobacterium avium subsp. paratuberculosis
gaccggcggccgcc

SEQ ID NO: 929424 - RNA, 22 nt, Mycobacterium avium subsp. paratuberculosis
gaccggcggccgccaucauccg

SEQ ID NO: 929425 - RNA, 15 nt, Mycobacterium avium subsp. paratuberculosis
gaccggcgccggccg

SEQ ID NO: 929426 - RNA, 16 nt, Mycobacterium avium subsp. paratuberculosis
gaccggcgccggccgc

SEQ ID NO: 929427 - RNA, 17 nt, Mycobacterium avium subsp. paratuberculosis
gaccggcgccggccgcc

SEQ ID NO: 929428 - RNA, 22 nt, Mycobacterium avium subsp. paratuberculosis
gaccuggugcucgaugcgacgc

SEQ ID NO: 929429 - RNA, 20 nt, Mycobacterium avium subsp. paratuberculosis
gaccugguugacaccaccga

SEQ ID NO: 929430 - RNA, 17 nt, Mycobacterium avium subsp. paratuberculosis
gaccugguugccgcccu

SEQ ID NO: 929431 - RNA, 20 nt, Mycobacterium avium subsp. paratuberculosis
gaccugguccaccgcggcgg

SEQ ID NO: 929432 - RNA, 21 nt, Mycobacterium avium subsp. paratuberculosis
gaccugguccaccgcggcggc

SEQ ID NO: 929433 - RNA, 15 nt, Mycobacterium avium subsp. paratuberculosis
gaccuggucgccgaa

SEQ ID NO: 929434 - RNA, 16 nt, Mycobacterium avium subsp. paratuberculosis
gaccuggucgccgccg

SEQ ID NO: 929435 - RNA, 17 nt, Mycobacterium avium subsp. paratuberculosis
gaccuggucgccgccgu

SEQ ID NO: 929436 - RNA, 14 nt, Mycobacterium avium subsp. paratuberculosis
gaccugcucgucgg

SEQ ID NO: 929437 - RNA, 17 nt, Mycobacterium avium subsp. paratuberculosis
gaccugcucgucgguga

SEQ ID NO: 929438 - RNA, 21 nt, Mycobacterium avium subsp. paratuberculosis
gaccugcugcucgucgcgggc

SEQ ID NO: 929439 - RNA, 14 nt, Mycobacterium avium subsp. paratuberculosis
gaccugcgggccca

SEQ ID NO: 929440 - RNA, 18 nt, Mycobacterium avium subsp. paratuberculosis
gaccugcgggcccaccgc

SEQ ID NO: 929441 - RNA, 19 nt, Mycobacterium avium subsp. paratuberculosis
gaccugcgggcccaccgcg

SEQ ID NO: 929442 - RNA, 13 nt, Mycobacterium avium subsp. paratuberculosis
gaccugcgggugc

SEQ ID NO: 929443 - RNA, 13 nt, Mycobacterium avium subsp. paratuberculosis
gaccugccggcga

SEQ ID NO: 929444 - RNA, 15 nt, Mycobacterium avium subsp. paratuberculosis
gaccugcccgggccc

SEQ ID NO: 929445 - RNA, 18 nt, Mycobacterium avium subsp. paratuberculosis
gaccugcccgggcccgau

SEQ ID NO: 929446 - RNA, 20 nt, Mycobacterium avium subsp. paratuberculosis
gacgacggccaccgcgacgc

SEQ ID NO: 929447 - RNA, 14 nt, Mycobacterium avium subsp. paratuberculosis
gacgacggccagcu

SEQ ID NO: 929448 - RNA, 13 nt, Mycobacterium avium subsp. paratuberculosis
gacgacgccacca

SEQ ID NO: 929449 - RNA, 13 nt, Mycobacterium avium subsp. paratuberculosis
gacgacgccagcu

SEQ ID NO: 929450 - RNA, 20 nt, Mycobacterium avium subsp. paratuberculosis
gacgacgccagcugccgcga

SEQ ID NO: 929451 - RNA, 22 nt, Mycobacterium avium subsp. paratuberculosis
gacgacgccgucacggaucgcc

SEQ ID NO: 929452 - RNA, 16 nt, Mycobacterium avium subsp. paratuberculosis
gacgacgaaucccgcc

SEQ ID NO: 929453 - RNA, 17 nt, Mycobacterium avium subsp. paratuberculosis
gacgacgaaucccgccu

SEQ ID NO: 929454 - RNA, 20 nt, Mycobacterium avium subsp. paratuberculosis
gacgacgaaucccgccucgg

SEQ ID NO: 929455 - RNA, 21 nt, Mycobacterium avium subsp. paratuberculosis
gacgacgaaucccgccucggu

SEQ ID NO: 929456 - RNA, 13 nt, Mycobacterium avium subsp. paratuberculosis
gacgacgacgucg

SEQ ID NO: 929457 - RNA, 13 nt, Mycobacterium avium subsp. paratuberculosis
gacgacggcgccg

SEQ ID NO: 929458 - RNA, 14 nt, Mycobacterium avium subsp. paratuberculosis
gacgacggcgccgc

SEQ ID NO: 929459 - RNA, 16 nt, Mycobacterium avium subsp. paratuberculosis
gacgacggcgccgccc

SEQ ID NO: 929460 - RNA, 15 nt, Mycobacterium avium subsp. paratuberculosis
gacgacggcgccgcg

SEQ ID NO: 929461 - RNA, 16 nt, Mycobacterium avium subsp. paratuberculosis
gacgacggcgccgcgu

SEQ ID NO: 929462 - RNA, 17 nt, Mycobacterium avium subsp. paratuberculosis
gacgacggcgccgcguc

SEQ ID NO: 929463 - RNA, 18 nt, Mycobacterium avium subsp. paratuberculosis
gacgacggcgccgcgucg

SEQ ID NO: 929464 - RNA, 19 nt, Mycobacterium avium subsp. paratuberculosis
gacgacggcgccgcgucgg

SEQ ID NO: 929465 - RNA, 22 nt, Mycobacterium avium subsp. paratuberculosis
gacgacggcggggaugcccggg

SEQ ID NO: 929466 - RNA, 23 nt, Mycobacterium avium subsp. paratuberculosis
gacgacggcuccuaugucggugc

SEQ ID NO: 929467 - RNA, 20 nt, Mycobacterium avium subsp. paratuberculosis
gacgacgggcagggugaccg

SEQ ID NO: 929468 - RNA, 15 nt, Mycobacterium avium subsp. paratuberculosis
gacgacgucgaccgc

SEQ ID NO: 929469 - RNA, 17 nt, Mycobacterium avium subsp. paratuberculosis
gacgacgucgaccgcgc

SEQ ID NO: 929470 - RNA, 15 nt, Mycobacterium avium subsp. paratuberculosis
gacgacgucgacgac

SEQ ID NO: 929471 - RNA, 17 nt, Mycobacterium avium subsp. paratuberculosis
gacgacgucgacgaccc

SEQ ID NO: 929472 - RNA, 14 nt, Mycobacterium avium subsp. paratuberculosis
gacgacgucgaugu

SEQ ID NO: 929473 - RNA, 20 nt, Mycobacterium avium subsp. paratuberculosis
gacgacgucgaugugcucgg

SEQ ID NO: 929474 - RNA, 16 nt, Mycobacterium avium subsp. paratuberculosis
gacgagaucagcacca

SEQ ID NO: 929475 - RNA, 18 nt, Mycobacterium avium subsp. paratuberculosis
gacgacucguucgacgcc

SEQ ID NO: 929476 - RNA, 15 nt, Mycobacterium avium subsp. paratuberculosis
gacgacgggugggug

SEQ ID NO: 929477 - RNA, 23 nt, Mycobacterium avium subsp. paratuberculosis
gacgacggucuucccgccgccgu

SEQ ID NO: 929478 - RNA, 16 nt, Mycobacterium avium subsp. paratuberculosis
gacgacgugacgaccu

SEQ ID NO: 929479 - RNA, 23 nt, Mycobacterium avium subsp. paratuberculosis
gacgacgugacgaccuggucgcc

SEQ ID NO: 929480 - RNA, 23 nt, Mycobacterium avium subsp. paratuberculosis
gacgacgugauaguggucgucgu

SEQ ID NO: 929481 - RNA, 23 nt, Mycobacterium avium subsp. paratuberculosis
gacgacgugcccuuccccggcgg

SEQ ID NO: 929482 - RNA, 14 nt, Mycobacterium avium subsp. paratuberculosis
gacgacguggugga

SEQ ID NO: 929483 - RNA, 20 nt, Mycobacterium avium subsp. paratuberculosis
gacgacgugguggaugaugc

SEQ ID NO: 929484 - RNA, 20 nt, Mycobacterium avium subsp. paratuberculosis
gacgacguugcgggccaggu

SEQ ID NO: 929485 - RNA, 16 nt, Mycobacterium avium subsp. paratuberculosis
gacgacguuggccagc

SEQ ID NO: 929486 - RNA, 17 nt, Mycobacterium avium subsp. paratuberculosis
gacgacguuggccagca

SEQ ID NO: 929487 - RNA, 22 nt, Mycobacterium avium subsp. paratuberculosis
gacgacguuggccagcaccgcg

SEQ ID NO: 929488 - RNA, 13 nt, Mycobacterium avium subsp. paratuberculosis
gacgagucgccgu

SEQ ID NO: 929489 - RNA, 22 nt, Mycobacterium avium subsp. paratuberculosis
gacgaggugaugccguccagca

SEQ ID NO: 929490 - RNA, 20 nt, Mycobacterium avium subsp. paratuberculosis
gacgagguugucccgggcga

SEQ ID NO: 929491 - RNA, 21 nt, Mycobacterium avium subsp. paratuberculosis
gacgaggagaccuccugcugg

SEQ ID NO: 929492 - RNA, 22 nt, Mycobacterium avium subsp. paratuberculosis
gacgacugggugcgcgggcgcc

SEQ ID NO: 929493 - RNA, 13 nt, Mycobacterium avium subsp. paratuberculosis
gacgaggcccacg

SEQ ID NO: 929494 - RNA, 14 nt, Mycobacterium avium subsp. paratuberculosis
gacgaggcccacga

SEQ ID NO: 929495 - RNA, 16 nt, Mycobacterium avium subsp. paratuberculosis
gacgaggcccgcaaga

SEQ ID NO: 929496 - RNA, 14 nt, Mycobacterium avium subsp. paratuberculosis
gacgagcucaccgc

SEQ ID NO: 929497 - RNA, 16 nt, Mycobacterium avium subsp. paratuberculosis
gacgagcucaccgccg

SEQ ID NO: 929498 - RNA, 17 nt, Mycobacterium avium subsp. paratuberculosis
gacgagcucaccgccga

SEQ ID NO: 929499 - RNA, 14 nt, Mycobacterium avium subsp. paratuberculosis
gacgagccgccgcg

SEQ ID NO: 929500 - RNA, 14 nt, Mycobacterium avium subsp. paratuberculosis
gacgagcagccgca

SEQ ID NO: 929501 - RNA, 14 nt, Mycobacterium avium subsp. paratuberculosis
gacgagcaggcuga

SEQ ID NO: 929502 - RNA, 22 nt, Mycobacterium avium subsp. paratuberculosis
gacgagcaggcugaucucggcg

SEQ ID NO: 929503 - RNA, 14 nt, Mycobacterium avium subsp. paratuberculosis
gacgagccgacgua

SEQ ID NO: 929504 - RNA, 14 nt, Mycobacterium avium subsp. paratuberculosis
gacgaucagcacgu

SEQ ID NO: 929505 - RNA, 20 nt, Mycobacterium avium subsp. paratuberculosis
gacgaucagcacgucgcggc

SEQ ID NO: 929506 - RNA, 12 nt, Mycobacterium avium subsp. paratuberculosis
gacgaucagcag

SEQ ID NO: 929507 - RNA, 15 nt, Mycobacterium avium subsp. paratuberculosis
gacgaucagcagccg

SEQ ID NO: 929508 - RNA, 23 nt, Mycobacterium avium subsp. paratuberculosis
gacgaucagcagccgggccugcg

SEQ ID NO: 929509 - RNA, 17 nt, Mycobacterium avium subsp. paratuberculosis
gacgauccacagcgcga

SEQ ID NO: 929510 - RNA, 18 nt, Mycobacterium avium subsp. paratuberculosis
gacgauccgcgcccuggu

SEQ ID NO: 929511 - RNA, 17 nt, Mycobacterium avium subsp. paratuberculosis
gacgauccgcgccgcga

SEQ ID NO: 929512 - RNA, 14 nt, Mycobacterium avium subsp. paratuberculosis
gacgauccgggccg

SEQ ID NO: 929513 - RNA, 16 nt, Mycobacterium avium subsp. paratuberculosis
gacgauccgggccggu

SEQ ID NO: 929514 - RNA, 14 nt, Mycobacterium avium subsp. paratuberculosis
gacgauccggucga

SEQ ID NO: 929515 - RNA, 20 nt, Mycobacterium avium subsp. paratuberculosis
gacgaugaaaccccagccgg

SEQ ID NO: 929516 - RNA, 23 nt, Mycobacterium avium subsp. paratuberculosis
gacgaugaaauccgggaccggcg

SEQ ID NO: 929517 - RNA, 19 nt, Mycobacterium avium subsp. paratuberculosis
gacgaugaacagucggccg

SEQ ID NO: 929518 - RNA, 19 nt, Mycobacterium avium subsp. paratuberculosis
gacgaucucgugggucagc

SEQ ID NO: 929519 - RNA, 13 nt, Mycobacterium avium subsp. paratuberculosis
gacgaucuggcgc

SEQ ID NO: 929520 - RNA, 19 nt, Mycobacterium avium subsp. paratuberculosis
gacgaucuggcgcaucagc

SEQ ID NO: 929521 - RNA, 21 nt, Mycobacterium avium subsp. paratuberculosis
gacgaucaccggcuugccgau

SEQ ID NO: 929522 - RNA, 12 nt, Mycobacterium avium subsp. paratuberculosis
gacgaucgcgac

SEQ ID NO: 929523 - RNA, 19 nt, Mycobacterium avium subsp. paratuberculosis
gacgaucgcgccggccgcc

SEQ ID NO: 929524 - RNA, 16 nt, Mycobacterium avium subsp. paratuberculosis
gacgaucggcucgagc

SEQ ID NO: 929525 - RNA, 12 nt, Mycobacterium avium subsp. paratuberculosis
gacgaucgucga

SEQ ID NO: 929526 - RNA, 14 nt, Mycobacterium avium subsp. paratuberculosis
gacgaucgucgacg

SEQ ID NO: 929527 - RNA, 17 nt, Mycobacterium avium subsp. paratuberculosis
gacgaugagggccagca

SEQ ID NO: 929528 - RNA, 19 nt, Mycobacterium avium subsp. paratuberculosis
gacgaugaugucgcccggc

SEQ ID NO: 929529 - RNA, 20 nt, Mycobacterium avium subsp. paratuberculosis
gacgaugaugucgcccggcg

SEQ ID NO: 929530 - RNA, 17 nt, Mycobacterium avium subsp. paratuberculosis
gacgaugaugucggccg

SEQ ID NO: 929531 - RNA, 19 nt, Mycobacterium avium subsp. paratuberculosis
gacgaugaugucggccggc

SEQ ID NO: 929532 - RNA, 20 nt, Mycobacterium avium subsp. paratuberculosis
gacgaugaugucggccggca

SEQ ID NO: 929533 - RNA, 14 nt, Mycobacterium avium subsp. paratuberculosis
aacgucacggcgag

SEQ ID NO: 929534 - RNA, 22 nt, Mycobacterium avium subsp. paratuberculosis
aacgucacggcgaggauggcga

SEQ ID NO: 929535 - RNA, 17 nt, Mycobacterium avium subsp. paratuberculosis
gacgaucucgccguccu

SEQ ID NO: 929536 - RNA, 18 nt, Mycobacterium avium subsp. paratuberculosis
aacgguuuuucccagcgg

SEQ ID NO: 929537 - RNA, 22 nt, Mycobacterium avium subsp. paratuberculosis
aacgguuuuucccagcggccga

SEQ ID NO: 929538 - RNA, 17 nt, Mycobacterium avium subsp. paratuberculosis
gacgcaaaagccccgcg

SEQ ID NO: 929539 - RNA, 21 nt, Mycobacterium avium subsp. paratuberculosis
gacgcaaaagccccgcgacac

SEQ ID NO: 929540 - RNA, 21 nt, Mycobacterium avium subsp. paratuberculosis
gacgauugugugccaagcggu

SEQ ID NO: 929541 - RNA, 13 nt, Mycobacterium avium subsp. paratuberculosis
gacgauucgcgau

SEQ ID NO: 929542 - RNA, 17 nt, Mycobacterium avium subsp. paratuberculosis
gacgauucgcgaucaac

SEQ ID NO: 929543 - RNA, 15 nt, Mycobacterium avium subsp. paratuberculosis
gacgauguuggcgac

SEQ ID NO: 929544 - RNA, 17 nt, Mycobacterium avium subsp. paratuberculosis
gacgauguuggcgacga

SEQ ID NO: 929545 - RNA, 14 nt, Mycobacterium avium subsp. paratuberculosis
gacgaugucgucgc

SEQ ID NO: 929546 - RNA, 16 nt, Mycobacterium avium subsp. paratuberculosis
gacgauguccgccggc

SEQ ID NO: 929547 - RNA, 19 nt, Mycobacterium avium subsp. paratuberculosis
gacgaugucgacccgcggc

SEQ ID NO: 929548 - RNA, 20 nt, Mycobacterium avium subsp. paratuberculosis
gacgaugucgaugacggcgg

SEQ ID NO: 929549 - RNA, 14 nt, Mycobacterium avium subsp. paratuberculosis
gacgcacgccggcg

SEQ ID NO: 929550 - RNA, 15 nt, Mycobacterium avium subsp. paratuberculosis
gacgcacgccggcgg

SEQ ID NO: 929551 - RNA, 16 nt, Mycobacterium avium subsp. paratuberculosis
gacgcacgccggcggg

SEQ ID NO: 929552 - RNA, 19 nt, Mycobacterium avium subsp. paratuberculosis
gacgcacgccggcgggggu

SEQ ID NO: 929553 - RNA, 20 nt, Mycobacterium avium subsp. paratuberculosis
gacgcacgccggcggggguu

SEQ ID NO: 929554 - RNA, 16 nt, Mycobacterium avium subsp. paratuberculosis
gacgcaccacgagcag

SEQ ID NO: 929555 - RNA, 20 nt, Mycobacterium avium subsp. paratuberculosis
gacgcaccacgagcagccga

SEQ ID NO: 929556 - RNA, 20 nt, Mycobacterium avium subsp. paratuberculosis
gacgcaccucgcucagcccg

SEQ ID NO: 929557 - RNA, 14 nt, Mycobacterium avium subsp. paratuberculosis
gacgaugcccagcc

SEQ ID NO: 929558 - RNA, 17 nt, Mycobacterium avium subsp. paratuberculosis
gacgaugcccagccccu

SEQ ID NO: 929559 - RNA, 16 nt, Mycobacterium avium subsp. paratuberculosis
gacgaugcccggggug

SEQ ID NO: 929560 - RNA, 21 nt, Mycobacterium avium subsp. paratuberculosis
gacgaugcccggggugcuggc

SEQ ID NO: 929561 - RNA, 14 nt, Mycobacterium avium subsp. paratuberculosis
gacgaugccgcggc

SEQ ID NO: 929562 - RNA, 16 nt, Mycobacterium avium subsp. paratuberculosis
gacgaugccggccggg

SEQ ID NO: 929563 - RNA, 14 nt, Mycobacterium avium subsp. paratuberculosis
gacgaugcgcugcu

SEQ ID NO: 929564 - RNA, 17 nt, Mycobacterium avium subsp. paratuberculosis
gacgaugcggggccggc

SEQ ID NO: 929565 - RNA, 18 nt, Mycobacterium avium subsp. paratuberculosis
gacgaugcggggccggcg

SEQ ID NO: 929566 - RNA, 23 nt, Mycobacterium avium subsp. paratuberculosis
gacgaugcggggccggcggcggc

SEQ ID NO: 929567 - RNA, 18 nt, Mycobacterium avium subsp. paratuberculosis
gacgaugcggggcggcgg

SEQ ID NO: 929568 - RNA, 14 nt, Mycobacterium avium subsp. paratuberculosis
gacgaugcgcaccc

SEQ ID NO: 929569 - RNA, 16 nt, Mycobacterium avium subsp. paratuberculosis
gacgaugcgcaccccc

SEQ ID NO: 929570 - RNA, 13 nt, Mycobacterium avium subsp. paratuberculosis
gacgaugcggccg

SEQ ID NO: 929571 - RNA, 15 nt, Mycobacterium avium subsp. paratuberculosis
gacgaugcguucggg

SEQ ID NO: 929572 - RNA, 18 nt, Mycobacterium avium subsp. paratuberculosis
gacgauggacgaagugcc

SEQ ID NO: 929573 - RNA, 22 nt, Mycobacterium avium subsp. paratuberculosis
gacgauggccaggcccagcccg

SEQ ID NO: 929574 - RNA, 14 nt, Mycobacterium avium subsp. paratuberculosis
gacgauggcccgga

SEQ ID NO: 929575 - RNA, 20 nt, Mycobacterium avium subsp. paratuberculosis
gacgauggcccggaccgccg

SEQ ID NO: 929576 - RNA, 15 nt, Mycobacterium avium subsp. paratuberculosis
gacgauggcgaccgc

SEQ ID NO: 929577 - RNA, 16 nt, Mycobacterium avium subsp. paratuberculosis
gacgauggcgaccgcg

SEQ ID NO: 929578 - RNA, 17 nt, Mycobacterium avium subsp. paratuberculosis
gacgauggcgaccgcgc

SEQ ID NO: 929579 - RNA, 14 nt, Mycobacterium avium subsp. paratuberculosis
gacgaugggccgcc

SEQ ID NO: 929580 - RNA, 17 nt, Mycobacterium avium subsp. paratuberculosis
gacgaugggccgcccgc

SEQ ID NO: 929581 - RNA, 20 nt, Mycobacterium avium subsp. paratuberculosis
gacgaugggccgcccgcugg

SEQ ID NO: 929582 - RNA, 19 nt, Mycobacterium avium subsp. paratuberculosis
gacgccagcggcagcgcca

SEQ ID NO: 929583 - RNA, 15 nt, Mycobacterium avium subsp. paratuberculosis
gacgccagcgggccg

SEQ ID NO: 929584 - RNA, 18 nt, Mycobacterium avium subsp. paratuberculosis
gacgccagcgggccgugc

SEQ ID NO: 929585 - RNA, 13 nt, Mycobacterium avium subsp. paratuberculosis
gacgccagcugcc

SEQ ID NO: 929586 - RNA, 16 nt, Mycobacterium avium subsp. paratuberculosis
gacgccagcugccgcg

SEQ ID NO: 929587 - RNA, 19 nt, Mycobacterium avium subsp. paratuberculosis
gacgccagcugccgcgacu

SEQ ID NO: 929588 - RNA, 20 nt, Mycobacterium avium subsp. paratuberculosis
gacgccagcacguggccggg

SEQ ID NO: 929589 - RNA, 24 nt, Mycobacterium avium subsp. paratuberculosis
gacgccagcacguggccgggcucg

SEQ ID NO: 929590 - RNA, 15 nt, Mycobacterium avium subsp. paratuberculosis
gacgccagcaugauc

SEQ ID NO: 929591 - RNA, 22 nt, Mycobacterium avium subsp. paratuberculosis
gacgccagcaugaucaccgcca

SEQ ID NO: 929592 - RNA, 23 nt, Mycobacterium avium subsp. paratuberculosis
gacgccagcaugaucaccgccag

SEQ ID NO: 929593 - RNA, 23 nt, Mycobacterium avium subsp. paratuberculosis
gacgccaccaucgaguaggccca

SEQ ID NO: 929594 - RNA, 23 nt, Mycobacterium avium subsp. paratuberculosis
gacgcccaggugcacccgaugcu

SEQ ID NO: 929595 - RNA, 15 nt, Mycobacterium avium subsp. paratuberculosis
gacgcccagcgcggc

SEQ ID NO: 929596 - RNA, 16 nt, Mycobacterium avium subsp. paratuberculosis
gacgcccagcgcggcg

SEQ ID NO: 929597 - RNA, 21 nt, Mycobacterium avium subsp. paratuberculosis
gacgcccaacuacccgccgac

SEQ ID NO: 929598 - RNA, 15 nt, Mycobacterium avium subsp. paratuberculosis
gacgcccacagcgcc

SEQ ID NO: 929599 - RNA, 17 nt, Mycobacterium avium subsp. paratuberculosis
gacgcccacagcgccag

SEQ ID NO: 929600 - RNA, 18 nt, Mycobacterium avium subsp. paratuberculosis
gacgcccacagcgccagc

SEQ ID NO: 929601 - RNA, 19 nt, Mycobacterium avium subsp. paratuberculosis
gacgcccacagcgccagca

SEQ ID NO: 929602 - RNA, 21 nt, Mycobacterium avium subsp. paratuberculosis
gacgcccacagcgccagcacg

SEQ ID NO: 929603 - RNA, 22 nt, Mycobacterium avium subsp. paratuberculosis
gacgcccacagcgccagcacgg

SEQ ID NO: 929604 - RNA, 19 nt, Mycobacterium avium subsp. paratuberculosis
gacgcccagaacugggccg

SEQ ID NO: 929605 - RNA, 23 nt, Mycobacterium avium subsp. paratuberculosis
gacgcccagaacugggccgccgu

SEQ ID NO: 929606 - RNA, 23 nt, Mycobacterium avium subsp. paratuberculosis
gacgccaugucgaugucgacgcc

SEQ ID NO: 929607 - RNA, 18 nt, Mycobacterium avium subsp. paratuberculosis
gacgccaguucgucggcc

SEQ ID NO: 929608 - RNA, 19 nt, Mycobacterium avium subsp. paratuberculosis
gacgccaguucgucggccg

SEQ ID NO: 929609 - RNA, 22 nt, Mycobacterium avium subsp. paratuberculosis
gacgccaguucgucggccgucg

SEQ ID NO: 929610 - RNA, 20 nt, Mycobacterium avium subsp. paratuberculosis
gacgcauucaaugucgcccu

SEQ ID NO: 929611 - RNA, 14 nt, Mycobacterium avium subsp. paratuberculosis
gacgcagcgaucgg

SEQ ID NO: 929612 - RNA, 14 nt, Mycobacterium avium subsp. paratuberculosis
gacgcaucaccacg

SEQ ID NO: 929613 - RNA, 15 nt, Mycobacterium avium subsp. paratuberculosis
gacgcaucaccacgc

SEQ ID NO: 929614 - RNA, 16 nt, Mycobacterium avium subsp. paratuberculosis
gacgcauccacggccg

SEQ ID NO: 929615 - RNA, 13 nt, Mycobacterium avium subsp. paratuberculosis
gacgcacgucggc

SEQ ID NO: 929616 - RNA, 16 nt, Mycobacterium avium subsp. paratuberculosis
gacgccgaacugccgg

SEQ ID NO: 929617 - RNA, 21 nt, Mycobacterium avium subsp. paratuberculosis
gacgccgaacugccggaccag

SEQ ID NO: 929618 - RNA, 18 nt, Mycobacterium avium subsp. paratuberculosis
gacgccgaagaucagcgc

SEQ ID NO: 929619 - RNA, 17 nt, Mycobacterium avium subsp. paratuberculosis
gacgcccuuggcgccca

SEQ ID NO: 929620 - RNA, 19 nt, Mycobacterium avium subsp. paratuberculosis
gacgcccuuggcgcccagc

SEQ ID NO: 929621 - RNA, 11 nt, Mycobacterium avium subsp. paratuberculosis
gacgccgacgc

SEQ ID NO: 929622 - RNA, 14 nt, Mycobacterium avium subsp. paratuberculosis
gacgccgacgccca

SEQ ID NO: 929623 - RNA, 16 nt, Mycobacterium avium subsp. paratuberculosis
gacgccgacgcccagc

SEQ ID NO: 929624 - RNA, 12 nt, Mycobacterium avium subsp. paratuberculosis
gacgccgacgua

SEQ ID NO: 929625 - RNA, 13 nt, Mycobacterium avium subsp. paratuberculosis
gacgccgaccgcg

SEQ ID NO: 929626 - RNA, 15 nt, Mycobacterium avium subsp. paratuberculosis
gacgccgaccgcggu

SEQ ID NO: 929627 - RNA, 16 nt, Mycobacterium avium subsp. paratuberculosis
gacgccgaauccgggc

SEQ ID NO: 929628 - RNA, 17 nt, Mycobacterium avium subsp. paratuberculosis
gacgccgaauccgggca

SEQ ID NO: 929629 - RNA, 16 nt, Mycobacterium avium subsp. paratuberculosis
gacgccgacaccagcg

SEQ ID NO: 929630 - RNA, 20 nt, Mycobacterium avium subsp. paratuberculosis
gacgccgacaucgcggcgau

SEQ ID NO: 929631 - RNA, 15 nt, Mycobacterium avium subsp. paratuberculosis
gacgcccugccacag

SEQ ID NO: 929632 - RNA, 16 nt, Mycobacterium avium subsp. paratuberculosis
gacgcccugccacagc

SEQ ID NO: 929633 - RNA, 20 nt, Mycobacterium avium subsp. paratuberculosis
gacgcccugccacagcgaca

SEQ ID NO: 929634 - RNA, 16 nt, Mycobacterium avium subsp. paratuberculosis
gacgcccuccuggcgg

SEQ ID NO: 929635 - RNA, 21 nt, Mycobacterium avium subsp. paratuberculosis
gacgcccuccuggcggguggc

SEQ ID NO: 929636 - RNA, 23 nt, Mycobacterium avium subsp. paratuberculosis
gacgcccuccuggcggguggcga

SEQ ID NO: 929637 - RNA, 13 nt, Mycobacterium avium subsp. paratuberculosis
gacgcccggcgag

SEQ ID NO: 929638 - RNA, 22 nt, Mycobacterium avium subsp. paratuberculosis
gacgcccccggugacgauccgg

SEQ ID NO: 929639 - RNA, 15 nt, Mycobacterium avium subsp. paratuberculosis
gacgcccgcgacccg

SEQ ID NO: 929640 - RNA, 19 nt, Mycobacterium avium subsp. paratuberculosis
gacgcccgcgacccgaacu

SEQ ID NO: 929641 - RNA, 14 nt, Mycobacterium avium subsp. paratuberculosis
gacgcccggcgccg

SEQ ID NO: 929642 - RNA, 16 nt, Mycobacterium avium subsp. paratuberculosis
gacgcccggcgccggc

SEQ ID NO: 929643 - RNA, 17 nt, Mycobacterium avium subsp. paratuberculosis
gacgcccggcgccggcg

SEQ ID NO: 929644 - RNA, 19 nt, Mycobacterium avium subsp. paratuberculosis
gacgcccggcuucgccgcc

SEQ ID NO: 929645 - RNA, 24 nt, Mycobacterium avium subsp. paratuberculosis
gacgcccggcuucgccgccgcacc

SEQ ID NO: 929646 - RNA, 14 nt, Mycobacterium avium subsp. paratuberculosis
gacgcccgucccgc

SEQ ID NO: 929647 - RNA, 15 nt, Mycobacterium avium subsp. paratuberculosis
gacgcccgucccgcc

SEQ ID NO: 929648 - RNA, 16 nt, Mycobacterium avium subsp. paratuberculosis
gacgccgcgcuggccg

SEQ ID NO: 929649 - RNA, 18 nt, Mycobacterium avium subsp. paratuberculosis
gacgccgcgccgcccggc

SEQ ID NO: 929650 - RNA, 19 nt, Mycobacterium avium subsp. paratuberculosis
gacgccgcgccgcccggcg

SEQ ID NO: 929651 - RNA, 21 nt, Mycobacterium avium subsp. paratuberculosis
gacgccgcgccgcccggcgau

SEQ ID NO: 929652 - RNA, 18 nt, Mycobacterium avium subsp. paratuberculosis
gacgccgcggugcagcag

SEQ ID NO: 929653 - RNA, 14 nt, Mycobacterium avium subsp. paratuberculosis
gacgccgcgguugg

SEQ ID NO: 929654 - RNA, 23 nt, Mycobacterium avium subsp. paratuberculosis
gacgccgcgguuggucaccaggu

SEQ ID NO: 929655 - RNA, 15 nt, Mycobacterium avium subsp. paratuberculosis
gacgccgccgccgag

SEQ ID NO: 929656 - RNA, 23 nt, Mycobacterium avium subsp. paratuberculosis
gacgccgccgccgagcucggcca

SEQ ID NO: 929657 - RNA, 21 nt, Mycobacterium avium subsp. paratuberculosis
gacgccgccgucguagccgcg

SEQ ID NO: 929658 - RNA, 13 nt, Mycobacterium avium subsp. paratuberculosis
gacgccgccgugg

SEQ ID NO: 929659 - RNA, 19 nt, Mycobacterium avium subsp. paratuberculosis
gacgccgccguggacgagu

SEQ ID NO: 929660 - RNA, 12 nt, Mycobacterium avium subsp. paratuberculosis
gacgccgcgcac

SEQ ID NO: 929661 - RNA, 14 nt, Mycobacterium avium subsp. paratuberculosis
gacgccgcgcacga

SEQ ID NO: 929662 - RNA, 14 nt, Mycobacterium avium subsp. paratuberculosis
gacgccgcgcagcg

SEQ ID NO: 929663 - RNA, 13 nt, Mycobacterium avium subsp. paratuberculosis
gacgccgccgaac

SEQ ID NO: 929664 - RNA, 15 nt, Mycobacterium avium subsp. paratuberculosis
gacgccgccgaaccc

SEQ ID NO: 929665 - RNA, 23 nt, Mycobacterium avium subsp. paratuberculosis
gacgccgccgaaccccagcuccg

SEQ ID NO: 929666 - RNA, 21 nt, Mycobacterium avium subsp. paratuberculosis
gacgccgagcagcucagccgc

SEQ ID NO: 929667 - RNA, 24 nt, Mycobacterium avium subsp. paratuberculosis
gacgccgagcagcucagccgccug

SEQ ID NO: 929668 - RNA, 14 nt, Mycobacterium avium subsp. paratuberculosis
gacgccgauccgca

SEQ ID NO: 929669 - RNA, 15 nt, Mycobacterium avium subsp. paratuberculosis
gacgccgauccgcag

SEQ ID NO: 929670 - RNA, 20 nt, Mycobacterium avium subsp. paratuberculosis
gacgccgauccgcagccgcu

SEQ ID NO: 929671 - RNA, 13 nt, Mycobacterium avium subsp. paratuberculosis
gacgccgagcagc

SEQ ID NO: 929672 - RNA, 13 nt, Mycobacterium avium subsp. paratuberculosis
gacgccgauggug

SEQ ID NO: 929673 - RNA, 17 nt, Mycobacterium avium subsp. paratuberculosis
gacgccgaugugcucgg

SEQ ID NO: 929674 - RNA, 12 nt, Mycobacterium avium subsp. paratuberculosis
gacgccgcacga

SEQ ID NO: 929675 - RNA, 14 nt, Mycobacterium avium subsp. paratuberculosis
gacgccgcacgcga

SEQ ID NO: 929676 - RNA, 20 nt, Mycobacterium avium subsp. paratuberculosis
gacgccgcacgcgaccgcgu

SEQ ID NO: 929677 - RNA, 14 nt, Mycobacterium avium subsp. paratuberculosis
gacgccucggugcg

SEQ ID NO: 929678 - RNA, 17 nt, Mycobacterium avium subsp. paratuberculosis
gacgccucaggcgagca

SEQ ID NO: 929679 - RNA, 12 nt, Mycobacterium avium subsp. paratuberculosis
gacgccucgcgc

SEQ ID NO: 929680 - RNA, 15 nt, Mycobacterium avium subsp. paratuberculosis
gacgccucgcgcagc

SEQ ID NO: 929681 - RNA, 17 nt, Mycobacterium avium subsp. paratuberculosis
gacgccucgcgcagcgc

SEQ ID NO: 929682 - RNA, 18 nt, Mycobacterium avium subsp. paratuberculosis
gacgccucgcgcagcgcg

SEQ ID NO: 929683 - RNA, 13 nt, Mycobacterium avium subsp. paratuberculosis
gacgccguggauc

SEQ ID NO: 929684 - RNA, 13 nt, Mycobacterium avium subsp. paratuberculosis
gacgccguggucc

SEQ ID NO: 929685 - RNA, 18 nt, Mycobacterium avium subsp. paratuberculosis
gacgccgugguccagccg

SEQ ID NO: 929686 - RNA, 17 nt, Mycobacterium avium subsp. paratuberculosis
gacgccguccgacgugc

SEQ ID NO: 929687 - RNA, 19 nt, Mycobacterium avium subsp. paratuberculosis
gacgcgaaagcacccgaca

SEQ ID NO: 929688 - RNA, 20 nt, Mycobacterium avium subsp. paratuberculosis
gacgcgaaagcacccgacac

SEQ ID NO: 929689 - RNA, 19 nt, Mycobacterium avium subsp. paratuberculosis
gacgcgaaagcagcguucg

SEQ ID NO: 929690 - RNA, 20 nt, Mycobacterium avium subsp. paratuberculosis
gacgcgaccaggcccagcgg

SEQ ID NO: 929691 - RNA, 15 nt, Mycobacterium avium subsp. paratuberculosis
gacgcgaagucgccg

SEQ ID NO: 929692 - RNA, 19 nt, Mycobacterium avium subsp. paratuberculosis
gacgcgaaugucgaccacc

SEQ ID NO: 929693 - RNA, 21 nt, Mycobacterium avium subsp. paratuberculosis
gacgcgaaugucgaccaccgg

SEQ ID NO: 929694 - RNA, 12 nt, Mycobacterium avium subsp. paratuberculosis
gacgccugccgc

SEQ ID NO: 929695 - RNA, 13 nt, Mycobacterium avium subsp. paratuberculosis
gacgccugcggcc

SEQ ID NO: 929696 - RNA, 15 nt, Mycobacterium avium subsp. paratuberculosis
gacgccugcggccca

SEQ ID NO: 929697 - RNA, 23 nt, Mycobacterium avium subsp. paratuberculosis
gacgccgucacggaucgcccacc

SEQ ID NO: 929698 - RNA, 11 nt, Mycobacterium avium subsp. paratuberculosis
gacgccggucg

SEQ ID NO: 929699 - RNA, 13 nt, Mycobacterium avium subsp. paratuberculosis
gacgccggucgcu

SEQ ID NO: 929700 - RNA, 15 nt, Mycobacterium avium subsp. paratuberculosis
gacgccggucgcugc

SEQ ID NO: 929701 - RNA, 17 nt, Mycobacterium avium subsp. paratuberculosis
gacgccggucgcugcga

SEQ ID NO: 929702 - RNA, 22 nt, Mycobacterium avium subsp. paratuberculosis
gacgccggugaaaccggcgccg

SEQ ID NO: 929703 - RNA, 13 nt, Mycobacterium avium subsp. paratuberculosis
gacgccgggcagc

SEQ ID NO: 929704 - RNA, 16 nt, Mycobacterium avium subsp. paratuberculosis
gacgccgggcagcgcg

SEQ ID NO: 929705 - RNA, 17 nt, Mycobacterium avium subsp. paratuberculosis
gacgccgggcagcgcgc

SEQ ID NO: 929706 - RNA, 13 nt, Mycobacterium avium subsp. paratuberculosis
gacgccgggccgc

SEQ ID NO: 929707 - RNA, 17 nt, Mycobacterium avium subsp. paratuberculosis
gacgccgggccgccgcg

SEQ ID NO: 929708 - RNA, 12 nt, Mycobacterium avium subsp. paratuberculosis
gacgccgggcgc

SEQ ID NO: 929709 - RNA, 15 nt, Mycobacterium avium subsp. paratuberculosis
gacgccgggcgcccg

SEQ ID NO: 929710 - RNA, 16 nt, Mycobacterium avium subsp. paratuberculosis
gacgccgggcgcccgc

SEQ ID NO: 929711 - RNA, 13 nt, Mycobacterium avium subsp. paratuberculosis
gacgccggcagcc

SEQ ID NO: 929712 - RNA, 20 nt, Mycobacterium avium subsp. paratuberculosis
gacgccggccucucgucgac

SEQ ID NO: 929713 - RNA, 21 nt, Mycobacterium avium subsp. paratuberculosis
gacgccggccucucgucgacg

SEQ ID NO: 929714 - RNA, 23 nt, Mycobacterium avium subsp. paratuberculosis
gacgccggccucucgucgacgau

SEQ ID NO: 929715 - RNA, 14 nt, Mycobacterium avium subsp. paratuberculosis
gacgccggccacca

SEQ ID NO: 929716 - RNA, 18 nt, Mycobacterium avium subsp. paratuberculosis
gacgccgcugggcguggu

SEQ ID NO: 929717 - RNA, 18 nt, Mycobacterium avium subsp. paratuberculosis
gacgccgcuguccucguc

SEQ ID NO: 929718 - RNA, 13 nt, Mycobacterium avium subsp. paratuberculosis
gacgccggacagc

SEQ ID NO: 929719 - RNA, 19 nt, Mycobacterium avium subsp. paratuberculosis
gacgccggacagcuggcgg

SEQ ID NO: 929720 - RNA, 15 nt, Mycobacterium avium subsp. paratuberculosis
gacgccgcucggcca

SEQ ID NO: 929721 - RNA, 17 nt, Mycobacterium avium subsp. paratuberculosis
gacgccgcucggccagc

SEQ ID NO: 929722 - RNA, 18 nt, Mycobacterium avium subsp. paratuberculosis
gacgccgcucggccagcg

SEQ ID NO: 929723 - RNA, 19 nt, Mycobacterium avium subsp. paratuberculosis
gacgccgcucggccagcgc

SEQ ID NO: 929724 - RNA, 22 nt, Mycobacterium avium subsp. paratuberculosis
gacgccgcucggccagcgcagc

SEQ ID NO: 929725 - RNA, 14 nt, Mycobacterium avium subsp. paratuberculosis
gacgccgcugcgug

SEQ ID NO: 929726 - RNA, 13 nt, Mycobacterium avium subsp. paratuberculosis
gaaaucaacgcgc

SEQ ID NO: 929727 - RNA, 16 nt, Mycobacterium avium subsp. paratuberculosis
gaaacgucgcagcccg

SEQ ID NO: 929728 - RNA, 19 nt, Mycobacterium avium subsp. paratuberculosis
gaaacuagcuucacgcucg

SEQ ID NO: 929729 - RNA, 21 nt, Mycobacterium avium subsp. paratuberculosis
gaaacuagcuucacgcucggc

SEQ ID NO: 929730 - RNA, 20 nt, Mycobacterium avium subsp. paratuberculosis
gaaacuagcuucacguucgg

SEQ ID NO: 929731 - RNA, 19 nt, Mycobacterium avium subsp. paratuberculosis
gaaacuaacuucacgcucg

SEQ ID NO: 929732 - RNA, 19 nt, Mycobacterium avium subsp. paratuberculosis
gaaaccccacgaucgcguc

SEQ ID NO: 929733 - RNA, 15 nt, Mycobacterium avium subsp. paratuberculosis
gaaaccccagccggc

SEQ ID NO: 929734 - RNA, 23 nt, Mycobacterium avium subsp. paratuberculosis
gaaacgcgcgcaguugcgcggcg

SEQ ID NO: 929735 - RNA, 14 nt, Mycobacterium avium subsp. paratuberculosis
gaaacggaugggcg

SEQ ID NO: 929736 - RNA, 19 nt, Mycobacterium avium subsp. paratuberculosis
gaaacggcugcugcgcggc

SEQ ID NO: 929737 - RNA, 20 nt, Mycobacterium avium subsp. paratuberculosis
gaaacggcugcugcgcggca

SEQ ID NO: 929738 - RNA, 13 nt, Mycobacterium avium subsp. paratuberculosis
gaaaugcccgcgc

SEQ ID NO: 929739 - RNA, 22 nt, Mycobacterium avium subsp. paratuberculosis
gaaaugccgugccagccggccg

SEQ ID NO: 929740 - RNA, 16 nt, Mycobacterium avium subsp. paratuberculosis
gaacaacagggccgcg

SEQ ID NO: 929741 - RNA, 14 nt, Mycobacterium avium subsp. paratuberculosis
gaacaaccgcagcg

SEQ ID NO: 929742 - RNA, 17 nt, Mycobacterium avium subsp. paratuberculosis
gaacaaccgcagcggcu

SEQ ID NO: 929743 - RNA, 17 nt, Mycobacterium avium subsp. paratuberculosis
gaacaccuccucggugu

SEQ ID NO: 929744 - RNA, 23 nt, Mycobacterium avium subsp. paratuberculosis
gaacaccuccucgguguacagcg

SEQ ID NO: 929745 - RNA, 23 nt, Mycobacterium avium subsp. paratuberculosis
gaacacaucguggcgcaucaccu

SEQ ID NO: 929746 - RNA, 18 nt, Mycobacterium avium subsp. paratuberculosis
gaacaacggcggaccggc

SEQ ID NO: 929747 - RNA, 15 nt, Mycobacterium avium subsp. paratuberculosis
gaacaacccggccgc

SEQ ID NO: 929748 - RNA, 20 nt, Mycobacterium avium subsp. paratuberculosis
gaacaacgcgcacaacagcc

SEQ ID NO: 929749 - RNA, 20 nt, Mycobacterium avium subsp. paratuberculosis
gaacaacgcggugaccgcgg

SEQ ID NO: 929750 - RNA, 19 nt, Mycobacterium avium subsp. paratuberculosis
gaacacgaacccggcggcc

SEQ ID NO: 929751 - RNA, 17 nt, Mycobacterium avium subsp. paratuberculosis
gaacaccgucaucgugu

SEQ ID NO: 929752 - RNA, 16 nt, Mycobacterium avium subsp. paratuberculosis
gaacaccugcggcggc

SEQ ID NO: 929753 - RNA, 14 nt, Mycobacterium avium subsp. paratuberculosis
gaacacgcaggugc

SEQ ID NO: 929754 - RNA, 20 nt, Mycobacterium avium subsp. paratuberculosis
gaacacgcccagcgccgcgu

SEQ ID NO: 929755 - RNA, 22 nt, Mycobacterium avium subsp. paratuberculosis
gaacacgcccagcgccgcguag

SEQ ID NO: 929756 - RNA, 20 nt, Mycobacterium avium subsp. paratuberculosis
gaacacggccgccuccagca

SEQ ID NO: 929757 - RNA, 16 nt, Mycobacterium avium subsp. paratuberculosis
gaacacggucgccggc

SEQ ID NO: 929758 - RNA, 19 nt, Mycobacterium avium subsp. paratuberculosis
gaacacguacagcggcggc

SEQ ID NO: 929759 - RNA, 17 nt, Mycobacterium avium subsp. paratuberculosis
gaacacguagcgaucgg

SEQ ID NO: 929760 - RNA, 16 nt, Mycobacterium avium subsp. paratuberculosis
gaacacgucggccagc

SEQ ID NO: 929761 - RNA, 19 nt, Mycobacterium avium subsp. paratuberculosis
gaacacgucggccagcgcg

SEQ ID NO: 929762 - RNA, 20 nt, Mycobacterium avium subsp. paratuberculosis
gaacacgucggccagcgcgu

SEQ ID NO: 929763 - RNA, 13 nt, Mycobacterium avium subsp. paratuberculosis
aaccuggccacca

SEQ ID NO: 929764 - RNA, 21 nt, Mycobacterium avium subsp. paratuberculosis
gaaaauguccuccugcgccgg

SEQ ID NO: 929765 - RNA, 18 nt, Mycobacterium avium subsp. paratuberculosis
gaaaauggcugcccggca

SEQ ID NO: 929766 - RNA, 21 nt, Mycobacterium avium subsp. paratuberculosis
gaaacaacgcaaugcgucgcg

SEQ ID NO: 929767 - RNA, 19 nt, Mycobacterium avium subsp. paratuberculosis
gaaaccauugcaccgcaac

SEQ ID NO: 929768 - RNA, 17 nt, Mycobacterium avium subsp. paratuberculosis
gaaaccauuccgccaga

SEQ ID NO: 929769 - RNA, 23 nt, Mycobacterium avium subsp. paratuberculosis
gaaaccaacacccuugcgccgcu

SEQ ID NO: 929770 - RNA, 15 nt, Mycobacterium avium subsp. paratuberculosis
gaaaccaccugccgc

SEQ ID NO: 929771 - RNA, 18 nt, Mycobacterium avium subsp. paratuberculosis
gaaaccaccugccgcaac

SEQ ID NO: 929772 - RNA, 18 nt, Mycobacterium avium subsp. paratuberculosis
aaccguugggcaacgcgg

SEQ ID NO: 929773 - RNA, 20 nt, Mycobacterium avium subsp. paratuberculosis
aaccguuugucccuugggcg

SEQ ID NO: 929774 - RNA, 20 nt, Mycobacterium avium subsp. paratuberculosis
aaccucgcggcggcgucggc

SEQ ID NO: 929775 - RNA, 14 nt, Mycobacterium avium subsp. paratuberculosis
aaccucggcggcgg

SEQ ID NO: 929776 - RNA, 23 nt, Mycobacterium avium subsp. paratuberculosis
gaaaagcgaccagcgcgccggcc

SEQ ID NO: 929777 - RNA, 16 nt, Mycobacterium avium subsp. paratuberculosis
gaaccagcaccgccgc

SEQ ID NO: 929778 - RNA, 17 nt, Mycobacterium avium subsp. paratuberculosis
gaaccagcaccgccgcg

SEQ ID NO: 929779 - RNA, 14 nt, Mycobacterium avium subsp. paratuberculosis
gaaccagcccaggu

SEQ ID NO: 929780 - RNA, 16 nt, Mycobacterium avium subsp. paratuberculosis
gaaccaccgcgcccac

SEQ ID NO: 929781 - RNA, 17 nt, Mycobacterium avium subsp. paratuberculosis
gaaccaggccgcgcugg

SEQ ID NO: 929782 - RNA, 20 nt, Mycobacterium avium subsp. paratuberculosis
gaaccaggccgcgcuggcgc

SEQ ID NO: 929783 - RNA, 21 nt, Mycobacterium avium subsp. paratuberculosis
gaaccaggccgcgcuggcgca

SEQ ID NO: 929784 - RNA, 14 nt, Mycobacterium avium subsp. paratuberculosis
gaaccagcccggcc

SEQ ID NO: 929785 - RNA, 18 nt, Mycobacterium avium subsp. paratuberculosis
gaaccagggcagccagcc

SEQ ID NO: 929786 - RNA, 22 nt, Mycobacterium avium subsp. paratuberculosis
gaaccagggcagccagcccgcg

SEQ ID NO: 929787 - RNA, 16 nt, Mycobacterium avium subsp. paratuberculosis
gaaccaggcgccggcc

SEQ ID NO: 929788 - RNA, 20 nt, Mycobacterium avium subsp. paratuberculosis
gaaccaguucgccaccacgg

SEQ ID NO: 929789 - RNA, 17 nt, Mycobacterium avium subsp. paratuberculosis
gaaccauuugcccagca

SEQ ID NO: 929790 - RNA, 18 nt, Mycobacterium avium subsp. paratuberculosis
gaaccauuugcccagcag

SEQ ID NO: 929791 - RNA, 15 nt, Mycobacterium avium subsp. paratuberculosis
gaacccaccagcgcc

SEQ ID NO: 929792 - RNA, 14 nt, Mycobacterium avium subsp. paratuberculosis
gaacccagcacccc

SEQ ID NO: 929793 - RNA, 14 nt, Mycobacterium avium subsp. paratuberculosis
gaacccagcgccuc

SEQ ID NO: 929794 - RNA, 18 nt, Mycobacterium avium subsp. paratuberculosis
gaacagcgggaacaccac

SEQ ID NO: 929795 - RNA, 14 nt, Mycobacterium avium subsp. paratuberculosis
gaacagcggggugc

SEQ ID NO: 929796 - RNA, 17 nt, Mycobacterium avium subsp. paratuberculosis
gaacagcgucgccgacg

SEQ ID NO: 929797 - RNA, 17 nt, Mycobacterium avium subsp. paratuberculosis
gaacagcucgaccagcc

SEQ ID NO: 929798 - RNA, 16 nt, Mycobacterium avium subsp. paratuberculosis
gaacagcgcggccacc

SEQ ID NO: 929799 - RNA, 23 nt, Mycobacterium avium subsp. paratuberculosis
gaacagcgacgucugcggcucgg

SEQ ID NO: 929800 - RNA, 19 nt, Mycobacterium avium subsp. paratuberculosis
gaacagcgacuccugacgc

SEQ ID NO: 929801 - RNA, 13 nt, Mycobacterium avium subsp. paratuberculosis
gaacagcgcccgg

SEQ ID NO: 929802 - RNA, 12 nt, Mycobacterium avium subsp. paratuberculosis
gaacagcgccgg

SEQ ID NO: 929803 - RNA, 18 nt, Mycobacterium avium subsp. paratuberculosis
gaacagcgaagccacgga

SEQ ID NO: 929804 - RNA, 13 nt, Mycobacterium avium subsp. paratuberculosis
gaacagccgggcc

SEQ ID NO: 929805 - RNA, 15 nt, Mycobacterium avium subsp. paratuberculosis
gaacagccgggccgc

SEQ ID NO: 929806 - RNA, 13 nt, Mycobacterium avium subsp. paratuberculosis
gaacagccggucc

SEQ ID NO: 929807 - RNA, 15 nt, Mycobacterium avium subsp. paratuberculosis
gaacacgugcagcuc

SEQ ID NO: 929808 - RNA, 16 nt, Mycobacterium avium subsp. paratuberculosis
gaacacgugcagcucg

SEQ ID NO: 929809 - RNA, 17 nt, Mycobacterium avium subsp. paratuberculosis
gaacacgugcagcucgg

SEQ ID NO: 929810 - RNA, 23 nt, Mycobacterium avium subsp. paratuberculosis
gaacacguuucggcccuccagca

SEQ ID NO: 929811 - RNA, 16 nt, Mycobacterium avium subsp. paratuberculosis
gaacgacagcaggauc

SEQ ID NO: 929812 - RNA, 14 nt, Mycobacterium avium subsp. paratuberculosis
gaacgacccuuccg

SEQ ID NO: 929813 - RNA, 15 nt, Mycobacterium avium subsp. paratuberculosis
gaacgacgagccguc

SEQ ID NO: 929814 - RNA, 12 nt, Mycobacterium avium subsp. paratuberculosis
gaacgacgccac

SEQ ID NO: 929815 - RNA, 14 nt, Mycobacterium avium subsp. paratuberculosis
gaacgacgccaccg

SEQ ID NO: 929816 - RNA, 13 nt, Mycobacterium avium subsp. paratuberculosis
gaacgacgccaga

SEQ ID NO: 929817 - RNA, 16 nt, Mycobacterium avium subsp. paratuberculosis
gaacgacgcgcucagc

SEQ ID NO: 929818 - RNA, 17 nt, Mycobacterium avium subsp. paratuberculosis
gaacgacgcgcucagcc

SEQ ID NO: 929819 - RNA, 24 nt, Mycobacterium avium subsp. paratuberculosis
gaacgacgcggcacgccgcucguc

SEQ ID NO: 929820 - RNA, 15 nt, Mycobacterium avium subsp. paratuberculosis
gaaccgggcacccgg

SEQ ID NO: 929821 - RNA, 17 nt, Mycobacterium avium subsp. paratuberculosis
gaaccgggcacccggcg

SEQ ID NO: 929822 - RNA, 18 nt, Mycobacterium avium subsp. paratuberculosis
gaaccgggcacccggcgc

SEQ ID NO: 929823 - RNA, 20 nt, Mycobacterium avium subsp. paratuberculosis
gaaccgggcacccggcgcgg

SEQ ID NO: 929824 - RNA, 14 nt, Mycobacterium avium subsp. paratuberculosis
gaaccgggccagga

SEQ ID NO: 929825 - RNA, 17 nt, Mycobacterium avium subsp. paratuberculosis
gaaccgggcccguaggu

SEQ ID NO: 929826 - RNA, 18 nt, Mycobacterium avium subsp. paratuberculosis
gaaccgggccgcuggccg

SEQ ID NO: 929827 - RNA, 15 nt, Mycobacterium avium subsp. paratuberculosis
gaaccgggcgcgcag

SEQ ID NO: 929828 - RNA, 23 nt, Mycobacterium avium subsp. paratuberculosis
gaaccggggcaccacguccacca

SEQ ID NO: 929829 - RNA, 15 nt, Mycobacterium avium subsp. paratuberculosis
gaaccggggccagca

SEQ ID NO: 929830 - RNA, 22 nt, Mycobacterium avium subsp. paratuberculosis
gaaccggggccagcacgccccc

SEQ ID NO: 929831 - RNA, 20 nt, Mycobacterium avium subsp. paratuberculosis
gaaccgggucagcaccacca

SEQ ID NO: 929832 - RNA, 17 nt, Mycobacterium avium subsp. paratuberculosis
gaaccgcaacaccagca

SEQ ID NO: 929833 - RNA, 22 nt, Mycobacterium avium subsp. paratuberculosis
gaaccgggagaacucgacgauc

SEQ ID NO: 929834 - RNA, 15 nt, Mycobacterium avium subsp. paratuberculosis
gaaccggccggggcg

SEQ ID NO: 929835 - RNA, 16 nt, Mycobacterium avium subsp. paratuberculosis
gaaccggccggggcgc

SEQ ID NO: 929836 - RNA, 19 nt, Mycobacterium avium subsp. paratuberculosis
gaaccggccggggcgccac

SEQ ID NO: 929837 - RNA, 13 nt, Mycobacterium avium subsp. paratuberculosis
gaaccggaucaug

SEQ ID NO: 929838 - RNA, 22 nt, Mycobacterium avium subsp. paratuberculosis
gaaccggccaccacgugcgcgu

SEQ ID NO: 929839 - RNA, 22 nt, Mycobacterium avium subsp. paratuberculosis
gaaccgaucaccggcagcagcg

SEQ ID NO: 929840 - RNA, 20 nt, Mycobacterium avium subsp. paratuberculosis
gaaccgacaccucgccgucc

SEQ ID NO: 929841 - RNA, 19 nt, Mycobacterium avium subsp. paratuberculosis
gaacccugggcggcgacac

SEQ ID NO: 929842 - RNA, 13 nt, Mycobacterium avium subsp. paratuberculosis
gaacccggcccgg

SEQ ID NO: 929843 - RNA, 23 nt, Mycobacterium avium subsp. paratuberculosis
gaaccgaaucggucgaccagcuc

SEQ ID NO: 929844 - RNA, 12 nt, Mycobacterium avium subsp. paratuberculosis
gaacccggcggc

SEQ ID NO: 929845 - RNA, 12 nt, Mycobacterium avium subsp. paratuberculosis
gaacccggcgug

SEQ ID NO: 929846 - RNA, 20 nt, Mycobacterium avium subsp. paratuberculosis
gaacccggcgugcuccagca

SEQ ID NO: 929847 - RNA, 21 nt, Mycobacterium avium subsp. paratuberculosis
gaacccggcgugcuccagcag

SEQ ID NO: 929848 - RNA, 18 nt, Mycobacterium avium subsp. paratuberculosis
gaacccgggcgcgcccac

SEQ ID NO: 929849 - RNA, 18 nt, Mycobacterium avium subsp. paratuberculosis
gaacccggguggcccgca

SEQ ID NO: 929850 - RNA, 16 nt, Mycobacterium avium subsp. paratuberculosis
gaacccgcccucgccc

SEQ ID NO: 929851 - RNA, 13 nt, Mycobacterium avium subsp. paratuberculosis
gaacccgccggcg

SEQ ID NO: 929852 - RNA, 24 nt, Mycobacterium avium subsp. paratuberculosis
gaacccgccggcgaacgacgucga

SEQ ID NO: 929853 - RNA, 22 nt, Mycobacterium avium subsp. paratuberculosis
gaacccgccagggcgacgccgc

SEQ ID NO: 929854 - RNA, 16 nt, Mycobacterium avium subsp. paratuberculosis
gaacccgaccccggcg

SEQ ID NO: 929855 - RNA, 18 nt, Mycobacterium avium subsp. paratuberculosis
gaacccgaccccggcgag

SEQ ID NO: 929856 - RNA, 14 nt, Mycobacterium avium subsp. paratuberculosis
gaacccgaccgcga

SEQ ID NO: 929857 - RNA, 16 nt, Mycobacterium avium subsp. paratuberculosis
gaacccgagcaccccg

SEQ ID NO: 929858 - RNA, 16 nt, Mycobacterium avium subsp. paratuberculosis
gaacccccucgcgcaa

SEQ ID NO: 929859 - RNA, 20 nt, Mycobacterium avium subsp. paratuberculosis
gaacuacuucgucagcagcg

SEQ ID NO: 929860 - RNA, 15 nt, Mycobacterium avium subsp. paratuberculosis
gaacucaagggcguc

SEQ ID NO: 929861 - RNA, 13 nt, Mycobacterium avium subsp. paratuberculosis
gaacgugcgcggc

SEQ ID NO: 929862 - RNA, 14 nt, Mycobacterium avium subsp. paratuberculosis
gaacgugcgcggcg

SEQ ID NO: 929863 - RNA, 17 nt, Mycobacterium avium subsp. paratuberculosis
gaacgugcgcggcgcgc

SEQ ID NO: 929864 - RNA, 20 nt, Mycobacterium avium subsp. paratuberculosis
gaacgugcgcggcgcgcgaa

SEQ ID NO: 929865 - RNA, 22 nt, Mycobacterium avium subsp. paratuberculosis
gaacgugugggugagcaucggg

SEQ ID NO: 929866 - RNA, 18 nt, Mycobacterium avium subsp. paratuberculosis
gaacucaccgguggccgc

SEQ ID NO: 929867 - RNA, 18 nt, Mycobacterium avium subsp. paratuberculosis
gaacucaggcgcgcacgu

SEQ ID NO: 929868 - RNA, 17 nt, Mycobacterium avium subsp. paratuberculosis
gaacuccacccugccga

SEQ ID NO: 929869 - RNA, 19 nt, Mycobacterium avium subsp. paratuberculosis
gaacuccacccugccgacc

SEQ ID NO: 929870 - RNA, 20 nt, Mycobacterium avium subsp. paratuberculosis
gaacuccacccugccgaccu

SEQ ID NO: 929871 - RNA, 18 nt, Mycobacterium avium subsp. paratuberculosis
gaacuccagaucgccgcc

SEQ ID NO: 929872 - RNA, 15 nt, Mycobacterium avium subsp. paratuberculosis
gaacuccagcagcug

SEQ ID NO: 929873 - RNA, 16 nt, Mycobacterium avium subsp. paratuberculosis
gaacuccgccgaaccg

SEQ ID NO: 929874 - RNA, 13 nt, Mycobacterium avium subsp. paratuberculosis
gaacuccgcgcgc

SEQ ID NO: 929875 - RNA, 21 nt, Mycobacterium avium subsp. paratuberculosis
gaacuccuugagcuccgguga

SEQ ID NO: 929876 - RNA, 18 nt, Mycobacterium avium subsp. paratuberculosis
gaacgggugcggcgcucg

SEQ ID NO: 929877 - RNA, 19 nt, Mycobacterium avium subsp. paratuberculosis
gaacgggugaccggcggcc

SEQ ID NO: 929878 - RNA, 20 nt, Mycobacterium avium subsp. paratuberculosis
gaacgggugaccggcggcca

SEQ ID NO: 929879 - RNA, 21 nt, Mycobacterium avium subsp. paratuberculosis
gaacgggugaccggcggccag

SEQ ID NO: 929880 - RNA, 15 nt, Mycobacterium avium subsp. paratuberculosis
gaacggucagccgcg

SEQ ID NO: 929881 - RNA, 14 nt, Mycobacterium avium subsp. paratuberculosis
gaacgggucggcga

SEQ ID NO: 929882 - RNA, 15 nt, Mycobacterium avium subsp. paratuberculosis
gaacggucggggcgg

SEQ ID NO: 929883 - RNA, 24 nt, Mycobacterium avium subsp. paratuberculosis
gaacggugucacguccacgccgcg

SEQ ID NO: 929884 - RNA, 16 nt, Mycobacterium avium subsp. paratuberculosis
gaacgucauggccagc

SEQ ID NO: 929885 - RNA, 17 nt, Mycobacterium avium subsp. paratuberculosis
gaacgucauggccagcu

SEQ ID NO: 929886 - RNA, 22 nt, Mycobacterium avium subsp. paratuberculosis
gaacgucauggccagcucgucg

SEQ ID NO: 929887 - RNA, 19 nt, Mycobacterium avium subsp. paratuberculosis
gaacgucgauccccgcagc

SEQ ID NO: 929888 - RNA, 14 nt, Mycobacterium avium subsp. paratuberculosis
gaacgucucgcggg

SEQ ID NO: 929889 - RNA, 21 nt, Mycobacterium avium subsp. paratuberculosis
gaacgucugcgggaagcccac

SEQ ID NO: 929890 - RNA, 17 nt, Mycobacterium avium subsp. paratuberculosis
gaacgucuugggcgcga

SEQ ID NO: 929891 - RNA, 20 nt, Mycobacterium avium subsp. paratuberculosis
gaacgccugccggcgccgga

SEQ ID NO: 929892 - RNA, 16 nt, Mycobacterium avium subsp. paratuberculosis
gaacgccugcgggaag

SEQ ID NO: 929893 - RNA, 14 nt, Mycobacterium avium subsp. paratuberculosis
gaacgccucggcga

SEQ ID NO: 929894 - RNA, 19 nt, Mycobacterium avium subsp. paratuberculosis
gaacgccucggcgagccgc

SEQ ID NO: 929895 - RNA, 17 nt, Mycobacterium avium subsp. paratuberculosis
gaacgccucgggccggc

SEQ ID NO: 929896 - RNA, 21 nt, Mycobacterium avium subsp. paratuberculosis
gaacgccucgggccggcagcc

SEQ ID NO: 929897 - RNA, 20 nt, Mycobacterium avium subsp. paratuberculosis
gaacgccucgguggucgacg

SEQ ID NO: 929898 - RNA, 22 nt, Mycobacterium avium subsp. paratuberculosis
gaacgccucguuggccagcucg

SEQ ID NO: 929899 - RNA, 23 nt, Mycobacterium avium subsp. paratuberculosis
gaacgccuugcacacggccuugc

SEQ ID NO: 929900 - RNA, 18 nt, Mycobacterium avium subsp. paratuberculosis
gaacgcgaaguccgacga

SEQ ID NO: 929901 - RNA, 15 nt, Mycobacterium avium subsp. paratuberculosis
gaacgcgaccgucgg

SEQ ID NO: 929902 - RNA, 16 nt, Mycobacterium avium subsp. paratuberculosis
gaacgcgaccgucggg

SEQ ID NO: 929903 - RNA, 15 nt, Mycobacterium avium subsp. paratuberculosis
gaacgcgcccggcgg

SEQ ID NO: 929904 - RNA, 14 nt, Mycobacterium avium subsp. paratuberculosis
gaacgcgccgccga

SEQ ID NO: 929905 - RNA, 16 nt, Mycobacterium avium subsp. paratuberculosis
gaacgcgccgccgagc

SEQ ID NO: 929906 - RNA, 20 nt, Mycobacterium avium subsp. paratuberculosis
gaacgaguuucccgucgucg

SEQ ID NO: 929907 - RNA, 17 nt, Mycobacterium avium subsp. paratuberculosis
gaacgagccggacaucu

SEQ ID NO: 929908 - RNA, 12 nt, Mycobacterium avium subsp. paratuberculosis
gaacgaggccgc

SEQ ID NO: 929909 - RNA, 16 nt, Mycobacterium avium subsp. paratuberculosis
gaacgaggccgcgccg

SEQ ID NO: 929910 - RNA, 23 nt, Mycobacterium avium subsp. paratuberculosis
gaacgaggccgcgccgugcgcca

SEQ ID NO: 929911 - RNA, 18 nt, Mycobacterium avium subsp. paratuberculosis
gaacgacuggcggcggcg

SEQ ID NO: 929912 - RNA, 15 nt, Mycobacterium avium subsp. paratuberculosis
gaacgacggugcgcc

SEQ ID NO: 929913 - RNA, 23 nt, Mycobacterium avium subsp. paratuberculosis
gaacgacggugcgcccgucgucg

SEQ ID NO: 929914 - RNA, 15 nt, Mycobacterium avium subsp. paratuberculosis
gaacgacgucgaggu

SEQ ID NO: 929915 - RNA, 20 nt, Mycobacterium avium subsp. paratuberculosis
gaacgacguguucaacgcgc

SEQ ID NO: 929916 - RNA, 22 nt, Mycobacterium avium subsp. paratuberculosis
gaacgacguguucaacgcgccg

SEQ ID NO: 929917 - RNA, 18 nt, Mycobacterium avium subsp. paratuberculosis
gaacggcaaccugggcgg

SEQ ID NO: 929918 - RNA, 16 nt, Mycobacterium avium subsp. paratuberculosis
gaacggcaacggcggc

SEQ ID NO: 929919 - RNA, 18 nt, Mycobacterium avium subsp. paratuberculosis
gaacggcacccgcagcuc

SEQ ID NO: 929920 - RNA, 23 nt, Mycobacterium avium subsp. paratuberculosis
gaacggcacccgcagcuccagcg

SEQ ID NO: 929921 - RNA, 14 nt, Mycobacterium avium subsp. paratuberculosis
gaacggcaccucga

SEQ ID NO: 929922 - RNA, 18 nt, Mycobacterium avium subsp. paratuberculosis
gaacgggccaagcaccgg

SEQ ID NO: 929923 - RNA, 24 nt, Mycobacterium avium subsp. paratuberculosis
gaacgggccaagcaccgggauggc

SEQ ID NO: 929924 - RNA, 14 nt, Mycobacterium avium subsp. paratuberculosis
gaacgggccgcacu

SEQ ID NO: 929925 - RNA, 20 nt, Mycobacterium avium subsp. paratuberculosis
gaacgggccgggcaccgcgc

SEQ ID NO: 929926 - RNA, 14 nt, Mycobacterium avium subsp. paratuberculosis
gaacgcguucgucg

SEQ ID NO: 929927 - RNA, 17 nt, Mycobacterium avium subsp. paratuberculosis
gaacgcgccggcgcaca

SEQ ID NO: 929928 - RNA, 13 nt, Mycobacterium avium subsp. paratuberculosis
gaacgcgccgucg

SEQ ID NO: 929929 - RNA, 14 nt, Mycobacterium avium subsp. paratuberculosis
gaacgcgccgucgu

SEQ ID NO: 929930 - RNA, 17 nt, Mycobacterium avium subsp. paratuberculosis
gaacgcucuucagcgcg

SEQ ID NO: 929931 - RNA, 16 nt, Mycobacterium avium subsp. paratuberculosis
gaacgcugccaggcgg

SEQ ID NO: 929932 - RNA, 13 nt, Mycobacterium avium subsp. paratuberculosis
gaaaaacgcgacg

SEQ ID NO: 929933 - RNA, 15 nt, Mycobacterium avium subsp. paratuberculosis
gaaaaacgcgacggc

SEQ ID NO: 929934 - RNA, 16 nt, Mycobacterium avium subsp. paratuberculosis
gaaaaacgcgacggcc

SEQ ID NO: 929935 - RNA, 20 nt, Mycobacterium avium subsp. paratuberculosis
gaaaaccaccugaccgcggg

SEQ ID NO: 929936 - RNA, 23 nt, Mycobacterium avium subsp. paratuberculosis
gaaaaccaccugaccgcgggccc

SEQ ID NO: 929937 - RNA, 15 nt, Mycobacterium avium subsp. paratuberculosis
gaaaaccagcgacgc

SEQ ID NO: 929938 - RNA, 17 nt, Mycobacterium avium subsp. paratuberculosis
gaaaaccagcgacgcca

SEQ ID NO: 929939 - RNA, 21 nt, Mycobacterium avium subsp. paratuberculosis
gaaaaccagcgacgccagcgg

SEQ ID NO: 929940 - RNA, 19 nt, Mycobacterium avium subsp. paratuberculosis
cuuuuccggcgacaccgca

SEQ ID NO: 929941 - RNA, 17 nt, Mycobacterium avium subsp. paratuberculosis
cuuugccgugcucggcg

SEQ ID NO: 929942 - RNA, 17 nt, Mycobacterium avium subsp. paratuberculosis
cuuugccguuccagccg

SEQ ID NO: 929943 - RNA, 20 nt, Mycobacterium avium subsp. paratuberculosis
cuuugccuuagcccggccgc

SEQ ID NO: 929944 - RNA, 16 nt, Mycobacterium avium subsp. paratuberculosis
cuuugcggccguggcg

SEQ ID NO: 929945 - RNA, 21 nt, Mycobacterium avium subsp. paratuberculosis
cuuugcggcgaaccgggcccg

SEQ ID NO: 929946 - RNA, 21 nt, Mycobacterium avium subsp. paratuberculosis
cuuugaaccuggccaccagca

SEQ ID NO: 929947 - RNA, 18 nt, Mycobacterium avium subsp. paratuberculosis
cuuucuugcugagcugcg

SEQ ID NO: 929948 - RNA, 14 nt, Mycobacterium avium subsp. paratuberculosis
cuuucggccgcgga

SEQ ID NO: 929949 - RNA, 12 nt, Mycobacterium avium subsp. paratuberculosis
cuuucgccgaau

SEQ ID NO: 929950 - RNA, 20 nt, Mycobacterium avium subsp. paratuberculosis
cuuucgauuucgccugcagc

SEQ ID NO: 929951 - RNA, 19 nt, Mycobacterium avium subsp. paratuberculosis
cuuucgggcggccugccgg

SEQ ID NO: 929952 - RNA, 20 nt, Mycobacterium avium subsp. paratuberculosis
cuuucgggcggccugccggc

SEQ ID NO: 929953 - RNA, 14 nt, Mycobacterium avium subsp. paratuberculosis
cuuucgggucgacg

SEQ ID NO: 929954 - RNA, 16 nt, Mycobacterium avium subsp. paratuberculosis
cuuucggugcgcaguu

SEQ ID NO: 929955 - RNA, 15 nt, Mycobacterium avium subsp. paratuberculosis
cuuuccgcgcggcgg

SEQ ID NO: 929956 - RNA, 16 nt, Mycobacterium avium subsp. paratuberculosis
cuuuccgcgcggcggg

SEQ ID NO: 929957 - RNA, 14 nt, Mycobacterium avium subsp. paratuberculosis
cuuggacgcccggu

SEQ ID NO: 929958 - RNA, 17 nt, Mycobacterium avium subsp. paratuberculosis
cuuggacgcccggucga

SEQ ID NO: 929959 - RNA, 19 nt, Mycobacterium avium subsp. paratuberculosis
cuuggacgcccggucgacc

SEQ ID NO: 929960 - RNA, 19 nt, Mycobacterium avium subsp. paratuberculosis
cuugcguucccagcccggc

SEQ ID NO: 929961 - RNA, 20 nt, Mycobacterium avium subsp. paratuberculosis
cuugcguuccucgacggcga

SEQ ID NO: 929962 - RNA, 15 nt, Mycobacterium avium subsp. paratuberculosis
cuugcguugcgcggc

SEQ ID NO: 929963 - RNA, 16 nt, Mycobacterium avium subsp. paratuberculosis
cuugcugacgccgcgg

SEQ ID NO: 929964 - RNA, 19 nt, Mycobacterium avium subsp. paratuberculosis
cuugcugacgccgcggugc

SEQ ID NO: 929965 - RNA, 14 nt, Mycobacterium avium subsp. paratuberculosis
cuugcugccgucgg

SEQ ID NO: 929966 - RNA, 21 nt, Mycobacterium avium subsp. paratuberculosis
cuugcucuucaggaacccgaa

SEQ ID NO: 929967 - RNA, 16 nt, Mycobacterium avium subsp. paratuberculosis
cuucguaacacccucg

SEQ ID NO: 929968 - RNA, 12 nt, Mycobacterium avium subsp. paratuberculosis
cuucgucgccgg

SEQ ID NO: 929969 - RNA, 15 nt, Mycobacterium avium subsp. paratuberculosis
cuucgucgccgggcu

SEQ ID NO: 929970 - RNA, 12 nt, Mycobacterium avium subsp. paratuberculosis
cuucgucggccg

SEQ ID NO: 929971 - RNA, 14 nt, Mycobacterium avium subsp. paratuberculosis
cuucgucggccggc

SEQ ID NO: 929972 - RNA, 16 nt, Mycobacterium avium subsp. paratuberculosis
cuuggcgucgaucagc

SEQ ID NO: 929973 - RNA, 21 nt, Mycobacterium avium subsp. paratuberculosis
cuuggcgucgaucagcgcgcc

SEQ ID NO: 929974 - RNA, 21 nt, Mycobacterium avium subsp. paratuberculosis
cuuggcguauucggcgcgcaa

SEQ ID NO: 929975 - RNA, 15 nt, Mycobacterium avium subsp. paratuberculosis
cuugggccggugcag

SEQ ID NO: 929976 - RNA, 20 nt, Mycobacterium avium subsp. paratuberculosis
cuugggcgaaucugucgaug

SEQ ID NO: 929977 - RNA, 15 nt, Mycobacterium avium subsp. paratuberculosis
cuugggcacguacgc

SEQ ID NO: 929978 - RNA, 17 nt, Mycobacterium avium subsp. paratuberculosis
cuugggcagcagcucga

SEQ ID NO: 929979 - RNA, 22 nt, Mycobacterium avium subsp. paratuberculosis
cuuggucagcgcggcccgcggc

SEQ ID NO: 929980 - RNA, 14 nt, Mycobacterium avium subsp. paratuberculosis
cuuggucagccgcg

SEQ ID NO: 929981 - RNA, 19 nt, Mycobacterium avium subsp. paratuberculosis
cuuggucagccgcggcggc

SEQ ID NO: 929982 - RNA, 17 nt, Mycobacterium avium subsp. paratuberculosis
cuuggucaccagcucgc

SEQ ID NO: 929983 - RNA, 13 nt, Mycobacterium avium subsp. paratuberculosis
cuugggucgccgg

SEQ ID NO: 929984 - RNA, 15 nt, Mycobacterium avium subsp. paratuberculosis
cuugggucgccgggu

SEQ ID NO: 929985 - RNA, 22 nt, Mycobacterium avium subsp. paratuberculosis
cuugggugagcuaucagcucgc

SEQ ID NO: 929986 - RNA, 20 nt, Mycobacterium avium subsp. paratuberculosis
cuugggcucgcgggugucga

SEQ ID NO: 929987 - RNA, 17 nt, Mycobacterium avium subsp. paratuberculosis
cuugggcgcgaucggca

SEQ ID NO: 929988 - RNA, 19 nt, Mycobacterium avium subsp. paratuberculosis
cuugggcgccucgccgacc

SEQ ID NO: 929989 - RNA, 14 nt, Mycobacterium avium subsp. paratuberculosis
cuugggcccgucgg

SEQ ID NO: 929990 - RNA, 16 nt, Mycobacterium avium subsp. paratuberculosis
cuuggcacgggcccgc

SEQ ID NO: 929991 - RNA, 20 nt, Mycobacterium avium subsp. paratuberculosis
cuuggccagcagugccacca

SEQ ID NO: 929992 - RNA, 18 nt, Mycobacterium avium subsp. paratuberculosis
cuuggccagcagccgcga

SEQ ID NO: 929993 - RNA, 19 nt, Mycobacterium avium subsp. paratuberculosis
cuuggccagcagccgcgac

SEQ ID NO: 929994 - RNA, 20 nt, Mycobacterium avium subsp. paratuberculosis
cuuggcggugauguugucca

SEQ ID NO: 929995 - RNA, 19 nt, Mycobacterium avium subsp. paratuberculosis
cuuggccaggcgggccacc

SEQ ID NO: 929996 - RNA, 20 nt, Mycobacterium avium subsp. paratuberculosis
cuuggcggccugcucgaagc

SEQ ID NO: 929997 - RNA, 23 nt, Mycobacterium avium subsp. paratuberculosis
cuuggcggcggucuucuuggcgg

SEQ ID NO: 929998 - RNA, 13 nt, Mycobacterium avium subsp. paratuberculosis
cuuggcggcgugg

SEQ ID NO: 929999 - RNA, 16 nt, Mycobacterium avium subsp. paratuberculosis
cuuggcggagagcggu

SEQ ID NO: 930000 - RNA, 13 nt, Mycobacterium avium subsp. paratuberculosis
cuuggcggccacc

SEQ ID NO: 930001 - RNA, 17 nt, Mycobacterium avium subsp. paratuberculosis
cuuggcggccacgacgg

SEQ ID NO: 930002 - RNA, 14 nt, Mycobacterium avium subsp. paratuberculosis
cuuggcgcagccgg

SEQ ID NO: 930003 - RNA, 16 nt, Mycobacterium avium subsp. paratuberculosis
cuuggcgcagccgguc

SEQ ID NO: 930004 - RNA, 17 nt, Mycobacterium avium subsp. paratuberculosis
cuuggcgcccagcgugg

SEQ ID NO: 930005 - RNA, 18 nt, Mycobacterium avium subsp. paratuberculosis
aaccgucuccggcgcggu

SEQ ID NO: 930006 - RNA, 15 nt, Mycobacterium avium subsp. paratuberculosis
aaccguagaccaccu

SEQ ID NO: 930007 - RNA, 22 nt, Mycobacterium avium subsp. paratuberculosis
aaccgguucggacacggcgccg

SEQ ID NO: 930008 - RNA, 12 nt, Mycobacterium avium subsp. paratuberculosis
aaccguucgucg

SEQ ID NO: 930009 - RNA, 15 nt, Mycobacterium avium subsp. paratuberculosis
aaccguugaccacca

SEQ ID NO: 930010 - RNA, 17 nt, Mycobacterium avium subsp. paratuberculosis
aaccguugaccaccagg

SEQ ID NO: 930011 - RNA, 14 nt, Mycobacterium avium subsp. paratuberculosis
cuuuagaaggccgc

SEQ ID NO: 930012 - RNA, 18 nt, Mycobacterium avium subsp. paratuberculosis
cuugucgcugaccaccga

SEQ ID NO: 930013 - RNA, 15 nt, Mycobacterium avium subsp. paratuberculosis
cuugucgugucgaug

SEQ ID NO: 930014 - RNA, 14 nt, Mycobacterium avium subsp. paratuberculosis
cuugucggcgagcu

SEQ ID NO: 930015 - RNA, 17 nt, Mycobacterium avium subsp. paratuberculosis
cuugucggcguggccgu

SEQ ID NO: 930016 - RNA, 15 nt, Mycobacterium avium subsp. paratuberculosis
cuugucgggccgcgg

SEQ ID NO: 930017 - RNA, 16 nt, Mycobacterium avium subsp. paratuberculosis
cuugucgggccgcggg

SEQ ID NO: 930018 - RNA, 20 nt, Mycobacterium avium subsp. paratuberculosis
cuugucgcgcacccgcacgu

SEQ ID NO: 930019 - RNA, 18 nt, Mycobacterium avium subsp. paratuberculosis
cuugucgcgcaccgcggc

SEQ ID NO: 930020 - RNA, 21 nt, Mycobacterium avium subsp. paratuberculosis
cuugucgcgcaccgcggcggg

SEQ ID NO: 930021 - RNA, 19 nt, Mycobacterium avium subsp. paratuberculosis
cuugucccagugcuugggc

SEQ ID NO: 930022 - RNA, 13 nt, Mycobacterium avium subsp. paratuberculosis
cuugucagcggcc

SEQ ID NO: 930023 - RNA, 21 nt, Mycobacterium avium subsp. paratuberculosis
cuuaacuucacgcucggcgag

SEQ ID NO: 930024 - RNA, 20 nt, Mycobacterium avium subsp. paratuberculosis
aaccggcccagcagcgucac

SEQ ID NO: 930025 - RNA, 19 nt, Mycobacterium avium subsp. paratuberculosis
aaccggcgccgaagcccgc

SEQ ID NO: 930026 - RNA, 20 nt, Mycobacterium avium subsp. paratuberculosis
aaccgggccugcgcgccgau

SEQ ID NO: 930027 - RNA, 20 nt, Mycobacterium avium subsp. paratuberculosis
aaccggcuggacacccccga

SEQ ID NO: 930028 - RNA, 15 nt, Mycobacterium avium subsp. paratuberculosis
aaccgggacagccgc

SEQ ID NO: 930029 - RNA, 16 nt, Mycobacterium avium subsp. paratuberculosis
aaccgggacagccgcg

SEQ ID NO: 930030 - RNA, 18 nt, Mycobacterium avium subsp. paratuberculosis
aaccgggacagccgcgcc

SEQ ID NO: 930031 - RNA, 20 nt, Mycobacterium avium subsp. paratuberculosis
aaccgggacagccgcgccga

SEQ ID NO: 930032 - RNA, 21 nt, Mycobacterium avium subsp. paratuberculosis
aaccgggacagccgcgccgac

SEQ ID NO: 930033 - RNA, 23 nt, Mycobacterium avium subsp. paratuberculosis
aaccggcguugcauuucggcguc

SEQ ID NO: 930034 - RNA, 18 nt, Mycobacterium avium subsp. paratuberculosis
aaccgggcacccggcgcg

SEQ ID NO: 930035 - RNA, 22 nt, Mycobacterium avium subsp. paratuberculosis
aaccgggccaacgguucggccg

SEQ ID NO: 930036 - RNA, 13 nt, Mycobacterium avium subsp. paratuberculosis
aaccgggccgcac

SEQ ID NO: 930037 - RNA, 18 nt, Mycobacterium avium subsp. paratuberculosis
aaccgggccgcuggccgc

SEQ ID NO: 930038 - RNA, 14 nt, Mycobacterium avium subsp. paratuberculosis
aaccgggggccguc

SEQ ID NO: 930039 - RNA, 16 nt, Mycobacterium avium subsp. paratuberculosis
aaccgggugacgacca

SEQ ID NO: 930040 - RNA, 15 nt, Mycobacterium avium subsp. paratuberculosis
cuguuagggcgacca

SEQ ID NO: 930041 - RNA, 13 nt, Mycobacterium avium subsp. paratuberculosis
cuguuacgcccga

SEQ ID NO: 930042 - RNA, 14 nt, Mycobacterium avium subsp. paratuberculosis
cuguuugaacaccu

SEQ ID NO: 930043 - RNA, 17 nt, Mycobacterium avium subsp. paratuberculosis
cugugguccucgucacc

SEQ ID NO: 930044 - RNA, 14 nt, Mycobacterium avium subsp. paratuberculosis
cugugguggcggua

SEQ ID NO: 930045 - RNA, 19 nt, Mycobacterium avium subsp. paratuberculosis
cugugguuuucgaaaccgg

SEQ ID NO: 930046 - RNA, 14 nt, Mycobacterium avium subsp. paratuberculosis
cugugggccagcag

SEQ ID NO: 930047 - RNA, 22 nt, Mycobacterium avium subsp. paratuberculosis
cugucaguuugcgcgacgggcg

SEQ ID NO: 930048 - RNA, 19 nt, Mycobacterium avium subsp. paratuberculosis
cugucgcccucgaucgcga

SEQ ID NO: 930049 - RNA, 18 nt, Mycobacterium avium subsp. paratuberculosis
cugucggcgccccgcccg

SEQ ID NO: 930050 - RNA, 18 nt, Mycobacterium avium subsp. paratuberculosis
cugucggcgcggacguga

SEQ ID NO: 930051 - RNA, 14 nt, Mycobacterium avium subsp. paratuberculosis
cugucgcgcgaaca

SEQ ID NO: 930052 - RNA, 14 nt, Mycobacterium avium subsp. paratuberculosis
cugucgcgggucug

SEQ ID NO: 930053 - RNA, 14 nt, Mycobacterium avium subsp. paratuberculosis
cugugccggcgggu

SEQ ID NO: 930054 - RNA, 19 nt, Mycobacterium avium subsp. paratuberculosis
cugugcgaugucggugcga

SEQ ID NO: 930055 - RNA, 13 nt, Mycobacterium avium subsp. paratuberculosis
cugugcgacggcg

SEQ ID NO: 930056 - RNA, 15 nt, Mycobacterium avium subsp. paratuberculosis
cugugcgccagagac

SEQ ID NO: 930057 - RNA, 19 nt, Mycobacterium avium subsp. paratuberculosis
cugugcgggugaggccagg

SEQ ID NO: 930058 - RNA, 19 nt, Mycobacterium avium subsp. paratuberculosis
cugugcgcuugggucgccg

SEQ ID NO: 930059 - RNA, 16 nt, Mycobacterium avium subsp. paratuberculosis
cugucggggucgcggc

SEQ ID NO: 930060 - RNA, 13 nt, Mycobacterium avium subsp. paratuberculosis
cuggucaugccgu

SEQ ID NO: 930061 - RNA, 16 nt, Mycobacterium avium subsp. paratuberculosis
cuggucaugccgucga

SEQ ID NO: 930062 - RNA, 18 nt, Mycobacterium avium subsp. paratuberculosis
cuggucaugccgucgacg

SEQ ID NO: 930063 - RNA, 20 nt, Mycobacterium avium subsp. paratuberculosis
cuggucaugccgucgacgac

SEQ ID NO: 930064 - RNA, 18 nt, Mycobacterium avium subsp. paratuberculosis
cugguccaccgcggcggc

SEQ ID NO: 930065 - RNA, 14 nt, Mycobacterium avium subsp. paratuberculosis
cugguccagcgugc

SEQ ID NO: 930066 - RNA, 22 nt, Mycobacterium avium subsp. paratuberculosis
cugguccagcgugcgcggcugg

SEQ ID NO: 930067 - RNA, 18 nt, Mycobacterium avium subsp. paratuberculosis
cugguccggaaccgcgcc

SEQ ID NO: 930068 - RNA, 14 nt, Mycobacterium avium subsp. paratuberculosis
cugguccggccggc

SEQ ID NO: 930069 - RNA, 14 nt, Mycobacterium avium subsp. paratuberculosis
cuggucccacagcg

SEQ ID NO: 930070 - RNA, 21 nt, Mycobacterium avium subsp. paratuberculosis
cugguccuccaacggcaccac

SEQ ID NO: 930071 - RNA, 13 nt, Mycobacterium avium subsp. paratuberculosis
cugguccugcggc

SEQ ID NO: 930072 - RNA, 17 nt, Mycobacterium avium subsp. paratuberculosis
cuggucgaagauggcca

SEQ ID NO: 930073 - RNA, 18 nt, Mycobacterium avium subsp. paratuberculosis
cuggucgaagauggccag

SEQ ID NO: 930074 - RNA, 23 nt, Mycobacterium avium subsp. paratuberculosis
cuggucgaagauggccagguagu

SEQ ID NO: 930075 - RNA, 16 nt, Mycobacterium avium subsp. paratuberculosis
cuggucgaacagcacg

SEQ ID NO: 930076 - RNA, 21 nt, Mycobacterium avium subsp. paratuberculosis
cuggucgaacagcacgccggc

SEQ ID NO: 930077 - RNA, 15 nt, Mycobacterium avium subsp. paratuberculosis
cuggucgaacagcgc

SEQ ID NO: 930078 - RNA, 18 nt, Mycobacterium avium subsp. paratuberculosis
cuggucgaacagcgcgcc

SEQ ID NO: 930079 - RNA, 19 nt, Mycobacterium avium subsp. paratuberculosis
cuggucgaacagcgcgccc

SEQ ID NO: 930080 - RNA, 20 nt, Mycobacterium avium subsp. paratuberculosis
cuggucgaacagcgcgcccg

SEQ ID NO: 930081 - RNA, 16 nt, Mycobacterium avium subsp. paratuberculosis
cuggucgaaccgcgag

SEQ ID NO: 930082 - RNA, 18 nt, Mycobacterium avium subsp. paratuberculosis
cuggucgaaccgcgagcg

SEQ ID NO: 930083 - RNA, 22 nt, Mycobacterium avium subsp. paratuberculosis
cuggucgaaccgcgagcgcgcg

SEQ ID NO: 930084 - RNA, 23 nt, Mycobacterium avium subsp. paratuberculosis
cuggucgaaccgcgagcgcgcgg

SEQ ID NO: 930085 - RNA, 23 nt, Mycobacterium avium subsp. paratuberculosis
cuggucgaacgccaccuucaccg

SEQ ID NO: 930086 - RNA, 15 nt, Mycobacterium avium subsp. paratuberculosis
cuguaguagccgggg

SEQ ID NO: 930087 - RNA, 21 nt, Mycobacterium avium subsp. paratuberculosis
cugucaacgagacacccucgc

SEQ ID NO: 930088 - RNA, 18 nt, Mycobacterium avium subsp. paratuberculosis
cuguagcacccggccggc

SEQ ID NO: 930089 - RNA, 20 nt, Mycobacterium avium subsp. paratuberculosis
cuguagcacccggccggcga

SEQ ID NO: 930090 - RNA, 22 nt, Mycobacterium avium subsp. paratuberculosis
cuguagcacccggccggcgaaa

SEQ ID NO: 930091 - RNA, 16 nt, Mycobacterium avium subsp. paratuberculosis
cuucaacuugcgcgac

SEQ ID NO: 930092 - RNA, 21 nt, Mycobacterium avium subsp. paratuberculosis
cuucaggcccucaucgucgac

SEQ ID NO: 930093 - RNA, 22 nt, Mycobacterium avium subsp. paratuberculosis
cuucaggcagcgcacgauguga

SEQ ID NO: 930094 - RNA, 14 nt, Mycobacterium avium subsp. paratuberculosis
cuucaggaacccga

SEQ ID NO: 930095 - RNA, 15 nt, Mycobacterium avium subsp. paratuberculosis
cuucagcgcgacagc

SEQ ID NO: 930096 - RNA, 23 nt, Mycobacterium avium subsp. paratuberculosis
cuucagccccucggggcugcgcg

SEQ ID NO: 930097 - RNA, 14 nt, Mycobacterium avium subsp. paratuberculosis
cuucagccgcagcu

SEQ ID NO: 930098 - RNA, 22 nt, Mycobacterium avium subsp. paratuberculosis
cuuccaccaccgcggcgccguc

SEQ ID NO: 930099 - RNA, 14 nt, Mycobacterium avium subsp. paratuberculosis
cuuccacgaccugg

SEQ ID NO: 930100 - RNA, 22 nt, Mycobacterium avium subsp. paratuberculosis
cuucaugcccuuggcccgggcg

SEQ ID NO: 930101 - RNA, 18 nt, Mycobacterium avium subsp. paratuberculosis
cuuccagcaccacccggu

SEQ ID NO: 930102 - RNA, 19 nt, Mycobacterium avium subsp. paratuberculosis
cuucagggcggugcggugc

SEQ ID NO: 930103 - RNA, 16 nt, Mycobacterium avium subsp. paratuberculosis
cuucauaugacgccgg

SEQ ID NO: 930104 - RNA, 16 nt, Mycobacterium avium subsp. paratuberculosis
cuucaguucggccggc

SEQ ID NO: 930105 - RNA, 14 nt, Mycobacterium avium subsp. paratuberculosis
cuucgaacgcccgc

SEQ ID NO: 930106 - RNA, 20 nt, Mycobacterium avium subsp. paratuberculosis
cuucgacccgcauccgccgg

SEQ ID NO: 930107 - RNA, 14 nt, Mycobacterium avium subsp. paratuberculosis
cuuccgggccaccg

SEQ ID NO: 930108 - RNA, 17 nt, Mycobacterium avium subsp. paratuberculosis
cuuccgggccaccgucu

SEQ ID NO: 930109 - RNA, 14 nt, Mycobacterium avium subsp. paratuberculosis
cuuccgcccggcga

SEQ ID NO: 930110 - RNA, 16 nt, Mycobacterium avium subsp. paratuberculosis
cuuccgcccggcgagc

SEQ ID NO: 930111 - RNA, 16 nt, Mycobacterium avium subsp. paratuberculosis
cuuccgccacgcccag

SEQ ID NO: 930112 - RNA, 16 nt, Mycobacterium avium subsp. paratuberculosis
cuuccggaacgacgcg

SEQ ID NO: 930113 - RNA, 13 nt, Mycobacterium avium subsp. paratuberculosis
cuuccgccucggc

SEQ ID NO: 930114 - RNA, 20 nt, Mycobacterium avium subsp. paratuberculosis
cuuccgccucggcgaggucg

SEQ ID NO: 930115 - RNA, 18 nt, Mycobacterium avium subsp. paratuberculosis
cuuccgcgcgucgggggu

SEQ ID NO: 930116 - RNA, 20 nt, Mycobacterium avium subsp. paratuberculosis
cuucgcggucggcaacccga

SEQ ID NO: 930117 - RNA, 23 nt, Mycobacterium avium subsp. paratuberculosis
cuucgcguuccgccacggcgggg

SEQ ID NO: 930118 - RNA, 21 nt, Mycobacterium avium subsp. paratuberculosis
cuucgauguagaagccguggg

SEQ ID NO: 930119 - RNA, 15 nt, Mycobacterium avium subsp. paratuberculosis
cuucgaugucgccgg

SEQ ID NO: 930120 - RNA, 16 nt, Mycobacterium avium subsp. paratuberculosis
cuucgaugucgccggc

SEQ ID NO: 930121 - RNA, 19 nt, Mycobacterium avium subsp. paratuberculosis
cuucgaugucgccggcgac

SEQ ID NO: 930122 - RNA, 23 nt, Mycobacterium avium subsp. paratuberculosis
cuucgaugucgccggcgaccgcc

SEQ ID NO: 930123 - RNA, 15 nt, Mycobacterium avium subsp. paratuberculosis
cuucggcacgaagcc

SEQ ID NO: 930124 - RNA, 15 nt, Mycobacterium avium subsp. paratuberculosis
cuucggucccggcgg

SEQ ID NO: 930125 - RNA, 17 nt, Mycobacterium avium subsp. paratuberculosis
cuucggucccggcgggg

SEQ ID NO: 930126 - RNA, 22 nt, Mycobacterium avium subsp. paratuberculosis
cuucggggauguagccgccggu

SEQ ID NO: 930127 - RNA, 18 nt, Mycobacterium avium subsp. paratuberculosis
cuucggggguggccagcu

SEQ ID NO: 930128 - RNA, 13 nt, Mycobacterium avium subsp. paratuberculosis
cuucggcgucacu

SEQ ID NO: 930129 - RNA, 15 nt, Mycobacterium avium subsp. paratuberculosis
cuucggcgucacucu

SEQ ID NO: 930130 - RNA, 13 nt, Mycobacterium avium subsp. paratuberculosis
cuucggcucggcg

SEQ ID NO: 930131 - RNA, 15 nt, Mycobacterium avium subsp. paratuberculosis
cuucggcucggcgac

SEQ ID NO: 930132 - RNA, 19 nt, Mycobacterium avium subsp. paratuberculosis
cuucggcucggcgacaaca

SEQ ID NO: 930133 - RNA, 20 nt, Mycobacterium avium subsp. paratuberculosis
cuucggcucggggucggccg

SEQ ID NO: 930134 - RNA, 15 nt, Mycobacterium avium subsp. paratuberculosis
cuggcguucgccgag

SEQ ID NO: 930135 - RNA, 17 nt, Mycobacterium avium subsp. paratuberculosis
cuggcgugcggcgcggu

SEQ ID NO: 930136 - RNA, 20 nt, Mycobacterium avium subsp. paratuberculosis
cuggcgugcuugaacgccgc

SEQ ID NO: 930137 - RNA, 14 nt, Mycobacterium avium subsp. paratuberculosis
cuggcguggcgccg

SEQ ID NO: 930138 - RNA, 16 nt, Mycobacterium avium subsp. paratuberculosis
cuggcguggcgccggc

SEQ ID NO: 930139 - RNA, 18 nt, Mycobacterium avium subsp. paratuberculosis
cuggcguugagcacgcgg

SEQ ID NO: 930140 - RNA, 13 nt, Mycobacterium avium subsp. paratuberculosis
cuggcugagcagc

SEQ ID NO: 930141 - RNA, 17 nt, Mycobacterium avium subsp. paratuberculosis
cuggcugagcagcaccc

SEQ ID NO: 930142 - RNA, 21 nt, Mycobacterium avium subsp. paratuberculosis
cuggcgguuggacaggccggc

SEQ ID NO: 930143 - RNA, 22 nt, Mycobacterium avium subsp. paratuberculosis
cuggcgguuggacaggccggcg

SEQ ID NO: 930144 - RNA, 17 nt, Mycobacterium avium subsp. paratuberculosis
cuggcguagagccgcuc

SEQ ID NO: 930145 - RNA, 19 nt, Mycobacterium avium subsp. paratuberculosis
cuggcguagagccgcucgc

SEQ ID NO: 930146 - RNA, 21 nt, Mycobacterium avium subsp. paratuberculosis
cuggcguagaucugcacgcug

SEQ ID NO: 930147 - RNA, 19 nt, Mycobacterium avium subsp. paratuberculosis
cuggcguaggacagcagcc

SEQ ID NO: 930148 - RNA, 16 nt, Mycobacterium avium subsp. paratuberculosis
cuggcguccaggucgc

SEQ ID NO: 930149 - RNA, 21 nt, Mycobacterium avium subsp. paratuberculosis
cuggcguccaggucgcccucg

SEQ ID NO: 930150 - RNA, 14 nt, Mycobacterium avium subsp. paratuberculosis
cuggcgucgaacgu

SEQ ID NO: 930151 - RNA, 18 nt, Mycobacterium avium subsp. paratuberculosis
cuggcgugacagucgagg

SEQ ID NO: 930152 - RNA, 15 nt, Mycobacterium avium subsp. paratuberculosis
cuggcgugacgcucg

SEQ ID NO: 930153 - RNA, 17 nt, Mycobacterium avium subsp. paratuberculosis
cuggcgugacgcucgac

SEQ ID NO: 930154 - RNA, 23 nt, Mycobacterium avium subsp. paratuberculosis
cuggcgugacgcucgacggccgg

SEQ ID NO: 930155 - RNA, 18 nt, Mycobacterium avium subsp. paratuberculosis
cuggcgugacgcucgccg

SEQ ID NO: 930156 - RNA, 17 nt, Mycobacterium avium subsp. paratuberculosis
cuggcgugacgcucggc

SEQ ID NO: 930157 - RNA, 18 nt, Mycobacterium avium subsp. paratuberculosis
cuggcgugacgcucggcc

SEQ ID NO: 930158 - RNA, 20 nt, Mycobacterium avium subsp. paratuberculosis
cuggcgugacgcucggcgcc

SEQ ID NO: 930159 - RNA, 21 nt, Mycobacterium avium subsp. paratuberculosis
cuggcgugacgcucggcgccg

SEQ ID NO: 930160 - RNA, 23 nt, Mycobacterium avium subsp. paratuberculosis
cuggcgugacgcucggcgcgucg

SEQ ID NO: 930161 - RNA, 22 nt, Mycobacterium avium subsp. paratuberculosis
cuggcgugacgcucggcggccg

SEQ ID NO: 930162 - RNA, 12 nt, Mycobacterium avium subsp. paratuberculosis
cuggcgugacgg

SEQ ID NO: 930163 - RNA, 19 nt, Mycobacterium avium subsp. paratuberculosis
cuggcgugacggucgaccu

SEQ ID NO: 930164 - RNA, 18 nt, Mycobacterium avium subsp. paratuberculosis
cuggcgugacguucguca

SEQ ID NO: 930165 - RNA, 15 nt, Mycobacterium avium subsp. paratuberculosis
cuggcguggcucggc

SEQ ID NO: 930166 - RNA, 16 nt, Mycobacterium avium subsp. paratuberculosis
cuggcguggcucggcc

SEQ ID NO: 930167 - RNA, 19 nt, Mycobacterium avium subsp. paratuberculosis
cuggcguggcucggcccgc

SEQ ID NO: 930168 - RNA, 21 nt, Mycobacterium avium subsp. paratuberculosis
cuggcguggcucggcccgccg

SEQ ID NO: 930169 - RNA, 13 nt, Mycobacterium avium subsp. paratuberculosis
cuggcgucgggcu

SEQ ID NO: 930170 - RNA, 18 nt, Mycobacterium avium subsp. paratuberculosis
cuggcgucguuggcgccg

SEQ ID NO: 930171 - RNA, 12 nt, Mycobacterium avium subsp. paratuberculosis
cuggcgcugcca

SEQ ID NO: 930172 - RNA, 16 nt, Mycobacterium avium subsp. paratuberculosis
cuggcgcugccagucg

SEQ ID NO: 930173 - RNA, 20 nt, Mycobacterium avium subsp. paratuberculosis
cuggcgcuggaucugcccga

SEQ ID NO: 930174 - RNA, 16 nt, Mycobacterium avium subsp. paratuberculosis
cuggcgcugcucggag

SEQ ID NO: 930175 - RNA, 17 nt, Mycobacterium avium subsp. paratuberculosis
cuggcggaaggccgcgc

SEQ ID NO: 930176 - RNA, 19 nt, Mycobacterium avium subsp. paratuberculosis
cuggcggaaggccgcgcgg

SEQ ID NO: 930177 - RNA, 20 nt, Mycobacterium avium subsp. paratuberculosis
cuggcggaaggccgcgcggg

SEQ ID NO: 930178 - RNA, 21 nt, Mycobacterium avium subsp. paratuberculosis
cuggcggaaggccgcgcgggc

SEQ ID NO: 930179 - RNA, 14 nt, Mycobacterium avium subsp. paratuberculosis
cuggcgggcgaagc

SEQ ID NO: 930180 - RNA, 21 nt, Mycobacterium avium subsp. paratuberculosis
cuggcgggcgaucgccucggc

SEQ ID NO: 930181 - RNA, 14 nt, Mycobacterium avium subsp. paratuberculosis
cuggcgggcggccc

SEQ ID NO: 930182 - RNA, 16 nt, Mycobacterium avium subsp. paratuberculosis
cuggcgggcggcccgc

SEQ ID NO: 930183 - RNA, 16 nt, Mycobacterium avium subsp. paratuberculosis
cuggcgggcgguccag

SEQ ID NO: 930184 - RNA, 23 nt, Mycobacterium avium subsp. paratuberculosis
cuggcggucgcugaccccgcucg

SEQ ID NO: 930185 - RNA, 17 nt, Mycobacterium avium subsp. paratuberculosis
cuggcggguacagccgc

SEQ ID NO: 930186 - RNA, 14 nt, Mycobacterium avium subsp. paratuberculosis
cuggcgggccagcu

SEQ ID NO: 930187 - RNA, 19 nt, Mycobacterium avium subsp. paratuberculosis
cuggcggggcgugcccggc

SEQ ID NO: 930188 - RNA, 13 nt, Mycobacterium avium subsp. paratuberculosis
cuggcggcgcggu

SEQ ID NO: 930189 - RNA, 16 nt, Mycobacterium avium subsp. paratuberculosis
cuggcggccggccgcg

SEQ ID NO: 930190 - RNA, 23 nt, Mycobacterium avium subsp. paratuberculosis
cuggcggccggccgcgcccaucg

SEQ ID NO: 930191 - RNA, 13 nt, Mycobacterium avium subsp. paratuberculosis
cuggcggcgauca

SEQ ID NO: 930192 - RNA, 23 nt, Mycobacterium avium subsp. paratuberculosis
cuggcggcgaucaccgccgcggc

SEQ ID NO: 930193 - RNA, 17 nt, Mycobacterium avium subsp. paratuberculosis
cuggcggauggcgcccu

SEQ ID NO: 930194 - RNA, 15 nt, Mycobacterium avium subsp. paratuberculosis
cugggcuccgaccgu

SEQ ID NO: 930195 - RNA, 15 nt, Mycobacterium avium subsp. paratuberculosis
cugggcguugccggu

SEQ ID NO: 930196 - RNA, 16 nt, Mycobacterium avium subsp. paratuberculosis
cugggcguugccgguc

SEQ ID NO: 930197 - RNA, 20 nt, Mycobacterium avium subsp. paratuberculosis
cugggcguugccggucucga

SEQ ID NO: 930198 - RNA, 23 nt, Mycobacterium avium subsp. paratuberculosis
cugggcguacugcucggcgcggc

SEQ ID NO: 930199 - RNA, 14 nt, Mycobacterium avium subsp. paratuberculosis
cugggcguggugcg

SEQ ID NO: 930200 - RNA, 18 nt, Mycobacterium avium subsp. paratuberculosis
cugggcguggugcggugc

SEQ ID NO: 930201 - RNA, 23 nt, Mycobacterium avium subsp. paratuberculosis
cugggcguggugcggugcaccgc

SEQ ID NO: 930202 - RNA, 16 nt, Mycobacterium avium subsp. paratuberculosis
cugggcgaacggcaac

SEQ ID NO: 930203 - RNA, 17 nt, Mycobacterium avium subsp. paratuberculosis
cugggugcgcggcgccg

SEQ ID NO: 930204 - RNA, 15 nt, Mycobacterium avium subsp. paratuberculosis
cugggugcgggcugc

SEQ ID NO: 930205 - RNA, 22 nt, Mycobacterium avium subsp. paratuberculosis
cuggguccgauuucccgacucc

SEQ ID NO: 930206 - RNA, 14 nt, Mycobacterium avium subsp. paratuberculosis
cugggugaccgagu

SEQ ID NO: 930207 - RNA, 23 nt, Mycobacterium avium subsp. paratuberculosis
cugggugagcaacagcgcuucgc

SEQ ID NO: 930208 - RNA, 18 nt, Mycobacterium avium subsp. paratuberculosis
cugggugaguucgucggc

SEQ ID NO: 930209 - RNA, 16 nt, Mycobacterium avium subsp. paratuberculosis
cugggcuggccguccg

SEQ ID NO: 930210 - RNA, 18 nt, Mycobacterium avium subsp. paratuberculosis
cuggggcagaucgucggc

SEQ ID NO: 930211 - RNA, 16 nt, Mycobacterium avium subsp. paratuberculosis
cugggucaccgucacg

SEQ ID NO: 930212 - RNA, 17 nt, Mycobacterium avium subsp. paratuberculosis
cugggucaccgucacgu

SEQ ID NO: 930213 - RNA, 12 nt, Mycobacterium avium subsp. paratuberculosis
cugggucacgcu

SEQ ID NO: 930214 - RNA, 15 nt, Mycobacterium avium subsp. paratuberculosis
cugggucacgcugaa

SEQ ID NO: 930215 - RNA, 21 nt, Mycobacterium avium subsp. paratuberculosis
cuggucacccacuggcggccg

SEQ ID NO: 930216 - RNA, 23 nt, Mycobacterium avium subsp. paratuberculosis
cuggucacccacuggcggccggc

SEQ ID NO: 930217 - RNA, 18 nt, Mycobacterium avium subsp. paratuberculosis
cuggucaacucgacccgc

SEQ ID NO: 930218 - RNA, 21 nt, Mycobacterium avium subsp. paratuberculosis
cuggucaacucgacccgcacc

SEQ ID NO: 930219 - RNA, 16 nt, Mycobacterium avium subsp. paratuberculosis
cugguaguggcgugcg

SEQ ID NO: 930220 - RNA, 22 nt, Mycobacterium avium subsp. paratuberculosis
cugguaguggcgugcggccucg

SEQ ID NO: 930221 - RNA, 22 nt, Mycobacterium avium subsp. paratuberculosis
cuggguuccgcgagacguaagc

SEQ ID NO: 930222 - RNA, 13 nt, Mycobacterium avium subsp. paratuberculosis
cugggugggugcg

SEQ ID NO: 930223 - RNA, 20 nt, Mycobacterium avium subsp. paratuberculosis
cugggugggugcggugcggc

SEQ ID NO: 930224 - RNA, 22 nt, Mycobacterium avium subsp. paratuberculosis
cugggugggugcggugcggccg

SEQ ID NO: 930225 - RNA, 17 nt, Mycobacterium avium subsp. paratuberculosis
cuggguggucaccagcg

SEQ ID NO: 930226 - RNA, 16 nt, Mycobacterium avium subsp. paratuberculosis
cuggguguaaccggcu

SEQ ID NO: 930227 - RNA, 17 nt, Mycobacterium avium subsp. paratuberculosis
cuggguguaaccggcuu

SEQ ID NO: 930228 - RNA, 15 nt, Mycobacterium avium subsp. paratuberculosis
cugggccuccggcgg

SEQ ID NO: 930229 - RNA, 17 nt, Mycobacterium avium subsp. paratuberculosis
cugggccuccggcggca

SEQ ID NO: 930230 - RNA, 17 nt, Mycobacterium avium subsp. paratuberculosis
cugggccgucgcccgga

SEQ ID NO: 930231 - RNA, 15 nt, Mycobacterium avium subsp. paratuberculosis
cugggccggcgccga

SEQ ID NO: 930232 - RNA, 16 nt, Mycobacterium avium subsp. paratuberculosis
cugggccggcgccgaa

SEQ ID NO: 930233 - RNA, 12 nt, Mycobacterium avium subsp. paratuberculosis
cugggagcggcc

SEQ ID NO: 930234 - RNA, 20 nt, Mycobacterium avium subsp. paratuberculosis
cugggaggaagugcacgccg

SEQ ID NO: 930235 - RNA, 20 nt, Mycobacterium avium subsp. paratuberculosis
cugggcgaccaugccgcggg

SEQ ID NO: 930236 - RNA, 19 nt, Mycobacterium avium subsp. paratuberculosis
cugggcgucgucggccggc

SEQ ID NO: 930237 - RNA, 17 nt, Mycobacterium avium subsp. paratuberculosis
cugggcguacagcggcg

SEQ ID NO: 930238 - RNA, 20 nt, Mycobacterium avium subsp. paratuberculosis
cugggcguacagcggcgcca

SEQ ID NO: 930239 - RNA, 22 nt, Mycobacterium avium subsp. paratuberculosis
cugggcgcccagaugccgccgc

SEQ ID NO: 930240 - RNA, 23 nt, Mycobacterium avium subsp. paratuberculosis
cugggcgcccagaugccgccgcc

SEQ ID NO: 930241 - RNA, 23 nt, Mycobacterium avium subsp. paratuberculosis
cugggcgauugcguugaucgacg

SEQ ID NO: 930242 - RNA, 15 nt, Mycobacterium avium subsp. paratuberculosis
cuggcuggucaccca

SEQ ID NO: 930243 - RNA, 23 nt, Mycobacterium avium subsp. paratuberculosis
cuggcuguagcggucgugcggga

SEQ ID NO: 930244 - RNA, 14 nt, Mycobacterium avium subsp. paratuberculosis
cuggcugccugguu

SEQ ID NO: 930245 - RNA, 17 nt, Mycobacterium avium subsp. paratuberculosis
cugggacagccggucga

SEQ ID NO: 930246 - RNA, 17 nt, Mycobacterium avium subsp. paratuberculosis
cugggacgggucggcgg

SEQ ID NO: 930247 - RNA, 18 nt, Mycobacterium avium subsp. paratuberculosis
cugggacgggucggcggc

SEQ ID NO: 930248 - RNA, 14 nt, Mycobacterium avium subsp. paratuberculosis
cuggaucaucucgu

SEQ ID NO: 930249 - RNA, 17 nt, Mycobacterium avium subsp. paratuberculosis
cuggagaggcccggcag

SEQ ID NO: 930250 - RNA, 21 nt, Mycobacterium avium subsp. paratuberculosis
cuggagaggcccggcagccgg

SEQ ID NO: 930251 - RNA, 17 nt, Mycobacterium avium subsp. paratuberculosis
cuggaguaggugcccga

SEQ ID NO: 930252 - RNA, 18 nt, Mycobacterium avium subsp. paratuberculosis
cuggaggccaacgagcgc

SEQ ID NO: 930253 - RNA, 18 nt, Mycobacterium avium subsp. paratuberculosis
cugcccgucgggcgcggc

SEQ ID NO: 930254 - RNA, 14 nt, Mycobacterium avium subsp. paratuberculosis
cugcccgugccgca

SEQ ID NO: 930255 - RNA, 23 nt, Mycobacterium avium subsp. paratuberculosis
cugcccgugccgcaccugguuga

SEQ ID NO: 930256 - RNA, 22 nt, Mycobacterium avium subsp. paratuberculosis
cugcccgggcuguugaccacgg

SEQ ID NO: 930257 - RNA, 16 nt, Mycobacterium avium subsp. paratuberculosis
cugcccguagucggcg

SEQ ID NO: 930258 - RNA, 20 nt, Mycobacterium avium subsp. paratuberculosis
cugcccgggcaucccgccga

SEQ ID NO: 930259 - RNA, 19 nt, Mycobacterium avium subsp. paratuberculosis
cugcccgggcccgauggcg

SEQ ID NO: 930260 - RNA, 22 nt, Mycobacterium avium subsp. paratuberculosis
cugcccgggcccgauggcggcc

SEQ ID NO: 930261 - RNA, 15 nt, Mycobacterium avium subsp. paratuberculosis
cugcccgggcgccga

SEQ ID NO: 930262 - RNA, 12 nt, Mycobacterium avium subsp. paratuberculosis
cugcccggcggu

SEQ ID NO: 930263 - RNA, 16 nt, Mycobacterium avium subsp. paratuberculosis
cugcccggcggugccg

SEQ ID NO: 930264 - RNA, 19 nt, Mycobacterium avium subsp. paratuberculosis
cugcccugaagcugggcgc

SEQ ID NO: 930265 - RNA, 23 nt, Mycobacterium avium subsp. paratuberculosis
cugcccugggaggaagugcacgc

SEQ ID NO: 930266 - RNA, 13 nt, Mycobacterium avium subsp. paratuberculosis
cugccgaccagga

SEQ ID NO: 930267 - RNA, 18 nt, Mycobacterium avium subsp. paratuberculosis
cugccgaccucgauggcg

SEQ ID NO: 930268 - RNA, 19 nt, Mycobacterium avium subsp. paratuberculosis
cugccgaccucgauggcga

SEQ ID NO: 930269 - RNA, 19 nt, Mycobacterium avium subsp. paratuberculosis
cugccgaccugcgcgacgg

SEQ ID NO: 930270 - RNA, 17 nt, Mycobacterium avium subsp. paratuberculosis
cugccgaacaucagccg

SEQ ID NO: 930271 - RNA, 12 nt, Mycobacterium avium subsp. paratuberculosis
cuggcacgacgc

SEQ ID NO: 930272 - RNA, 14 nt, Mycobacterium avium subsp. paratuberculosis
cuggcacgacgccg

SEQ ID NO: 930273 - RNA, 15 nt, Mycobacterium avium subsp. paratuberculosis
cuggcacgacgccgc

SEQ ID NO: 930274 - RNA, 16 nt, Mycobacterium avium subsp. paratuberculosis
cuggcacgacgccgcc

SEQ ID NO: 930275 - RNA, 21 nt, Mycobacterium avium subsp. paratuberculosis
cuggccaccacgggucggucg

SEQ ID NO: 930276 - RNA, 23 nt, Mycobacterium avium subsp. paratuberculosis
cuggccaccacgggucggucggc

SEQ ID NO: 930277 - RNA, 12 nt, Mycobacterium avium subsp. paratuberculosis
cuggccaccagc

SEQ ID NO: 930278 - RNA, 14 nt, Mycobacterium avium subsp. paratuberculosis
cuggccaccagcag

SEQ ID NO: 930279 - RNA, 16 nt, Mycobacterium avium subsp. paratuberculosis
cuggccaccucgacgg

SEQ ID NO: 930280 - RNA, 14 nt, Mycobacterium avium subsp. paratuberculosis
cuggccaccgaagc

SEQ ID NO: 930281 - RNA, 16 nt, Mycobacterium avium subsp. paratuberculosis
cuggccaccgaagccg

SEQ ID NO: 930282 - RNA, 13 nt, Mycobacterium avium subsp. paratuberculosis
cuggcccuggcag

SEQ ID NO: 930283 - RNA, 17 nt, Mycobacterium avium subsp. paratuberculosis
cuggcccgccaucgccc

SEQ ID NO: 930284 - RNA, 15 nt, Mycobacterium avium subsp. paratuberculosis
cuggcccggcgcggc

SEQ ID NO: 930285 - RNA, 19 nt, Mycobacterium avium subsp. paratuberculosis
cuggcccggcgcggcggcg

SEQ ID NO: 930286 - RNA, 22 nt, Mycobacterium avium subsp. paratuberculosis
cuggcccggcgcggcggcgccg

SEQ ID NO: 930287 - RNA, 19 nt, Mycobacterium avium subsp. paratuberculosis
cuggcccggugcgacgccg

SEQ ID NO: 930288 - RNA, 20 nt, Mycobacterium avium subsp. paratuberculosis
cuggcccggugcgacgccgc

SEQ ID NO: 930289 - RNA, 22 nt, Mycobacterium avium subsp. paratuberculosis
cuggcccggugcgacgccgcgc

SEQ ID NO: 930290 - RNA, 20 nt, Mycobacterium avium subsp. paratuberculosis
cuggcccucggaggugccgc

SEQ ID NO: 930291 - RNA, 22 nt, Mycobacterium avium subsp. paratuberculosis
cuggccccagaaccgcucggcg

SEQ ID NO: 930292 - RNA, 23 nt, Mycobacterium avium subsp. paratuberculosis
cuggccccagaaccgcucggcgg

SEQ ID NO: 930293 - RNA, 17 nt, Mycobacterium avium subsp. paratuberculosis
cuggccagcaccagcgc

SEQ ID NO: 930294 - RNA, 22 nt, Mycobacterium avium subsp. paratuberculosis
cuggccagcaccagcgcgcggg

SEQ ID NO: 930295 - RNA, 13 nt, Mycobacterium avium subsp. paratuberculosis
cuggccagcaccg

SEQ ID NO: 930296 - RNA, 14 nt, Mycobacterium avium subsp. paratuberculosis
cuggccagcaccgc

SEQ ID NO: 930297 - RNA, 17 nt, Mycobacterium avium subsp. paratuberculosis
cuggcgaauuccccgua

SEQ ID NO: 930298 - RNA, 14 nt, Mycobacterium avium subsp. paratuberculosis
cuggcgaaccgcgg

SEQ ID NO: 930299 - RNA, 16 nt, Mycobacterium avium subsp. paratuberculosis
cuggcgaaccgcggcg

SEQ ID NO: 930300 - RNA, 21 nt, Mycobacterium avium subsp. paratuberculosis
cuggcgaaccgcggcggcagc

SEQ ID NO: 930301 - RNA, 18 nt, Mycobacterium avium subsp. paratuberculosis
cuggccuggucggccggc

SEQ ID NO: 930302 - RNA, 19 nt, Mycobacterium avium subsp. paratuberculosis
cuggccuggucggccggca

SEQ ID NO: 930303 - RNA, 17 nt, Mycobacterium avium subsp. paratuberculosis
cuggccuugcagcccgc

SEQ ID NO: 930304 - RNA, 22 nt, Mycobacterium avium subsp. paratuberculosis
cuggccuccagcuuugccagca

SEQ ID NO: 930305 - RNA, 20 nt, Mycobacterium avium subsp. paratuberculosis
cuggccugauugacggccca

SEQ ID NO: 930306 - RNA, 21 nt, Mycobacterium avium subsp. paratuberculosis
cuggccugauugacggcccac

SEQ ID NO: 930307 - RNA, 16 nt, Mycobacterium avium subsp. paratuberculosis
cuggccgggcucgagg

SEQ ID NO: 930308 - RNA, 22 nt, Mycobacterium avium subsp. paratuberculosis
cuggccgggcucgagggcggcg

SEQ ID NO: 930309 - RNA, 21 nt, Mycobacterium avium subsp. paratuberculosis
cuggccggccucgaugucguc

SEQ ID NO: 930310 - RNA, 18 nt, Mycobacterium avium subsp. paratuberculosis
cuggccggccaccagcgg

SEQ ID NO: 930311 - RNA, 20 nt, Mycobacterium avium subsp. paratuberculosis
cuggccggccaccagcggcc

SEQ ID NO: 930312 - RNA, 22 nt, Mycobacterium avium subsp. paratuberculosis
cuggccggccaccagcggccgg

SEQ ID NO: 930313 - RNA, 14 nt, Mycobacterium avium subsp. paratuberculosis
cuggccgcggccag

SEQ ID NO: 930314 - RNA, 18 nt, Mycobacterium avium subsp. paratuberculosis
cuggccgcggccagcugc

SEQ ID NO: 930315 - RNA, 17 nt, Mycobacterium avium subsp. paratuberculosis
cuggccgcggcgaucgg

SEQ ID NO: 930316 - RNA, 20 nt, Mycobacterium avium subsp. paratuberculosis
cuggccgcgggugcggccca

SEQ ID NO: 930317 - RNA, 13 nt, Mycobacterium avium subsp. paratuberculosis
cuggccgcgcagc

SEQ ID NO: 930318 - RNA, 20 nt, Mycobacterium avium subsp. paratuberculosis
cuggcgaugugaucgcggcc

SEQ ID NO: 930319 - RNA, 15 nt, Mycobacterium avium subsp. paratuberculosis
cuggcgaucgaugcc

SEQ ID NO: 930320 - RNA, 17 nt, Mycobacterium avium subsp. paratuberculosis
cuggcgaucaucgucgu

SEQ ID NO: 930321 - RNA, 21 nt, Mycobacterium avium subsp. paratuberculosis
cuggcgaucaccuugcggccg

SEQ ID NO: 930322 - RNA, 22 nt, Mycobacterium avium subsp. paratuberculosis
cuggcgaucaccuugcggccgg

SEQ ID NO: 930323 - RNA, 23 nt, Mycobacterium avium subsp. paratuberculosis
cuggcgaucaccuugcggccggc

SEQ ID NO: 930324 - RNA, 17 nt, Mycobacterium avium subsp. paratuberculosis
cuggcgcaccgccgcgg

SEQ ID NO: 930325 - RNA, 18 nt, Mycobacterium avium subsp. paratuberculosis
cuggcgcaccgccgcggg

SEQ ID NO: 930326 - RNA, 19 nt, Mycobacterium avium subsp. paratuberculosis
cuggcgcagcaccgacucc

SEQ ID NO: 930327 - RNA, 20 nt, Mycobacterium avium subsp. paratuberculosis
cuggcgcagcgucaacggcu

SEQ ID NO: 930328 - RNA, 16 nt, Mycobacterium avium subsp. paratuberculosis
cuggcgcaucagcggg

SEQ ID NO: 930329 - RNA, 13 nt, Mycobacterium avium subsp. paratuberculosis
cuggcgccggucg

SEQ ID NO: 930330 - RNA, 12 nt, Mycobacterium avium subsp. paratuberculosis
gaugcaccggca

SEQ ID NO: 930331 - RNA, 18 nt, Mycobacterium avium subsp. paratuberculosis
gaugcaccggcagccaga

SEQ ID NO: 930332 - RNA, 19 nt, Mycobacterium avium subsp. paratuberculosis
aacugguuccacaccacca

SEQ ID NO: 930333 - RNA, 13 nt, Mycobacterium avium subsp. paratuberculosis
aacugugcggugc

SEQ ID NO: 930334 - RNA, 23 nt, Mycobacterium avium subsp. paratuberculosis
aacuguucgcggcuggccgcggc

SEQ ID NO: 930335 - RNA, 17 nt, Mycobacterium avium subsp. paratuberculosis
gaugcaccucgcccugc

SEQ ID NO: 930336 - RNA, 16 nt, Mycobacterium avium subsp. paratuberculosis
gaugcagaucaccacg

SEQ ID NO: 930337 - RNA, 18 nt, Mycobacterium avium subsp. paratuberculosis
gaugcagaucaccacggu

SEQ ID NO: 930338 - RNA, 14 nt, Mycobacterium avium subsp. paratuberculosis
gaugccagacgaac

SEQ ID NO: 930339 - RNA, 21 nt, Mycobacterium avium subsp. paratuberculosis
gaugccagacgaacgcggccg

SEQ ID NO: 930340 - RNA, 13 nt, Mycobacterium avium subsp. paratuberculosis
gaugcccagcgcg

SEQ ID NO: 930341 - RNA, 14 nt, Mycobacterium avium subsp. paratuberculosis
gaugcccagcgcgc

SEQ ID NO: 930342 - RNA, 14 nt, Mycobacterium avium subsp. paratuberculosis
gaugcccagcagcg

SEQ ID NO: 930343 - RNA, 15 nt, Mycobacterium avium subsp. paratuberculosis
gaugcccagcagcgg

SEQ ID NO: 930344 - RNA, 20 nt, Mycobacterium avium subsp. paratuberculosis
gaugcccaagccggccaggc

SEQ ID NO: 930345 - RNA, 13 nt, Mycobacterium avium subsp. paratuberculosis
gaugcccagcccc

SEQ ID NO: 930346 - RNA, 12 nt, Mycobacterium avium subsp. paratuberculosis
gaugcccacccg

SEQ ID NO: 930347 - RNA, 15 nt, Mycobacterium avium subsp. paratuberculosis
gaugcccacccgcuc

SEQ ID NO: 930348 - RNA, 19 nt, Mycobacterium avium subsp. paratuberculosis
gaugcccacccgcucggcg

SEQ ID NO: 930349 - RNA, 22 nt, Mycobacterium avium subsp. paratuberculosis
gaugccaguccugggccggggc

SEQ ID NO: 930350 - RNA, 16 nt, Mycobacterium avium subsp. paratuberculosis
gaugauggccgcgccg

SEQ ID NO: 930351 - RNA, 15 nt, Mycobacterium avium subsp. paratuberculosis
gaugaugcugucggu

SEQ ID NO: 930352 - RNA, 14 nt, Mycobacterium avium subsp. paratuberculosis
gaugaugccggcgg

SEQ ID NO: 930353 - RNA, 13 nt, Mycobacterium avium subsp. paratuberculosis
gaugaugguggcg

SEQ ID NO: 930354 - RNA, 16 nt, Mycobacterium avium subsp. paratuberculosis
gaugaugucgcccggc

SEQ ID NO: 930355 - RNA, 16 nt, Mycobacterium avium subsp. paratuberculosis
gaugaugucggcggcc

SEQ ID NO: 930356 - RNA, 15 nt, Mycobacterium avium subsp. paratuberculosis
gaugaugggcgaucg

SEQ ID NO: 930357 - RNA, 16 nt, Mycobacterium avium subsp. paratuberculosis
gaugaugggcgaucga

SEQ ID NO: 930358 - RNA, 21 nt, Mycobacterium avium subsp. paratuberculosis
aacuggucgugcagcaccgcc

SEQ ID NO: 930359 - RNA, 18 nt, Mycobacterium avium subsp. paratuberculosis
aacuggucgugcucgucg

SEQ ID NO: 930360 - RNA, 13 nt, Mycobacterium avium subsp. paratuberculosis
gaugaucgccggc

SEQ ID NO: 930361 - RNA, 16 nt, Mycobacterium avium subsp. paratuberculosis
gaugaucgccggcgcc

SEQ ID NO: 930362 - RNA, 13 nt, Mycobacterium avium subsp. paratuberculosis
gaugaucgccgau

SEQ ID NO: 930363 - RNA, 19 nt, Mycobacterium avium subsp. paratuberculosis
gaugaucccggugaugccg

SEQ ID NO: 930364 - RNA, 17 nt, Mycobacterium avium subsp. paratuberculosis
gaugauccuggccuggu

SEQ ID NO: 930365 - RNA, 17 nt, Mycobacterium avium subsp. paratuberculosis
gaugaucgagccgcggc

SEQ ID NO: 930366 - RNA, 19 nt, Mycobacterium avium subsp. paratuberculosis
gaugaucccgaggaugccg

SEQ ID NO: 930367 - RNA, 18 nt, Mycobacterium avium subsp. paratuberculosis
gaugaucucgccgagcgg

SEQ ID NO: 930368 - RNA, 12 nt, Mycobacterium avium subsp. paratuberculosis
gaugaucgggau

SEQ ID NO: 930369 - RNA, 13 nt, Mycobacterium avium subsp. paratuberculosis
gaugaucgggaug

SEQ ID NO: 930370 - RNA, 17 nt, Mycobacterium avium subsp. paratuberculosis
gaugaggucgcgaccgc

SEQ ID NO: 930371 - RNA, 19 nt, Mycobacterium avium subsp. paratuberculosis
gaugagcaagucggcggug

SEQ ID NO: 930372 - RNA, 17 nt, Mycobacterium avium subsp. paratuberculosis
gaugaucaacacgucgu

SEQ ID NO: 930373 - RNA, 20 nt, Mycobacterium avium subsp. paratuberculosis
gaugaucagcgcgcccaggc

SEQ ID NO: 930374 - RNA, 14 nt, Mycobacterium avium subsp. paratuberculosis
gaugaucagcucgc

SEQ ID NO: 930375 - RNA, 16 nt, Mycobacterium avium subsp. paratuberculosis
gaugcgaugggugauc

SEQ ID NO: 930376 - RNA, 19 nt, Mycobacterium avium subsp. paratuberculosis
gaugcgaugggugaucgcg

SEQ ID NO: 930377 - RNA, 20 nt, Mycobacterium avium subsp. paratuberculosis
gaugcgcaccgcggcgugcg

SEQ ID NO: 930378 - RNA, 20 nt, Mycobacterium avium subsp. paratuberculosis
gaugcgcaagcaccggcugg

SEQ ID NO: 930379 - RNA, 21 nt, Mycobacterium avium subsp. paratuberculosis
gaugcgcaagcaccggcuggc

SEQ ID NO: 930380 - RNA, 18 nt, Mycobacterium avium subsp. paratuberculosis
gaugcgcacgucggccgc

SEQ ID NO: 930381 - RNA, 19 nt, Mycobacterium avium subsp. paratuberculosis
gaugcgcacgucggccgcc

SEQ ID NO: 930382 - RNA, 20 nt, Mycobacterium avium subsp. paratuberculosis
gaugcgcaccgugccgcccg

SEQ ID NO: 930383 - RNA, 13 nt, Mycobacterium avium subsp. paratuberculosis
gaugccugcccag

SEQ ID NO: 930384 - RNA, 16 nt, Mycobacterium avium subsp. paratuberculosis
gaugccugcccgcgca

SEQ ID NO: 930385 - RNA, 15 nt, Mycobacterium avium subsp. paratuberculosis
gaugccguggucggc

SEQ ID NO: 930386 - RNA, 16 nt, Mycobacterium avium subsp. paratuberculosis
gaugccguggucggcg

SEQ ID NO: 930387 - RNA, 17 nt, Mycobacterium avium subsp. paratuberculosis
gaugccguggucggcga

SEQ ID NO: 930388 - RNA, 18 nt, Mycobacterium avium subsp. paratuberculosis
gaugccguggucggcgaa

SEQ ID NO: 930389 - RNA, 22 nt, Mycobacterium avium subsp. paratuberculosis
gaugccguggucggcgaacgcc

SEQ ID NO: 930390 - RNA, 20 nt, Mycobacterium avium subsp. paratuberculosis
gaugccguccagcaacgccg

SEQ ID NO: 930391 - RNA, 16 nt, Mycobacterium avium subsp. paratuberculosis
gaugccgugccggugg

SEQ ID NO: 930392 - RNA, 16 nt, Mycobacterium avium subsp. paratuberculosis
gaugccgugcgcgcug

SEQ ID NO: 930393 - RNA, 18 nt, Mycobacterium avium subsp. paratuberculosis
gaugccgugcgcgcuggu

SEQ ID NO: 930394 - RNA, 17 nt, Mycobacterium avium subsp. paratuberculosis
gaugccguagaccagca

SEQ ID NO: 930395 - RNA, 17 nt, Mycobacterium avium subsp. paratuberculosis
gaugccgguggccuugc

SEQ ID NO: 930396 - RNA, 20 nt, Mycobacterium avium subsp. paratuberculosis
gaugccgggugggcagcccc

SEQ ID NO: 930397 - RNA, 20 nt, Mycobacterium avium subsp. paratuberculosis
gaugccgguacggccgacgc

SEQ ID NO: 930398 - RNA, 22 nt, Mycobacterium avium subsp. paratuberculosis
gaugccgguacggccgacgccc

SEQ ID NO: 930399 - RNA, 12 nt, Mycobacterium avium subsp. paratuberculosis
gaugccggcguu

SEQ ID NO: 930400 - RNA, 19 nt, Mycobacterium avium subsp. paratuberculosis
gaugccggcguugacgaug

SEQ ID NO: 930401 - RNA, 18 nt, Mycobacterium avium subsp. paratuberculosis
gaugccgggaagcgaagc

SEQ ID NO: 930402 - RNA, 13 nt, Mycobacterium avium subsp. paratuberculosis
gaugccggcggug

SEQ ID NO: 930403 - RNA, 15 nt, Mycobacterium avium subsp. paratuberculosis
gaugccggcgcccag

SEQ ID NO: 930404 - RNA, 20 nt, Mycobacterium avium subsp. paratuberculosis
gaugccggcggacagccccg

SEQ ID NO: 930405 - RNA, 19 nt, Mycobacterium avium subsp. paratuberculosis
gaugccggacucugacuca

SEQ ID NO: 930406 - RNA, 15 nt, Mycobacterium avium subsp. paratuberculosis
gaugcccgacaccgc

SEQ ID NO: 930407 - RNA, 23 nt, Mycobacterium avium subsp. paratuberculosis
gaugcccgacaccgccccgccgc

SEQ ID NO: 930408 - RNA, 14 nt, Mycobacterium avium subsp. paratuberculosis
gaugcccgccccgc

SEQ ID NO: 930409 - RNA, 17 nt, Mycobacterium avium subsp. paratuberculosis
gaugcccgccccgcccg

SEQ ID NO: 930410 - RNA, 14 nt, Mycobacterium avium subsp. paratuberculosis
gaugcccgccggcg

SEQ ID NO: 930411 - RNA, 21 nt, Mycobacterium avium subsp. paratuberculosis
gaugcccgcguccugcagcgc

SEQ ID NO: 930412 - RNA, 15 nt, Mycobacterium avium subsp. paratuberculosis
gaugcccucgccggu

SEQ ID NO: 930413 - RNA, 19 nt, Mycobacterium avium subsp. paratuberculosis
gaugcccucgccggucagc

SEQ ID NO: 930414 - RNA, 17 nt, Mycobacterium avium subsp. paratuberculosis
gaugcccgcgccgacca

SEQ ID NO: 930415 - RNA, 12 nt, Mycobacterium avium subsp. paratuberculosis
gaugcccgggcc

SEQ ID NO: 930416 - RNA, 14 nt, Mycobacterium avium subsp. paratuberculosis
gaugcccggggugc

SEQ ID NO: 930417 - RNA, 14 nt, Mycobacterium avium subsp. paratuberculosis
gaugccgaccgaca

SEQ ID NO: 930418 - RNA, 17 nt, Mycobacterium avium subsp. paratuberculosis
gaugccgaccgacagcc

SEQ ID NO: 930419 - RNA, 22 nt, Mycobacterium avium subsp. paratuberculosis
gaugccgaccgacagccgcacc

SEQ ID NO: 930420 - RNA, 16 nt, Mycobacterium avium subsp. paratuberculosis
gaugccgaagccguug

SEQ ID NO: 930421 - RNA, 13 nt, Mycobacterium avium subsp. paratuberculosis
gaugccgacaccc

SEQ ID NO: 930422 - RNA, 16 nt, Mycobacterium avium subsp. paratuberculosis
gaugccgacaccccac

SEQ ID NO: 930423 - RNA, 23 nt, Mycobacterium avium subsp. paratuberculosis
gaugccgaccaacacccccgcgc

SEQ ID NO: 930424 - RNA, 14 nt, Mycobacterium avium subsp. paratuberculosis
gaugccgagccggc

SEQ ID NO: 930425 - RNA, 21 nt, Mycobacterium avium subsp. paratuberculosis
gaugccgaguuccugcgaccg

SEQ ID NO: 930426 - RNA, 24 nt, Mycobacterium avium subsp. paratuberculosis
gaugccgaguuccugcgaccgccg

SEQ ID NO: 930427 - RNA, 13 nt, Mycobacterium avium subsp. paratuberculosis
gaugccgaacgcg

SEQ ID NO: 930428 - RNA, 19 nt, Mycobacterium avium subsp. paratuberculosis
gaugccgaacgucaccaac

SEQ ID NO: 930429 - RNA, 20 nt, Mycobacterium avium subsp. paratuberculosis
gaugccgaacgucaccaaca

SEQ ID NO: 930430 - RNA, 21 nt, Mycobacterium avium subsp. paratuberculosis
gaugccgaacgucaccaacau

SEQ ID NO: 930431 - RNA, 17 nt, Mycobacterium avium subsp. paratuberculosis
gaugccccaggcgaaca

SEQ ID NO: 930432 - RNA, 23 nt, Mycobacterium avium subsp. paratuberculosis
gaugccgcuuuccaaccaggcgc

SEQ ID NO: 930433 - RNA, 13 nt, Mycobacterium avium subsp. paratuberculosis
gaugccgcucggc

SEQ ID NO: 930434 - RNA, 15 nt, Mycobacterium avium subsp. paratuberculosis
gaugccgcucggcgc

SEQ ID NO: 930435 - RNA, 19 nt, Mycobacterium avium subsp. paratuberculosis
gaugccgcucggcgcucca

SEQ ID NO: 930436 - RNA, 21 nt, Mycobacterium avium subsp. paratuberculosis
gaugccgcgcggcgccagcgg

SEQ ID NO: 930437 - RNA, 14 nt, Mycobacterium avium subsp. paratuberculosis
gaugccgcgcucga

SEQ ID NO: 930438 - RNA, 21 nt, Mycobacterium avium subsp. paratuberculosis
gaugccgcgcugcgccgggug

SEQ ID NO: 930439 - RNA, 13 nt, Mycobacterium avium subsp. paratuberculosis
gaugccgcggcgu

SEQ ID NO: 930440 - RNA, 21 nt, Mycobacterium avium subsp. paratuberculosis
gaugccggccuggcccagccg

SEQ ID NO: 930441 - RNA, 16 nt, Mycobacterium avium subsp. paratuberculosis
gaugccgcccagcagc

SEQ ID NO: 930442 - RNA, 18 nt, Mycobacterium avium subsp. paratuberculosis
gaugccggaggcgccgua

SEQ ID NO: 930443 - RNA, 13 nt, Mycobacterium avium subsp. paratuberculosis
gaugccggccagc

SEQ ID NO: 930444 - RNA, 18 nt, Mycobacterium avium subsp. paratuberculosis
gaugccggccagccgcgc

SEQ ID NO: 930445 - RNA, 22 nt, Mycobacterium avium subsp. paratuberculosis
gaugccggccagcggccagccc

SEQ ID NO: 930446 - RNA, 23 nt, Mycobacterium avium subsp. paratuberculosis
gaugccggccagcggccagcccg

SEQ ID NO: 930447 - RNA, 12 nt, Mycobacterium avium subsp. paratuberculosis
gaugccggccgc

SEQ ID NO: 930448 - RNA, 17 nt, Mycobacterium avium subsp. paratuberculosis
gaugccggccgcguacu

SEQ ID NO: 930449 - RNA, 16 nt, Mycobacterium avium subsp. paratuberculosis
gaugccggccgggacg

SEQ ID NO: 930450 - RNA, 23 nt, Mycobacterium avium subsp. paratuberculosis
gaugccggccgggacgcggucca

SEQ ID NO: 930451 - RNA, 14 nt, Mycobacterium avium subsp. paratuberculosis
gaugccgaucacgg

SEQ ID NO: 930452 - RNA, 22 nt, Mycobacterium avium subsp. paratuberculosis
gaugccgaucacggugaucgcc

SEQ ID NO: 930453 - RNA, 23 nt, Mycobacterium avium subsp. paratuberculosis
gaugccgaucacggugaucgccg

SEQ ID NO: 930454 - RNA, 13 nt, Mycobacterium avium subsp. paratuberculosis
gaugccgaucagg

SEQ ID NO: 930455 - RNA, 13 nt, Mycobacterium avium subsp. paratuberculosis
gaugccgcccagc

SEQ ID NO: 930456 - RNA, 16 nt, Mycobacterium avium subsp. paratuberculosis
gaugccgccggggugc

SEQ ID NO: 930457 - RNA, 12 nt, Mycobacterium avium subsp. paratuberculosis
gaugccgccggu

SEQ ID NO: 930458 - RNA, 20 nt, Mycobacterium avium subsp. paratuberculosis
gaugccgccgaagcggcgca

SEQ ID NO: 930459 - RNA, 17 nt, Mycobacterium avium subsp. paratuberculosis
gaugcccuuggcggcca

SEQ ID NO: 930460 - RNA, 17 nt, Mycobacterium avium subsp. paratuberculosis
gaugaaaccggccagca

SEQ ID NO: 930461 - RNA, 17 nt, Mycobacterium avium subsp. paratuberculosis
gaugaaacuuccgcccg

SEQ ID NO: 930462 - RNA, 16 nt, Mycobacterium avium subsp. paratuberculosis
gaugaacacggucgcc

SEQ ID NO: 930463 - RNA, 19 nt, Mycobacterium avium subsp. paratuberculosis
gaugaacacggucgccggc

SEQ ID NO: 930464 - RNA, 23 nt, Mycobacterium avium subsp. paratuberculosis
gaugaacucgugcggcgccgccc

SEQ ID NO: 930465 - RNA, 21 nt, Mycobacterium avium subsp. paratuberculosis
aacugcgcgucggagaucacc

SEQ ID NO: 930466 - RNA, 23 nt, Mycobacterium avium subsp. paratuberculosis
gaugaagugcgccagcgacggcc

SEQ ID NO: 930467 - RNA, 23 nt, Mycobacterium avium subsp. paratuberculosis
gaugaagaugaucucgccgagcg

SEQ ID NO: 930468 - RNA, 21 nt, Mycobacterium avium subsp. paratuberculosis
gaugacaaccaucgaggcgau

SEQ ID NO: 930469 - RNA, 23 nt, Mycobacterium avium subsp. paratuberculosis
gaugacaaccaucgaggcgauca

SEQ ID NO: 930470 - RNA, 22 nt, Mycobacterium avium subsp. paratuberculosis
gaugaccagggccucgucgucg

SEQ ID NO: 930471 - RNA, 14 nt, Mycobacterium avium subsp. paratuberculosis
gaugaccacccucg

SEQ ID NO: 930472 - RNA, 18 nt, Mycobacterium avium subsp. paratuberculosis
gaugaccaccgcugugga

SEQ ID NO: 930473 - RNA, 19 nt, Mycobacterium avium subsp. paratuberculosis
aacugcucccaggcgucgu

SEQ ID NO: 930474 - RNA, 16 nt, Mycobacterium avium subsp. paratuberculosis
aacugcucgaccagcg

SEQ ID NO: 930475 - RNA, 22 nt, Mycobacterium avium subsp. paratuberculosis
aacugcucgaccagcgccgagg

SEQ ID NO: 930476 - RNA, 16 nt, Mycobacterium avium subsp. paratuberculosis
gaugaccggcccggcg

SEQ ID NO: 930477 - RNA, 17 nt, Mycobacterium avium subsp. paratuberculosis
gaugaccggcccggcgg

SEQ ID NO: 930478 - RNA, 21 nt, Mycobacterium avium subsp. paratuberculosis
gaugaccggccugcagcgcgg

SEQ ID NO: 930479 - RNA, 22 nt, Mycobacterium avium subsp. paratuberculosis
gaugaccuccuugcccagcgcg

SEQ ID NO: 930480 - RNA, 22 nt, Mycobacterium avium subsp. paratuberculosis
gaugaccucgcgcagcccccgg

SEQ ID NO: 930481 - RNA, 18 nt, Mycobacterium avium subsp. paratuberculosis
gaugaccucgcgcccggc

SEQ ID NO: 930482 - RNA, 15 nt, Mycobacterium avium subsp. paratuberculosis
gaugacgagcagcgu

SEQ ID NO: 930483 - RNA, 20 nt, Mycobacterium avium subsp. paratuberculosis
gaugacgagcagcgugcuga

SEQ ID NO: 930484 - RNA, 22 nt, Mycobacterium avium subsp. paratuberculosis
gaugacgaugaugucgcccggc

SEQ ID NO: 930485 - RNA, 14 nt, Mycobacterium avium subsp. paratuberculosis
gaugacgaugcccg

SEQ ID NO: 930486 - RNA, 16 nt, Mycobacterium avium subsp. paratuberculosis
gaugacgaugcccggg

SEQ ID NO: 930487 - RNA, 18 nt, Mycobacterium avium subsp. paratuberculosis
gaugacgaugcccggggu

SEQ ID NO: 930488 - RNA, 14 nt, Mycobacterium avium subsp. paratuberculosis
gaugacgcagccga

SEQ ID NO: 930489 - RNA, 22 nt, Mycobacterium avium subsp. paratuberculosis
gaugacccaccagccgagaucg

SEQ ID NO: 930490 - RNA, 14 nt, Mycobacterium avium subsp. paratuberculosis
gaugacccagccca

SEQ ID NO: 930491 - RNA, 15 nt, Mycobacterium avium subsp. paratuberculosis
gaugaccaggguggu

SEQ ID NO: 930492 - RNA, 23 nt, Mycobacterium avium subsp. paratuberculosis
gaugaccaggguggucagcgucu

SEQ ID NO: 930493 - RNA, 20 nt, Mycobacterium avium subsp. paratuberculosis
gaugaccaggucgccggcgg

SEQ ID NO: 930494 - RNA, 21 nt, Mycobacterium avium subsp. paratuberculosis
gaugaccaggucgccggcggc

SEQ ID NO: 930495 - RNA, 14 nt, Mycobacterium avium subsp. paratuberculosis
gaugaccgcccagg

SEQ ID NO: 930496 - RNA, 15 nt, Mycobacterium avium subsp. paratuberculosis
gaugaccgcccagga

SEQ ID NO: 930497 - RNA, 18 nt, Mycobacterium avium subsp. paratuberculosis
gaugaccgcccaggaccc

SEQ ID NO: 930498 - RNA, 15 nt, Mycobacterium avium subsp. paratuberculosis
gaugaccgccugcgg

SEQ ID NO: 930499 - RNA, 12 nt, Mycobacterium avium subsp. paratuberculosis
gaugaccgcguc

SEQ ID NO: 930500 - RNA, 14 nt, Mycobacterium avium subsp. paratuberculosis
gaugaccgcgucgg

SEQ ID NO: 930501 - RNA, 20 nt, Mycobacterium avium subsp. paratuberculosis
gaugaccgcgucggcgccgu

SEQ ID NO: 930502 - RNA, 15 nt, Mycobacterium avium subsp. paratuberculosis
gaugagccgcagccg

SEQ ID NO: 930503 - RNA, 18 nt, Mycobacterium avium subsp. paratuberculosis
gaugagcugggcggcgcg

SEQ ID NO: 930504 - RNA, 19 nt, Mycobacterium avium subsp. paratuberculosis
gaugagcugggcggcgcgc

SEQ ID NO: 930505 - RNA, 15 nt, Mycobacterium avium subsp. paratuberculosis
gaugagcucgcgcug

SEQ ID NO: 930506 - RNA, 13 nt, Mycobacterium avium subsp. paratuberculosis
gaugacgccggac

SEQ ID NO: 930507 - RNA, 17 nt, Mycobacterium avium subsp. paratuberculosis
gaugacgcugccgcgcc

SEQ ID NO: 930508 - RNA, 15 nt, Mycobacterium avium subsp. paratuberculosis
gaugacggcggcggu

SEQ ID NO: 930509 - RNA, 13 nt, Mycobacterium avium subsp. paratuberculosis
gaugacgccgcgc

SEQ ID NO: 930510 - RNA, 14 nt, Mycobacterium avium subsp. paratuberculosis
gaugacgccgcgcc

SEQ ID NO: 930511 - RNA, 15 nt, Mycobacterium avium subsp. paratuberculosis
gaugacgccgcgccg

SEQ ID NO: 930512 - RNA, 19 nt, Mycobacterium avium subsp. paratuberculosis
gaugacgccgcgccgcccg

SEQ ID NO: 930513 - RNA, 22 nt, Mycobacterium avium subsp. paratuberculosis
gaugacguccaccaggguggcc

SEQ ID NO: 930514 - RNA, 21 nt, Mycobacterium avium subsp. paratuberculosis
gaugacguccuugacccggcc

SEQ ID NO: 930515 - RNA, 16 nt, Mycobacterium avium subsp. paratuberculosis
gaugacgucgcccacc

SEQ ID NO: 930516 - RNA, 17 nt, Mycobacterium avium subsp. paratuberculosis
gaugacgugcaccaccg

SEQ ID NO: 930517 - RNA, 18 nt, Mycobacterium avium subsp. paratuberculosis
gaucugcacgucggcggc

SEQ ID NO: 930518 - RNA, 19 nt, Mycobacterium avium subsp. paratuberculosis
gaucugcacgucggcggcc

SEQ ID NO: 930519 - RNA, 20 nt, Mycobacterium avium subsp. paratuberculosis
gaucugcagccggcgcggca

SEQ ID NO: 930520 - RNA, 15 nt, Mycobacterium avium subsp. paratuberculosis
gaucugcaccagcgu

SEQ ID NO: 930521 - RNA, 20 nt, Mycobacterium avium subsp. paratuberculosis
gaucugauaggucagcucga

SEQ ID NO: 930522 - RNA, 18 nt, Mycobacterium avium subsp. paratuberculosis
gaucugaccgagcagcgg

SEQ ID NO: 930523 - RNA, 21 nt, Mycobacterium avium subsp. paratuberculosis
gaucugaccgagcagcggggu

SEQ ID NO: 930524 - RNA, 21 nt, Mycobacterium avium subsp. paratuberculosis
gaucucuucgaugccgguggc

SEQ ID NO: 930525 - RNA, 17 nt, Mycobacterium avium subsp. paratuberculosis
gaucucuucgccggaca

SEQ ID NO: 930526 - RNA, 13 nt, Mycobacterium avium subsp. paratuberculosis
gaucuggugcgcg

SEQ ID NO: 930527 - RNA, 22 nt, Mycobacterium avium subsp. paratuberculosis
gaucugguaugccuuggcccgc

SEQ ID NO: 930528 - RNA, 19 nt, Mycobacterium avium subsp. paratuberculosis
gaucuggucggccagcgcg

SEQ ID NO: 930529 - RNA, 21 nt, Mycobacterium avium subsp. paratuberculosis
gaucuggucggccagcgcgcg

SEQ ID NO: 930530 - RNA, 22 nt, Mycobacterium avium subsp. paratuberculosis
gaucuggucggccagcgcgcgc

SEQ ID NO: 930531 - RNA, 18 nt, Mycobacterium avium subsp. paratuberculosis
gaucugggaucggugcgc

SEQ ID NO: 930532 - RNA, 19 nt, Mycobacterium avium subsp. paratuberculosis
gaucugggaucggugcgcg

SEQ ID NO: 930533 - RNA, 14 nt, Mycobacterium avium subsp. paratuberculosis
gaucugggccagga

SEQ ID NO: 930534 - RNA, 19 nt, Mycobacterium avium subsp. paratuberculosis
gaucugggccaggaucucg

SEQ ID NO: 930535 - RNA, 14 nt, Mycobacterium avium subsp. paratuberculosis
gaucugggcggcgg

SEQ ID NO: 930536 - RNA, 22 nt, Mycobacterium avium subsp. paratuberculosis
gaucuucgagacacgcgccggc

SEQ ID NO: 930537 - RNA, 19 nt, Mycobacterium avium subsp. paratuberculosis
gaucuucucgcugcucugc

SEQ ID NO: 930538 - RNA, 16 nt, Mycobacterium avium subsp. paratuberculosis
gaucuucgcggcguac

SEQ ID NO: 930539 - RNA, 15 nt, Mycobacterium avium subsp. paratuberculosis
gaucuguucggcggc

SEQ ID NO: 930540 - RNA, 19 nt, Mycobacterium avium subsp. paratuberculosis
gaucuguucggcggcgauc

SEQ ID NO: 930541 - RNA, 17 nt, Mycobacterium avium subsp. paratuberculosis
gaucugguucaccgcca

SEQ ID NO: 930542 - RNA, 18 nt, Mycobacterium avium subsp. paratuberculosis
gaucugguucaccgccac

SEQ ID NO: 930543 - RNA, 23 nt, Mycobacterium avium subsp. paratuberculosis
gaucugguuccacagcugcaggc

SEQ ID NO: 930544 - RNA, 14 nt, Mycobacterium avium subsp. paratuberculosis
gaucuugaucgcga

SEQ ID NO: 930545 - RNA, 19 nt, Mycobacterium avium subsp. paratuberculosis
gaucuugaugucggggcgu

SEQ ID NO: 930546 - RNA, 14 nt, Mycobacterium avium subsp. paratuberculosis
gaucuugacggcga

SEQ ID NO: 930547 - RNA, 22 nt, Mycobacterium avium subsp. paratuberculosis
gaucuugcguuccucgacggcg

SEQ ID NO: 930548 - RNA, 19 nt, Mycobacterium avium subsp. paratuberculosis
gaucuuggcacgggcccgc

SEQ ID NO: 930549 - RNA, 17 nt, Mycobacterium avium subsp. paratuberculosis
gaucuugucggcggccu

SEQ ID NO: 930550 - RNA, 20 nt, Mycobacterium avium subsp. paratuberculosis
gaucuuguuguuggugccgc

SEQ ID NO: 930551 - RNA, 15 nt, Mycobacterium avium subsp. paratuberculosis
gaucucaccggcggc

SEQ ID NO: 930552 - RNA, 17 nt, Mycobacterium avium subsp. paratuberculosis
gaucucaccggcggcgg

SEQ ID NO: 930553 - RNA, 19 nt, Mycobacterium avium subsp. paratuberculosis
gaucucaccggcggcggcc

SEQ ID NO: 930554 - RNA, 15 nt, Mycobacterium avium subsp. paratuberculosis
gaucgccgugagauc

SEQ ID NO: 930555 - RNA, 16 nt, Mycobacterium avium subsp. paratuberculosis
gaucgccuccgucagc

SEQ ID NO: 930556 - RNA, 22 nt, Mycobacterium avium subsp. paratuberculosis
gaucgccuccucauaggcguac

SEQ ID NO: 930557 - RNA, 21 nt, Mycobacterium avium subsp. paratuberculosis
gaucuccaccgagugcggcgc

SEQ ID NO: 930558 - RNA, 15 nt, Mycobacterium avium subsp. paratuberculosis
gaucuccagcggccg

SEQ ID NO: 930559 - RNA, 21 nt, Mycobacterium avium subsp. paratuberculosis
gaucuccaucccgcugaagcc

SEQ ID NO: 930560 - RNA, 23 nt, Mycobacterium avium subsp. paratuberculosis
gaucuccaucccgcugaagccga

SEQ ID NO: 930561 - RNA, 16 nt, Mycobacterium avium subsp. paratuberculosis
gaucuccgcggcgaug

SEQ ID NO: 930562 - RNA, 17 nt, Mycobacterium avium subsp. paratuberculosis
gaucuccgcggcgauga

SEQ ID NO: 930563 - RNA, 22 nt, Mycobacterium avium subsp. paratuberculosis
gaucuccgcggcgaugaccgga

SEQ ID NO: 930564 - RNA, 17 nt, Mycobacterium avium subsp. paratuberculosis
gaucuccgucaccgugg

SEQ ID NO: 930565 - RNA, 14 nt, Mycobacterium avium subsp. paratuberculosis
gaucucgaccaggc

SEQ ID NO: 930566 - RNA, 22 nt, Mycobacterium avium subsp. paratuberculosis
gaucucgaccaggccguugucc

SEQ ID NO: 930567 - RNA, 21 nt, Mycobacterium avium subsp. paratuberculosis
gaucucgaccucgucggcggc

SEQ ID NO: 930568 - RNA, 20 nt, Mycobacterium avium subsp. paratuberculosis
gaucucgaccuucuugucca

SEQ ID NO: 930569 - RNA, 24 nt, Mycobacterium avium subsp. paratuberculosis
gaucucgaccuucuuguccaggau

SEQ ID NO: 930570 - RNA, 20 nt, Mycobacterium avium subsp. paratuberculosis
gaucucgacgguggccucgg

SEQ ID NO: 930571 - RNA, 21 nt, Mycobacterium avium subsp. paratuberculosis
gaucucgacgguggccucggc

SEQ ID NO: 930572 - RNA, 16 nt, Mycobacterium avium subsp. paratuberculosis
gaucucgucggugagg

SEQ ID NO: 930573 - RNA, 14 nt, Mycobacterium avium subsp. paratuberculosis
gaucucgugccgca

SEQ ID NO: 930574 - RNA, 14 nt, Mycobacterium avium subsp. paratuberculosis
gaucgccgacgcca

SEQ ID NO: 930575 - RNA, 19 nt, Mycobacterium avium subsp. paratuberculosis
gaucgccgacgccagcacg

SEQ ID NO: 930576 - RNA, 17 nt, Mycobacterium avium subsp. paratuberculosis
gaucgccgcccaucggc

SEQ ID NO: 930577 - RNA, 18 nt, Mycobacterium avium subsp. paratuberculosis
gaucgccgcccaucggca

SEQ ID NO: 930578 - RNA, 23 nt, Mycobacterium avium subsp. paratuberculosis
gaucgccgcccaucggcagcccg

SEQ ID NO: 930579 - RNA, 20 nt, Mycobacterium avium subsp. paratuberculosis
gaucgccgagguagccgcgc

SEQ ID NO: 930580 - RNA, 20 nt, Mycobacterium avium subsp. paratuberculosis
gaucgccgagucgaucgcca

SEQ ID NO: 930581 - RNA, 17 nt, Mycobacterium avium subsp. paratuberculosis
gaucgccgauccggcgc

SEQ ID NO: 930582 - RNA, 21 nt, Mycobacterium avium subsp. paratuberculosis
gaucgccgauccggcgccgcg

SEQ ID NO: 930583 - RNA, 15 nt, Mycobacterium avium subsp. paratuberculosis
gaucgccggugcggc

SEQ ID NO: 930584 - RNA, 19 nt, Mycobacterium avium subsp. paratuberculosis
gaucgccggugcggccgcg

SEQ ID NO: 930585 - RNA, 23 nt, Mycobacterium avium subsp. paratuberculosis
gaucgccggaucggucucggugg

SEQ ID NO: 930586 - RNA, 14 nt, Mycobacterium avium subsp. paratuberculosis
gaucgccgggucgc

SEQ ID NO: 930587 - RNA, 16 nt, Mycobacterium avium subsp. paratuberculosis
gaucgccggcgccgga

SEQ ID NO: 930588 - RNA, 22 nt, Mycobacterium avium subsp. paratuberculosis
gaucgccgcaacuugcccgacg

SEQ ID NO: 930589 - RNA, 13 nt, Mycobacterium avium subsp. paratuberculosis
gaucgccgcgcau

SEQ ID NO: 930590 - RNA, 14 nt, Mycobacterium avium subsp. paratuberculosis
gaucgccgcgccca

SEQ ID NO: 930591 - RNA, 16 nt, Mycobacterium avium subsp. paratuberculosis
gaucgccgcgcccagc

SEQ ID NO: 930592 - RNA, 20 nt, Mycobacterium avium subsp. paratuberculosis
gaucgccgcgcccagcacgu

SEQ ID NO: 930593 - RNA, 13 nt, Mycobacterium avium subsp. paratuberculosis
gauguugcggccg

SEQ ID NO: 930594 - RNA, 16 nt, Mycobacterium avium subsp. paratuberculosis
gauguugcggccggcc

SEQ ID NO: 930595 - RNA, 16 nt, Mycobacterium avium subsp. paratuberculosis
gauguuggccgcgacg

SEQ ID NO: 930596 - RNA, 16 nt, Mycobacterium avium subsp. paratuberculosis
gauguugaugucgcgc

SEQ ID NO: 930597 - RNA, 23 nt, Mycobacterium avium subsp. paratuberculosis
gauguucaguucguccagcccga

SEQ ID NO: 930598 - RNA, 19 nt, Mycobacterium avium subsp. paratuberculosis
gauguucaccccggcgcgg

SEQ ID NO: 930599 - RNA, 13 nt, Mycobacterium avium subsp. paratuberculosis
gauguggccggcg

SEQ ID NO: 930600 - RNA, 17 nt, Mycobacterium avium subsp. paratuberculosis
gaugucggugcggccgc

SEQ ID NO: 930601 - RNA, 18 nt, Mycobacterium avium subsp. paratuberculosis
gaugucggugcggccgca

SEQ ID NO: 930602 - RNA, 19 nt, Mycobacterium avium subsp. paratuberculosis
gaugucgguggcgcgcagu

SEQ ID NO: 930603 - RNA, 17 nt, Mycobacterium avium subsp. paratuberculosis
gaugucggugggccgca

SEQ ID NO: 930604 - RNA, 18 nt, Mycobacterium avium subsp. paratuberculosis
gaugucggugagcgccac

SEQ ID NO: 930605 - RNA, 19 nt, Mycobacterium avium subsp. paratuberculosis
gaugucggugagcgccacc

SEQ ID NO: 930606 - RNA, 23 nt, Mycobacterium avium subsp. paratuberculosis
gaugugggccgcagcagcgaggc

SEQ ID NO: 930607 - RNA, 20 nt, Mycobacterium avium subsp. paratuberculosis
gauguggcgggcguccugcg

SEQ ID NO: 930608 - RNA, 16 nt, Mycobacterium avium subsp. paratuberculosis
gauguggucggccacg

SEQ ID NO: 930609 - RNA, 18 nt, Mycobacterium avium subsp. paratuberculosis
gauucaaccccgcgcgcg

SEQ ID NO: 930610 - RNA, 23 nt, Mycobacterium avium subsp. paratuberculosis
gauucaaccccgcgcgcgggcca

SEQ ID NO: 930611 - RNA, 13 nt, Mycobacterium avium subsp. paratuberculosis
gauugcgcggcgc

SEQ ID NO: 930612 - RNA, 20 nt, Mycobacterium avium subsp. paratuberculosis
gauugcgcggcgccggaugg

SEQ ID NO: 930613 - RNA, 17 nt, Mycobacterium avium subsp. paratuberculosis
gauugccgggcaccagc

SEQ ID NO: 930614 - RNA, 20 nt, Mycobacterium avium subsp. paratuberculosis
gauugccgggcaccagcgac

SEQ ID NO: 930615 - RNA, 21 nt, Mycobacterium avium subsp. paratuberculosis
gauugccgggcaccagcgaca

SEQ ID NO: 930616 - RNA, 14 nt, Mycobacterium avium subsp. paratuberculosis
gauugucggccgcc

SEQ ID NO: 930617 - RNA, 21 nt, Mycobacterium avium subsp. paratuberculosis
gauugucggccgcccguccgg

SEQ ID NO: 930618 - RNA, 16 nt, Mycobacterium avium subsp. paratuberculosis
gauugucggggccgca

SEQ ID NO: 930619 - RNA, 18 nt, Mycobacterium avium subsp. paratuberculosis
gauucgggucagaccgcg

SEQ ID NO: 930620 - RNA, 19 nt, Mycobacterium avium subsp. paratuberculosis
gauucgggucagaccgcgg

SEQ ID NO: 930621 - RNA, 18 nt, Mycobacterium avium subsp. paratuberculosis
gauucgcgguggcgaacu

SEQ ID NO: 930622 - RNA, 14 nt, Mycobacterium avium subsp. paratuberculosis
gauucggcgccgcg

SEQ ID NO: 930623 - RNA, 22 nt, Mycobacterium avium subsp. paratuberculosis
gauucggcuccugccguucggc

SEQ ID NO: 930624 - RNA, 16 nt, Mycobacterium avium subsp. paratuberculosis
gauucggccaugccgc

SEQ ID NO: 930625 - RNA, 19 nt, Mycobacterium avium subsp. paratuberculosis
gauucgaucaaaucccgca

SEQ ID NO: 930626 - RNA, 14 nt, Mycobacterium avium subsp. paratuberculosis
gauucaucgccgaa

SEQ ID NO: 930627 - RNA, 16 nt, Mycobacterium avium subsp. paratuberculosis
gcaaaccgaccgccgc

SEQ ID NO: 930628 - RNA, 17 nt, Mycobacterium avium subsp. paratuberculosis
gcaaaccgaccgccgcg

SEQ ID NO: 930629 - RNA, 19 nt, Mycobacterium avium subsp. paratuberculosis
gcaaacgaaucgagccgcc

SEQ ID NO: 930630 - RNA, 18 nt, Mycobacterium avium subsp. paratuberculosis
gauugcggccgccggcca

SEQ ID NO: 930631 - RNA, 21 nt, Mycobacterium avium subsp. paratuberculosis
gauuuccgguuccucggcgug

SEQ ID NO: 930632 - RNA, 14 nt, Mycobacterium avium subsp. paratuberculosis
gcaacaccucggcg

SEQ ID NO: 930633 - RNA, 15 nt, Mycobacterium avium subsp. paratuberculosis
gcaacaccucggcga

SEQ ID NO: 930634 - RNA, 16 nt, Mycobacterium avium subsp. paratuberculosis
gcaacaccucggcgac

SEQ ID NO: 930635 - RNA, 17 nt, Mycobacterium avium subsp. paratuberculosis
gcaacaccucggcgacg

SEQ ID NO: 930636 - RNA, 23 nt, Mycobacterium avium subsp. paratuberculosis
gcaacaccucgggcacguccagc

SEQ ID NO: 930637 - RNA, 15 nt, Mycobacterium avium subsp. paratuberculosis
gcaaagacgacggcu

SEQ ID NO: 930638 - RNA, 21 nt, Mycobacterium avium subsp. paratuberculosis
gcaacacguugagucccucgg

SEQ ID NO: 930639 - RNA, 14 nt, Mycobacterium avium subsp. paratuberculosis
gcaacacucgagcg

SEQ ID NO: 930640 - RNA, 17 nt, Mycobacterium avium subsp. paratuberculosis
gcaacacucgagcgcgc

SEQ ID NO: 930641 - RNA, 19 nt, Mycobacterium avium subsp. paratuberculosis
gcaacacucgagcgcgcuc

SEQ ID NO: 930642 - RNA, 23 nt, Mycobacterium avium subsp. paratuberculosis
gcaacacucgagcgcgcucaacc

SEQ ID NO: 930643 - RNA, 20 nt, Mycobacterium avium subsp. paratuberculosis
gcaacaccggcggcgacggc

SEQ ID NO: 930644 - RNA, 20 nt, Mycobacterium avium subsp. paratuberculosis
gcaacaccuuucggccgcgg

SEQ ID NO: 930645 - RNA, 17 nt, Mycobacterium avium subsp. paratuberculosis
gcaacagcagcggcaug

SEQ ID NO: 930646 - RNA, 14 nt, Mycobacterium avium subsp. paratuberculosis
gcaacagcaccagc

SEQ ID NO: 930647 - RNA, 16 nt, Mycobacterium avium subsp. paratuberculosis
gcaacagccggcccga

SEQ ID NO: 930648 - RNA, 19 nt, Mycobacterium avium subsp. paratuberculosis
gcaacagccggcccgagcc

SEQ ID NO: 930649 - RNA, 16 nt, Mycobacterium avium subsp. paratuberculosis
gcaacagcgagucggu

SEQ ID NO: 930650 - RNA, 18 nt, Mycobacterium avium subsp. paratuberculosis
gcaacagcgagucggucg

SEQ ID NO: 930651 - RNA, 19 nt, Mycobacterium avium subsp. paratuberculosis
gcaacagcgagucggucga

SEQ ID NO: 930652 - RNA, 19 nt, Mycobacterium avium subsp. paratuberculosis
gcaacagcaccagcaccac

SEQ ID NO: 930653 - RNA, 15 nt, Mycobacterium avium subsp. paratuberculosis
gcaacagcgucucga

SEQ ID NO: 930654 - RNA, 18 nt, Mycobacterium avium subsp. paratuberculosis
gcaacagcgucucgacgg

SEQ ID NO: 930655 - RNA, 19 nt, Mycobacterium avium subsp. paratuberculosis
gcaacagcgugcacacccg

SEQ ID NO: 930656 - RNA, 20 nt, Mycobacterium avium subsp. paratuberculosis
gcaacagcauuucgcgcggc

SEQ ID NO: 930657 - RNA, 15 nt, Mycobacterium avium subsp. paratuberculosis
gcaacagcccgaccg

SEQ ID NO: 930658 - RNA, 13 nt, Mycobacterium avium subsp. paratuberculosis
gcaacagcgcgcc

SEQ ID NO: 930659 - RNA, 17 nt, Mycobacterium avium subsp. paratuberculosis
gcaacagcgcgccggcc

SEQ ID NO: 930660 - RNA, 20 nt, Mycobacterium avium subsp. paratuberculosis
gcaacagcgcgccggccggc

SEQ ID NO: 930661 - RNA, 21 nt, Mycobacterium avium subsp. paratuberculosis
gcaacagcgcgccggccggca

SEQ ID NO: 930662 - RNA, 18 nt, Mycobacterium avium subsp. paratuberculosis
aacuucacgcucgcaggc

SEQ ID NO: 930663 - RNA, 15 nt, Mycobacterium avium subsp. paratuberculosis
aacuucacgcucggc

SEQ ID NO: 930664 - RNA, 18 nt, Mycobacterium avium subsp. paratuberculosis
aacuucacgcucggcgag

SEQ ID NO: 930665 - RNA, 23 nt, Mycobacterium avium subsp. paratuberculosis
gaugcggcccggccacucgccgc

SEQ ID NO: 930666 - RNA, 23 nt, Mycobacterium avium subsp. paratuberculosis
gaugcggcccuggcgggcggccc

SEQ ID NO: 930667 - RNA, 17 nt, Mycobacterium avium subsp. paratuberculosis
aacuuccgcccggcgag

SEQ ID NO: 930668 - RNA, 18 nt, Mycobacterium avium subsp. paratuberculosis
aacuuccgcccggcgagc

SEQ ID NO: 930669 - RNA, 14 nt, Mycobacterium avium subsp. paratuberculosis
gaugcgcggcccgu

SEQ ID NO: 930670 - RNA, 23 nt, Mycobacterium avium subsp. paratuberculosis
gaugcgcggcccguugagcaccg

SEQ ID NO: 930671 - RNA, 14 nt, Mycobacterium avium subsp. paratuberculosis
gaugcgcgucgcgg

SEQ ID NO: 930672 - RNA, 17 nt, Mycobacterium avium subsp. paratuberculosis
gaugcgcgucgcggcgc

SEQ ID NO: 930673 - RNA, 21 nt, Mycobacterium avium subsp. paratuberculosis
gaugcgcuggugcacccgaug

SEQ ID NO: 930674 - RNA, 18 nt, Mycobacterium avium subsp. paratuberculosis
gaugcgcugugcggguga

SEQ ID NO: 930675 - RNA, 21 nt, Mycobacterium avium subsp. paratuberculosis
gaugcggcccagcccggccag

SEQ ID NO: 930676 - RNA, 23 nt, Mycobacterium avium subsp. paratuberculosis
gaugcggcccagcccggccagca

SEQ ID NO: 930677 - RNA, 15 nt, Mycobacterium avium subsp. paratuberculosis
gaugcggcccgaccc

SEQ ID NO: 930678 - RNA, 21 nt, Mycobacterium avium subsp. paratuberculosis
gaugcggacaccagucgcaca

SEQ ID NO: 930679 - RNA, 20 nt, Mycobacterium avium subsp. paratuberculosis
gaugcggcaccagcccgccg

SEQ ID NO: 930680 - RNA, 18 nt, Mycobacterium avium subsp. paratuberculosis
gaugcgccgugcccaaca

SEQ ID NO: 930681 - RNA, 19 nt, Mycobacterium avium subsp. paratuberculosis
gaugcgcgccuccgacgac

SEQ ID NO: 930682 - RNA, 16 nt, Mycobacterium avium subsp. paratuberculosis
gaugcgcgccgacgac

SEQ ID NO: 930683 - RNA, 18 nt, Mycobacterium avium subsp. paratuberculosis
gaugcgcgccaccaggcg

SEQ ID NO: 930684 - RNA, 13 nt, Mycobacterium avium subsp. paratuberculosis
gaugcgcgacggc

SEQ ID NO: 930685 - RNA, 14 nt, Mycobacterium avium subsp. paratuberculosis
gaugcgcgacggcc

SEQ ID NO: 930686 - RNA, 20 nt, Mycobacterium avium subsp. paratuberculosis
gaugcgcgacggccucgccg

SEQ ID NO: 930687 - RNA, 24 nt, Mycobacterium avium subsp. paratuberculosis
gaugcgcgacggccucgccgucgc

SEQ ID NO: 930688 - RNA, 19 nt, Mycobacterium avium subsp. paratuberculosis
gaugcgccggguccagccg

SEQ ID NO: 930689 - RNA, 22 nt, Mycobacterium avium subsp. paratuberculosis
gaugcgccggguccagccgcgg

SEQ ID NO: 930690 - RNA, 15 nt, Mycobacterium avium subsp. paratuberculosis
gaugcgcccgcgcca

SEQ ID NO: 930691 - RNA, 17 nt, Mycobacterium avium subsp. paratuberculosis
gaugcgcccgcgccacc

SEQ ID NO: 930692 - RNA, 20 nt, Mycobacterium avium subsp. paratuberculosis
gaugcgcccgcgccaccccg

SEQ ID NO: 930693 - RNA, 21 nt, Mycobacterium avium subsp. paratuberculosis
gaugcgcccgcgccaccccga

SEQ ID NO: 930694 - RNA, 20 nt, Mycobacterium avium subsp. paratuberculosis
gaugcgcccgcugcggcgca

SEQ ID NO: 930695 - RNA, 16 nt, Mycobacterium avium subsp. paratuberculosis
gaugcgccaccgacac

SEQ ID NO: 930696 - RNA, 17 nt, Mycobacterium avium subsp. paratuberculosis
gaugcgccaccgacacc

SEQ ID NO: 930697 - RNA, 18 nt, Mycobacterium avium subsp. paratuberculosis
gaugcgccaccgacacca

SEQ ID NO: 930698 - RNA, 19 nt, Mycobacterium avium subsp. paratuberculosis
gaugcgccaccgacaccac

SEQ ID NO: 930699 - RNA, 23 nt, Mycobacterium avium subsp. paratuberculosis
aacuucggggugacuucgagccg

SEQ ID NO: 930700 - RNA, 15 nt, Mycobacterium avium subsp. paratuberculosis
gaugcguucggccgc

SEQ ID NO: 930701 - RNA, 17 nt, Mycobacterium avium subsp. paratuberculosis
gaugcguucggccgcag

SEQ ID NO: 930702 - RNA, 21 nt, Mycobacterium avium subsp. paratuberculosis
gaugcguuggccgagcagccg

SEQ ID NO: 930703 - RNA, 23 nt, Mycobacterium avium subsp. paratuberculosis
gaugcguugguguagccgaacgu

SEQ ID NO: 930704 - RNA, 14 nt, Mycobacterium avium subsp. paratuberculosis
gaugcgggcccgca

SEQ ID NO: 930705 - RNA, 18 nt, Mycobacterium avium subsp. paratuberculosis
gaugcgggcgccgaacgu

SEQ ID NO: 930706 - RNA, 12 nt, Mycobacterium avium subsp. paratuberculosis
gaugcgggcgcu

SEQ ID NO: 930707 - RNA, 14 nt, Mycobacterium avium subsp. paratuberculosis
gaugcugauccgca

SEQ ID NO: 930708 - RNA, 23 nt, Mycobacterium avium subsp. paratuberculosis
gaugcucgaugcgcaccugcggc

SEQ ID NO: 930709 - RNA, 13 nt, Mycobacterium avium subsp. paratuberculosis
gauggagcugacc

SEQ ID NO: 930710 - RNA, 16 nt, Mycobacterium avium subsp. paratuberculosis
gauggaggucccgagg

SEQ ID NO: 930711 - RNA, 15 nt, Mycobacterium avium subsp. paratuberculosis
gauggcaacgccggu

SEQ ID NO: 930712 - RNA, 15 nt, Mycobacterium avium subsp. paratuberculosis
gauggagccgcccau

SEQ ID NO: 930713 - RNA, 18 nt, Mycobacterium avium subsp. paratuberculosis
gauggacguccagcggcc

SEQ ID NO: 930714 - RNA, 14 nt, Mycobacterium avium subsp. paratuberculosis
gauggacgcccaga

SEQ ID NO: 930715 - RNA, 19 nt, Mycobacterium avium subsp. paratuberculosis
gauggacggggcgaugccg

SEQ ID NO: 930716 - RNA, 15 nt, Mycobacterium avium subsp. paratuberculosis
gaugcugcccggcgc

SEQ ID NO: 930717 - RNA, 13 nt, Mycobacterium avium subsp. paratuberculosis
gauggccggccgg

SEQ ID NO: 930718 - RNA, 14 nt, Mycobacterium avium subsp. paratuberculosis
gauggccggccggg

SEQ ID NO: 930719 - RNA, 15 nt, Mycobacterium avium subsp. paratuberculosis
gauggccggccgggu

SEQ ID NO: 930720 - RNA, 17 nt, Mycobacterium avium subsp. paratuberculosis
gauggccggccggguca

SEQ ID NO: 930721 - RNA, 13 nt, Mycobacterium avium subsp. paratuberculosis
gauggccgcgccg

SEQ ID NO: 930722 - RNA, 21 nt, Mycobacterium avium subsp. paratuberculosis
gauggccaccaucaggccggc

SEQ ID NO: 930723 - RNA, 22 nt, Mycobacterium avium subsp. paratuberculosis
gauggccaccaucaggccggcc

SEQ ID NO: 930724 - RNA, 13 nt, Mycobacterium avium subsp. paratuberculosis
gauggccaccggg

SEQ ID NO: 930725 - RNA, 21 nt, Mycobacterium avium subsp. paratuberculosis
gauggccacgcucucgccggu

SEQ ID NO: 930726 - RNA, 19 nt, Mycobacterium avium subsp. paratuberculosis
gauggccgccgcaggcgaa

SEQ ID NO: 930727 - RNA, 22 nt, Mycobacterium avium subsp. paratuberculosis
gauggcucgcgggggccgcgau

SEQ ID NO: 930728 - RNA, 13 nt, Mycobacterium avium subsp. paratuberculosis
gaugggcagcgcc

SEQ ID NO: 930729 - RNA, 18 nt, Mycobacterium avium subsp. paratuberculosis
gaugggcagcgccccggu

SEQ ID NO: 930730 - RNA, 14 nt, Mycobacterium avium subsp. paratuberculosis
gauggucagccgca

SEQ ID NO: 930731 - RNA, 22 nt, Mycobacterium avium subsp. paratuberculosis
gaugggcauugcccaucgccac

SEQ ID NO: 930732 - RNA, 23 nt, Mycobacterium avium subsp. paratuberculosis
gaugggcauugcccaucgccacg

SEQ ID NO: 930733 - RNA, 23 nt, Mycobacterium avium subsp. paratuberculosis
gauggcggcgcgcucgucgucgg

SEQ ID NO: 930734 - RNA, 15 nt, Mycobacterium avium subsp. paratuberculosis
gauggcgcggccggc

SEQ ID NO: 930735 - RNA, 14 nt, Mycobacterium avium subsp. paratuberculosis
gauggcgcggcgca

SEQ ID NO: 930736 - RNA, 20 nt, Mycobacterium avium subsp. paratuberculosis
gauggcgcggcgcaccgccc

SEQ ID NO: 930737 - RNA, 21 nt, Mycobacterium avium subsp. paratuberculosis
gauggcgcggcgcaccgcccg

SEQ ID NO: 930738 - RNA, 14 nt, Mycobacterium avium subsp. paratuberculosis
gauggccugcacgg

SEQ ID NO: 930739 - RNA, 14 nt, Mycobacterium avium subsp. paratuberculosis
gauggccucgucga

SEQ ID NO: 930740 - RNA, 22 nt, Mycobacterium avium subsp. paratuberculosis
gauggccucgucgaugucggcg

SEQ ID NO: 930741 - RNA, 15 nt, Mycobacterium avium subsp. paratuberculosis
gauggccucgucgcg

SEQ ID NO: 930742 - RNA, 17 nt, Mycobacterium avium subsp. paratuberculosis
gauggccucgucgcgga

SEQ ID NO: 930743 - RNA, 18 nt, Mycobacterium avium subsp. paratuberculosis
gauggccucggcgaugcc

SEQ ID NO: 930744 - RNA, 16 nt, Mycobacterium avium subsp. paratuberculosis
gauggccuccgacccg

SEQ ID NO: 930745 - RNA, 14 nt, Mycobacterium avium subsp. paratuberculosis
gauggccgggcagg

SEQ ID NO: 930746 - RNA, 12 nt, Mycobacterium avium subsp. paratuberculosis
gauggucgucgg

SEQ ID NO: 930747 - RNA, 13 nt, Mycobacterium avium subsp. paratuberculosis
gauggucgucggg

SEQ ID NO: 930748 - RNA, 17 nt, Mycobacterium avium subsp. paratuberculosis
gauggucgucgugguga

SEQ ID NO: 930749 - RNA, 22 nt, Mycobacterium avium subsp. paratuberculosis
gauggucucccgggcggucgcg

SEQ ID NO: 930750 - RNA, 13 nt, Mycobacterium avium subsp. paratuberculosis
gaugggccgcccg

SEQ ID NO: 930751 - RNA, 17 nt, Mycobacterium avium subsp. paratuberculosis
gaugguccgcaugucga

SEQ ID NO: 930752 - RNA, 19 nt, Mycobacterium avium subsp. paratuberculosis
gaugguccagcaccggcgc

SEQ ID NO: 930753 - RNA, 21 nt, Mycobacterium avium subsp. paratuberculosis
gaugguccagcaccggcgccc

SEQ ID NO: 930754 - RNA, 15 nt, Mycobacterium avium subsp. paratuberculosis
gauggucgcgccgcg

SEQ ID NO: 930755 - RNA, 16 nt, Mycobacterium avium subsp. paratuberculosis
gauggucgcgccgcgg

SEQ ID NO: 930756 - RNA, 17 nt, Mycobacterium avium subsp. paratuberculosis
gauggucgcgccgcggc

SEQ ID NO: 930757 - RNA, 18 nt, Mycobacterium avium subsp. paratuberculosis
gauggucgcgccgcggcg

SEQ ID NO: 930758 - RNA, 15 nt, Mycobacterium avium subsp. paratuberculosis
gauggugcccaccgg

SEQ ID NO: 930759 - RNA, 19 nt, Mycobacterium avium subsp. paratuberculosis
gauggugcccaccgggcag

SEQ ID NO: 930760 - RNA, 14 nt, Mycobacterium avium subsp. paratuberculosis
gauggugccgaagc

SEQ ID NO: 930761 - RNA, 14 nt, Mycobacterium avium subsp. paratuberculosis
gauggugaagccgu

SEQ ID NO: 930762 - RNA, 17 nt, Mycobacterium avium subsp. paratuberculosis
gauggugaccaaccaca

SEQ ID NO: 930763 - RNA, 17 nt, Mycobacterium avium subsp. paratuberculosis
gauggugaccucggucg

SEQ ID NO: 930764 - RNA, 13 nt, Mycobacterium avium subsp. paratuberculosis
gauggugacggcc

SEQ ID NO: 930765 - RNA, 17 nt, Mycobacterium avium subsp. paratuberculosis
gauggugacggccguga

SEQ ID NO: 930766 - RNA, 16 nt, Mycobacterium avium subsp. paratuberculosis
gauggugaucgaccgg

SEQ ID NO: 930767 - RNA, 19 nt, Mycobacterium avium subsp. paratuberculosis
gauggugaucgaccggacg

SEQ ID NO: 930768 - RNA, 19 nt, Mycobacterium avium subsp. paratuberculosis
gauggugaucucgccgcgg

SEQ ID NO: 930769 - RNA, 23 nt, Mycobacterium avium subsp. paratuberculosis
gauggugaucucgccgcgguggu

SEQ ID NO: 930770 - RNA, 16 nt, Mycobacterium avium subsp. paratuberculosis
gauguacuugaugacg

SEQ ID NO: 930771 - RNA, 23 nt, Mycobacterium avium subsp. paratuberculosis
gauguacugggccgucgcccgga

SEQ ID NO: 930772 - RNA, 17 nt, Mycobacterium avium subsp. paratuberculosis
gauguagccgccggugg

SEQ ID NO: 930773 - RNA, 18 nt, Mycobacterium avium subsp. paratuberculosis
gauguagcggcggucggc

SEQ ID NO: 930774 - RNA, 20 nt, Mycobacterium avium subsp. paratuberculosis
gauguagcggcggucggcgc

SEQ ID NO: 930775 - RNA, 14 nt, Mycobacterium avium subsp. paratuberculosis
gaugucgcugccgc

SEQ ID NO: 930776 - RNA, 17 nt, Mycobacterium avium subsp. paratuberculosis
gaugucgcugccgccgc

SEQ ID NO: 930777 - RNA, 18 nt, Mycobacterium avium subsp. paratuberculosis
gaugucgcugccgccgcc

SEQ ID NO: 930778 - RNA, 18 nt, Mycobacterium avium subsp. paratuberculosis
gaugucgcggcgcacggu

SEQ ID NO: 930779 - RNA, 14 nt, Mycobacterium avium subsp. paratuberculosis
gaugucgcgcggcu

SEQ ID NO: 930780 - RNA, 13 nt, Mycobacterium avium subsp. paratuberculosis
gaugucgccggcg

SEQ ID NO: 930781 - RNA, 18 nt, Mycobacterium avium subsp. paratuberculosis
gaugucgccggcgaccgc

SEQ ID NO: 930782 - RNA, 17 nt, Mycobacterium avium subsp. paratuberculosis
gaugucgccggcggcga

SEQ ID NO: 930783 - RNA, 14 nt, Mycobacterium avium subsp. paratuberculosis
gaugucggcgaacc

SEQ ID NO: 930784 - RNA, 20 nt, Mycobacterium avium subsp. paratuberculosis
gaugucggcuucguacggcc

SEQ ID NO: 930785 - RNA, 14 nt, Mycobacterium avium subsp. paratuberculosis
gaugucgggcgagg

SEQ ID NO: 930786 - RNA, 20 nt, Mycobacterium avium subsp. paratuberculosis
gaugucggcgaaccagggca

SEQ ID NO: 930787 - RNA, 16 nt, Mycobacterium avium subsp. paratuberculosis
gaugucggcggccggg

SEQ ID NO: 930788 - RNA, 19 nt, Mycobacterium avium subsp. paratuberculosis
gaugucggcgggccggucc

SEQ ID NO: 930789 - RNA, 14 nt, Mycobacterium avium subsp. paratuberculosis
gaugucggccagcg

SEQ ID NO: 930790 - RNA, 22 nt, Mycobacterium avium subsp. paratuberculosis
gaugucggccagcgcggcggcc

SEQ ID NO: 930791 - RNA, 14 nt, Mycobacterium avium subsp. paratuberculosis
gaugucggccagga

SEQ ID NO: 930792 - RNA, 16 nt, Mycobacterium avium subsp. paratuberculosis
gaugucggccggcagu

SEQ ID NO: 930793 - RNA, 13 nt, Mycobacterium avium subsp. paratuberculosis
gaugucggccggu

SEQ ID NO: 930794 - RNA, 23 nt, Mycobacterium avium subsp. paratuberculosis
gaugucggccgguccgugcacgg

SEQ ID NO: 930795 - RNA, 17 nt, Mycobacterium avium subsp. paratuberculosis
gaugucgcccggcgcgg

SEQ ID NO: 930796 - RNA, 20 nt, Mycobacterium avium subsp. paratuberculosis
gaugucacccguuugaggcg

SEQ ID NO: 930797 - RNA, 18 nt, Mycobacterium avium subsp. paratuberculosis
gaugucacccucgaggcc

SEQ ID NO: 930798 - RNA, 16 nt, Mycobacterium avium subsp. paratuberculosis
gaugucacguugauga

SEQ ID NO: 930799 - RNA, 18 nt, Mycobacterium avium subsp. paratuberculosis
gauccucgucuccggcgg

SEQ ID NO: 930800 - RNA, 14 nt, Mycobacterium avium subsp. paratuberculosis
gauccucgccgcgg

SEQ ID NO: 930801 - RNA, 17 nt, Mycobacterium avium subsp. paratuberculosis
gauccgucaucucguca

SEQ ID NO: 930802 - RNA, 15 nt, Mycobacterium avium subsp. paratuberculosis
gauccgucgccccgc

SEQ ID NO: 930803 - RNA, 22 nt, Mycobacterium avium subsp. paratuberculosis
gauccgcaccggacgcagcgau

SEQ ID NO: 930804 - RNA, 12 nt, Mycobacterium avium subsp. paratuberculosis
gauccggugacc

SEQ ID NO: 930805 - RNA, 16 nt, Mycobacterium avium subsp. paratuberculosis
gauccggugaccgcga

SEQ ID NO: 930806 - RNA, 17 nt, Mycobacterium avium subsp. paratuberculosis
gauccggugaccgcgac

SEQ ID NO: 930807 - RNA, 21 nt, Mycobacterium avium subsp. paratuberculosis
gauccggugaccgcgacgcug

SEQ ID NO: 930808 - RNA, 17 nt, Mycobacterium avium subsp. paratuberculosis
gauccgguaccagaucg

SEQ ID NO: 930809 - RNA, 18 nt, Mycobacterium avium subsp. paratuberculosis
gauccggucgaucaccuc

SEQ ID NO: 930810 - RNA, 15 nt, Mycobacterium avium subsp. paratuberculosis
gauccgggcgccggc

SEQ ID NO: 930811 - RNA, 14 nt, Mycobacterium avium subsp. paratuberculosis
gauccgggcggcag

SEQ ID NO: 930812 - RNA, 17 nt, Mycobacterium avium subsp. paratuberculosis
gauccggggcacgauga

SEQ ID NO: 930813 - RNA, 17 nt, Mycobacterium avium subsp. paratuberculosis
gauccggggggcggggu

SEQ ID NO: 930814 - RNA, 21 nt, Mycobacterium avium subsp. paratuberculosis
gauccggcgucucagucggcc

SEQ ID NO: 930815 - RNA, 22 nt, Mycobacterium avium subsp. paratuberculosis
gauccggcgucucagucggcca

SEQ ID NO: 930816 - RNA, 21 nt, Mycobacterium avium subsp. paratuberculosis
gauccggcuccacagcaguuc

SEQ ID NO: 930817 - RNA, 18 nt, Mycobacterium avium subsp. paratuberculosis
gauccggcugagcagcuc

SEQ ID NO: 930818 - RNA, 20 nt, Mycobacterium avium subsp. paratuberculosis
gauccggcugagcagcucgc

SEQ ID NO: 930819 - RNA, 21 nt, Mycobacterium avium subsp. paratuberculosis
gauccggcugagcagcucgcg

SEQ ID NO: 930820 - RNA, 13 nt, Mycobacterium avium subsp. paratuberculosis
gauccgggccggc

SEQ ID NO: 930821 - RNA, 15 nt, Mycobacterium avium subsp. paratuberculosis
gauccgggccggcgu

SEQ ID NO: 930822 - RNA, 17 nt, Mycobacterium avium subsp. paratuberculosis
gaucccuuggcggcggc

SEQ ID NO: 930823 - RNA, 20 nt, Mycobacterium avium subsp. paratuberculosis
gaucccuuggcggcggccag

SEQ ID NO: 930824 - RNA, 16 nt, Mycobacterium avium subsp. paratuberculosis
gauccgaucugcucga

SEQ ID NO: 930825 - RNA, 23 nt, Mycobacterium avium subsp. paratuberculosis
gauccgaugacgcugccgcgccg

SEQ ID NO: 930826 - RNA, 17 nt, Mycobacterium avium subsp. paratuberculosis
gauccgaugcagggccg

SEQ ID NO: 930827 - RNA, 17 nt, Mycobacterium avium subsp. paratuberculosis
gauccgaucagcagcac

SEQ ID NO: 930828 - RNA, 18 nt, Mycobacterium avium subsp. paratuberculosis
gauccaggaauucgggca

SEQ ID NO: 930829 - RNA, 14 nt, Mycobacterium avium subsp. paratuberculosis
gauccgcccgccgg

SEQ ID NO: 930830 - RNA, 20 nt, Mycobacterium avium subsp. paratuberculosis
gauccgcccgccgguggccg

SEQ ID NO: 930831 - RNA, 23 nt, Mycobacterium avium subsp. paratuberculosis
gauccgcccgccgguggccgcga

SEQ ID NO: 930832 - RNA, 13 nt, Mycobacterium avium subsp. paratuberculosis
gauccgccguugc

SEQ ID NO: 930833 - RNA, 14 nt, Mycobacterium avium subsp. paratuberculosis
gauccgccugcgcg

SEQ ID NO: 930834 - RNA, 15 nt, Mycobacterium avium subsp. paratuberculosis
gauccgccugcgcgg

SEQ ID NO: 930835 - RNA, 19 nt, Mycobacterium avium subsp. paratuberculosis
gauccgccugcgcgggcgc

SEQ ID NO: 930836 - RNA, 19 nt, Mycobacterium avium subsp. paratuberculosis
gauccgccggugccguuga

SEQ ID NO: 930837 - RNA, 14 nt, Mycobacterium avium subsp. paratuberculosis
gauccggcgccgcg

SEQ ID NO: 930838 - RNA, 15 nt, Mycobacterium avium subsp. paratuberculosis
gauccggcgccgcgg

SEQ ID NO: 930839 - RNA, 19 nt, Mycobacterium avium subsp. paratuberculosis
gauccggcgccgcgggcgc

SEQ ID NO: 930840 - RNA, 15 nt, Mycobacterium avium subsp. paratuberculosis
gauccggcgcgccgc

SEQ ID NO: 930841 - RNA, 16 nt, Mycobacterium avium subsp. paratuberculosis
gauccggcgcgccgcg

SEQ ID NO: 930842 - RNA, 15 nt, Mycobacterium avium subsp. paratuberculosis
gaucgacccgcuccg

SEQ ID NO: 930843 - RNA, 17 nt, Mycobacterium avium subsp. paratuberculosis
gaucgagggggucauca

SEQ ID NO: 930844 - RNA, 19 nt, Mycobacterium avium subsp. paratuberculosis
gaucgagguagcgugcgcc

SEQ ID NO: 930845 - RNA, 20 nt, Mycobacterium avium subsp. paratuberculosis
gaucgaggugauguuggccg

SEQ ID NO: 930846 - RNA, 22 nt, Mycobacterium avium subsp. paratuberculosis
gaucgaggugauguuggccgcg

SEQ ID NO: 930847 - RNA, 23 nt, Mycobacterium avium subsp. paratuberculosis
gaucgaggugauguuggccgcga

SEQ ID NO: 930848 - RNA, 20 nt, Mycobacterium avium subsp. paratuberculosis
gaucgagucccgcgcggcgc

SEQ ID NO: 930849 - RNA, 14 nt, Mycobacterium avium subsp. paratuberculosis
gaucgaggccagcg

SEQ ID NO: 930850 - RNA, 15 nt, Mycobacterium avium subsp. paratuberculosis
gaucgaggccagcgc

SEQ ID NO: 930851 - RNA, 21 nt, Mycobacterium avium subsp. paratuberculosis
gaucgaggccagcgcgaucgc

SEQ ID NO: 930852 - RNA, 23 nt, Mycobacterium avium subsp. paratuberculosis
gaucgagcucgcagucgaucagc

SEQ ID NO: 930853 - RNA, 15 nt, Mycobacterium avium subsp. paratuberculosis
gaucgagcucggccu

SEQ ID NO: 930854 - RNA, 16 nt, Mycobacterium avium subsp. paratuberculosis
gaucgacgacgccagc

SEQ ID NO: 930855 - RNA, 22 nt, Mycobacterium avium subsp. paratuberculosis
gaucgacgccaugggcccagca

SEQ ID NO: 930856 - RNA, 22 nt, Mycobacterium avium subsp. paratuberculosis
gaucgacgccgacaucgcggcg

SEQ ID NO: 930857 - RNA, 16 nt, Mycobacterium avium subsp. paratuberculosis
gaucgagcgcaccgcc

SEQ ID NO: 930858 - RNA, 17 nt, Mycobacterium avium subsp. paratuberculosis
gaucgagcgcaccgccc

SEQ ID NO: 930859 - RNA, 14 nt, Mycobacterium avium subsp. paratuberculosis
gaucgcccgcuccg

SEQ ID NO: 930860 - RNA, 20 nt, Mycobacterium avium subsp. paratuberculosis
gaucgcccgcuccgcgggca

SEQ ID NO: 930861 - RNA, 21 nt, Mycobacterium avium subsp. paratuberculosis
gaucgcccgcuccgcggugcu

SEQ ID NO: 930862 - RNA, 14 nt, Mycobacterium avium subsp. paratuberculosis
gaucgcccgggcgg

SEQ ID NO: 930863 - RNA, 15 nt, Mycobacterium avium subsp. paratuberculosis
gaucgcccgggcggc

SEQ ID NO: 930864 - RNA, 18 nt, Mycobacterium avium subsp. paratuberculosis
gaucgcccgggcggcggg

SEQ ID NO: 930865 - RNA, 20 nt, Mycobacterium avium subsp. paratuberculosis
gaucgcccgguaggccgccg

SEQ ID NO: 930866 - RNA, 23 nt, Mycobacterium avium subsp. paratuberculosis
gaucgcccgguaggccgccgcga

SEQ ID NO: 930867 - RNA, 15 nt, Mycobacterium avium subsp. paratuberculosis
gaucgaucagccgcg

SEQ ID NO: 930868 - RNA, 21 nt, Mycobacterium avium subsp. paratuberculosis
gaucgaucaucgccucggucg

SEQ ID NO: 930869 - RNA, 21 nt, Mycobacterium avium subsp. paratuberculosis
gaucgaucccgucggccauca

SEQ ID NO: 930870 - RNA, 20 nt, Mycobacterium avium subsp. paratuberculosis
gaucgaucccuuggcggcgg

SEQ ID NO: 930871 - RNA, 22 nt, Mycobacterium avium subsp. paratuberculosis
gaucgaucccuuggcggcggcc

SEQ ID NO: 930872 - RNA, 20 nt, Mycobacterium avium subsp. paratuberculosis
gaucgaguuccgcgucggcc

SEQ ID NO: 930873 - RNA, 16 nt, Mycobacterium avium subsp. paratuberculosis
gaucgaguucacccga

SEQ ID NO: 930874 - RNA, 17 nt, Mycobacterium avium subsp. paratuberculosis
gaucgaguucagcgucg

SEQ ID NO: 930875 - RNA, 21 nt, Mycobacterium avium subsp. paratuberculosis
gaucgaguucagcgucgaugu

SEQ ID NO: 930876 - RNA, 17 nt, Mycobacterium avium subsp. paratuberculosis
gaucgaaaugaccgcgc

SEQ ID NO: 930877 - RNA, 22 nt, Mycobacterium avium subsp. paratuberculosis
gauccuggccuggucggccggc

SEQ ID NO: 930878 - RNA, 20 nt, Mycobacterium avium subsp. paratuberculosis
gaucgaaggcgugcucgauc

SEQ ID NO: 930879 - RNA, 21 nt, Mycobacterium avium subsp. paratuberculosis
gaucgaacuugaucaccgcgu

SEQ ID NO: 930880 - RNA, 22 nt, Mycobacterium avium subsp. paratuberculosis
gaucgaacuugaucaccgcgua

SEQ ID NO: 930881 - RNA, 18 nt, Mycobacterium avium subsp. paratuberculosis
gaucgacaacgcgugaug

SEQ ID NO: 930882 - RNA, 19 nt, Mycobacterium avium subsp. paratuberculosis
gaucgacaacgcgugaugc

SEQ ID NO: 930883 - RNA, 15 nt, Mycobacterium avium subsp. paratuberculosis
gaucgaacggcggaa

SEQ ID NO: 930884 - RNA, 22 nt, Mycobacterium avium subsp. paratuberculosis
gaucgaacggcggaaccgggcc

SEQ ID NO: 930885 - RNA, 21 nt, Mycobacterium avium subsp. paratuberculosis
gaucgaauacaccugccgcac

SEQ ID NO: 930886 - RNA, 22 nt, Mycobacterium avium subsp. paratuberculosis
gaucgaauacaccugccgcaca

SEQ ID NO: 930887 - RNA, 17 nt, Mycobacterium avium subsp. paratuberculosis
gaucgaauccggcggcg

SEQ ID NO: 930888 - RNA, 12 nt, Mycobacterium avium subsp. paratuberculosis
gaucgaccccca

SEQ ID NO: 930889 - RNA, 16 nt, Mycobacterium avium subsp. paratuberculosis
gaucgacccccaccgc

SEQ ID NO: 930890 - RNA, 17 nt, Mycobacterium avium subsp. paratuberculosis
gaucgacccccaccgcg

SEQ ID NO: 930891 - RNA, 18 nt, Mycobacterium avium subsp. paratuberculosis
gaucgacccccaccgcga

SEQ ID NO: 930892 - RNA, 20 nt, Mycobacterium avium subsp. paratuberculosis
gaucgacccccaccgcgaca

SEQ ID NO: 930893 - RNA, 14 nt, Mycobacterium avium subsp. paratuberculosis
gaucgacagcucca

SEQ ID NO: 930894 - RNA, 22 nt, Mycobacterium avium subsp. paratuberculosis
gaucgacagcuccaacagccgg

SEQ ID NO: 930895 - RNA, 15 nt, Mycobacterium avium subsp. paratuberculosis
gaucagcaugccggu

SEQ ID NO: 930896 - RNA, 20 nt, Mycobacterium avium subsp. paratuberculosis
gaucagcaugucgcccgcgu

SEQ ID NO: 930897 - RNA, 19 nt, Mycobacterium avium subsp. paratuberculosis
gaucagccacaccgccggc

SEQ ID NO: 930898 - RNA, 24 nt, Mycobacterium avium subsp. paratuberculosis
gaucagcagguugauccgcgcguc

SEQ ID NO: 930899 - RNA, 17 nt, Mycobacterium avium subsp. paratuberculosis
gaucagcaugacgaacu

SEQ ID NO: 930900 - RNA, 19 nt, Mycobacterium avium subsp. paratuberculosis
gaucagcaggcccucggcc

SEQ ID NO: 930901 - RNA, 22 nt, Mycobacterium avium subsp. paratuberculosis
gaucagcaggcccucggccagc

SEQ ID NO: 930902 - RNA, 19 nt, Mycobacterium avium subsp. paratuberculosis
gaucagcaggcuggcggcg

SEQ ID NO: 930903 - RNA, 21 nt, Mycobacterium avium subsp. paratuberculosis
gaucagcaggcuggcggcgau

SEQ ID NO: 930904 - RNA, 22 nt, Mycobacterium avium subsp. paratuberculosis
gaucagcaggcuggcggcgauc

SEQ ID NO: 930905 - RNA, 16 nt, Mycobacterium avium subsp. paratuberculosis
gaucagcagcaccggc

SEQ ID NO: 930906 - RNA, 20 nt, Mycobacterium avium subsp. paratuberculosis
gaucagccccagggugcgcc

SEQ ID NO: 930907 - RNA, 15 nt, Mycobacterium avium subsp. paratuberculosis
gaucagcccggcccg

SEQ ID NO: 930908 - RNA, 18 nt, Mycobacterium avium subsp. paratuberculosis
gaucagcgacggcccgcc

SEQ ID NO: 930909 - RNA, 14 nt, Mycobacterium avium subsp. paratuberculosis
gaucagccgcccga

SEQ ID NO: 930910 - RNA, 20 nt, Mycobacterium avium subsp. paratuberculosis
gaucagccggcgagcgcgcu

SEQ ID NO: 930911 - RNA, 20 nt, Mycobacterium avium subsp. paratuberculosis
gaucagccggguagcgccgc

SEQ ID NO: 930912 - RNA, 17 nt, Mycobacterium avium subsp. paratuberculosis
gaucagccguaccgauc

SEQ ID NO: 930913 - RNA, 14 nt, Mycobacterium avium subsp. paratuberculosis
gaucagcgucgcga

SEQ ID NO: 930914 - RNA, 12 nt, Mycobacterium avium subsp. paratuberculosis
gaucagcguggu

SEQ ID NO: 930915 - RNA, 15 nt, Mycobacterium avium subsp. paratuberculosis
gaucagcucgccgau

SEQ ID NO: 930916 - RNA, 23 nt, Mycobacterium avium subsp. paratuberculosis
gaucagcucgccgaugucggccg

SEQ ID NO: 930917 - RNA, 18 nt, Mycobacterium avium subsp. paratuberculosis
gaucagcgggcuguccgc

SEQ ID NO: 930918 - RNA, 18 nt, Mycobacterium avium subsp. paratuberculosis
gaucagcgguccacccga

SEQ ID NO: 930919 - RNA, 14 nt, Mycobacterium avium subsp. paratuberculosis
gaucagcgucagca

SEQ ID NO: 930920 - RNA, 16 nt, Mycobacterium avium subsp. paratuberculosis
gaucagcgucagcacc

SEQ ID NO: 930921 - RNA, 19 nt, Mycobacterium avium subsp. paratuberculosis
gaucagcgucagcaccgcg

SEQ ID NO: 930922 - RNA, 15 nt, Mycobacterium avium subsp. paratuberculosis
gaucagcugcccgga

SEQ ID NO: 930923 - RNA, 19 nt, Mycobacterium avium subsp. paratuberculosis
gaucagcugcucggccacc

SEQ ID NO: 930924 - RNA, 22 nt, Mycobacterium avium subsp. paratuberculosis
gaucagcugcucggccaccgcg

SEQ ID NO: 930925 - RNA, 13 nt, Mycobacterium avium subsp. paratuberculosis
gaucagcucgugg

SEQ ID NO: 930926 - RNA, 20 nt, Mycobacterium avium subsp. paratuberculosis
gaucagcucguggcgggccc

SEQ ID NO: 930927 - RNA, 16 nt, Mycobacterium avium subsp. paratuberculosis
gaucagcucgcgcauc

SEQ ID NO: 930928 - RNA, 13 nt, Mycobacterium avium subsp. paratuberculosis
gaucagcucgcgg

SEQ ID NO: 930929 - RNA, 19 nt, Mycobacterium avium subsp. paratuberculosis
gaucagcucuucgauggcc

SEQ ID NO: 930930 - RNA, 16 nt, Mycobacterium avium subsp. paratuberculosis
gaucagcugaccggcg

SEQ ID NO: 930931 - RNA, 14 nt, Mycobacterium avium subsp. paratuberculosis
gaucagcggcgggc

SEQ ID NO: 930932 - RNA, 15 nt, Mycobacterium avium subsp. paratuberculosis
gaucagcggcgggcc

SEQ ID NO: 930933 - RNA, 20 nt, Mycobacterium avium subsp. paratuberculosis
gaucagcggcgggcccagca

SEQ ID NO: 930934 - RNA, 20 nt, Mycobacterium avium subsp. paratuberculosis
gaucagcgcguccaaccgcg

SEQ ID NO: 930935 - RNA, 14 nt, Mycobacterium avium subsp. paratuberculosis
gaucagcgcgucgg

SEQ ID NO: 930936 - RNA, 19 nt, Mycobacterium avium subsp. paratuberculosis
gaucagcgcgccgcccagc

SEQ ID NO: 930937 - RNA, 12 nt, Mycobacterium avium subsp. paratuberculosis
gaucagcgcgca

SEQ ID NO: 930938 - RNA, 14 nt, Mycobacterium avium subsp. paratuberculosis
gaucagcgcgccca

SEQ ID NO: 930939 - RNA, 22 nt, Mycobacterium avium subsp. paratuberculosis
gaucagcgccguggcccggucg

SEQ ID NO: 930940 - RNA, 23 nt, Mycobacterium avium subsp. paratuberculosis
gaucagcgccguggcccggucgg

SEQ ID NO: 930941 - RNA, 14 nt, Mycobacterium avium subsp. paratuberculosis
gaucagcgaaggca

SEQ ID NO: 930942 - RNA, 16 nt, Mycobacterium avium subsp. paratuberculosis
gaucagcgccaggugg

SEQ ID NO: 930943 - RNA, 23 nt, Mycobacterium avium subsp. paratuberculosis
gaucaugauccggaagccgucgg

SEQ ID NO: 930944 - RNA, 14 nt, Mycobacterium avium subsp. paratuberculosis
gauccagcaccgcc

SEQ ID NO: 930945 - RNA, 16 nt, Mycobacterium avium subsp. paratuberculosis
gauccagcaccgccac

SEQ ID NO: 930946 - RNA, 12 nt, Mycobacterium avium subsp. paratuberculosis
gauccagcagcg

SEQ ID NO: 930947 - RNA, 14 nt, Mycobacterium avium subsp. paratuberculosis
gauccagcagcgcc

SEQ ID NO: 930948 - RNA, 19 nt, Mycobacterium avium subsp. paratuberculosis
gauccagcccugcucggcc

SEQ ID NO: 930949 - RNA, 20 nt, Mycobacterium avium subsp. paratuberculosis
gauccagcccugcucggcca

SEQ ID NO: 930950 - RNA, 22 nt, Mycobacterium avium subsp. paratuberculosis
gauccagcccugcucggccagc

SEQ ID NO: 930951 - RNA, 19 nt, Mycobacterium avium subsp. paratuberculosis
gauccagcgcuggccggcc

SEQ ID NO: 930952 - RNA, 22 nt, Mycobacterium avium subsp. paratuberculosis
gauccagcgcuggccggccacc

SEQ ID NO: 930953 - RNA, 14 nt, Mycobacterium avium subsp. paratuberculosis
gauccagcggcgca

SEQ ID NO: 930954 - RNA, 16 nt, Mycobacterium avium subsp. paratuberculosis
gauccagcggcggccu

SEQ ID NO: 930955 - RNA, 17 nt, Mycobacterium avium subsp. paratuberculosis
gauccagcggcggccuu

SEQ ID NO: 930956 - RNA, 18 nt, Mycobacterium avium subsp. paratuberculosis
gaucaucuccacccggca

SEQ ID NO: 930957 - RNA, 16 nt, Mycobacterium avium subsp. paratuberculosis
gaucaucgccucgguc

SEQ ID NO: 930958 - RNA, 15 nt, Mycobacterium avium subsp. paratuberculosis
gaucaucgcgucggu

SEQ ID NO: 930959 - RNA, 20 nt, Mycobacterium avium subsp. paratuberculosis
gaucaucccggccaccccgc

SEQ ID NO: 930960 - RNA, 13 nt, Mycobacterium avium subsp. paratuberculosis
gaucaggcugccg

SEQ ID NO: 930961 - RNA, 16 nt, Mycobacterium avium subsp. paratuberculosis
gaucagggccgcggcc

SEQ ID NO: 930962 - RNA, 13 nt, Mycobacterium avium subsp. paratuberculosis
gaucaggccggcc

SEQ ID NO: 930963 - RNA, 19 nt, Mycobacterium avium subsp. paratuberculosis
gaucaggaucggcgggcgc

SEQ ID NO: 930964 - RNA, 18 nt, Mycobacterium avium subsp. paratuberculosis
gaucaggaugacgccgcg

SEQ ID NO: 930965 - RNA, 17 nt, Mycobacterium avium subsp. paratuberculosis
gaucaggccccacccgc

SEQ ID NO: 930966 - RNA, 17 nt, Mycobacterium avium subsp. paratuberculosis
gaucaggcccucgucgg

SEQ ID NO: 930967 - RNA, 18 nt, Mycobacterium avium subsp. paratuberculosis
gaucaggcccucgucggc

SEQ ID NO: 930968 - RNA, 21 nt, Mycobacterium avium subsp. paratuberculosis
gauagccggugaucgcggcgc

SEQ ID NO: 930969 - RNA, 17 nt, Mycobacterium avium subsp. paratuberculosis
gauagccguacacggcg

SEQ ID NO: 930970 - RNA, 20 nt, Mycobacterium avium subsp. paratuberculosis
gauagccguacacggcggcg

SEQ ID NO: 930971 - RNA, 22 nt, Mycobacterium avium subsp. paratuberculosis
gauacucgggcaacgcgccggc

SEQ ID NO: 930972 - RNA, 16 nt, Mycobacterium avium subsp. paratuberculosis
gauacccgcgcggcgc

SEQ ID NO: 930973 - RNA, 20 nt, Mycobacterium avium subsp. paratuberculosis
gauacccgcgcggcgcaggu

SEQ ID NO: 930974 - RNA, 18 nt, Mycobacterium avium subsp. paratuberculosis
gauacccguugcgcccca

SEQ ID NO: 930975 - RNA, 20 nt, Mycobacterium avium subsp. paratuberculosis
gauaccagccgcggacggcc

SEQ ID NO: 930976 - RNA, 16 nt, Mycobacterium avium subsp. paratuberculosis
gauaaccucggcggcg

SEQ ID NO: 930977 - RNA, 18 nt, Mycobacterium avium subsp. paratuberculosis
gauaaccucggcggcggc

SEQ ID NO: 930978 - RNA, 22 nt, Mycobacterium avium subsp. paratuberculosis
gauaaccucggcggcggcgcgc

SEQ ID NO: 930979 - RNA, 16 nt, Mycobacterium avium subsp. paratuberculosis
gaguaaccggugcgcu

SEQ ID NO: 930980 - RNA, 20 nt, Mycobacterium avium subsp. paratuberculosis
gaguaaggccgaggcgagug

SEQ ID NO: 930981 - RNA, 22 nt, Mycobacterium avium subsp. paratuberculosis
gaguacucgguguagagcaccu

SEQ ID NO: 930982 - RNA, 16 nt, Mycobacterium avium subsp. paratuberculosis
gaguccggcucggugc

SEQ ID NO: 930983 - RNA, 17 nt, Mycobacterium avium subsp. paratuberculosis
gaguccggcucggugcc

SEQ ID NO: 930984 - RNA, 21 nt, Mycobacterium avium subsp. paratuberculosis
gaguccggcucggugccgcgg

SEQ ID NO: 930985 - RNA, 18 nt, Mycobacterium avium subsp. paratuberculosis
gaguccgggccgccggcc

SEQ ID NO: 930986 - RNA, 16 nt, Mycobacterium avium subsp. paratuberculosis
gaguccucgcgguugc

SEQ ID NO: 930987 - RNA, 19 nt, Mycobacterium avium subsp. paratuberculosis
gaguccugguaccccagca

SEQ ID NO: 930988 - RNA, 19 nt, Mycobacterium avium subsp. paratuberculosis
gagucgaagcggugcacca

SEQ ID NO: 930989 - RNA, 15 nt, Mycobacterium avium subsp. paratuberculosis
gagucgagcaccgcg

SEQ ID NO: 930990 - RNA, 16 nt, Mycobacterium avium subsp. paratuberculosis
gagucgagguugaugc

SEQ ID NO: 930991 - RNA, 22 nt, Mycobacterium avium subsp. paratuberculosis
gagucgagguugaugccgacgu

SEQ ID NO: 930992 - RNA, 17 nt, Mycobacterium avium subsp. paratuberculosis
gagucgaucgccagcgc

SEQ ID NO: 930993 - RNA, 17 nt, Mycobacterium avium subsp. paratuberculosis
gagucgaugaccucgcg

SEQ ID NO: 930994 - RNA, 19 nt, Mycobacterium avium subsp. paratuberculosis
gagucgaugaccucgcgcc

SEQ ID NO: 930995 - RNA, 13 nt, Mycobacterium avium subsp. paratuberculosis
gagucgccguugg

SEQ ID NO: 930996 - RNA, 13 nt, Mycobacterium avium subsp. paratuberculosis
gagucgcgccgcg

SEQ ID NO: 930997 - RNA, 23 nt, Mycobacterium avium subsp. paratuberculosis
gagucgcgccgcgucgcgccgcc

SEQ ID NO: 930998 - RNA, 14 nt, Mycobacterium avium subsp. paratuberculosis
gauagccgucggcg

SEQ ID NO: 930999 - RNA, 22 nt, Mycobacterium avium subsp. paratuberculosis
gauagccgucggcggaggucau

SEQ ID NO: 931000 - RNA, 12 nt, Mycobacterium avium subsp. paratuberculosis
gauagcggccgc

SEQ ID NO: 931001 - RNA, 14 nt, Mycobacterium avium subsp. paratuberculosis
gauagcggccgcgg

SEQ ID NO: 931002 - RNA, 22 nt, Mycobacterium avium subsp. paratuberculosis
gauagcggcguaccgcggcggc

SEQ ID NO: 931003 - RNA, 22 nt, Mycobacterium avium subsp. paratuberculosis
gauaugcugcaacggcuggcgc

SEQ ID NO: 931004 - RNA, 16 nt, Mycobacterium avium subsp. paratuberculosis
gaucacaccgucggcg

SEQ ID NO: 931005 - RNA, 18 nt, Mycobacterium avium subsp. paratuberculosis
gaucacaccgucggcgau

SEQ ID NO: 931006 - RNA, 16 nt, Mycobacterium avium subsp. paratuberculosis
gaucaccaccuggucc

SEQ ID NO: 931007 - RNA, 21 nt, Mycobacterium avium subsp. paratuberculosis
gaucaccaccugguccugccc

SEQ ID NO: 931008 - RNA, 17 nt, Mycobacterium avium subsp. paratuberculosis
gaucaccacggucaggg

SEQ ID NO: 931009 - RNA, 18 nt, Mycobacterium avium subsp. paratuberculosis
gaucaccacgguggccgc

SEQ ID NO: 931010 - RNA, 14 nt, Mycobacterium avium subsp. paratuberculosis
gaucacacccacga

SEQ ID NO: 931011 - RNA, 14 nt, Mycobacterium avium subsp. paratuberculosis
gaucaccucgguga

SEQ ID NO: 931012 - RNA, 23 nt, Mycobacterium avium subsp. paratuberculosis
gaucaccucggugaugucgacgu

SEQ ID NO: 931013 - RNA, 17 nt, Mycobacterium avium subsp. paratuberculosis
gaucaccuggugcucgc

SEQ ID NO: 931014 - RNA, 18 nt, Mycobacterium avium subsp. paratuberculosis
gaucaccuugcggccggc

SEQ ID NO: 931015 - RNA, 23 nt, Mycobacterium avium subsp. paratuberculosis
gaucagcaccguccacagccggc

SEQ ID NO: 931016 - RNA, 24 nt, Mycobacterium avium subsp. paratuberculosis
gaucagcaccguccacagccggcg

SEQ ID NO: 931017 - RNA, 13 nt, Mycobacterium avium subsp. paratuberculosis
gaucagcagcacc

SEQ ID NO: 931018 - RNA, 16 nt, Mycobacterium avium subsp. paratuberculosis
gaucagcagcacccgg

SEQ ID NO: 931019 - RNA, 14 nt, Mycobacterium avium subsp. paratuberculosis
gaucagcagcaccg

SEQ ID NO: 931020 - RNA, 19 nt, Mycobacterium avium subsp. paratuberculosis
gaucaccggcagcagcgcg

SEQ ID NO: 931021 - RNA, 23 nt, Mycobacterium avium subsp. paratuberculosis
gaucaccucaucgcccagccggc

SEQ ID NO: 931022 - RNA, 16 nt, Mycobacterium avium subsp. paratuberculosis
gaucaccucgccggcc

SEQ ID NO: 931023 - RNA, 19 nt, Mycobacterium avium subsp. paratuberculosis
gaucaccucgccggccggg

SEQ ID NO: 931024 - RNA, 19 nt, Mycobacterium avium subsp. paratuberculosis
gaucaccucgcugacgucg

SEQ ID NO: 931025 - RNA, 21 nt, Mycobacterium avium subsp. paratuberculosis
gaucaccggcgcguuggcccg

SEQ ID NO: 931026 - RNA, 14 nt, Mycobacterium avium subsp. paratuberculosis
gaucaccgggcggc

SEQ ID NO: 931027 - RNA, 16 nt, Mycobacterium avium subsp. paratuberculosis
gaucaccgggcggccg

SEQ ID NO: 931028 - RNA, 23 nt, Mycobacterium avium subsp. paratuberculosis
gaucaccgugaguucgcugaccg

SEQ ID NO: 931029 - RNA, 15 nt, Mycobacterium avium subsp. paratuberculosis
gaucaccgugaucgc

SEQ ID NO: 931030 - RNA, 20 nt, Mycobacterium avium subsp. paratuberculosis
gaucaccgugaucgccacca

SEQ ID NO: 931031 - RNA, 21 nt, Mycobacterium avium subsp. paratuberculosis
gaucaccgugaucgccaccac

SEQ ID NO: 931032 - RNA, 19 nt, Mycobacterium avium subsp. paratuberculosis
gaucaccaggcccaggccg

SEQ ID NO: 931033 - RNA, 15 nt, Mycobacterium avium subsp. paratuberculosis
gaucaccgcgucggc

SEQ ID NO: 931034 - RNA, 20 nt, Mycobacterium avium subsp. paratuberculosis
gaucaccgcgucggcccaga

SEQ ID NO: 931035 - RNA, 19 nt, Mycobacterium avium subsp. paratuberculosis
gaucaccgcguugucggcg

SEQ ID NO: 931036 - RNA, 20 nt, Mycobacterium avium subsp. paratuberculosis
gaucaccgcguugucggcga

SEQ ID NO: 931037 - RNA, 14 nt, Mycobacterium avium subsp. paratuberculosis
gaucaccgcugcca

SEQ ID NO: 931038 - RNA, 15 nt, Mycobacterium avium subsp. paratuberculosis
gagcgggccgaccgu

SEQ ID NO: 931039 - RNA, 17 nt, Mycobacterium avium subsp. paratuberculosis
gagcgggccgaccguca

SEQ ID NO: 931040 - RNA, 23 nt, Mycobacterium avium subsp. paratuberculosis
gagcgggccgaucagugccgcgc

SEQ ID NO: 931041 - RNA, 19 nt, Mycobacterium avium subsp. paratuberculosis
gagcgggcacgccgccgcg

SEQ ID NO: 931042 - RNA, 20 nt, Mycobacterium avium subsp. paratuberculosis
gagcgggcacgccgccgcga

SEQ ID NO: 931043 - RNA, 21 nt, Mycobacterium avium subsp. paratuberculosis
gagcgggcacgccgccgcgaa

SEQ ID NO: 931044 - RNA, 23 nt, Mycobacterium avium subsp. paratuberculosis
aacugcaccagcacgacaccgac

SEQ ID NO: 931045 - RNA, 24 nt, Mycobacterium avium subsp. paratuberculosis
aacugcagauaggacccggcgagc

SEQ ID NO: 931046 - RNA, 15 nt, Mycobacterium avium subsp. paratuberculosis
aacugcagcaacgaa

SEQ ID NO: 931047 - RNA, 12 nt, Mycobacterium avium subsp. paratuberculosis
gagcgguggcca

SEQ ID NO: 931048 - RNA, 15 nt, Mycobacterium avium subsp. paratuberculosis
gagcgguggccacgc

SEQ ID NO: 931049 - RNA, 22 nt, Mycobacterium avium subsp. paratuberculosis
gagcgguccaacgggcucagca

SEQ ID NO: 931050 - RNA, 11 nt, Mycobacterium avium subsp. paratuberculosis
gagcggugacc

SEQ ID NO: 931051 - RNA, 18 nt, Mycobacterium avium subsp. paratuberculosis
gagcggugaccucgagca

SEQ ID NO: 931052 - RNA, 20 nt, Mycobacterium avium subsp. paratuberculosis
gagcgggguguggcugucgg

SEQ ID NO: 931053 - RNA, 20 nt, Mycobacterium avium subsp. paratuberculosis
gagcggguaaccgcagccgg

SEQ ID NO: 931054 - RNA, 17 nt, Mycobacterium avium subsp. paratuberculosis
gagcggguccgccccga

SEQ ID NO: 931055 - RNA, 21 nt, Mycobacterium avium subsp. paratuberculosis
gagcggguccgccccgagauc

SEQ ID NO: 931056 - RNA, 14 nt, Mycobacterium avium subsp. paratuberculosis
gagcgggucggccg

SEQ ID NO: 931057 - RNA, 16 nt, Mycobacterium avium subsp. paratuberculosis
gagcgggucggccggc

SEQ ID NO: 931058 - RNA, 20 nt, Mycobacterium avium subsp. paratuberculosis
gagcguagcccuaccggcuc

SEQ ID NO: 931059 - RNA, 20 nt, Mycobacterium avium subsp. paratuberculosis
gagcgguucgaucucgucgg

SEQ ID NO: 931060 - RNA, 15 nt, Mycobacterium avium subsp. paratuberculosis
gagcgucacgccagc

SEQ ID NO: 931061 - RNA, 16 nt, Mycobacterium avium subsp. paratuberculosis
gagcgucacgccagcg

SEQ ID NO: 931062 - RNA, 17 nt, Mycobacterium avium subsp. paratuberculosis
gagcgucacgccagcgu

SEQ ID NO: 931063 - RNA, 20 nt, Mycobacterium avium subsp. paratuberculosis
gagcgucacgccagcgugac

SEQ ID NO: 931064 - RNA, 20 nt, Mycobacterium avium subsp. paratuberculosis
gagcgucacgccaguguggc

SEQ ID NO: 931065 - RNA, 14 nt, Mycobacterium avium subsp. paratuberculosis
gagcgucacgccgc

SEQ ID NO: 931066 - RNA, 23 nt, Mycobacterium avium subsp. paratuberculosis
gagcgucacgccgcgcccgucga

SEQ ID NO: 931067 - RNA, 12 nt, Mycobacterium avium subsp. paratuberculosis
gagcgucacgcu

SEQ ID NO: 931068 - RNA, 20 nt, Mycobacterium avium subsp. paratuberculosis
gagcgucacgcuagcgugac

SEQ ID NO: 931069 - RNA, 21 nt, Mycobacterium avium subsp. paratuberculosis
gagcgucacgcuagcgugaca

SEQ ID NO: 931070 - RNA, 21 nt, Mycobacterium avium subsp. paratuberculosis
gagcgucacgcuggcgugacg

SEQ ID NO: 931071 - RNA, 16 nt, Mycobacterium avium subsp. paratuberculosis
gagcgggcgaucucga

SEQ ID NO: 931072 - RNA, 22 nt, Mycobacterium avium subsp. paratuberculosis
gagcgggcgaucucgauggcca

SEQ ID NO: 931073 - RNA, 14 nt, Mycobacterium avium subsp. paratuberculosis
gagcgggcgggcuc

SEQ ID NO: 931074 - RNA, 13 nt, Mycobacterium avium subsp. paratuberculosis
aacucggcggcgg

SEQ ID NO: 931075 - RNA, 19 nt, Mycobacterium avium subsp. paratuberculosis
aacucggugaugccggcca

SEQ ID NO: 931076 - RNA, 18 nt, Mycobacterium avium subsp. paratuberculosis
gagcggcugcuggucgac

SEQ ID NO: 931077 - RNA, 20 nt, Mycobacterium avium subsp. paratuberculosis
gagcggcugcuggucgacgu

SEQ ID NO: 931078 - RNA, 11 nt, Mycobacterium avium subsp. paratuberculosis
aacucgccgau

SEQ ID NO: 931079 - RNA, 16 nt, Mycobacterium avium subsp. paratuberculosis
gagcggcuugccgccg

SEQ ID NO: 931080 - RNA, 18 nt, Mycobacterium avium subsp. paratuberculosis
gagcggcuugccgccgca

SEQ ID NO: 931081 - RNA, 17 nt, Mycobacterium avium subsp. paratuberculosis
gagcgggaagcugcugg

SEQ ID NO: 931082 - RNA, 18 nt, Mycobacterium avium subsp. paratuberculosis
gagcgggaccgaggugcc

SEQ ID NO: 931083 - RNA, 21 nt, Mycobacterium avium subsp. paratuberculosis
gagcgggaccgaggugccgcg

SEQ ID NO: 931084 - RNA, 14 nt, Mycobacterium avium subsp. paratuberculosis
gagcgggacgcgca

SEQ ID NO: 931085 - RNA, 22 nt, Mycobacterium avium subsp. paratuberculosis
aacucgaugggggugccgcagc

SEQ ID NO: 931086 - RNA, 18 nt, Mycobacterium avium subsp. paratuberculosis
aacucgcgcucccggcgc

SEQ ID NO: 931087 - RNA, 13 nt, Mycobacterium avium subsp. paratuberculosis
gagcggcccaaca

SEQ ID NO: 931088 - RNA, 20 nt, Mycobacterium avium subsp. paratuberculosis
gagcggcgacuccagcagcg

SEQ ID NO: 931089 - RNA, 14 nt, Mycobacterium avium subsp. paratuberculosis
gagcggcgccacgu

SEQ ID NO: 931090 - RNA, 20 nt, Mycobacterium avium subsp. paratuberculosis
gagcggcgccacguggucga

SEQ ID NO: 931091 - RNA, 16 nt, Mycobacterium avium subsp. paratuberculosis
gagcggcggucacgaa

SEQ ID NO: 931092 - RNA, 21 nt, Mycobacterium avium subsp. paratuberculosis
gagcggcgcugcagcagcccg

SEQ ID NO: 931093 - RNA, 14 nt, Mycobacterium avium subsp. paratuberculosis
gagcggcaccaggu

SEQ ID NO: 931094 - RNA, 19 nt, Mycobacterium avium subsp. paratuberculosis
gagcggcaccuuggugagc

SEQ ID NO: 931095 - RNA, 14 nt, Mycobacterium avium subsp. paratuberculosis
gagcggcacgaucg

SEQ ID NO: 931096 - RNA, 21 nt, Mycobacterium avium subsp. paratuberculosis
gagcggcacgaucggcagcgc

SEQ ID NO: 931097 - RNA, 17 nt, Mycobacterium avium subsp. paratuberculosis
gagcggaucggcggcga

SEQ ID NO: 931098 - RNA, 15 nt, Mycobacterium avium subsp. paratuberculosis
gagcggauggcgccg

SEQ ID NO: 931099 - RNA, 13 nt, Mycobacterium avium subsp. paratuberculosis
gagcggcccgucg

SEQ ID NO: 931100 - RNA, 18 nt, Mycobacterium avium subsp. paratuberculosis
gagcggcccugcgcggcc

SEQ ID NO: 931101 - RNA, 21 nt, Mycobacterium avium subsp. paratuberculosis
gagcggcccugcgcggccugc

SEQ ID NO: 931102 - RNA, 16 nt, Mycobacterium avium subsp. paratuberculosis
gagcggccgcagcgca

SEQ ID NO: 931103 - RNA, 19 nt, Mycobacterium avium subsp. paratuberculosis
gagcgcuggucggcgaacc

SEQ ID NO: 931104 - RNA, 16 nt, Mycobacterium avium subsp. paratuberculosis
gagcgcgucgucgccg

SEQ ID NO: 931105 - RNA, 23 nt, Mycobacterium avium subsp. paratuberculosis
gagcgcgugcacgaacgcggcca

SEQ ID NO: 931106 - RNA, 12 nt, Mycobacterium avium subsp. paratuberculosis
gagcgcuaccgc

SEQ ID NO: 931107 - RNA, 13 nt, Mycobacterium avium subsp. paratuberculosis
gagcgcuccacca

SEQ ID NO: 931108 - RNA, 12 nt, Mycobacterium avium subsp. paratuberculosis
gagcgcggcccg

SEQ ID NO: 931109 - RNA, 17 nt, Mycobacterium avium subsp. paratuberculosis
gagcgcggcccgccgaa

SEQ ID NO: 931110 - RNA, 16 nt, Mycobacterium avium subsp. paratuberculosis
gagcgcguacacgaug

SEQ ID NO: 931111 - RNA, 14 nt, Mycobacterium avium subsp. paratuberculosis
gagcgcgucgacca

SEQ ID NO: 931112 - RNA, 18 nt, Mycobacterium avium subsp. paratuberculosis
gagcgcgucgaccagccg

SEQ ID NO: 931113 - RNA, 14 nt, Mycobacterium avium subsp. paratuberculosis
gagcgcgucgacgc

SEQ ID NO: 931114 - RNA, 19 nt, Mycobacterium avium subsp. paratuberculosis
gagcgcggcaugccgcccg

SEQ ID NO: 931115 - RNA, 11 nt, Mycobacterium avium subsp. paratuberculosis
gagcgcccggc

SEQ ID NO: 931116 - RNA, 21 nt, Mycobacterium avium subsp. paratuberculosis
gagcgaacacgugcagcucgg

SEQ ID NO: 931117 - RNA, 13 nt, Mycobacterium avium subsp. paratuberculosis
gagcgcaccgcgg

SEQ ID NO: 931118 - RNA, 19 nt, Mycobacterium avium subsp. paratuberculosis
gagccuucuucgccgcagc

SEQ ID NO: 931119 - RNA, 18 nt, Mycobacterium avium subsp. paratuberculosis
gagccuucuugaccgcag

SEQ ID NO: 931120 - RNA, 15 nt, Mycobacterium avium subsp. paratuberculosis
gagccuugcuggcgg

SEQ ID NO: 931121 - RNA, 15 nt, Mycobacterium avium subsp. paratuberculosis
gagccugggauugcc

SEQ ID NO: 931122 - RNA, 20 nt, Mycobacterium avium subsp. paratuberculosis
gagccugggauugccgggca

SEQ ID NO: 931123 - RNA, 19 nt, Mycobacterium avium subsp. paratuberculosis
gagcgcaucgacugcgaca

SEQ ID NO: 931124 - RNA, 14 nt, Mycobacterium avium subsp. paratuberculosis
gagcgccaccccga

SEQ ID NO: 931125 - RNA, 19 nt, Mycobacterium avium subsp. paratuberculosis
gagcgccaccccgaacccg

SEQ ID NO: 931126 - RNA, 17 nt, Mycobacterium avium subsp. paratuberculosis
gagcgccagggucuggc

SEQ ID NO: 931127 - RNA, 22 nt, Mycobacterium avium subsp. paratuberculosis
gagcgccagggucuggcccggu

SEQ ID NO: 931128 - RNA, 14 nt, Mycobacterium avium subsp. paratuberculosis
gagcgccagcgcgg

SEQ ID NO: 931129 - RNA, 21 nt, Mycobacterium avium subsp. paratuberculosis
gagcgccccagggccucggcg

SEQ ID NO: 931130 - RNA, 15 nt, Mycobacterium avium subsp. paratuberculosis
gagcgcccggccagc

SEQ ID NO: 931131 - RNA, 16 nt, Mycobacterium avium subsp. paratuberculosis
gagcgcccggccagcc

SEQ ID NO: 931132 - RNA, 19 nt, Mycobacterium avium subsp. paratuberculosis
gagcgcccggccagccggc

SEQ ID NO: 931133 - RNA, 22 nt, Mycobacterium avium subsp. paratuberculosis
gagcgcccgggcguucccgcgc

SEQ ID NO: 931134 - RNA, 14 nt, Mycobacterium avium subsp. paratuberculosis
gagccgccgccggc

SEQ ID NO: 931135 - RNA, 17 nt, Mycobacterium avium subsp. paratuberculosis
gacgguuucugccggcc

SEQ ID NO: 931136 - RNA, 18 nt, Mycobacterium avium subsp. paratuberculosis
gacgguuucugccggccg

SEQ ID NO: 931137 - RNA, 20 nt, Mycobacterium avium subsp. paratuberculosis
gacgguuucugccggccgcc

SEQ ID NO: 931138 - RNA, 21 nt, Mycobacterium avium subsp. paratuberculosis
gacgguuucugccggccgccg

SEQ ID NO: 931139 - RNA, 22 nt, Mycobacterium avium subsp. paratuberculosis
gacgguuucugccggccgccgu

SEQ ID NO: 931140 - RNA, 16 nt, Mycobacterium avium subsp. paratuberculosis
gacgguuugcccggcg

SEQ ID NO: 931141 - RNA, 17 nt, Mycobacterium avium subsp. paratuberculosis
gacgguuugcccggcga

SEQ ID NO: 931142 - RNA, 15 nt, Mycobacterium avium subsp. paratuberculosis
gagccgccugcgcgc

SEQ ID NO: 931143 - RNA, 16 nt, Mycobacterium avium subsp. paratuberculosis
gagccgccgcgggucg

SEQ ID NO: 931144 - RNA, 22 nt, Mycobacterium avium subsp. paratuberculosis
gagccgccgcgggucggcgacg

SEQ ID NO: 931145 - RNA, 20 nt, Mycobacterium avium subsp. paratuberculosis
gagccgccggaucggcagcg

SEQ ID NO: 931146 - RNA, 22 nt, Mycobacterium avium subsp. paratuberculosis
gagccgccggaucggcagcgcg

SEQ ID NO: 931147 - RNA, 14 nt, Mycobacterium avium subsp. paratuberculosis
gagccgcgccacgc

SEQ ID NO: 931148 - RNA, 19 nt, Mycobacterium avium subsp. paratuberculosis
gagccgcggauggccucgg

SEQ ID NO: 931149 - RNA, 13 nt, Mycobacterium avium subsp. paratuberculosis
gagccgcggcccg

SEQ ID NO: 931150 - RNA, 14 nt, Mycobacterium avium subsp. paratuberculosis
gagccgcggcccgc

SEQ ID NO: 931151 - RNA, 23 nt, Mycobacterium avium subsp. paratuberculosis
gagccgcgggugacgaucaccgc

SEQ ID NO: 931152 - RNA, 22 nt, Mycobacterium avium subsp. paratuberculosis
gagccgcugagcuucugcccgg

SEQ ID NO: 931153 - RNA, 11 nt, Mycobacterium avium subsp. paratuberculosis
gagccgcucca

SEQ ID NO: 931154 - RNA, 13 nt, Mycobacterium avium subsp. paratuberculosis
gagccgcucgccg

SEQ ID NO: 931155 - RNA, 13 nt, Mycobacterium avium subsp. paratuberculosis
gagccgcucgcgc

SEQ ID NO: 931156 - RNA, 16 nt, Mycobacterium avium subsp. paratuberculosis
gagccgcucgcgcacc

SEQ ID NO: 931157 - RNA, 20 nt, Mycobacterium avium subsp. paratuberculosis
gagccgcucgcgcaccggga

SEQ ID NO: 931158 - RNA, 20 nt, Mycobacterium avium subsp. paratuberculosis
gagccguuuggcgccgccca

SEQ ID NO: 931159 - RNA, 22 nt, Mycobacterium avium subsp. paratuberculosis
gagccguuuggcgccgcccacc

SEQ ID NO: 931160 - RNA, 13 nt, Mycobacterium avium subsp. paratuberculosis
gagccuaugaggc

SEQ ID NO: 931161 - RNA, 14 nt, Mycobacterium avium subsp. paratuberculosis
gagccucagcgcgc

SEQ ID NO: 931162 - RNA, 17 nt, Mycobacterium avium subsp. paratuberculosis
gagccgggcgcgggcgc

SEQ ID NO: 931163 - RNA, 14 nt, Mycobacterium avium subsp. paratuberculosis
gagccgggcggcca

SEQ ID NO: 931164 - RNA, 16 nt, Mycobacterium avium subsp. paratuberculosis
gagccgggcggccagc

SEQ ID NO: 931165 - RNA, 18 nt, Mycobacterium avium subsp. paratuberculosis
gagccgggcggccagcgu

SEQ ID NO: 931166 - RNA, 16 nt, Mycobacterium avium subsp. paratuberculosis
gagccgugcccgaggu

SEQ ID NO: 931167 - RNA, 18 nt, Mycobacterium avium subsp. paratuberculosis
gagccgugcccgagguga

SEQ ID NO: 931168 - RNA, 16 nt, Mycobacterium avium subsp. paratuberculosis
gagccgggcagcgcga

SEQ ID NO: 931169 - RNA, 17 nt, Mycobacterium avium subsp. paratuberculosis
gagccgggcagcgcgac

SEQ ID NO: 931170 - RNA, 15 nt, Mycobacterium avium subsp. paratuberculosis
gagccggcggcguug

SEQ ID NO: 931171 - RNA, 12 nt, Mycobacterium avium subsp. paratuberculosis
gagccggcgucg

SEQ ID NO: 931172 - RNA, 16 nt, Mycobacterium avium subsp. paratuberculosis
gagccggcgucgccgc

SEQ ID NO: 931173 - RNA, 12 nt, Mycobacterium avium subsp. paratuberculosis
gagccggccgga

SEQ ID NO: 931174 - RNA, 14 nt, Mycobacterium avium subsp. paratuberculosis
gagccggccucgcc

SEQ ID NO: 931175 - RNA, 16 nt, Mycobacterium avium subsp. paratuberculosis
gagccggccucgccgg

SEQ ID NO: 931176 - RNA, 17 nt, Mycobacterium avium subsp. paratuberculosis
gagccggccucgccggc

SEQ ID NO: 931177 - RNA, 19 nt, Mycobacterium avium subsp. paratuberculosis
gagccggccucgccggcgc

SEQ ID NO: 931178 - RNA, 21 nt, Mycobacterium avium subsp. paratuberculosis
gagccggcgcaccgcgucgau

SEQ ID NO: 931179 - RNA, 13 nt, Mycobacterium avium subsp. paratuberculosis
gagccggcgcacu

SEQ ID NO: 931180 - RNA, 13 nt, Mycobacterium avium subsp. paratuberculosis
gagccggcccugc

SEQ ID NO: 931181 - RNA, 14 nt, Mycobacterium avium subsp. paratuberculosis
gagccggccgaagc

SEQ ID NO: 931182 - RNA, 15 nt, Mycobacterium avium subsp. paratuberculosis
gagccggccgccgaa

SEQ ID NO: 931183 - RNA, 15 nt, Mycobacterium avium subsp. paratuberculosis
gagccggcacggccg

SEQ ID NO: 931184 - RNA, 18 nt, Mycobacterium avium subsp. paratuberculosis
gagccggcacggccggcc

SEQ ID NO: 931185 - RNA, 22 nt, Mycobacterium avium subsp. paratuberculosis
gagccggagccuugcuggcggc

SEQ ID NO: 931186 - RNA, 17 nt, Mycobacterium avium subsp. paratuberculosis
gagccggaugcggccga

SEQ ID NO: 931187 - RNA, 14 nt, Mycobacterium avium subsp. paratuberculosis
gaggaccgagauga

SEQ ID NO: 931188 - RNA, 14 nt, Mycobacterium avium subsp. paratuberculosis
gaggacgucgagcg

SEQ ID NO: 931189 - RNA, 19 nt, Mycobacterium avium subsp. paratuberculosis
gaggacgucgagcggcgcc

SEQ ID NO: 931190 - RNA, 15 nt, Mycobacterium avium subsp. paratuberculosis
gaggaggggucggug

SEQ ID NO: 931191 - RNA, 23 nt, Mycobacterium avium subsp. paratuberculosis
gaggaggggucggugcggaugcu

SEQ ID NO: 931192 - RNA, 16 nt, Mycobacterium avium subsp. paratuberculosis
gaggagggugucggcg

SEQ ID NO: 931193 - RNA, 13 nt, Mycobacterium avium subsp. paratuberculosis
gagcugggcccgc

SEQ ID NO: 931194 - RNA, 21 nt, Mycobacterium avium subsp. paratuberculosis
gagcugggcccgcgcaucccg

SEQ ID NO: 931195 - RNA, 14 nt, Mycobacterium avium subsp. paratuberculosis
gagcugggccggcg

SEQ ID NO: 931196 - RNA, 22 nt, Mycobacterium avium subsp. paratuberculosis
gagcugggccggcgccgaagcc

SEQ ID NO: 931197 - RNA, 15 nt, Mycobacterium avium subsp. paratuberculosis
gagcuggugcagcga

SEQ ID NO: 931198 - RNA, 22 nt, Mycobacterium avium subsp. paratuberculosis
gagcugugccgcggugcggccc

SEQ ID NO: 931199 - RNA, 12 nt, Mycobacterium avium subsp. paratuberculosis
gagcuggccgcg

SEQ ID NO: 931200 - RNA, 16 nt, Mycobacterium avium subsp. paratuberculosis
gagcugcgcgccccgg

SEQ ID NO: 931201 - RNA, 15 nt, Mycobacterium avium subsp. paratuberculosis
gagcuucccggcggu

SEQ ID NO: 931202 - RNA, 15 nt, Mycobacterium avium subsp. paratuberculosis
gagcuuccgccgagu

SEQ ID NO: 931203 - RNA, 21 nt, Mycobacterium avium subsp. paratuberculosis
gagcuucucggugaucacccg

SEQ ID NO: 931204 - RNA, 22 nt, Mycobacterium avium subsp. paratuberculosis
gagcuucucggugaucacccgc

SEQ ID NO: 931205 - RNA, 16 nt, Mycobacterium avium subsp. paratuberculosis
gagcuugccuugcgcc

SEQ ID NO: 931206 - RNA, 14 nt, Mycobacterium avium subsp. paratuberculosis
gagcuuggcgggcg

SEQ ID NO: 931207 - RNA, 18 nt, Mycobacterium avium subsp. paratuberculosis
gagcuuggcgggcgucac

SEQ ID NO: 931208 - RNA, 13 nt, Mycobacterium avium subsp. paratuberculosis
gagcuuggcggug

SEQ ID NO: 931209 - RNA, 15 nt, Mycobacterium avium subsp. paratuberculosis
gagcuugggccggug

SEQ ID NO: 931210 - RNA, 13 nt, Mycobacterium avium subsp. paratuberculosis
gagcucuugcgcc

SEQ ID NO: 931211 - RNA, 19 nt, Mycobacterium avium subsp. paratuberculosis
gagcugaaguucaccaccg

SEQ ID NO: 931212 - RNA, 21 nt, Mycobacterium avium subsp. paratuberculosis
gagcugaaguucaccaccgcg

SEQ ID NO: 931213 - RNA, 22 nt, Mycobacterium avium subsp. paratuberculosis
gagcugaaguucaccaccgcgc

SEQ ID NO: 931214 - RNA, 14 nt, Mycobacterium avium subsp. paratuberculosis
gagcucgcagucga

SEQ ID NO: 931215 - RNA, 19 nt, Mycobacterium avium subsp. paratuberculosis
gagcucgccgcugucgucg

SEQ ID NO: 931216 - RNA, 20 nt, Mycobacterium avium subsp. paratuberculosis
gagcucgccgcugucgucga

SEQ ID NO: 931217 - RNA, 20 nt, Mycobacterium avium subsp. paratuberculosis
gagcucgcgcugcaugccgg

SEQ ID NO: 931218 - RNA, 17 nt, Mycobacterium avium subsp. paratuberculosis
gagcucgcggcgcagcu

SEQ ID NO: 931219 - RNA, 20 nt, Mycobacterium avium subsp. paratuberculosis
gagcucgcggcgcagcucgc

SEQ ID NO: 931220 - RNA, 22 nt, Mycobacterium avium subsp. paratuberculosis
gagcucgcggcgcagcucgcgc

SEQ ID NO: 931221 - RNA, 16 nt, Mycobacterium avium subsp. paratuberculosis
gagcucggccaccagc

SEQ ID NO: 931222 - RNA, 20 nt, Mycobacterium avium subsp. paratuberculosis
gagcucggccaccagcgccc

SEQ ID NO: 931223 - RNA, 18 nt, Mycobacterium avium subsp. paratuberculosis
gagcucgucggguguggc

SEQ ID NO: 931224 - RNA, 23 nt, Mycobacterium avium subsp. paratuberculosis
gagcucgucggguguggcgccgu

SEQ ID NO: 931225 - RNA, 23 nt, Mycobacterium avium subsp. paratuberculosis
gagcucgugaugguccagcaccg

SEQ ID NO: 931226 - RNA, 17 nt, Mycobacterium avium subsp. paratuberculosis
gagcucguucucggcga

SEQ ID NO: 931227 - RNA, 18 nt, Mycobacterium avium subsp. paratuberculosis
gagcucguucucggcgaa

SEQ ID NO: 931228 - RNA, 21 nt, Mycobacterium avium subsp. paratuberculosis
gagcugaccuggcugacggcg

SEQ ID NO: 931229 - RNA, 16 nt, Mycobacterium avium subsp. paratuberculosis
gagcugacggccauga

SEQ ID NO: 931230 - RNA, 18 nt, Mycobacterium avium subsp. paratuberculosis
gagcugcaacgcgucggc

SEQ ID NO: 931231 - RNA, 22 nt, Mycobacterium avium subsp. paratuberculosis
gagcugcaccggguacaccggc

SEQ ID NO: 931232 - RNA, 23 nt, Mycobacterium avium subsp. paratuberculosis
gagcugcaccggguacaccggcu

SEQ ID NO: 931233 - RNA, 15 nt, Mycobacterium avium subsp. paratuberculosis
gagcugaucggcguu

SEQ ID NO: 931234 - RNA, 19 nt, Mycobacterium avium subsp. paratuberculosis
gagcugccccuucgcgaca

SEQ ID NO: 931235 - RNA, 23 nt, Mycobacterium avium subsp. paratuberculosis
gagcugccccuucgcgacacugc

SEQ ID NO: 931236 - RNA, 12 nt, Mycobacterium avium subsp. paratuberculosis
gagcugccggcg

SEQ ID NO: 931237 - RNA, 22 nt, Mycobacterium avium subsp. paratuberculosis
gagcugccggcgaccagccccu

SEQ ID NO: 931238 - RNA, 14 nt, Mycobacterium avium subsp. paratuberculosis
gagcugccggcggc

SEQ ID NO: 931239 - RNA, 18 nt, Mycobacterium avium subsp. paratuberculosis
gagcugccggcggccgcc

SEQ ID NO: 931240 - RNA, 16 nt, Mycobacterium avium subsp. paratuberculosis
gagcguggacaccgca

SEQ ID NO: 931241 - RNA, 14 nt, Mycobacterium avium subsp. paratuberculosis
gagcguuccagcuu

SEQ ID NO: 931242 - RNA, 21 nt, Mycobacterium avium subsp. paratuberculosis
gagcguuccagguucagcccg

SEQ ID NO: 931243 - RNA, 20 nt, Mycobacterium avium subsp. paratuberculosis
gagcguuccuuacgccgacg

SEQ ID NO: 931244 - RNA, 23 nt, Mycobacterium avium subsp. paratuberculosis
gagcguuccuuacgccgacguca

SEQ ID NO: 931245 - RNA, 17 nt, Mycobacterium avium subsp. paratuberculosis
gagcgugggggccaugu

SEQ ID NO: 931246 - RNA, 13 nt, Mycobacterium avium subsp. paratuberculosis
gagcgucgccacc

SEQ ID NO: 931247 - RNA, 14 nt, Mycobacterium avium subsp. paratuberculosis
gagcgucgccacca

SEQ ID NO: 931248 - RNA, 17 nt, Mycobacterium avium subsp. paratuberculosis
gagcgucggucucgacg

SEQ ID NO: 931249 - RNA, 19 nt, Mycobacterium avium subsp. paratuberculosis
gagcgguuggcgacgcuga

SEQ ID NO: 931250 - RNA, 16 nt, Mycobacterium avium subsp. paratuberculosis
gagcgguuugcggguc

SEQ ID NO: 931251 - RNA, 20 nt, Mycobacterium avium subsp. paratuberculosis
gagcgugaaacuagcuucac

SEQ ID NO: 931252 - RNA, 14 nt, Mycobacterium avium subsp. paratuberculosis
gagcgugcccgcgc

SEQ ID NO: 931253 - RNA, 18 nt, Mycobacterium avium subsp. paratuberculosis
gagcgugcccgcgcccac

SEQ ID NO: 931254 - RNA, 20 nt, Mycobacterium avium subsp. paratuberculosis
gagcgugaagcuagcuucac

SEQ ID NO: 931255 - RNA, 20 nt, Mycobacterium avium subsp. paratuberculosis
gagcgugaaguuaacuucac

SEQ ID NO: 931256 - RNA, 14 nt, Mycobacterium avium subsp. paratuberculosis
gagcgugccgccgg

SEQ ID NO: 931257 - RNA, 12 nt, Mycobacterium avium subsp. paratuberculosis
gagcucgauguc

SEQ ID NO: 931258 - RNA, 23 nt, Mycobacterium avium subsp. paratuberculosis
gagcucaugguguuccaccagcg

SEQ ID NO: 931259 - RNA, 12 nt, Mycobacterium avium subsp. paratuberculosis
gagcuaggcggc

SEQ ID NO: 931260 - RNA, 14 nt, Mycobacterium avium subsp. paratuberculosis
gagcuaggcggccg

SEQ ID NO: 931261 - RNA, 19 nt, Mycobacterium avium subsp. paratuberculosis
gagcuaggcggccgggcgg

SEQ ID NO: 931262 - RNA, 24 nt, Mycobacterium avium subsp. paratuberculosis
gagcuaggcggccgggcggccgga

SEQ ID NO: 931263 - RNA, 16 nt, Mycobacterium avium subsp. paratuberculosis
gagcuaggucaccgga

SEQ ID NO: 931264 - RNA, 15 nt, Mycobacterium avium subsp. paratuberculosis
gagcuaucagcucgc

SEQ ID NO: 931265 - RNA, 15 nt, Mycobacterium avium subsp. paratuberculosis
gagcucaaccggucc

SEQ ID NO: 931266 - RNA, 22 nt, Mycobacterium avium subsp. paratuberculosis
gagcucaccgacaagggccggg

SEQ ID NO: 931267 - RNA, 13 nt, Mycobacterium avium subsp. paratuberculosis
gaggcuggcgauc

SEQ ID NO: 931268 - RNA, 21 nt, Mycobacterium avium subsp. paratuberculosis
gaggcccucgacaccgguggc

SEQ ID NO: 931269 - RNA, 15 nt, Mycobacterium avium subsp. paratuberculosis
gaggcguuggcccgc

SEQ ID NO: 931270 - RNA, 19 nt, Mycobacterium avium subsp. paratuberculosis
gaggcguuuucggugugcc

SEQ ID NO: 931271 - RNA, 21 nt, Mycobacterium avium subsp. paratuberculosis
gaggcuauugggucagcuccc

SEQ ID NO: 931272 - RNA, 21 nt, Mycobacterium avium subsp. paratuberculosis
gaggcucaggccgguggcgac

SEQ ID NO: 931273 - RNA, 19 nt, Mycobacterium avium subsp. paratuberculosis
gaggccaacgagcgcgccg

SEQ ID NO: 931274 - RNA, 14 nt, Mycobacterium avium subsp. paratuberculosis
gaggccaccgcgcc

SEQ ID NO: 931275 - RNA, 18 nt, Mycobacterium avium subsp. paratuberculosis
gaggccaccgcgccgucu

SEQ ID NO: 931276 - RNA, 19 nt, Mycobacterium avium subsp. paratuberculosis
gaggccagcacgccgguca

SEQ ID NO: 931277 - RNA, 13 nt, Mycobacterium avium subsp. paratuberculosis
gaggccagcacgc

SEQ ID NO: 931278 - RNA, 13 nt, Mycobacterium avium subsp. paratuberculosis
gaggccagcgcga

SEQ ID NO: 931279 - RNA, 14 nt, Mycobacterium avium subsp. paratuberculosis
gaggccagcgcgau

SEQ ID NO: 931280 - RNA, 15 nt, Mycobacterium avium subsp. paratuberculosis
gaggccagcgcgauc

SEQ ID NO: 931281 - RNA, 16 nt, Mycobacterium avium subsp. paratuberculosis
gaggccagcgcgaucg

SEQ ID NO: 931282 - RNA, 19 nt, Mycobacterium avium subsp. paratuberculosis
gaggccagcucgaccgcgg

SEQ ID NO: 931283 - RNA, 20 nt, Mycobacterium avium subsp. paratuberculosis
gaggccagcugcaccggggc

SEQ ID NO: 931284 - RNA, 22 nt, Mycobacterium avium subsp. paratuberculosis
gaggcccggcgugggccgcagc

SEQ ID NO: 931285 - RNA, 18 nt, Mycobacterium avium subsp. paratuberculosis
gaggcccggacggccacc

SEQ ID NO: 931286 - RNA, 21 nt, Mycobacterium avium subsp. paratuberculosis
gaggcccggcagccggggugc

SEQ ID NO: 931287 - RNA, 16 nt, Mycobacterium avium subsp. paratuberculosis
gaggccccgcgugacg

SEQ ID NO: 931288 - RNA, 22 nt, Mycobacterium avium subsp. paratuberculosis
gaggccccgcgugacggccgcg

SEQ ID NO: 931289 - RNA, 12 nt, Mycobacterium avium subsp. paratuberculosis
gaggggcgcggc

SEQ ID NO: 931290 - RNA, 22 nt, Mycobacterium avium subsp. paratuberculosis
gagggucaagauaccggccggc

SEQ ID NO: 931291 - RNA, 19 nt, Mycobacterium avium subsp. paratuberculosis
gagggugacccgggcgaug

SEQ ID NO: 931292 - RNA, 19 nt, Mycobacterium avium subsp. paratuberculosis
gagggucgagacaccgucg

SEQ ID NO: 931293 - RNA, 21 nt, Mycobacterium avium subsp. paratuberculosis
gagggucgccaggccaccgca

SEQ ID NO: 931294 - RNA, 18 nt, Mycobacterium avium subsp. paratuberculosis
gagggcuaaccaccggug

SEQ ID NO: 931295 - RNA, 14 nt, Mycobacterium avium subsp. paratuberculosis
gagggaacgccgau

SEQ ID NO: 931296 - RNA, 16 nt, Mycobacterium avium subsp. paratuberculosis
gagggaacgccgauca

SEQ ID NO: 931297 - RNA, 22 nt, Mycobacterium avium subsp. paratuberculosis
gagggaacgccgaucaccggca

SEQ ID NO: 931298 - RNA, 17 nt, Mycobacterium avium subsp. paratuberculosis
gaggcugucggaggccu

SEQ ID NO: 931299 - RNA, 14 nt, Mycobacterium avium subsp. paratuberculosis
gaggucauggcgac

SEQ ID NO: 931300 - RNA, 17 nt, Mycobacterium avium subsp. paratuberculosis
gaggucauggcgaccgc

SEQ ID NO: 931301 - RNA, 16 nt, Mycobacterium avium subsp. paratuberculosis
gagguccucgcgcaac

SEQ ID NO: 931302 - RNA, 18 nt, Mycobacterium avium subsp. paratuberculosis
gagguccucgcgcaacug

SEQ ID NO: 931303 - RNA, 14 nt, Mycobacterium avium subsp. paratuberculosis
gagguccucggcga

SEQ ID NO: 931304 - RNA, 19 nt, Mycobacterium avium subsp. paratuberculosis
gaggucgaaccacgcggcg

SEQ ID NO: 931305 - RNA, 21 nt, Mycobacterium avium subsp. paratuberculosis
gaggucgaaccacgcggcggc

SEQ ID NO: 931306 - RNA, 22 nt, Mycobacterium avium subsp. paratuberculosis
gaggucgaaccacgcggcggcg

SEQ ID NO: 931307 - RNA, 22 nt, Mycobacterium avium subsp. paratuberculosis
gagguagucccgcgccuggcgc

SEQ ID NO: 931308 - RNA, 13 nt, Mycobacterium avium subsp. paratuberculosis
gagguagccgcgc

SEQ ID NO: 931309 - RNA, 12 nt, Mycobacterium avium subsp. paratuberculosis
gaggucaccgcg

SEQ ID NO: 931310 - RNA, 15 nt, Mycobacterium avium subsp. paratuberculosis
gaggucaccgcgacc

SEQ ID NO: 931311 - RNA, 19 nt, Mycobacterium avium subsp. paratuberculosis
gaggucaccgcgaccaugc

SEQ ID NO: 931312 - RNA, 18 nt, Mycobacterium avium subsp. paratuberculosis
gaggucagcagggugacg

SEQ ID NO: 931313 - RNA, 16 nt, Mycobacterium avium subsp. paratuberculosis
gagggugucggcgauc

SEQ ID NO: 931314 - RNA, 16 nt, Mycobacterium avium subsp. paratuberculosis
gaggguuuucggggcg

SEQ ID NO: 931315 - RNA, 23 nt, Mycobacterium avium subsp. paratuberculosis
gaggguucgguggccccgggccg

SEQ ID NO: 931316 - RNA, 16 nt, Mycobacterium avium subsp. paratuberculosis
gaggguuggcgugucg

SEQ ID NO: 931317 - RNA, 17 nt, Mycobacterium avium subsp. paratuberculosis
gagguacucgagcgugc

SEQ ID NO: 931318 - RNA, 14 nt, Mycobacterium avium subsp. paratuberculosis
gagguaggccaccg

SEQ ID NO: 931319 - RNA, 16 nt, Mycobacterium avium subsp. paratuberculosis
gagguaggccaccggg

SEQ ID NO: 931320 - RNA, 14 nt, Mycobacterium avium subsp. paratuberculosis
gagguaggcgagau

SEQ ID NO: 931321 - RNA, 14 nt, Mycobacterium avium subsp. paratuberculosis
gagguagaccgccg

SEQ ID NO: 931322 - RNA, 13 nt, Mycobacterium avium subsp. paratuberculosis
gaggugaagccgu

SEQ ID NO: 931323 - RNA, 18 nt, Mycobacterium avium subsp. paratuberculosis
gaggugaauaccacugcg

SEQ ID NO: 931324 - RNA, 15 nt, Mycobacterium avium subsp. paratuberculosis
gaggucucccggucc

SEQ ID NO: 931325 - RNA, 17 nt, Mycobacterium avium subsp. paratuberculosis
gagguugaugccgacgu

SEQ ID NO: 931326 - RNA, 20 nt, Mycobacterium avium subsp. paratuberculosis
gagguuuccgcugaugcggc

SEQ ID NO: 931327 - RNA, 22 nt, Mycobacterium avium subsp. paratuberculosis
gaggucgacggagucgucggcg

SEQ ID NO: 931328 - RNA, 12 nt, Mycobacterium avium subsp. paratuberculosis
gaggucgccgac

SEQ ID NO: 931329 - RNA, 14 nt, Mycobacterium avium subsp. paratuberculosis
gaggucgcgaccgc

SEQ ID NO: 931330 - RNA, 16 nt, Mycobacterium avium subsp. paratuberculosis
gaggucgcgaccgccg

SEQ ID NO: 931331 - RNA, 18 nt, Mycobacterium avium subsp. paratuberculosis
gaggucgcggcggccggc

SEQ ID NO: 931332 - RNA, 13 nt, Mycobacterium avium subsp. paratuberculosis
gaggucgccggug

SEQ ID NO: 931333 - RNA, 14 nt, Mycobacterium avium subsp. paratuberculosis
gaggucggacgccu

SEQ ID NO: 931334 - RNA, 13 nt, Mycobacterium avium subsp. paratuberculosis
gaggucggccagc

SEQ ID NO: 931335 - RNA, 14 nt, Mycobacterium avium subsp. paratuberculosis
gaggucggccagca

SEQ ID NO: 931336 - RNA, 19 nt, Mycobacterium avium subsp. paratuberculosis
gaggucggccagcaggucg

SEQ ID NO: 931337 - RNA, 14 nt, Mycobacterium avium subsp. paratuberculosis
gaggucgucgaggg

SEQ ID NO: 931338 - RNA, 14 nt, Mycobacterium avium subsp. paratuberculosis
gaggucgucgcguc

SEQ ID NO: 931339 - RNA, 13 nt, Mycobacterium avium subsp. paratuberculosis
gaggucgucggcc

SEQ ID NO: 931340 - RNA, 23 nt, Mycobacterium avium subsp. paratuberculosis
gcaggucguaguaggcgccgaac

SEQ ID NO: 931341 - RNA, 12 nt, Mycobacterium avium subsp. paratuberculosis
gcaggucgucga

SEQ ID NO: 931342 - RNA, 14 nt, Mycobacterium avium subsp. paratuberculosis
gcaggucgucgacg

SEQ ID NO: 931343 - RNA, 15 nt, Mycobacterium avium subsp. paratuberculosis
gcaggucgucgacgu

SEQ ID NO: 931344 - RNA, 18 nt, Mycobacterium avium subsp. paratuberculosis
gcaggucgucgacgucgc

SEQ ID NO: 931345 - RNA, 22 nt, Mycobacterium avium subsp. paratuberculosis
gcaggucggcgggagccggcgg

SEQ ID NO: 931346 - RNA, 21 nt, Mycobacterium avium subsp. paratuberculosis
gcaggucggcgugcucgucgc

SEQ ID NO: 931347 - RNA, 23 nt, Mycobacterium avium subsp. paratuberculosis
gcaggucggcgugcucgucgcgg

SEQ ID NO: 931348 - RNA, 18 nt, Mycobacterium avium subsp. paratuberculosis
gcaggucgggccggccga

SEQ ID NO: 931349 - RNA, 20 nt, Mycobacterium avium subsp. paratuberculosis
gcaggucgucgaucagggcg

SEQ ID NO: 931350 - RNA, 17 nt, Mycobacterium avium subsp. paratuberculosis
gcaggucgucgucgccg

SEQ ID NO: 931351 - RNA, 19 nt, Mycobacterium avium subsp. paratuberculosis
gcaggucgucgucgccgcg

SEQ ID NO: 931352 - RNA, 22 nt, Mycobacterium avium subsp. paratuberculosis
gcaggucgucgucgccgcgcgc

SEQ ID NO: 931353 - RNA, 14 nt, Mycobacterium avium subsp. paratuberculosis
gcagguggucggcg

SEQ ID NO: 931354 - RNA, 14 nt, Mycobacterium avium subsp. paratuberculosis
gcagguggucggug

SEQ ID NO: 931355 - RNA, 18 nt, Mycobacterium avium subsp. paratuberculosis
gcagguggauugucggcc

SEQ ID NO: 931356 - RNA, 13 nt, Mycobacterium avium subsp. paratuberculosis
gcaggugggcggu

SEQ ID NO: 931357 - RNA, 14 nt, Mycobacterium avium subsp. paratuberculosis
gcaggugcgccaga

SEQ ID NO: 931358 - RNA, 14 nt, Mycobacterium avium subsp. paratuberculosis
gcaggugcgccgcu

SEQ ID NO: 931359 - RNA, 23 nt, Mycobacterium avium subsp. paratuberculosis
gcaggugcgccgcucgucggcca

SEQ ID NO: 931360 - RNA, 14 nt, Mycobacterium avium subsp. paratuberculosis
gcaggugcgcgguc

SEQ ID NO: 931361 - RNA, 15 nt, Mycobacterium avium subsp. paratuberculosis
gcaggugcccgucgg

SEQ ID NO: 931362 - RNA, 16 nt, Mycobacterium avium subsp. paratuberculosis
gcaggugcccgucggc

SEQ ID NO: 931363 - RNA, 23 nt, Mycobacterium avium subsp. paratuberculosis
gcaggugcccgucggccucggcg

SEQ ID NO: 931364 - RNA, 19 nt, Mycobacterium avium subsp. paratuberculosis
gcaggugcaccacccaggc

SEQ ID NO: 931365 - RNA, 17 nt, Mycobacterium avium subsp. paratuberculosis
gcaggugcaucgaccgg

SEQ ID NO: 931366 - RNA, 21 nt, Mycobacterium avium subsp. paratuberculosis
gcaggugcaucgaccggcgga

SEQ ID NO: 931367 - RNA, 17 nt, Mycobacterium avium subsp. paratuberculosis
gcaggugcaucgccacc

SEQ ID NO: 931368 - RNA, 19 nt, Mycobacterium avium subsp. paratuberculosis
gcaggugcaucgccaccgu

SEQ ID NO: 931369 - RNA, 18 nt, Mycobacterium avium subsp. paratuberculosis
gcaggugagccgggugcc

SEQ ID NO: 931370 - RNA, 23 nt, Mycobacterium avium subsp. paratuberculosis
gcaggugaucuugcccagccacg

SEQ ID NO: 931371 - RNA, 18 nt, Mycobacterium avium subsp. paratuberculosis
gcaggugaaggugcccca

SEQ ID NO: 931372 - RNA, 23 nt, Mycobacterium avium subsp. paratuberculosis
gcaggugacggauguggucggcc

SEQ ID NO: 931373 - RNA, 21 nt, Mycobacterium avium subsp. paratuberculosis
gcaguagcacuuucgcggcaa

SEQ ID NO: 931374 - RNA, 14 nt, Mycobacterium avium subsp. paratuberculosis
gcaguagccgacgu

SEQ ID NO: 931375 - RNA, 13 nt, Mycobacterium avium subsp. paratuberculosis
gcaguagccggcc

SEQ ID NO: 931376 - RNA, 20 nt, Mycobacterium avium subsp. paratuberculosis
gcaguagccggccagcucga

SEQ ID NO: 931377 - RNA, 16 nt, Mycobacterium avium subsp. paratuberculosis
gcaguagaacggcccg

SEQ ID NO: 931378 - RNA, 21 nt, Mycobacterium avium subsp. paratuberculosis
gcaguaucuuguucgccgaca

SEQ ID NO: 931379 - RNA, 19 nt, Mycobacterium avium subsp. paratuberculosis
gcaguacgcaucggcgccg

SEQ ID NO: 931380 - RNA, 15 nt, Mycobacterium avium subsp. paratuberculosis
gcaguacgcgccggc

SEQ ID NO: 931381 - RNA, 18 nt, Mycobacterium avium subsp. paratuberculosis
gcagguuguugacgacgu

SEQ ID NO: 931382 - RNA, 20 nt, Mycobacterium avium subsp. paratuberculosis
gcagguuucucgaccaagaa

SEQ ID NO: 931383 - RNA, 18 nt, Mycobacterium avium subsp. paratuberculosis
gcagguuguccagccggu

SEQ ID NO: 931384 - RNA, 14 nt, Mycobacterium avium subsp. paratuberculosis
gcagguugucggcc

SEQ ID NO: 931385 - RNA, 17 nt, Mycobacterium avium subsp. paratuberculosis
gcagguugucggccaac

SEQ ID NO: 931386 - RNA, 23 nt, Mycobacterium avium subsp. paratuberculosis
gcagguucauccccgcggccacc

SEQ ID NO: 931387 - RNA, 19 nt, Mycobacterium avium subsp. paratuberculosis
gcagguucaugugaccggg

SEQ ID NO: 931388 - RNA, 14 nt, Mycobacterium avium subsp. paratuberculosis
gcagguggugggcg

SEQ ID NO: 931389 - RNA, 16 nt, Mycobacterium avium subsp. paratuberculosis
gcagguucgacacgcc

SEQ ID NO: 931390 - RNA, 15 nt, Mycobacterium avium subsp. paratuberculosis
gcagguucugcacgu

SEQ ID NO: 931391 - RNA, 17 nt, Mycobacterium avium subsp. paratuberculosis
gcagguugauccgcgcg

SEQ ID NO: 931392 - RNA, 22 nt, Mycobacterium avium subsp. paratuberculosis
gcagguugcgguguugcgcagc

SEQ ID NO: 931393 - RNA, 14 nt, Mycobacterium avium subsp. paratuberculosis
gcagggucagcagc

SEQ ID NO: 931394 - RNA, 18 nt, Mycobacterium avium subsp. paratuberculosis
gcagggucagcagcaccc

SEQ ID NO: 931395 - RNA, 12 nt, Mycobacterium avium subsp. paratuberculosis
gcagggucagcg

SEQ ID NO: 931396 - RNA, 18 nt, Mycobacterium avium subsp. paratuberculosis
gcagggggacgaaccagu

SEQ ID NO: 931397 - RNA, 15 nt, Mycobacterium avium subsp. paratuberculosis
gcagggugacgucgu

SEQ ID NO: 931398 - RNA, 18 nt, Mycobacterium avium subsp. paratuberculosis
gcagggugacgucguuga

SEQ ID NO: 931399 - RNA, 15 nt, Mycobacterium avium subsp. paratuberculosis
gcagggugccgccgc

SEQ ID NO: 931400 - RNA, 16 nt, Mycobacterium avium subsp. paratuberculosis
gcagggugccgccgcc

SEQ ID NO: 931401 - RNA, 18 nt, Mycobacterium avium subsp. paratuberculosis
gcagggugccgccgcccg

SEQ ID NO: 931402 - RNA, 12 nt, Mycobacterium avium subsp. paratuberculosis
gcagggcggcac

SEQ ID NO: 931403 - RNA, 17 nt, Mycobacterium avium subsp. paratuberculosis
gcagggcguucgacguc

SEQ ID NO: 931404 - RNA, 16 nt, Mycobacterium avium subsp. paratuberculosis
gcagggcggcgaucga

SEQ ID NO: 931405 - RNA, 14 nt, Mycobacterium avium subsp. paratuberculosis
gcagggcgccggug

SEQ ID NO: 931406 - RNA, 16 nt, Mycobacterium avium subsp. paratuberculosis
gcagggcgccgacgau

SEQ ID NO: 931407 - RNA, 16 nt, Mycobacterium avium subsp. paratuberculosis
gcagggcgaacggcgg

SEQ ID NO: 931408 - RNA, 15 nt, Mycobacterium avium subsp. paratuberculosis
gcagggccucgccgu

SEQ ID NO: 931409 - RNA, 15 nt, Mycobacterium avium subsp. paratuberculosis
gcagggccgggucga

SEQ ID NO: 931410 - RNA, 18 nt, Mycobacterium avium subsp. paratuberculosis
gcagggccagcgccucgg

SEQ ID NO: 931411 - RNA, 19 nt, Mycobacterium avium subsp. paratuberculosis
gcagggcaccgacggccgc

SEQ ID NO: 931412 - RNA, 14 nt, Mycobacterium avium subsp. paratuberculosis
gcagggccagcacc

SEQ ID NO: 931413 - RNA, 19 nt, Mycobacterium avium subsp. paratuberculosis
gcagggcaucucccgcgcg

SEQ ID NO: 931414 - RNA, 17 nt, Mycobacterium avium subsp. paratuberculosis
gcaggguccgccgucga

SEQ ID NO: 931415 - RNA, 19 nt, Mycobacterium avium subsp. paratuberculosis
gcaggguccgccgucgagu

SEQ ID NO: 931416 - RNA, 20 nt, Mycobacterium avium subsp. paratuberculosis
gcaggguuuucacgucgagc

SEQ ID NO: 931417 - RNA, 23 nt, Mycobacterium avium subsp. paratuberculosis
gcaggguuuucacgucgagcggc

SEQ ID NO: 931418 - RNA, 19 nt, Mycobacterium avium subsp. paratuberculosis
gcagguagaagccgcgacg

SEQ ID NO: 931419 - RNA, 20 nt, Mycobacterium avium subsp. paratuberculosis
gcagguauuuggugaccugc

SEQ ID NO: 931420 - RNA, 21 nt, Mycobacterium avium subsp. paratuberculosis
gcaggucacccuccucgcggc

SEQ ID NO: 931421 - RNA, 14 nt, Mycobacterium avium subsp. paratuberculosis
gcaggucaccggau

SEQ ID NO: 931422 - RNA, 22 nt, Mycobacterium avium subsp. paratuberculosis
gcagguccguggugaucgccgc

SEQ ID NO: 931423 - RNA, 15 nt, Mycobacterium avium subsp. paratuberculosis
gcaggucgagcaugc

SEQ ID NO: 931424 - RNA, 22 nt, Mycobacterium avium subsp. paratuberculosis
gcaggucgaaggcggccgcgag

SEQ ID NO: 931425 - RNA, 14 nt, Mycobacterium avium subsp. paratuberculosis
gcagguccgccggu

SEQ ID NO: 931426 - RNA, 17 nt, Mycobacterium avium subsp. paratuberculosis
gcagguccgccggugcc

SEQ ID NO: 931427 - RNA, 18 nt, Mycobacterium avium subsp. paratuberculosis
gcagguccgccggugcca

SEQ ID NO: 931428 - RNA, 14 nt, Mycobacterium avium subsp. paratuberculosis
gcagguccggcagc

SEQ ID NO: 931429 - RNA, 16 nt, Mycobacterium avium subsp. paratuberculosis
gcaggucggccagcgc

SEQ ID NO: 931430 - RNA, 22 nt, Mycobacterium avium subsp. paratuberculosis
gcaggucggccagcgccgcccg

SEQ ID NO: 931431 - RNA, 20 nt, Mycobacterium avium subsp. paratuberculosis
gcaggucggcgggagccggc

SEQ ID NO: 931432 - RNA, 21 nt, Mycobacterium avium subsp. paratuberculosis
gcaggucgcggugggcgcggg

SEQ ID NO: 931433 - RNA, 22 nt, Mycobacterium avium subsp. paratuberculosis
gcaggucgauggcguagcgggu

SEQ ID NO: 931434 - RNA, 23 nt, Mycobacterium avium subsp. paratuberculosis
gcaggcguccuugauccgggcgc

SEQ ID NO: 931435 - RNA, 19 nt, Mycobacterium avium subsp. paratuberculosis
gcaggcuucgcagcagauc

SEQ ID NO: 931436 - RNA, 18 nt, Mycobacterium avium subsp. paratuberculosis
gcagggauucggccaugc

SEQ ID NO: 931437 - RNA, 18 nt, Mycobacterium avium subsp. paratuberculosis
gcaggcuggcaucgucgg

SEQ ID NO: 931438 - RNA, 22 nt, Mycobacterium avium subsp. paratuberculosis
gcaggcuggcaucgucggcgcc

SEQ ID NO: 931439 - RNA, 19 nt, Mycobacterium avium subsp. paratuberculosis
gcaggcuggcaugccggaa

SEQ ID NO: 931440 - RNA, 18 nt, Mycobacterium avium subsp. paratuberculosis
gcaggcugacgcgaccgc

SEQ ID NO: 931441 - RNA, 18 nt, Mycobacterium avium subsp. paratuberculosis
gcaggcugaucucggcgg

SEQ ID NO: 931442 - RNA, 16 nt, Mycobacterium avium subsp. paratuberculosis
gcaggcuguccugcgg

SEQ ID NO: 931443 - RNA, 21 nt, Mycobacterium avium subsp. paratuberculosis
gcaggcgguuucaccgaggcg

SEQ ID NO: 931444 - RNA, 17 nt, Mycobacterium avium subsp. paratuberculosis
gcaggcgcugagcgggu

SEQ ID NO: 931445 - RNA, 13 nt, Mycobacterium avium subsp. paratuberculosis
gcaggcggcgcgc

SEQ ID NO: 931446 - RNA, 16 nt, Mycobacterium avium subsp. paratuberculosis
gcaggcggcgcgcagc

SEQ ID NO: 931447 - RNA, 17 nt, Mycobacterium avium subsp. paratuberculosis
gcaggcggcgcgcagcc

SEQ ID NO: 931448 - RNA, 15 nt, Mycobacterium avium subsp. paratuberculosis
gcaggcggcgacggc

SEQ ID NO: 931449 - RNA, 16 nt, Mycobacterium avium subsp. paratuberculosis
gcaggcggcgacggcc

SEQ ID NO: 931450 - RNA, 17 nt, Mycobacterium avium subsp. paratuberculosis
gcaggcggcgacggccg

SEQ ID NO: 931451 - RNA, 20 nt, Mycobacterium avium subsp. paratuberculosis
gcaggcguggcccagccggu

SEQ ID NO: 931452 - RNA, 21 nt, Mycobacterium avium subsp. paratuberculosis
gcaggcguggcccagccggug

SEQ ID NO: 931453 - RNA, 22 nt, Mycobacterium avium subsp. paratuberculosis
gcaggcguggcccagccggugc

SEQ ID NO: 931454 - RNA, 23 nt, Mycobacterium avium subsp. paratuberculosis
gcaggcguggcccagccggugcg

SEQ ID NO: 931455 - RNA, 15 nt, Mycobacterium avium subsp. paratuberculosis
gcaggcucagcagca

SEQ ID NO: 931456 - RNA, 18 nt, Mycobacterium avium subsp. paratuberculosis
gcaggcucagcagcaccg

SEQ ID NO: 931457 - RNA, 17 nt, Mycobacterium avium subsp. paratuberculosis
gcaggcucagguaggcg

SEQ ID NO: 931458 - RNA, 15 nt, Mycobacterium avium subsp. paratuberculosis
gcaggcggaucggcc

SEQ ID NO: 931459 - RNA, 16 nt, Mycobacterium avium subsp. paratuberculosis
gcaggcggaucggccc

SEQ ID NO: 931460 - RNA, 13 nt, Mycobacterium avium subsp. paratuberculosis
gcaggcggccagc

SEQ ID NO: 931461 - RNA, 16 nt, Mycobacterium avium subsp. paratuberculosis
gcaggcggccagggcg

SEQ ID NO: 931462 - RNA, 14 nt, Mycobacterium avium subsp. paratuberculosis
gcaggcggcccgcu

SEQ ID NO: 931463 - RNA, 17 nt, Mycobacterium avium subsp. paratuberculosis
gcaggcggcccgcucga

SEQ ID NO: 931464 - RNA, 14 nt, Mycobacterium avium subsp. paratuberculosis
gcaggcgcgcggcc

SEQ ID NO: 931465 - RNA, 21 nt, Mycobacterium avium subsp. paratuberculosis
gcaggcgcgcggccagccccg

SEQ ID NO: 931466 - RNA, 13 nt, Mycobacterium avium subsp. paratuberculosis
gcaggcgccgguc

SEQ ID NO: 931467 - RNA, 15 nt, Mycobacterium avium subsp. paratuberculosis
gcaggcgcgccgagc

SEQ ID NO: 931468 - RNA, 21 nt, Mycobacterium avium subsp. paratuberculosis
gcaggcgcgccgagcgcuggu

SEQ ID NO: 931469 - RNA, 16 nt, Mycobacterium avium subsp. paratuberculosis
gcaggcgcgcaccauc

SEQ ID NO: 931470 - RNA, 13 nt, Mycobacterium avium subsp. paratuberculosis
gcaggcgcgcagc

SEQ ID NO: 931471 - RNA, 14 nt, Mycobacterium avium subsp. paratuberculosis
gcaggcgcccagga

SEQ ID NO: 931472 - RNA, 16 nt, Mycobacterium avium subsp. paratuberculosis
gcaggcgaacaccucg

SEQ ID NO: 931473 - RNA, 17 nt, Mycobacterium avium subsp. paratuberculosis
gcaggcgaucucgccga

SEQ ID NO: 931474 - RNA, 23 nt, Mycobacterium avium subsp. paratuberculosis
gcaggcgcaccaccagcucgucg

SEQ ID NO: 931475 - RNA, 21 nt, Mycobacterium avium subsp. paratuberculosis
gcaggcgagccgacagucgcg

SEQ ID NO: 931476 - RNA, 22 nt, Mycobacterium avium subsp. paratuberculosis
gcaggcgagccgacagucgcgg

SEQ ID NO: 931477 - RNA, 18 nt, Mycobacterium avium subsp. paratuberculosis
gcaggcgauggcgucggc

SEQ ID NO: 931478 - RNA, 19 nt, Mycobacterium avium subsp. paratuberculosis
gcaggcgauggcgucggcc

SEQ ID NO: 931479 - RNA, 21 nt, Mycobacterium avium subsp. paratuberculosis
gcaggcgauggcgucggccag

SEQ ID NO: 931480 - RNA, 22 nt, Mycobacterium avium subsp. paratuberculosis
gcaggcgauggcgucggccagc

SEQ ID NO: 931481 - RNA, 19 nt, Mycobacterium avium subsp. paratuberculosis
gcaggcgauggugccggcc

SEQ ID NO: 931482 - RNA, 20 nt, Mycobacterium avium subsp. paratuberculosis
gcaggcgauggugccggcca

SEQ ID NO: 931483 - RNA, 19 nt, Mycobacterium avium subsp. paratuberculosis
gcaggcgaugugggugguc

SEQ ID NO: 931484 - RNA, 14 nt, Mycobacterium avium subsp. paratuberculosis
gcaggccggugcug

SEQ ID NO: 931485 - RNA, 14 nt, Mycobacterium avium subsp. paratuberculosis
gcaggccguccagc

SEQ ID NO: 931486 - RNA, 21 nt, Mycobacterium avium subsp. paratuberculosis
gcaggccgggauagagcaccg

SEQ ID NO: 931487 - RNA, 12 nt, Mycobacterium avium subsp. paratuberculosis
gcaggccgcgac

SEQ ID NO: 931488 - RNA, 16 nt, Mycobacterium avium subsp. paratuberculosis
gcaggccgcgacgggc

SEQ ID NO: 931489 - RNA, 15 nt, Mycobacterium avium subsp. paratuberculosis
gcaggccgcgggugg

SEQ ID NO: 931490 - RNA, 19 nt, Mycobacterium avium subsp. paratuberculosis
gcaggccggcagccggcgc

SEQ ID NO: 931491 - RNA, 13 nt, Mycobacterium avium subsp. paratuberculosis
gcaggccgccgac

SEQ ID NO: 931492 - RNA, 17 nt, Mycobacterium avium subsp. paratuberculosis
gcaggccgccgacgacg

SEQ ID NO: 931493 - RNA, 17 nt, Mycobacterium avium subsp. paratuberculosis
gcaggccgcccgacccg

SEQ ID NO: 931494 - RNA, 16 nt, Mycobacterium avium subsp. paratuberculosis
gcaggccgaggccaac

SEQ ID NO: 931495 - RNA, 16 nt, Mycobacterium avium subsp. paratuberculosis
gcaggccccggauccg

SEQ ID NO: 931496 - RNA, 21 nt, Mycobacterium avium subsp. paratuberculosis
gcaggccccggauccgucgcc

SEQ ID NO: 931497 - RNA, 13 nt, Mycobacterium avium subsp. paratuberculosis
gcaggccccggcg

SEQ ID NO: 931498 - RNA, 14 nt, Mycobacterium avium subsp. paratuberculosis
gcaggccccggcgc

SEQ ID NO: 931499 - RNA, 16 nt, Mycobacterium avium subsp. paratuberculosis
gcaggccccggcgcgc

SEQ ID NO: 931500 - RNA, 15 nt, Mycobacterium avium subsp. paratuberculosis
gcaggcccgggcggc

SEQ ID NO: 931501 - RNA, 16 nt, Mycobacterium avium subsp. paratuberculosis
gcaggcccgggcggcg

SEQ ID NO: 931502 - RNA, 20 nt, Mycobacterium avium subsp. paratuberculosis
gcaggcccgagcccgacggc

SEQ ID NO: 931503 - RNA, 14 nt, Mycobacterium avium subsp. paratuberculosis
gcaggcccucgacg

SEQ ID NO: 931504 - RNA, 14 nt, Mycobacterium avium subsp. paratuberculosis
gcaggcccucggcc

SEQ ID NO: 931505 - RNA, 17 nt, Mycobacterium avium subsp. paratuberculosis
gcaggccgagccgccgg

SEQ ID NO: 931506 - RNA, 18 nt, Mycobacterium avium subsp. paratuberculosis
gcaggccgagccgccgga

SEQ ID NO: 931507 - RNA, 20 nt, Mycobacterium avium subsp. paratuberculosis
gcaggccgagccgccggauc

SEQ ID NO: 931508 - RNA, 20 nt, Mycobacterium avium subsp. paratuberculosis
gcaggccgaggcugucggag

SEQ ID NO: 931509 - RNA, 19 nt, Mycobacterium avium subsp. paratuberculosis
gcaggccgaacaccgucau

SEQ ID NO: 931510 - RNA, 20 nt, Mycobacterium avium subsp. paratuberculosis
gcaggccgaagaacucagcc

SEQ ID NO: 931511 - RNA, 15 nt, Mycobacterium avium subsp. paratuberculosis
gcaggccacgcccac

SEQ ID NO: 931512 - RNA, 17 nt, Mycobacterium avium subsp. paratuberculosis
gcaggccaggugcagcu

SEQ ID NO: 931513 - RNA, 16 nt, Mycobacterium avium subsp. paratuberculosis
gcaggcaggccggcag

SEQ ID NO: 931514 - RNA, 19 nt, Mycobacterium avium subsp. paratuberculosis
gcaggcaggccggcagccg

SEQ ID NO: 931515 - RNA, 17 nt, Mycobacterium avium subsp. paratuberculosis
gcaggcaucgcgugccg

SEQ ID NO: 931516 - RNA, 13 nt, Mycobacterium avium subsp. paratuberculosis
gcaggcagcagca

SEQ ID NO: 931517 - RNA, 13 nt, Mycobacterium avium subsp. paratuberculosis
gcaggcagccguu

SEQ ID NO: 931518 - RNA, 15 nt, Mycobacterium avium subsp. paratuberculosis
gcaggaugucguagg

SEQ ID NO: 931519 - RNA, 23 nt, Mycobacterium avium subsp. paratuberculosis
gcaggaugccgcguuccacgcag

SEQ ID NO: 931520 - RNA, 12 nt, Mycobacterium avium subsp. paratuberculosis
gcaggauggccu

SEQ ID NO: 931521 - RNA, 20 nt, Mycobacterium avium subsp. paratuberculosis
gcaggaugaccgcgucggcg

SEQ ID NO: 931522 - RNA, 16 nt, Mycobacterium avium subsp. paratuberculosis
gcaggaugcccagcac

SEQ ID NO: 931523 - RNA, 22 nt, Mycobacterium avium subsp. paratuberculosis
gcaggaucuuugcauacagcag

SEQ ID NO: 931524 - RNA, 18 nt, Mycobacterium avium subsp. paratuberculosis
gcaggaucuggugcgcgc

SEQ ID NO: 931525 - RNA, 20 nt, Mycobacterium avium subsp. paratuberculosis
gcaggaucuggugcgcgcgc

SEQ ID NO: 931526 - RNA, 18 nt, Mycobacterium avium subsp. paratuberculosis
gcaggaucuccggccggu

SEQ ID NO: 931527 - RNA, 16 nt, Mycobacterium avium subsp. paratuberculosis
gcagcgaaaccuccgg

SEQ ID NO: 931528 - RNA, 23 nt, Mycobacterium avium subsp. paratuberculosis
gcagcgaaaccuccggagaucgc

SEQ ID NO: 931529 - RNA, 16 nt, Mycobacterium avium subsp. paratuberculosis
gcagcgaacccgccag

SEQ ID NO: 931530 - RNA, 22 nt, Mycobacterium avium subsp. paratuberculosis
gcagcgaacccgccagggcgac

SEQ ID NO: 931531 - RNA, 13 nt, Mycobacterium avium subsp. paratuberculosis
gcagccgggccag

SEQ ID NO: 931532 - RNA, 18 nt, Mycobacterium avium subsp. paratuberculosis
gcagcgaaucggggucga

SEQ ID NO: 931533 - RNA, 17 nt, Mycobacterium avium subsp. paratuberculosis
gcagcgaagcgaggcgc

SEQ ID NO: 931534 - RNA, 17 nt, Mycobacterium avium subsp. paratuberculosis
gcagcgaauacaccguc

SEQ ID NO: 931535 - RNA, 21 nt, Mycobacterium avium subsp. paratuberculosis
gcagcgaauacaccguccagc

SEQ ID NO: 931536 - RNA, 16 nt, Mycobacterium avium subsp. paratuberculosis
gcagcgaacgcggcug

SEQ ID NO: 931537 - RNA, 22 nt, Mycobacterium avium subsp. paratuberculosis
gcagccggccgaccgccucgau

SEQ ID NO: 931538 - RNA, 13 nt, Mycobacterium avium subsp. paratuberculosis
gcagccggccggc

SEQ ID NO: 931539 - RNA, 16 nt, Mycobacterium avium subsp. paratuberculosis
gcagccggccggcgga

SEQ ID NO: 931540 - RNA, 13 nt, Mycobacterium avium subsp. paratuberculosis
gcagccggccguc

SEQ ID NO: 931541 - RNA, 20 nt, Mycobacterium avium subsp. paratuberculosis
gcagccggccguccacggcg

SEQ ID NO: 931542 - RNA, 23 nt, Mycobacterium avium subsp. paratuberculosis
gcagccggccguccacggcggug

SEQ ID NO: 931543 - RNA, 15 nt, Mycobacterium avium subsp. paratuberculosis
gcagccggcgcccgc

SEQ ID NO: 931544 - RNA, 16 nt, Mycobacterium avium subsp. paratuberculosis
gcagccggcgcggcag

SEQ ID NO: 931545 - RNA, 14 nt, Mycobacterium avium subsp. paratuberculosis
gcagccggcgcggu

SEQ ID NO: 931546 - RNA, 13 nt, Mycobacterium avium subsp. paratuberculosis
gcagccggcggcg

SEQ ID NO: 931547 - RNA, 21 nt, Mycobacterium avium subsp. paratuberculosis
gcagccggcguacucgcacag

SEQ ID NO: 931548 - RNA, 20 nt, Mycobacterium avium subsp. paratuberculosis
gcagccgggccagcaacagc

SEQ ID NO: 931549 - RNA, 13 nt, Mycobacterium avium subsp. paratuberculosis
gcagccgggccug

SEQ ID NO: 931550 - RNA, 14 nt, Mycobacterium avium subsp. paratuberculosis
gcagccgggcgauc

SEQ ID NO: 931551 - RNA, 20 nt, Mycobacterium avium subsp. paratuberculosis
gcagccgggcgaucauccag

SEQ ID NO: 931552 - RNA, 21 nt, Mycobacterium avium subsp. paratuberculosis
gcagccgggcgaucauccagg

SEQ ID NO: 931553 - RNA, 13 nt, Mycobacterium avium subsp. paratuberculosis
gcagccgggcggc

SEQ ID NO: 931554 - RNA, 18 nt, Mycobacterium avium subsp. paratuberculosis
gcagccgggcggcgccga

SEQ ID NO: 931555 - RNA, 20 nt, Mycobacterium avium subsp. paratuberculosis
gcagccgggcggcgccgaac

SEQ ID NO: 931556 - RNA, 21 nt, Mycobacterium avium subsp. paratuberculosis
gcagccgggcggcggccuccg

SEQ ID NO: 931557 - RNA, 15 nt, Mycobacterium avium subsp. paratuberculosis
gcagccgggggcggu

SEQ ID NO: 931558 - RNA, 16 nt, Mycobacterium avium subsp. paratuberculosis
gcagccgggggcggug

SEQ ID NO: 931559 - RNA, 17 nt, Mycobacterium avium subsp. paratuberculosis
gcagccgggggcggugc

SEQ ID NO: 931560 - RNA, 19 nt, Mycobacterium avium subsp. paratuberculosis
gcagccgggggcggugcag

SEQ ID NO: 931561 - RNA, 22 nt, Mycobacterium avium subsp. paratuberculosis
gcagccgggggcggugcagccg

SEQ ID NO: 931562 - RNA, 16 nt, Mycobacterium avium subsp. paratuberculosis
gcagccggggugcccg

SEQ ID NO: 931563 - RNA, 20 nt, Mycobacterium avium subsp. paratuberculosis
gcagccggggugcccgggcc

SEQ ID NO: 931564 - RNA, 23 nt, Mycobacterium avium subsp. paratuberculosis
gcagccgggucaguucgcggcgc

SEQ ID NO: 931565 - RNA, 14 nt, Mycobacterium avium subsp. paratuberculosis
gcagcgaucggcgg

SEQ ID NO: 931566 - RNA, 16 nt, Mycobacterium avium subsp. paratuberculosis
gcagcgacggaucggc

SEQ ID NO: 931567 - RNA, 19 nt, Mycobacterium avium subsp. paratuberculosis
gcagcgacggaucggccgc

SEQ ID NO: 931568 - RNA, 20 nt, Mycobacterium avium subsp. paratuberculosis
gcagcgacggaucggccgcg

SEQ ID NO: 931569 - RNA, 17 nt, Mycobacterium avium subsp. paratuberculosis
gcagcgacaugaccacc

SEQ ID NO: 931570 - RNA, 19 nt, Mycobacterium avium subsp. paratuberculosis
gcagcgacaugaccaccgc

SEQ ID NO: 931571 - RNA, 21 nt, Mycobacterium avium subsp. paratuberculosis
gcagcgacaugaccaccgcgu

SEQ ID NO: 931572 - RNA, 14 nt, Mycobacterium avium subsp. paratuberculosis
gcagcgacagcgcg

SEQ ID NO: 931573 - RNA, 19 nt, Mycobacterium avium subsp. paratuberculosis
gcagcgacagcgcgucggc

SEQ ID NO: 931574 - RNA, 23 nt, Mycobacterium avium subsp. paratuberculosis
gcagcgacagcgcgucggccagc

SEQ ID NO: 931575 - RNA, 22 nt, Mycobacterium avium subsp. paratuberculosis
gcagcgaccugguccaccgcgg

SEQ ID NO: 931576 - RNA, 21 nt, Mycobacterium avium subsp. paratuberculosis
gcagcgacgcggugagcgcgc

SEQ ID NO: 931577 - RNA, 19 nt, Mycobacterium avium subsp. paratuberculosis
gcagcgcauccgacaccgc

SEQ ID NO: 931578 - RNA, 20 nt, Mycobacterium avium subsp. paratuberculosis
gcagcgcauccgacaccgcc

SEQ ID NO: 931579 - RNA, 12 nt, Mycobacterium avium subsp. paratuberculosis
gcagcgccacca

SEQ ID NO: 931580 - RNA, 14 nt, Mycobacterium avium subsp. paratuberculosis
gcagcgccaccagc

SEQ ID NO: 931581 - RNA, 16 nt, Mycobacterium avium subsp. paratuberculosis
gcagcgccaccagcuc

SEQ ID NO: 931582 - RNA, 17 nt, Mycobacterium avium subsp. paratuberculosis
gcagcgccaccagcucc

SEQ ID NO: 931583 - RNA, 15 nt, Mycobacterium avium subsp. paratuberculosis
gcagcgcaucgccgg

SEQ ID NO: 931584 - RNA, 16 nt, Mycobacterium avium subsp. paratuberculosis
gcagcgcaucgccggc

SEQ ID NO: 931585 - RNA, 17 nt, Mycobacterium avium subsp. paratuberculosis
gcagcgcaucgccggcg

SEQ ID NO: 931586 - RNA, 19 nt, Mycobacterium avium subsp. paratuberculosis
gcagcgcaucgccggcgau

SEQ ID NO: 931587 - RNA, 19 nt, Mycobacterium avium subsp. paratuberculosis
gcagcgcaucguugccggc

SEQ ID NO: 931588 - RNA, 15 nt, Mycobacterium avium subsp. paratuberculosis
gcagcgcagcgucgg

SEQ ID NO: 931589 - RNA, 14 nt, Mycobacterium avium subsp. paratuberculosis
gcagcgcagcacca

SEQ ID NO: 931590 - RNA, 17 nt, Mycobacterium avium subsp. paratuberculosis
gcagcgcagcaccaucc

SEQ ID NO: 931591 - RNA, 12 nt, Mycobacterium avium subsp. paratuberculosis
gcagcgcaccgg

SEQ ID NO: 931592 - RNA, 14 nt, Mycobacterium avium subsp. paratuberculosis
gcagcgcaccggcg

SEQ ID NO: 931593 - RNA, 16 nt, Mycobacterium avium subsp. paratuberculosis
gcagccggaucaccug

SEQ ID NO: 931594 - RNA, 18 nt, Mycobacterium avium subsp. paratuberculosis
gcagccggaucucgucgg

SEQ ID NO: 931595 - RNA, 12 nt, Mycobacterium avium subsp. paratuberculosis
gcagccggcagc

SEQ ID NO: 931596 - RNA, 22 nt, Mycobacterium avium subsp. paratuberculosis
gcagccggcagcauucgccggg

SEQ ID NO: 931597 - RNA, 23 nt, Mycobacterium avium subsp. paratuberculosis
gcagccggcagcauucgccgggg

SEQ ID NO: 931598 - RNA, 21 nt, Mycobacterium avium subsp. paratuberculosis
gcagccggccaccgccccagc

SEQ ID NO: 931599 - RNA, 15 nt, Mycobacterium avium subsp. paratuberculosis
gcagccggccaccuc

SEQ ID NO: 931600 - RNA, 23 nt, Mycobacterium avium subsp. paratuberculosis
gcagccggccaccucgucccagc

SEQ ID NO: 931601 - RNA, 20 nt, Mycobacterium avium subsp. paratuberculosis
gcagccggccaucucggcgg

SEQ ID NO: 931602 - RNA, 18 nt, Mycobacterium avium subsp. paratuberculosis
gcagccgcuccggcccga

SEQ ID NO: 931603 - RNA, 19 nt, Mycobacterium avium subsp. paratuberculosis
gcagccgcucggggauccc

SEQ ID NO: 931604 - RNA, 18 nt, Mycobacterium avium subsp. paratuberculosis
gcagccgcugcagcgccg

SEQ ID NO: 931605 - RNA, 20 nt, Mycobacterium avium subsp. paratuberculosis
gcagccgcugcagcgccgcc

SEQ ID NO: 931606 - RNA, 13 nt, Mycobacterium avium subsp. paratuberculosis
gcagccgcugccg

SEQ ID NO: 931607 - RNA, 17 nt, Mycobacterium avium subsp. paratuberculosis
gcagccgcugccgcacc

SEQ ID NO: 931608 - RNA, 20 nt, Mycobacterium avium subsp. paratuberculosis
gcagccgcugccgcaccccg

SEQ ID NO: 931609 - RNA, 20 nt, Mycobacterium avium subsp. paratuberculosis
gcagccgcugcugggugccg

SEQ ID NO: 931610 - RNA, 21 nt, Mycobacterium avium subsp. paratuberculosis
gcagccgcugcugggugccgc

SEQ ID NO: 931611 - RNA, 14 nt, Mycobacterium avium subsp. paratuberculosis
gcagccgcuggccg

SEQ ID NO: 931612 - RNA, 15 nt, Mycobacterium avium subsp. paratuberculosis
gcagccgcuggccgc

SEQ ID NO: 931613 - RNA, 18 nt, Mycobacterium avium subsp. paratuberculosis
gcagccgcuggccgcgcc

SEQ ID NO: 931614 - RNA, 18 nt, Mycobacterium avium subsp. paratuberculosis
gcagccgcgcggccggcc

SEQ ID NO: 931615 - RNA, 22 nt, Mycobacterium avium subsp. paratuberculosis
gcagcccggcuaauucgggccg

SEQ ID NO: 931616 - RNA, 19 nt, Mycobacterium avium subsp. paratuberculosis
gcagccgcgccgacgccca

SEQ ID NO: 931617 - RNA, 20 nt, Mycobacterium avium subsp. paratuberculosis
gcagccgcgccgacgcccac

SEQ ID NO: 931618 - RNA, 14 nt, Mycobacterium avium subsp. paratuberculosis
gcagccgcgccgcc

SEQ ID NO: 931619 - RNA, 14 nt, Mycobacterium avium subsp. paratuberculosis
gcagccgcgcgugc

SEQ ID NO: 931620 - RNA, 17 nt, Mycobacterium avium subsp. paratuberculosis
gcagccgcgccgggcgg

SEQ ID NO: 931621 - RNA, 23 nt, Mycobacterium avium subsp. paratuberculosis
gcagccgcgcgagcaucaccguc

SEQ ID NO: 931622 - RNA, 15 nt, Mycobacterium avium subsp. paratuberculosis
gcagccgcgguggcg

SEQ ID NO: 931623 - RNA, 14 nt, Mycobacterium avium subsp. paratuberculosis
gcagcccgccggga

SEQ ID NO: 931624 - RNA, 15 nt, Mycobacterium avium subsp. paratuberculosis
gcagcccgccgggau

SEQ ID NO: 931625 - RNA, 15 nt, Mycobacterium avium subsp. paratuberculosis
gcagcccgcguccag

SEQ ID NO: 931626 - RNA, 17 nt, Mycobacterium avium subsp. paratuberculosis
gcagcccgcguccagca

SEQ ID NO: 931627 - RNA, 18 nt, Mycobacterium avium subsp. paratuberculosis
gcagcccgcguccagcag

SEQ ID NO: 931628 - RNA, 19 nt, Mycobacterium avium subsp. paratuberculosis
gcagcccgcguccagcagc

SEQ ID NO: 931629 - RNA, 14 nt, Mycobacterium avium subsp. paratuberculosis
gcagcccccggacc

SEQ ID NO: 931630 - RNA, 17 nt, Mycobacterium avium subsp. paratuberculosis
gcagcccccggaccacg

SEQ ID NO: 931631 - RNA, 12 nt, Mycobacterium avium subsp. paratuberculosis
gcagcaccggcg

SEQ ID NO: 931632 - RNA, 15 nt, Mycobacterium avium subsp. paratuberculosis
gcagcaccggcgccu

SEQ ID NO: 931633 - RNA, 18 nt, Mycobacterium avium subsp. paratuberculosis
gcagcaccgcgucggcgc

SEQ ID NO: 931634 - RNA, 23 nt, Mycobacterium avium subsp. paratuberculosis
gcagcaccgcguuguccggggug

SEQ ID NO: 931635 - RNA, 14 nt, Mycobacterium avium subsp. paratuberculosis
gcagccccgucggu

SEQ ID NO: 931636 - RNA, 18 nt, Mycobacterium avium subsp. paratuberculosis
gcagccccugcaccacga

SEQ ID NO: 931637 - RNA, 21 nt, Mycobacterium avium subsp. paratuberculosis
gcagccccugcaccacgaagc

SEQ ID NO: 931638 - RNA, 18 nt, Mycobacterium avium subsp. paratuberculosis
gcagcccgaacagccggg

SEQ ID NO: 931639 - RNA, 20 nt, Mycobacterium avium subsp. paratuberculosis
gcagcccgaacagccgggcg

SEQ ID NO: 931640 - RNA, 18 nt, Mycobacterium avium subsp. paratuberculosis
gcagcccgacguccuuga

SEQ ID NO: 931641 - RNA, 16 nt, Mycobacterium avium subsp. paratuberculosis
gcagcccgaucgccag

SEQ ID NO: 931642 - RNA, 17 nt, Mycobacterium avium subsp. paratuberculosis
gcagcccgaucgccagc

SEQ ID NO: 931643 - RNA, 19 nt, Mycobacterium avium subsp. paratuberculosis
gcagcccgaucucgcgguc

SEQ ID NO: 931644 - RNA, 14 nt, Mycobacterium avium subsp. paratuberculosis
gcagcccgccgacc

SEQ ID NO: 931645 - RNA, 18 nt, Mycobacterium avium subsp. paratuberculosis
gcagcccgccgaccaccu

SEQ ID NO: 931646 - RNA, 14 nt, Mycobacterium avium subsp. paratuberculosis
gcagcccgccgaug

SEQ ID NO: 931647 - RNA, 13 nt, Mycobacterium avium subsp. paratuberculosis
gcagcccgccgcg

SEQ ID NO: 931648 - RNA, 12 nt, Mycobacterium avium subsp. paratuberculosis
gcagcccgccgg

SEQ ID NO: 931649 - RNA, 13 nt, Mycobacterium avium subsp. paratuberculosis
gcagcaccggcag

SEQ ID NO: 931650 - RNA, 14 nt, Mycobacterium avium subsp. paratuberculosis
gcagcaccggcagc

SEQ ID NO: 931651 - RNA, 15 nt, Mycobacterium avium subsp. paratuberculosis
gcagcaccggccgga

SEQ ID NO: 931652 - RNA, 12 nt, Mycobacterium avium subsp. paratuberculosis
gcagcaccggca

SEQ ID NO: 931653 - RNA, 14 nt, Mycobacterium avium subsp. paratuberculosis
gcagcaccggcacc

SEQ ID NO: 931654 - RNA, 15 nt, Mycobacterium avium subsp. paratuberculosis
gcagcaccggcaccg

SEQ ID NO: 931655 - RNA, 20 nt, Mycobacterium avium subsp. paratuberculosis
gcagcaccggcaccgcggcg

SEQ ID NO: 931656 - RNA, 23 nt, Mycobacterium avium subsp. paratuberculosis
gcagcaccggcaccgcggcgaug

SEQ ID NO: 931657 - RNA, 13 nt, Mycobacterium avium subsp. paratuberculosis
gcagcaccgcgac

SEQ ID NO: 931658 - RNA, 17 nt, Mycobacterium avium subsp. paratuberculosis
gcagcaccgcgacccag

SEQ ID NO: 931659 - RNA, 20 nt, Mycobacterium avium subsp. paratuberculosis
gcagcaccgcgacccaggcc

SEQ ID NO: 931660 - RNA, 19 nt, Mycobacterium avium subsp. paratuberculosis
gcagcaccgcgaccggucc

SEQ ID NO: 931661 - RNA, 14 nt, Mycobacterium avium subsp. paratuberculosis
gcagcaccgccgac

SEQ ID NO: 931662 - RNA, 15 nt, Mycobacterium avium subsp. paratuberculosis
gcagcaccgccgagc

SEQ ID NO: 931663 - RNA, 13 nt, Mycobacterium avium subsp. paratuberculosis
gcagcaccgccag

SEQ ID NO: 931664 - RNA, 15 nt, Mycobacterium avium subsp. paratuberculosis
gcagcacccggguga

SEQ ID NO: 931665 - RNA, 17 nt, Mycobacterium avium subsp. paratuberculosis
gcagcacccgggugauc

SEQ ID NO: 931666 - RNA, 17 nt, Mycobacterium avium subsp. paratuberculosis
gcagcacccggucgccg

SEQ ID NO: 931667 - RNA, 13 nt, Mycobacterium avium subsp. paratuberculosis
gcagcaccgacuc

SEQ ID NO: 931668 - RNA, 20 nt, Mycobacterium avium subsp. paratuberculosis
gcagcgcgaccagcccggcc

SEQ ID NO: 931669 - RNA, 20 nt, Mycobacterium avium subsp. paratuberculosis
gcagcgcgacgaacagcacc

SEQ ID NO: 931670 - RNA, 16 nt, Mycobacterium avium subsp. paratuberculosis
gcagcgcgacgccgac

SEQ ID NO: 931671 - RNA, 17 nt, Mycobacterium avium subsp. paratuberculosis
gcagcgcgaugccggcc

SEQ ID NO: 931672 - RNA, 12 nt, Mycobacterium avium subsp. paratuberculosis
gcagcgccgccc

SEQ ID NO: 931673 - RNA, 14 nt, Mycobacterium avium subsp. paratuberculosis
gcagcgccgccacc

SEQ ID NO: 931674 - RNA, 19 nt, Mycobacterium avium subsp. paratuberculosis
gcagcgccgccaccggccg

SEQ ID NO: 931675 - RNA, 21 nt, Mycobacterium avium subsp. paratuberculosis
gcagcgccgccaccggccggu

SEQ ID NO: 931676 - RNA, 16 nt, Mycobacterium avium subsp. paratuberculosis
gcagcgccgaggccag

SEQ ID NO: 931677 - RNA, 19 nt, Mycobacterium avium subsp. paratuberculosis
gcagcgccgaggccagcac

SEQ ID NO: 931678 - RNA, 15 nt, Mycobacterium avium subsp. paratuberculosis
gcagcgcccgggugc

SEQ ID NO: 931679 - RNA, 21 nt, Mycobacterium avium subsp. paratuberculosis
gcagcgccgcccgcaccugcg

SEQ ID NO: 931680 - RNA, 13 nt, Mycobacterium avium subsp. paratuberculosis
gcagcgccgcgac

SEQ ID NO: 931681 - RNA, 16 nt, Mycobacterium avium subsp. paratuberculosis
gcagcgccgcgccgac

SEQ ID NO: 931682 - RNA, 12 nt, Mycobacterium avium subsp. paratuberculosis
gcagcgccgcgg

SEQ ID NO: 931683 - RNA, 17 nt, Mycobacterium avium subsp. paratuberculosis
gcagcgccgcggccggu

SEQ ID NO: 931684 - RNA, 18 nt, Mycobacterium avium subsp. paratuberculosis
gcagcgccgcggccggug

SEQ ID NO: 931685 - RNA, 19 nt, Mycobacterium avium subsp. paratuberculosis
gcagcgccgcggccggugc

SEQ ID NO: 931686 - RNA, 18 nt, Mycobacterium avium subsp. paratuberculosis
gcagcgccgcggcgcccu

SEQ ID NO: 931687 - RNA, 13 nt, Mycobacterium avium subsp. paratuberculosis
gcagcgcggugcc

SEQ ID NO: 931688 - RNA, 14 nt, Mycobacterium avium subsp. paratuberculosis
gcagcgcggugccg

SEQ ID NO: 931689 - RNA, 19 nt, Mycobacterium avium subsp. paratuberculosis
gcagcgcgucgcgcccggc

SEQ ID NO: 931690 - RNA, 14 nt, Mycobacterium avium subsp. paratuberculosis
gcagcgcgucgcgg

SEQ ID NO: 931691 - RNA, 13 nt, Mycobacterium avium subsp. paratuberculosis
gcagcgcgguggu

SEQ ID NO: 931692 - RNA, 20 nt, Mycobacterium avium subsp. paratuberculosis
gcagcgcgguggucagcacc

SEQ ID NO: 931693 - RNA, 20 nt, Mycobacterium avium subsp. paratuberculosis
gcagcgcggucaacaccggg

SEQ ID NO: 931694 - RNA, 21 nt, Mycobacterium avium subsp. paratuberculosis
gcagcgcggucaacaccggga

SEQ ID NO: 931695 - RNA, 14 nt, Mycobacterium avium subsp. paratuberculosis
gcagcgcggcgauc

SEQ ID NO: 931696 - RNA, 15 nt, Mycobacterium avium subsp. paratuberculosis
gcagcgcggcgauca

SEQ ID NO: 931697 - RNA, 19 nt, Mycobacterium avium subsp. paratuberculosis
gcagcgcggcgaucucggc

SEQ ID NO: 931698 - RNA, 11 nt, Mycobacterium avium subsp. paratuberculosis
gcagcgcggcg

SEQ ID NO: 931699 - RNA, 13 nt, Mycobacterium avium subsp. paratuberculosis
gcagcgcggcgau

SEQ ID NO: 931700 - RNA, 12 nt, Mycobacterium avium subsp. paratuberculosis
gcagcgcggcca

SEQ ID NO: 931701 - RNA, 13 nt, Mycobacterium avium subsp. paratuberculosis
gcagcgcggccag

SEQ ID NO: 931702 - RNA, 20 nt, Mycobacterium avium subsp. paratuberculosis
gcagcgcggauuccagcgcg

SEQ ID NO: 931703 - RNA, 14 nt, Mycobacterium avium subsp. paratuberculosis
gcagcgcggccagc

SEQ ID NO: 931704 - RNA, 16 nt, Mycobacterium avium subsp. paratuberculosis
gcagcgcggccagcac

SEQ ID NO: 931705 - RNA, 15 nt, Mycobacterium avium subsp. paratuberculosis
gcagcgcgcgcucgg

SEQ ID NO: 931706 - RNA, 15 nt, Mycobacterium avium subsp. paratuberculosis
gcagcgcgcggcgca

SEQ ID NO: 931707 - RNA, 14 nt, Mycobacterium avium subsp. paratuberculosis
gcagcgcgcgguuc

SEQ ID NO: 931708 - RNA, 14 nt, Mycobacterium avium subsp. paratuberculosis
gcagcgcgcgaccg

SEQ ID NO: 931709 - RNA, 15 nt, Mycobacterium avium subsp. paratuberculosis
gcagcgcgcgaccgc

SEQ ID NO: 931710 - RNA, 13 nt, Mycobacterium avium subsp. paratuberculosis
gcagcgcgcgaga

SEQ ID NO: 931711 - RNA, 22 nt, Mycobacterium avium subsp. paratuberculosis
gcagcgcgcccugaggcccggu

SEQ ID NO: 931712 - RNA, 12 nt, Mycobacterium avium subsp. paratuberculosis
gcagcgcgccga

SEQ ID NO: 931713 - RNA, 13 nt, Mycobacterium avium subsp. paratuberculosis
gcagcgcgccgac

SEQ ID NO: 931714 - RNA, 15 nt, Mycobacterium avium subsp. paratuberculosis
gcagcgcgccgacca

SEQ ID NO: 931715 - RNA, 15 nt, Mycobacterium avium subsp. paratuberculosis
gcagcgcgauccgcg

SEQ ID NO: 931716 - RNA, 19 nt, Mycobacterium avium subsp. paratuberculosis
gcagcggcgccgcagcucg

SEQ ID NO: 931717 - RNA, 14 nt, Mycobacterium avium subsp. paratuberculosis
gcagcggcgccggg

SEQ ID NO: 931718 - RNA, 15 nt, Mycobacterium avium subsp. paratuberculosis
gcagcggccggcgca

SEQ ID NO: 931719 - RNA, 16 nt, Mycobacterium avium subsp. paratuberculosis
gcagcggccggcgcag

SEQ ID NO: 931720 - RNA, 17 nt, Mycobacterium avium subsp. paratuberculosis
gcagcggccggcgcagc

SEQ ID NO: 931721 - RNA, 18 nt, Mycobacterium avium subsp. paratuberculosis
gcagcggcaggucgucgu

SEQ ID NO: 931722 - RNA, 16 nt, Mycobacterium avium subsp. paratuberculosis
gcagcggcaguagcgc

SEQ ID NO: 931723 - RNA, 18 nt, Mycobacterium avium subsp. paratuberculosis
gcagcggcuugaccggcu

SEQ ID NO: 931724 - RNA, 23 nt, Mycobacterium avium subsp. paratuberculosis
gcagcggcuugaccggcucgccg

SEQ ID NO: 931725 - RNA, 16 nt, Mycobacterium avium subsp. paratuberculosis
gcagcggcuugagcgc

SEQ ID NO: 931726 - RNA, 23 nt, Mycobacterium avium subsp. paratuberculosis
gcagcggcuugagcgccagcgcg

SEQ ID NO: 931727 - RNA, 14 nt, Mycobacterium avium subsp. paratuberculosis
gcagcggcggcacg

SEQ ID NO: 931728 - RNA, 15 nt, Mycobacterium avium subsp. paratuberculosis
gcagcggcggcacgg

SEQ ID NO: 931729 - RNA, 20 nt, Mycobacterium avium subsp. paratuberculosis
gcagcgcuccugcagcgcgg

SEQ ID NO: 931730 - RNA, 21 nt, Mycobacterium avium subsp. paratuberculosis
gcagcgcuccugcagcgcggc

SEQ ID NO: 931731 - RNA, 17 nt, Mycobacterium avium subsp. paratuberculosis
gcagcgcucgucgucgg

SEQ ID NO: 931732 - RNA, 14 nt, Mycobacterium avium subsp. paratuberculosis
gcagcgcgucgggc

SEQ ID NO: 931733 - RNA, 22 nt, Mycobacterium avium subsp. paratuberculosis
gcagcgcgucgggcucggccgc

SEQ ID NO: 931734 - RNA, 15 nt, Mycobacterium avium subsp. paratuberculosis
gcagcgcgucgucgg

SEQ ID NO: 931735 - RNA, 20 nt, Mycobacterium avium subsp. paratuberculosis
gcagcgcgucgugcaacucc

SEQ ID NO: 931736 - RNA, 16 nt, Mycobacterium avium subsp. paratuberculosis
gcagcgcuaaccgcgg

SEQ ID NO: 931737 - RNA, 18 nt, Mycobacterium avium subsp. paratuberculosis
gcagcgcuaaccgcgggc

SEQ ID NO: 931738 - RNA, 17 nt, Mycobacterium avium subsp. paratuberculosis
gcagcgcuuccaagucc

SEQ ID NO: 931739 - RNA, 23 nt, Mycobacterium avium subsp. paratuberculosis
gcagcggaaacgacgucgccacc

SEQ ID NO: 931740 - RNA, 20 nt, Mycobacterium avium subsp. paratuberculosis
gcagcgcgguuuccggcgau

SEQ ID NO: 931741 - RNA, 21 nt, Mycobacterium avium subsp. paratuberculosis
gcagcggaugccggaggcgcc

SEQ ID NO: 931742 - RNA, 22 nt, Mycobacterium avium subsp. paratuberculosis
gcagcggaaugaacgcggccag

SEQ ID NO: 931743 - RNA, 14 nt, Mycobacterium avium subsp. paratuberculosis
gcagcggacccggu

SEQ ID NO: 931744 - RNA, 22 nt, Mycobacterium avium subsp. paratuberculosis
gcagcggacccggucggccgcg

SEQ ID NO: 931745 - RNA, 18 nt, Mycobacterium avium subsp. paratuberculosis
gcagcgugucccgguaca

SEQ ID NO: 931746 - RNA, 19 nt, Mycobacterium avium subsp. paratuberculosis
gcagcgugguccagcacgu

SEQ ID NO: 931747 - RNA, 22 nt, Mycobacterium avium subsp. paratuberculosis
gcagcguggucuccuggccgcc

SEQ ID NO: 931748 - RNA, 23 nt, Mycobacterium avium subsp. paratuberculosis
gcagcguggucuccuggccgccg

SEQ ID NO: 931749 - RNA, 16 nt, Mycobacterium avium subsp. paratuberculosis
gcagcgugugcaccug

SEQ ID NO: 931750 - RNA, 16 nt, Mycobacterium avium subsp. paratuberculosis
gcagcguuccgucggc

SEQ ID NO: 931751 - RNA, 20 nt, Mycobacterium avium subsp. paratuberculosis
gcagcguucggucagcacga

SEQ ID NO: 931752 - RNA, 13 nt, Mycobacterium avium subsp. paratuberculosis
gcagcucagccgc

SEQ ID NO: 931753 - RNA, 16 nt, Mycobacterium avium subsp. paratuberculosis
gcagcucauacagcgg

SEQ ID NO: 931754 - RNA, 18 nt, Mycobacterium avium subsp. paratuberculosis
gcagcucauacagcggcg

SEQ ID NO: 931755 - RNA, 21 nt, Mycobacterium avium subsp. paratuberculosis
gcagcucauacagcggcgcgc

SEQ ID NO: 931756 - RNA, 12 nt, Mycobacterium avium subsp. paratuberculosis
gcagcuccagcg

SEQ ID NO: 931757 - RNA, 18 nt, Mycobacterium avium subsp. paratuberculosis
gcagcucccccggcguga

SEQ ID NO: 931758 - RNA, 15 nt, Mycobacterium avium subsp. paratuberculosis
gcagcucggugcgca

SEQ ID NO: 931759 - RNA, 17 nt, Mycobacterium avium subsp. paratuberculosis
gcagcucggugcgcacc

SEQ ID NO: 931760 - RNA, 14 nt, Mycobacterium avium subsp. paratuberculosis
gcagcucgguggcg

SEQ ID NO: 931761 - RNA, 19 nt, Mycobacterium avium subsp. paratuberculosis
gcagcucgguggcgucggc

SEQ ID NO: 931762 - RNA, 21 nt, Mycobacterium avium subsp. paratuberculosis
gcagcucgguggcgucggcgg

SEQ ID NO: 931763 - RNA, 22 nt, Mycobacterium avium subsp. paratuberculosis
gcagcucgguggcgucggcggc

SEQ ID NO: 931764 - RNA, 14 nt, Mycobacterium avium subsp. paratuberculosis
gcagcucggugcag

SEQ ID NO: 931765 - RNA, 22 nt, Mycobacterium avium subsp. paratuberculosis
gcagcucggugcagaccccggc

SEQ ID NO: 931766 - RNA, 17 nt, Mycobacterium avium subsp. paratuberculosis
gcagcucggucaccagc

SEQ ID NO: 931767 - RNA, 18 nt, Mycobacterium avium subsp. paratuberculosis
gcagcucggucaccagcg

SEQ ID NO: 931768 - RNA, 20 nt, Mycobacterium avium subsp. paratuberculosis
gcagcucggucaccagcggc

SEQ ID NO: 931769 - RNA, 20 nt, Mycobacterium avium subsp. paratuberculosis
gcagcucggcggcccgccgg

SEQ ID NO: 931770 - RNA, 13 nt, Mycobacterium avium subsp. paratuberculosis
gcagcucggcggg

SEQ ID NO: 931771 - RNA, 14 nt, Mycobacterium avium subsp. paratuberculosis
gcagcucggcgggc

SEQ ID NO: 931772 - RNA, 15 nt, Mycobacterium avium subsp. paratuberculosis
gcagcucggcgggcu

SEQ ID NO: 931773 - RNA, 14 nt, Mycobacterium avium subsp. paratuberculosis
gcagcucgggcagc

SEQ ID NO: 931774 - RNA, 17 nt, Mycobacterium avium subsp. paratuberculosis
gcagcucgggcagcccg

SEQ ID NO: 931775 - RNA, 17 nt, Mycobacterium avium subsp. paratuberculosis
gcagcucggggucggcg

SEQ ID NO: 931776 - RNA, 23 nt, Mycobacterium avium subsp. paratuberculosis
gcagcucggggucggcgucgggc

SEQ ID NO: 931777 - RNA, 14 nt, Mycobacterium avium subsp. paratuberculosis
gcagcucgcguagc

SEQ ID NO: 931778 - RNA, 20 nt, Mycobacterium avium subsp. paratuberculosis
gcagcucgcugagcgggacg

SEQ ID NO: 931779 - RNA, 19 nt, Mycobacterium avium subsp. paratuberculosis
gcagcucgcggauccgcag

SEQ ID NO: 931780 - RNA, 21 nt, Mycobacterium avium subsp. paratuberculosis
gcagcucgcggauccgcagcu

SEQ ID NO: 931781 - RNA, 21 nt, Mycobacterium avium subsp. paratuberculosis
gcagcucgccggcgcgcagcc

SEQ ID NO: 931782 - RNA, 14 nt, Mycobacterium avium subsp. paratuberculosis
gcagcucgccggcg

SEQ ID NO: 931783 - RNA, 15 nt, Mycobacterium avium subsp. paratuberculosis
gcagcucgccggugg

SEQ ID NO: 931784 - RNA, 16 nt, Mycobacterium avium subsp. paratuberculosis
gcagcucgccgguggc

SEQ ID NO: 931785 - RNA, 17 nt, Mycobacterium avium subsp. paratuberculosis
gcagcucgcgcagccgg

SEQ ID NO: 931786 - RNA, 22 nt, Mycobacterium avium subsp. paratuberculosis
gcagcucgcgcagcuggccgug

SEQ ID NO: 931787 - RNA, 15 nt, Mycobacterium avium subsp. paratuberculosis
gcagcuccucggcgg

SEQ ID NO: 931788 - RNA, 21 nt, Mycobacterium avium subsp. paratuberculosis
gcagcuccuugagccgccgcg

SEQ ID NO: 931789 - RNA, 16 nt, Mycobacterium avium subsp. paratuberculosis
gcagcuccggucggcg

SEQ ID NO: 931790 - RNA, 17 nt, Mycobacterium avium subsp. paratuberculosis
gcagcuccggucggcgc

SEQ ID NO: 931791 - RNA, 14 nt, Mycobacterium avium subsp. paratuberculosis
gcagcucgacgacc

SEQ ID NO: 931792 - RNA, 14 nt, Mycobacterium avium subsp. paratuberculosis
gcagcucgcaaacg

SEQ ID NO: 931793 - RNA, 14 nt, Mycobacterium avium subsp. paratuberculosis
gcagcucgcccagc

SEQ ID NO: 931794 - RNA, 22 nt, Mycobacterium avium subsp. paratuberculosis
gcagcucgcccagcaccgucug

SEQ ID NO: 931795 - RNA, 21 nt, Mycobacterium avium subsp. paratuberculosis
gcagcgucgucaggccgugau

SEQ ID NO: 931796 - RNA, 15 nt, Mycobacterium avium subsp. paratuberculosis
gcagcgucccgucgg

SEQ ID NO: 931797 - RNA, 13 nt, Mycobacterium avium subsp. paratuberculosis
gcagcgucgccag

SEQ ID NO: 931798 - RNA, 14 nt, Mycobacterium avium subsp. paratuberculosis
gcagcgucgccagc

SEQ ID NO: 931799 - RNA, 20 nt, Mycobacterium avium subsp. paratuberculosis
gcagcgucgccagccgccgg

SEQ ID NO: 931800 - RNA, 14 nt, Mycobacterium avium subsp. paratuberculosis
gcagcgucacgucg

SEQ ID NO: 931801 - RNA, 19 nt, Mycobacterium avium subsp. paratuberculosis
gcagcgucacgucgacggc

SEQ ID NO: 931802 - RNA, 22 nt, Mycobacterium avium subsp. paratuberculosis
gcagcgucacgucgacggccgc

SEQ ID NO: 931803 - RNA, 15 nt, Mycobacterium avium subsp. paratuberculosis
gcagcgucaucgcgu

SEQ ID NO: 931804 - RNA, 21 nt, Mycobacterium avium subsp. paratuberculosis
gcagcgucaacggcuugcgca

SEQ ID NO: 931805 - RNA, 22 nt, Mycobacterium avium subsp. paratuberculosis
gcagcgggucgucgggccgggg

SEQ ID NO: 931806 - RNA, 17 nt, Mycobacterium avium subsp. paratuberculosis
gcagcgugcugacgucg

SEQ ID NO: 931807 - RNA, 21 nt, Mycobacterium avium subsp. paratuberculosis
gcagcgucuugcccagcgggg

SEQ ID NO: 931808 - RNA, 14 nt, Mycobacterium avium subsp. paratuberculosis
gcagcgucugcgcc

SEQ ID NO: 931809 - RNA, 23 nt, Mycobacterium avium subsp. paratuberculosis
gcagcgucugcgccagcugggug

SEQ ID NO: 931810 - RNA, 20 nt, Mycobacterium avium subsp. paratuberculosis
gcagcgucugcgccccggcg

SEQ ID NO: 931811 - RNA, 14 nt, Mycobacterium avium subsp. paratuberculosis
gcagcgucucccgg

SEQ ID NO: 931812 - RNA, 18 nt, Mycobacterium avium subsp. paratuberculosis
gcagcgucucccgggugc

SEQ ID NO: 931813 - RNA, 22 nt, Mycobacterium avium subsp. paratuberculosis
gcagcgucucccgggugcgcgu

SEQ ID NO: 931814 - RNA, 19 nt, Mycobacterium avium subsp. paratuberculosis
gcagcgucuccucgaccgc

SEQ ID NO: 931815 - RNA, 14 nt, Mycobacterium avium subsp. paratuberculosis
gcagcggguugcgg

SEQ ID NO: 931816 - RNA, 22 nt, Mycobacterium avium subsp. paratuberculosis
gcagcggguuuggccgcgggcg

SEQ ID NO: 931817 - RNA, 18 nt, Mycobacterium avium subsp. paratuberculosis
gcagcggugaucgcguca

SEQ ID NO: 931818 - RNA, 17 nt, Mycobacterium avium subsp. paratuberculosis
gcagcggugcagccccg

SEQ ID NO: 931819 - RNA, 13 nt, Mycobacterium avium subsp. paratuberculosis
gcagcggugccgc

SEQ ID NO: 931820 - RNA, 15 nt, Mycobacterium avium subsp. paratuberculosis
gcagcggugccgccc

SEQ ID NO: 931821 - RNA, 18 nt, Mycobacterium avium subsp. paratuberculosis
gcagcggugccgcccgga

SEQ ID NO: 931822 - RNA, 13 nt, Mycobacterium avium subsp. paratuberculosis
gcagcggucggcg

SEQ ID NO: 931823 - RNA, 14 nt, Mycobacterium avium subsp. paratuberculosis
gcagcggucggcgg

SEQ ID NO: 931824 - RNA, 17 nt, Mycobacterium avium subsp. paratuberculosis
gcagcggucggcggcug

SEQ ID NO: 931825 - RNA, 22 nt, Mycobacterium avium subsp. paratuberculosis
gcagcgguuggcccuucgaccu

SEQ ID NO: 931826 - RNA, 15 nt, Mycobacterium avium subsp. paratuberculosis
gcagcgggccgaaga

SEQ ID NO: 931827 - RNA, 18 nt, Mycobacterium avium subsp. paratuberculosis
gcagcgggaucagcuccu

SEQ ID NO: 931828 - RNA, 19 nt, Mycobacterium avium subsp. paratuberculosis
gcagcgggauuggcgccac

SEQ ID NO: 931829 - RNA, 23 nt, Mycobacterium avium subsp. paratuberculosis
gcagcggcuccgagcggaugccg

SEQ ID NO: 931830 - RNA, 18 nt, Mycobacterium avium subsp. paratuberculosis
gcagcgggacgaucugcg

SEQ ID NO: 931831 - RNA, 21 nt, Mycobacterium avium subsp. paratuberculosis
gcagcggcugcugcagcgccc

SEQ ID NO: 931832 - RNA, 14 nt, Mycobacterium avium subsp. paratuberculosis
gcagcgggcuggcg

SEQ ID NO: 931833 - RNA, 16 nt, Mycobacterium avium subsp. paratuberculosis
gcagcgggcuggcgua

SEQ ID NO: 931834 - RNA, 18 nt, Mycobacterium avium subsp. paratuberculosis
gcagcggggaggcccagc

SEQ ID NO: 931835 - RNA, 19 nt, Mycobacterium avium subsp. paratuberculosis
gcagcggggaggcccagcc

SEQ ID NO: 931836 - RNA, 19 nt, Mycobacterium avium subsp. paratuberculosis
gcagcggggcgaacccggc

SEQ ID NO: 931837 - RNA, 22 nt, Mycobacterium avium subsp. paratuberculosis
gcagcggggcgagcuggccgcc

SEQ ID NO: 931838 - RNA, 16 nt, Mycobacterium avium subsp. paratuberculosis
gcagcggggcgcgcag

SEQ ID NO: 931839 - RNA, 23 nt, Mycobacterium avium subsp. paratuberculosis
gcagcggggcgcgcaggcgcacc

SEQ ID NO: 931840 - RNA, 16 nt, Mycobacterium avium subsp. paratuberculosis
gcagcggggcgcuguc

SEQ ID NO: 931841 - RNA, 20 nt, Mycobacterium avium subsp. paratuberculosis
gcagcggggugagcaccgcg

SEQ ID NO: 931842 - RNA, 22 nt, Mycobacterium avium subsp. paratuberculosis
gcagcggggugugcucggcggc

SEQ ID NO: 931843 - RNA, 17 nt, Mycobacterium avium subsp. paratuberculosis
gcaggaacagcgacccg

SEQ ID NO: 931844 - RNA, 22 nt, Mycobacterium avium subsp. paratuberculosis
gcaggaaccgggucagcaccac

SEQ ID NO: 931845 - RNA, 14 nt, Mycobacterium avium subsp. paratuberculosis
gcaggaacuccagc

SEQ ID NO: 931846 - RNA, 18 nt, Mycobacterium avium subsp. paratuberculosis
gcaggaacuccagcagcu

SEQ ID NO: 931847 - RNA, 21 nt, Mycobacterium avium subsp. paratuberculosis
gcaggaacucccgcgccgcau

SEQ ID NO: 931848 - RNA, 15 nt, Mycobacterium avium subsp. paratuberculosis
gcaggaccgagccgc

SEQ ID NO: 931849 - RNA, 19 nt, Mycobacterium avium subsp. paratuberculosis
gcaggaccgagccgcgcgc

SEQ ID NO: 931850 - RNA, 20 nt, Mycobacterium avium subsp. paratuberculosis
gcaggaccgagccgcgcgcc

SEQ ID NO: 931851 - RNA, 13 nt, Mycobacterium avium subsp. paratuberculosis
gcaggaccaggcc

SEQ ID NO: 931852 - RNA, 14 nt, Mycobacterium avium subsp. paratuberculosis
gcaggagaucggcg

SEQ ID NO: 931853 - RNA, 20 nt, Mycobacterium avium subsp. paratuberculosis
gcaggacgggggccggugcg

SEQ ID NO: 931854 - RNA, 13 nt, Mycobacterium avium subsp. paratuberculosis
gcaggacgguggc

SEQ ID NO: 931855 - RNA, 16 nt, Mycobacterium avium subsp. paratuberculosis
gcaggacgcgcccggc

SEQ ID NO: 931856 - RNA, 17 nt, Mycobacterium avium subsp. paratuberculosis
gcaggacgcgcccggcg

SEQ ID NO: 931857 - RNA, 18 nt, Mycobacterium avium subsp. paratuberculosis
gcaggaccuugucgggcc

SEQ ID NO: 931858 - RNA, 16 nt, Mycobacterium avium subsp. paratuberculosis
gcaggaucgagccggc

SEQ ID NO: 931859 - RNA, 18 nt, Mycobacterium avium subsp. paratuberculosis
gcaggaucgagccggccg

SEQ ID NO: 931860 - RNA, 15 nt, Mycobacterium avium subsp. paratuberculosis
gcaggauccgcucga

SEQ ID NO: 931861 - RNA, 20 nt, Mycobacterium avium subsp. paratuberculosis
gcaggauccgcucgacgagu

SEQ ID NO: 931862 - RNA, 15 nt, Mycobacterium avium subsp. paratuberculosis
gcaggauccggucga

SEQ ID NO: 931863 - RNA, 23 nt, Mycobacterium avium subsp. paratuberculosis
gcagcuguuccugguagucgucg

SEQ ID NO: 931864 - RNA, 17 nt, Mycobacterium avium subsp. paratuberculosis
gcagcuucaugcccgcg

SEQ ID NO: 931865 - RNA, 18 nt, Mycobacterium avium subsp. paratuberculosis
gcagcuucaugcccgcga

SEQ ID NO: 931866 - RNA, 19 nt, Mycobacterium avium subsp. paratuberculosis
gcagcuuccgccucggcga

SEQ ID NO: 931867 - RNA, 18 nt, Mycobacterium avium subsp. paratuberculosis
gcagcuucgugucaccgc

SEQ ID NO: 931868 - RNA, 21 nt, Mycobacterium avium subsp. paratuberculosis
gcagcuucgugucaccgccca

SEQ ID NO: 931869 - RNA, 17 nt, Mycobacterium avium subsp. paratuberculosis
gcagcuucugcagcucg

SEQ ID NO: 931870 - RNA, 14 nt, Mycobacterium avium subsp. paratuberculosis
gcagcuugaucgcc

SEQ ID NO: 931871 - RNA, 18 nt, Mycobacterium avium subsp. paratuberculosis
gcagcuugaucgccgggg

SEQ ID NO: 931872 - RNA, 22 nt, Mycobacterium avium subsp. paratuberculosis
gcagcuugaugcuggcaacguc

SEQ ID NO: 931873 - RNA, 17 nt, Mycobacterium avium subsp. paratuberculosis
gcagcuguugcggcguc

SEQ ID NO: 931874 - RNA, 18 nt, Mycobacterium avium subsp. paratuberculosis
gcagcuguugcggcguca

SEQ ID NO: 931875 - RNA, 19 nt, Mycobacterium avium subsp. paratuberculosis
gcagcuguugcggcgucag

SEQ ID NO: 931876 - RNA, 23 nt, Mycobacterium avium subsp. paratuberculosis
gcagcugcugggacgggucggcg

SEQ ID NO: 931877 - RNA, 21 nt, Mycobacterium avium subsp. paratuberculosis
gcagcugggacagcgucacca

SEQ ID NO: 931878 - RNA, 15 nt, Mycobacterium avium subsp. paratuberculosis
gcagcuggccgugca

SEQ ID NO: 931879 - RNA, 22 nt, Mycobacterium avium subsp. paratuberculosis
gcagcuggccgugcaccgucgc

SEQ ID NO: 931880 - RNA, 20 nt, Mycobacterium avium subsp. paratuberculosis
gcagcuggaaauaggccggg

SEQ ID NO: 931881 - RNA, 18 nt, Mycobacterium avium subsp. paratuberculosis
gcagcuggaacaccacgg

SEQ ID NO: 931882 - RNA, 21 nt, Mycobacterium avium subsp. paratuberculosis
gcagcuggaacaccacggccg

SEQ ID NO: 931883 - RNA, 13 nt, Mycobacterium avium subsp. paratuberculosis
gcagcucguugug

SEQ ID NO: 931884 - RNA, 21 nt, Mycobacterium avium subsp. paratuberculosis
gcagcucgugguagaugucgc

SEQ ID NO: 931885 - RNA, 15 nt, Mycobacterium avium subsp. paratuberculosis
gcagcucgucgacgu

SEQ ID NO: 931886 - RNA, 22 nt, Mycobacterium avium subsp. paratuberculosis
gcagcucgucgacguccucgcc

SEQ ID NO: 931887 - RNA, 23 nt, Mycobacterium avium subsp. paratuberculosis
gcagcucgucgacguccucgccc

SEQ ID NO: 931888 - RNA, 14 nt, Mycobacterium avium subsp. paratuberculosis
gcagcucgucggcg

SEQ ID NO: 931889 - RNA, 17 nt, Mycobacterium avium subsp. paratuberculosis
gcagcucgucggcgcgc

SEQ ID NO: 931890 - RNA, 20 nt, Mycobacterium avium subsp. paratuberculosis
gcagcugcgccgcgucgacg

SEQ ID NO: 931891 - RNA, 13 nt, Mycobacterium avium subsp. paratuberculosis
gcagcugcgggac

SEQ ID NO: 931892 - RNA, 14 nt, Mycobacterium avium subsp. paratuberculosis
gcagcugcgggacc

SEQ ID NO: 931893 - RNA, 21 nt, Mycobacterium avium subsp. paratuberculosis
gcagcugcgucggcaccagcg

SEQ ID NO: 931894 - RNA, 22 nt, Mycobacterium avium subsp. paratuberculosis
gcagcugcgucggcaccagcgg

SEQ ID NO: 931895 - RNA, 20 nt, Mycobacterium avium subsp. paratuberculosis
gcagcugaagugcacucggc

SEQ ID NO: 931896 - RNA, 21 nt, Mycobacterium avium subsp. paratuberculosis
gcagcugaagugcacucggcg

SEQ ID NO: 931897 - RNA, 21 nt, Mycobacterium avium subsp. paratuberculosis
gcagcugauagcccgccgcgg

SEQ ID NO: 931898 - RNA, 16 nt, Mycobacterium avium subsp. paratuberculosis
gcagcugaucggggcc

SEQ ID NO: 931899 - RNA, 19 nt, Mycobacterium avium subsp. paratuberculosis
gcagcugcagcuccucggc

SEQ ID NO: 931900 - RNA, 13 nt, Mycobacterium avium subsp. paratuberculosis
gcagcugcccgag

SEQ ID NO: 931901 - RNA, 19 nt, Mycobacterium avium subsp. paratuberculosis
gcagcugcccgucggagga

SEQ ID NO: 931902 - RNA, 21 nt, Mycobacterium avium subsp. paratuberculosis
aacuuguugacgaaaccgcca

SEQ ID NO: 931903 - RNA, 15 nt, Mycobacterium avium subsp. paratuberculosis
gcagagcgaugggcg

SEQ ID NO: 931904 - RNA, 23 nt, Mycobacterium avium subsp. paratuberculosis
gcagagcggugacaucgccaccu

SEQ ID NO: 931905 - RNA, 20 nt, Mycobacterium avium subsp. paratuberculosis
gcagacacaaaagcgcccga

SEQ ID NO: 931906 - RNA, 14 nt, Mycobacterium avium subsp. paratuberculosis
gcagaacgccauca

SEQ ID NO: 931907 - RNA, 15 nt, Mycobacterium avium subsp. paratuberculosis
gcagaccagcccguc

SEQ ID NO: 931908 - RNA, 19 nt, Mycobacterium avium subsp. paratuberculosis
gcagaccagcccgucgucc

SEQ ID NO: 931909 - RNA, 14 nt, Mycobacterium avium subsp. paratuberculosis
gcagacccccagca

SEQ ID NO: 931910 - RNA, 20 nt, Mycobacterium avium subsp. paratuberculosis
gcagacccccagcagcgggg

SEQ ID NO: 931911 - RNA, 20 nt, Mycobacterium avium subsp. paratuberculosis
gcagacccgacgggaacucg

SEQ ID NO: 931912 - RNA, 14 nt, Mycobacterium avium subsp. paratuberculosis
gcagacccgccgcg

SEQ ID NO: 931913 - RNA, 21 nt, Mycobacterium avium subsp. paratuberculosis
gcagacccgccgcggcaacgc

SEQ ID NO: 931914 - RNA, 13 nt, Mycobacterium avium subsp. paratuberculosis
gcagacccagcag

SEQ ID NO: 931915 - RNA, 17 nt, Mycobacterium avium subsp. paratuberculosis
gcagacccagcagcggc

SEQ ID NO: 931916 - RNA, 18 nt, Mycobacterium avium subsp. paratuberculosis
gcagacgugaaauccccc

SEQ ID NO: 931917 - RNA, 20 nt, Mycobacterium avium subsp. paratuberculosis
gcagacgugaaaucccccga

SEQ ID NO: 931918 - RNA, 22 nt, Mycobacterium avium subsp. paratuberculosis
gcagacgugaaaucccccgacc

SEQ ID NO: 931919 - RNA, 17 nt, Mycobacterium avium subsp. paratuberculosis
gcagauugguucggccg

SEQ ID NO: 931920 - RNA, 18 nt, Mycobacterium avium subsp. paratuberculosis
gcagauagaucagcaggc

SEQ ID NO: 931921 - RNA, 17 nt, Mycobacterium avium subsp. paratuberculosis
gcagauagaucgacgcg

SEQ ID NO: 931922 - RNA, 20 nt, Mycobacterium avium subsp. paratuberculosis
gcagauagccguacacggcg

SEQ ID NO: 931923 - RNA, 16 nt, Mycobacterium avium subsp. paratuberculosis
gcagauaggacccggc

SEQ ID NO: 931924 - RNA, 21 nt, Mycobacterium avium subsp. paratuberculosis
gcagauggugaaguugccggu

SEQ ID NO: 931925 - RNA, 22 nt, Mycobacterium avium subsp. paratuberculosis
gcagauggugaaguugccgguc

SEQ ID NO: 931926 - RNA, 13 nt, Mycobacterium avium subsp. paratuberculosis
gcagauggucggg

SEQ ID NO: 931927 - RNA, 21 nt, Mycobacterium avium subsp. paratuberculosis
gcagauggucgggacgucggc

SEQ ID NO: 931928 - RNA, 17 nt, Mycobacterium avium subsp. paratuberculosis
gcagauagcccagccag

SEQ ID NO: 931929 - RNA, 18 nt, Mycobacterium avium subsp. paratuberculosis
gcagauagcccagccagc

SEQ ID NO: 931930 - RNA, 19 nt, Mycobacterium avium subsp. paratuberculosis
gcagauagcccagccagcc

SEQ ID NO: 931931 - RNA, 22 nt, Mycobacterium avium subsp. paratuberculosis
gcagauagcccagccagccggu

SEQ ID NO: 931932 - RNA, 20 nt, Mycobacterium avium subsp. paratuberculosis
gcagcaacaugaacgacccu

SEQ ID NO: 931933 - RNA, 14 nt, Mycobacterium avium subsp. paratuberculosis
gcagcaacgcggug

SEQ ID NO: 931934 - RNA, 15 nt, Mycobacterium avium subsp. paratuberculosis
gcagcaaccggguca

SEQ ID NO: 931935 - RNA, 20 nt, Mycobacterium avium subsp. paratuberculosis
gcagcaacuccaccucgggc

SEQ ID NO: 931936 - RNA, 14 nt, Mycobacterium avium subsp. paratuberculosis
gcagcaacggcggc

SEQ ID NO: 931937 - RNA, 24 nt, Mycobacterium avium subsp. paratuberculosis
gcagcaacugaccgaucuggcgau

SEQ ID NO: 931938 - RNA, 20 nt, Mycobacterium avium subsp. paratuberculosis
gcagcaacucgcgcucccgg

SEQ ID NO: 931939 - RNA, 20 nt, Mycobacterium avium subsp. paratuberculosis
gcagcaacggcggcggcacc

SEQ ID NO: 931940 - RNA, 18 nt, Mycobacterium avium subsp. paratuberculosis
gcagcaccgaaccggcgg

SEQ ID NO: 931941 - RNA, 22 nt, Mycobacterium avium subsp. paratuberculosis
gcagcaccgaaccggcgggguc

SEQ ID NO: 931942 - RNA, 13 nt, Mycobacterium avium subsp. paratuberculosis
gcagcacaccggc

SEQ ID NO: 931943 - RNA, 14 nt, Mycobacterium avium subsp. paratuberculosis
gcagcacaccggca

SEQ ID NO: 931944 - RNA, 14 nt, Mycobacterium avium subsp. paratuberculosis
gcagcacccgggcc

SEQ ID NO: 931945 - RNA, 19 nt, Mycobacterium avium subsp. paratuberculosis
gcagcacccgggccugcgg

SEQ ID NO: 931946 - RNA, 18 nt, Mycobacterium avium subsp. paratuberculosis
gcagcaauugacgccgac

SEQ ID NO: 931947 - RNA, 19 nt, Mycobacterium avium subsp. paratuberculosis
gcacuuucgcggucagccg

SEQ ID NO: 931948 - RNA, 21 nt, Mycobacterium avium subsp. paratuberculosis
gcacuuucgcggucagccggc

SEQ ID NO: 931949 - RNA, 15 nt, Mycobacterium avium subsp. paratuberculosis
gcacuucgcgggcgg

SEQ ID NO: 931950 - RNA, 13 nt, Mycobacterium avium subsp. paratuberculosis
gcagaaaaaggcc

SEQ ID NO: 931951 - RNA, 16 nt, Mycobacterium avium subsp. paratuberculosis
gcagaacaccaccgcc

SEQ ID NO: 931952 - RNA, 13 nt, Mycobacterium avium subsp. paratuberculosis
gcagaacaccagc

SEQ ID NO: 931953 - RNA, 16 nt, Mycobacterium avium subsp. paratuberculosis
gcagaacagccggucc

SEQ ID NO: 931954 - RNA, 16 nt, Mycobacterium avium subsp. paratuberculosis
gcagaaccagcaccgc

SEQ ID NO: 931955 - RNA, 21 nt, Mycobacterium avium subsp. paratuberculosis
gcagaaccgcaccccgucgcg

SEQ ID NO: 931956 - RNA, 22 nt, Mycobacterium avium subsp. paratuberculosis
gcagaaccgcaccccgucgcgg

SEQ ID NO: 931957 - RNA, 18 nt, Mycobacterium avium subsp. paratuberculosis
gcacuucauggucgucgu

SEQ ID NO: 931958 - RNA, 17 nt, Mycobacterium avium subsp. paratuberculosis
gcacuuaacaccucgcc

SEQ ID NO: 931959 - RNA, 18 nt, Mycobacterium avium subsp. paratuberculosis
gcacuuaacaccucgccu

SEQ ID NO: 931960 - RNA, 20 nt, Mycobacterium avium subsp. paratuberculosis
gcacugcugcccgcgacggc

SEQ ID NO: 931961 - RNA, 21 nt, Mycobacterium avium subsp. paratuberculosis
gcacugcugcccgcgacggcg

SEQ ID NO: 931962 - RNA, 20 nt, Mycobacterium avium subsp. paratuberculosis
gcacugcuucgggucgccgg

SEQ ID NO: 931963 - RNA, 18 nt, Mycobacterium avium subsp. paratuberculosis
gcacucagagcagcgccu

SEQ ID NO: 931964 - RNA, 24 nt, Mycobacterium avium subsp. paratuberculosis
gcacucagagcagcgccugcugcc

SEQ ID NO: 931965 - RNA, 16 nt, Mycobacterium avium subsp. paratuberculosis
gcacucgaacggcccg

SEQ ID NO: 931966 - RNA, 18 nt, Mycobacterium avium subsp. paratuberculosis
gcacucgaacggcccgga

SEQ ID NO: 931967 - RNA, 22 nt, Mycobacterium avium subsp. paratuberculosis
gcacucgaacggcccggacgga

SEQ ID NO: 931968 - RNA, 14 nt, Mycobacterium avium subsp. paratuberculosis
gcacgugcaccgcg

SEQ ID NO: 931969 - RNA, 20 nt, Mycobacterium avium subsp. paratuberculosis
gcacgugcaccgcggccaac

SEQ ID NO: 931970 - RNA, 12 nt, Mycobacterium avium subsp. paratuberculosis
gcacgugcaggu

SEQ ID NO: 931971 - RNA, 17 nt, Mycobacterium avium subsp. paratuberculosis
gcacgugcccagcccgc

SEQ ID NO: 931972 - RNA, 16 nt, Mycobacterium avium subsp. paratuberculosis
gcacgugcccgccgug

SEQ ID NO: 931973 - RNA, 20 nt, Mycobacterium avium subsp. paratuberculosis
gcacgugcgcgccgaccgcg

SEQ ID NO: 931974 - RNA, 21 nt, Mycobacterium avium subsp. paratuberculosis
gcacgugcgcgccgaccgcga

SEQ ID NO: 931975 - RNA, 16 nt, Mycobacterium avium subsp. paratuberculosis
gcacgugcgcgggaac

SEQ ID NO: 931976 - RNA, 18 nt, Mycobacterium avium subsp. paratuberculosis
gcacuaccgccucgccag

SEQ ID NO: 931977 - RNA, 20 nt, Mycobacterium avium subsp. paratuberculosis
gcacuaccgccucgccagcc

SEQ ID NO: 931978 - RNA, 15 nt, Mycobacterium avium subsp. paratuberculosis
gcacugcccgcaucg

SEQ ID NO: 931979 - RNA, 16 nt, Mycobacterium avium subsp. paratuberculosis
gcacugcccgcaucgc

SEQ ID NO: 931980 - RNA, 16 nt, Mycobacterium avium subsp. paratuberculosis
gcacugccgacccggc

SEQ ID NO: 931981 - RNA, 12 nt, Mycobacterium avium subsp. paratuberculosis
gcacugcacggc

SEQ ID NO: 931982 - RNA, 18 nt, Mycobacterium avium subsp. paratuberculosis
gcacugcaucucgaccug

SEQ ID NO: 931983 - RNA, 19 nt, Mycobacterium avium subsp. paratuberculosis
gcacugaucccuccgucga

SEQ ID NO: 931984 - RNA, 16 nt, Mycobacterium avium subsp. paratuberculosis
gcacugaacgggauga

SEQ ID NO: 931985 - RNA, 19 nt, Mycobacterium avium subsp. paratuberculosis
gcacucuugcgugcggguc

SEQ ID NO: 931986 - RNA, 16 nt, Mycobacterium avium subsp. paratuberculosis
gcacucgucguggcgg

SEQ ID NO: 931987 - RNA, 14 nt, Mycobacterium avium subsp. paratuberculosis
gcacucggcgaugc

SEQ ID NO: 931988 - RNA, 23 nt, Mycobacterium avium subsp. paratuberculosis
gcacucgaucagcaccgccacgc

SEQ ID NO: 931989 - RNA, 12 nt, Mycobacterium avium subsp. paratuberculosis
gcacucgcgcag

SEQ ID NO: 931990 - RNA, 19 nt, Mycobacterium avium subsp. paratuberculosis
gcacucgcgggacggcggc

SEQ ID NO: 931991 - RNA, 22 nt, Mycobacterium avium subsp. paratuberculosis
gcacucgcgggacggcggcgag

SEQ ID NO: 931992 - RNA, 23 nt, Mycobacterium avium subsp. paratuberculosis
gcacggcaaugguugcggcgggc

SEQ ID NO: 931993 - RNA, 15 nt, Mycobacterium avium subsp. paratuberculosis
gcacgcugcgccagc

SEQ ID NO: 931994 - RNA, 16 nt, Mycobacterium avium subsp. paratuberculosis
gcacgcugcgccagcc

SEQ ID NO: 931995 - RNA, 19 nt, Mycobacterium avium subsp. paratuberculosis
gcacgcugcgccagccguc

SEQ ID NO: 931996 - RNA, 23 nt, Mycobacterium avium subsp. paratuberculosis
gcacgcugcgcacccgguccggc

SEQ ID NO: 931997 - RNA, 14 nt, Mycobacterium avium subsp. paratuberculosis
gcacgcugaucacc

SEQ ID NO: 931998 - RNA, 16 nt, Mycobacterium avium subsp. paratuberculosis
gcacgcugaucaccac

SEQ ID NO: 931999 - RNA, 13 nt, Mycobacterium avium subsp. paratuberculosis
gcacgcccugcgg

SEQ ID NO: 932000 - RNA, 16 nt, Mycobacterium avium subsp. paratuberculosis
gcacgcugaagcccac

SEQ ID NO: 932001 - RNA, 19 nt, Mycobacterium avium subsp. paratuberculosis
gcacgcugaagcccaccgc

SEQ ID NO: 932002 - RNA, 21 nt, Mycobacterium avium subsp. paratuberculosis
gcacgcugaagcccaccgccg

SEQ ID NO: 932003 - RNA, 22 nt, Mycobacterium avium subsp. paratuberculosis
gcacgcugaagcccaccgccgu

SEQ ID NO: 932004 - RNA, 14 nt, Mycobacterium avium subsp. paratuberculosis
gcacgcucgcggug

SEQ ID NO: 932005 - RNA, 13 nt, Mycobacterium avium subsp. paratuberculosis
gcacgcucggcgc

SEQ ID NO: 932006 - RNA, 17 nt, Mycobacterium avium subsp. paratuberculosis
gcacgcucggcgcgacg

SEQ ID NO: 932007 - RNA, 18 nt, Mycobacterium avium subsp. paratuberculosis
gcacgcguugcagcgccg

SEQ ID NO: 932008 - RNA, 22 nt, Mycobacterium avium subsp. paratuberculosis
gcacgcguugcagcgccgcggc

SEQ ID NO: 932009 - RNA, 13 nt, Mycobacterium avium subsp. paratuberculosis
gcacggcgccacc

SEQ ID NO: 932010 - RNA, 14 nt, Mycobacterium avium subsp. paratuberculosis
gcacggcgccacca

SEQ ID NO: 932011 - RNA, 15 nt, Mycobacterium avium subsp. paratuberculosis
gcacggcgcccaggu

SEQ ID NO: 932012 - RNA, 13 nt, Mycobacterium avium subsp. paratuberculosis
gcacggcgaccag

SEQ ID NO: 932013 - RNA, 17 nt, Mycobacterium avium subsp. paratuberculosis
gcacggcgaccagcgag

SEQ ID NO: 932014 - RNA, 23 nt, Mycobacterium avium subsp. paratuberculosis
gcacggcgaccagcgagcccagc

SEQ ID NO: 932015 - RNA, 15 nt, Mycobacterium avium subsp. paratuberculosis
gcacggcgaggucgg

SEQ ID NO: 932016 - RNA, 16 nt, Mycobacterium avium subsp. paratuberculosis
gcacggcgaggucggg

SEQ ID NO: 932017 - RNA, 13 nt, Mycobacterium avium subsp. paratuberculosis
gcacggccgccag

SEQ ID NO: 932018 - RNA, 14 nt, Mycobacterium avium subsp. paratuberculosis
gcacggccgccagg

SEQ ID NO: 932019 - RNA, 15 nt, Mycobacterium avium subsp. paratuberculosis
gcacggccgccagga

SEQ ID NO: 932020 - RNA, 12 nt, Mycobacterium avium subsp. paratuberculosis
gcacggccucgg

SEQ ID NO: 932021 - RNA, 14 nt, Mycobacterium avium subsp. paratuberculosis
gcacggcgaacggc

SEQ ID NO: 932022 - RNA, 19 nt, Mycobacterium avium subsp. paratuberculosis
gcacggcgaacggccgcga

SEQ ID NO: 932023 - RNA, 20 nt, Mycobacterium avium subsp. paratuberculosis
gcacggcgaacggccgcgau

SEQ ID NO: 932024 - RNA, 21 nt, Mycobacterium avium subsp. paratuberculosis
gcacggcgaacggccgcgaug

SEQ ID NO: 932025 - RNA, 13 nt, Mycobacterium avium subsp. paratuberculosis
gcacggccggccg

SEQ ID NO: 932026 - RNA, 14 nt, Mycobacterium avium subsp. paratuberculosis
gcacggccgcggcc

SEQ ID NO: 932027 - RNA, 15 nt, Mycobacterium avium subsp. paratuberculosis
gcacggccgcggcca

SEQ ID NO: 932028 - RNA, 16 nt, Mycobacterium avium subsp. paratuberculosis
gcacggccgcggccag

SEQ ID NO: 932029 - RNA, 18 nt, Mycobacterium avium subsp. paratuberculosis
gcacggcccaucaccagc

SEQ ID NO: 932030 - RNA, 19 nt, Mycobacterium avium subsp. paratuberculosis
gcacggcccaucaccagcg

SEQ ID NO: 932031 - RNA, 20 nt, Mycobacterium avium subsp. paratuberculosis
gcacggcccaucaccagcgg

SEQ ID NO: 932032 - RNA, 19 nt, Mycobacterium avium subsp. paratuberculosis
gcacggcccgcucgggcca

SEQ ID NO: 932033 - RNA, 18 nt, Mycobacterium avium subsp. paratuberculosis
gcacggcagcccgacguc

SEQ ID NO: 932034 - RNA, 16 nt, Mycobacterium avium subsp. paratuberculosis
gcacggccagccagcc

SEQ ID NO: 932035 - RNA, 21 nt, Mycobacterium avium subsp. paratuberculosis
gcacggccagccagccgccca

SEQ ID NO: 932036 - RNA, 15 nt, Mycobacterium avium subsp. paratuberculosis
gcacggcaccgcgag

SEQ ID NO: 932037 - RNA, 16 nt, Mycobacterium avium subsp. paratuberculosis
gcacggcaccgcgagc

SEQ ID NO: 932038 - RNA, 16 nt, Mycobacterium avium subsp. paratuberculosis
gcacggcaucgauggc

SEQ ID NO: 932039 - RNA, 18 nt, Mycobacterium avium subsp. paratuberculosis
gcacggcauggcgaacac

SEQ ID NO: 932040 - RNA, 23 nt, Mycobacterium avium subsp. paratuberculosis
gcacggcauggcgaacacgucgg

SEQ ID NO: 932041 - RNA, 14 nt, Mycobacterium avium subsp. paratuberculosis
gcacggccaccagc

SEQ ID NO: 932042 - RNA, 21 nt, Mycobacterium avium subsp. paratuberculosis
gcacggccaccagcagcgaga

SEQ ID NO: 932043 - RNA, 21 nt, Mycobacterium avium subsp. paratuberculosis
gcacggccacugccccggcga

SEQ ID NO: 932044 - RNA, 21 nt, Mycobacterium avium subsp. paratuberculosis
gcacguagacggugucgcccu

SEQ ID NO: 932045 - RNA, 15 nt, Mycobacterium avium subsp. paratuberculosis
gcacgguuggccggc

SEQ ID NO: 932046 - RNA, 22 nt, Mycobacterium avium subsp. paratuberculosis
gcacgguuggccggcccgcccg

SEQ ID NO: 932047 - RNA, 20 nt, Mycobacterium avium subsp. paratuberculosis
gcacguaccgguacagcgac

SEQ ID NO: 932048 - RNA, 14 nt, Mycobacterium avium subsp. paratuberculosis
gcacguacgcgcug

SEQ ID NO: 932049 - RNA, 14 nt, Mycobacterium avium subsp. paratuberculosis
gcacguauccgcgg

SEQ ID NO: 932050 - RNA, 15 nt, Mycobacterium avium subsp. paratuberculosis
gcacguauccgcggu

SEQ ID NO: 932051 - RNA, 12 nt, Mycobacterium avium subsp. paratuberculosis
gcacgucaccgc

SEQ ID NO: 932052 - RNA, 14 nt, Mycobacterium avium subsp. paratuberculosis
gcacgucaccgcug

SEQ ID NO: 932053 - RNA, 14 nt, Mycobacterium avium subsp. paratuberculosis
gcacguaggcggcg

SEQ ID NO: 932054 - RNA, 16 nt, Mycobacterium avium subsp. paratuberculosis
gcacguaggcggcgag

SEQ ID NO: 932055 - RNA, 17 nt, Mycobacterium avium subsp. paratuberculosis
gcacgucggcgcgcagg

SEQ ID NO: 932056 - RNA, 15 nt, Mycobacterium avium subsp. paratuberculosis
gcacgucggcggccg

SEQ ID NO: 932057 - RNA, 13 nt, Mycobacterium avium subsp. paratuberculosis
gcacgucgcgcgg

SEQ ID NO: 932058 - RNA, 17 nt, Mycobacterium avium subsp. paratuberculosis
gcacgucgcgcgggguc

SEQ ID NO: 932059 - RNA, 14 nt, Mycobacterium avium subsp. paratuberculosis
gcacgucgcggccc

SEQ ID NO: 932060 - RNA, 14 nt, Mycobacterium avium subsp. paratuberculosis
gcacgucggccacg

SEQ ID NO: 932061 - RNA, 15 nt, Mycobacterium avium subsp. paratuberculosis
gcacgucggccacgc

SEQ ID NO: 932062 - RNA, 20 nt, Mycobacterium avium subsp. paratuberculosis
gcacgucggccacgccgggc

SEQ ID NO: 932063 - RNA, 18 nt, Mycobacterium avium subsp. paratuberculosis
gcacgucacgggccaggc

SEQ ID NO: 932064 - RNA, 21 nt, Mycobacterium avium subsp. paratuberculosis
gcacgucacgggccaggcgcg

SEQ ID NO: 932065 - RNA, 14 nt, Mycobacterium avium subsp. paratuberculosis
gcacguccagcccg

SEQ ID NO: 932066 - RNA, 13 nt, Mycobacterium avium subsp. paratuberculosis
gcacgucgccgcc

SEQ ID NO: 932067 - RNA, 14 nt, Mycobacterium avium subsp. paratuberculosis
gcacgucgccggcg

SEQ ID NO: 932068 - RNA, 18 nt, Mycobacterium avium subsp. paratuberculosis
gcacgucgccggcgaccg

SEQ ID NO: 932069 - RNA, 14 nt, Mycobacterium avium subsp. paratuberculosis
gcacgucgccguuc

SEQ ID NO: 932070 - RNA, 23 nt, Mycobacterium avium subsp. paratuberculosis
gcacggcgauguaggacgccgca

SEQ ID NO: 932071 - RNA, 15 nt, Mycobacterium avium subsp. paratuberculosis
gcacggcgccgugcc

SEQ ID NO: 932072 - RNA, 17 nt, Mycobacterium avium subsp. paratuberculosis
gcacggcgccgugccgc

SEQ ID NO: 932073 - RNA, 18 nt, Mycobacterium avium subsp. paratuberculosis
gcacggcgcgcaccgcgg

SEQ ID NO: 932074 - RNA, 14 nt, Mycobacterium avium subsp. paratuberculosis
gcacggcgcuggcg

SEQ ID NO: 932075 - RNA, 23 nt, Mycobacterium avium subsp. paratuberculosis
gcacggggacgcugaacagcccg

SEQ ID NO: 932076 - RNA, 16 nt, Mycobacterium avium subsp. paratuberculosis
gcacggggacgucguc

SEQ ID NO: 932077 - RNA, 17 nt, Mycobacterium avium subsp. paratuberculosis
gcacggggacgucgucg

SEQ ID NO: 932078 - RNA, 21 nt, Mycobacterium avium subsp. paratuberculosis
gcacgggggaguagcgcgcga

SEQ ID NO: 932079 - RNA, 14 nt, Mycobacterium avium subsp. paratuberculosis
gcacggucagcggc

SEQ ID NO: 932080 - RNA, 17 nt, Mycobacterium avium subsp. paratuberculosis
gcacggucagcggccag

SEQ ID NO: 932081 - RNA, 18 nt, Mycobacterium avium subsp. paratuberculosis
gcacggucagcggccagc

SEQ ID NO: 932082 - RNA, 18 nt, Mycobacterium avium subsp. paratuberculosis
gcacggucagcucgcgcc

SEQ ID NO: 932083 - RNA, 17 nt, Mycobacterium avium subsp. paratuberculosis
gcacggucccguccauc

SEQ ID NO: 932084 - RNA, 22 nt, Mycobacterium avium subsp. paratuberculosis
gcacggucccguccaucgccgc

SEQ ID NO: 932085 - RNA, 11 nt, Mycobacterium avium subsp. paratuberculosis
gcacggucgcg

SEQ ID NO: 932086 - RNA, 16 nt, Mycobacterium avium subsp. paratuberculosis
gcacggucgcgguguc

SEQ ID NO: 932087 - RNA, 20 nt, Mycobacterium avium subsp. paratuberculosis
gcacggucgcggugucggcg

SEQ ID NO: 932088 - RNA, 15 nt, Mycobacterium avium subsp. paratuberculosis
gcacggucggccccg

SEQ ID NO: 932089 - RNA, 20 nt, Mycobacterium avium subsp. paratuberculosis
gcacggucggccccgcgcau

SEQ ID NO: 932090 - RNA, 21 nt, Mycobacterium avium subsp. paratuberculosis
gcacgguguugcgcacccgcg

SEQ ID NO: 932091 - RNA, 22 nt, Mycobacterium avium subsp. paratuberculosis
gcacgguguugcgcacccgcgg

SEQ ID NO: 932092 - RNA, 16 nt, Mycobacterium avium subsp. paratuberculosis
gcacggucugguggca

SEQ ID NO: 932093 - RNA, 18 nt, Mycobacterium avium subsp. paratuberculosis
gcacggucugguggcagc

SEQ ID NO: 932094 - RNA, 19 nt, Mycobacterium avium subsp. paratuberculosis
gcaccugcucgaugcgcgc

SEQ ID NO: 932095 - RNA, 21 nt, Mycobacterium avium subsp. paratuberculosis
gcaccugcucgaugcgcgcca

SEQ ID NO: 932096 - RNA, 12 nt, Mycobacterium avium subsp. paratuberculosis
gcaccggccggc

SEQ ID NO: 932097 - RNA, 13 nt, Mycobacterium avium subsp. paratuberculosis
gcaccggccggcc

SEQ ID NO: 932098 - RNA, 16 nt, Mycobacterium avium subsp. paratuberculosis
gcaccggccggccccg

SEQ ID NO: 932099 - RNA, 18 nt, Mycobacterium avium subsp. paratuberculosis
gcaccuggagcggguccg

SEQ ID NO: 932100 - RNA, 18 nt, Mycobacterium avium subsp. paratuberculosis
gcaccuggcagcauccgc

SEQ ID NO: 932101 - RNA, 23 nt, Mycobacterium avium subsp. paratuberculosis
gcaccuggcagcauccgccgacg

SEQ ID NO: 932102 - RNA, 15 nt, Mycobacterium avium subsp. paratuberculosis
gcaccggcagcaccg

SEQ ID NO: 932103 - RNA, 13 nt, Mycobacterium avium subsp. paratuberculosis
gcaccggcagcca

SEQ ID NO: 932104 - RNA, 14 nt, Mycobacterium avium subsp. paratuberculosis
gcaccggcagccgc

SEQ ID NO: 932105 - RNA, 19 nt, Mycobacterium avium subsp. paratuberculosis
gcaccggcagugaucggcg

SEQ ID NO: 932106 - RNA, 21 nt, Mycobacterium avium subsp. paratuberculosis
gcaccggcagugaucggcgga

SEQ ID NO: 932107 - RNA, 16 nt, Mycobacterium avium subsp. paratuberculosis
gcaccuucaccgacca

SEQ ID NO: 932108 - RNA, 19 nt, Mycobacterium avium subsp. paratuberculosis
gcaccugugaggcaccgaa

SEQ ID NO: 932109 - RNA, 22 nt, Mycobacterium avium subsp. paratuberculosis
gcaccugugaggcaccgaacgc

SEQ ID NO: 932110 - RNA, 14 nt, Mycobacterium avium subsp. paratuberculosis
gcaccuggcgcagc

SEQ ID NO: 932111 - RNA, 15 nt, Mycobacterium avium subsp. paratuberculosis
gcaccuggccgucgg

SEQ ID NO: 932112 - RNA, 18 nt, Mycobacterium avium subsp. paratuberculosis
gcaccuggccgucggugg

SEQ ID NO: 932113 - RNA, 15 nt, Mycobacterium avium subsp. paratuberculosis
gcaccuggcgcagca

SEQ ID NO: 932114 - RNA, 21 nt, Mycobacterium avium subsp. paratuberculosis
gcaccuucagcgggcgcagcu

SEQ ID NO: 932115 - RNA, 17 nt, Mycobacterium avium subsp. paratuberculosis
gcacgaagccgaacgac

SEQ ID NO: 932116 - RNA, 15 nt, Mycobacterium avium subsp. paratuberculosis
gcacgaacgcgacga

SEQ ID NO: 932117 - RNA, 15 nt, Mycobacterium avium subsp. paratuberculosis
gcacgaacgcggcca

SEQ ID NO: 932118 - RNA, 16 nt, Mycobacterium avium subsp. paratuberculosis
gcacgaacgcggccag

SEQ ID NO: 932119 - RNA, 17 nt, Mycobacterium avium subsp. paratuberculosis
gcacgaacgcggccgcc

SEQ ID NO: 932120 - RNA, 18 nt, Mycobacterium avium subsp. paratuberculosis
gcacgaacgcggccgcca

SEQ ID NO: 932121 - RNA, 19 nt, Mycobacterium avium subsp. paratuberculosis
gcacgaacgcggccgccau

SEQ ID NO: 932122 - RNA, 17 nt, Mycobacterium avium subsp. paratuberculosis
gcacgaagaaggcuccg

SEQ ID NO: 932123 - RNA, 21 nt, Mycobacterium avium subsp. paratuberculosis
gcacgaagaaggcuccgccga

SEQ ID NO: 932124 - RNA, 17 nt, Mycobacterium avium subsp. paratuberculosis
gcacgaauugccggugg

SEQ ID NO: 932125 - RNA, 23 nt, Mycobacterium avium subsp. paratuberculosis
gcacgaauugccgguggugcggc

SEQ ID NO: 932126 - RNA, 21 nt, Mycobacterium avium subsp. paratuberculosis
gcacgaagucgaccgcggcuc

SEQ ID NO: 932127 - RNA, 14 nt, Mycobacterium avium subsp. paratuberculosis
gcacgaaggccgcc

SEQ ID NO: 932128 - RNA, 18 nt, Mycobacterium avium subsp. paratuberculosis
gcacgaaggccgccgggu

SEQ ID NO: 932129 - RNA, 12 nt, Mycobacterium avium subsp. paratuberculosis
gcacgacaccga

SEQ ID NO: 932130 - RNA, 18 nt, Mycobacterium avium subsp. paratuberculosis
gcacgacaccgacgacca

SEQ ID NO: 932131 - RNA, 14 nt, Mycobacterium avium subsp. paratuberculosis
gcacgcccguagcg

SEQ ID NO: 932132 - RNA, 21 nt, Mycobacterium avium subsp. paratuberculosis
gcacgcccguagcggugggcg

SEQ ID NO: 932133 - RNA, 16 nt, Mycobacterium avium subsp. paratuberculosis
gcacgcccguucgagc

SEQ ID NO: 932134 - RNA, 20 nt, Mycobacterium avium subsp. paratuberculosis
gcacgcccguucgagcgccg

SEQ ID NO: 932135 - RNA, 22 nt, Mycobacterium avium subsp. paratuberculosis
gcacgcccguucgagcgccgga

SEQ ID NO: 932136 - RNA, 18 nt, Mycobacterium avium subsp. paratuberculosis
gcacgcccucggcuuccg

SEQ ID NO: 932137 - RNA, 13 nt, Mycobacterium avium subsp. paratuberculosis
gcacgccggucag

SEQ ID NO: 932138 - RNA, 15 nt, Mycobacterium avium subsp. paratuberculosis
gcacgccggucagca

SEQ ID NO: 932139 - RNA, 13 nt, Mycobacterium avium subsp. paratuberculosis
gcacgccggggcc

SEQ ID NO: 932140 - RNA, 15 nt, Mycobacterium avium subsp. paratuberculosis
gcacgccggggcccu

SEQ ID NO: 932141 - RNA, 20 nt, Mycobacterium avium subsp. paratuberculosis
gcacgccggguugggcggcg

SEQ ID NO: 932142 - RNA, 22 nt, Mycobacterium avium subsp. paratuberculosis
gcacgccuuccacgaccuggcg

SEQ ID NO: 932143 - RNA, 23 nt, Mycobacterium avium subsp. paratuberculosis
gcacgccuuccacgaccuggcgg

SEQ ID NO: 932144 - RNA, 16 nt, Mycobacterium avium subsp. paratuberculosis
gcacgccguggcggcg

SEQ ID NO: 932145 - RNA, 17 nt, Mycobacterium avium subsp. paratuberculosis
gcacgccguggcggcgg

SEQ ID NO: 932146 - RNA, 21 nt, Mycobacterium avium subsp. paratuberculosis
gcacgccguggcggcgggcca

SEQ ID NO: 932147 - RNA, 14 nt, Mycobacterium avium subsp. paratuberculosis
gcacgccguacccg

SEQ ID NO: 932148 - RNA, 12 nt, Mycobacterium avium subsp. paratuberculosis
gcacgccgucgu

SEQ ID NO: 932149 - RNA, 21 nt, Mycobacterium avium subsp. paratuberculosis
gcacgcgaccgcgucgacggc

SEQ ID NO: 932150 - RNA, 19 nt, Mycobacterium avium subsp. paratuberculosis
gcacgcgagacgagccgcc

SEQ ID NO: 932151 - RNA, 20 nt, Mycobacterium avium subsp. paratuberculosis
gcacgcgagacgagccgccg

SEQ ID NO: 932152 - RNA, 16 nt, Mycobacterium avium subsp. paratuberculosis
gcacgaucgagccggu

SEQ ID NO: 932153 - RNA, 13 nt, Mycobacterium avium subsp. paratuberculosis
gcacgaucgcggu

SEQ ID NO: 932154 - RNA, 18 nt, Mycobacterium avium subsp. paratuberculosis
gcacgaucagggugucga

SEQ ID NO: 932155 - RNA, 14 nt, Mycobacterium avium subsp. paratuberculosis
gcacgaucccgccg

SEQ ID NO: 932156 - RNA, 19 nt, Mycobacterium avium subsp. paratuberculosis
gcacgaucgucgccgccaa

SEQ ID NO: 932157 - RNA, 23 nt, Mycobacterium avium subsp. paratuberculosis
gcacgaucgucgccgccaacgcg

SEQ ID NO: 932158 - RNA, 15 nt, Mycobacterium avium subsp. paratuberculosis
gcacgaucucgacca

SEQ ID NO: 932159 - RNA, 16 nt, Mycobacterium avium subsp. paratuberculosis
gcacgaucucgaccag

SEQ ID NO: 932160 - RNA, 13 nt, Mycobacterium avium subsp. paratuberculosis
gcacgaucucggc

SEQ ID NO: 932161 - RNA, 16 nt, Mycobacterium avium subsp. paratuberculosis
gcacgaucucggcggu

SEQ ID NO: 932162 - RNA, 21 nt, Mycobacterium avium subsp. paratuberculosis
gcacgaugaacuccucgaucg

SEQ ID NO: 932163 - RNA, 18 nt, Mycobacterium avium subsp. paratuberculosis
gcacgaugacgaccgggu

SEQ ID NO: 932164 - RNA, 23 nt, Mycobacterium avium subsp. paratuberculosis
gcacgaucggguagacgucgggc

SEQ ID NO: 932165 - RNA, 20 nt, Mycobacterium avium subsp. paratuberculosis
gcacgaucgcggugacgcgc

SEQ ID NO: 932166 - RNA, 22 nt, Mycobacterium avium subsp. paratuberculosis
gcacgaucgcggugacgcgccg

SEQ ID NO: 932167 - RNA, 18 nt, Mycobacterium avium subsp. paratuberculosis
gcacgaucggcagcgcca

SEQ ID NO: 932168 - RNA, 15 nt, Mycobacterium avium subsp. paratuberculosis
gcacgaucugcaggc

SEQ ID NO: 932169 - RNA, 18 nt, Mycobacterium avium subsp. paratuberculosis
gcacgaucugcaggccga

SEQ ID NO: 932170 - RNA, 16 nt, Mycobacterium avium subsp. paratuberculosis
gcacgcccaugaucac

SEQ ID NO: 932171 - RNA, 19 nt, Mycobacterium avium subsp. paratuberculosis
gcacgcccaugaucacacc

SEQ ID NO: 932172 - RNA, 20 nt, Mycobacterium avium subsp. paratuberculosis
gcacgcccaugaucacaccg

SEQ ID NO: 932173 - RNA, 21 nt, Mycobacterium avium subsp. paratuberculosis
gcacgcccccgcuggcccggc

SEQ ID NO: 932174 - RNA, 17 nt, Mycobacterium avium subsp. paratuberculosis
gcacgcccagcccgcgg

SEQ ID NO: 932175 - RNA, 17 nt, Mycobacterium avium subsp. paratuberculosis
gcacgccaucgccucgg

SEQ ID NO: 932176 - RNA, 19 nt, Mycobacterium avium subsp. paratuberculosis
gcacgccaucgccucggcc

SEQ ID NO: 932177 - RNA, 22 nt, Mycobacterium avium subsp. paratuberculosis
gcacgccaucgccucggccacc

SEQ ID NO: 932178 - RNA, 20 nt, Mycobacterium avium subsp. paratuberculosis
gcacgcccagaucgacgccg

SEQ ID NO: 932179 - RNA, 22 nt, Mycobacterium avium subsp. paratuberculosis
gcacgcccagaucgccgacccg

SEQ ID NO: 932180 - RNA, 23 nt, Mycobacterium avium subsp. paratuberculosis
gcacagugcgucgcccaucacca

SEQ ID NO: 932181 - RNA, 14 nt, Mycobacterium avium subsp. paratuberculosis
gcacauagcgcagc

SEQ ID NO: 932182 - RNA, 15 nt, Mycobacterium avium subsp. paratuberculosis
gcacauagcgcagcu

SEQ ID NO: 932183 - RNA, 16 nt, Mycobacterium avium subsp. paratuberculosis
gcacauagcgcagcuc

SEQ ID NO: 932184 - RNA, 19 nt, Mycobacterium avium subsp. paratuberculosis
gcacaucacgguggccgcc

SEQ ID NO: 932185 - RNA, 20 nt, Mycobacterium avium subsp. paratuberculosis
gcacaucacgguggccgcca

SEQ ID NO: 932186 - RNA, 22 nt, Mycobacterium avium subsp. paratuberculosis
gcacaucacgguggccgccacc

SEQ ID NO: 932187 - RNA, 23 nt, Mycobacterium avium subsp. paratuberculosis
gcacaucacgguggccgccacca

SEQ ID NO: 932188 - RNA, 22 nt, Mycobacterium avium subsp. paratuberculosis
gcacaucguggcgacgacgccg

SEQ ID NO: 932189 - RNA, 15 nt, Mycobacterium avium subsp. paratuberculosis
gcacaugcccgucgg

SEQ ID NO: 932190 - RNA, 22 nt, Mycobacterium avium subsp. paratuberculosis
gcacaugcccgucgggcggggu

SEQ ID NO: 932191 - RNA, 15 nt, Mycobacterium avium subsp. paratuberculosis
gcaccaacacgucga

SEQ ID NO: 932192 - RNA, 17 nt, Mycobacterium avium subsp. paratuberculosis
gcaccaacacgucgagu

SEQ ID NO: 932193 - RNA, 14 nt, Mycobacterium avium subsp. paratuberculosis
gcaccaacagcggc

SEQ ID NO: 932194 - RNA, 17 nt, Mycobacterium avium subsp. paratuberculosis
gcaccaacagcggcccg

SEQ ID NO: 932195 - RNA, 18 nt, Mycobacterium avium subsp. paratuberculosis
gcaccaacagcggcccga

SEQ ID NO: 932196 - RNA, 21 nt, Mycobacterium avium subsp. paratuberculosis
gcaccaacccgaucggcccgg

SEQ ID NO: 932197 - RNA, 22 nt, Mycobacterium avium subsp. paratuberculosis
gcaccaacccgaucggcccggc

SEQ ID NO: 932198 - RNA, 18 nt, Mycobacterium avium subsp. paratuberculosis
gcaccaaccggccccgag

SEQ ID NO: 932199 - RNA, 22 nt, Mycobacterium avium subsp. paratuberculosis
gcaccaaccggccccgagcguc

SEQ ID NO: 932200 - RNA, 17 nt, Mycobacterium avium subsp. paratuberculosis
gcaccaccaacagcagc

SEQ ID NO: 932201 - RNA, 20 nt, Mycobacterium avium subsp. paratuberculosis
gcaccaccaacagcagcgag

SEQ ID NO: 932202 - RNA, 21 nt, Mycobacterium avium subsp. paratuberculosis
gcaccaccaacggcucgccgc

SEQ ID NO: 932203 - RNA, 22 nt, Mycobacterium avium subsp. paratuberculosis
gcaccaccaacggcucgccgcg

SEQ ID NO: 932204 - RNA, 20 nt, Mycobacterium avium subsp. paratuberculosis
gcaccaccacacccagcgcc

SEQ ID NO: 932205 - RNA, 22 nt, Mycobacterium avium subsp. paratuberculosis
gcaccaccacacccagcgccag

SEQ ID NO: 932206 - RNA, 18 nt, Mycobacterium avium subsp. paratuberculosis
gcaccaccacccccgacc

SEQ ID NO: 932207 - RNA, 20 nt, Mycobacterium avium subsp. paratuberculosis
gcaccaccacccccgacccg

SEQ ID NO: 932208 - RNA, 20 nt, Mycobacterium avium subsp. paratuberculosis
gcaccacaucggauucgucg

SEQ ID NO: 932209 - RNA, 23 nt, Mycobacterium avium subsp. paratuberculosis
gcaccacaucgguugcuccggcg

SEQ ID NO: 932210 - RNA, 17 nt, Mycobacterium avium subsp. paratuberculosis
gcaccaccaccgacacc

SEQ ID NO: 932211 - RNA, 18 nt, Mycobacterium avium subsp. paratuberculosis
gcaccaccaccgacaccc

SEQ ID NO: 932212 - RNA, 20 nt, Mycobacterium avium subsp. paratuberculosis
gcaccagaugcaccucgccc

SEQ ID NO: 932213 - RNA, 20 nt, Mycobacterium avium subsp. paratuberculosis
gcaccagauucaccagcgcc

SEQ ID NO: 932214 - RNA, 16 nt, Mycobacterium avium subsp. paratuberculosis
gcaccagaacacguuu

SEQ ID NO: 932215 - RNA, 20 nt, Mycobacterium avium subsp. paratuberculosis
gcaccagaacacguuucggc

SEQ ID NO: 932216 - RNA, 18 nt, Mycobacterium avium subsp. paratuberculosis
gcaccacguugcgcccgg

SEQ ID NO: 932217 - RNA, 21 nt, Mycobacterium avium subsp. paratuberculosis
gcaccacuuccagcaccggcu

SEQ ID NO: 932218 - RNA, 15 nt, Mycobacterium avium subsp. paratuberculosis
gcaccacguccacca

SEQ ID NO: 932219 - RNA, 20 nt, Mycobacterium avium subsp. paratuberculosis
gcaccacguccaccagcacc

SEQ ID NO: 932220 - RNA, 22 nt, Mycobacterium avium subsp. paratuberculosis
gcaccacgucggguucgccggu

SEQ ID NO: 932221 - RNA, 23 nt, Mycobacterium avium subsp. paratuberculosis
gcaccacgucggguucgccggug

SEQ ID NO: 932222 - RNA, 15 nt, Mycobacterium avium subsp. paratuberculosis
gcaccacgugcgcga

SEQ ID NO: 932223 - RNA, 18 nt, Mycobacterium avium subsp. paratuberculosis
gcaccacgugcgcgaagc

SEQ ID NO: 932224 - RNA, 23 nt, Mycobacterium avium subsp. paratuberculosis
gcaccacggugaucucgccgagc

SEQ ID NO: 932225 - RNA, 16 nt, Mycobacterium avium subsp. paratuberculosis
gcaccacgguggcgcc

SEQ ID NO: 932226 - RNA, 19 nt, Mycobacterium avium subsp. paratuberculosis
gcaccacgguggcgccgcg

SEQ ID NO: 932227 - RNA, 22 nt, Mycobacterium avium subsp. paratuberculosis
gcaccacgguggcgccgcgcag

SEQ ID NO: 932228 - RNA, 15 nt, Mycobacterium avium subsp. paratuberculosis
gcaccacggcggcau

SEQ ID NO: 932229 - RNA, 17 nt, Mycobacterium avium subsp. paratuberculosis
gcaccacggcccgcgcc

SEQ ID NO: 932230 - RNA, 16 nt, Mycobacterium avium subsp. paratuberculosis
gcaccacgacgucgag

SEQ ID NO: 932231 - RNA, 14 nt, Mycobacterium avium subsp. paratuberculosis
gcaccacgagcagc

SEQ ID NO: 932232 - RNA, 17 nt, Mycobacterium avium subsp. paratuberculosis
gcaccacgcccgacgac

SEQ ID NO: 932233 - RNA, 18 nt, Mycobacterium avium subsp. paratuberculosis
gcaccacgcccgacgacg

SEQ ID NO: 932234 - RNA, 12 nt, Mycobacterium avium subsp. paratuberculosis
gcaccacgccga

SEQ ID NO: 932235 - RNA, 13 nt, Mycobacterium avium subsp. paratuberculosis
gcaccacgccgac

SEQ ID NO: 932236 - RNA, 14 nt, Mycobacterium avium subsp. paratuberculosis
gcaccacgccgacg

SEQ ID NO: 932237 - RNA, 23 nt, Mycobacterium avium subsp. paratuberculosis
gcaccacgccgacguggguggug

SEQ ID NO: 932238 - RNA, 16 nt, Mycobacterium avium subsp. paratuberculosis
gcaccaccacgcuggc

SEQ ID NO: 932239 - RNA, 20 nt, Mycobacterium avium subsp. paratuberculosis
gcaccaccacgguggcgccg

SEQ ID NO: 932240 - RNA, 22 nt, Mycobacterium avium subsp. paratuberculosis
gcaccaccacguugcgcggccg

SEQ ID NO: 932241 - RNA, 14 nt, Mycobacterium avium subsp. paratuberculosis
gcaccaccagcgug

SEQ ID NO: 932242 - RNA, 13 nt, Mycobacterium avium subsp. paratuberculosis
gcaccaccaggcc

SEQ ID NO: 932243 - RNA, 13 nt, Mycobacterium avium subsp. paratuberculosis
gcaccacccaggc

SEQ ID NO: 932244 - RNA, 15 nt, Mycobacterium avium subsp. paratuberculosis
gcaccacccaggcca

SEQ ID NO: 932245 - RNA, 20 nt, Mycobacterium avium subsp. paratuberculosis
gcaccacccaggccacccgg

SEQ ID NO: 932246 - RNA, 23 nt, Mycobacterium avium subsp. paratuberculosis
gcaccacccgcaccucgcccggc

SEQ ID NO: 932247 - RNA, 12 nt, Mycobacterium avium subsp. paratuberculosis
gcaccacccgcg

SEQ ID NO: 932248 - RNA, 14 nt, Mycobacterium avium subsp. paratuberculosis
gcaccacccgcggc

SEQ ID NO: 932249 - RNA, 16 nt, Mycobacterium avium subsp. paratuberculosis
gcaccacccgcggccg

SEQ ID NO: 932250 - RNA, 18 nt, Mycobacterium avium subsp. paratuberculosis
gcaccacccgcggccggc

SEQ ID NO: 932251 - RNA, 15 nt, Mycobacterium avium subsp. paratuberculosis
gcaccacccgggugu

SEQ ID NO: 932252 - RNA, 19 nt, Mycobacterium avium subsp. paratuberculosis
gcaccacccggucgaugug

SEQ ID NO: 932253 - RNA, 17 nt, Mycobacterium avium subsp. paratuberculosis
gcaccaccgcccggacc

SEQ ID NO: 932254 - RNA, 13 nt, Mycobacterium avium subsp. paratuberculosis
gcaccaccgcgag

SEQ ID NO: 932255 - RNA, 19 nt, Mycobacterium avium subsp. paratuberculosis
gcaccaccgcgagcgggug

SEQ ID NO: 932256 - RNA, 14 nt, Mycobacterium avium subsp. paratuberculosis
gcaccaccgcggug

SEQ ID NO: 932257 - RNA, 19 nt, Mycobacterium avium subsp. paratuberculosis
gcaccaccgucaccgccgc

SEQ ID NO: 932258 - RNA, 18 nt, Mycobacterium avium subsp. paratuberculosis
gcaccaccgugccgucgc

SEQ ID NO: 932259 - RNA, 14 nt, Mycobacterium avium subsp. paratuberculosis
gcaccaccguggcg

SEQ ID NO: 932260 - RNA, 16 nt, Mycobacterium avium subsp. paratuberculosis
gcaccaccguggcgau

SEQ ID NO: 932261 - RNA, 18 nt, Mycobacterium avium subsp. paratuberculosis
gcaccaccguggcgaugg

SEQ ID NO: 932262 - RNA, 20 nt, Mycobacterium avium subsp. paratuberculosis
gcaccaccucgcgcggggcg

SEQ ID NO: 932263 - RNA, 14 nt, Mycobacterium avium subsp. paratuberculosis
gcaccaccucggcg

SEQ ID NO: 932264 - RNA, 15 nt, Mycobacterium avium subsp. paratuberculosis
gcaccaccucggcga

SEQ ID NO: 932265 - RNA, 16 nt, Mycobacterium avium subsp. paratuberculosis
gcaccaccucggcgau

SEQ ID NO: 932266 - RNA, 18 nt, Mycobacterium avium subsp. paratuberculosis
gcaccacgaacgcugcca

SEQ ID NO: 932267 - RNA, 13 nt, Mycobacterium avium subsp. paratuberculosis
gcaccacgaagcg

SEQ ID NO: 932268 - RNA, 17 nt, Mycobacterium avium subsp. paratuberculosis
gcaccacgaagcgggcg

SEQ ID NO: 932269 - RNA, 21 nt, Mycobacterium avium subsp. paratuberculosis
gcacaaaagggcccaugccgc

SEQ ID NO: 932270 - RNA, 16 nt, Mycobacterium avium subsp. paratuberculosis
gcacaauccggucagc

SEQ ID NO: 932271 - RNA, 20 nt, Mycobacterium avium subsp. paratuberculosis
gcacaauccggucagcgugg

SEQ ID NO: 932272 - RNA, 18 nt, Mycobacterium avium subsp. paratuberculosis
gcacacacaggucgcccg

SEQ ID NO: 932273 - RNA, 20 nt, Mycobacterium avium subsp. paratuberculosis
gcacacacaggucgcccggc

SEQ ID NO: 932274 - RNA, 21 nt, Mycobacterium avium subsp. paratuberculosis
gcacacacaggucgcccggcu

SEQ ID NO: 932275 - RNA, 13 nt, Mycobacterium avium subsp. paratuberculosis
gcacacagcagca

SEQ ID NO: 932276 - RNA, 20 nt, Mycobacterium avium subsp. paratuberculosis
gcacacagcagcagcaccag

SEQ ID NO: 932277 - RNA, 15 nt, Mycobacterium avium subsp. paratuberculosis
gcacaauucggucag

SEQ ID NO: 932278 - RNA, 17 nt, Mycobacterium avium subsp. paratuberculosis
gcacaauucggucagcg

SEQ ID NO: 932279 - RNA, 19 nt, Mycobacterium avium subsp. paratuberculosis
gcacaauucggucagcgcg

SEQ ID NO: 932280 - RNA, 15 nt, Mycobacterium avium subsp. paratuberculosis
gcaauugacgccgac

SEQ ID NO: 932281 - RNA, 15 nt, Mycobacterium avium subsp. paratuberculosis
gcaauugcgccagca

SEQ ID NO: 932282 - RNA, 18 nt, Mycobacterium avium subsp. paratuberculosis
gcaauugcgccagcagca

SEQ ID NO: 932283 - RNA, 21 nt, Mycobacterium avium subsp. paratuberculosis
gcaauucggugacggcgucgg

SEQ ID NO: 932284 - RNA, 23 nt, Mycobacterium avium subsp. paratuberculosis
gcaacauccugguccggcgcccg

SEQ ID NO: 932285 - RNA, 22 nt, Mycobacterium avium subsp. paratuberculosis
gcacagcuaggucguggcgccg

SEQ ID NO: 932286 - RNA, 23 nt, Mycobacterium avium subsp. paratuberculosis
gcacagcuaggucguggcgccga

SEQ ID NO: 932287 - RNA, 17 nt, Mycobacterium avium subsp. paratuberculosis
gcacagcuucggcgccg

SEQ ID NO: 932288 - RNA, 20 nt, Mycobacterium avium subsp. paratuberculosis
gcacagcuucggcgccgagc

SEQ ID NO: 932289 - RNA, 16 nt, Mycobacterium avium subsp. paratuberculosis
gcacagcuuucgggcg

SEQ ID NO: 932290 - RNA, 17 nt, Mycobacterium avium subsp. paratuberculosis
gcacaggaacgcgacgg

SEQ ID NO: 932291 - RNA, 19 nt, Mycobacterium avium subsp. paratuberculosis
gcacaggaacgcgacggug

SEQ ID NO: 932292 - RNA, 20 nt, Mycobacterium avium subsp. paratuberculosis
gcacaggaacgcgacggugg

SEQ ID NO: 932293 - RNA, 19 nt, Mycobacterium avium subsp. paratuberculosis
gcacagcgccgcguugucg

SEQ ID NO: 932294 - RNA, 12 nt, Mycobacterium avium subsp. paratuberculosis
gcacagcggcgg

SEQ ID NO: 932295 - RNA, 22 nt, Mycobacterium avium subsp. paratuberculosis
gcacagcguuauccaccagguu

SEQ ID NO: 932296 - RNA, 13 nt, Mycobacterium avium subsp. paratuberculosis
gcacaggccgccg

SEQ ID NO: 932297 - RNA, 14 nt, Mycobacterium avium subsp. paratuberculosis
gcacaggggcgcgu

SEQ ID NO: 932298 - RNA, 14 nt, Mycobacterium avium subsp. paratuberculosis
gcacaggucgaugg

SEQ ID NO: 932299 - RNA, 15 nt, Mycobacterium avium subsp. paratuberculosis
gcacacgggcccguc

SEQ ID NO: 932300 - RNA, 23 nt, Mycobacterium avium subsp. paratuberculosis
gcacacgaucucguagguggcca

SEQ ID NO: 932301 - RNA, 23 nt, Mycobacterium avium subsp. paratuberculosis
gcacacgcgguccacuuccgcgc

SEQ ID NO: 932302 - RNA, 15 nt, Mycobacterium avium subsp. paratuberculosis
gcacacggccucgcc

SEQ ID NO: 932303 - RNA, 17 nt, Mycobacterium avium subsp. paratuberculosis
gcacagcgaggcgacgu

SEQ ID NO: 932304 - RNA, 23 nt, Mycobacterium avium subsp. paratuberculosis
gcacagcgaggcgacgucgaacg

SEQ ID NO: 932305 - RNA, 18 nt, Mycobacterium avium subsp. paratuberculosis
gcacagccggcgcgcggu

SEQ ID NO: 932306 - RNA, 21 nt, Mycobacterium avium subsp. paratuberculosis
gcacagccggcgcgcgguggu

SEQ ID NO: 932307 - RNA, 13 nt, Mycobacterium avium subsp. paratuberculosis
gcacagccggcgg

SEQ ID NO: 932308 - RNA, 15 nt, Mycobacterium avium subsp. paratuberculosis
gcacagccggcggcg

SEQ ID NO: 932309 - RNA, 23 nt, Mycobacterium avium subsp. paratuberculosis
gcacagccggcggcggcggucgg

SEQ ID NO: 932310 - RNA, 19 nt, Mycobacterium avium subsp. paratuberculosis
gcacaccguucccaccggc

SEQ ID NO: 932311 - RNA, 20 nt, Mycobacterium avium subsp. paratuberculosis
gcacaccguucccaccggcu

SEQ ID NO: 932312 - RNA, 15 nt, Mycobacterium avium subsp. paratuberculosis
gcacaccuuccacca

SEQ ID NO: 932313 - RNA, 18 nt, Mycobacterium avium subsp. paratuberculosis
gcacaccuuccaccaccg

SEQ ID NO: 932314 - RNA, 20 nt, Mycobacterium avium subsp. paratuberculosis
gcacaccuuccaccaccgcg

SEQ ID NO: 932315 - RNA, 21 nt, Mycobacterium avium subsp. paratuberculosis
gcacaccuuccaccaccgcgg

SEQ ID NO: 932316 - RNA, 18 nt, Mycobacterium avium subsp. paratuberculosis
gcacacgaacaccggcgg

SEQ ID NO: 932317 - RNA, 14 nt, Mycobacterium avium subsp. paratuberculosis
gcacaccaccagcg

SEQ ID NO: 932318 - RNA, 16 nt, Mycobacterium avium subsp. paratuberculosis
gcacaccaccagcgag

SEQ ID NO: 932319 - RNA, 15 nt, Mycobacterium avium subsp. paratuberculosis
gcacaccgucgcccg

SEQ ID NO: 932320 - RNA, 17 nt, Mycobacterium avium subsp. paratuberculosis
gcacaccgucgcccgcc

SEQ ID NO: 932321 - RNA, 15 nt, Mycobacterium avium subsp. paratuberculosis
gcaccggaucgacca

SEQ ID NO: 932322 - RNA, 15 nt, Mycobacterium avium subsp. paratuberculosis
gcaccggaccgccga

SEQ ID NO: 932323 - RNA, 17 nt, Mycobacterium avium subsp. paratuberculosis
gcaccggaccgccgaga

SEQ ID NO: 932324 - RNA, 16 nt, Mycobacterium avium subsp. paratuberculosis
gcaccggacgcagcga

SEQ ID NO: 932325 - RNA, 15 nt, Mycobacterium avium subsp. paratuberculosis
gcaccggagccuugg

SEQ ID NO: 932326 - RNA, 19 nt, Mycobacterium avium subsp. paratuberculosis
gcaccggagccuuggucgc

SEQ ID NO: 932327 - RNA, 17 nt, Mycobacterium avium subsp. paratuberculosis
gcaccggaugcucaccg

SEQ ID NO: 932328 - RNA, 19 nt, Mycobacterium avium subsp. paratuberculosis
gcaccggcacgucgagcuc

SEQ ID NO: 932329 - RNA, 16 nt, Mycobacterium avium subsp. paratuberculosis
gcaccggcaccgccag

SEQ ID NO: 932330 - RNA, 17 nt, Mycobacterium avium subsp. paratuberculosis
gcaccggcaccgccagc

SEQ ID NO: 932331 - RNA, 18 nt, Mycobacterium avium subsp. paratuberculosis
gcaccggcaccgccagcc

SEQ ID NO: 932332 - RNA, 19 nt, Mycobacterium avium subsp. paratuberculosis
gcaccggcaccgcggcgau

SEQ ID NO: 932333 - RNA, 20 nt, Mycobacterium avium subsp. paratuberculosis
gcaccggcaccgcggcgaug

SEQ ID NO: 932334 - RNA, 15 nt, Mycobacterium avium subsp. paratuberculosis
gcaccgcugccggcc

SEQ ID NO: 932335 - RNA, 15 nt, Mycobacterium avium subsp. paratuberculosis
gcaccgcgucggcgc

SEQ ID NO: 932336 - RNA, 16 nt, Mycobacterium avium subsp. paratuberculosis
gcaccgcgucggcgcu

SEQ ID NO: 932337 - RNA, 20 nt, Mycobacterium avium subsp. paratuberculosis
gcaccgcgucggcgcuggcc

SEQ ID NO: 932338 - RNA, 12 nt, Mycobacterium avium subsp. paratuberculosis
gcaccgcgucgu

SEQ ID NO: 932339 - RNA, 16 nt, Mycobacterium avium subsp. paratuberculosis
gcaccgcggucugcgc

SEQ ID NO: 932340 - RNA, 17 nt, Mycobacterium avium subsp. paratuberculosis
gcaccgcggucugcgcc

SEQ ID NO: 932341 - RNA, 21 nt, Mycobacterium avium subsp. paratuberculosis
gcaccgcggucugcgccagcu

SEQ ID NO: 932342 - RNA, 12 nt, Mycobacterium avium subsp. paratuberculosis
gcaccgcguccg

SEQ ID NO: 932343 - RNA, 21 nt, Mycobacterium avium subsp. paratuberculosis
gcaccgcguccgcgucgucga

SEQ ID NO: 932344 - RNA, 12 nt, Mycobacterium avium subsp. paratuberculosis
gcaccgcgucga

SEQ ID NO: 932345 - RNA, 18 nt, Mycobacterium avium subsp. paratuberculosis
gcaccgcgucgaccaccg

SEQ ID NO: 932346 - RNA, 21 nt, Mycobacterium avium subsp. paratuberculosis
gcaccgcgucgaccaccgccg

SEQ ID NO: 932347 - RNA, 23 nt, Mycobacterium avium subsp. paratuberculosis
gcaccgcgucgaccaccgccggc

SEQ ID NO: 932348 - RNA, 14 nt, Mycobacterium avium subsp. paratuberculosis
gcaccgcgucgaug

SEQ ID NO: 932349 - RNA, 15 nt, Mycobacterium avium subsp. paratuberculosis
gcaccgcgucgaugc

SEQ ID NO: 932350 - RNA, 17 nt, Mycobacterium avium subsp. paratuberculosis
gcaccgcgucgaugcgg

SEQ ID NO: 932351 - RNA, 16 nt, Mycobacterium avium subsp. paratuberculosis
gcaccgcgucgauguc

SEQ ID NO: 932352 - RNA, 20 nt, Mycobacterium avium subsp. paratuberculosis
gcaccgcgucgaugucgucg

SEQ ID NO: 932353 - RNA, 15 nt, Mycobacterium avium subsp. paratuberculosis
gcaccgccucggcca

SEQ ID NO: 932354 - RNA, 18 nt, Mycobacterium avium subsp. paratuberculosis
gcaccgccucggccaccu

SEQ ID NO: 932355 - RNA, 16 nt, Mycobacterium avium subsp. paratuberculosis
gcaccgccgucccguc

SEQ ID NO: 932356 - RNA, 14 nt, Mycobacterium avium subsp. paratuberculosis
gcaccgccgucggg

SEQ ID NO: 932357 - RNA, 22 nt, Mycobacterium avium subsp. paratuberculosis
gcaccgccgucggggcgucggc

SEQ ID NO: 932358 - RNA, 24 nt, Mycobacterium avium subsp. paratuberculosis
gcaccgccgucggggcgucggcgg

SEQ ID NO: 932359 - RNA, 20 nt, Mycobacterium avium subsp. paratuberculosis
gcaccgccggcgccgucgau

SEQ ID NO: 932360 - RNA, 21 nt, Mycobacterium avium subsp. paratuberculosis
gcaccgccggcggccuccgcc

SEQ ID NO: 932361 - RNA, 18 nt, Mycobacterium avium subsp. paratuberculosis
gcaccgccgggcauccgg

SEQ ID NO: 932362 - RNA, 19 nt, Mycobacterium avium subsp. paratuberculosis
gcaccgccuccucgauguc

SEQ ID NO: 932363 - RNA, 17 nt, Mycobacterium avium subsp. paratuberculosis
gcaccgcgaaacgcaac

SEQ ID NO: 932364 - RNA, 16 nt, Mycobacterium avium subsp. paratuberculosis
gcaccgcgaacaucgc

SEQ ID NO: 932365 - RNA, 21 nt, Mycobacterium avium subsp. paratuberculosis
gcaccgcgaacaucgccagca

SEQ ID NO: 932366 - RNA, 21 nt, Mycobacterium avium subsp. paratuberculosis
gcaccgcgaccacgccgcggu

SEQ ID NO: 932367 - RNA, 18 nt, Mycobacterium avium subsp. paratuberculosis
gcaccgcgaccagcucgg

SEQ ID NO: 932368 - RNA, 17 nt, Mycobacterium avium subsp. paratuberculosis
gcaccgcgacgaucgcg

SEQ ID NO: 932369 - RNA, 15 nt, Mycobacterium avium subsp. paratuberculosis
gcaccgcgagcaccg

SEQ ID NO: 932370 - RNA, 19 nt, Mycobacterium avium subsp. paratuberculosis
gcaccgcgggcacggcgau

SEQ ID NO: 932371 - RNA, 18 nt, Mycobacterium avium subsp. paratuberculosis
gcaccgcgggggcggccg

SEQ ID NO: 932372 - RNA, 21 nt, Mycobacterium avium subsp. paratuberculosis
gcaccgccugggucucgggau

SEQ ID NO: 932373 - RNA, 21 nt, Mycobacterium avium subsp. paratuberculosis
gcaccgccugugcgacggcgu

SEQ ID NO: 932374 - RNA, 23 nt, Mycobacterium avium subsp. paratuberculosis
gcaccgccugugcgacggcgucg

SEQ ID NO: 932375 - RNA, 19 nt, Mycobacterium avium subsp. paratuberculosis
gcaccgcgacccaggccgc

SEQ ID NO: 932376 - RNA, 14 nt, Mycobacterium avium subsp. paratuberculosis
gcaccgcgaccggu

SEQ ID NO: 932377 - RNA, 15 nt, Mycobacterium avium subsp. paratuberculosis
gcaccgcgaucaccg

SEQ ID NO: 932378 - RNA, 23 nt, Mycobacterium avium subsp. paratuberculosis
gcaccgcgaucaccgagauggcc

SEQ ID NO: 932379 - RNA, 16 nt, Mycobacterium avium subsp. paratuberculosis
gcaccgcgaucgccga

SEQ ID NO: 932380 - RNA, 17 nt, Mycobacterium avium subsp. paratuberculosis
gcaccgcgaucugcucg

SEQ ID NO: 932381 - RNA, 19 nt, Mycobacterium avium subsp. paratuberculosis
gcaccgcgaucugcucggu

SEQ ID NO: 932382 - RNA, 13 nt, Mycobacterium avium subsp. paratuberculosis
gcaccgcgauggc

SEQ ID NO: 932383 - RNA, 16 nt, Mycobacterium avium subsp. paratuberculosis
gcaccgcgauggcccg

SEQ ID NO: 932384 - RNA, 14 nt, Mycobacterium avium subsp. paratuberculosis
gcaccgccggcgcc

SEQ ID NO: 932385 - RNA, 14 nt, Mycobacterium avium subsp. paratuberculosis
gcaccgccgcgcgg

SEQ ID NO: 932386 - RNA, 15 nt, Mycobacterium avium subsp. paratuberculosis
gcaccgccgcgcggc

SEQ ID NO: 932387 - RNA, 14 nt, Mycobacterium avium subsp. paratuberculosis
gcaccgccgcggcc

SEQ ID NO: 932388 - RNA, 15 nt, Mycobacterium avium subsp. paratuberculosis
gcaccgccgcggccg

SEQ ID NO: 932389 - RNA, 17 nt, Mycobacterium avium subsp. paratuberculosis
gcaccgccgcggccgcg

SEQ ID NO: 932390 - RNA, 18 nt, Mycobacterium avium subsp. paratuberculosis
gcaccgccgcggccgcga

SEQ ID NO: 932391 - RNA, 19 nt, Mycobacterium avium subsp. paratuberculosis
gcaccgccgcggccgcgau

SEQ ID NO: 932392 - RNA, 14 nt, Mycobacterium avium subsp. paratuberculosis
gcaccgccgcgggc

SEQ ID NO: 932393 - RNA, 22 nt, Mycobacterium avium subsp. paratuberculosis
gcaccgcccgcgcgaugcgggc

SEQ ID NO: 932394 - RNA, 15 nt, Mycobacterium avium subsp. paratuberculosis
gcaccgcccgcggug

SEQ ID NO: 932395 - RNA, 17 nt, Mycobacterium avium subsp. paratuberculosis
gcaccgcccgcggugug

SEQ ID NO: 932396 - RNA, 15 nt, Mycobacterium avium subsp. paratuberculosis
gcaccgccgacaucg

SEQ ID NO: 932397 - RNA, 21 nt, Mycobacterium avium subsp. paratuberculosis
gcaccgccgacaucgcccggu

SEQ ID NO: 932398 - RNA, 18 nt, Mycobacterium avium subsp. paratuberculosis
gcaccgccgagccgucgu

SEQ ID NO: 932399 - RNA, 22 nt, Mycobacterium avium subsp. paratuberculosis
gcaccgccgagccgucgucgcu

SEQ ID NO: 932400 - RNA, 22 nt, Mycobacterium avium subsp. paratuberculosis
gcaccgauaguagccagcaucg

SEQ ID NO: 932401 - RNA, 15 nt, Mycobacterium avium subsp. paratuberculosis
gcaccgaucggcacg

SEQ ID NO: 932402 - RNA, 20 nt, Mycobacterium avium subsp. paratuberculosis
gcaccgaucggcacgucgag

SEQ ID NO: 932403 - RNA, 18 nt, Mycobacterium avium subsp. paratuberculosis
gcaccgauggguuggccg

SEQ ID NO: 932404 - RNA, 20 nt, Mycobacterium avium subsp. paratuberculosis
gcaccgcaaagcaccgcgaa

SEQ ID NO: 932405 - RNA, 15 nt, Mycobacterium avium subsp. paratuberculosis
gcaccgcaacguugu

SEQ ID NO: 932406 - RNA, 23 nt, Mycobacterium avium subsp. paratuberculosis
gcaccgccccggucaccccggcc

SEQ ID NO: 932407 - RNA, 23 nt, Mycobacterium avium subsp. paratuberculosis
gcaccgagaucucgucgaugggc

SEQ ID NO: 932408 - RNA, 22 nt, Mycobacterium avium subsp. paratuberculosis
gcacccgggccuugacggccug

SEQ ID NO: 932409 - RNA, 23 nt, Mycobacterium avium subsp. paratuberculosis
gcacccgggccuuguugcggcgc

SEQ ID NO: 932410 - RNA, 17 nt, Mycobacterium avium subsp. paratuberculosis
gcacccgggcgacaugc

SEQ ID NO: 932411 - RNA, 21 nt, Mycobacterium avium subsp. paratuberculosis
gcacccgggugaucaacgcgg

SEQ ID NO: 932412 - RNA, 17 nt, Mycobacterium avium subsp. paratuberculosis
gcacccgggugcccggc

SEQ ID NO: 932413 - RNA, 23 nt, Mycobacterium avium subsp. paratuberculosis
gcacccgggugcccggcugggcg

SEQ ID NO: 932414 - RNA, 20 nt, Mycobacterium avium subsp. paratuberculosis
gcacccggguggacaccgcg

SEQ ID NO: 932415 - RNA, 22 nt, Mycobacterium avium subsp. paratuberculosis
gcacccggguggacaccgcgau

SEQ ID NO: 932416 - RNA, 19 nt, Mycobacterium avium subsp. paratuberculosis
gcacccgggcgcgacgguc

SEQ ID NO: 932417 - RNA, 13 nt, Mycobacterium avium subsp. paratuberculosis
gcacccggucgcc

SEQ ID NO: 932418 - RNA, 18 nt, Mycobacterium avium subsp. paratuberculosis
gcacccgguuccaccggg

SEQ ID NO: 932419 - RNA, 21 nt, Mycobacterium avium subsp. paratuberculosis
gcacccgguuccaccgggccg

SEQ ID NO: 932420 - RNA, 23 nt, Mycobacterium avium subsp. paratuberculosis
gcacccgguuccaccgggccgcc

SEQ ID NO: 932421 - RNA, 19 nt, Mycobacterium avium subsp. paratuberculosis
gcaccgagaccaugccgcc

SEQ ID NO: 932422 - RNA, 21 nt, Mycobacterium avium subsp. paratuberculosis
gcaccgagaccaugccgccga

SEQ ID NO: 932423 - RNA, 13 nt, Mycobacterium avium subsp. paratuberculosis
gcacccggccggc

SEQ ID NO: 932424 - RNA, 16 nt, Mycobacterium avium subsp. paratuberculosis
gcacccggcccacgcc

SEQ ID NO: 932425 - RNA, 20 nt, Mycobacterium avium subsp. paratuberculosis
gcacccggcccacgccgucg

SEQ ID NO: 932426 - RNA, 17 nt, Mycobacterium avium subsp. paratuberculosis
gcacccgauccacggcg

SEQ ID NO: 932427 - RNA, 21 nt, Mycobacterium avium subsp. paratuberculosis
gcacccggacgugaucgcggu

SEQ ID NO: 932428 - RNA, 22 nt, Mycobacterium avium subsp. paratuberculosis
gcacccggacgugaucgcggug

SEQ ID NO: 932429 - RNA, 23 nt, Mycobacterium avium subsp. paratuberculosis
gcacccggacgugaucgcggugg

SEQ ID NO: 932430 - RNA, 15 nt, Mycobacterium avium subsp. paratuberculosis
gcacccggcgcggcc

SEQ ID NO: 932431 - RNA, 16 nt, Mycobacterium avium subsp. paratuberculosis
gcacccggcgcggccg

SEQ ID NO: 932432 - RNA, 18 nt, Mycobacterium avium subsp. paratuberculosis
gcacccggcgcggccgcc

SEQ ID NO: 932433 - RNA, 13 nt, Mycobacterium avium subsp. paratuberculosis
gcacccggcccua

SEQ ID NO: 932434 - RNA, 22 nt, Mycobacterium avium subsp. paratuberculosis
gcacccgggccugcggcggccg

SEQ ID NO: 932435 - RNA, 21 nt, Mycobacterium avium subsp. paratuberculosis
gcacccgcaacaccacgucgg

SEQ ID NO: 932436 - RNA, 17 nt, Mycobacterium avium subsp. paratuberculosis
gcacccgcaacgcgcgc

SEQ ID NO: 932437 - RNA, 14 nt, Mycobacterium avium subsp. paratuberculosis
gcacccgacuucgg

SEQ ID NO: 932438 - RNA, 15 nt, Mycobacterium avium subsp. paratuberculosis
gcacccgacuucggc

SEQ ID NO: 932439 - RNA, 18 nt, Mycobacterium avium subsp. paratuberculosis
gcacccgacuucggcucg

SEQ ID NO: 932440 - RNA, 22 nt, Mycobacterium avium subsp. paratuberculosis
gcacccgacuucggcucggcga

SEQ ID NO: 932441 - RNA, 12 nt, Mycobacterium avium subsp. paratuberculosis
gcacccgacacg

SEQ ID NO: 932442 - RNA, 18 nt, Mycobacterium avium subsp. paratuberculosis
gcacccgacacgccgauc

SEQ ID NO: 932443 - RNA, 15 nt, Mycobacterium avium subsp. paratuberculosis
gcacccgaccgacgc

SEQ ID NO: 932444 - RNA, 17 nt, Mycobacterium avium subsp. paratuberculosis
gcacccgaccgacgccc

SEQ ID NO: 932445 - RNA, 21 nt, Mycobacterium avium subsp. paratuberculosis
gcacccgacgucgacgcgggc

SEQ ID NO: 932446 - RNA, 22 nt, Mycobacterium avium subsp. paratuberculosis
gcacccgacgucgacgcgggcg

SEQ ID NO: 932447 - RNA, 13 nt, Mycobacterium avium subsp. paratuberculosis
gcaccccguugcc

SEQ ID NO: 932448 - RNA, 19 nt, Mycobacterium avium subsp. paratuberculosis
gcaccccguugccgccggc

SEQ ID NO: 932449 - RNA, 20 nt, Mycobacterium avium subsp. paratuberculosis
gcaccccguugccgccggcg

SEQ ID NO: 932450 - RNA, 15 nt, Mycobacterium avium subsp. paratuberculosis
gcaccccugccgcca

SEQ ID NO: 932451 - RNA, 17 nt, Mycobacterium avium subsp. paratuberculosis
gcaccccugccgccacc

SEQ ID NO: 932452 - RNA, 18 nt, Mycobacterium avium subsp. paratuberculosis
gcaccccugccgccaccg

SEQ ID NO: 932453 - RNA, 22 nt, Mycobacterium avium subsp. paratuberculosis
gcaccccugccgccaccgcgaa

SEQ ID NO: 932454 - RNA, 15 nt, Mycobacterium avium subsp. paratuberculosis
gcaccccgcgccggg

SEQ ID NO: 932455 - RNA, 16 nt, Mycobacterium avium subsp. paratuberculosis
gcaccccgcgccgggc

SEQ ID NO: 932456 - RNA, 20 nt, Mycobacterium avium subsp. paratuberculosis
gcaccccgcggucggcggcg

SEQ ID NO: 932457 - RNA, 13 nt, Mycobacterium avium subsp. paratuberculosis
gcaccccggcaua

SEQ ID NO: 932458 - RNA, 14 nt, Mycobacterium avium subsp. paratuberculosis
gcaccccggcggcc

SEQ ID NO: 932459 - RNA, 15 nt, Mycobacterium avium subsp. paratuberculosis
gcaccccggcggccg

SEQ ID NO: 932460 - RNA, 17 nt, Mycobacterium avium subsp. paratuberculosis
gcaccccggucaccggu

SEQ ID NO: 932461 - RNA, 21 nt, Mycobacterium avium subsp. paratuberculosis
gcaccccgucgagcagccgca

SEQ ID NO: 932462 - RNA, 14 nt, Mycobacterium avium subsp. paratuberculosis
gcaccccgucgagg

SEQ ID NO: 932463 - RNA, 17 nt, Mycobacterium avium subsp. paratuberculosis
gcaccccgucgcggacc

SEQ ID NO: 932464 - RNA, 12 nt, Mycobacterium avium subsp. paratuberculosis
gcaccccguggu

SEQ ID NO: 932465 - RNA, 23 nt, Mycobacterium avium subsp. paratuberculosis
gcaccccgugguagacgccggac

SEQ ID NO: 932466 - RNA, 16 nt, Mycobacterium avium subsp. paratuberculosis
gcacccaccggcccag

SEQ ID NO: 932467 - RNA, 13 nt, Mycobacterium avium subsp. paratuberculosis
gcacccaccggcg

SEQ ID NO: 932468 - RNA, 15 nt, Mycobacterium avium subsp. paratuberculosis
gcacccacgccagcc

SEQ ID NO: 932469 - RNA, 22 nt, Mycobacterium avium subsp. paratuberculosis
gcacccacgccagccggguggc

SEQ ID NO: 932470 - RNA, 16 nt, Mycobacterium avium subsp. paratuberculosis
gcaccaucgcgaugga

SEQ ID NO: 932471 - RNA, 17 nt, Mycobacterium avium subsp. paratuberculosis
gcaccaggucguugccg

SEQ ID NO: 932472 - RNA, 18 nt, Mycobacterium avium subsp. paratuberculosis
gcaccagguggcccgacc

SEQ ID NO: 932473 - RNA, 21 nt, Mycobacterium avium subsp. paratuberculosis
gcaccagguggcccgacccgu

SEQ ID NO: 932474 - RNA, 18 nt, Mycobacterium avium subsp. paratuberculosis
gcaccagguucacgucgg

SEQ ID NO: 932475 - RNA, 22 nt, Mycobacterium avium subsp. paratuberculosis
gcaccagguucacgucggggau

SEQ ID NO: 932476 - RNA, 23 nt, Mycobacterium avium subsp. paratuberculosis
gcaccagggcguguugcaggcgg

SEQ ID NO: 932477 - RNA, 21 nt, Mycobacterium avium subsp. paratuberculosis
gcaccagggucuucagcccgc

SEQ ID NO: 932478 - RNA, 13 nt, Mycobacterium avium subsp. paratuberculosis
gcaccaggguguc

SEQ ID NO: 932479 - RNA, 19 nt, Mycobacterium avium subsp. paratuberculosis
gcaccagggugucgucgcg

SEQ ID NO: 932480 - RNA, 22 nt, Mycobacterium avium subsp. paratuberculosis
gcaccagggugucgucgcgcac

SEQ ID NO: 932481 - RNA, 16 nt, Mycobacterium avium subsp. paratuberculosis
gcaccagguaccggcg

SEQ ID NO: 932482 - RNA, 17 nt, Mycobacterium avium subsp. paratuberculosis
gcaccagguaccggcgg

SEQ ID NO: 932483 - RNA, 19 nt, Mycobacterium avium subsp. paratuberculosis
gcaccagguaccggcgggc

SEQ ID NO: 932484 - RNA, 20 nt, Mycobacterium avium subsp. paratuberculosis
gcaccagguaccggcgggcg

SEQ ID NO: 932485 - RNA, 15 nt, Mycobacterium avium subsp. paratuberculosis
gcaccagguaggugg

SEQ ID NO: 932486 - RNA, 18 nt, Mycobacterium avium subsp. paratuberculosis
gcaccagguagguggccg

SEQ ID NO: 932487 - RNA, 20 nt, Mycobacterium avium subsp. paratuberculosis
gcaccaggcugaccagcgcc

SEQ ID NO: 932488 - RNA, 18 nt, Mycobacterium avium subsp. paratuberculosis
gcaccagggccugcagca

SEQ ID NO: 932489 - RNA, 20 nt, Mycobacterium avium subsp. paratuberculosis
gcaccagggccugcagcacc

SEQ ID NO: 932490 - RNA, 21 nt, Mycobacterium avium subsp. paratuberculosis
gcaccagggccugcagcacca

SEQ ID NO: 932491 - RNA, 22 nt, Mycobacterium avium subsp. paratuberculosis
gcaccagggccugcagcaccag

SEQ ID NO: 932492 - RNA, 24 nt, Mycobacterium avium subsp. paratuberculosis
gcaccagggccugcagcaccaggc

SEQ ID NO: 932493 - RNA, 14 nt, Mycobacterium avium subsp. paratuberculosis
gcaccaggaaggcg

SEQ ID NO: 932494 - RNA, 18 nt, Mycobacterium avium subsp. paratuberculosis
gcaccaggaaggcgaccg

SEQ ID NO: 932495 - RNA, 17 nt, Mycobacterium avium subsp. paratuberculosis
gcaccaggacgcgaccg

SEQ ID NO: 932496 - RNA, 22 nt, Mycobacterium avium subsp. paratuberculosis
gcaccaggacgcgaccggccau

SEQ ID NO: 932497 - RNA, 17 nt, Mycobacterium avium subsp. paratuberculosis
gcaccaggcccucgccg

SEQ ID NO: 932498 - RNA, 19 nt, Mycobacterium avium subsp. paratuberculosis
gcaccaggcccucgccgcg

SEQ ID NO: 932499 - RNA, 20 nt, Mycobacterium avium subsp. paratuberculosis
gcaccaggcccucgccgcgg

SEQ ID NO: 932500 - RNA, 20 nt, Mycobacterium avium subsp. paratuberculosis
gcaccagcugauucgcggug

SEQ ID NO: 932501 - RNA, 14 nt, Mycobacterium avium subsp. paratuberculosis
gcaccaggcgccac

SEQ ID NO: 932502 - RNA, 17 nt, Mycobacterium avium subsp. paratuberculosis
gcaccaggcgccacagc

SEQ ID NO: 932503 - RNA, 20 nt, Mycobacterium avium subsp. paratuberculosis
gcaccaggcgccacagcagc

SEQ ID NO: 932504 - RNA, 23 nt, Mycobacterium avium subsp. paratuberculosis
gcaccaggcgccacagcagcacc

SEQ ID NO: 932505 - RNA, 21 nt, Mycobacterium avium subsp. paratuberculosis
gcaccaggccgacgcuggccg

SEQ ID NO: 932506 - RNA, 15 nt, Mycobacterium avium subsp. paratuberculosis
gcaccaggcgcacca

SEQ ID NO: 932507 - RNA, 18 nt, Mycobacterium avium subsp. paratuberculosis
gcaccaggcgcaccagcu

SEQ ID NO: 932508 - RNA, 19 nt, Mycobacterium avium subsp. paratuberculosis
gcaccaggcgcaccagcug

SEQ ID NO: 932509 - RNA, 15 nt, Mycobacterium avium subsp. paratuberculosis
gcaccagcgucgacg

SEQ ID NO: 932510 - RNA, 17 nt, Mycobacterium avium subsp. paratuberculosis
gcaccagcgucgacgcg

SEQ ID NO: 932511 - RNA, 20 nt, Mycobacterium avium subsp. paratuberculosis
gcaccagcguggugcgcccg

SEQ ID NO: 932512 - RNA, 21 nt, Mycobacterium avium subsp. paratuberculosis
gcaccagcguggugcgcccgu

SEQ ID NO: 932513 - RNA, 18 nt, Mycobacterium avium subsp. paratuberculosis
gcaccagcucgaggccgc

SEQ ID NO: 932514 - RNA, 23 nt, Mycobacterium avium subsp. paratuberculosis
gcaccagcucgaggccgcgggcg

SEQ ID NO: 932515 - RNA, 15 nt, Mycobacterium avium subsp. paratuberculosis
gcaccagcucggcgc

SEQ ID NO: 932516 - RNA, 17 nt, Mycobacterium avium subsp. paratuberculosis
gcaccagcucggcgcug

SEQ ID NO: 932517 - RNA, 13 nt, Mycobacterium avium subsp. paratuberculosis
gcaccagcucggu

SEQ ID NO: 932518 - RNA, 18 nt, Mycobacterium avium subsp. paratuberculosis
gcaccagcggcaucgccg

SEQ ID NO: 932519 - RNA, 20 nt, Mycobacterium avium subsp. paratuberculosis
gcaccagcggcaucgccgcc

SEQ ID NO: 932520 - RNA, 15 nt, Mycobacterium avium subsp. paratuberculosis
gcaccagcggcgccc

SEQ ID NO: 932521 - RNA, 20 nt, Mycobacterium avium subsp. paratuberculosis
gcaccagcggcgcccacggc

SEQ ID NO: 932522 - RNA, 21 nt, Mycobacterium avium subsp. paratuberculosis
gcaccagcggacccuucagcc

SEQ ID NO: 932523 - RNA, 16 nt, Mycobacterium avium subsp. paratuberculosis
gcaccagcgcgcgggu

SEQ ID NO: 932524 - RNA, 17 nt, Mycobacterium avium subsp. paratuberculosis
gcaccagcgcgcgggug

SEQ ID NO: 932525 - RNA, 12 nt, Mycobacterium avium subsp. paratuberculosis
gcaccagcgccg

SEQ ID NO: 932526 - RNA, 13 nt, Mycobacterium avium subsp. paratuberculosis
gcaccagcgcgac

SEQ ID NO: 932527 - RNA, 14 nt, Mycobacterium avium subsp. paratuberculosis
gcaccagcgcgacg

SEQ ID NO: 932528 - RNA, 16 nt, Mycobacterium avium subsp. paratuberculosis
gcaccagcgcgacggu

SEQ ID NO: 932529 - RNA, 13 nt, Mycobacterium avium subsp. paratuberculosis
gcaccagcgccgc

SEQ ID NO: 932530 - RNA, 14 nt, Mycobacterium avium subsp. paratuberculosis
gcaccagcgccgcg

SEQ ID NO: 932531 - RNA, 15 nt, Mycobacterium avium subsp. paratuberculosis
gcaccagcgccgcga

SEQ ID NO: 932532 - RNA, 16 nt, Mycobacterium avium subsp. paratuberculosis
gcaccagcgauccggc

SEQ ID NO: 932533 - RNA, 19 nt, Mycobacterium avium subsp. paratuberculosis
gcaccagcgauccggcgcg

SEQ ID NO: 932534 - RNA, 18 nt, Mycobacterium avium subsp. paratuberculosis
gcaccagcgacagcaccc

SEQ ID NO: 932535 - RNA, 19 nt, Mycobacterium avium subsp. paratuberculosis
gcaccagcgacagcacccg

SEQ ID NO: 932536 - RNA, 21 nt, Mycobacterium avium subsp. paratuberculosis
gcaccagcagccgcagcgcgc

SEQ ID NO: 932537 - RNA, 15 nt, Mycobacterium avium subsp. paratuberculosis
gcaccagcagccggu

SEQ ID NO: 932538 - RNA, 15 nt, Mycobacterium avium subsp. paratuberculosis
gcaccagcagcgcga

SEQ ID NO: 932539 - RNA, 17 nt, Mycobacterium avium subsp. paratuberculosis
gcaccagcagcgcgacg

SEQ ID NO: 932540 - RNA, 15 nt, Mycobacterium avium subsp. paratuberculosis
gcaccagcaggcccc

SEQ ID NO: 932541 - RNA, 22 nt, Mycobacterium avium subsp. paratuberculosis
gcaccagcaggccccguucggu

SEQ ID NO: 932542 - RNA, 19 nt, Mycobacterium avium subsp. paratuberculosis
gcaccagcccgaugccgcc

SEQ ID NO: 932543 - RNA, 22 nt, Mycobacterium avium subsp. paratuberculosis
gcaccagcccgaugccgccgag

SEQ ID NO: 932544 - RNA, 13 nt, Mycobacterium avium subsp. paratuberculosis
gcaccagcccgcc

SEQ ID NO: 932545 - RNA, 18 nt, Mycobacterium avium subsp. paratuberculosis
gcaccagcccgccgucgg

SEQ ID NO: 932546 - RNA, 21 nt, Mycobacterium avium subsp. paratuberculosis
gcaccagcccgccgucggcau

SEQ ID NO: 932547 - RNA, 14 nt, Mycobacterium avium subsp. paratuberculosis
gcaccagcccggcc

SEQ ID NO: 932548 - RNA, 17 nt, Mycobacterium avium subsp. paratuberculosis
gcaccagcccggccagc

SEQ ID NO: 932549 - RNA, 16 nt, Mycobacterium avium subsp. paratuberculosis
gcaccagcccgucggc

SEQ ID NO: 932550 - RNA, 20 nt, Mycobacterium avium subsp. paratuberculosis
gcaccagcagccagcccagc

SEQ ID NO: 932551 - RNA, 14 nt, Mycobacterium avium subsp. paratuberculosis
gcaccagcacggcg

SEQ ID NO: 932552 - RNA, 16 nt, Mycobacterium avium subsp. paratuberculosis
gcaccagcacggcgac

SEQ ID NO: 932553 - RNA, 18 nt, Mycobacterium avium subsp. paratuberculosis
gcaccagcaccaccgugg

SEQ ID NO: 932554 - RNA, 14 nt, Mycobacterium avium subsp. paratuberculosis
gcaccagcaccccg

SEQ ID NO: 932555 - RNA, 16 nt, Mycobacterium avium subsp. paratuberculosis
gcaccagcaccccgcc

SEQ ID NO: 932556 - RNA, 17 nt, Mycobacterium avium subsp. paratuberculosis
gcaccagcacgacaccg

SEQ ID NO: 932557 - RNA, 18 nt, Mycobacterium avium subsp. paratuberculosis
gcaccagcacgacaccga

SEQ ID NO: 932558 - RNA, 24 nt, Mycobacterium avium subsp. paratuberculosis
gcaccagcacgacaccgacgacca

SEQ ID NO: 932559 - RNA, 16 nt, Mycobacterium avium subsp. paratuberculosis
gccgagcagagcuacg

SEQ ID NO: 932560 - RNA, 21 nt, Mycobacterium avium subsp. paratuberculosis
aagauggccagcgcggcguca

SEQ ID NO: 932561 - RNA, 19 nt, Mycobacterium avium subsp. paratuberculosis
aagauggucgcgccgcggc

SEQ ID NO: 932562 - RNA, 15 nt, Mycobacterium avium subsp. paratuberculosis
gccgagccgcaccgc

SEQ ID NO: 932563 - RNA, 16 nt, Mycobacterium avium subsp. paratuberculosis
gccgagcagcaccgcg

SEQ ID NO: 932564 - RNA, 19 nt, Mycobacterium avium subsp. paratuberculosis
gccgagcagcaccgcgacc

SEQ ID NO: 932565 - RNA, 17 nt, Mycobacterium avium subsp. paratuberculosis
gccgagcagcaccggca

SEQ ID NO: 932566 - RNA, 12 nt, Mycobacterium avium subsp. paratuberculosis
gccgagcagccg

SEQ ID NO: 932567 - RNA, 15 nt, Mycobacterium avium subsp. paratuberculosis
gccgagcagccgggc

SEQ ID NO: 932568 - RNA, 17 nt, Mycobacterium avium subsp. paratuberculosis
gccgagcagccgggcca

SEQ ID NO: 932569 - RNA, 19 nt, Mycobacterium avium subsp. paratuberculosis
gccgagcagccgggccagc

SEQ ID NO: 932570 - RNA, 22 nt, Mycobacterium avium subsp. paratuberculosis
gccgagcagccgggccagcaac

SEQ ID NO: 932571 - RNA, 17 nt, Mycobacterium avium subsp. paratuberculosis
gccgagcagccggucca

SEQ ID NO: 932572 - RNA, 20 nt, Mycobacterium avium subsp. paratuberculosis
gccgagcagccgguccaugu

SEQ ID NO: 932573 - RNA, 14 nt, Mycobacterium avium subsp. paratuberculosis
aagauguugcggcg

SEQ ID NO: 932574 - RNA, 13 nt, Mycobacterium avium subsp. paratuberculosis
gccgacggccgcg

SEQ ID NO: 932575 - RNA, 15 nt, Mycobacterium avium subsp. paratuberculosis
gccgacggccgcgcc

SEQ ID NO: 932576 - RNA, 16 nt, Mycobacterium avium subsp. paratuberculosis
gccgacggccgcgccg

SEQ ID NO: 932577 - RNA, 14 nt, Mycobacterium avium subsp. paratuberculosis
gccgacggccagca

SEQ ID NO: 932578 - RNA, 13 nt, Mycobacterium avium subsp. paratuberculosis
gccgacggcgccg

SEQ ID NO: 932579 - RNA, 15 nt, Mycobacterium avium subsp. paratuberculosis
gccgacggcgccggu

SEQ ID NO: 932580 - RNA, 17 nt, Mycobacterium avium subsp. paratuberculosis
gccgacggcgccggugc

SEQ ID NO: 932581 - RNA, 19 nt, Mycobacterium avium subsp. paratuberculosis
gccgacggcgccggugccc

SEQ ID NO: 932582 - RNA, 20 nt, Mycobacterium avium subsp. paratuberculosis
gccgacggcgccggugccca

SEQ ID NO: 932583 - RNA, 14 nt, Mycobacterium avium subsp. paratuberculosis
gccgagcagaucgg

SEQ ID NO: 932584 - RNA, 20 nt, Mycobacterium avium subsp. paratuberculosis
gccgagcagaucggguccca

SEQ ID NO: 932585 - RNA, 20 nt, Mycobacterium avium subsp. paratuberculosis
gccgagcaccgggcugucgg

SEQ ID NO: 932586 - RNA, 12 nt, Mycobacterium avium subsp. paratuberculosis
gccgagcaccuc

SEQ ID NO: 932587 - RNA, 22 nt, Mycobacterium avium subsp. paratuberculosis
gccgagcaccucgucgccgucg

SEQ ID NO: 932588 - RNA, 16 nt, Mycobacterium avium subsp. paratuberculosis
gccgagcacgaacgcg

SEQ ID NO: 932589 - RNA, 15 nt, Mycobacterium avium subsp. paratuberculosis
gccgagcacgcagcc

SEQ ID NO: 932590 - RNA, 16 nt, Mycobacterium avium subsp. paratuberculosis
gccgagcacgcagccg

SEQ ID NO: 932591 - RNA, 23 nt, Mycobacterium avium subsp. paratuberculosis
gccgagcacgcagccgcgcccga

SEQ ID NO: 932592 - RNA, 13 nt, Mycobacterium avium subsp. paratuberculosis
gccgagcacgcgg

SEQ ID NO: 932593 - RNA, 14 nt, Mycobacterium avium subsp. paratuberculosis
gccgagcacgcggc

SEQ ID NO: 932594 - RNA, 16 nt, Mycobacterium avium subsp. paratuberculosis
gccgagcacgcggccg

SEQ ID NO: 932595 - RNA, 17 nt, Mycobacterium avium subsp. paratuberculosis
gccgagcacgcggccgc

SEQ ID NO: 932596 - RNA, 18 nt, Mycobacterium avium subsp. paratuberculosis
gccgagcacgcggccgcg

SEQ ID NO: 932597 - RNA, 16 nt, Mycobacterium avium subsp. paratuberculosis
gccgagcacggcucgu

SEQ ID NO: 932598 - RNA, 19 nt, Mycobacterium avium subsp. paratuberculosis
gccgagcacggcucgucca

SEQ ID NO: 932599 - RNA, 22 nt, Mycobacterium avium subsp. paratuberculosis
gccgagcacggcucguccauca

SEQ ID NO: 932600 - RNA, 19 nt, Mycobacterium avium subsp. paratuberculosis
gccgacggcugcccggccc

SEQ ID NO: 932601 - RNA, 21 nt, Mycobacterium avium subsp. paratuberculosis
aagaucagcgcgucggugaug

SEQ ID NO: 932602 - RNA, 17 nt, Mycobacterium avium subsp. paratuberculosis
gccgacgggcccagcgc

SEQ ID NO: 932603 - RNA, 18 nt, Mycobacterium avium subsp. paratuberculosis
gccgacgggcccagcgcg

SEQ ID NO: 932604 - RNA, 19 nt, Mycobacterium avium subsp. paratuberculosis
gccgacgggcccagcgcga

SEQ ID NO: 932605 - RNA, 17 nt, Mycobacterium avium subsp. paratuberculosis
gccgagcaccaggcgca

SEQ ID NO: 932606 - RNA, 20 nt, Mycobacterium avium subsp. paratuberculosis
gccgagcaccccgucgagca

SEQ ID NO: 932607 - RNA, 22 nt, Mycobacterium avium subsp. paratuberculosis
gccgagcaccccgucgagcagc

SEQ ID NO: 932608 - RNA, 13 nt, Mycobacterium avium subsp. paratuberculosis
gccgagcaccggc

SEQ ID NO: 932609 - RNA, 14 nt, Mycobacterium avium subsp. paratuberculosis
gccgagcaccggca

SEQ ID NO: 932610 - RNA, 17 nt, Mycobacterium avium subsp. paratuberculosis
gccgagcaccggcagca

SEQ ID NO: 932611 - RNA, 19 nt, Mycobacterium avium subsp. paratuberculosis
gccgagcaccggcagcacc

SEQ ID NO: 932612 - RNA, 20 nt, Mycobacterium avium subsp. paratuberculosis
gccgagcaccggcagcaccg

SEQ ID NO: 932613 - RNA, 21 nt, Mycobacterium avium subsp. paratuberculosis
gccgagcaccggcagcaccgc

SEQ ID NO: 932614 - RNA, 22 nt, Mycobacterium avium subsp. paratuberculosis
gccgagcaccggcagcaccgcc

SEQ ID NO: 932615 - RNA, 18 nt, Mycobacterium avium subsp. paratuberculosis
gccgaggcacagcagcac

SEQ ID NO: 932616 - RNA, 20 nt, Mycobacterium avium subsp. paratuberculosis
gccgaggauuucgcgaucga

SEQ ID NO: 932617 - RNA, 13 nt, Mycobacterium avium subsp. paratuberculosis
gccgaggaggccg

SEQ ID NO: 932618 - RNA, 16 nt, Mycobacterium avium subsp. paratuberculosis
gccgaggaggccgcgg

SEQ ID NO: 932619 - RNA, 17 nt, Mycobacterium avium subsp. paratuberculosis
gccgaggaggccgcggc

SEQ ID NO: 932620 - RNA, 16 nt, Mycobacterium avium subsp. paratuberculosis
gccgaggccaacucgc

SEQ ID NO: 932621 - RNA, 14 nt, Mycobacterium avium subsp. paratuberculosis
gccgaggccagcac

SEQ ID NO: 932622 - RNA, 16 nt, Mycobacterium avium subsp. paratuberculosis
gccgaggccuccaggu

SEQ ID NO: 932623 - RNA, 14 nt, Mycobacterium avium subsp. paratuberculosis
gccgaggcugucgg

SEQ ID NO: 932624 - RNA, 16 nt, Mycobacterium avium subsp. paratuberculosis
gccgaggcugucggag

SEQ ID NO: 932625 - RNA, 20 nt, Mycobacterium avium subsp. paratuberculosis
gccgaggcugacgaucgucg

SEQ ID NO: 932626 - RNA, 21 nt, Mycobacterium avium subsp. paratuberculosis
gccgaggcgagugaggacgag

SEQ ID NO: 932627 - RNA, 13 nt, Mycobacterium avium subsp. paratuberculosis
gccgaggcgaugc

SEQ ID NO: 932628 - RNA, 15 nt, Mycobacterium avium subsp. paratuberculosis
gccgaggcgaugccg

SEQ ID NO: 932629 - RNA, 16 nt, Mycobacterium avium subsp. paratuberculosis
gccgaggcgcaacacc

SEQ ID NO: 932630 - RNA, 13 nt, Mycobacterium avium subsp. paratuberculosis
gccgaggcgcagg

SEQ ID NO: 932631 - RNA, 14 nt, Mycobacterium avium subsp. paratuberculosis
gccgaggcgcucgg

SEQ ID NO: 932632 - RNA, 18 nt, Mycobacterium avium subsp. paratuberculosis
gccgaggcgcucggcccg

SEQ ID NO: 932633 - RNA, 14 nt, Mycobacterium avium subsp. paratuberculosis
gccgagcgcgccga

SEQ ID NO: 932634 - RNA, 12 nt, Mycobacterium avium subsp. paratuberculosis
gccgagcggcgc

SEQ ID NO: 932635 - RNA, 14 nt, Mycobacterium avium subsp. paratuberculosis
gccgagcggcgcca

SEQ ID NO: 932636 - RNA, 16 nt, Mycobacterium avium subsp. paratuberculosis
gccgagcggcgccacg

SEQ ID NO: 932637 - RNA, 15 nt, Mycobacterium avium subsp. paratuberculosis
gccgagcggcugcug

SEQ ID NO: 932638 - RNA, 16 nt, Mycobacterium avium subsp. paratuberculosis
gccgagcggcugcugg

SEQ ID NO: 932639 - RNA, 13 nt, Mycobacterium avium subsp. paratuberculosis
gccgagcgcgccg

SEQ ID NO: 932640 - RNA, 13 nt, Mycobacterium avium subsp. paratuberculosis
gccgagcgccgcg

SEQ ID NO: 932641 - RNA, 17 nt, Mycobacterium avium subsp. paratuberculosis
gccgagcgcgccgagca

SEQ ID NO: 932642 - RNA, 21 nt, Mycobacterium avium subsp. paratuberculosis
gccgagcgcgccgagcagcug

SEQ ID NO: 932643 - RNA, 15 nt, Mycobacterium avium subsp. paratuberculosis
gccgagcgcgccgcc

SEQ ID NO: 932644 - RNA, 16 nt, Mycobacterium avium subsp. paratuberculosis
gccgagcgcgccgccg

SEQ ID NO: 932645 - RNA, 13 nt, Mycobacterium avium subsp. paratuberculosis
gccgagcgucacg

SEQ ID NO: 932646 - RNA, 18 nt, Mycobacterium avium subsp. paratuberculosis
gccgaggaaagcucgcga

SEQ ID NO: 932647 - RNA, 17 nt, Mycobacterium avium subsp. paratuberculosis
gccgaggaagacgucga

SEQ ID NO: 932648 - RNA, 21 nt, Mycobacterium avium subsp. paratuberculosis
gccgagcuugggccggugcag

SEQ ID NO: 932649 - RNA, 17 nt, Mycobacterium avium subsp. paratuberculosis
gccgagcgcgccgccgc

SEQ ID NO: 932650 - RNA, 17 nt, Mycobacterium avium subsp. paratuberculosis
gccgaggaaccggcagc

SEQ ID NO: 932651 - RNA, 23 nt, Mycobacterium avium subsp. paratuberculosis
gccgaggaaccggcagccggcgu

SEQ ID NO: 932652 - RNA, 22 nt, Mycobacterium avium subsp. paratuberculosis
gccgagcgguccaacgggcuca

SEQ ID NO: 932653 - RNA, 17 nt, Mycobacterium avium subsp. paratuberculosis
gccgaguaacucggccu

SEQ ID NO: 932654 - RNA, 18 nt, Mycobacterium avium subsp. paratuberculosis
gccgaguaccgacgagau

SEQ ID NO: 932655 - RNA, 23 nt, Mycobacterium avium subsp. paratuberculosis
gccgaguaccgacgagaucagca

SEQ ID NO: 932656 - RNA, 18 nt, Mycobacterium avium subsp. paratuberculosis
gccgaguauccgcgcagc

SEQ ID NO: 932657 - RNA, 21 nt, Mycobacterium avium subsp. paratuberculosis
gccgaguauccgcgcagcguc

SEQ ID NO: 932658 - RNA, 15 nt, Mycobacterium avium subsp. paratuberculosis
gccgaguccgggccg

SEQ ID NO: 932659 - RNA, 19 nt, Mycobacterium avium subsp. paratuberculosis
gccgaguccgggccgccgg

SEQ ID NO: 932660 - RNA, 21 nt, Mycobacterium avium subsp. paratuberculosis
gccgagucgacgugcucggcg

SEQ ID NO: 932661 - RNA, 23 nt, Mycobacterium avium subsp. paratuberculosis
gccgagucgacgugcucggcggc

SEQ ID NO: 932662 - RNA, 22 nt, Mycobacterium avium subsp. paratuberculosis
gccgagucgaucgccagcgcgc

SEQ ID NO: 932663 - RNA, 23 nt, Mycobacterium avium subsp. paratuberculosis
gccgagucgaucgccagcgcgca

SEQ ID NO: 932664 - RNA, 14 nt, Mycobacterium avium subsp. paratuberculosis
gccgagucgcgccg

SEQ ID NO: 932665 - RNA, 16 nt, Mycobacterium avium subsp. paratuberculosis
gccgagucgcgccgcg

SEQ ID NO: 932666 - RNA, 19 nt, Mycobacterium avium subsp. paratuberculosis
gccgagucgcgccgcgucg

SEQ ID NO: 932667 - RNA, 23 nt, Mycobacterium avium subsp. paratuberculosis
gccgagucgcgccgcgucgcgcc

SEQ ID NO: 932668 - RNA, 13 nt, Mycobacterium avium subsp. paratuberculosis
gccgagguggccc

SEQ ID NO: 932669 - RNA, 20 nt, Mycobacterium avium subsp. paratuberculosis
gccgagguggcccgccacgu

SEQ ID NO: 932670 - RNA, 16 nt, Mycobacterium avium subsp. paratuberculosis
gccgagguggccgcca

SEQ ID NO: 932671 - RNA, 17 nt, Mycobacterium avium subsp. paratuberculosis
gccgagguggccgccag

SEQ ID NO: 932672 - RNA, 19 nt, Mycobacterium avium subsp. paratuberculosis
gccgagguggccgccagca

SEQ ID NO: 932673 - RNA, 20 nt, Mycobacterium avium subsp. paratuberculosis
gccgagguggccgccagcac

SEQ ID NO: 932674 - RNA, 13 nt, Mycobacterium avium subsp. paratuberculosis
gccgagggccagc

SEQ ID NO: 932675 - RNA, 17 nt, Mycobacterium avium subsp. paratuberculosis
gccgagggccagcagcc

SEQ ID NO: 932676 - RNA, 18 nt, Mycobacterium avium subsp. paratuberculosis
gccgagggccagcagcca

SEQ ID NO: 932677 - RNA, 20 nt, Mycobacterium avium subsp. paratuberculosis
gccgagggccagcagccagc

SEQ ID NO: 932678 - RNA, 19 nt, Mycobacterium avium subsp. paratuberculosis
gccgagggcccgggcaggc

SEQ ID NO: 932679 - RNA, 18 nt, Mycobacterium avium subsp. paratuberculosis
gccgaggugcugucgucg

SEQ ID NO: 932680 - RNA, 19 nt, Mycobacterium avium subsp. paratuberculosis
gccgaggugcugucgucgc

SEQ ID NO: 932681 - RNA, 22 nt, Mycobacterium avium subsp. paratuberculosis
gccgagggcgacgaugccggcc

SEQ ID NO: 932682 - RNA, 13 nt, Mycobacterium avium subsp. paratuberculosis
gccgauccgcggg

SEQ ID NO: 932683 - RNA, 23 nt, Mycobacterium avium subsp. paratuberculosis
gccgauccgcggguacggucggc

SEQ ID NO: 932684 - RNA, 21 nt, Mycobacterium avium subsp. paratuberculosis
gccgauccggcgccgcgggcg

SEQ ID NO: 932685 - RNA, 23 nt, Mycobacterium avium subsp. paratuberculosis
gccgauccggcgccgcgggcgcc

SEQ ID NO: 932686 - RNA, 22 nt, Mycobacterium avium subsp. paratuberculosis
gccgauccggcuccacagcagu

SEQ ID NO: 932687 - RNA, 17 nt, Mycobacterium avium subsp. paratuberculosis
gccgauccgggcggcag

SEQ ID NO: 932688 - RNA, 20 nt, Mycobacterium avium subsp. paratuberculosis
gccgauccgggcggcaggug

SEQ ID NO: 932689 - RNA, 13 nt, Mycobacterium avium subsp. paratuberculosis
gccgaucaccgcg

SEQ ID NO: 932690 - RNA, 20 nt, Mycobacterium avium subsp. paratuberculosis
gccgaucaccgcguugucgg

SEQ ID NO: 932691 - RNA, 22 nt, Mycobacterium avium subsp. paratuberculosis
gccgaucaccgcguugucggcg

SEQ ID NO: 932692 - RNA, 19 nt, Mycobacterium avium subsp. paratuberculosis
gccgauccgcaccggacgc

SEQ ID NO: 932693 - RNA, 20 nt, Mycobacterium avium subsp. paratuberculosis
gccgauccgcaccggacgca

SEQ ID NO: 932694 - RNA, 20 nt, Mycobacterium avium subsp. paratuberculosis
gccgauccgcagccgcugcc

SEQ ID NO: 932695 - RNA, 15 nt, Mycobacterium avium subsp. paratuberculosis
gccgaucaacaggcc

SEQ ID NO: 932696 - RNA, 20 nt, Mycobacterium avium subsp. paratuberculosis
gccgaucaacaggcccagca

SEQ ID NO: 932697 - RNA, 13 nt, Mycobacterium avium subsp. paratuberculosis
gccgaucaccggc

SEQ ID NO: 932698 - RNA, 17 nt, Mycobacterium avium subsp. paratuberculosis
gccgaucaccggcacgu

SEQ ID NO: 932699 - RNA, 14 nt, Mycobacterium avium subsp. paratuberculosis
gccgaucaccggcg

SEQ ID NO: 932700 - RNA, 15 nt, Mycobacterium avium subsp. paratuberculosis
gccgaucaccggcgc

SEQ ID NO: 932701 - RNA, 16 nt, Mycobacterium avium subsp. paratuberculosis
gccgaucaccggcgcg

SEQ ID NO: 932702 - RNA, 17 nt, Mycobacterium avium subsp. paratuberculosis
gccgaucaccggcgcgu

SEQ ID NO: 932703 - RNA, 18 nt, Mycobacterium avium subsp. paratuberculosis
gccgaucaccggcgcguu

SEQ ID NO: 932704 - RNA, 14 nt, Mycobacterium avium subsp. paratuberculosis
gccgaucaccucga

SEQ ID NO: 932705 - RNA, 15 nt, Mycobacterium avium subsp. paratuberculosis
gccgaucaccucgaa

SEQ ID NO: 932706 - RNA, 16 nt, Mycobacterium avium subsp. paratuberculosis
gccgaucaccucgaug

SEQ ID NO: 932707 - RNA, 19 nt, Mycobacterium avium subsp. paratuberculosis
gccgaucaccucgauggcc

SEQ ID NO: 932708 - RNA, 20 nt, Mycobacterium avium subsp. paratuberculosis
gccgaucaccucgauggccg

SEQ ID NO: 932709 - RNA, 15 nt, Mycobacterium avium subsp. paratuberculosis
gccgaucaccucgcc

SEQ ID NO: 932710 - RNA, 16 nt, Mycobacterium avium subsp. paratuberculosis
gccgaucaccucgccg

SEQ ID NO: 932711 - RNA, 18 nt, Mycobacterium avium subsp. paratuberculosis
gccgaucaccucgccggc

SEQ ID NO: 932712 - RNA, 22 nt, Mycobacterium avium subsp. paratuberculosis
gccgaugagccucagcgcgcaa

SEQ ID NO: 932713 - RNA, 20 nt, Mycobacterium avium subsp. paratuberculosis
gccgaugaugaaaccggcca

SEQ ID NO: 932714 - RNA, 22 nt, Mycobacterium avium subsp. paratuberculosis
gccgaugaugaaaccggccagc

SEQ ID NO: 932715 - RNA, 18 nt, Mycobacterium avium subsp. paratuberculosis
gccgaugaugaugccgcc

SEQ ID NO: 932716 - RNA, 22 nt, Mycobacterium avium subsp. paratuberculosis
gccgaugaugaugccgcccauc

SEQ ID NO: 932717 - RNA, 16 nt, Mycobacterium avium subsp. paratuberculosis
gccgaugacggcgcga

SEQ ID NO: 932718 - RNA, 19 nt, Mycobacterium avium subsp. paratuberculosis
gccgaugacguugcgcgcc

SEQ ID NO: 932719 - RNA, 21 nt, Mycobacterium avium subsp. paratuberculosis
gccgaugacguugcgcgccau

SEQ ID NO: 932720 - RNA, 15 nt, Mycobacterium avium subsp. paratuberculosis
gccgaugcgcccgcg

SEQ ID NO: 932721 - RNA, 17 nt, Mycobacterium avium subsp. paratuberculosis
gccgaugcgcccgcgcc

SEQ ID NO: 932722 - RNA, 23 nt, Mycobacterium avium subsp. paratuberculosis
gccgaugcgcccgcgccaccccg

SEQ ID NO: 932723 - RNA, 15 nt, Mycobacterium avium subsp. paratuberculosis
gccgaugcgcccgcu

SEQ ID NO: 932724 - RNA, 14 nt, Mycobacterium avium subsp. paratuberculosis
gccgaugccggccu

SEQ ID NO: 932725 - RNA, 15 nt, Mycobacterium avium subsp. paratuberculosis
gccgaugccgcgcug

SEQ ID NO: 932726 - RNA, 16 nt, Mycobacterium avium subsp. paratuberculosis
gccgaugccgcgcugc

SEQ ID NO: 932727 - RNA, 20 nt, Mycobacterium avium subsp. paratuberculosis
gccgaugccgcgcugcgccg

SEQ ID NO: 932728 - RNA, 20 nt, Mycobacterium avium subsp. paratuberculosis
gccgaugcccaucacgcccc

SEQ ID NO: 932729 - RNA, 14 nt, Mycobacterium avium subsp. paratuberculosis
gccgaugcccgccc

SEQ ID NO: 932730 - RNA, 16 nt, Mycobacterium avium subsp. paratuberculosis
gccgaugccgaacguc

SEQ ID NO: 932731 - RNA, 18 nt, Mycobacterium avium subsp. paratuberculosis
gccgaugaacaugcccug

SEQ ID NO: 932732 - RNA, 20 nt, Mycobacterium avium subsp. paratuberculosis
gccgaugaacaugcccugca

SEQ ID NO: 932733 - RNA, 12 nt, Mycobacterium avium subsp. paratuberculosis
gccgaucugguc

SEQ ID NO: 932734 - RNA, 15 nt, Mycobacterium avium subsp. paratuberculosis
gccgaucugucgcgc

SEQ ID NO: 932735 - RNA, 16 nt, Mycobacterium avium subsp. paratuberculosis
gccgaucugucgcgcu

SEQ ID NO: 932736 - RNA, 15 nt, Mycobacterium avium subsp. paratuberculosis
gccgaucuugucgac

SEQ ID NO: 932737 - RNA, 16 nt, Mycobacterium avium subsp. paratuberculosis
gccgaugaccgcggcg

SEQ ID NO: 932738 - RNA, 17 nt, Mycobacterium avium subsp. paratuberculosis
gccgaugaccgcggcgg

SEQ ID NO: 932739 - RNA, 12 nt, Mycobacterium avium subsp. paratuberculosis
gccgaugaccac

SEQ ID NO: 932740 - RNA, 16 nt, Mycobacterium avium subsp. paratuberculosis
gccgaucgcggugcug

SEQ ID NO: 932741 - RNA, 16 nt, Mycobacterium avium subsp. paratuberculosis
gccgaucgcgcgcagg

SEQ ID NO: 932742 - RNA, 14 nt, Mycobacterium avium subsp. paratuberculosis
gccgaucgcggcga

SEQ ID NO: 932743 - RNA, 15 nt, Mycobacterium avium subsp. paratuberculosis
gccgaucgcggcgau

SEQ ID NO: 932744 - RNA, 16 nt, Mycobacterium avium subsp. paratuberculosis
gccgaucgcccagugc

SEQ ID NO: 932745 - RNA, 14 nt, Mycobacterium avium subsp. paratuberculosis
gccgaucgcccggu

SEQ ID NO: 932746 - RNA, 23 nt, Mycobacterium avium subsp. paratuberculosis
gccgaucgcccgguaggccgccg

SEQ ID NO: 932747 - RNA, 19 nt, Mycobacterium avium subsp. paratuberculosis
gccgaucgccgcggcgauc

SEQ ID NO: 932748 - RNA, 21 nt, Mycobacterium avium subsp. paratuberculosis
gccgaucgccgcggcgaucuc

SEQ ID NO: 932749 - RNA, 21 nt, Mycobacterium avium subsp. paratuberculosis
gccgaucgaucagccgcgaca

SEQ ID NO: 932750 - RNA, 15 nt, Mycobacterium avium subsp. paratuberculosis
gccgaucuggcgcag

SEQ ID NO: 932751 - RNA, 17 nt, Mycobacterium avium subsp. paratuberculosis
gccgaucuggcgcagcg

SEQ ID NO: 932752 - RNA, 19 nt, Mycobacterium avium subsp. paratuberculosis
gccgaucuggcgcagcguc

SEQ ID NO: 932753 - RNA, 13 nt, Mycobacterium avium subsp. paratuberculosis
gccgaucuggcgg

SEQ ID NO: 932754 - RNA, 14 nt, Mycobacterium avium subsp. paratuberculosis
gccgaucuggcggg

SEQ ID NO: 932755 - RNA, 17 nt, Mycobacterium avium subsp. paratuberculosis
gccgaucuggcgggcgg

SEQ ID NO: 932756 - RNA, 21 nt, Mycobacterium avium subsp. paratuberculosis
gccgaucuggcgggcggucca

SEQ ID NO: 932757 - RNA, 16 nt, Mycobacterium avium subsp. paratuberculosis
aagcacgaccacaccc

SEQ ID NO: 932758 - RNA, 12 nt, Mycobacterium avium subsp. paratuberculosis
aagcaccaggcu

SEQ ID NO: 932759 - RNA, 15 nt, Mycobacterium avium subsp. paratuberculosis
aagcaccaggcucgc

SEQ ID NO: 932760 - RNA, 21 nt, Mycobacterium avium subsp. paratuberculosis
gccgcaacggcgcaacggauu

SEQ ID NO: 932761 - RNA, 13 nt, Mycobacterium avium subsp. paratuberculosis
gccgcaacggcgg

SEQ ID NO: 932762 - RNA, 14 nt, Mycobacterium avium subsp. paratuberculosis
gccgcaacggcggu

SEQ ID NO: 932763 - RNA, 15 nt, Mycobacterium avium subsp. paratuberculosis
gccgcaacggcgguc

SEQ ID NO: 932764 - RNA, 16 nt, Mycobacterium avium subsp. paratuberculosis
gccgcaacggcggucg

SEQ ID NO: 932765 - RNA, 20 nt, Mycobacterium avium subsp. paratuberculosis
gccgcaacggcggucgugcg

SEQ ID NO: 932766 - RNA, 14 nt, Mycobacterium avium subsp. paratuberculosis
gccgcaacgggccg

SEQ ID NO: 932767 - RNA, 18 nt, Mycobacterium avium subsp. paratuberculosis
gccgcaacgggccgcagc

SEQ ID NO: 932768 - RNA, 19 nt, Mycobacterium avium subsp. paratuberculosis
gccgcaacgggccgcagcc

SEQ ID NO: 932769 - RNA, 23 nt, Mycobacterium avium subsp. paratuberculosis
gccgcaacgggccgcagccgcgc

SEQ ID NO: 932770 - RNA, 17 nt, Mycobacterium avium subsp. paratuberculosis
gccgcaacuugcccgac

SEQ ID NO: 932771 - RNA, 22 nt, Mycobacterium avium subsp. paratuberculosis
gccgcaaggugauucgcgcggc

SEQ ID NO: 932772 - RNA, 17 nt, Mycobacterium avium subsp. paratuberculosis
gccgcaauacaccgcga

SEQ ID NO: 932773 - RNA, 17 nt, Mycobacterium avium subsp. paratuberculosis
gccgcaauacggugccc

SEQ ID NO: 932774 - RNA, 18 nt, Mycobacterium avium subsp. paratuberculosis
gccgcaauacggugcccg

SEQ ID NO: 932775 - RNA, 19 nt, Mycobacterium avium subsp. paratuberculosis
gccgcacgaauugccggug

SEQ ID NO: 932776 - RNA, 23 nt, Mycobacterium avium subsp. paratuberculosis
gccgcacgaauugccgguggugc

SEQ ID NO: 932777 - RNA, 13 nt, Mycobacterium avium subsp. paratuberculosis
gccgcaccgcgac

SEQ ID NO: 932778 - RNA, 15 nt, Mycobacterium avium subsp. paratuberculosis
gccgcaccgcgaccg

SEQ ID NO: 932779 - RNA, 14 nt, Mycobacterium avium subsp. paratuberculosis
gccgcaccggccgg

SEQ ID NO: 932780 - RNA, 19 nt, Mycobacterium avium subsp. paratuberculosis
gccgcaccggccggccccg

SEQ ID NO: 932781 - RNA, 19 nt, Mycobacterium avium subsp. paratuberculosis
gccgcaccgucgugccagc

SEQ ID NO: 932782 - RNA, 12 nt, Mycobacterium avium subsp. paratuberculosis
gccgcaccucgc

SEQ ID NO: 932783 - RNA, 19 nt, Mycobacterium avium subsp. paratuberculosis
gccgcaccucgccggccgc

SEQ ID NO: 932784 - RNA, 21 nt, Mycobacterium avium subsp. paratuberculosis
gccgcaccucggggcguggcg

SEQ ID NO: 932785 - RNA, 22 nt, Mycobacterium avium subsp. paratuberculosis
gccgcaccucggggcguggcgg

SEQ ID NO: 932786 - RNA, 18 nt, Mycobacterium avium subsp. paratuberculosis
gccgcaccggcgccgcca

SEQ ID NO: 932787 - RNA, 15 nt, Mycobacterium avium subsp. paratuberculosis
gccgcaccuggcagc

SEQ ID NO: 932788 - RNA, 17 nt, Mycobacterium avium subsp. paratuberculosis
gccgcacgaaccgcucg

SEQ ID NO: 932789 - RNA, 19 nt, Mycobacterium avium subsp. paratuberculosis
gccgauggucagcugccgc

SEQ ID NO: 932790 - RNA, 15 nt, Mycobacterium avium subsp. paratuberculosis
gccgauggcggucca

SEQ ID NO: 932791 - RNA, 21 nt, Mycobacterium avium subsp. paratuberculosis
gccgauggcgguccaccacca

SEQ ID NO: 932792 - RNA, 16 nt, Mycobacterium avium subsp. paratuberculosis
gccgauggcgcccagc

SEQ ID NO: 932793 - RNA, 16 nt, Mycobacterium avium subsp. paratuberculosis
gccgauggccuggugg

SEQ ID NO: 932794 - RNA, 19 nt, Mycobacterium avium subsp. paratuberculosis
gccgauggccugguggccc

SEQ ID NO: 932795 - RNA, 17 nt, Mycobacterium avium subsp. paratuberculosis
gccgaugcgccgcacca

SEQ ID NO: 932796 - RNA, 23 nt, Mycobacterium avium subsp. paratuberculosis
gccgauggaacgcaagaagucgg

SEQ ID NO: 932797 - RNA, 20 nt, Mycobacterium avium subsp. paratuberculosis
gccgauggacacgcugccga

SEQ ID NO: 932798 - RNA, 14 nt, Mycobacterium avium subsp. paratuberculosis
gccgauggccaccg

SEQ ID NO: 932799 - RNA, 15 nt, Mycobacterium avium subsp. paratuberculosis
gccgauggccaccgg

SEQ ID NO: 932800 - RNA, 17 nt, Mycobacterium avium subsp. paratuberculosis
gccgauggccaccgggc

SEQ ID NO: 932801 - RNA, 17 nt, Mycobacterium avium subsp. paratuberculosis
gccgauggcccaggccg

SEQ ID NO: 932802 - RNA, 20 nt, Mycobacterium avium subsp. paratuberculosis
gccgauggcccaggccgcgg

SEQ ID NO: 932803 - RNA, 17 nt, Mycobacterium avium subsp. paratuberculosis
gccgaugcugagcgggu

SEQ ID NO: 932804 - RNA, 19 nt, Mycobacterium avium subsp. paratuberculosis
gccgaugcugagcgggucg

SEQ ID NO: 932805 - RNA, 14 nt, Mycobacterium avium subsp. paratuberculosis
gccgauuccagcaa

SEQ ID NO: 932806 - RNA, 15 nt, Mycobacterium avium subsp. paratuberculosis
gccgauuccagcaac

SEQ ID NO: 932807 - RNA, 16 nt, Mycobacterium avium subsp. paratuberculosis
gccgauuccagcaacu

SEQ ID NO: 932808 - RNA, 15 nt, Mycobacterium avium subsp. paratuberculosis
gccgaugucggcguu

SEQ ID NO: 932809 - RNA, 17 nt, Mycobacterium avium subsp. paratuberculosis
gccgaugucggcguugc

SEQ ID NO: 932810 - RNA, 17 nt, Mycobacterium avium subsp. paratuberculosis
gccgaugucugaucgcg

SEQ ID NO: 932811 - RNA, 18 nt, Mycobacterium avium subsp. paratuberculosis
gccgaugucugaucgcgu

SEQ ID NO: 932812 - RNA, 19 nt, Mycobacterium avium subsp. paratuberculosis
gccgaugugaucggcggcc

SEQ ID NO: 932813 - RNA, 20 nt, Mycobacterium avium subsp. paratuberculosis
gccgaugugaucggcggcca

SEQ ID NO: 932814 - RNA, 23 nt, Mycobacterium avium subsp. paratuberculosis
gccgaugugaucggcggccacca

SEQ ID NO: 932815 - RNA, 15 nt, Mycobacterium avium subsp. paratuberculosis
gccgauguggccggc

SEQ ID NO: 932816 - RNA, 16 nt, Mycobacterium avium subsp. paratuberculosis
gccgauguggccggcg

SEQ ID NO: 932817 - RNA, 17 nt, Mycobacterium avium subsp. paratuberculosis
gccgauguggccggcga

SEQ ID NO: 932818 - RNA, 21 nt, Mycobacterium avium subsp. paratuberculosis
gccgauguggccggcgauggc

SEQ ID NO: 932819 - RNA, 17 nt, Mycobacterium avium subsp. paratuberculosis
gccgauguggcgggcgu

SEQ ID NO: 932820 - RNA, 20 nt, Mycobacterium avium subsp. paratuberculosis
gccgauguggcgggcguccu

SEQ ID NO: 932821 - RNA, 23 nt, Mycobacterium avium subsp. paratuberculosis
gccgauguaggacaggucgcggu

SEQ ID NO: 932822 - RNA, 17 nt, Mycobacterium avium subsp. paratuberculosis
gccgaugucggccgguc

SEQ ID NO: 932823 - RNA, 13 nt, Mycobacterium avium subsp. paratuberculosis
gccgaugucgucg

SEQ ID NO: 932824 - RNA, 14 nt, Mycobacterium avium subsp. paratuberculosis
gccgaugucgucga

SEQ ID NO: 932825 - RNA, 17 nt, Mycobacterium avium subsp. paratuberculosis
gccgaugucgucgaacg

SEQ ID NO: 932826 - RNA, 15 nt, Mycobacterium avium subsp. paratuberculosis
gccgauguccccgcg

SEQ ID NO: 932827 - RNA, 16 nt, Mycobacterium avium subsp. paratuberculosis
gccgauguccccgcgg

SEQ ID NO: 932828 - RNA, 18 nt, Mycobacterium avium subsp. paratuberculosis
gccgauguccccgcgggu

SEQ ID NO: 932829 - RNA, 18 nt, Mycobacterium avium subsp. paratuberculosis
gccgaugguguggaucgc

SEQ ID NO: 932830 - RNA, 18 nt, Mycobacterium avium subsp. paratuberculosis
gccgauggugaccucggu

SEQ ID NO: 932831 - RNA, 19 nt, Mycobacterium avium subsp. paratuberculosis
gccgauggugaccucgguc

SEQ ID NO: 932832 - RNA, 21 nt, Mycobacterium avium subsp. paratuberculosis
gccgauggugaccucggucga

SEQ ID NO: 932833 - RNA, 17 nt, Mycobacterium avium subsp. paratuberculosis
gccgauggugacggugc

SEQ ID NO: 932834 - RNA, 12 nt, Mycobacterium avium subsp. paratuberculosis
gccgauggcgcc

SEQ ID NO: 932835 - RNA, 13 nt, Mycobacterium avium subsp. paratuberculosis
gccgauggucagc

SEQ ID NO: 932836 - RNA, 18 nt, Mycobacterium avium subsp. paratuberculosis
gccgauggugguaccgac

SEQ ID NO: 932837 - RNA, 20 nt, Mycobacterium avium subsp. paratuberculosis
gccgauggugguaccgaccu

SEQ ID NO: 932838 - RNA, 13 nt, Mycobacterium avium subsp. paratuberculosis
gccgcacgcccac

SEQ ID NO: 932839 - RNA, 23 nt, Mycobacterium avium subsp. paratuberculosis
gccgcacuccgucgcgaucacac

SEQ ID NO: 932840 - RNA, 17 nt, Mycobacterium avium subsp. paratuberculosis
gccgcacugcacggccu

SEQ ID NO: 932841 - RNA, 12 nt, Mycobacterium avium subsp. paratuberculosis
gccgcacggugc

SEQ ID NO: 932842 - RNA, 17 nt, Mycobacterium avium subsp. paratuberculosis
gccgcacggugcagcag

SEQ ID NO: 932843 - RNA, 20 nt, Mycobacterium avium subsp. paratuberculosis
gccgcacggugcagcagcgc

SEQ ID NO: 932844 - RNA, 19 nt, Mycobacterium avium subsp. paratuberculosis
gccgcacguauccgcgguc

SEQ ID NO: 932845 - RNA, 21 nt, Mycobacterium avium subsp. paratuberculosis
gccgcacguauccgcggucga

SEQ ID NO: 932846 - RNA, 22 nt, Mycobacterium avium subsp. paratuberculosis
gccgcacguauccgcggucgac

SEQ ID NO: 932847 - RNA, 14 nt, Mycobacterium avium subsp. paratuberculosis
gccgcacgucccgc

SEQ ID NO: 932848 - RNA, 16 nt, Mycobacterium avium subsp. paratuberculosis
gccgcacgucccgccc

SEQ ID NO: 932849 - RNA, 19 nt, Mycobacterium avium subsp. paratuberculosis
gccgcacgucccgcccggc

SEQ ID NO: 932850 - RNA, 20 nt, Mycobacterium avium subsp. paratuberculosis
gccgcacgucccgcccggcg

SEQ ID NO: 932851 - RNA, 22 nt, Mycobacterium avium subsp. paratuberculosis
gccgcacgucccgcccggcgcc

SEQ ID NO: 932852 - RNA, 14 nt, Mycobacterium avium subsp. paratuberculosis
gccgcacgcgaaca

SEQ ID NO: 932853 - RNA, 15 nt, Mycobacterium avium subsp. paratuberculosis
gccgcacgcgaacac

SEQ ID NO: 932854 - RNA, 14 nt, Mycobacterium avium subsp. paratuberculosis
gccgcacgcgaccg

SEQ ID NO: 932855 - RNA, 15 nt, Mycobacterium avium subsp. paratuberculosis
gccgcacgcgaccgc

SEQ ID NO: 932856 - RNA, 17 nt, Mycobacterium avium subsp. paratuberculosis
gccgcacgcgaccgcgu

SEQ ID NO: 932857 - RNA, 18 nt, Mycobacterium avium subsp. paratuberculosis
gccgcacgcgaccgcguc

SEQ ID NO: 932858 - RNA, 22 nt, Mycobacterium avium subsp. paratuberculosis
gccgcacgcgaccgcgucgacg

SEQ ID NO: 932859 - RNA, 15 nt, Mycobacterium avium subsp. paratuberculosis
gccgcagcggugauc

SEQ ID NO: 932860 - RNA, 18 nt, Mycobacterium avium subsp. paratuberculosis
gccgcagcggugaucgcg

SEQ ID NO: 932861 - RNA, 21 nt, Mycobacterium avium subsp. paratuberculosis
gccgcagcggugaucgcguca

SEQ ID NO: 932862 - RNA, 18 nt, Mycobacterium avium subsp. paratuberculosis
gccgcagcgugggcaccg

SEQ ID NO: 932863 - RNA, 22 nt, Mycobacterium avium subsp. paratuberculosis
gccgcagcgugggcaccggcac

SEQ ID NO: 932864 - RNA, 22 nt, Mycobacterium avium subsp. paratuberculosis
gccgcagcucgaucacccaggu

SEQ ID NO: 932865 - RNA, 13 nt, Mycobacterium avium subsp. paratuberculosis
gccgcagcucgcc

SEQ ID NO: 932866 - RNA, 16 nt, Mycobacterium avium subsp. paratuberculosis
gccgcagcucgcccag

SEQ ID NO: 932867 - RNA, 17 nt, Mycobacterium avium subsp. paratuberculosis
gccgcagcucgcccagc

SEQ ID NO: 932868 - RNA, 18 nt, Mycobacterium avium subsp. paratuberculosis
gccgcagcucgcccagca

SEQ ID NO: 932869 - RNA, 19 nt, Mycobacterium avium subsp. paratuberculosis
gccgcagcucgcccagcac

SEQ ID NO: 932870 - RNA, 21 nt, Mycobacterium avium subsp. paratuberculosis
gccgcagcucgcccagcaccg

SEQ ID NO: 932871 - RNA, 14 nt, Mycobacterium avium subsp. paratuberculosis
gccgcagcggcgcc

SEQ ID NO: 932872 - RNA, 15 nt, Mycobacterium avium subsp. paratuberculosis
gccgcagcggcgccg

SEQ ID NO: 932873 - RNA, 17 nt, Mycobacterium avium subsp. paratuberculosis
gccgcagcggcgccgca

SEQ ID NO: 932874 - RNA, 18 nt, Mycobacterium avium subsp. paratuberculosis
gccgcagcggcgccgcag

SEQ ID NO: 932875 - RNA, 23 nt, Mycobacterium avium subsp. paratuberculosis
gccgcagcggcgccgcagcucgu

SEQ ID NO: 932876 - RNA, 17 nt, Mycobacterium avium subsp. paratuberculosis
gccgcagcggcggcacg

SEQ ID NO: 932877 - RNA, 15 nt, Mycobacterium avium subsp. paratuberculosis
gccgcagcggcggcu

SEQ ID NO: 932878 - RNA, 20 nt, Mycobacterium avium subsp. paratuberculosis
gccgcagcggcaggucgucg

SEQ ID NO: 932879 - RNA, 21 nt, Mycobacterium avium subsp. paratuberculosis
gccgcagcggcaggucgucgu

SEQ ID NO: 932880 - RNA, 15 nt, Mycobacterium avium subsp. paratuberculosis
gccgcagcgcccggc

SEQ ID NO: 932881 - RNA, 18 nt, Mycobacterium avium subsp. paratuberculosis
gccgcagcgcccggcagc

SEQ ID NO: 932882 - RNA, 12 nt, Mycobacterium avium subsp. paratuberculosis
gccgcagcgcga

SEQ ID NO: 932883 - RNA, 15 nt, Mycobacterium avium subsp. paratuberculosis
gccgcagcgcgacga

SEQ ID NO: 932884 - RNA, 13 nt, Mycobacterium avium subsp. paratuberculosis
gccgcagcgcgcg

SEQ ID NO: 932885 - RNA, 15 nt, Mycobacterium avium subsp. paratuberculosis
gccgcagcgcgcgac

SEQ ID NO: 932886 - RNA, 16 nt, Mycobacterium avium subsp. paratuberculosis
gccgcagcgcgcgacc

SEQ ID NO: 932887 - RNA, 17 nt, Mycobacterium avium subsp. paratuberculosis
gccgcagcgcgcgaccg

SEQ ID NO: 932888 - RNA, 19 nt, Mycobacterium avium subsp. paratuberculosis
gccgcagcgcgcgaccgcg

SEQ ID NO: 932889 - RNA, 16 nt, Mycobacterium avium subsp. paratuberculosis
gccgcagcgcgcgcuc

SEQ ID NO: 932890 - RNA, 14 nt, Mycobacterium avium subsp. paratuberculosis
gccgcagcgcggcg

SEQ ID NO: 932891 - RNA, 17 nt, Mycobacterium avium subsp. paratuberculosis
gccgcaugaugcggcca

SEQ ID NO: 932892 - RNA, 16 nt, Mycobacterium avium subsp. paratuberculosis
gccgccaccacggcag

SEQ ID NO: 932893 - RNA, 15 nt, Mycobacterium avium subsp. paratuberculosis
gccgccaccccaggc

SEQ ID NO: 932894 - RNA, 16 nt, Mycobacterium avium subsp. paratuberculosis
gccgccaccgucgccg

SEQ ID NO: 932895 - RNA, 18 nt, Mycobacterium avium subsp. paratuberculosis
gccgccaccgucgccggc

SEQ ID NO: 932896 - RNA, 12 nt, Mycobacterium avium subsp. paratuberculosis
gccgccaccgcc

SEQ ID NO: 932897 - RNA, 14 nt, Mycobacterium avium subsp. paratuberculosis
gccgccaccgccau

SEQ ID NO: 932898 - RNA, 12 nt, Mycobacterium avium subsp. paratuberculosis
gccgccaccggc

SEQ ID NO: 932899 - RNA, 13 nt, Mycobacterium avium subsp. paratuberculosis
gccgccaccggcc

SEQ ID NO: 932900 - RNA, 16 nt, Mycobacterium avium subsp. paratuberculosis
gccgccaccggccggu

SEQ ID NO: 932901 - RNA, 18 nt, Mycobacterium avium subsp. paratuberculosis
gccgccaccggccggucc

SEQ ID NO: 932902 - RNA, 23 nt, Mycobacterium avium subsp. paratuberculosis
gccgccaccggccgguccgccca

SEQ ID NO: 932903 - RNA, 23 nt, Mycobacterium avium subsp. paratuberculosis
gccgcaucguugguccaggcguu

SEQ ID NO: 932904 - RNA, 15 nt, Mycobacterium avium subsp. paratuberculosis
gccgcauccagcgcc

SEQ ID NO: 932905 - RNA, 20 nt, Mycobacterium avium subsp. paratuberculosis
gccgcauccagcgccgccaa

SEQ ID NO: 932906 - RNA, 20 nt, Mycobacterium avium subsp. paratuberculosis
gccgcaggguggccagcacc

SEQ ID NO: 932907 - RNA, 22 nt, Mycobacterium avium subsp. paratuberculosis
gccgcaggguggccagcaccgc

SEQ ID NO: 932908 - RNA, 23 nt, Mycobacterium avium subsp. paratuberculosis
gccgcaggguggccagcaccgcg

SEQ ID NO: 932909 - RNA, 13 nt, Mycobacterium avium subsp. paratuberculosis
gccgcaggugcag

SEQ ID NO: 932910 - RNA, 17 nt, Mycobacterium avium subsp. paratuberculosis
gccgcaggugcucgccg

SEQ ID NO: 932911 - RNA, 19 nt, Mycobacterium avium subsp. paratuberculosis
gccgcaggugcucgccggc

SEQ ID NO: 932912 - RNA, 20 nt, Mycobacterium avium subsp. paratuberculosis
gccgcaggugcucgccggcg

SEQ ID NO: 932913 - RNA, 14 nt, Mycobacterium avium subsp. paratuberculosis
gccgcaggcgaagg

SEQ ID NO: 932914 - RNA, 14 nt, Mycobacterium avium subsp. paratuberculosis
gccgcaggcggcca

SEQ ID NO: 932915 - RNA, 15 nt, Mycobacterium avium subsp. paratuberculosis
gccgcaggcggccag

SEQ ID NO: 932916 - RNA, 16 nt, Mycobacterium avium subsp. paratuberculosis
gccgcauccgcgagcc

SEQ ID NO: 932917 - RNA, 22 nt, Mycobacterium avium subsp. paratuberculosis
gccgcaucgcaagaaccuccau

SEQ ID NO: 932918 - RNA, 22 nt, Mycobacterium avium subsp. paratuberculosis
gccgacgauacgugcucccgcc

SEQ ID NO: 932919 - RNA, 16 nt, Mycobacterium avium subsp. paratuberculosis
gccgacgaucccggcg

SEQ ID NO: 932920 - RNA, 20 nt, Mycobacterium avium subsp. paratuberculosis
gccgacgccgaagaucagcg

SEQ ID NO: 932921 - RNA, 13 nt, Mycobacterium avium subsp. paratuberculosis
gccgacgccggcc

SEQ ID NO: 932922 - RNA, 23 nt, Mycobacterium avium subsp. paratuberculosis
gccgacgccgucgaugacgcgcu

SEQ ID NO: 932923 - RNA, 12 nt, Mycobacterium avium subsp. paratuberculosis
gccgacgccguu

SEQ ID NO: 932924 - RNA, 20 nt, Mycobacterium avium subsp. paratuberculosis
gccgacgccguuucggaucc

SEQ ID NO: 932925 - RNA, 15 nt, Mycobacterium avium subsp. paratuberculosis
gccgacgccugcgcg

SEQ ID NO: 932926 - RNA, 15 nt, Mycobacterium avium subsp. paratuberculosis
gccgaccuggucgcc

SEQ ID NO: 932927 - RNA, 18 nt, Mycobacterium avium subsp. paratuberculosis
gccgaccuugacccaggc

SEQ ID NO: 932928 - RNA, 17 nt, Mycobacterium avium subsp. paratuberculosis
gccgacgaagaucccgc

SEQ ID NO: 932929 - RNA, 19 nt, Mycobacterium avium subsp. paratuberculosis
gccgacgaagaucccgcug

SEQ ID NO: 932930 - RNA, 20 nt, Mycobacterium avium subsp. paratuberculosis
gccgacgaagaugcgcccgg

SEQ ID NO: 932931 - RNA, 13 nt, Mycobacterium avium subsp. paratuberculosis
gccgacgacggcg

SEQ ID NO: 932932 - RNA, 15 nt, Mycobacterium avium subsp. paratuberculosis
gccgacgacgucgcg

SEQ ID NO: 932933 - RNA, 14 nt, Mycobacterium avium subsp. paratuberculosis
gccgaccggccggu

SEQ ID NO: 932934 - RNA, 19 nt, Mycobacterium avium subsp. paratuberculosis
gccgaccggccgguuguug

SEQ ID NO: 932935 - RNA, 20 nt, Mycobacterium avium subsp. paratuberculosis
gccgaccggccgguuguugc

SEQ ID NO: 932936 - RNA, 22 nt, Mycobacterium avium subsp. paratuberculosis
gccgaccggccgguuguugcgg

SEQ ID NO: 932937 - RNA, 14 nt, Mycobacterium avium subsp. paratuberculosis
gccgaccgguccgc

SEQ ID NO: 932938 - RNA, 15 nt, Mycobacterium avium subsp. paratuberculosis
gccgaccgguccgcc

SEQ ID NO: 932939 - RNA, 18 nt, Mycobacterium avium subsp. paratuberculosis
gccgaccgguccgccgcc

SEQ ID NO: 932940 - RNA, 19 nt, Mycobacterium avium subsp. paratuberculosis
gccgaccgguccgccgccg

SEQ ID NO: 932941 - RNA, 20 nt, Mycobacterium avium subsp. paratuberculosis
gccgaccgguccgccgccgg

SEQ ID NO: 932942 - RNA, 22 nt, Mycobacterium avium subsp. paratuberculosis
gccgaccgguccgccgccggcg

SEQ ID NO: 932943 - RNA, 15 nt, Mycobacterium avium subsp. paratuberculosis
gccgaccggucucga

SEQ ID NO: 932944 - RNA, 18 nt, Mycobacterium avium subsp. paratuberculosis
gccgaccuggcggccgga

SEQ ID NO: 932945 - RNA, 16 nt, Mycobacterium avium subsp. paratuberculosis
gccgaccugggcggcc

SEQ ID NO: 932946 - RNA, 19 nt, Mycobacterium avium subsp. paratuberculosis
gccgaccugggcggccacc

SEQ ID NO: 932947 - RNA, 16 nt, Mycobacterium avium subsp. paratuberculosis
gccgaccgcgaucgag

SEQ ID NO: 932948 - RNA, 23 nt, Mycobacterium avium subsp. paratuberculosis
gccgaccuguagggcgagcucgu

SEQ ID NO: 932949 - RNA, 19 nt, Mycobacterium avium subsp. paratuberculosis
gccgacagaugcggcacca

SEQ ID NO: 932950 - RNA, 21 nt, Mycobacterium avium subsp. paratuberculosis
gccgacagaugcggcaccagc

SEQ ID NO: 932951 - RNA, 22 nt, Mycobacterium avium subsp. paratuberculosis
gccgacagaugcggcaccagcc

SEQ ID NO: 932952 - RNA, 15 nt, Mycobacterium avium subsp. paratuberculosis
gccgacagcacgccg

SEQ ID NO: 932953 - RNA, 22 nt, Mycobacterium avium subsp. paratuberculosis
gccgacagcacgccgggcaugc

SEQ ID NO: 932954 - RNA, 14 nt, Mycobacterium avium subsp. paratuberculosis
gccgacagcagcuc

SEQ ID NO: 932955 - RNA, 16 nt, Mycobacterium avium subsp. paratuberculosis
gccgacagcgcgucgg

SEQ ID NO: 932956 - RNA, 19 nt, Mycobacterium avium subsp. paratuberculosis
gccgacagcgcgucggcga

SEQ ID NO: 932957 - RNA, 13 nt, Mycobacterium avium subsp. paratuberculosis
gccgacaugcugg

SEQ ID NO: 932958 - RNA, 14 nt, Mycobacterium avium subsp. paratuberculosis
gccgacaugcuggg

SEQ ID NO: 932959 - RNA, 18 nt, Mycobacterium avium subsp. paratuberculosis
gccgacauggacgcggcc

SEQ ID NO: 932960 - RNA, 20 nt, Mycobacterium avium subsp. paratuberculosis
gccgacauggacgcggccuc

SEQ ID NO: 932961 - RNA, 14 nt, Mycobacterium avium subsp. paratuberculosis
gccgacauccgggu

SEQ ID NO: 932962 - RNA, 16 nt, Mycobacterium avium subsp. paratuberculosis
gccgacauccggguag

SEQ ID NO: 932963 - RNA, 14 nt, Mycobacterium avium subsp. paratuberculosis
gccgacaucgcccg

SEQ ID NO: 932964 - RNA, 14 nt, Mycobacterium avium subsp. paratuberculosis
gccgacaucgcggc

SEQ ID NO: 932965 - RNA, 15 nt, Mycobacterium avium subsp. paratuberculosis
gccgacaucgcggcg

SEQ ID NO: 932966 - RNA, 17 nt, Mycobacterium avium subsp. paratuberculosis
gccgacaucgcggcgau

SEQ ID NO: 932967 - RNA, 16 nt, Mycobacterium avium subsp. paratuberculosis
gccgacagggugccaa

SEQ ID NO: 932968 - RNA, 23 nt, Mycobacterium avium subsp. paratuberculosis
gccgacagggugccaaggucgcc

SEQ ID NO: 932969 - RNA, 22 nt, Mycobacterium avium subsp. paratuberculosis
gccgacagguagcaggcgcgca

SEQ ID NO: 932970 - RNA, 23 nt, Mycobacterium avium subsp. paratuberculosis
gccgacagguagcaggcgcgcag

SEQ ID NO: 932971 - RNA, 13 nt, Mycobacterium avium subsp. paratuberculosis
gccgacagcgucg

SEQ ID NO: 932972 - RNA, 23 nt, Mycobacterium avium subsp. paratuberculosis
gccgacagcugagcagcccgacc

SEQ ID NO: 932973 - RNA, 17 nt, Mycobacterium avium subsp. paratuberculosis
gccgacagucgcgggcg

SEQ ID NO: 932974 - RNA, 18 nt, Mycobacterium avium subsp. paratuberculosis
gccgacagucgcgggcgg

SEQ ID NO: 932975 - RNA, 21 nt, Mycobacterium avium subsp. paratuberculosis
gccgacagucgcgggcggggc

SEQ ID NO: 932976 - RNA, 14 nt, Mycobacterium avium subsp. paratuberculosis
gccgacccccgccg

SEQ ID NO: 932977 - RNA, 16 nt, Mycobacterium avium subsp. paratuberculosis
gccgacccccgccgcg

SEQ ID NO: 932978 - RNA, 19 nt, Mycobacterium avium subsp. paratuberculosis
gccgacccccgccgcgucg

SEQ ID NO: 932979 - RNA, 20 nt, Mycobacterium avium subsp. paratuberculosis
gccgacccccgccgcgucgg

SEQ ID NO: 932980 - RNA, 18 nt, Mycobacterium avium subsp. paratuberculosis
gccgaccccgaugcgcuc

SEQ ID NO: 932981 - RNA, 12 nt, Mycobacterium avium subsp. paratuberculosis
gccgacccgccc

SEQ ID NO: 932982 - RNA, 14 nt, Mycobacterium avium subsp. paratuberculosis
gccgacccgcccgc

SEQ ID NO: 932983 - RNA, 18 nt, Mycobacterium avium subsp. paratuberculosis
gccgacccgcccgccggg

SEQ ID NO: 932984 - RNA, 23 nt, Mycobacterium avium subsp. paratuberculosis
gccgacccgcccgccgggcaccc

SEQ ID NO: 932985 - RNA, 15 nt, Mycobacterium avium subsp. paratuberculosis
gccgaccgccccgcu

SEQ ID NO: 932986 - RNA, 13 nt, Mycobacterium avium subsp. paratuberculosis
gccgaccgcccgc

SEQ ID NO: 932987 - RNA, 12 nt, Mycobacterium avium subsp. paratuberculosis
gccgaccgccga

SEQ ID NO: 932988 - RNA, 12 nt, Mycobacterium avium subsp. paratuberculosis
gccgaccgccgc

SEQ ID NO: 932989 - RNA, 13 nt, Mycobacterium avium subsp. paratuberculosis
gccgaccgccgcc

SEQ ID NO: 932990 - RNA, 16 nt, Mycobacterium avium subsp. paratuberculosis
gccgaccgccgccauc

SEQ ID NO: 932991 - RNA, 17 nt, Mycobacterium avium subsp. paratuberculosis
gccgaccgccgccaucc

SEQ ID NO: 932992 - RNA, 15 nt, Mycobacterium avium subsp. paratuberculosis
gccgaccgcggucgc

SEQ ID NO: 932993 - RNA, 16 nt, Mycobacterium avium subsp. paratuberculosis
gccgaccgcgugucgg

SEQ ID NO: 932994 - RNA, 23 nt, Mycobacterium avium subsp. paratuberculosis
gccgaccgcgugucggcacacca

SEQ ID NO: 932995 - RNA, 19 nt, Mycobacterium avium subsp. paratuberculosis
gccgaccaguucggccacc

SEQ ID NO: 932996 - RNA, 19 nt, Mycobacterium avium subsp. paratuberculosis
gccgacaucucccggucga

SEQ ID NO: 932997 - RNA, 12 nt, Mycobacterium avium subsp. paratuberculosis
gccgaccaggaa

SEQ ID NO: 932998 - RNA, 18 nt, Mycobacterium avium subsp. paratuberculosis
gccgaccaacacccccgc

SEQ ID NO: 932999 - RNA, 21 nt, Mycobacterium avium subsp. paratuberculosis
gccgaccaacacccccgcgcu

SEQ ID NO: 933000 - RNA, 15 nt, Mycobacterium avium subsp. paratuberculosis
gccgaccagcgcguu

SEQ ID NO: 933001 - RNA, 20 nt, Mycobacterium avium subsp. paratuberculosis
gccgaccagcggucgggugc

SEQ ID NO: 933002 - RNA, 14 nt, Mycobacterium avium subsp. paratuberculosis
gccgaacaccacgc

SEQ ID NO: 933003 - RNA, 18 nt, Mycobacterium avium subsp. paratuberculosis
gccgaaaaaccugcggug

SEQ ID NO: 933004 - RNA, 20 nt, Mycobacterium avium subsp. paratuberculosis
gccgaaaaaccugcggugcc

SEQ ID NO: 933005 - RNA, 21 nt, Mycobacterium avium subsp. paratuberculosis
gccgaaaaaccugcggugcca

SEQ ID NO: 933006 - RNA, 18 nt, Mycobacterium avium subsp. paratuberculosis
gcccuuguugacguaccg

SEQ ID NO: 933007 - RNA, 19 nt, Mycobacterium avium subsp. paratuberculosis
gcccuuuacccggacgaug

SEQ ID NO: 933008 - RNA, 22 nt, Mycobacterium avium subsp. paratuberculosis
gccgaacaccgucaucgugugg

SEQ ID NO: 933009 - RNA, 15 nt, Mycobacterium avium subsp. paratuberculosis
gccgaacagcagcga

SEQ ID NO: 933010 - RNA, 20 nt, Mycobacterium avium subsp. paratuberculosis
gccgaacagcagcgcgccga

SEQ ID NO: 933011 - RNA, 14 nt, Mycobacterium avium subsp. paratuberculosis
gccgaacaccggca

SEQ ID NO: 933012 - RNA, 16 nt, Mycobacterium avium subsp. paratuberculosis
gccgaacaccggcagc

SEQ ID NO: 933013 - RNA, 22 nt, Mycobacterium avium subsp. paratuberculosis
gccgaacaccggcagcgccacc

SEQ ID NO: 933014 - RNA, 13 nt, Mycobacterium avium subsp. paratuberculosis
gccgaacaccguc

SEQ ID NO: 933015 - RNA, 17 nt, Mycobacterium avium subsp. paratuberculosis
gccgaacaccugcggcg

SEQ ID NO: 933016 - RNA, 21 nt, Mycobacterium avium subsp. paratuberculosis
gccgaacaccugcggcggcag

SEQ ID NO: 933017 - RNA, 22 nt, Mycobacterium avium subsp. paratuberculosis
gccgaacacguacagcggcggc

SEQ ID NO: 933018 - RNA, 15 nt, Mycobacterium avium subsp. paratuberculosis
gcccuuguccucgag

SEQ ID NO: 933019 - RNA, 21 nt, Mycobacterium avium subsp. paratuberculosis
gcccuugguguaggcgaucgg

SEQ ID NO: 933020 - RNA, 17 nt, Mycobacterium avium subsp. paratuberculosis
gcccuugcucgcggcgu

SEQ ID NO: 933021 - RNA, 17 nt, Mycobacterium avium subsp. paratuberculosis
gcccuuggcccgggcgu

SEQ ID NO: 933022 - RNA, 16 nt, Mycobacterium avium subsp. paratuberculosis
gcccuuggcggccacg

SEQ ID NO: 933023 - RNA, 20 nt, Mycobacterium avium subsp. paratuberculosis
gcccuuggcggccacgacgg

SEQ ID NO: 933024 - RNA, 13 nt, Mycobacterium avium subsp. paratuberculosis
gcccuucggcgcc

SEQ ID NO: 933025 - RNA, 18 nt, Mycobacterium avium subsp. paratuberculosis
gcccuugaacggcaccag

SEQ ID NO: 933026 - RNA, 22 nt, Mycobacterium avium subsp. paratuberculosis
gcccuugaagcgcagaucgcgc

SEQ ID NO: 933027 - RNA, 22 nt, Mycobacterium avium subsp. paratuberculosis
gcccuugagcuucccggcgguc

SEQ ID NO: 933028 - RNA, 15 nt, Mycobacterium avium subsp. paratuberculosis
gcccuugaccgccug

SEQ ID NO: 933029 - RNA, 18 nt, Mycobacterium avium subsp. paratuberculosis
gcccuugcagcacaccgg

SEQ ID NO: 933030 - RNA, 23 nt, Mycobacterium avium subsp. paratuberculosis
gcccuugaucgucuugccgaaga

SEQ ID NO: 933031 - RNA, 16 nt, Mycobacterium avium subsp. paratuberculosis
gccgacaccaccacga

SEQ ID NO: 933032 - RNA, 15 nt, Mycobacterium avium subsp. paratuberculosis
gccgacaccaccgcg

SEQ ID NO: 933033 - RNA, 16 nt, Mycobacterium avium subsp. paratuberculosis
gccgacaccaccgcgc

SEQ ID NO: 933034 - RNA, 12 nt, Mycobacterium avium subsp. paratuberculosis
gccgacaccagc

SEQ ID NO: 933035 - RNA, 15 nt, Mycobacterium avium subsp. paratuberculosis
gccgacaccagcgcg

SEQ ID NO: 933036 - RNA, 16 nt, Mycobacterium avium subsp. paratuberculosis
gccgacaccagcgcgc

SEQ ID NO: 933037 - RNA, 22 nt, Mycobacterium avium subsp. paratuberculosis
gccgacaccagcgcgcacgcgg

SEQ ID NO: 933038 - RNA, 12 nt, Mycobacterium avium subsp. paratuberculosis
gccgacacccca

SEQ ID NO: 933039 - RNA, 14 nt, Mycobacterium avium subsp. paratuberculosis
gccgacaccccaca

SEQ ID NO: 933040 - RNA, 19 nt, Mycobacterium avium subsp. paratuberculosis
gccgacaccccacaccguc

SEQ ID NO: 933041 - RNA, 24 nt, Mycobacterium avium subsp. paratuberculosis
gccgacaccccacaccguccgacc

SEQ ID NO: 933042 - RNA, 18 nt, Mycobacterium avium subsp. paratuberculosis
gccgacaccccgaugccg

SEQ ID NO: 933043 - RNA, 20 nt, Mycobacterium avium subsp. paratuberculosis
gccgacaccccgaugccgaa

SEQ ID NO: 933044 - RNA, 17 nt, Mycobacterium avium subsp. paratuberculosis
gccgaagaucagcgcgu

SEQ ID NO: 933045 - RNA, 21 nt, Mycobacterium avium subsp. paratuberculosis
gccgaagaucagcgcguccaa

SEQ ID NO: 933046 - RNA, 21 nt, Mycobacterium avium subsp. paratuberculosis
gccgaaggcggcgccggccgg

SEQ ID NO: 933047 - RNA, 23 nt, Mycobacterium avium subsp. paratuberculosis
gccgaaguuccagccgaucgcgg

SEQ ID NO: 933048 - RNA, 14 nt, Mycobacterium avium subsp. paratuberculosis
gccgaaguuggcgu

SEQ ID NO: 933049 - RNA, 13 nt, Mycobacterium avium subsp. paratuberculosis
gccgaaguugucg

SEQ ID NO: 933050 - RNA, 15 nt, Mycobacterium avium subsp. paratuberculosis
gccgaagauggccag

SEQ ID NO: 933051 - RNA, 18 nt, Mycobacterium avium subsp. paratuberculosis
gccgaagauggccagcgc

SEQ ID NO: 933052 - RNA, 20 nt, Mycobacterium avium subsp. paratuberculosis
gccgaagauggccagcgcgg

SEQ ID NO: 933053 - RNA, 22 nt, Mycobacterium avium subsp. paratuberculosis
gccgaacugguuguagucgucg

SEQ ID NO: 933054 - RNA, 23 nt, Mycobacterium avium subsp. paratuberculosis
gccgaacugguuguagucgucga

SEQ ID NO: 933055 - RNA, 22 nt, Mycobacterium avium subsp. paratuberculosis
gccgaagaacgacuggcggcgg

SEQ ID NO: 933056 - RNA, 23 nt, Mycobacterium avium subsp. paratuberculosis
gccgaagaacgacuggcggcggc

SEQ ID NO: 933057 - RNA, 18 nt, Mycobacterium avium subsp. paratuberculosis
gccgaagaacucagccga

SEQ ID NO: 933058 - RNA, 19 nt, Mycobacterium avium subsp. paratuberculosis
gccgaagaacucagccgaa

SEQ ID NO: 933059 - RNA, 16 nt, Mycobacterium avium subsp. paratuberculosis
gccgaagaagauguug

SEQ ID NO: 933060 - RNA, 17 nt, Mycobacterium avium subsp. paratuberculosis
gccgaagaagauguugc

SEQ ID NO: 933061 - RNA, 16 nt, Mycobacterium avium subsp. paratuberculosis
gccgaagaccgggccg

SEQ ID NO: 933062 - RNA, 13 nt, Mycobacterium avium subsp. paratuberculosis
gccgaacugccgg

SEQ ID NO: 933063 - RNA, 17 nt, Mycobacterium avium subsp. paratuberculosis
gccgaacugccggacca

SEQ ID NO: 933064 - RNA, 13 nt, Mycobacterium avium subsp. paratuberculosis
gccgaacucggcg

SEQ ID NO: 933065 - RNA, 16 nt, Mycobacterium avium subsp. paratuberculosis
gccgaacucggcgccg

SEQ ID NO: 933066 - RNA, 22 nt, Mycobacterium avium subsp. paratuberculosis
gccgaacucggcgccgccgguc

SEQ ID NO: 933067 - RNA, 18 nt, Mycobacterium avium subsp. paratuberculosis
gccgaacucucccaggac

SEQ ID NO: 933068 - RNA, 12 nt, Mycobacterium avium subsp. paratuberculosis
gccgaacagcga

SEQ ID NO: 933069 - RNA, 16 nt, Mycobacterium avium subsp. paratuberculosis
gccgaacagcgacguc

SEQ ID NO: 933070 - RNA, 14 nt, Mycobacterium avium subsp. paratuberculosis
gccgaacaggcgca

SEQ ID NO: 933071 - RNA, 14 nt, Mycobacterium avium subsp. paratuberculosis
gccgaacuccgccg

SEQ ID NO: 933072 - RNA, 16 nt, Mycobacterium avium subsp. paratuberculosis
gccgaacuccgccgaa

SEQ ID NO: 933073 - RNA, 17 nt, Mycobacterium avium subsp. paratuberculosis
gccgaacuccgccgaac

SEQ ID NO: 933074 - RNA, 21 nt, Mycobacterium avium subsp. paratuberculosis
gcccugguugagcaccgcgau

SEQ ID NO: 933075 - RNA, 21 nt, Mycobacterium avium subsp. paratuberculosis
gcccugguugauccagcggcg

SEQ ID NO: 933076 - RNA, 16 nt, Mycobacterium avium subsp. paratuberculosis
gcccuggugcaacacc

SEQ ID NO: 933077 - RNA, 18 nt, Mycobacterium avium subsp. paratuberculosis
gcccuguucgccgucgcg

SEQ ID NO: 933078 - RNA, 14 nt, Mycobacterium avium subsp. paratuberculosis
gcccugugaggcgu

SEQ ID NO: 933079 - RNA, 13 nt, Mycobacterium avium subsp. paratuberculosis
gcccuuccagcac

SEQ ID NO: 933080 - RNA, 18 nt, Mycobacterium avium subsp. paratuberculosis
gcccuuccccggcggccg

SEQ ID NO: 933081 - RNA, 20 nt, Mycobacterium avium subsp. paratuberculosis
gcccuuccccggcggccggc

SEQ ID NO: 933082 - RNA, 14 nt, Mycobacterium avium subsp. paratuberculosis
gcccuucaccucgg

SEQ ID NO: 933083 - RNA, 17 nt, Mycobacterium avium subsp. paratuberculosis
gcccuucaccucggccu

SEQ ID NO: 933084 - RNA, 12 nt, Mycobacterium avium subsp. paratuberculosis
gcccuucgaccu

SEQ ID NO: 933085 - RNA, 20 nt, Mycobacterium avium subsp. paratuberculosis
gcccuggcgggcggcccgca

SEQ ID NO: 933086 - RNA, 20 nt, Mycobacterium avium subsp. paratuberculosis
gcccuggcaggugagccggg

SEQ ID NO: 933087 - RNA, 15 nt, Mycobacterium avium subsp. paratuberculosis
gcccuggccgccggc

SEQ ID NO: 933088 - RNA, 19 nt, Mycobacterium avium subsp. paratuberculosis
gcccuggccgccggccgcg

SEQ ID NO: 933089 - RNA, 20 nt, Mycobacterium avium subsp. paratuberculosis
gcccugcagguagguggcca

SEQ ID NO: 933090 - RNA, 22 nt, Mycobacterium avium subsp. paratuberculosis
gcccugcagguucugcacgugg

SEQ ID NO: 933091 - RNA, 17 nt, Mycobacterium avium subsp. paratuberculosis
gcccugcagccgggugg

SEQ ID NO: 933092 - RNA, 22 nt, Mycobacterium avium subsp. paratuberculosis
gcccugcagcgccuugaccgcg

SEQ ID NO: 933093 - RNA, 14 nt, Mycobacterium avium subsp. paratuberculosis
gcccugcagcgcga

SEQ ID NO: 933094 - RNA, 19 nt, Mycobacterium avium subsp. paratuberculosis
gcccugcacgaucucggcg

SEQ ID NO: 933095 - RNA, 22 nt, Mycobacterium avium subsp. paratuberculosis
gcccugcacgaucucggcgguc

SEQ ID NO: 933096 - RNA, 23 nt, Mycobacterium avium subsp. paratuberculosis
gcccugcacgcaaaaaccaugcc

SEQ ID NO: 933097 - RNA, 14 nt, Mycobacterium avium subsp. paratuberculosis
gcccugcgccagca

SEQ ID NO: 933098 - RNA, 15 nt, Mycobacterium avium subsp. paratuberculosis
gcccugcgccagcag

SEQ ID NO: 933099 - RNA, 16 nt, Mycobacterium avium subsp. paratuberculosis
gcccugcgccagcagc

SEQ ID NO: 933100 - RNA, 19 nt, Mycobacterium avium subsp. paratuberculosis
gcccugcgccagcagcagc

SEQ ID NO: 933101 - RNA, 17 nt, Mycobacterium avium subsp. paratuberculosis
gcccugccugcugccca

SEQ ID NO: 933102 - RNA, 22 nt, Mycobacterium avium subsp. paratuberculosis
gcccugcgaauacccgcccagc

SEQ ID NO: 933103 - RNA, 16 nt, Mycobacterium avium subsp. paratuberculosis
gcccugcgagcccggg

SEQ ID NO: 933104 - RNA, 22 nt, Mycobacterium avium subsp. paratuberculosis
gcccugcgagcccgggaacguc

SEQ ID NO: 933105 - RNA, 16 nt, Mycobacterium avium subsp. paratuberculosis
gcccugcccgucgggc

SEQ ID NO: 933106 - RNA, 17 nt, Mycobacterium avium subsp. paratuberculosis
gcccugcucgucguuga

SEQ ID NO: 933107 - RNA, 15 nt, Mycobacterium avium subsp. paratuberculosis
gcccugcucggccag

SEQ ID NO: 933108 - RNA, 18 nt, Mycobacterium avium subsp. paratuberculosis
gcccugcucggugaugcc

SEQ ID NO: 933109 - RNA, 20 nt, Mycobacterium avium subsp. paratuberculosis
gcccugcucggugaugccga

SEQ ID NO: 933110 - RNA, 18 nt, Mycobacterium avium subsp. paratuberculosis
gcccuggaugucacgguc

SEQ ID NO: 933111 - RNA, 19 nt, Mycobacterium avium subsp. paratuberculosis
gcccugcuugaccgcgacg

SEQ ID NO: 933112 - RNA, 14 nt, Mycobacterium avium subsp. paratuberculosis
gcccuggaaggcga

SEQ ID NO: 933113 - RNA, 18 nt, Mycobacterium avium subsp. paratuberculosis
gcccuggaaggcgaucac

SEQ ID NO: 933114 - RNA, 15 nt, Mycobacterium avium subsp. paratuberculosis
gcccucuuccucgcu

SEQ ID NO: 933115 - RNA, 19 nt, Mycobacterium avium subsp. paratuberculosis
gcccucgucggcgagcagc

SEQ ID NO: 933116 - RNA, 22 nt, Mycobacterium avium subsp. paratuberculosis
gcccucguagaaggaccggucc

SEQ ID NO: 933117 - RNA, 17 nt, Mycobacterium avium subsp. paratuberculosis
gcccucguagcggccgc

SEQ ID NO: 933118 - RNA, 20 nt, Mycobacterium avium subsp. paratuberculosis
gcccucguccgacagcgccu

SEQ ID NO: 933119 - RNA, 13 nt, Mycobacterium avium subsp. paratuberculosis
gcccucgucgacc

SEQ ID NO: 933120 - RNA, 18 nt, Mycobacterium avium subsp. paratuberculosis
gcccucgucgaccagggc

SEQ ID NO: 933121 - RNA, 14 nt, Mycobacterium avium subsp. paratuberculosis
gcccucgucgauga

SEQ ID NO: 933122 - RNA, 20 nt, Mycobacterium avium subsp. paratuberculosis
gcccucgucuuccgcggcgg

SEQ ID NO: 933123 - RNA, 21 nt, Mycobacterium avium subsp. paratuberculosis
gcccucgugcguagcggcccg

SEQ ID NO: 933124 - RNA, 16 nt, Mycobacterium avium subsp. paratuberculosis
gcccucgcugaucuuc

SEQ ID NO: 933125 - RNA, 14 nt, Mycobacterium avium subsp. paratuberculosis
gcccugcacccagc

SEQ ID NO: 933126 - RNA, 15 nt, Mycobacterium avium subsp. paratuberculosis
gcccugaggcccggu

SEQ ID NO: 933127 - RNA, 15 nt, Mycobacterium avium subsp. paratuberculosis
gcccugaagcugggc

SEQ ID NO: 933128 - RNA, 16 nt, Mycobacterium avium subsp. paratuberculosis
gcccugaagcugggcg

SEQ ID NO: 933129 - RNA, 17 nt, Mycobacterium avium subsp. paratuberculosis
gcccugacacagcaccg

SEQ ID NO: 933130 - RNA, 19 nt, Mycobacterium avium subsp. paratuberculosis
gcccugacacagcaccggc

SEQ ID NO: 933131 - RNA, 21 nt, Mycobacterium avium subsp. paratuberculosis
gcccucggacgggagacgcug

SEQ ID NO: 933132 - RNA, 16 nt, Mycobacterium avium subsp. paratuberculosis
gcccucggaggugccg

SEQ ID NO: 933133 - RNA, 19 nt, Mycobacterium avium subsp. paratuberculosis
gcccucggaggugccgcgc

SEQ ID NO: 933134 - RNA, 12 nt, Mycobacterium avium subsp. paratuberculosis
gcccucggccag

SEQ ID NO: 933135 - RNA, 12 nt, Mycobacterium avium subsp. paratuberculosis
gcccucgccggc

SEQ ID NO: 933136 - RNA, 13 nt, Mycobacterium avium subsp. paratuberculosis
gcccucgccggcg

SEQ ID NO: 933137 - RNA, 14 nt, Mycobacterium avium subsp. paratuberculosis
gcccucgccggcgg

SEQ ID NO: 933138 - RNA, 15 nt, Mycobacterium avium subsp. paratuberculosis
gcccucgccggcggc

SEQ ID NO: 933139 - RNA, 17 nt, Mycobacterium avium subsp. paratuberculosis
gcccucgccggucagcg

SEQ ID NO: 933140 - RNA, 14 nt, Mycobacterium avium subsp. paratuberculosis
gcccucggccagcc

SEQ ID NO: 933141 - RNA, 17 nt, Mycobacterium avium subsp. paratuberculosis
gcccucggccagccagg

SEQ ID NO: 933142 - RNA, 19 nt, Mycobacterium avium subsp. paratuberculosis
gcccucggccguaccggcg

SEQ ID NO: 933143 - RNA, 19 nt, Mycobacterium avium subsp. paratuberculosis
gcccucggcgaucucgucc

SEQ ID NO: 933144 - RNA, 13 nt, Mycobacterium avium subsp. paratuberculosis
gcccuccucgccg

SEQ ID NO: 933145 - RNA, 16 nt, Mycobacterium avium subsp. paratuberculosis
gcccuccuggcgggug

SEQ ID NO: 933146 - RNA, 15 nt, Mycobacterium avium subsp. paratuberculosis
gcccuccuucccggu

SEQ ID NO: 933147 - RNA, 16 nt, Mycobacterium avium subsp. paratuberculosis
gcccgcugaccgccgc

SEQ ID NO: 933148 - RNA, 17 nt, Mycobacterium avium subsp. paratuberculosis
gcccgcugaccgccgcg

SEQ ID NO: 933149 - RNA, 17 nt, Mycobacterium avium subsp. paratuberculosis
gcccgcugcagcgccga

SEQ ID NO: 933150 - RNA, 18 nt, Mycobacterium avium subsp. paratuberculosis
gcccgcugcagcgccgag

SEQ ID NO: 933151 - RNA, 22 nt, Mycobacterium avium subsp. paratuberculosis
gcccucgaaguagagccgcugc

SEQ ID NO: 933152 - RNA, 19 nt, Mycobacterium avium subsp. paratuberculosis
gcccucgacguaguccggc

SEQ ID NO: 933153 - RNA, 22 nt, Mycobacterium avium subsp. paratuberculosis
gcccucgacguaguccggccag

SEQ ID NO: 933154 - RNA, 15 nt, Mycobacterium avium subsp. paratuberculosis
gcccucgacaccggu

SEQ ID NO: 933155 - RNA, 20 nt, Mycobacterium avium subsp. paratuberculosis
gcccucgacaccgguggcgu

SEQ ID NO: 933156 - RNA, 24 nt, Mycobacterium avium subsp. paratuberculosis
gcccucgagccauaaaccggccgg

SEQ ID NO: 933157 - RNA, 19 nt, Mycobacterium avium subsp. paratuberculosis
gcccucgauaauggcggcc

SEQ ID NO: 933158 - RNA, 20 nt, Mycobacterium avium subsp. paratuberculosis
gcccucgauaauggcggccg

SEQ ID NO: 933159 - RNA, 22 nt, Mycobacterium avium subsp. paratuberculosis
gcccucgauaauggcggccgcc

SEQ ID NO: 933160 - RNA, 20 nt, Mycobacterium avium subsp. paratuberculosis
gcccucgaucgcgaccaccg

SEQ ID NO: 933161 - RNA, 21 nt, Mycobacterium avium subsp. paratuberculosis
gcccucgaucgcgaccaccgg

SEQ ID NO: 933162 - RNA, 22 nt, Mycobacterium avium subsp. paratuberculosis
gcccucgaucgcgaccaccggc

SEQ ID NO: 933163 - RNA, 23 nt, Mycobacterium avium subsp. paratuberculosis
gcccucgaucgcgaccaccggcc

SEQ ID NO: 933164 - RNA, 15 nt, Mycobacterium avium subsp. paratuberculosis
gcccgcugaccaggc

SEQ ID NO: 933165 - RNA, 18 nt, Mycobacterium avium subsp. paratuberculosis
gcccgcucggcgggucgu

SEQ ID NO: 933166 - RNA, 21 nt, Mycobacterium avium subsp. paratuberculosis
gcccgcucggcgggucguagc

SEQ ID NO: 933167 - RNA, 23 nt, Mycobacterium avium subsp. paratuberculosis
gcccgcuccugcaggccgagccg

SEQ ID NO: 933168 - RNA, 14 nt, Mycobacterium avium subsp. paratuberculosis
gcccgcucgacggc

SEQ ID NO: 933169 - RNA, 18 nt, Mycobacterium avium subsp. paratuberculosis
gcccgcucgacggccggu

SEQ ID NO: 933170 - RNA, 19 nt, Mycobacterium avium subsp. paratuberculosis
gcccgcucgacggccggug

SEQ ID NO: 933171 - RNA, 16 nt, Mycobacterium avium subsp. paratuberculosis
gcccgcucgaugucgg

SEQ ID NO: 933172 - RNA, 15 nt, Mycobacterium avium subsp. paratuberculosis
gcccgcucgcuagca

SEQ ID NO: 933173 - RNA, 15 nt, Mycobacterium avium subsp. paratuberculosis
gcccgcuccgcgggc

SEQ ID NO: 933174 - RNA, 14 nt, Mycobacterium avium subsp. paratuberculosis
gcccgcuccgcggu

SEQ ID NO: 933175 - RNA, 15 nt, Mycobacterium avium subsp. paratuberculosis
gcccgcuccggcgga

SEQ ID NO: 933176 - RNA, 13 nt, Mycobacterium avium subsp. paratuberculosis
gcccgcucaccug

SEQ ID NO: 933177 - RNA, 16 nt, Mycobacterium avium subsp. paratuberculosis
gcccgcucaccugcgg

SEQ ID NO: 933178 - RNA, 18 nt, Mycobacterium avium subsp. paratuberculosis
gcccgcucaccugcggcc

SEQ ID NO: 933179 - RNA, 21 nt, Mycobacterium avium subsp. paratuberculosis
gcccgcucagagcugcaccgg

SEQ ID NO: 933180 - RNA, 11 nt, Mycobacterium avium subsp. paratuberculosis
gccgcgcccgg

SEQ ID NO: 933181 - RNA, 12 nt, Mycobacterium avium subsp. paratuberculosis
gccgcgcccgau

SEQ ID NO: 933182 - RNA, 16 nt, Mycobacterium avium subsp. paratuberculosis
gccgcgcccgauggag

SEQ ID NO: 933183 - RNA, 14 nt, Mycobacterium avium subsp. paratuberculosis
gccgcgcccgccgg

SEQ ID NO: 933184 - RNA, 16 nt, Mycobacterium avium subsp. paratuberculosis
gccgcgcccgccggcc

SEQ ID NO: 933185 - RNA, 14 nt, Mycobacterium avium subsp. paratuberculosis
gccgcgcccagcac

SEQ ID NO: 933186 - RNA, 16 nt, Mycobacterium avium subsp. paratuberculosis
gccgcgcccagcacgu

SEQ ID NO: 933187 - RNA, 16 nt, Mycobacterium avium subsp. paratuberculosis
gccgcgccccgagcag

SEQ ID NO: 933188 - RNA, 15 nt, Mycobacterium avium subsp. paratuberculosis
gccgcgccccggcgc

SEQ ID NO: 933189 - RNA, 18 nt, Mycobacterium avium subsp. paratuberculosis
gccgcgccccggcgcgcc

SEQ ID NO: 933190 - RNA, 17 nt, Mycobacterium avium subsp. paratuberculosis
gccgcgcccaguguggg

SEQ ID NO: 933191 - RNA, 20 nt, Mycobacterium avium subsp. paratuberculosis
gccgcgcccaguguggggcc

SEQ ID NO: 933192 - RNA, 15 nt, Mycobacterium avium subsp. paratuberculosis
gccgcgcccaucgcg

SEQ ID NO: 933193 - RNA, 18 nt, Mycobacterium avium subsp. paratuberculosis
gccgcgcccaucgcggcc

SEQ ID NO: 933194 - RNA, 15 nt, Mycobacterium avium subsp. paratuberculosis
gccgcgcccacccgc

SEQ ID NO: 933195 - RNA, 18 nt, Mycobacterium avium subsp. paratuberculosis
gccgcgcccacccgcgca

SEQ ID NO: 933196 - RNA, 13 nt, Mycobacterium avium subsp. paratuberculosis
gccgcgccagccg

SEQ ID NO: 933197 - RNA, 14 nt, Mycobacterium avium subsp. paratuberculosis
gccgcgccagccgc

SEQ ID NO: 933198 - RNA, 15 nt, Mycobacterium avium subsp. paratuberculosis
gccgcgccagccgcc

SEQ ID NO: 933199 - RNA, 21 nt, Mycobacterium avium subsp. paratuberculosis
gccgcgccaccgaggccagca

SEQ ID NO: 933200 - RNA, 18 nt, Mycobacterium avium subsp. paratuberculosis
gccgcgccaccgcggggc

SEQ ID NO: 933201 - RNA, 22 nt, Mycobacterium avium subsp. paratuberculosis
gccgcgcaucaucgcccagcgc

SEQ ID NO: 933202 - RNA, 16 nt, Mycobacterium avium subsp. paratuberculosis
gccgcgccaacgaggc

SEQ ID NO: 933203 - RNA, 22 nt, Mycobacterium avium subsp. paratuberculosis
gccgcgccaacgaggcacggcc

SEQ ID NO: 933204 - RNA, 14 nt, Mycobacterium avium subsp. paratuberculosis
gccgcgccagcacc

SEQ ID NO: 933205 - RNA, 15 nt, Mycobacterium avium subsp. paratuberculosis
gccgcgccagcaccu

SEQ ID NO: 933206 - RNA, 16 nt, Mycobacterium avium subsp. paratuberculosis
gccgcgccagcaccuc

SEQ ID NO: 933207 - RNA, 17 nt, Mycobacterium avium subsp. paratuberculosis
gccgcgccagcaccucg

SEQ ID NO: 933208 - RNA, 18 nt, Mycobacterium avium subsp. paratuberculosis
gccgcgccagcaccucgg

SEQ ID NO: 933209 - RNA, 19 nt, Mycobacterium avium subsp. paratuberculosis
gccgcgccagcaccucggc

SEQ ID NO: 933210 - RNA, 20 nt, Mycobacterium avium subsp. paratuberculosis
gccgcgccagcaccucggcg

SEQ ID NO: 933211 - RNA, 22 nt, Mycobacterium avium subsp. paratuberculosis
gccgcgccagcaccucggcgac

SEQ ID NO: 933212 - RNA, 15 nt, Mycobacterium avium subsp. paratuberculosis
gccgcgcagcguguc

SEQ ID NO: 933213 - RNA, 14 nt, Mycobacterium avium subsp. paratuberculosis
gccgcgcagcucgg

SEQ ID NO: 933214 - RNA, 18 nt, Mycobacterium avium subsp. paratuberculosis
gccgcgcagcucgggguc

SEQ ID NO: 933215 - RNA, 18 nt, Mycobacterium avium subsp. paratuberculosis
gccgcgcaggccgccgac

SEQ ID NO: 933216 - RNA, 19 nt, Mycobacterium avium subsp. paratuberculosis
gccgcgcaggccgccgacg

SEQ ID NO: 933217 - RNA, 17 nt, Mycobacterium avium subsp. paratuberculosis
gccgcgcaggccgucca

SEQ ID NO: 933218 - RNA, 15 nt, Mycobacterium avium subsp. paratuberculosis
gccgcgcagcggggc

SEQ ID NO: 933219 - RNA, 17 nt, Mycobacterium avium subsp. paratuberculosis
gccgcgcagcggggcgc

SEQ ID NO: 933220 - RNA, 20 nt, Mycobacterium avium subsp. paratuberculosis
gccgcgcagccagaccucgc

SEQ ID NO: 933221 - RNA, 22 nt, Mycobacterium avium subsp. paratuberculosis
gccgcgcagccagaccucgccg

SEQ ID NO: 933222 - RNA, 21 nt, Mycobacterium avium subsp. paratuberculosis
gccgcgauguagcggacgggc

SEQ ID NO: 933223 - RNA, 16 nt, Mycobacterium avium subsp. paratuberculosis
gccgcgcacgacgugg

SEQ ID NO: 933224 - RNA, 20 nt, Mycobacterium avium subsp. paratuberculosis
gccgcgcacuggagugcugc

SEQ ID NO: 933225 - RNA, 22 nt, Mycobacterium avium subsp. paratuberculosis
gccgcgcacuggagugcugcag

SEQ ID NO: 933226 - RNA, 18 nt, Mycobacterium avium subsp. paratuberculosis
gccgcgaucucggcggac

SEQ ID NO: 933227 - RNA, 24 nt, Mycobacterium avium subsp. paratuberculosis
gccgcgaucucggcggacucggcg

SEQ ID NO: 933228 - RNA, 14 nt, Mycobacterium avium subsp. paratuberculosis
gccgcgauccgggc

SEQ ID NO: 933229 - RNA, 16 nt, Mycobacterium avium subsp. paratuberculosis
gccgcgaucgccaacg

SEQ ID NO: 933230 - RNA, 19 nt, Mycobacterium avium subsp. paratuberculosis
gccgcgaucgccaacgcgc

SEQ ID NO: 933231 - RNA, 22 nt, Mycobacterium avium subsp. paratuberculosis
gccgcgauccagcgcuggccgg

SEQ ID NO: 933232 - RNA, 15 nt, Mycobacterium avium subsp. paratuberculosis
gccgcgagucgaggu

SEQ ID NO: 933233 - RNA, 22 nt, Mycobacterium avium subsp. paratuberculosis
gccgcgagucgagguugaugcc

SEQ ID NO: 933234 - RNA, 22 nt, Mycobacterium avium subsp. paratuberculosis
gccgcgaggauuucgcucagcc

SEQ ID NO: 933235 - RNA, 13 nt, Mycobacterium avium subsp. paratuberculosis
gccgcgagcccgc

SEQ ID NO: 933236 - RNA, 23 nt, Mycobacterium avium subsp. paratuberculosis
gccgcgagcccgcaaaucagccg

SEQ ID NO: 933237 - RNA, 14 nt, Mycobacterium avium subsp. paratuberculosis
gccgcgagcccggc

SEQ ID NO: 933238 - RNA, 19 nt, Mycobacterium avium subsp. paratuberculosis
gccgcgagcccggcgacgu

SEQ ID NO: 933239 - RNA, 13 nt, Mycobacterium avium subsp. paratuberculosis
gccgcgagcgcag

SEQ ID NO: 933240 - RNA, 15 nt, Mycobacterium avium subsp. paratuberculosis
gccgcgacugcaccc

SEQ ID NO: 933241 - RNA, 17 nt, Mycobacterium avium subsp. paratuberculosis
gccgcgacugcacccga

SEQ ID NO: 933242 - RNA, 21 nt, Mycobacterium avium subsp. paratuberculosis
gccgcgacugcaggugacgga

SEQ ID NO: 933243 - RNA, 22 nt, Mycobacterium avium subsp. paratuberculosis
gccgcgacugcaggugacggau

SEQ ID NO: 933244 - RNA, 17 nt, Mycobacterium avium subsp. paratuberculosis
gccgcgagcacgacguc

SEQ ID NO: 933245 - RNA, 18 nt, Mycobacterium avium subsp. paratuberculosis
gccgcgagcacgacgucg

SEQ ID NO: 933246 - RNA, 19 nt, Mycobacterium avium subsp. paratuberculosis
gccgcgagcacgacgucga

SEQ ID NO: 933247 - RNA, 17 nt, Mycobacterium avium subsp. paratuberculosis
gccgcgaugaucacacc

SEQ ID NO: 933248 - RNA, 16 nt, Mycobacterium avium subsp. paratuberculosis
gccgcgaugcaacacc

SEQ ID NO: 933249 - RNA, 18 nt, Mycobacterium avium subsp. paratuberculosis
gccgcgaugcaacaccga

SEQ ID NO: 933250 - RNA, 23 nt, Mycobacterium avium subsp. paratuberculosis
gccgcgaugcaacaccgaacgcc

SEQ ID NO: 933251 - RNA, 17 nt, Mycobacterium avium subsp. paratuberculosis
gccgcgaugcccgccgg

SEQ ID NO: 933252 - RNA, 19 nt, Mycobacterium avium subsp. paratuberculosis
gccgcgaugcccgccggcc

SEQ ID NO: 933253 - RNA, 20 nt, Mycobacterium avium subsp. paratuberculosis
gccgcgcagaucgccagcac

SEQ ID NO: 933254 - RNA, 22 nt, Mycobacterium avium subsp. paratuberculosis
gccgcgcagaucgccagcaccg

SEQ ID NO: 933255 - RNA, 14 nt, Mycobacterium avium subsp. paratuberculosis
gccgcgcagcaccg

SEQ ID NO: 933256 - RNA, 16 nt, Mycobacterium avium subsp. paratuberculosis
gccgcgcagcaccgcg

SEQ ID NO: 933257 - RNA, 17 nt, Mycobacterium avium subsp. paratuberculosis
gccgcgcagcaccgcgu

SEQ ID NO: 933258 - RNA, 19 nt, Mycobacterium avium subsp. paratuberculosis
gccgcgcagcaccgcgucg

SEQ ID NO: 933259 - RNA, 22 nt, Mycobacterium avium subsp. paratuberculosis
gccgcgcagcaccgcgucggcg

SEQ ID NO: 933260 - RNA, 17 nt, Mycobacterium avium subsp. paratuberculosis
gccgcgcagcaccguca

SEQ ID NO: 933261 - RNA, 23 nt, Mycobacterium avium subsp. paratuberculosis
gccgcgcaccccgaaccgcccgc

SEQ ID NO: 933262 - RNA, 14 nt, Mycobacterium avium subsp. paratuberculosis
gccgcgcacccggc

SEQ ID NO: 933263 - RNA, 15 nt, Mycobacterium avium subsp. paratuberculosis
gccgcgcacccggcc

SEQ ID NO: 933264 - RNA, 13 nt, Mycobacterium avium subsp. paratuberculosis
gccgcgcaccgcc

SEQ ID NO: 933265 - RNA, 14 nt, Mycobacterium avium subsp. paratuberculosis
gccgcgcaccgcgc

SEQ ID NO: 933266 - RNA, 13 nt, Mycobacterium avium subsp. paratuberculosis
gccgcgcaccacg

SEQ ID NO: 933267 - RNA, 14 nt, Mycobacterium avium subsp. paratuberculosis
gccgcgcaccacgg

SEQ ID NO: 933268 - RNA, 19 nt, Mycobacterium avium subsp. paratuberculosis
gccgcgaaaauaccgccgg

SEQ ID NO: 933269 - RNA, 21 nt, Mycobacterium avium subsp. paratuberculosis
gccgcgaaaauaccgccggcc

SEQ ID NO: 933270 - RNA, 23 nt, Mycobacterium avium subsp. paratuberculosis
gccgcgaaaauaccgccggccgc

SEQ ID NO: 933271 - RNA, 21 nt, Mycobacterium avium subsp. paratuberculosis
gccgcgaacaauuccucugcg

SEQ ID NO: 933272 - RNA, 16 nt, Mycobacterium avium subsp. paratuberculosis
gccgccuugacgccgg

SEQ ID NO: 933273 - RNA, 18 nt, Mycobacterium avium subsp. paratuberculosis
gccgccuugacgccgggc

SEQ ID NO: 933274 - RNA, 19 nt, Mycobacterium avium subsp. paratuberculosis
gccgccuugggccggucgg

SEQ ID NO: 933275 - RNA, 19 nt, Mycobacterium avium subsp. paratuberculosis
gccgccuucuugcgcggcg

SEQ ID NO: 933276 - RNA, 22 nt, Mycobacterium avium subsp. paratuberculosis
gccgccuucuugcgcggcgcga

SEQ ID NO: 933277 - RNA, 17 nt, Mycobacterium avium subsp. paratuberculosis
gccgcgaacggcccgcc

SEQ ID NO: 933278 - RNA, 20 nt, Mycobacterium avium subsp. paratuberculosis
gccgcgaacggcccgccgcc

SEQ ID NO: 933279 - RNA, 22 nt, Mycobacterium avium subsp. paratuberculosis
gccgcgaacggcccgccgccgg

SEQ ID NO: 933280 - RNA, 21 nt, Mycobacterium avium subsp. paratuberculosis
gccgcgaacgggucgggggug

SEQ ID NO: 933281 - RNA, 21 nt, Mycobacterium avium subsp. paratuberculosis
gccgcgaacgggugaccggcg

SEQ ID NO: 933282 - RNA, 22 nt, Mycobacterium avium subsp. paratuberculosis
gccgcgaacgggugaccggcgg

SEQ ID NO: 933283 - RNA, 23 nt, Mycobacterium avium subsp. paratuberculosis
gccgcgaacgggugaccggcggc

SEQ ID NO: 933284 - RNA, 15 nt, Mycobacterium avium subsp. paratuberculosis
gccgcgaacgacgac

SEQ ID NO: 933285 - RNA, 16 nt, Mycobacterium avium subsp. paratuberculosis
gccgcgaacgacgacc

SEQ ID NO: 933286 - RNA, 16 nt, Mycobacterium avium subsp. paratuberculosis
gccgcgaacgccucgg

SEQ ID NO: 933287 - RNA, 14 nt, Mycobacterium avium subsp. paratuberculosis
gccgcgaagauguc

SEQ ID NO: 933288 - RNA, 22 nt, Mycobacterium avium subsp. paratuberculosis
gccgcgaagaugucgccguaca

SEQ ID NO: 933289 - RNA, 17 nt, Mycobacterium avium subsp. paratuberculosis
gccgcgaaggcggcguc

SEQ ID NO: 933290 - RNA, 19 nt, Mycobacterium avium subsp. paratuberculosis
gccgcgaaggcggcgucga

SEQ ID NO: 933291 - RNA, 21 nt, Mycobacterium avium subsp. paratuberculosis
gccgcgaaggcggcgucgaug

SEQ ID NO: 933292 - RNA, 17 nt, Mycobacterium avium subsp. paratuberculosis
gccgcgaauucggcgau

SEQ ID NO: 933293 - RNA, 18 nt, Mycobacterium avium subsp. paratuberculosis
gccgcgaauucggcgaug

SEQ ID NO: 933294 - RNA, 19 nt, Mycobacterium avium subsp. paratuberculosis
gccgcgaauucggcgauga

SEQ ID NO: 933295 - RNA, 18 nt, Mycobacterium avium subsp. paratuberculosis
gccgcgacguagccggua

SEQ ID NO: 933296 - RNA, 15 nt, Mycobacterium avium subsp. paratuberculosis
gccgcgacggaccag

SEQ ID NO: 933297 - RNA, 16 nt, Mycobacterium avium subsp. paratuberculosis
gccgcgacucgguguc

SEQ ID NO: 933298 - RNA, 12 nt, Mycobacterium avium subsp. paratuberculosis
gccgcgacggcc

SEQ ID NO: 933299 - RNA, 15 nt, Mycobacterium avium subsp. paratuberculosis
gccgcgacggccgcc

SEQ ID NO: 933300 - RNA, 18 nt, Mycobacterium avium subsp. paratuberculosis
gccgcgacggccgccgau

SEQ ID NO: 933301 - RNA, 14 nt, Mycobacterium avium subsp. paratuberculosis
gccgcgacggcggg

SEQ ID NO: 933302 - RNA, 15 nt, Mycobacterium avium subsp. paratuberculosis
gccgcgacggguugc

SEQ ID NO: 933303 - RNA, 14 nt, Mycobacterium avium subsp. paratuberculosis
gccgcgacgaccgc

SEQ ID NO: 933304 - RNA, 17 nt, Mycobacterium avium subsp. paratuberculosis
gccgcgacgaccgccug

SEQ ID NO: 933305 - RNA, 19 nt, Mycobacterium avium subsp. paratuberculosis
gccgcgacgaccgccugcu

SEQ ID NO: 933306 - RNA, 23 nt, Mycobacterium avium subsp. paratuberculosis
gccgcgacgaugucgacccgcgg

SEQ ID NO: 933307 - RNA, 12 nt, Mycobacterium avium subsp. paratuberculosis
gccgcgacgccg

SEQ ID NO: 933308 - RNA, 14 nt, Mycobacterium avium subsp. paratuberculosis
gccgcgacgccgcc

SEQ ID NO: 933309 - RNA, 21 nt, Mycobacterium avium subsp. paratuberculosis
gccgcgacgccgccgccgagc

SEQ ID NO: 933310 - RNA, 17 nt, Mycobacterium avium subsp. paratuberculosis
gccgcgacacccgcgac

SEQ ID NO: 933311 - RNA, 20 nt, Mycobacterium avium subsp. paratuberculosis
gccgcgacagccgcccggcg

SEQ ID NO: 933312 - RNA, 14 nt, Mycobacterium avium subsp. paratuberculosis
gccgcgacagccgg

SEQ ID NO: 933313 - RNA, 14 nt, Mycobacterium avium subsp. paratuberculosis
gccgcgaccacagc

SEQ ID NO: 933314 - RNA, 17 nt, Mycobacterium avium subsp. paratuberculosis
gccgcgaccacagcgcc

SEQ ID NO: 933315 - RNA, 22 nt, Mycobacterium avium subsp. paratuberculosis
gccgcgaccacagcgccucguc

SEQ ID NO: 933316 - RNA, 13 nt, Mycobacterium avium subsp. paratuberculosis
gccgcgaccccgg

SEQ ID NO: 933317 - RNA, 17 nt, Mycobacterium avium subsp. paratuberculosis
gccgcgaccccggaccg

SEQ ID NO: 933318 - RNA, 19 nt, Mycobacterium avium subsp. paratuberculosis
gccgcgaccccggaccgcg

SEQ ID NO: 933319 - RNA, 21 nt, Mycobacterium avium subsp. paratuberculosis
gccgcgaccgucagcagggcc

SEQ ID NO: 933320 - RNA, 12 nt, Mycobacterium avium subsp. paratuberculosis
gccgcgacccgg

SEQ ID NO: 933321 - RNA, 18 nt, Mycobacterium avium subsp. paratuberculosis
gccgcgacccgggccgcc

SEQ ID NO: 933322 - RNA, 12 nt, Mycobacterium avium subsp. paratuberculosis
gccgcgaccgcg

SEQ ID NO: 933323 - RNA, 13 nt, Mycobacterium avium subsp. paratuberculosis
gccgcgaccgcga

SEQ ID NO: 933324 - RNA, 15 nt, Mycobacterium avium subsp. paratuberculosis
gccgccugcccgggc

SEQ ID NO: 933325 - RNA, 21 nt, Mycobacterium avium subsp. paratuberculosis
gccgccugcccgggcgccgag

SEQ ID NO: 933326 - RNA, 13 nt, Mycobacterium avium subsp. paratuberculosis
gccgccucgucga

SEQ ID NO: 933327 - RNA, 14 nt, Mycobacterium avium subsp. paratuberculosis
gccgccucgaaguc

SEQ ID NO: 933328 - RNA, 18 nt, Mycobacterium avium subsp. paratuberculosis
gccgccucgaagucgccg

SEQ ID NO: 933329 - RNA, 20 nt, Mycobacterium avium subsp. paratuberculosis
gccgccucgaagucgccggc

SEQ ID NO: 933330 - RNA, 14 nt, Mycobacterium avium subsp. paratuberculosis
gccgccuccgggcu

SEQ ID NO: 933331 - RNA, 15 nt, Mycobacterium avium subsp. paratuberculosis
gccgccuccgggcug

SEQ ID NO: 933332 - RNA, 22 nt, Mycobacterium avium subsp. paratuberculosis
gccgccuccgggcugccguaga

SEQ ID NO: 933333 - RNA, 15 nt, Mycobacterium avium subsp. paratuberculosis
gccgccucccgcagc

SEQ ID NO: 933334 - RNA, 20 nt, Mycobacterium avium subsp. paratuberculosis
gccgccucccgcagcgccag

SEQ ID NO: 933335 - RNA, 21 nt, Mycobacterium avium subsp. paratuberculosis
gccgccucccgcagcgccagc

SEQ ID NO: 933336 - RNA, 13 nt, Mycobacterium avium subsp. paratuberculosis
gccgccuccgaca

SEQ ID NO: 933337 - RNA, 14 nt, Mycobacterium avium subsp. paratuberculosis
gccgccuccgacag

SEQ ID NO: 933338 - RNA, 17 nt, Mycobacterium avium subsp. paratuberculosis
gccgccuccgacagccg

SEQ ID NO: 933339 - RNA, 13 nt, Mycobacterium avium subsp. paratuberculosis
gccgccucacgca

SEQ ID NO: 933340 - RNA, 18 nt, Mycobacterium avium subsp. paratuberculosis
gccgccuucacgaccggc

SEQ ID NO: 933341 - RNA, 21 nt, Mycobacterium avium subsp. paratuberculosis
gccgccuucacgaccggcagc

SEQ ID NO: 933342 - RNA, 13 nt, Mycobacterium avium subsp. paratuberculosis
gccgccuggcgaa

SEQ ID NO: 933343 - RNA, 14 nt, Mycobacterium avium subsp. paratuberculosis
gccgccugcgcgcc

SEQ ID NO: 933344 - RNA, 16 nt, Mycobacterium avium subsp. paratuberculosis
gccgccugcgcgccgu

SEQ ID NO: 933345 - RNA, 20 nt, Mycobacterium avium subsp. paratuberculosis
gccgccugcgcgccgucggc

SEQ ID NO: 933346 - RNA, 22 nt, Mycobacterium avium subsp. paratuberculosis
gccgccugcgcgccgucggcga

SEQ ID NO: 933347 - RNA, 20 nt, Mycobacterium avium subsp. paratuberculosis
gccgccgcuagucgcccagc

SEQ ID NO: 933348 - RNA, 13 nt, Mycobacterium avium subsp. paratuberculosis
gccgccgcgucgc

SEQ ID NO: 933349 - RNA, 21 nt, Mycobacterium avium subsp. paratuberculosis
gccgccgcgucgccgccgggc

SEQ ID NO: 933350 - RNA, 17 nt, Mycobacterium avium subsp. paratuberculosis
gccgccgcgucgugccg

SEQ ID NO: 933351 - RNA, 13 nt, Mycobacterium avium subsp. paratuberculosis
gccgccgcggguc

SEQ ID NO: 933352 - RNA, 14 nt, Mycobacterium avium subsp. paratuberculosis
gccgccgcgggucg

SEQ ID NO: 933353 - RNA, 19 nt, Mycobacterium avium subsp. paratuberculosis
gccgccgcgggucggcgac

SEQ ID NO: 933354 - RNA, 12 nt, Mycobacterium avium subsp. paratuberculosis
gccgccgcgucg

SEQ ID NO: 933355 - RNA, 16 nt, Mycobacterium avium subsp. paratuberculosis
gccgccgcggccgcgg

SEQ ID NO: 933356 - RNA, 15 nt, Mycobacterium avium subsp. paratuberculosis
gccgccgcggcaccu

SEQ ID NO: 933357 - RNA, 12 nt, Mycobacterium avium subsp. paratuberculosis
gccgccggcgau

SEQ ID NO: 933358 - RNA, 18 nt, Mycobacterium avium subsp. paratuberculosis
gccgccggcgaucucguc

SEQ ID NO: 933359 - RNA, 21 nt, Mycobacterium avium subsp. paratuberculosis
gccgccggcgaucucgucgcg

SEQ ID NO: 933360 - RNA, 22 nt, Mycobacterium avium subsp. paratuberculosis
gccgccggcgaucucgucgcgc

SEQ ID NO: 933361 - RNA, 13 nt, Mycobacterium avium subsp. paratuberculosis
gccgccggccucg

SEQ ID NO: 933362 - RNA, 14 nt, Mycobacterium avium subsp. paratuberculosis
gccgccggccucgg

SEQ ID NO: 933363 - RNA, 18 nt, Mycobacterium avium subsp. paratuberculosis
gccgccggccgcggcgug

SEQ ID NO: 933364 - RNA, 21 nt, Mycobacterium avium subsp. paratuberculosis
gccgccggccgcucgcgggcc

SEQ ID NO: 933365 - RNA, 13 nt, Mycobacterium avium subsp. paratuberculosis
gccgccggccagc

SEQ ID NO: 933366 - RNA, 13 nt, Mycobacterium avium subsp. paratuberculosis
gccgccggcaccg

SEQ ID NO: 933367 - RNA, 14 nt, Mycobacterium avium subsp. paratuberculosis
gccgccggccacca

SEQ ID NO: 933368 - RNA, 15 nt, Mycobacterium avium subsp. paratuberculosis
gccgccagcaacccc

SEQ ID NO: 933369 - RNA, 18 nt, Mycobacterium avium subsp. paratuberculosis
gccgccagcaaccccgcg

SEQ ID NO: 933370 - RNA, 21 nt, Mycobacterium avium subsp. paratuberculosis
gccgccagcaaccccgcggug

SEQ ID NO: 933371 - RNA, 18 nt, Mycobacterium avium subsp. paratuberculosis
gccgccacgcggcgcgca

SEQ ID NO: 933372 - RNA, 15 nt, Mycobacterium avium subsp. paratuberculosis
gccgccacggcacgu

SEQ ID NO: 933373 - RNA, 16 nt, Mycobacterium avium subsp. paratuberculosis
gccgccacggccaccg

SEQ ID NO: 933374 - RNA, 19 nt, Mycobacterium avium subsp. paratuberculosis
gccgccacggccaccgccg

SEQ ID NO: 933375 - RNA, 13 nt, Mycobacterium avium subsp. paratuberculosis
gccgccacggcgc

SEQ ID NO: 933376 - RNA, 21 nt, Mycobacterium avium subsp. paratuberculosis
gccgccacggcgccaugcgcc

SEQ ID NO: 933377 - RNA, 20 nt, Mycobacterium avium subsp. paratuberculosis
gccgccacggggcccgcgac

SEQ ID NO: 933378 - RNA, 22 nt, Mycobacterium avium subsp. paratuberculosis
gccgccacguccggaugcggcg

SEQ ID NO: 933379 - RNA, 12 nt, Mycobacterium avium subsp. paratuberculosis
gccgccgagggc

SEQ ID NO: 933380 - RNA, 17 nt, Mycobacterium avium subsp. paratuberculosis
gccgccgaucaacaggc

SEQ ID NO: 933381 - RNA, 14 nt, Mycobacterium avium subsp. paratuberculosis
gccgccgaucuuga

SEQ ID NO: 933382 - RNA, 16 nt, Mycobacterium avium subsp. paratuberculosis
gccgccgaugacggcg

SEQ ID NO: 933383 - RNA, 19 nt, Mycobacterium avium subsp. paratuberculosis
gccgccgaugacggcgcga

SEQ ID NO: 933384 - RNA, 22 nt, Mycobacterium avium subsp. paratuberculosis
gccgccgaugacggcgcgaacg

SEQ ID NO: 933385 - RNA, 16 nt, Mycobacterium avium subsp. paratuberculosis
gccgccgaggacacgu

SEQ ID NO: 933386 - RNA, 18 nt, Mycobacterium avium subsp. paratuberculosis
gccgccgaggcgaugccg

SEQ ID NO: 933387 - RNA, 14 nt, Mycobacterium avium subsp. paratuberculosis
gccgccgagggcca

SEQ ID NO: 933388 - RNA, 15 nt, Mycobacterium avium subsp. paratuberculosis
gccgccgagggccag

SEQ ID NO: 933389 - RNA, 17 nt, Mycobacterium avium subsp. paratuberculosis
gccgccgagggccagca

SEQ ID NO: 933390 - RNA, 14 nt, Mycobacterium avium subsp. paratuberculosis
gccgccgccggcgu

SEQ ID NO: 933391 - RNA, 15 nt, Mycobacterium avium subsp. paratuberculosis
gccgccgcgaccaca

SEQ ID NO: 933392 - RNA, 13 nt, Mycobacterium avium subsp. paratuberculosis
gccgccgcgaccg

SEQ ID NO: 933393 - RNA, 22 nt, Mycobacterium avium subsp. paratuberculosis
gccgccgcgaccgucagcaggg

SEQ ID NO: 933394 - RNA, 23 nt, Mycobacterium avium subsp. paratuberculosis
gccgccgcgaccgucagcagggc

SEQ ID NO: 933395 - RNA, 12 nt, Mycobacterium avium subsp. paratuberculosis
gccgccgcgacg

SEQ ID NO: 933396 - RNA, 19 nt, Mycobacterium avium subsp. paratuberculosis
gccgccgcggagcggcggu

SEQ ID NO: 933397 - RNA, 13 nt, Mycobacterium avium subsp. paratuberculosis
gccgccgccggcg

SEQ ID NO: 933398 - RNA, 19 nt, Mycobacterium avium subsp. paratuberculosis
gccgccgcccuggccccag

SEQ ID NO: 933399 - RNA, 14 nt, Mycobacterium avium subsp. paratuberculosis
gccgccgcccgcgc

SEQ ID NO: 933400 - RNA, 15 nt, Mycobacterium avium subsp. paratuberculosis
gccgccgcccgcgcg

SEQ ID NO: 933401 - RNA, 22 nt, Mycobacterium avium subsp. paratuberculosis
gccgccgaugugaucggcggcc

SEQ ID NO: 933402 - RNA, 14 nt, Mycobacterium avium subsp. paratuberculosis
gccgccgccgagcu

SEQ ID NO: 933403 - RNA, 12 nt, Mycobacterium avium subsp. paratuberculosis
gccgccgccgau

SEQ ID NO: 933404 - RNA, 13 nt, Mycobacterium avium subsp. paratuberculosis
gccgccgccgauc

SEQ ID NO: 933405 - RNA, 16 nt, Mycobacterium avium subsp. paratuberculosis
gccgccgccgaccaca

SEQ ID NO: 933406 - RNA, 14 nt, Mycobacterium avium subsp. paratuberculosis
gccgccgcccaggc

SEQ ID NO: 933407 - RNA, 21 nt, Mycobacterium avium subsp. paratuberculosis
gccgccgaugcgcccgcugcg

SEQ ID NO: 933408 - RNA, 17 nt, Mycobacterium avium subsp. paratuberculosis
gccgccgaugcugaucc

SEQ ID NO: 933409 - RNA, 21 nt, Mycobacterium avium subsp. paratuberculosis
gccgccgaugcugauccgcag

SEQ ID NO: 933410 - RNA, 18 nt, Mycobacterium avium subsp. paratuberculosis
gccgccgugcgcggcgac

SEQ ID NO: 933411 - RNA, 18 nt, Mycobacterium avium subsp. paratuberculosis
gccgccguguaggccgcg

SEQ ID NO: 933412 - RNA, 16 nt, Mycobacterium avium subsp. paratuberculosis
gccgccgugcauccag

SEQ ID NO: 933413 - RNA, 21 nt, Mycobacterium avium subsp. paratuberculosis
gccgccgucuucccagugccg

SEQ ID NO: 933414 - RNA, 12 nt, Mycobacterium avium subsp. paratuberculosis
gccgccgucggu

SEQ ID NO: 933415 - RNA, 14 nt, Mycobacterium avium subsp. paratuberculosis
gccgccgucggugu

SEQ ID NO: 933416 - RNA, 14 nt, Mycobacterium avium subsp. paratuberculosis
gccgccgucguagc

SEQ ID NO: 933417 - RNA, 16 nt, Mycobacterium avium subsp. paratuberculosis
gccgccgucguagccg

SEQ ID NO: 933418 - RNA, 19 nt, Mycobacterium avium subsp. paratuberculosis
gccgccgucguagccgcgg

SEQ ID NO: 933419 - RNA, 15 nt, Mycobacterium avium subsp. paratuberculosis
gccgccguucgccgg

SEQ ID NO: 933420 - RNA, 16 nt, Mycobacterium avium subsp. paratuberculosis
gccgccguucgccggc

SEQ ID NO: 933421 - RNA, 22 nt, Mycobacterium avium subsp. paratuberculosis
gccgccguucgccggcgacggc

SEQ ID NO: 933422 - RNA, 16 nt, Mycobacterium avium subsp. paratuberculosis
gccgccguucucgcgc

SEQ ID NO: 933423 - RNA, 17 nt, Mycobacterium avium subsp. paratuberculosis
gccgccguucucgcgca

SEQ ID NO: 933424 - RNA, 18 nt, Mycobacterium avium subsp. paratuberculosis
gccgccguucucgcgcag

SEQ ID NO: 933425 - RNA, 22 nt, Mycobacterium avium subsp. paratuberculosis
gccgccguucucgcgcagguca

SEQ ID NO: 933426 - RNA, 20 nt, Mycobacterium avium subsp. paratuberculosis
gccgccguugcgagucaucg

SEQ ID NO: 933427 - RNA, 21 nt, Mycobacterium avium subsp. paratuberculosis
gccgccguugcgagucaucgc

SEQ ID NO: 933428 - RNA, 19 nt, Mycobacterium avium subsp. paratuberculosis
gccgccgucgccaccaccg

SEQ ID NO: 933429 - RNA, 20 nt, Mycobacterium avium subsp. paratuberculosis
gccgccgucgccaccaccgc

SEQ ID NO: 933430 - RNA, 21 nt, Mycobacterium avium subsp. paratuberculosis
gccgccgucgccaccaccgcg

SEQ ID NO: 933431 - RNA, 13 nt, Mycobacterium avium subsp. paratuberculosis
gccgccgucgcgc

SEQ ID NO: 933432 - RNA, 21 nt, Mycobacterium avium subsp. paratuberculosis
gccgccgucgcgccaggacca

SEQ ID NO: 933433 - RNA, 17 nt, Mycobacterium avium subsp. paratuberculosis
gccgccgucccaccggc

SEQ ID NO: 933434 - RNA, 20 nt, Mycobacterium avium subsp. paratuberculosis
gccgccgucccaccggcgau

SEQ ID NO: 933435 - RNA, 21 nt, Mycobacterium avium subsp. paratuberculosis
gccgccgucccaccggcgaug

SEQ ID NO: 933436 - RNA, 20 nt, Mycobacterium avium subsp. paratuberculosis
gccgccguccccgcgcggcu

SEQ ID NO: 933437 - RNA, 15 nt, Mycobacterium avium subsp. paratuberculosis
gccgccgucgacgac

SEQ ID NO: 933438 - RNA, 18 nt, Mycobacterium avium subsp. paratuberculosis
gccgccgucgacgacgaa

SEQ ID NO: 933439 - RNA, 16 nt, Mycobacterium avium subsp. paratuberculosis
gccgccguaucccugc

SEQ ID NO: 933440 - RNA, 15 nt, Mycobacterium avium subsp. paratuberculosis
gccgccguagccggc

SEQ ID NO: 933441 - RNA, 16 nt, Mycobacterium avium subsp. paratuberculosis
gccgccguagccggcg

SEQ ID NO: 933442 - RNA, 22 nt, Mycobacterium avium subsp. paratuberculosis
gccgccguagccggcgguggcc

SEQ ID NO: 933443 - RNA, 22 nt, Mycobacterium avium subsp. paratuberculosis
gccgccgguggagauggccagc

SEQ ID NO: 933444 - RNA, 23 nt, Mycobacterium avium subsp. paratuberculosis
gccgccgguggagauggccagca

SEQ ID NO: 933445 - RNA, 19 nt, Mycobacterium avium subsp. paratuberculosis
gccgccgguggcgucggug

SEQ ID NO: 933446 - RNA, 20 nt, Mycobacterium avium subsp. paratuberculosis
gccgccgguggcgucgguga

SEQ ID NO: 933447 - RNA, 14 nt, Mycobacterium avium subsp. paratuberculosis
gccgccggucgccc

SEQ ID NO: 933448 - RNA, 13 nt, Mycobacterium avium subsp. paratuberculosis
gccgccggugccg

SEQ ID NO: 933449 - RNA, 15 nt, Mycobacterium avium subsp. paratuberculosis
gccgccggugccgac

SEQ ID NO: 933450 - RNA, 17 nt, Mycobacterium avium subsp. paratuberculosis
gccgccggugccgacga

SEQ ID NO: 933451 - RNA, 14 nt, Mycobacterium avium subsp. paratuberculosis
gccgccggugaaca

SEQ ID NO: 933452 - RNA, 22 nt, Mycobacterium avium subsp. paratuberculosis
gccgccggugaacacgaacggc

SEQ ID NO: 933453 - RNA, 14 nt, Mycobacterium avium subsp. paratuberculosis
gccgccggugacca

SEQ ID NO: 933454 - RNA, 17 nt, Mycobacterium avium subsp. paratuberculosis
gccgccggugaccacgc

SEQ ID NO: 933455 - RNA, 16 nt, Mycobacterium avium subsp. paratuberculosis
gccgccgguccagugc

SEQ ID NO: 933456 - RNA, 21 nt, Mycobacterium avium subsp. paratuberculosis
gccgccgguccagugccggcg

SEQ ID NO: 933457 - RNA, 23 nt, Mycobacterium avium subsp. paratuberculosis
gccgccgguccagugccggcgag

SEQ ID NO: 933458 - RNA, 16 nt, Mycobacterium avium subsp. paratuberculosis
gccgccggucacggcg

SEQ ID NO: 933459 - RNA, 20 nt, Mycobacterium avium subsp. paratuberculosis
gccgccggucacggcgucgg

SEQ ID NO: 933460 - RNA, 22 nt, Mycobacterium avium subsp. paratuberculosis
gccgccggucacggcgucggcg

SEQ ID NO: 933461 - RNA, 14 nt, Mycobacterium avium subsp. paratuberculosis
gccgccggggcgca

SEQ ID NO: 933462 - RNA, 14 nt, Mycobacterium avium subsp. paratuberculosis
gccgccggguggcg

SEQ ID NO: 933463 - RNA, 13 nt, Mycobacterium avium subsp. paratuberculosis
gccgccggggcgu

SEQ ID NO: 933464 - RNA, 16 nt, Mycobacterium avium subsp. paratuberculosis
gccgccggggcgucgg

SEQ ID NO: 933465 - RNA, 17 nt, Mycobacterium avium subsp. paratuberculosis
gccgccggggcgucgga

SEQ ID NO: 933466 - RNA, 12 nt, Mycobacterium avium subsp. paratuberculosis
gccgccggggug

SEQ ID NO: 933467 - RNA, 18 nt, Mycobacterium avium subsp. paratuberculosis
gccgccgggcguagucga

SEQ ID NO: 933468 - RNA, 16 nt, Mycobacterium avium subsp. paratuberculosis
gccgccggggacccgc

SEQ ID NO: 933469 - RNA, 15 nt, Mycobacterium avium subsp. paratuberculosis
gccgccggggcgccg

SEQ ID NO: 933470 - RNA, 19 nt, Mycobacterium avium subsp. paratuberculosis
gccgccggggcgccgccga

SEQ ID NO: 933471 - RNA, 20 nt, Mycobacterium avium subsp. paratuberculosis
gccgccggggcgccgccgaa

SEQ ID NO: 933472 - RNA, 19 nt, Mycobacterium avium subsp. paratuberculosis
gccgccggggcgggcagca

SEQ ID NO: 933473 - RNA, 22 nt, Mycobacterium avium subsp. paratuberculosis
gccgccggggcgggcagcacca

SEQ ID NO: 933474 - RNA, 15 nt, Mycobacterium avium subsp. paratuberculosis
gccgccggcgguggc

SEQ ID NO: 933475 - RNA, 16 nt, Mycobacterium avium subsp. paratuberculosis
gccgccggcgguggcg

SEQ ID NO: 933476 - RNA, 20 nt, Mycobacterium avium subsp. paratuberculosis
gccgccggcgguggcguagc

SEQ ID NO: 933477 - RNA, 14 nt, Mycobacterium avium subsp. paratuberculosis
gccgccggcgucga

SEQ ID NO: 933478 - RNA, 12 nt, Mycobacterium avium subsp. paratuberculosis
gccgccggcuca

SEQ ID NO: 933479 - RNA, 22 nt, Mycobacterium avium subsp. paratuberculosis
gccgccgggaacagcgacgccc

SEQ ID NO: 933480 - RNA, 15 nt, Mycobacterium avium subsp. paratuberculosis
gccgccgggacgggc

SEQ ID NO: 933481 - RNA, 16 nt, Mycobacterium avium subsp. paratuberculosis
gccgccgggcaccucg

SEQ ID NO: 933482 - RNA, 19 nt, Mycobacterium avium subsp. paratuberculosis
gccgccgggcaccucggcg

SEQ ID NO: 933483 - RNA, 23 nt, Mycobacterium avium subsp. paratuberculosis
gccgccgggcaccucggcgucgg

SEQ ID NO: 933484 - RNA, 23 nt, Mycobacterium avium subsp. paratuberculosis
gccgccgggauaacccagcacca

SEQ ID NO: 933485 - RNA, 12 nt, Mycobacterium avium subsp. paratuberculosis
gccgccgggcca

SEQ ID NO: 933486 - RNA, 13 nt, Mycobacterium avium subsp. paratuberculosis
gccgccgggccag

SEQ ID NO: 933487 - RNA, 20 nt, Mycobacterium avium subsp. paratuberculosis
gccgccgggccaggugugcc

SEQ ID NO: 933488 - RNA, 12 nt, Mycobacterium avium subsp. paratuberculosis
gccgccgggccg

SEQ ID NO: 933489 - RNA, 14 nt, Mycobacterium avium subsp. paratuberculosis
gccgccgggccggc

SEQ ID NO: 933490 - RNA, 15 nt, Mycobacterium avium subsp. paratuberculosis
gccgccgggccggcg

SEQ ID NO: 933491 - RNA, 16 nt, Mycobacterium avium subsp. paratuberculosis
gccgccgggccggcgg

SEQ ID NO: 933492 - RNA, 20 nt, Mycobacterium avium subsp. paratuberculosis
gccgccgggccggcggccag

SEQ ID NO: 933493 - RNA, 12 nt, Mycobacterium avium subsp. paratuberculosis
gccgccgggccu

SEQ ID NO: 933494 - RNA, 13 nt, Mycobacterium avium subsp. paratuberculosis
gccgccggcggcg

SEQ ID NO: 933495 - RNA, 15 nt, Mycobacterium avium subsp. paratuberculosis
gccgccggcgcgguu

SEQ ID NO: 933496 - RNA, 14 nt, Mycobacterium avium subsp. paratuberculosis
gccgccggcgcggu

SEQ ID NO: 933497 - RNA, 17 nt, Mycobacterium avium subsp. paratuberculosis
gccgccggcgcuggcgc

SEQ ID NO: 933498 - RNA, 22 nt, Mycobacterium avium subsp. paratuberculosis
gccgccggcgcuggcgcgccgu

SEQ ID NO: 933499 - RNA, 12 nt, Mycobacterium avium subsp. paratuberculosis
gccgccggcggc

SEQ ID NO: 933500 - RNA, 14 nt, Mycobacterium avium subsp. paratuberculosis
gccgccggcgcccu

SEQ ID NO: 933501 - RNA, 13 nt, Mycobacterium avium subsp. paratuberculosis
gccgccggcgccc

SEQ ID NO: 933502 - RNA, 15 nt, Mycobacterium avium subsp. paratuberculosis
gccgccggcgcccug

SEQ ID NO: 933503 - RNA, 19 nt, Mycobacterium avium subsp. paratuberculosis
gccgccggcgcccugcgcg

SEQ ID NO: 933504 - RNA, 13 nt, Mycobacterium avium subsp. paratuberculosis
gccgcuacgccga

SEQ ID NO: 933505 - RNA, 19 nt, Mycobacterium avium subsp. paratuberculosis
gccgcuagaccgauggcgg

SEQ ID NO: 933506 - RNA, 19 nt, Mycobacterium avium subsp. paratuberculosis
gccgcuagguuuggccagc

SEQ ID NO: 933507 - RNA, 21 nt, Mycobacterium avium subsp. paratuberculosis
gccgcuagguuuggccagcac

SEQ ID NO: 933508 - RNA, 23 nt, Mycobacterium avium subsp. paratuberculosis
gccgcuagguuuggccagcaccg

SEQ ID NO: 933509 - RNA, 14 nt, Mycobacterium avium subsp. paratuberculosis
gccgcuagucgccc

SEQ ID NO: 933510 - RNA, 16 nt, Mycobacterium avium subsp. paratuberculosis
gccgcuagucgcccag

SEQ ID NO: 933511 - RNA, 19 nt, Mycobacterium avium subsp. paratuberculosis
gccgcuagucgcccagcag

SEQ ID NO: 933512 - RNA, 21 nt, Mycobacterium avium subsp. paratuberculosis
gccgcuagucgcccagcagcc

SEQ ID NO: 933513 - RNA, 20 nt, Mycobacterium avium subsp. paratuberculosis
gccgcuaguuggugcugggc

SEQ ID NO: 933514 - RNA, 23 nt, Mycobacterium avium subsp. paratuberculosis
gccgcucaaguccucgguggcca

SEQ ID NO: 933515 - RNA, 19 nt, Mycobacterium avium subsp. paratuberculosis
gccgcguuccccggcgugg

SEQ ID NO: 933516 - RNA, 14 nt, Mycobacterium avium subsp. paratuberculosis
gccgcguugucgac

SEQ ID NO: 933517 - RNA, 16 nt, Mycobacterium avium subsp. paratuberculosis
gccgcguugucgacca

SEQ ID NO: 933518 - RNA, 19 nt, Mycobacterium avium subsp. paratuberculosis
gccgcguugucgaccacca

SEQ ID NO: 933519 - RNA, 22 nt, Mycobacterium avium subsp. paratuberculosis
gccgcguugucgaccaccaggu

SEQ ID NO: 933520 - RNA, 12 nt, Mycobacterium avium subsp. paratuberculosis
gccgcguucgga

SEQ ID NO: 933521 - RNA, 13 nt, Mycobacterium avium subsp. paratuberculosis
gccgcguucggag

SEQ ID NO: 933522 - RNA, 15 nt, Mycobacterium avium subsp. paratuberculosis
gccgcguucggcggc

SEQ ID NO: 933523 - RNA, 21 nt, Mycobacterium avium subsp. paratuberculosis
gccgcguucggcggcgcgcug

SEQ ID NO: 933524 - RNA, 12 nt, Mycobacterium avium subsp. paratuberculosis
gccgcgucggcg

SEQ ID NO: 933525 - RNA, 16 nt, Mycobacterium avium subsp. paratuberculosis
gccgcgucgucgucga

SEQ ID NO: 933526 - RNA, 17 nt, Mycobacterium avium subsp. paratuberculosis
gccgcgucgucgucgac

SEQ ID NO: 933527 - RNA, 18 nt, Mycobacterium avium subsp. paratuberculosis
gccgcgucgucgucgacc

SEQ ID NO: 933528 - RNA, 18 nt, Mycobacterium avium subsp. paratuberculosis
gccgcgucgugccgagcg

SEQ ID NO: 933529 - RNA, 20 nt, Mycobacterium avium subsp. paratuberculosis
gccgcgucguugagugcgcu

SEQ ID NO: 933530 - RNA, 22 nt, Mycobacterium avium subsp. paratuberculosis
gccgcgucguugagugcgcugu

SEQ ID NO: 933531 - RNA, 23 nt, Mycobacterium avium subsp. paratuberculosis
gccgcgucguugagugcgcugug

SEQ ID NO: 933532 - RNA, 21 nt, Mycobacterium avium subsp. paratuberculosis
gccgcguucacccgcgcccgc

SEQ ID NO: 933533 - RNA, 19 nt, Mycobacterium avium subsp. paratuberculosis
gccgcgugggagagcggga

SEQ ID NO: 933534 - RNA, 15 nt, Mycobacterium avium subsp. paratuberculosis
gccgcucccggcgca

SEQ ID NO: 933535 - RNA, 17 nt, Mycobacterium avium subsp. paratuberculosis
gccgcucccggcgcagc

SEQ ID NO: 933536 - RNA, 18 nt, Mycobacterium avium subsp. paratuberculosis
gccgcucccggcgcagca

SEQ ID NO: 933537 - RNA, 13 nt, Mycobacterium avium subsp. paratuberculosis
gccgcuccgcggc

SEQ ID NO: 933538 - RNA, 16 nt, Mycobacterium avium subsp. paratuberculosis
gccgcuccgcggcggg

SEQ ID NO: 933539 - RNA, 18 nt, Mycobacterium avium subsp. paratuberculosis
gccgcuccgcggcgggcg

SEQ ID NO: 933540 - RNA, 13 nt, Mycobacterium avium subsp. paratuberculosis
gccgcuccggccc

SEQ ID NO: 933541 - RNA, 14 nt, Mycobacterium avium subsp. paratuberculosis
gccgcuccggucgc

SEQ ID NO: 933542 - RNA, 14 nt, Mycobacterium avium subsp. paratuberculosis
gccgcuccaccgcg

SEQ ID NO: 933543 - RNA, 15 nt, Mycobacterium avium subsp. paratuberculosis
gccgcuccaccgcgu

SEQ ID NO: 933544 - RNA, 18 nt, Mycobacterium avium subsp. paratuberculosis
gccgcuccaccgcguccu

SEQ ID NO: 933545 - RNA, 22 nt, Mycobacterium avium subsp. paratuberculosis
gccgcucagcgauugcggccgc

SEQ ID NO: 933546 - RNA, 12 nt, Mycobacterium avium subsp. paratuberculosis
gccgcucaccgc

SEQ ID NO: 933547 - RNA, 14 nt, Mycobacterium avium subsp. paratuberculosis
gccgcucaccgccg

SEQ ID NO: 933548 - RNA, 15 nt, Mycobacterium avium subsp. paratuberculosis
gccgcucaccgccga

SEQ ID NO: 933549 - RNA, 16 nt, Mycobacterium avium subsp. paratuberculosis
gccgcucaccgccgag

SEQ ID NO: 933550 - RNA, 24 nt, Mycobacterium avium subsp. paratuberculosis
gccgcucaccgccgagccgcucca

SEQ ID NO: 933551 - RNA, 17 nt, Mycobacterium avium subsp. paratuberculosis
gccgcucagcgggcggc

SEQ ID NO: 933552 - RNA, 14 nt, Mycobacterium avium subsp. paratuberculosis
gccgcucguaguug

SEQ ID NO: 933553 - RNA, 23 nt, Mycobacterium avium subsp. paratuberculosis
gccgcucguaguuggggccggcc

SEQ ID NO: 933554 - RNA, 14 nt, Mycobacterium avium subsp. paratuberculosis
gccgcucgucgagu

SEQ ID NO: 933555 - RNA, 17 nt, Mycobacterium avium subsp. paratuberculosis
gccgcucgucgaguccg

SEQ ID NO: 933556 - RNA, 13 nt, Mycobacterium avium subsp. paratuberculosis
gccgcucgucggc

SEQ ID NO: 933557 - RNA, 15 nt, Mycobacterium avium subsp. paratuberculosis
gccgcucgucggcca

SEQ ID NO: 933558 - RNA, 17 nt, Mycobacterium avium subsp. paratuberculosis
gccgcucgucgggcaca

SEQ ID NO: 933559 - RNA, 19 nt, Mycobacterium avium subsp. paratuberculosis
gccgcucgucgggcacauc

SEQ ID NO: 933560 - RNA, 22 nt, Mycobacterium avium subsp. paratuberculosis
gccgcucgucgggcacaucccg

SEQ ID NO: 933561 - RNA, 14 nt, Mycobacterium avium subsp. paratuberculosis
gccgcucggaguuc

SEQ ID NO: 933562 - RNA, 20 nt, Mycobacterium avium subsp. paratuberculosis
gccgcucggaguucgcccgc

SEQ ID NO: 933563 - RNA, 20 nt, Mycobacterium avium subsp. paratuberculosis
gccgcucggauucccgcucg

SEQ ID NO: 933564 - RNA, 12 nt, Mycobacterium avium subsp. paratuberculosis
gccgcucggcgc

SEQ ID NO: 933565 - RNA, 13 nt, Mycobacterium avium subsp. paratuberculosis
gccgcucggcgcu

SEQ ID NO: 933566 - RNA, 22 nt, Mycobacterium avium subsp. paratuberculosis
gccgcucggcgcuccagcgggc

SEQ ID NO: 933567 - RNA, 19 nt, Mycobacterium avium subsp. paratuberculosis
gccgcucggggaucccgaa

SEQ ID NO: 933568 - RNA, 14 nt, Mycobacterium avium subsp. paratuberculosis
gccgcucggguguc

SEQ ID NO: 933569 - RNA, 20 nt, Mycobacterium avium subsp. paratuberculosis
gccgcucgggugucgccgag

SEQ ID NO: 933570 - RNA, 23 nt, Mycobacterium avium subsp. paratuberculosis
gccgcucgggugucgccgagccg

SEQ ID NO: 933571 - RNA, 18 nt, Mycobacterium avium subsp. paratuberculosis
gccgcucguaacgccacg

SEQ ID NO: 933572 - RNA, 20 nt, Mycobacterium avium subsp. paratuberculosis
gccgcucguaacgccacggc

SEQ ID NO: 933573 - RNA, 21 nt, Mycobacterium avium subsp. paratuberculosis
gccgcucguaacgccacggcg

SEQ ID NO: 933574 - RNA, 19 nt, Mycobacterium avium subsp. paratuberculosis
gccgcugaaauccgggguc

SEQ ID NO: 933575 - RNA, 13 nt, Mycobacterium avium subsp. paratuberculosis
gccgcucggccag

SEQ ID NO: 933576 - RNA, 14 nt, Mycobacterium avium subsp. paratuberculosis
gccgcucggccagc

SEQ ID NO: 933577 - RNA, 15 nt, Mycobacterium avium subsp. paratuberculosis
gccgcucggccagcg

SEQ ID NO: 933578 - RNA, 20 nt, Mycobacterium avium subsp. paratuberculosis
gccgcucggccagcgcagcg

SEQ ID NO: 933579 - RNA, 15 nt, Mycobacterium avium subsp. paratuberculosis
gccgcucgcgcaccg

SEQ ID NO: 933580 - RNA, 15 nt, Mycobacterium avium subsp. paratuberculosis
gccgcucgcgggcca

SEQ ID NO: 933581 - RNA, 22 nt, Mycobacterium avium subsp. paratuberculosis
gccgcucgcgggccacagcggc

SEQ ID NO: 933582 - RNA, 14 nt, Mycobacterium avium subsp. paratuberculosis
gccgcucgcccagc

SEQ ID NO: 933583 - RNA, 21 nt, Mycobacterium avium subsp. paratuberculosis
gccgcucgcccagcgcggcgg

SEQ ID NO: 933584 - RNA, 24 nt, Mycobacterium avium subsp. paratuberculosis
gccgcucgcccagcgcggcggcca

SEQ ID NO: 933585 - RNA, 12 nt, Mycobacterium avium subsp. paratuberculosis
gccgcucgccgg

SEQ ID NO: 933586 - RNA, 15 nt, Mycobacterium avium subsp. paratuberculosis
gccgcucgccgggga

SEQ ID NO: 933587 - RNA, 23 nt, Mycobacterium avium subsp. paratuberculosis
gccgcgugacaggggcagcagca

SEQ ID NO: 933588 - RNA, 16 nt, Mycobacterium avium subsp. paratuberculosis
gccgcgucgucaucgu

SEQ ID NO: 933589 - RNA, 15 nt, Mycobacterium avium subsp. paratuberculosis
gccgcgucggcggcg

SEQ ID NO: 933590 - RNA, 16 nt, Mycobacterium avium subsp. paratuberculosis
gccgcgucggcggcgg

SEQ ID NO: 933591 - RNA, 19 nt, Mycobacterium avium subsp. paratuberculosis
gccgcgucggaccccgaug

SEQ ID NO: 933592 - RNA, 21 nt, Mycobacterium avium subsp. paratuberculosis
gccgcgucggaccccgaugcg

SEQ ID NO: 933593 - RNA, 14 nt, Mycobacterium avium subsp. paratuberculosis
gccgcgucggccaa

SEQ ID NO: 933594 - RNA, 18 nt, Mycobacterium avium subsp. paratuberculosis
gccgcgucggccaacgga

SEQ ID NO: 933595 - RNA, 18 nt, Mycobacterium avium subsp. paratuberculosis
gccgcgucgcgccgccgc

SEQ ID NO: 933596 - RNA, 13 nt, Mycobacterium avium subsp. paratuberculosis
gccgcgucgccga

SEQ ID NO: 933597 - RNA, 14 nt, Mycobacterium avium subsp. paratuberculosis
gccgcgucgccgac

SEQ ID NO: 933598 - RNA, 22 nt, Mycobacterium avium subsp. paratuberculosis
gccgcgucgccgaccagcagga

SEQ ID NO: 933599 - RNA, 15 nt, Mycobacterium avium subsp. paratuberculosis
gccgcgucgccgauc

SEQ ID NO: 933600 - RNA, 22 nt, Mycobacterium avium subsp. paratuberculosis
gccgcgucgccgaucgcccggu

SEQ ID NO: 933601 - RNA, 16 nt, Mycobacterium avium subsp. paratuberculosis
gccgcgucgccgccgg

SEQ ID NO: 933602 - RNA, 12 nt, Mycobacterium avium subsp. paratuberculosis
gccgcgucgacc

SEQ ID NO: 933603 - RNA, 13 nt, Mycobacterium avium subsp. paratuberculosis
gccgcgucgacca

SEQ ID NO: 933604 - RNA, 21 nt, Mycobacterium avium subsp. paratuberculosis
gccgcgucgacgccgcugccg

SEQ ID NO: 933605 - RNA, 19 nt, Mycobacterium avium subsp. paratuberculosis
gccgcguccucgucgaugc

SEQ ID NO: 933606 - RNA, 21 nt, Mycobacterium avium subsp. paratuberculosis
gccgcguccucgucgaugccg

SEQ ID NO: 933607 - RNA, 15 nt, Mycobacterium avium subsp. paratuberculosis
gccgcguccggggug

SEQ ID NO: 933608 - RNA, 16 nt, Mycobacterium avium subsp. paratuberculosis
gccgcguccggggugc

SEQ ID NO: 933609 - RNA, 23 nt, Mycobacterium avium subsp. paratuberculosis
gccgcguccucgccguacgcgcc

SEQ ID NO: 933610 - RNA, 16 nt, Mycobacterium avium subsp. paratuberculosis
gccgcguacaccggcu

SEQ ID NO: 933611 - RNA, 17 nt, Mycobacterium avium subsp. paratuberculosis
gccgcguacaccggcug

SEQ ID NO: 933612 - RNA, 19 nt, Mycobacterium avium subsp. paratuberculosis
gccgcguacaccggcugac

SEQ ID NO: 933613 - RNA, 13 nt, Mycobacterium avium subsp. paratuberculosis
gccgcguacagca

SEQ ID NO: 933614 - RNA, 15 nt, Mycobacterium avium subsp. paratuberculosis
gccgcguacagcagc

SEQ ID NO: 933615 - RNA, 17 nt, Mycobacterium avium subsp. paratuberculosis
gccgcguacagcagcug

SEQ ID NO: 933616 - RNA, 15 nt, Mycobacterium avium subsp. paratuberculosis
gccgcguacagccag

SEQ ID NO: 933617 - RNA, 16 nt, Mycobacterium avium subsp. paratuberculosis
gccgcguacagccagc

SEQ ID NO: 933618 - RNA, 17 nt, Mycobacterium avium subsp. paratuberculosis
gccgcguacagccagcc

SEQ ID NO: 933619 - RNA, 23 nt, Mycobacterium avium subsp. paratuberculosis
gccgcguacagccagcccguggc

SEQ ID NO: 933620 - RNA, 15 nt, Mycobacterium avium subsp. paratuberculosis
gccgcguaccagcgc

SEQ ID NO: 933621 - RNA, 16 nt, Mycobacterium avium subsp. paratuberculosis
gccgcguaccagcgcc

SEQ ID NO: 933622 - RNA, 15 nt, Mycobacterium avium subsp. paratuberculosis
gccgcguacgccgcc

SEQ ID NO: 933623 - RNA, 16 nt, Mycobacterium avium subsp. paratuberculosis
gccgcguacgccgccu

SEQ ID NO: 933624 - RNA, 19 nt, Mycobacterium avium subsp. paratuberculosis
gccgcguaggccaggaccg

SEQ ID NO: 933625 - RNA, 14 nt, Mycobacterium avium subsp. paratuberculosis
gccgcguaggccuu

SEQ ID NO: 933626 - RNA, 17 nt, Mycobacterium avium subsp. paratuberculosis
gccgcgucacgucggcc

SEQ ID NO: 933627 - RNA, 18 nt, Mycobacterium avium subsp. paratuberculosis
gccgcgucacgucggccu

SEQ ID NO: 933628 - RNA, 14 nt, Mycobacterium avium subsp. paratuberculosis
gccgcgucagcggc

SEQ ID NO: 933629 - RNA, 16 nt, Mycobacterium avium subsp. paratuberculosis
gccgcgucagcggcgg

SEQ ID NO: 933630 - RNA, 18 nt, Mycobacterium avium subsp. paratuberculosis
gccgcgucagcggcgggc

SEQ ID NO: 933631 - RNA, 14 nt, Mycobacterium avium subsp. paratuberculosis
gccgcgguggcggu

SEQ ID NO: 933632 - RNA, 16 nt, Mycobacterium avium subsp. paratuberculosis
gccgcgguggcggugu

SEQ ID NO: 933633 - RNA, 17 nt, Mycobacterium avium subsp. paratuberculosis
gccgcgguggcgguguu

SEQ ID NO: 933634 - RNA, 21 nt, Mycobacterium avium subsp. paratuberculosis
gccgcgguggguccgccgggc

SEQ ID NO: 933635 - RNA, 14 nt, Mycobacterium avium subsp. paratuberculosis
gccgcgguucggcg

SEQ ID NO: 933636 - RNA, 17 nt, Mycobacterium avium subsp. paratuberculosis
gccgcgguucggcgucg

SEQ ID NO: 933637 - RNA, 18 nt, Mycobacterium avium subsp. paratuberculosis
gccgcgguucggcgucgg

SEQ ID NO: 933638 - RNA, 21 nt, Mycobacterium avium subsp. paratuberculosis
gccgcgguuggucaccagguc

SEQ ID NO: 933639 - RNA, 13 nt, Mycobacterium avium subsp. paratuberculosis
gccgcggugcgcc

SEQ ID NO: 933640 - RNA, 21 nt, Mycobacterium avium subsp. paratuberculosis
gccgcggugcgccacgcccgc

SEQ ID NO: 933641 - RNA, 15 nt, Mycobacterium avium subsp. paratuberculosis
gccgcggugcggccc

SEQ ID NO: 933642 - RNA, 16 nt, Mycobacterium avium subsp. paratuberculosis
gccgcggugcggcccg

SEQ ID NO: 933643 - RNA, 17 nt, Mycobacterium avium subsp. paratuberculosis
gccgcggugcggcccgc

SEQ ID NO: 933644 - RNA, 20 nt, Mycobacterium avium subsp. paratuberculosis
gccgcggugcggcccgcggc

SEQ ID NO: 933645 - RNA, 22 nt, Mycobacterium avium subsp. paratuberculosis
gccgcggugcggcccgcggcau

SEQ ID NO: 933646 - RNA, 13 nt, Mycobacterium avium subsp. paratuberculosis
gccgcggucucga

SEQ ID NO: 933647 - RNA, 23 nt, Mycobacterium avium subsp. paratuberculosis
gccgcggucucgaccgacugcga

SEQ ID NO: 933648 - RNA, 14 nt, Mycobacterium avium subsp. paratuberculosis
gccgcggugaccgc

SEQ ID NO: 933649 - RNA, 17 nt, Mycobacterium avium subsp. paratuberculosis
gccgcggugaccgcgcc

SEQ ID NO: 933650 - RNA, 17 nt, Mycobacterium avium subsp. paratuberculosis
gccgcgguggccgggau

SEQ ID NO: 933651 - RNA, 12 nt, Mycobacterium avium subsp. paratuberculosis
gccgcgguggcg

SEQ ID NO: 933652 - RNA, 15 nt, Mycobacterium avium subsp. paratuberculosis
gccgcgguggcgccg

SEQ ID NO: 933653 - RNA, 14 nt, Mycobacterium avium subsp. paratuberculosis
gccgcggucgcacu

SEQ ID NO: 933654 - RNA, 13 nt, Mycobacterium avium subsp. paratuberculosis
gccgcggucgccc

SEQ ID NO: 933655 - RNA, 15 nt, Mycobacterium avium subsp. paratuberculosis
gccgcggucgccccg

SEQ ID NO: 933656 - RNA, 16 nt, Mycobacterium avium subsp. paratuberculosis
gccgcggucgccccgg

SEQ ID NO: 933657 - RNA, 17 nt, Mycobacterium avium subsp. paratuberculosis
gccgcggucgccccggc

SEQ ID NO: 933658 - RNA, 19 nt, Mycobacterium avium subsp. paratuberculosis
gccgcggucgccccggccg

SEQ ID NO: 933659 - RNA, 14 nt, Mycobacterium avium subsp. paratuberculosis
gccgcggucaucga

SEQ ID NO: 933660 - RNA, 18 nt, Mycobacterium avium subsp. paratuberculosis
gccgcggucaucgagccg

SEQ ID NO: 933661 - RNA, 17 nt, Mycobacterium avium subsp. paratuberculosis
gccgcgguagcggaccu

SEQ ID NO: 933662 - RNA, 23 nt, Mycobacterium avium subsp. paratuberculosis
gccgcgguagcggaccugcgaga

SEQ ID NO: 933663 - RNA, 17 nt, Mycobacterium avium subsp. paratuberculosis
gccgcgguagacaccgc

SEQ ID NO: 933664 - RNA, 17 nt, Mycobacterium avium subsp. paratuberculosis
gccgcgggugucgcccu

SEQ ID NO: 933665 - RNA, 13 nt, Mycobacterium avium subsp. paratuberculosis
gccgcggguggcg

SEQ ID NO: 933666 - RNA, 21 nt, Mycobacterium avium subsp. paratuberculosis
gccgcgggucgauaugcugca

SEQ ID NO: 933667 - RNA, 20 nt, Mycobacterium avium subsp. paratuberculosis
gccgcgggugaaauccgacg

SEQ ID NO: 933668 - RNA, 24 nt, Mycobacterium avium subsp. paratuberculosis
gccgcgggugacgaucaccgcugc

SEQ ID NO: 933669 - RNA, 17 nt, Mycobacterium avium subsp. paratuberculosis
gccgcgggugcggcacg

SEQ ID NO: 933670 - RNA, 17 nt, Mycobacterium avium subsp. paratuberculosis
gccgcgggugcggccca

SEQ ID NO: 933671 - RNA, 16 nt, Mycobacterium avium subsp. paratuberculosis
gccgcggguggccagc

SEQ ID NO: 933672 - RNA, 17 nt, Mycobacterium avium subsp. paratuberculosis
gccgcggguggccagcc

SEQ ID NO: 933673 - RNA, 16 nt, Mycobacterium avium subsp. paratuberculosis
gccgcggggccggcgc

SEQ ID NO: 933674 - RNA, 17 nt, Mycobacterium avium subsp. paratuberculosis
gccgcggggccggcgcu

SEQ ID NO: 933675 - RNA, 18 nt, Mycobacterium avium subsp. paratuberculosis
gccgcggggccggcgcug

SEQ ID NO: 933676 - RNA, 16 nt, Mycobacterium avium subsp. paratuberculosis
gccgcgggucggcgac

SEQ ID NO: 933677 - RNA, 18 nt, Mycobacterium avium subsp. paratuberculosis
gccgcgggucggcgacgg

SEQ ID NO: 933678 - RNA, 23 nt, Mycobacterium avium subsp. paratuberculosis
gccgcgggcguucaucaccuggu

SEQ ID NO: 933679 - RNA, 18 nt, Mycobacterium avium subsp. paratuberculosis
gccgcgggcucccgcucg

SEQ ID NO: 933680 - RNA, 14 nt, Mycobacterium avium subsp. paratuberculosis
gccgcgggcgggcc

SEQ ID NO: 933681 - RNA, 15 nt, Mycobacterium avium subsp. paratuberculosis
gccgcgggcgggccg

SEQ ID NO: 933682 - RNA, 18 nt, Mycobacterium avium subsp. paratuberculosis
gccgcgggcggucgcgca

SEQ ID NO: 933683 - RNA, 20 nt, Mycobacterium avium subsp. paratuberculosis
gccgcgggcggucgcgcagc

SEQ ID NO: 933684 - RNA, 22 nt, Mycobacterium avium subsp. paratuberculosis
gccgcgggcggucgcgcagccg

SEQ ID NO: 933685 - RNA, 13 nt, Mycobacterium avium subsp. paratuberculosis
gccgcgggcgccg

SEQ ID NO: 933686 - RNA, 18 nt, Mycobacterium avium subsp. paratuberculosis
gccgcgggcgccguaggc

SEQ ID NO: 933687 - RNA, 12 nt, Mycobacterium avium subsp. paratuberculosis
gccgcgggccca

SEQ ID NO: 933688 - RNA, 17 nt, Mycobacterium avium subsp. paratuberculosis
gccgcgggcccaccgcc

SEQ ID NO: 933689 - RNA, 18 nt, Mycobacterium avium subsp. paratuberculosis
gccgcgggcccaccgcca

SEQ ID NO: 933690 - RNA, 14 nt, Mycobacterium avium subsp. paratuberculosis
gccgcgggccagca

SEQ ID NO: 933691 - RNA, 15 nt, Mycobacterium avium subsp. paratuberculosis
gccgcgggccagcag

SEQ ID NO: 933692 - RNA, 17 nt, Mycobacterium avium subsp. paratuberculosis
gccgcgggccagcagcc

SEQ ID NO: 933693 - RNA, 15 nt, Mycobacterium avium subsp. paratuberculosis
gccgcgggccagcca

SEQ ID NO: 933694 - RNA, 19 nt, Mycobacterium avium subsp. paratuberculosis
gccgcggcgcgcaucccga

SEQ ID NO: 933695 - RNA, 20 nt, Mycobacterium avium subsp. paratuberculosis
gccgcgggaugcuuggucgc

SEQ ID NO: 933696 - RNA, 13 nt, Mycobacterium avium subsp. paratuberculosis
gccgcgggccagc

SEQ ID NO: 933697 - RNA, 13 nt, Mycobacterium avium subsp. paratuberculosis
gccgcggcuccag

SEQ ID NO: 933698 - RNA, 18 nt, Mycobacterium avium subsp. paratuberculosis
gccgcggcuccagcagcg

SEQ ID NO: 933699 - RNA, 12 nt, Mycobacterium avium subsp. paratuberculosis
gccgcggcucga

SEQ ID NO: 933700 - RNA, 16 nt, Mycobacterium avium subsp. paratuberculosis
gccgcggcucgcgacg

SEQ ID NO: 933701 - RNA, 20 nt, Mycobacterium avium subsp. paratuberculosis
gccgcggcucgcgacgcggc

SEQ ID NO: 933702 - RNA, 20 nt, Mycobacterium avium subsp. paratuberculosis
gccgcggaucagcaggaccg

SEQ ID NO: 933703 - RNA, 23 nt, Mycobacterium avium subsp. paratuberculosis
gccgcggaucgguuucuccaccc

SEQ ID NO: 933704 - RNA, 16 nt, Mycobacterium avium subsp. paratuberculosis
gccgcggaguaggcgc

SEQ ID NO: 933705 - RNA, 18 nt, Mycobacterium avium subsp. paratuberculosis
gccgcggaguaggcgccg

SEQ ID NO: 933706 - RNA, 20 nt, Mycobacterium avium subsp. paratuberculosis
gccgcggaguaggcgccgcc

SEQ ID NO: 933707 - RNA, 16 nt, Mycobacterium avium subsp. paratuberculosis
gccgcggacggcgaac

SEQ ID NO: 933708 - RNA, 17 nt, Mycobacterium avium subsp. paratuberculosis
gccgcggacggcgaacu

SEQ ID NO: 933709 - RNA, 22 nt, Mycobacterium avium subsp. paratuberculosis
gccgcggauggccucggcgaug

SEQ ID NO: 933710 - RNA, 21 nt, Mycobacterium avium subsp. paratuberculosis
gccgcggauggugacggccgu

SEQ ID NO: 933711 - RNA, 18 nt, Mycobacterium avium subsp. paratuberculosis
gccgcggauuccggcauc

SEQ ID NO: 933712 - RNA, 20 nt, Mycobacterium avium subsp. paratuberculosis
gccgcggauuccggcaucgg

SEQ ID NO: 933713 - RNA, 19 nt, Mycobacterium avium subsp. paratuberculosis
gccgcggcaacgccagcca

SEQ ID NO: 933714 - RNA, 13 nt, Mycobacterium avium subsp. paratuberculosis
gccgcggccaagu

SEQ ID NO: 933715 - RNA, 21 nt, Mycobacterium avium subsp. paratuberculosis
gccgcggccaagugcggucgg

SEQ ID NO: 933716 - RNA, 12 nt, Mycobacterium avium subsp. paratuberculosis
gccgcggccaca

SEQ ID NO: 933717 - RNA, 20 nt, Mycobacterium avium subsp. paratuberculosis
gccgcggacauucugcacga

SEQ ID NO: 933718 - RNA, 19 nt, Mycobacterium avium subsp. paratuberculosis
gccgcggacggccagcccg

SEQ ID NO: 933719 - RNA, 20 nt, Mycobacterium avium subsp. paratuberculosis
gccgcggacggccagcccgu

SEQ ID NO: 933720 - RNA, 12 nt, Mycobacterium avium subsp. paratuberculosis
gccgcggacccc

SEQ ID NO: 933721 - RNA, 22 nt, Mycobacterium avium subsp. paratuberculosis
gccgcggaccccagcgugacgu

SEQ ID NO: 933722 - RNA, 18 nt, Mycobacterium avium subsp. paratuberculosis
gccgcggacccgacgguc

SEQ ID NO: 933723 - RNA, 15 nt, Mycobacterium avium subsp. paratuberculosis
gccgcgcuugacggc

SEQ ID NO: 933724 - RNA, 18 nt, Mycobacterium avium subsp. paratuberculosis
gccgcgcuugacggccgg

SEQ ID NO: 933725 - RNA, 21 nt, Mycobacterium avium subsp. paratuberculosis
gccgcgcuugacggccgggcc

SEQ ID NO: 933726 - RNA, 14 nt, Mycobacterium avium subsp. paratuberculosis
gccgcgcuugcgac

SEQ ID NO: 933727 - RNA, 17 nt, Mycobacterium avium subsp. paratuberculosis
gccgcgcuugcgaucgc

SEQ ID NO: 933728 - RNA, 18 nt, Mycobacterium avium subsp. paratuberculosis
gccgcgcuugcgaucgcc

SEQ ID NO: 933729 - RNA, 19 nt, Mycobacterium avium subsp. paratuberculosis
gccgcgcuugcgaucgccg

SEQ ID NO: 933730 - RNA, 13 nt, Mycobacterium avium subsp. paratuberculosis
gccgcggaacgca

SEQ ID NO: 933731 - RNA, 17 nt, Mycobacterium avium subsp. paratuberculosis
gccgcggaagaacaguu

SEQ ID NO: 933732 - RNA, 16 nt, Mycobacterium avium subsp. paratuberculosis
gccgcggaagccccag

SEQ ID NO: 933733 - RNA, 20 nt, Mycobacterium avium subsp. paratuberculosis
gccgcggaagccccaggccc

SEQ ID NO: 933734 - RNA, 16 nt, Mycobacterium avium subsp. paratuberculosis
gccgcggaaggccagc

SEQ ID NO: 933735 - RNA, 17 nt, Mycobacterium avium subsp. paratuberculosis
gccgcggaaggccagcu

SEQ ID NO: 933736 - RNA, 20 nt, Mycobacterium avium subsp. paratuberculosis
gccgcggaaggccagcuccu

SEQ ID NO: 933737 - RNA, 13 nt, Mycobacterium avium subsp. paratuberculosis
gccgcgcugucca

SEQ ID NO: 933738 - RNA, 16 nt, Mycobacterium avium subsp. paratuberculosis
gccgcgcuguccacgu

SEQ ID NO: 933739 - RNA, 18 nt, Mycobacterium avium subsp. paratuberculosis
gccgcgcuggucaacucg

SEQ ID NO: 933740 - RNA, 19 nt, Mycobacterium avium subsp. paratuberculosis
gccgcgcuggucaacucga

SEQ ID NO: 933741 - RNA, 23 nt, Mycobacterium avium subsp. paratuberculosis
gccgcgcuggucaacucgacccg

SEQ ID NO: 933742 - RNA, 14 nt, Mycobacterium avium subsp. paratuberculosis
gccgcgcuggcgca

SEQ ID NO: 933743 - RNA, 16 nt, Mycobacterium avium subsp. paratuberculosis
gccgcgcuggcgcagg

SEQ ID NO: 933744 - RNA, 19 nt, Mycobacterium avium subsp. paratuberculosis
gccgcgcuggcgcaggcgc

SEQ ID NO: 933745 - RNA, 23 nt, Mycobacterium avium subsp. paratuberculosis
gccgcgcuggcgcaggcgcuggg

SEQ ID NO: 933746 - RNA, 15 nt, Mycobacterium avium subsp. paratuberculosis
gccgcgcuggccagc

SEQ ID NO: 933747 - RNA, 17 nt, Mycobacterium avium subsp. paratuberculosis
gccgcgcuggccgaucc

SEQ ID NO: 933748 - RNA, 14 nt, Mycobacterium avium subsp. paratuberculosis
gccgcgcuggccgg

SEQ ID NO: 933749 - RNA, 17 nt, Mycobacterium avium subsp. paratuberculosis
gccgcgcugcgccgggu

SEQ ID NO: 933750 - RNA, 16 nt, Mycobacterium avium subsp. paratuberculosis
gccgcgcucggccauc

SEQ ID NO: 933751 - RNA, 22 nt, Mycobacterium avium subsp. paratuberculosis
gccgcgcucggccauccgggcg

SEQ ID NO: 933752 - RNA, 14 nt, Mycobacterium avium subsp. paratuberculosis
gccgcgcucgucga

SEQ ID NO: 933753 - RNA, 23 nt, Mycobacterium avium subsp. paratuberculosis
gccgcgcucgucgaucaagaacg

SEQ ID NO: 933754 - RNA, 13 nt, Mycobacterium avium subsp. paratuberculosis
gccgcgcucgugc

SEQ ID NO: 933755 - RNA, 16 nt, Mycobacterium avium subsp. paratuberculosis
gccgcgcugaacgcgg

SEQ ID NO: 933756 - RNA, 13 nt, Mycobacterium avium subsp. paratuberculosis
gccgcgcucgaac

SEQ ID NO: 933757 - RNA, 18 nt, Mycobacterium avium subsp. paratuberculosis
gccgcgcucaacccgggc

SEQ ID NO: 933758 - RNA, 23 nt, Mycobacterium avium subsp. paratuberculosis
gccgcgcucaacccgggccggac

SEQ ID NO: 933759 - RNA, 15 nt, Mycobacterium avium subsp. paratuberculosis
gccgcgcucgcacca

SEQ ID NO: 933760 - RNA, 13 nt, Mycobacterium avium subsp. paratuberculosis
gccgcggcgucgg

SEQ ID NO: 933761 - RNA, 23 nt, Mycobacterium avium subsp. paratuberculosis
gccgcggcgucgggauggucgau

SEQ ID NO: 933762 - RNA, 21 nt, Mycobacterium avium subsp. paratuberculosis
gccgcggcggcucggcggcgu

SEQ ID NO: 933763 - RNA, 18 nt, Mycobacterium avium subsp. paratuberculosis
gccgcggcgggcgcgucg

SEQ ID NO: 933764 - RNA, 15 nt, Mycobacterium avium subsp. paratuberculosis
gccgcggcggugccg

SEQ ID NO: 933765 - RNA, 16 nt, Mycobacterium avium subsp. paratuberculosis
gccgcggcggugccgg

SEQ ID NO: 933766 - RNA, 22 nt, Mycobacterium avium subsp. paratuberculosis
gccgcggcggugccgguguugc

SEQ ID NO: 933767 - RNA, 13 nt, Mycobacterium avium subsp. paratuberculosis
gccgcggcggugg

SEQ ID NO: 933768 - RNA, 15 nt, Mycobacterium avium subsp. paratuberculosis
gccgcggcgguggcc

SEQ ID NO: 933769 - RNA, 15 nt, Mycobacterium avium subsp. paratuberculosis
gccgcggcggcgccg

SEQ ID NO: 933770 - RNA, 16 nt, Mycobacterium avium subsp. paratuberculosis
gccgcggcggcgccga

SEQ ID NO: 933771 - RNA, 21 nt, Mycobacterium avium subsp. paratuberculosis
gccgcggcggcgccgacgggc

SEQ ID NO: 933772 - RNA, 22 nt, Mycobacterium avium subsp. paratuberculosis
gccgcggcggcgccgacgggcc

SEQ ID NO: 933773 - RNA, 13 nt, Mycobacterium avium subsp. paratuberculosis
gccgcggcggcaa

SEQ ID NO: 933774 - RNA, 19 nt, Mycobacterium avium subsp. paratuberculosis
gccgcggcggcacccaggu

SEQ ID NO: 933775 - RNA, 14 nt, Mycobacterium avium subsp. paratuberculosis
gccgcggcggcagc

SEQ ID NO: 933776 - RNA, 12 nt, Mycobacterium avium subsp. paratuberculosis
gccgcggcggca

SEQ ID NO: 933777 - RNA, 18 nt, Mycobacterium avium subsp. paratuberculosis
gccgcggcggcagcaccc

SEQ ID NO: 933778 - RNA, 13 nt, Mycobacterium avium subsp. paratuberculosis
gccgcggcggccc

SEQ ID NO: 933779 - RNA, 19 nt, Mycobacterium avium subsp. paratuberculosis
gccgcggcggcccggcguc

SEQ ID NO: 933780 - RNA, 13 nt, Mycobacterium avium subsp. paratuberculosis
gccgcggcggccu

SEQ ID NO: 933781 - RNA, 15 nt, Mycobacterium avium subsp. paratuberculosis
gccgcggcggccugc

SEQ ID NO: 933782 - RNA, 15 nt, Mycobacterium avium subsp. paratuberculosis
gccgcggcgccgcca

SEQ ID NO: 933783 - RNA, 12 nt, Mycobacterium avium subsp. paratuberculosis
gccgcggcgccg

SEQ ID NO: 933784 - RNA, 16 nt, Mycobacterium avium subsp. paratuberculosis
gccgcggcgcccggcg

SEQ ID NO: 933785 - RNA, 13 nt, Mycobacterium avium subsp. paratuberculosis
gccgcggcgcccu

SEQ ID NO: 933786 - RNA, 18 nt, Mycobacterium avium subsp. paratuberculosis
gccgcggcgcccucgccg

SEQ ID NO: 933787 - RNA, 11 nt, Mycobacterium avium subsp. paratuberculosis
gccgcggcgcc

SEQ ID NO: 933788 - RNA, 14 nt, Mycobacterium avium subsp. paratuberculosis
gccgcggcgcccgg

SEQ ID NO: 933789 - RNA, 15 nt, Mycobacterium avium subsp. paratuberculosis
gccgcggcgaucggc

SEQ ID NO: 933790 - RNA, 22 nt, Mycobacterium avium subsp. paratuberculosis
gccgcggcgaucucgaucgugg

SEQ ID NO: 933791 - RNA, 15 nt, Mycobacterium avium subsp. paratuberculosis
gccgcggcgcccggc

SEQ ID NO: 933792 - RNA, 19 nt, Mycobacterium avium subsp. paratuberculosis
gccgcggcgagccggccgu

SEQ ID NO: 933793 - RNA, 13 nt, Mycobacterium avium subsp. paratuberculosis
gccgcggcgaccg

SEQ ID NO: 933794 - RNA, 23 nt, Mycobacterium avium subsp. paratuberculosis
gccgcggcgaccggggcggugac

SEQ ID NO: 933795 - RNA, 18 nt, Mycobacterium avium subsp. paratuberculosis
gccgcggcgacacccagc

SEQ ID NO: 933796 - RNA, 13 nt, Mycobacterium avium subsp. paratuberculosis
gccgcggccuugc

SEQ ID NO: 933797 - RNA, 22 nt, Mycobacterium avium subsp. paratuberculosis
gccgcggccuugcgagccggag

SEQ ID NO: 933798 - RNA, 13 nt, Mycobacterium avium subsp. paratuberculosis
gccgcggccggug

SEQ ID NO: 933799 - RNA, 18 nt, Mycobacterium avium subsp. paratuberculosis
gccgcggccggugccacg

SEQ ID NO: 933800 - RNA, 13 nt, Mycobacterium avium subsp. paratuberculosis
gccgcggccgucg

SEQ ID NO: 933801 - RNA, 14 nt, Mycobacterium avium subsp. paratuberculosis
gccgcggccgucgu

SEQ ID NO: 933802 - RNA, 14 nt, Mycobacterium avium subsp. paratuberculosis
gccgcggccggcgg

SEQ ID NO: 933803 - RNA, 17 nt, Mycobacterium avium subsp. paratuberculosis
gccgcggccggcggcag

SEQ ID NO: 933804 - RNA, 16 nt, Mycobacterium avium subsp. paratuberculosis
gccgcggcccugcagc

SEQ ID NO: 933805 - RNA, 12 nt, Mycobacterium avium subsp. paratuberculosis
gccgcggccgcc

SEQ ID NO: 933806 - RNA, 14 nt, Mycobacterium avium subsp. paratuberculosis
gccgcggccgccgc

SEQ ID NO: 933807 - RNA, 15 nt, Mycobacterium avium subsp. paratuberculosis
gccgcggccgccgcg

SEQ ID NO: 933808 - RNA, 16 nt, Mycobacterium avium subsp. paratuberculosis
gccgcggccgccgcga

SEQ ID NO: 933809 - RNA, 17 nt, Mycobacterium avium subsp. paratuberculosis
gccgcggccgccgcgac

SEQ ID NO: 933810 - RNA, 19 nt, Mycobacterium avium subsp. paratuberculosis
gccgcggccgccgcgacgg

SEQ ID NO: 933811 - RNA, 14 nt, Mycobacterium avium subsp. paratuberculosis
gccgcggccgcgau

SEQ ID NO: 933812 - RNA, 15 nt, Mycobacterium avium subsp. paratuberculosis
gccgcggccgcgaug

SEQ ID NO: 933813 - RNA, 15 nt, Mycobacterium avium subsp. paratuberculosis
gccgcggccgcggcg

SEQ ID NO: 933814 - RNA, 13 nt, Mycobacterium avium subsp. paratuberculosis
gccgcggccgcgu

SEQ ID NO: 933815 - RNA, 18 nt, Mycobacterium avium subsp. paratuberculosis
gccgcggccgcguugucg

SEQ ID NO: 933816 - RNA, 20 nt, Mycobacterium avium subsp. paratuberculosis
gccgcggccgcuggcguuga

SEQ ID NO: 933817 - RNA, 15 nt, Mycobacterium avium subsp. paratuberculosis
gccgcggccagcgcc

SEQ ID NO: 933818 - RNA, 16 nt, Mycobacterium avium subsp. paratuberculosis
gccgcggcccggccac

SEQ ID NO: 933819 - RNA, 20 nt, Mycobacterium avium subsp. paratuberculosis
gccgcggcccaugggggaac

SEQ ID NO: 933820 - RNA, 14 nt, Mycobacterium avium subsp. paratuberculosis
gccgcggccagguc

SEQ ID NO: 933821 - RNA, 14 nt, Mycobacterium avium subsp. paratuberculosis
gccgcggccagcuc

SEQ ID NO: 933822 - RNA, 21 nt, Mycobacterium avium subsp. paratuberculosis
gccgcggccagcuccgggucg

SEQ ID NO: 933823 - RNA, 22 nt, Mycobacterium avium subsp. paratuberculosis
gccgcggccagcuccgggucga

SEQ ID NO: 933824 - RNA, 16 nt, Mycobacterium avium subsp. paratuberculosis
gccgcggccagcugcc

SEQ ID NO: 933825 - RNA, 13 nt, Mycobacterium avium subsp. paratuberculosis
gccgcggccagcg

SEQ ID NO: 933826 - RNA, 19 nt, Mycobacterium avium subsp. paratuberculosis
gccgcggccagcgaggugg

SEQ ID NO: 933827 - RNA, 12 nt, Mycobacterium avium subsp. paratuberculosis
gccgcggccacg

SEQ ID NO: 933828 - RNA, 13 nt, Mycobacterium avium subsp. paratuberculosis
gccgcggccacgc

SEQ ID NO: 933829 - RNA, 21 nt, Mycobacterium avium subsp. paratuberculosis
gccgcggccacgcucgggccg

SEQ ID NO: 933830 - RNA, 22 nt, Mycobacterium avium subsp. paratuberculosis
gccgcggcaccuucaccgacca

SEQ ID NO: 933831 - RNA, 21 nt, Mycobacterium avium subsp. paratuberculosis
gccgcggccacacuggcguga

SEQ ID NO: 933832 - RNA, 13 nt, Mycobacterium avium subsp. paratuberculosis
gccgcggccaccg

SEQ ID NO: 933833 - RNA, 17 nt, Mycobacterium avium subsp. paratuberculosis
gccgcgcguagaucauc

SEQ ID NO: 933834 - RNA, 14 nt, Mycobacterium avium subsp. paratuberculosis
gccgcgcgugcagc

SEQ ID NO: 933835 - RNA, 19 nt, Mycobacterium avium subsp. paratuberculosis
gccgcgcgugcagccgggc

SEQ ID NO: 933836 - RNA, 20 nt, Mycobacterium avium subsp. paratuberculosis
gccgcgcgugcagccgggcg

SEQ ID NO: 933837 - RNA, 17 nt, Mycobacterium avium subsp. paratuberculosis
gccgcgcgugcccgcgg

SEQ ID NO: 933838 - RNA, 13 nt, Mycobacterium avium subsp. paratuberculosis
gccgcgcgugcgc

SEQ ID NO: 933839 - RNA, 18 nt, Mycobacterium avium subsp. paratuberculosis
gccgcgcguuccagcacg

SEQ ID NO: 933840 - RNA, 20 nt, Mycobacterium avium subsp. paratuberculosis
gccgcgcguuccagcacgcc

SEQ ID NO: 933841 - RNA, 19 nt, Mycobacterium avium subsp. paratuberculosis
gccgcgcgggcggcgucgu

SEQ ID NO: 933842 - RNA, 13 nt, Mycobacterium avium subsp. paratuberculosis
gccgcgcgggcga

SEQ ID NO: 933843 - RNA, 14 nt, Mycobacterium avium subsp. paratuberculosis
gccgcgcgggcgac

SEQ ID NO: 933844 - RNA, 18 nt, Mycobacterium avium subsp. paratuberculosis
gccgcgcggcggugaccg

SEQ ID NO: 933845 - RNA, 19 nt, Mycobacterium avium subsp. paratuberculosis
gccgcgcggguacggcggc

SEQ ID NO: 933846 - RNA, 21 nt, Mycobacterium avium subsp. paratuberculosis
gccgcgcggguacggcggccg

SEQ ID NO: 933847 - RNA, 22 nt, Mycobacterium avium subsp. paratuberculosis
gccgcgcggguacggcggccgc

SEQ ID NO: 933848 - RNA, 16 nt, Mycobacterium avium subsp. paratuberculosis
gccgcgcggcgucggc

SEQ ID NO: 933849 - RNA, 21 nt, Mycobacterium avium subsp. paratuberculosis
gccgcgcggcgucggccgggc

SEQ ID NO: 933850 - RNA, 22 nt, Mycobacterium avium subsp. paratuberculosis
gccgcgcggcgucggccgggcu

SEQ ID NO: 933851 - RNA, 23 nt, Mycobacterium avium subsp. paratuberculosis
gccgcgcggcgucggccgggcug

SEQ ID NO: 933852 - RNA, 16 nt, Mycobacterium avium subsp. paratuberculosis
gccgcgcggcgccagc

SEQ ID NO: 933853 - RNA, 17 nt, Mycobacterium avium subsp. paratuberculosis
gccgcgcggcgccagcg

SEQ ID NO: 933854 - RNA, 14 nt, Mycobacterium avium subsp. paratuberculosis
gccgcgcggccggc

SEQ ID NO: 933855 - RNA, 15 nt, Mycobacterium avium subsp. paratuberculosis
gccgcgcggccgggc

SEQ ID NO: 933856 - RNA, 14 nt, Mycobacterium avium subsp. paratuberculosis
gccgcgcggcaggu

SEQ ID NO: 933857 - RNA, 18 nt, Mycobacterium avium subsp. paratuberculosis
gccgcgcggccgccuccg

SEQ ID NO: 933858 - RNA, 21 nt, Mycobacterium avium subsp. paratuberculosis
gccgcgcgcgucgacguucgc

SEQ ID NO: 933859 - RNA, 14 nt, Mycobacterium avium subsp. paratuberculosis
gccgcgcggacgcg

SEQ ID NO: 933860 - RNA, 15 nt, Mycobacterium avium subsp. paratuberculosis
gccgcgcggacgcgg

SEQ ID NO: 933861 - RNA, 14 nt, Mycobacterium avium subsp. paratuberculosis
gccgcgcgcgucga

SEQ ID NO: 933862 - RNA, 13 nt, Mycobacterium avium subsp. paratuberculosis
gccgcgcgcggcg

SEQ ID NO: 933863 - RNA, 12 nt, Mycobacterium avium subsp. paratuberculosis
gccgcgcgcagc

SEQ ID NO: 933864 - RNA, 21 nt, Mycobacterium avium subsp. paratuberculosis
gccgcgcgcccuagucgacgc

SEQ ID NO: 933865 - RNA, 20 nt, Mycobacterium avium subsp. paratuberculosis
gccgcgcgcggcgcggagcc

SEQ ID NO: 933866 - RNA, 15 nt, Mycobacterium avium subsp. paratuberculosis
gccgcgcgcggccac

SEQ ID NO: 933867 - RNA, 19 nt, Mycobacterium avium subsp. paratuberculosis
gccgcgcgcggccaccgcg

SEQ ID NO: 933868 - RNA, 19 nt, Mycobacterium avium subsp. paratuberculosis
gccgcgcgcgcggccucca

SEQ ID NO: 933869 - RNA, 22 nt, Mycobacterium avium subsp. paratuberculosis
gccgcgcgcgcggccuccagcc

SEQ ID NO: 933870 - RNA, 23 nt, Mycobacterium avium subsp. paratuberculosis
gccgcgcgcgcggccuccagccg

SEQ ID NO: 933871 - RNA, 13 nt, Mycobacterium avium subsp. paratuberculosis
gccgcgcgccgac

SEQ ID NO: 933872 - RNA, 16 nt, Mycobacterium avium subsp. paratuberculosis
gccgcgcgccgacaga

SEQ ID NO: 933873 - RNA, 20 nt, Mycobacterium avium subsp. paratuberculosis
gccgcgcgccgacagacccg

SEQ ID NO: 933874 - RNA, 18 nt, Mycobacterium avium subsp. paratuberculosis
gccgcgcgcccgcggcca

SEQ ID NO: 933875 - RNA, 21 nt, Mycobacterium avium subsp. paratuberculosis
gccgcgcgcccgcggccaucg

SEQ ID NO: 933876 - RNA, 15 nt, Mycobacterium avium subsp. paratuberculosis
gccgcgcgccagcgc

SEQ ID NO: 933877 - RNA, 16 nt, Mycobacterium avium subsp. paratuberculosis
gccgcgcgccagcgcg

SEQ ID NO: 933878 - RNA, 21 nt, Mycobacterium avium subsp. paratuberculosis
gccgcgcgccagcgcgugcgg

SEQ ID NO: 933879 - RNA, 22 nt, Mycobacterium avium subsp. paratuberculosis
gccgcgcgccagcgcgugcggg

SEQ ID NO: 933880 - RNA, 15 nt, Mycobacterium avium subsp. paratuberculosis
gccgcgcgcaucucg

SEQ ID NO: 933881 - RNA, 14 nt, Mycobacterium avium subsp. paratuberculosis
gccgcgcgacgccg

SEQ ID NO: 933882 - RNA, 18 nt, Mycobacterium avium subsp. paratuberculosis
gccgcgcgacgccguaga

SEQ ID NO: 933883 - RNA, 14 nt, Mycobacterium avium subsp. paratuberculosis
gccgcgcgagcauc

SEQ ID NO: 933884 - RNA, 21 nt, Mycobacterium avium subsp. paratuberculosis
gccgcgccguugaccgcggcg

SEQ ID NO: 933885 - RNA, 16 nt, Mycobacterium avium subsp. paratuberculosis
gccgcgccgggguguc

SEQ ID NO: 933886 - RNA, 12 nt, Mycobacterium avium subsp. paratuberculosis
gccgcgccgcca

SEQ ID NO: 933887 - RNA, 17 nt, Mycobacterium avium subsp. paratuberculosis
gccgcgccgugcgccag

SEQ ID NO: 933888 - RNA, 19 nt, Mycobacterium avium subsp. paratuberculosis
gccgcgccgggcggauguc

SEQ ID NO: 933889 - RNA, 20 nt, Mycobacterium avium subsp. paratuberculosis
gccgcgccguagcggcccag

SEQ ID NO: 933890 - RNA, 22 nt, Mycobacterium avium subsp. paratuberculosis
gccgcgccguagcggcccaggu

SEQ ID NO: 933891 - RNA, 11 nt, Mycobacterium avium subsp. paratuberculosis
gccgcgccggg

SEQ ID NO: 933892 - RNA, 13 nt, Mycobacterium avium subsp. paratuberculosis
gccgcgccgggcg

SEQ ID NO: 933893 - RNA, 14 nt, Mycobacterium avium subsp. paratuberculosis
gccgcgccgggcgc

SEQ ID NO: 933894 - RNA, 14 nt, Mycobacterium avium subsp. paratuberculosis
gccgcgccgccgcc

SEQ ID NO: 933895 - RNA, 19 nt, Mycobacterium avium subsp. paratuberculosis
gccgcgccgccgcccuggc

SEQ ID NO: 933896 - RNA, 13 nt, Mycobacterium avium subsp. paratuberculosis
gccgcgccggcac

SEQ ID NO: 933897 - RNA, 13 nt, Mycobacterium avium subsp. paratuberculosis
gccgcgccgccgg

SEQ ID NO: 933898 - RNA, 15 nt, Mycobacterium avium subsp. paratuberculosis
gccgcgccgccggug

SEQ ID NO: 933899 - RNA, 16 nt, Mycobacterium avium subsp. paratuberculosis
gccgcgccgccgguga

SEQ ID NO: 933900 - RNA, 22 nt, Mycobacterium avium subsp. paratuberculosis
gccgcgccgccggugaccacgc

SEQ ID NO: 933901 - RNA, 14 nt, Mycobacterium avium subsp. paratuberculosis
gccgcgccgcgccg

SEQ ID NO: 933902 - RNA, 17 nt, Mycobacterium avium subsp. paratuberculosis
gccgcgccgcgccgccu

SEQ ID NO: 933903 - RNA, 12 nt, Mycobacterium avium subsp. paratuberculosis
gccgcgccgccg

SEQ ID NO: 933904 - RNA, 13 nt, Mycobacterium avium subsp. paratuberculosis
gccgcgccgccga

SEQ ID NO: 933905 - RNA, 15 nt, Mycobacterium avium subsp. paratuberculosis
gccgcgccgccgacc

SEQ ID NO: 933906 - RNA, 17 nt, Mycobacterium avium subsp. paratuberculosis
gccgcgccgcccggcga

SEQ ID NO: 933907 - RNA, 19 nt, Mycobacterium avium subsp. paratuberculosis
gccgcgccgcccggcgauc

SEQ ID NO: 933908 - RNA, 13 nt, Mycobacterium avium subsp. paratuberculosis
gccgcgccgacag

SEQ ID NO: 933909 - RNA, 13 nt, Mycobacterium avium subsp. paratuberculosis
gccgcgccgaccu

SEQ ID NO: 933910 - RNA, 13 nt, Mycobacterium avium subsp. paratuberculosis
gccgcgccgagga

SEQ ID NO: 933911 - RNA, 23 nt, Mycobacterium avium subsp. paratuberculosis
gccgcgccgaggaacugcagcga

SEQ ID NO: 933912 - RNA, 20 nt, Mycobacterium avium subsp. paratuberculosis
gccgcgccgaggcgcucggc

SEQ ID NO: 933913 - RNA, 16 nt, Mycobacterium avium subsp. paratuberculosis
gccgcgccgaccucgu

SEQ ID NO: 933914 - RNA, 17 nt, Mycobacterium avium subsp. paratuberculosis
gccgcgccgaccucguc

SEQ ID NO: 933915 - RNA, 19 nt, Mycobacterium avium subsp. paratuberculosis
gccgcgccgaccucgucgg

SEQ ID NO: 933916 - RNA, 12 nt, Mycobacterium avium subsp. paratuberculosis
gccgcgccgacg

SEQ ID NO: 933917 - RNA, 23 nt, Mycobacterium avium subsp. paratuberculosis
gccgcgcccuucuucgcgggugc

SEQ ID NO: 933918 - RNA, 13 nt, Mycobacterium avium subsp. paratuberculosis
gccgcgccgaaca

SEQ ID NO: 933919 - RNA, 23 nt, Mycobacterium avium subsp. paratuberculosis
gccgcgccgaacaccacgccgag

SEQ ID NO: 933920 - RNA, 15 nt, Mycobacterium avium subsp. paratuberculosis
gccgcgcccgucgag

SEQ ID NO: 933921 - RNA, 13 nt, Mycobacterium avium subsp. paratuberculosis
gccgcgcccggcu

SEQ ID NO: 933922 - RNA, 23 nt, Mycobacterium avium subsp. paratuberculosis
gccgcgcccggcuucgccgcgcu

SEQ ID NO: 933923 - RNA, 23 nt, Mycobacterium avium subsp. paratuberculosis
gcccacauacaccgggaucggcg

SEQ ID NO: 933924 - RNA, 19 nt, Mycobacterium avium subsp. paratuberculosis
gcccaccaccgccucgacg

SEQ ID NO: 933925 - RNA, 21 nt, Mycobacterium avium subsp. paratuberculosis
gcccaccaccgccucgacggu

SEQ ID NO: 933926 - RNA, 22 nt, Mycobacterium avium subsp. paratuberculosis
gcccaccaccgccucgacggug

SEQ ID NO: 933927 - RNA, 15 nt, Mycobacterium avium subsp. paratuberculosis
gcccacagguccagc

SEQ ID NO: 933928 - RNA, 14 nt, Mycobacterium avium subsp. paratuberculosis
gcccacaguccgcc

SEQ ID NO: 933929 - RNA, 18 nt, Mycobacterium avium subsp. paratuberculosis
gcccacaguccgcccagc

SEQ ID NO: 933930 - RNA, 20 nt, Mycobacterium avium subsp. paratuberculosis
gcccacaguccgcccagcga

SEQ ID NO: 933931 - RNA, 13 nt, Mycobacterium avium subsp. paratuberculosis
gcccacagcagcc

SEQ ID NO: 933932 - RNA, 15 nt, Mycobacterium avium subsp. paratuberculosis
gcccacagcagccgc

SEQ ID NO: 933933 - RNA, 20 nt, Mycobacterium avium subsp. paratuberculosis
gcccacagcagccgcaccuc

SEQ ID NO: 933934 - RNA, 21 nt, Mycobacterium avium subsp. paratuberculosis
gcccacagcagccgcaccucg

SEQ ID NO: 933935 - RNA, 13 nt, Mycobacterium avium subsp. paratuberculosis
gcccacagcgcca

SEQ ID NO: 933936 - RNA, 22 nt, Mycobacterium avium subsp. paratuberculosis
gcccacagcugacgggccggcg

SEQ ID NO: 933937 - RNA, 18 nt, Mycobacterium avium subsp. paratuberculosis
gcccaccaucccgccgcc

SEQ ID NO: 933938 - RNA, 19 nt, Mycobacterium avium subsp. paratuberculosis
gcccaccaucccgccgccg

SEQ ID NO: 933939 - RNA, 20 nt, Mycobacterium avium subsp. paratuberculosis
gcccaccaucccgccgccga

SEQ ID NO: 933940 - RNA, 14 nt, Mycobacterium avium subsp. paratuberculosis
gcccaccagccggc

SEQ ID NO: 933941 - RNA, 17 nt, Mycobacterium avium subsp. paratuberculosis
gcccaccagccggccgg

SEQ ID NO: 933942 - RNA, 20 nt, Mycobacterium avium subsp. paratuberculosis
gcccaccagccggccggcga

SEQ ID NO: 933943 - RNA, 17 nt, Mycobacterium avium subsp. paratuberculosis
gcccaccagcacaccgg

SEQ ID NO: 933944 - RNA, 16 nt, Mycobacterium avium subsp. paratuberculosis
gcccaccagcaggucg

SEQ ID NO: 933945 - RNA, 17 nt, Mycobacterium avium subsp. paratuberculosis
gcccaccagcaggucga

SEQ ID NO: 933946 - RNA, 17 nt, Mycobacterium avium subsp. paratuberculosis
gcccaccacgaacgcgc

SEQ ID NO: 933947 - RNA, 22 nt, Mycobacterium avium subsp. paratuberculosis
gcccaccacgaacgcgccgccg

SEQ ID NO: 933948 - RNA, 22 nt, Mycobacterium avium subsp. paratuberculosis
gcccaccacgacgacguggugg

SEQ ID NO: 933949 - RNA, 15 nt, Mycobacterium avium subsp. paratuberculosis
gcccaccggcccggc

SEQ ID NO: 933950 - RNA, 18 nt, Mycobacterium avium subsp. paratuberculosis
gcccaccggcccggcggg

SEQ ID NO: 933951 - RNA, 23 nt, Mycobacterium avium subsp. paratuberculosis
gcccaccggcccggcgggcauca

SEQ ID NO: 933952 - RNA, 14 nt, Mycobacterium avium subsp. paratuberculosis
gcccaccgggcagc

SEQ ID NO: 933953 - RNA, 18 nt, Mycobacterium avium subsp. paratuberculosis
gcccaccgggcagccgca

SEQ ID NO: 933954 - RNA, 12 nt, Mycobacterium avium subsp. paratuberculosis
gcccaccgcgac

SEQ ID NO: 933955 - RNA, 14 nt, Mycobacterium avium subsp. paratuberculosis
gcccaccgcgaccc

SEQ ID NO: 933956 - RNA, 17 nt, Mycobacterium avium subsp. paratuberculosis
gcccaccgcgacccggc

SEQ ID NO: 933957 - RNA, 18 nt, Mycobacterium avium subsp. paratuberculosis
gcccaccgcgacccggcc

SEQ ID NO: 933958 - RNA, 22 nt, Mycobacterium avium subsp. paratuberculosis
gcccaccgcgacccggccgagc

SEQ ID NO: 933959 - RNA, 15 nt, Mycobacterium avium subsp. paratuberculosis
gcccaccgcgcccag

SEQ ID NO: 933960 - RNA, 14 nt, Mycobacterium avium subsp. paratuberculosis
gcccaccgcgcgcu

SEQ ID NO: 933961 - RNA, 17 nt, Mycobacterium avium subsp. paratuberculosis
gcccaccgcgcgcugca

SEQ ID NO: 933962 - RNA, 16 nt, Mycobacterium avium subsp. paratuberculosis
gcccaccgcggcgcgc

SEQ ID NO: 933963 - RNA, 21 nt, Mycobacterium avium subsp. paratuberculosis
gcccaccgcggcgcgcggccg

SEQ ID NO: 933964 - RNA, 23 nt, Mycobacterium avium subsp. paratuberculosis
gcccaccgcggcgcgcggccgcg

SEQ ID NO: 933965 - RNA, 22 nt, Mycobacterium avium subsp. paratuberculosis
gcccaccgcggugaccgcccgc

SEQ ID NO: 933966 - RNA, 15 nt, Mycobacterium avium subsp. paratuberculosis
gcccaccgcgucgca

SEQ ID NO: 933967 - RNA, 23 nt, Mycobacterium avium subsp. paratuberculosis
gcccaccgcgucgcagugccggu

SEQ ID NO: 933968 - RNA, 13 nt, Mycobacterium avium subsp. paratuberculosis
gcccaccgcucgu

SEQ ID NO: 933969 - RNA, 16 nt, Mycobacterium avium subsp. paratuberculosis
gcccaccgcucgucgg

SEQ ID NO: 933970 - RNA, 22 nt, Mycobacterium avium subsp. paratuberculosis
gcccaccgaaucacccacggcc

SEQ ID NO: 933971 - RNA, 20 nt, Mycobacterium avium subsp. paratuberculosis
gcccaccgacgcggcggccg

SEQ ID NO: 933972 - RNA, 17 nt, Mycobacterium avium subsp. paratuberculosis
gcccaccgcuggaaccg

SEQ ID NO: 933973 - RNA, 13 nt, Mycobacterium avium subsp. paratuberculosis
gcccaccgccguu

SEQ ID NO: 933974 - RNA, 19 nt, Mycobacterium avium subsp. paratuberculosis
gcccacccggggccguccg

SEQ ID NO: 933975 - RNA, 24 nt, Mycobacterium avium subsp. paratuberculosis
gcccacccguuggcaggcccggua

SEQ ID NO: 933976 - RNA, 12 nt, Mycobacterium avium subsp. paratuberculosis
gcccaccccgga

SEQ ID NO: 933977 - RNA, 14 nt, Mycobacterium avium subsp. paratuberculosis
gcccaccccggaca

SEQ ID NO: 933978 - RNA, 12 nt, Mycobacterium avium subsp. paratuberculosis
gcccaccccggc

SEQ ID NO: 933979 - RNA, 15 nt, Mycobacterium avium subsp. paratuberculosis
gcccaccccggcguc

SEQ ID NO: 933980 - RNA, 16 nt, Mycobacterium avium subsp. paratuberculosis
gcccaccccggcgucc

SEQ ID NO: 933981 - RNA, 15 nt, Mycobacterium avium subsp. paratuberculosis
gcccacccgaugacc

SEQ ID NO: 933982 - RNA, 18 nt, Mycobacterium avium subsp. paratuberculosis
gcccacccgaugaccggc

SEQ ID NO: 933983 - RNA, 12 nt, Mycobacterium avium subsp. paratuberculosis
gcccacccgcac

SEQ ID NO: 933984 - RNA, 20 nt, Mycobacterium avium subsp. paratuberculosis
gcccacccgcacgcccgggc

SEQ ID NO: 933985 - RNA, 18 nt, Mycobacterium avium subsp. paratuberculosis
gcccacccgcagggcgcc

SEQ ID NO: 933986 - RNA, 21 nt, Mycobacterium avium subsp. paratuberculosis
gcccacccgcagggcgccggu

SEQ ID NO: 933987 - RNA, 22 nt, Mycobacterium avium subsp. paratuberculosis
gcccacccgcagggcgccggug

SEQ ID NO: 933988 - RNA, 15 nt, Mycobacterium avium subsp. paratuberculosis
gcccacccgccagcc

SEQ ID NO: 933989 - RNA, 16 nt, Mycobacterium avium subsp. paratuberculosis
gcccacccgcgccggc

SEQ ID NO: 933990 - RNA, 17 nt, Mycobacterium avium subsp. paratuberculosis
gcccacccgcgccggca

SEQ ID NO: 933991 - RNA, 15 nt, Mycobacterium avium subsp. paratuberculosis
gcccacccgcucggc

SEQ ID NO: 933992 - RNA, 18 nt, Mycobacterium avium subsp. paratuberculosis
gcccacccgcucggcgau

SEQ ID NO: 933993 - RNA, 17 nt, Mycobacterium avium subsp. paratuberculosis
gcccaacuacccgccga

SEQ ID NO: 933994 - RNA, 19 nt, Mycobacterium avium subsp. paratuberculosis
gcccaacuacccgccgacg

SEQ ID NO: 933995 - RNA, 20 nt, Mycobacterium avium subsp. paratuberculosis
gcccaacuacccgccgacgc

SEQ ID NO: 933996 - RNA, 17 nt, Mycobacterium avium subsp. paratuberculosis
gcccaaccgcauucggc

SEQ ID NO: 933997 - RNA, 19 nt, Mycobacterium avium subsp. paratuberculosis
gcccaaccgcauucggccg

SEQ ID NO: 933998 - RNA, 20 nt, Mycobacterium avium subsp. paratuberculosis
gcccaaccgcauucggccgc

SEQ ID NO: 933999 - RNA, 22 nt, Mycobacterium avium subsp. paratuberculosis
gcccaaccgcauucggccgcca

SEQ ID NO: 934000 - RNA, 14 nt, Mycobacterium avium subsp. paratuberculosis
gcccaacgacgucg

SEQ ID NO: 934001 - RNA, 17 nt, Mycobacterium avium subsp. paratuberculosis
gcccaacgacgucggcg

SEQ ID NO: 934002 - RNA, 19 nt, Mycobacterium avium subsp. paratuberculosis
gcccaacgacgucggcguc

SEQ ID NO: 934003 - RNA, 23 nt, Mycobacterium avium subsp. paratuberculosis
gcccaaugcuuuuugcggaccca

SEQ ID NO: 934004 - RNA, 16 nt, Mycobacterium avium subsp. paratuberculosis
gcccaauucgacugcg

SEQ ID NO: 934005 - RNA, 17 nt, Mycobacterium avium subsp. paratuberculosis
gcccaauucgacugcga

SEQ ID NO: 934006 - RNA, 21 nt, Mycobacterium avium subsp. paratuberculosis
gcccaauucgacugcgaugcu

SEQ ID NO: 934007 - RNA, 18 nt, Mycobacterium avium subsp. paratuberculosis
gcccacaccgacaccggc

SEQ ID NO: 934008 - RNA, 19 nt, Mycobacterium avium subsp. paratuberculosis
gcccacaccgacaccggcc

SEQ ID NO: 934009 - RNA, 21 nt, Mycobacterium avium subsp. paratuberculosis
gcccacaccgacaccggccgg

SEQ ID NO: 934010 - RNA, 14 nt, Mycobacterium avium subsp. paratuberculosis
gcccaacuggcgac

SEQ ID NO: 934011 - RNA, 18 nt, Mycobacterium avium subsp. paratuberculosis
gcccaacuggcgaccggu

SEQ ID NO: 934012 - RNA, 13 nt, Mycobacterium avium subsp. paratuberculosis
gcccaagacccgc

SEQ ID NO: 934013 - RNA, 15 nt, Mycobacterium avium subsp. paratuberculosis
gcccaagccggccag

SEQ ID NO: 934014 - RNA, 15 nt, Mycobacterium avium subsp. paratuberculosis
gcccaagugcccgcg

SEQ ID NO: 934015 - RNA, 17 nt, Mycobacterium avium subsp. paratuberculosis
gcccaagugcccgcggg

SEQ ID NO: 934016 - RNA, 16 nt, Mycobacterium avium subsp. paratuberculosis
gcccaauagcacccgc

SEQ ID NO: 934017 - RNA, 22 nt, Mycobacterium avium subsp. paratuberculosis
gccauugucaucauggugaagg

SEQ ID NO: 934018 - RNA, 21 nt, Mycobacterium avium subsp. paratuberculosis
gccauuuccguugugccaccg

SEQ ID NO: 934019 - RNA, 23 nt, Mycobacterium avium subsp. paratuberculosis
gccauuuccguugugccaccgcc

SEQ ID NO: 934020 - RNA, 19 nt, Mycobacterium avium subsp. paratuberculosis
gccauuucagcagcgcggc

SEQ ID NO: 934021 - RNA, 15 nt, Mycobacterium avium subsp. paratuberculosis
gccaugugccggcgc

SEQ ID NO: 934022 - RNA, 21 nt, Mycobacterium avium subsp. paratuberculosis
gccaugugccggcgcucgucg

SEQ ID NO: 934023 - RNA, 15 nt, Mycobacterium avium subsp. paratuberculosis
gccaugucgaugucg

SEQ ID NO: 934024 - RNA, 18 nt, Mycobacterium avium subsp. paratuberculosis
gccaugucgaugucgacg

SEQ ID NO: 934025 - RNA, 20 nt, Mycobacterium avium subsp. paratuberculosis
gccaugucgaugucgacgcc

SEQ ID NO: 934026 - RNA, 14 nt, Mycobacterium avium subsp. paratuberculosis
gccaugucggagcu

SEQ ID NO: 934027 - RNA, 18 nt, Mycobacterium avium subsp. paratuberculosis
gccaugucggagcugcgc

SEQ ID NO: 934028 - RNA, 20 nt, Mycobacterium avium subsp. paratuberculosis
gccaugucggagcugcgcgc

SEQ ID NO: 934029 - RNA, 21 nt, Mycobacterium avium subsp. paratuberculosis
gccaugucggagcugcgcgcc

SEQ ID NO: 934030 - RNA, 22 nt, Mycobacterium avium subsp. paratuberculosis
gccauucaucgcgcaccagggc

SEQ ID NO: 934031 - RNA, 15 nt, Mycobacterium avium subsp. paratuberculosis
gccagucgccggcca

SEQ ID NO: 934032 - RNA, 19 nt, Mycobacterium avium subsp. paratuberculosis
gccagucgccggccaggcc

SEQ ID NO: 934033 - RNA, 22 nt, Mycobacterium avium subsp. paratuberculosis
gccagucgccggccaggccggc

SEQ ID NO: 934034 - RNA, 20 nt, Mycobacterium avium subsp. paratuberculosis
gccagucugagcccgggcag

SEQ ID NO: 934035 - RNA, 16 nt, Mycobacterium avium subsp. paratuberculosis
gccaugcagaccagcc

SEQ ID NO: 934036 - RNA, 20 nt, Mycobacterium avium subsp. paratuberculosis
gccaugcagaccagcccguc

SEQ ID NO: 934037 - RNA, 13 nt, Mycobacterium avium subsp. paratuberculosis
gccaugcgccgcg

SEQ ID NO: 934038 - RNA, 22 nt, Mycobacterium avium subsp. paratuberculosis
gccaugcgcgagucgagcaccg

SEQ ID NO: 934039 - RNA, 16 nt, Mycobacterium avium subsp. paratuberculosis
gccauggccaggaacg

SEQ ID NO: 934040 - RNA, 20 nt, Mycobacterium avium subsp. paratuberculosis
gccauggcccacgacgucug

SEQ ID NO: 934041 - RNA, 22 nt, Mycobacterium avium subsp. paratuberculosis
gccauguccuuggugaugucgg

SEQ ID NO: 934042 - RNA, 19 nt, Mycobacterium avium subsp. paratuberculosis
gccaugucgaaggugaagg

SEQ ID NO: 934043 - RNA, 21 nt, Mycobacterium avium subsp. paratuberculosis
gccauguccccgccgguggcg

SEQ ID NO: 934044 - RNA, 13 nt, Mycobacterium avium subsp. paratuberculosis
gcccacuucgacg

SEQ ID NO: 934045 - RNA, 16 nt, Mycobacterium avium subsp. paratuberculosis
gcccacuucgacggug

SEQ ID NO: 934046 - RNA, 16 nt, Mycobacterium avium subsp. paratuberculosis
gcccagaacgacgcgc

SEQ ID NO: 934047 - RNA, 18 nt, Mycobacterium avium subsp. paratuberculosis
gcccagaacgacgcgcuc

SEQ ID NO: 934048 - RNA, 22 nt, Mycobacterium avium subsp. paratuberculosis
gcccagaacgacgcgcucagcc

SEQ ID NO: 934049 - RNA, 16 nt, Mycobacterium avium subsp. paratuberculosis
gcccagaacugggccg

SEQ ID NO: 934050 - RNA, 18 nt, Mycobacterium avium subsp. paratuberculosis
gcccagaacugggccgcc

SEQ ID NO: 934051 - RNA, 19 nt, Mycobacterium avium subsp. paratuberculosis
gcccagaacugggccgccg

SEQ ID NO: 934052 - RNA, 22 nt, Mycobacterium avium subsp. paratuberculosis
gcccagaacugggccgccgucg

SEQ ID NO: 934053 - RNA, 16 nt, Mycobacterium avium subsp. paratuberculosis
gcccacgggucgccga

SEQ ID NO: 934054 - RNA, 17 nt, Mycobacterium avium subsp. paratuberculosis
gcccacgggucgccgau

SEQ ID NO: 934055 - RNA, 15 nt, Mycobacterium avium subsp. paratuberculosis
gcccacggugaggac

SEQ ID NO: 934056 - RNA, 23 nt, Mycobacterium avium subsp. paratuberculosis
gcccacguaggggcccggguuga

SEQ ID NO: 934057 - RNA, 16 nt, Mycobacterium avium subsp. paratuberculosis
gcccacgucgcgccga

SEQ ID NO: 934058 - RNA, 13 nt, Mycobacterium avium subsp. paratuberculosis
gcccacguucagc

SEQ ID NO: 934059 - RNA, 17 nt, Mycobacterium avium subsp. paratuberculosis
gcccacguugagcacgc

SEQ ID NO: 934060 - RNA, 18 nt, Mycobacterium avium subsp. paratuberculosis
gcccacguugagcacgcc

SEQ ID NO: 934061 - RNA, 21 nt, Mycobacterium avium subsp. paratuberculosis
gcccacguugagcacgcccgc

SEQ ID NO: 934062 - RNA, 14 nt, Mycobacterium avium subsp. paratuberculosis
gcccacgcucgacg

SEQ ID NO: 934063 - RNA, 17 nt, Mycobacterium avium subsp. paratuberculosis
gcccacgcucgacgcgu

SEQ ID NO: 934064 - RNA, 18 nt, Mycobacterium avium subsp. paratuberculosis
gcccacgcucgacgcguc

SEQ ID NO: 934065 - RNA, 16 nt, Mycobacterium avium subsp. paratuberculosis
gcccacgccgcccagg

SEQ ID NO: 934066 - RNA, 13 nt, Mycobacterium avium subsp. paratuberculosis
gcccacgccggug

SEQ ID NO: 934067 - RNA, 14 nt, Mycobacterium avium subsp. paratuberculosis
gcccacgccgucga

SEQ ID NO: 934068 - RNA, 15 nt, Mycobacterium avium subsp. paratuberculosis
gcccacgccgucguc

SEQ ID NO: 934069 - RNA, 16 nt, Mycobacterium avium subsp. paratuberculosis
gcccacgccgucgucg

SEQ ID NO: 934070 - RNA, 22 nt, Mycobacterium avium subsp. paratuberculosis
gcccacgccgagggugccggcc

SEQ ID NO: 934071 - RNA, 16 nt, Mycobacterium avium subsp. paratuberculosis
gcccacgcagccgucg

SEQ ID NO: 934072 - RNA, 17 nt, Mycobacterium avium subsp. paratuberculosis
gcccacgcagccgucga

SEQ ID NO: 934073 - RNA, 14 nt, Mycobacterium avium subsp. paratuberculosis
gcccaccgucgcca

SEQ ID NO: 934074 - RNA, 16 nt, Mycobacterium avium subsp. paratuberculosis
gcccaccgucgccacg

SEQ ID NO: 934075 - RNA, 16 nt, Mycobacterium avium subsp. paratuberculosis
gcccacgacgucuggg

SEQ ID NO: 934076 - RNA, 23 nt, Mycobacterium avium subsp. paratuberculosis
gcccacgacgucugggccgccga

SEQ ID NO: 934077 - RNA, 16 nt, Mycobacterium avium subsp. paratuberculosis
gcccaccuuggcgucg

SEQ ID NO: 934078 - RNA, 22 nt, Mycobacterium avium subsp. paratuberculosis
gcccacgaaccgguugcgggcc

SEQ ID NO: 934079 - RNA, 19 nt, Mycobacterium avium subsp. paratuberculosis
gcccacgaagaugaucagc

SEQ ID NO: 934080 - RNA, 20 nt, Mycobacterium avium subsp. paratuberculosis
gcccaccugguucucccguc

SEQ ID NO: 934081 - RNA, 21 nt, Mycobacterium avium subsp. paratuberculosis
gcccaccugguucucccgucg

SEQ ID NO: 934082 - RNA, 21 nt, Mycobacterium avium subsp. paratuberculosis
gcccaccgguggccgggagug

SEQ ID NO: 934083 - RNA, 14 nt, Mycobacterium avium subsp. paratuberculosis
gcccagccagccgg

SEQ ID NO: 934084 - RNA, 13 nt, Mycobacterium avium subsp. paratuberculosis
gcccagccagcga

SEQ ID NO: 934085 - RNA, 15 nt, Mycobacterium avium subsp. paratuberculosis
gcccagccaggccgc

SEQ ID NO: 934086 - RNA, 16 nt, Mycobacterium avium subsp. paratuberculosis
gcccagccaggccgcc

SEQ ID NO: 934087 - RNA, 17 nt, Mycobacterium avium subsp. paratuberculosis
gcccagccaggccgccg

SEQ ID NO: 934088 - RNA, 20 nt, Mycobacterium avium subsp. paratuberculosis
gcccagccaggccgccgggc

SEQ ID NO: 934089 - RNA, 21 nt, Mycobacterium avium subsp. paratuberculosis
gcccagccaggccgccgggcc

SEQ ID NO: 934090 - RNA, 23 nt, Mycobacterium avium subsp. paratuberculosis
gcccagcaguuuguccugcucgg

SEQ ID NO: 934091 - RNA, 22 nt, Mycobacterium avium subsp. paratuberculosis
gcccagcauaggugcgccggau

SEQ ID NO: 934092 - RNA, 20 nt, Mycobacterium avium subsp. paratuberculosis
gcccagcagggcggcgaucg

SEQ ID NO: 934093 - RNA, 15 nt, Mycobacterium avium subsp. paratuberculosis
gcccagcaguccggc

SEQ ID NO: 934094 - RNA, 17 nt, Mycobacterium avium subsp. paratuberculosis
gcccagcaguccggcgg

SEQ ID NO: 934095 - RNA, 19 nt, Mycobacterium avium subsp. paratuberculosis
gcccagcagcgcaccggcg

SEQ ID NO: 934096 - RNA, 20 nt, Mycobacterium avium subsp. paratuberculosis
gcccagcagcgcaccggcga

SEQ ID NO: 934097 - RNA, 13 nt, Mycobacterium avium subsp. paratuberculosis
gcccagcagcccg

SEQ ID NO: 934098 - RNA, 15 nt, Mycobacterium avium subsp. paratuberculosis
gcccagcagcccggc

SEQ ID NO: 934099 - RNA, 19 nt, Mycobacterium avium subsp. paratuberculosis
gcccagcagcccggccagc

SEQ ID NO: 934100 - RNA, 21 nt, Mycobacterium avium subsp. paratuberculosis
gcccagcagcccggccagccg

SEQ ID NO: 934101 - RNA, 20 nt, Mycobacterium avium subsp. paratuberculosis
gcccagcagccgcgccgacg

SEQ ID NO: 934102 - RNA, 13 nt, Mycobacterium avium subsp. paratuberculosis
gcccagcagccug

SEQ ID NO: 934103 - RNA, 15 nt, Mycobacterium avium subsp. paratuberculosis
gcccagcagcggggc

SEQ ID NO: 934104 - RNA, 16 nt, Mycobacterium avium subsp. paratuberculosis
gcccagcagcggggcg

SEQ ID NO: 934105 - RNA, 17 nt, Mycobacterium avium subsp. paratuberculosis
gcccagcagcggggcga

SEQ ID NO: 934106 - RNA, 13 nt, Mycobacterium avium subsp. paratuberculosis
gcccagcagcguc

SEQ ID NO: 934107 - RNA, 23 nt, Mycobacterium avium subsp. paratuberculosis
gcccagcagcgucacgucgacgg

SEQ ID NO: 934108 - RNA, 19 nt, Mycobacterium avium subsp. paratuberculosis
gcccagcagcugcgcgucg

SEQ ID NO: 934109 - RNA, 20 nt, Mycobacterium avium subsp. paratuberculosis
gcccagcagcugcgcgucga

SEQ ID NO: 934110 - RNA, 23 nt, Mycobacterium avium subsp. paratuberculosis
gcccagcagcugcgcgucgaaga

SEQ ID NO: 934111 - RNA, 16 nt, Mycobacterium avium subsp. paratuberculosis
gcccagcacgacgccg

SEQ ID NO: 934112 - RNA, 19 nt, Mycobacterium avium subsp. paratuberculosis
gcccagcagauagcccagc

SEQ ID NO: 934113 - RNA, 21 nt, Mycobacterium avium subsp. paratuberculosis
gcccagcagauagcccagcca

SEQ ID NO: 934114 - RNA, 22 nt, Mycobacterium avium subsp. paratuberculosis
gcccagcagauagcccagccag

SEQ ID NO: 934115 - RNA, 24 nt, Mycobacterium avium subsp. paratuberculosis
gcccagcagauagcccagccagcc

SEQ ID NO: 934116 - RNA, 14 nt, Mycobacterium avium subsp. paratuberculosis
gcccagcagcaccg

SEQ ID NO: 934117 - RNA, 19 nt, Mycobacterium avium subsp. paratuberculosis
gcccagcagcaccgcgacc

SEQ ID NO: 934118 - RNA, 14 nt, Mycobacterium avium subsp. paratuberculosis
gcccagcaccgccg

SEQ ID NO: 934119 - RNA, 16 nt, Mycobacterium avium subsp. paratuberculosis
gcccagcaccgccggc

SEQ ID NO: 934120 - RNA, 16 nt, Mycobacterium avium subsp. paratuberculosis
gcccagcaccgcgacg

SEQ ID NO: 934121 - RNA, 17 nt, Mycobacterium avium subsp. paratuberculosis
gcccagcaccgcgacga

SEQ ID NO: 934122 - RNA, 19 nt, Mycobacterium avium subsp. paratuberculosis
gcccagcaccgcgacgauc

SEQ ID NO: 934123 - RNA, 23 nt, Mycobacterium avium subsp. paratuberculosis
gcccagcaccgucugcgccguca

SEQ ID NO: 934124 - RNA, 13 nt, Mycobacterium avium subsp. paratuberculosis
gcccagcaccgcc

SEQ ID NO: 934125 - RNA, 14 nt, Mycobacterium avium subsp. paratuberculosis
gcccagcacccgcu

SEQ ID NO: 934126 - RNA, 23 nt, Mycobacterium avium subsp. paratuberculosis
gcccagcacccgcucgccgauga

SEQ ID NO: 934127 - RNA, 13 nt, Mycobacterium avium subsp. paratuberculosis
gcccagcacccgg

SEQ ID NO: 934128 - RNA, 22 nt, Mycobacterium avium subsp. paratuberculosis
gcccagcaccacuuccagcacc

SEQ ID NO: 934129 - RNA, 16 nt, Mycobacterium avium subsp. paratuberculosis
gcccagaugccgccgc

SEQ ID NO: 934130 - RNA, 16 nt, Mycobacterium avium subsp. paratuberculosis
gcccagcaccaccacg

SEQ ID NO: 934131 - RNA, 17 nt, Mycobacterium avium subsp. paratuberculosis
gcccagcaccaccacgu

SEQ ID NO: 934132 - RNA, 18 nt, Mycobacterium avium subsp. paratuberculosis
gcccagcaccaccacguu

SEQ ID NO: 934133 - RNA, 18 nt, Mycobacterium avium subsp. paratuberculosis
gcccagcaaacccagcac

SEQ ID NO: 934134 - RNA, 19 nt, Mycobacterium avium subsp. paratuberculosis
gcccagcaaacccagcacc

SEQ ID NO: 934135 - RNA, 14 nt, Mycobacterium avium subsp. paratuberculosis
gcccagacaggccg

SEQ ID NO: 934136 - RNA, 16 nt, Mycobacterium avium subsp. paratuberculosis
gcccagacaggccggc

SEQ ID NO: 934137 - RNA, 17 nt, Mycobacterium avium subsp. paratuberculosis
gcccagacaggccggcc

SEQ ID NO: 934138 - RNA, 17 nt, Mycobacterium avium subsp. paratuberculosis
gcccagacgaugucguc

SEQ ID NO: 934139 - RNA, 21 nt, Mycobacterium avium subsp. paratuberculosis
gcccagacgaugucgucgccg

SEQ ID NO: 934140 - RNA, 14 nt, Mycobacterium avium subsp. paratuberculosis
gcccagacgcgggc

SEQ ID NO: 934141 - RNA, 17 nt, Mycobacterium avium subsp. paratuberculosis
gcccagacgcgggcgcc

SEQ ID NO: 934142 - RNA, 18 nt, Mycobacterium avium subsp. paratuberculosis
gcccagauacgccgcgac

SEQ ID NO: 934143 - RNA, 19 nt, Mycobacterium avium subsp. paratuberculosis
gcccagauacgccgcgacg

SEQ ID NO: 934144 - RNA, 20 nt, Mycobacterium avium subsp. paratuberculosis
gcccagauacgccgcgacga

SEQ ID NO: 934145 - RNA, 17 nt, Mycobacterium avium subsp. paratuberculosis
gcccagaucgacgccga

SEQ ID NO: 934146 - RNA, 19 nt, Mycobacterium avium subsp. paratuberculosis
gcccagaucgacgccgacc

SEQ ID NO: 934147 - RNA, 21 nt, Mycobacterium avium subsp. paratuberculosis
gcccagaucgacgccgaccgc

SEQ ID NO: 934148 - RNA, 23 nt, Mycobacterium avium subsp. paratuberculosis
gcccagaucgacgccgaccgcgg

SEQ ID NO: 934149 - RNA, 24 nt, Mycobacterium avium subsp. paratuberculosis
gcccagaucgacgccgaccgcggu

SEQ ID NO: 934150 - RNA, 13 nt, Mycobacterium avium subsp. paratuberculosis
gcccagaucgccg

SEQ ID NO: 934151 - RNA, 15 nt, Mycobacterium avium subsp. paratuberculosis
gcccagaucgccgac

SEQ ID NO: 934152 - RNA, 20 nt, Mycobacterium avium subsp. paratuberculosis
gcccagaucgccgacccggu

SEQ ID NO: 934153 - RNA, 15 nt, Mycobacterium avium subsp. paratuberculosis
gcccagaucgcgguc

SEQ ID NO: 934154 - RNA, 15 nt, Mycobacterium avium subsp. paratuberculosis
gcccagaucggccag

SEQ ID NO: 934155 - RNA, 16 nt, Mycobacterium avium subsp. paratuberculosis
gcccagaucggccagc

SEQ ID NO: 934156 - RNA, 15 nt, Mycobacterium avium subsp. paratuberculosis
gcccaggcaguagcc

SEQ ID NO: 934157 - RNA, 19 nt, Mycobacterium avium subsp. paratuberculosis
gcccaggcaguagccgauc

SEQ ID NO: 934158 - RNA, 15 nt, Mycobacterium avium subsp. paratuberculosis
gcccaggcacagcga

SEQ ID NO: 934159 - RNA, 23 nt, Mycobacterium avium subsp. paratuberculosis
gcccaggcagacccccagcagcg

SEQ ID NO: 934160 - RNA, 17 nt, Mycobacterium avium subsp. paratuberculosis
gcccaggaacgcgccgg

SEQ ID NO: 934161 - RNA, 20 nt, Mycobacterium avium subsp. paratuberculosis
gcccaggaacgcgccggcgc

SEQ ID NO: 934162 - RNA, 20 nt, Mycobacterium avium subsp. paratuberculosis
gcccaggaaguagccggcca

SEQ ID NO: 934163 - RNA, 21 nt, Mycobacterium avium subsp. paratuberculosis
gcccaggaaguagccggccag

SEQ ID NO: 934164 - RNA, 13 nt, Mycobacterium avium subsp. paratuberculosis
gcccagcugggcc

SEQ ID NO: 934165 - RNA, 18 nt, Mycobacterium avium subsp. paratuberculosis
gcccagcugggccagcgc

SEQ ID NO: 934166 - RNA, 21 nt, Mycobacterium avium subsp. paratuberculosis
gcccagcugggccagcgcggu

SEQ ID NO: 934167 - RNA, 17 nt, Mycobacterium avium subsp. paratuberculosis
gcccagcugcgcggagc

SEQ ID NO: 934168 - RNA, 18 nt, Mycobacterium avium subsp. paratuberculosis
gcccagcugcucgagcau

SEQ ID NO: 934169 - RNA, 19 nt, Mycobacterium avium subsp. paratuberculosis
gcccagcugcacccaccgg

SEQ ID NO: 934170 - RNA, 22 nt, Mycobacterium avium subsp. paratuberculosis
gcccagcugcacccaccggccc

SEQ ID NO: 934171 - RNA, 15 nt, Mycobacterium avium subsp. paratuberculosis
gcccagcuccacgcg

SEQ ID NO: 934172 - RNA, 19 nt, Mycobacterium avium subsp. paratuberculosis
gcccagcucguugccggcg

SEQ ID NO: 934173 - RNA, 21 nt, Mycobacterium avium subsp. paratuberculosis
gcccagcucguugccggcggc

SEQ ID NO: 934174 - RNA, 24 nt, Mycobacterium avium subsp. paratuberculosis
gcccagcucguugccggcggccag

SEQ ID NO: 934175 - RNA, 16 nt, Mycobacterium avium subsp. paratuberculosis
gcccagcucggugcgc

SEQ ID NO: 934176 - RNA, 17 nt, Mycobacterium avium subsp. paratuberculosis
gcccagcucggugcgca

SEQ ID NO: 934177 - RNA, 12 nt, Mycobacterium avium subsp. paratuberculosis
gcccagcguggu

SEQ ID NO: 934178 - RNA, 23 nt, Mycobacterium avium subsp. paratuberculosis
gcccagcguggucacccgcagcc

SEQ ID NO: 934179 - RNA, 15 nt, Mycobacterium avium subsp. paratuberculosis
gcccagcgugucggc

SEQ ID NO: 934180 - RNA, 18 nt, Mycobacterium avium subsp. paratuberculosis
gcccagcgugucggcgau

SEQ ID NO: 934181 - RNA, 19 nt, Mycobacterium avium subsp. paratuberculosis
gcccagcgugucggcgauc

SEQ ID NO: 934182 - RNA, 16 nt, Mycobacterium avium subsp. paratuberculosis
gcccagcgucucggcg

SEQ ID NO: 934183 - RNA, 17 nt, Mycobacterium avium subsp. paratuberculosis
gcccagcgucucggcgg

SEQ ID NO: 934184 - RNA, 19 nt, Mycobacterium avium subsp. paratuberculosis
gcccagcgucucggcggcc

SEQ ID NO: 934185 - RNA, 15 nt, Mycobacterium avium subsp. paratuberculosis
gcccagcggcgaugc

SEQ ID NO: 934186 - RNA, 14 nt, Mycobacterium avium subsp. paratuberculosis
gcccagcggcacga

SEQ ID NO: 934187 - RNA, 14 nt, Mycobacterium avium subsp. paratuberculosis
gcccagcggcaugg

SEQ ID NO: 934188 - RNA, 18 nt, Mycobacterium avium subsp. paratuberculosis
gcccagcggccccggcuc

SEQ ID NO: 934189 - RNA, 20 nt, Mycobacterium avium subsp. paratuberculosis
gcccagcggccccggcucgg

SEQ ID NO: 934190 - RNA, 22 nt, Mycobacterium avium subsp. paratuberculosis
gcccagcggcuguagcacccgg

SEQ ID NO: 934191 - RNA, 23 nt, Mycobacterium avium subsp. paratuberculosis
gcccagcggcuguagcacccggc

SEQ ID NO: 934192 - RNA, 22 nt, Mycobacterium avium subsp. paratuberculosis
gcccagcgucaacucgucggcg

SEQ ID NO: 934193 - RNA, 23 nt, Mycobacterium avium subsp. paratuberculosis
gcccagcgucaacucgucggcga

SEQ ID NO: 934194 - RNA, 23 nt, Mycobacterium avium subsp. paratuberculosis
gcccagcgcggucgccaccacca

SEQ ID NO: 934195 - RNA, 13 nt, Mycobacterium avium subsp. paratuberculosis
gcccagcgcggug

SEQ ID NO: 934196 - RNA, 14 nt, Mycobacterium avium subsp. paratuberculosis
gcccagcgcggcgg

SEQ ID NO: 934197 - RNA, 15 nt, Mycobacterium avium subsp. paratuberculosis
gcccagcgcggcggc

SEQ ID NO: 934198 - RNA, 16 nt, Mycobacterium avium subsp. paratuberculosis
gcccagcgcggcggcc

SEQ ID NO: 934199 - RNA, 19 nt, Mycobacterium avium subsp. paratuberculosis
gcccagcgcguugcggccg

SEQ ID NO: 934200 - RNA, 20 nt, Mycobacterium avium subsp. paratuberculosis
gcccagcgcguugcggccgu

SEQ ID NO: 934201 - RNA, 21 nt, Mycobacterium avium subsp. paratuberculosis
gcccagcgcguugcggccguc

SEQ ID NO: 934202 - RNA, 22 nt, Mycobacterium avium subsp. paratuberculosis
gcccagcgcguugcggccgucc

SEQ ID NO: 934203 - RNA, 17 nt, Mycobacterium avium subsp. paratuberculosis
gcccagcgcggcggcca

SEQ ID NO: 934204 - RNA, 18 nt, Mycobacterium avium subsp. paratuberculosis
gcccagcgcggcggccac

SEQ ID NO: 934205 - RNA, 19 nt, Mycobacterium avium subsp. paratuberculosis
gcccagcgcggcggccacc

SEQ ID NO: 934206 - RNA, 16 nt, Mycobacterium avium subsp. paratuberculosis
gcccagcgcgacgucg

SEQ ID NO: 934207 - RNA, 17 nt, Mycobacterium avium subsp. paratuberculosis
gcccagcgcgacgucga

SEQ ID NO: 934208 - RNA, 13 nt, Mycobacterium avium subsp. paratuberculosis
gcccagcgcgcga

SEQ ID NO: 934209 - RNA, 22 nt, Mycobacterium avium subsp. paratuberculosis
gcccagcgcgcgaucgccggug

SEQ ID NO: 934210 - RNA, 23 nt, Mycobacterium avium subsp. paratuberculosis
gcccagcgcgcgaucgccggugc

SEQ ID NO: 934211 - RNA, 14 nt, Mycobacterium avium subsp. paratuberculosis
gcccagcgcgcggc

SEQ ID NO: 934212 - RNA, 16 nt, Mycobacterium avium subsp. paratuberculosis
gcccagcgcgcggcgg

SEQ ID NO: 934213 - RNA, 14 nt, Mycobacterium avium subsp. paratuberculosis
gcccagcgcgcggu

SEQ ID NO: 934214 - RNA, 15 nt, Mycobacterium avium subsp. paratuberculosis
gcccagcgcgcggug

SEQ ID NO: 934215 - RNA, 19 nt, Mycobacterium avium subsp. paratuberculosis
gcccagcgcgcggugcgcc

SEQ ID NO: 934216 - RNA, 21 nt, Mycobacterium avium subsp. paratuberculosis
gcccagcgcgcggugcgccag

SEQ ID NO: 934217 - RNA, 22 nt, Mycobacterium avium subsp. paratuberculosis
gcccagcgcgcggugcgccagc

SEQ ID NO: 934218 - RNA, 16 nt, Mycobacterium avium subsp. paratuberculosis
gcccagcgcggcgaac

SEQ ID NO: 934219 - RNA, 19 nt, Mycobacterium avium subsp. paratuberculosis
gcccagcgccgcggcgaaa

SEQ ID NO: 934220 - RNA, 14 nt, Mycobacterium avium subsp. paratuberculosis
gcccagcgccacgg

SEQ ID NO: 934221 - RNA, 22 nt, Mycobacterium avium subsp. paratuberculosis
gcccagcgccacgguggcgguc

SEQ ID NO: 934222 - RNA, 14 nt, Mycobacterium avium subsp. paratuberculosis
gcccagcgcccgua

SEQ ID NO: 934223 - RNA, 22 nt, Mycobacterium avium subsp. paratuberculosis
gcccagcgcccguagccgcggu

SEQ ID NO: 934224 - RNA, 13 nt, Mycobacterium avium subsp. paratuberculosis
gcccagcgccccg

SEQ ID NO: 934225 - RNA, 17 nt, Mycobacterium avium subsp. paratuberculosis
gcccagcgacucggcca

SEQ ID NO: 934226 - RNA, 15 nt, Mycobacterium avium subsp. paratuberculosis
gcccagcgcagcgcc

SEQ ID NO: 934227 - RNA, 16 nt, Mycobacterium avium subsp. paratuberculosis
gcccagcgcagcgccu

SEQ ID NO: 934228 - RNA, 17 nt, Mycobacterium avium subsp. paratuberculosis
gcccagcgcagcgccuc

SEQ ID NO: 934229 - RNA, 14 nt, Mycobacterium avium subsp. paratuberculosis
gcccagcgagcugc

SEQ ID NO: 934230 - RNA, 18 nt, Mycobacterium avium subsp. paratuberculosis
gcccagcgagcugccggc

SEQ ID NO: 934231 - RNA, 19 nt, Mycobacterium avium subsp. paratuberculosis
gcccagcgagcugccggcg

SEQ ID NO: 934232 - RNA, 23 nt, Mycobacterium avium subsp. paratuberculosis
gcccagcgagcugccggcggccg

SEQ ID NO: 934233 - RNA, 16 nt, Mycobacterium avium subsp. paratuberculosis
gcccagcgaggcggcc

SEQ ID NO: 934234 - RNA, 19 nt, Mycobacterium avium subsp. paratuberculosis
gcccagcgaggcggccagc

SEQ ID NO: 934235 - RNA, 16 nt, Mycobacterium avium subsp. paratuberculosis
gcccagccuucgccgc

SEQ ID NO: 934236 - RNA, 19 nt, Mycobacterium avium subsp. paratuberculosis
gcccagccuucgccgcacg

SEQ ID NO: 934237 - RNA, 19 nt, Mycobacterium avium subsp. paratuberculosis
gcccagccgcgucacgucg

SEQ ID NO: 934238 - RNA, 21 nt, Mycobacterium avium subsp. paratuberculosis
gcccagccgcgucacgucggc

SEQ ID NO: 934239 - RNA, 23 nt, Mycobacterium avium subsp. paratuberculosis
gcccagccgcgucacgucggccu

SEQ ID NO: 934240 - RNA, 18 nt, Mycobacterium avium subsp. paratuberculosis
gcccagccgucgcaccgc

SEQ ID NO: 934241 - RNA, 19 nt, Mycobacterium avium subsp. paratuberculosis
gcccagccgucgcaccgcc

SEQ ID NO: 934242 - RNA, 17 nt, Mycobacterium avium subsp. paratuberculosis
gcccagccggucgccgg

SEQ ID NO: 934243 - RNA, 19 nt, Mycobacterium avium subsp. paratuberculosis
gcccagccggucgccgggc

SEQ ID NO: 934244 - RNA, 21 nt, Mycobacterium avium subsp. paratuberculosis
gcccagccggucgccgggccg

SEQ ID NO: 934245 - RNA, 17 nt, Mycobacterium avium subsp. paratuberculosis
gcccagccggugcgagc

SEQ ID NO: 934246 - RNA, 20 nt, Mycobacterium avium subsp. paratuberculosis
gcccagccggugcgagccgc

SEQ ID NO: 934247 - RNA, 23 nt, Mycobacterium avium subsp. paratuberculosis
gcccagccggugcgagccgcuga

SEQ ID NO: 934248 - RNA, 15 nt, Mycobacterium avium subsp. paratuberculosis
gcccagccggccgac

SEQ ID NO: 934249 - RNA, 17 nt, Mycobacterium avium subsp. paratuberculosis
gcccagccggccgacgc

SEQ ID NO: 934250 - RNA, 20 nt, Mycobacterium avium subsp. paratuberculosis
gcccagccggccgacgcggc

SEQ ID NO: 934251 - RNA, 13 nt, Mycobacterium avium subsp. paratuberculosis
gcccagccggcgg

SEQ ID NO: 934252 - RNA, 15 nt, Mycobacterium avium subsp. paratuberculosis
gcccagccggcggug

SEQ ID NO: 934253 - RNA, 21 nt, Mycobacterium avium subsp. paratuberculosis
gcccagccggcggugcagggu

SEQ ID NO: 934254 - RNA, 14 nt, Mycobacterium avium subsp. paratuberculosis
gcccagccgcugcg

SEQ ID NO: 934255 - RNA, 16 nt, Mycobacterium avium subsp. paratuberculosis
gcccagccgccagccg

SEQ ID NO: 934256 - RNA, 18 nt, Mycobacterium avium subsp. paratuberculosis
gcccagccgccagccggu

SEQ ID NO: 934257 - RNA, 13 nt, Mycobacterium avium subsp. paratuberculosis
gcccagccgagcc

SEQ ID NO: 934258 - RNA, 21 nt, Mycobacterium avium subsp. paratuberculosis
gcccagcccggccccaccgcc

SEQ ID NO: 934259 - RNA, 22 nt, Mycobacterium avium subsp. paratuberculosis
gcccagcccggccccaccgccg

SEQ ID NO: 934260 - RNA, 23 nt, Mycobacterium avium subsp. paratuberculosis
gcccagcccggccccaccgccgc

SEQ ID NO: 934261 - RNA, 16 nt, Mycobacterium avium subsp. paratuberculosis
gcccagcccgcgccga

SEQ ID NO: 934262 - RNA, 14 nt, Mycobacterium avium subsp. paratuberculosis
gcccagcccgcgcg

SEQ ID NO: 934263 - RNA, 20 nt, Mycobacterium avium subsp. paratuberculosis
gcccagcccgcgcgagcgca

SEQ ID NO: 934264 - RNA, 15 nt, Mycobacterium avium subsp. paratuberculosis
gcccagcccgcgggc

SEQ ID NO: 934265 - RNA, 16 nt, Mycobacterium avium subsp. paratuberculosis
gcccagcccgcgggcg

SEQ ID NO: 934266 - RNA, 18 nt, Mycobacterium avium subsp. paratuberculosis
gcccagcccgcgggcggc

SEQ ID NO: 934267 - RNA, 14 nt, Mycobacterium avium subsp. paratuberculosis
gcccagcccgccgc

SEQ ID NO: 934268 - RNA, 16 nt, Mycobacterium avium subsp. paratuberculosis
gcccagccccucgacg

SEQ ID NO: 934269 - RNA, 21 nt, Mycobacterium avium subsp. paratuberculosis
gcccagccccucgacguccag

SEQ ID NO: 934270 - RNA, 17 nt, Mycobacterium avium subsp. paratuberculosis
gcccagcccgagcacca

SEQ ID NO: 934271 - RNA, 14 nt, Mycobacterium avium subsp. paratuberculosis
gcccagccccagca

SEQ ID NO: 934272 - RNA, 17 nt, Mycobacterium avium subsp. paratuberculosis
gcccagccccagcacga

SEQ ID NO: 934273 - RNA, 20 nt, Mycobacterium avium subsp. paratuberculosis
gcccagccccagcacgauga

SEQ ID NO: 934274 - RNA, 21 nt, Mycobacterium avium subsp. paratuberculosis
gcccagccccagcacgaugac

SEQ ID NO: 934275 - RNA, 15 nt, Mycobacterium avium subsp. paratuberculosis
gcccagccaguccgc

SEQ ID NO: 934276 - RNA, 16 nt, Mycobacterium avium subsp. paratuberculosis
gcccagccaguccgcc

SEQ ID NO: 934277 - RNA, 19 nt, Mycobacterium avium subsp. paratuberculosis
gcccagccaguccgccgcc

SEQ ID NO: 934278 - RNA, 21 nt, Mycobacterium avium subsp. paratuberculosis
gcccagccaguccgccgccgu

SEQ ID NO: 934279 - RNA, 13 nt, Mycobacterium avium subsp. paratuberculosis
gcccagccaucug

SEQ ID NO: 934280 - RNA, 15 nt, Mycobacterium avium subsp. paratuberculosis
gccccacacgaugcg

SEQ ID NO: 934281 - RNA, 19 nt, Mycobacterium avium subsp. paratuberculosis
gccccacacgaugcgcggu

SEQ ID NO: 934282 - RNA, 21 nt, Mycobacterium avium subsp. paratuberculosis
gcccaucugcacagcuucggc

SEQ ID NO: 934283 - RNA, 17 nt, Mycobacterium avium subsp. paratuberculosis
gcccaugaacgcgucgc

SEQ ID NO: 934284 - RNA, 16 nt, Mycobacterium avium subsp. paratuberculosis
gccccaccaccgccac

SEQ ID NO: 934285 - RNA, 18 nt, Mycobacterium avium subsp. paratuberculosis
gccccaccaccgccggcc

SEQ ID NO: 934286 - RNA, 21 nt, Mycobacterium avium subsp. paratuberculosis
gccccacacgcucggcgcgcg

SEQ ID NO: 934287 - RNA, 16 nt, Mycobacterium avium subsp. paratuberculosis
gccccaccccggacgg

SEQ ID NO: 934288 - RNA, 15 nt, Mycobacterium avium subsp. paratuberculosis
gccccacccgcagug

SEQ ID NO: 934289 - RNA, 13 nt, Mycobacterium avium subsp. paratuberculosis
gcccaucgcggcc

SEQ ID NO: 934290 - RNA, 16 nt, Mycobacterium avium subsp. paratuberculosis
gcccaucgcggccgcc

SEQ ID NO: 934291 - RNA, 19 nt, Mycobacterium avium subsp. paratuberculosis
gcccaucgcggccgcccgg

SEQ ID NO: 934292 - RNA, 20 nt, Mycobacterium avium subsp. paratuberculosis
gcccaucgcggccgcccggu

SEQ ID NO: 934293 - RNA, 16 nt, Mycobacterium avium subsp. paratuberculosis
gcccaucgcggucagc

SEQ ID NO: 934294 - RNA, 18 nt, Mycobacterium avium subsp. paratuberculosis
gcccaucgcggucagcgu

SEQ ID NO: 934295 - RNA, 15 nt, Mycobacterium avium subsp. paratuberculosis
gcccauccggcgccg

SEQ ID NO: 934296 - RNA, 19 nt, Mycobacterium avium subsp. paratuberculosis
gcccauccggcgccgcgca

SEQ ID NO: 934297 - RNA, 12 nt, Mycobacterium avium subsp. paratuberculosis
gcccaucgccac

SEQ ID NO: 934298 - RNA, 14 nt, Mycobacterium avium subsp. paratuberculosis
gcccaucgccacgc

SEQ ID NO: 934299 - RNA, 15 nt, Mycobacterium avium subsp. paratuberculosis
gcccaucgccacgcc

SEQ ID NO: 934300 - RNA, 16 nt, Mycobacterium avium subsp. paratuberculosis
gcccaucgccacgccg

SEQ ID NO: 934301 - RNA, 19 nt, Mycobacterium avium subsp. paratuberculosis
gcccaucgccacgccgugg

SEQ ID NO: 934302 - RNA, 16 nt, Mycobacterium avium subsp. paratuberculosis
gcccaggcccagcagc

SEQ ID NO: 934303 - RNA, 17 nt, Mycobacterium avium subsp. paratuberculosis
gcccaguugcacggugu

SEQ ID NO: 934304 - RNA, 14 nt, Mycobacterium avium subsp. paratuberculosis
gcccaggcccggca

SEQ ID NO: 934305 - RNA, 15 nt, Mycobacterium avium subsp. paratuberculosis
gcccaggcccggcac

SEQ ID NO: 934306 - RNA, 17 nt, Mycobacterium avium subsp. paratuberculosis
gcccaggcccggcaccg

SEQ ID NO: 934307 - RNA, 14 nt, Mycobacterium avium subsp. paratuberculosis
gcccaggccccggc

SEQ ID NO: 934308 - RNA, 15 nt, Mycobacterium avium subsp. paratuberculosis
gcccaggccccggcc

SEQ ID NO: 934309 - RNA, 16 nt, Mycobacterium avium subsp. paratuberculosis
gcccaggccccggccg

SEQ ID NO: 934310 - RNA, 17 nt, Mycobacterium avium subsp. paratuberculosis
gcccaggccccggccga

SEQ ID NO: 934311 - RNA, 20 nt, Mycobacterium avium subsp. paratuberculosis
gcccaggccccggccgagcg

SEQ ID NO: 934312 - RNA, 18 nt, Mycobacterium avium subsp. paratuberculosis
gcccaggccaacagcagc

SEQ ID NO: 934313 - RNA, 19 nt, Mycobacterium avium subsp. paratuberculosis
gcccaggccaacagcagca

SEQ ID NO: 934314 - RNA, 17 nt, Mycobacterium avium subsp. paratuberculosis
gcccaucccgauccgcg

SEQ ID NO: 934315 - RNA, 20 nt, Mycobacterium avium subsp. paratuberculosis
gcccaucccgauccgcgccg

SEQ ID NO: 934316 - RNA, 21 nt, Mycobacterium avium subsp. paratuberculosis
gcccaucccgauccgcgccgc

SEQ ID NO: 934317 - RNA, 13 nt, Mycobacterium avium subsp. paratuberculosis
gcccaucagcacg

SEQ ID NO: 934318 - RNA, 15 nt, Mycobacterium avium subsp. paratuberculosis
gcccaucagcaggac

SEQ ID NO: 934319 - RNA, 13 nt, Mycobacterium avium subsp. paratuberculosis
gcccaucaccagc

SEQ ID NO: 934320 - RNA, 14 nt, Mycobacterium avium subsp. paratuberculosis
gcccaucaccagcg

SEQ ID NO: 934321 - RNA, 16 nt, Mycobacterium avium subsp. paratuberculosis
gcccaucaccagcggc

SEQ ID NO: 934322 - RNA, 22 nt, Mycobacterium avium subsp. paratuberculosis
gcccaucaccagcggcugcagc

SEQ ID NO: 934323 - RNA, 14 nt, Mycobacterium avium subsp. paratuberculosis
gcccaucaccccga

SEQ ID NO: 934324 - RNA, 14 nt, Mycobacterium avium subsp. paratuberculosis
gcccaucaccgcac

SEQ ID NO: 934325 - RNA, 16 nt, Mycobacterium avium subsp. paratuberculosis
gcccaucaccgcaccg

SEQ ID NO: 934326 - RNA, 17 nt, Mycobacterium avium subsp. paratuberculosis
gcccaucaccgcaccga

SEQ ID NO: 934327 - RNA, 22 nt, Mycobacterium avium subsp. paratuberculosis
gcccaucaccggaccggccagc

SEQ ID NO: 934328 - RNA, 14 nt, Mycobacterium avium subsp. paratuberculosis
gccccacggcgcgu

SEQ ID NO: 934329 - RNA, 15 nt, Mycobacterium avium subsp. paratuberculosis
gccccacggcgcgug

SEQ ID NO: 934330 - RNA, 22 nt, Mycobacterium avium subsp. paratuberculosis
gccccacggucuuugccggcca

SEQ ID NO: 934331 - RNA, 20 nt, Mycobacterium avium subsp. paratuberculosis
gccccacgccaugugccggc

SEQ ID NO: 934332 - RNA, 21 nt, Mycobacterium avium subsp. paratuberculosis
gccccacgccaugugccggcg

SEQ ID NO: 934333 - RNA, 15 nt, Mycobacterium avium subsp. paratuberculosis
gccccacgccuggcg

SEQ ID NO: 934334 - RNA, 16 nt, Mycobacterium avium subsp. paratuberculosis
gccccacgccuggcgg

SEQ ID NO: 934335 - RNA, 15 nt, Mycobacterium avium subsp. paratuberculosis
gccccacgcgcucag

SEQ ID NO: 934336 - RNA, 16 nt, Mycobacterium avium subsp. paratuberculosis
gccccacgcgcucagc

SEQ ID NO: 934337 - RNA, 17 nt, Mycobacterium avium subsp. paratuberculosis
gccccaccgccgcugcg

SEQ ID NO: 934338 - RNA, 20 nt, Mycobacterium avium subsp. paratuberculosis
gccccaccgccgcugcgcgc

SEQ ID NO: 934339 - RNA, 15 nt, Mycobacterium avium subsp. paratuberculosis
gccccaccggccacu

SEQ ID NO: 934340 - RNA, 23 nt, Mycobacterium avium subsp. paratuberculosis
gccccagccaccguggccccacg

SEQ ID NO: 934341 - RNA, 14 nt, Mycobacterium avium subsp. paratuberculosis
gccccagcccggcu

SEQ ID NO: 934342 - RNA, 13 nt, Mycobacterium avium subsp. paratuberculosis
gccccagcccggg

SEQ ID NO: 934343 - RNA, 15 nt, Mycobacterium avium subsp. paratuberculosis
gccccagccgaccag

SEQ ID NO: 934344 - RNA, 15 nt, Mycobacterium avium subsp. paratuberculosis
gccccagccgccgcg

SEQ ID NO: 934345 - RNA, 20 nt, Mycobacterium avium subsp. paratuberculosis
gccccagaaccgcucggcgg

SEQ ID NO: 934346 - RNA, 24 nt, Mycobacterium avium subsp. paratuberculosis
gccccagacgauuugggcgguccg

SEQ ID NO: 934347 - RNA, 14 nt, Mycobacterium avium subsp. paratuberculosis
gccccagacguuuc

SEQ ID NO: 934348 - RNA, 16 nt, Mycobacterium avium subsp. paratuberculosis
gccccagcugucgggu

SEQ ID NO: 934349 - RNA, 20 nt, Mycobacterium avium subsp. paratuberculosis
gccccagggaccaguggugg

SEQ ID NO: 934350 - RNA, 14 nt, Mycobacterium avium subsp. paratuberculosis
gccccaggcgaaca

SEQ ID NO: 934351 - RNA, 14 nt, Mycobacterium avium subsp. paratuberculosis
gccccaggcgcccu

SEQ ID NO: 934352 - RNA, 18 nt, Mycobacterium avium subsp. paratuberculosis
gccccaggcgcccugcac

SEQ ID NO: 934353 - RNA, 20 nt, Mycobacterium avium subsp. paratuberculosis
gccccaggcgcccugcacga

SEQ ID NO: 934354 - RNA, 15 nt, Mycobacterium avium subsp. paratuberculosis
gccccagguuccggu

SEQ ID NO: 934355 - RNA, 18 nt, Mycobacterium avium subsp. paratuberculosis
gccccagguuccgguguc

SEQ ID NO: 934356 - RNA, 15 nt, Mycobacterium avium subsp. paratuberculosis
gccccagggccucgg

SEQ ID NO: 934357 - RNA, 16 nt, Mycobacterium avium subsp. paratuberculosis
gccccagggccucggc

SEQ ID NO: 934358 - RNA, 17 nt, Mycobacterium avium subsp. paratuberculosis
gccccagggccucggcg

SEQ ID NO: 934359 - RNA, 19 nt, Mycobacterium avium subsp. paratuberculosis
gccccagggccucggcgac

SEQ ID NO: 934360 - RNA, 22 nt, Mycobacterium avium subsp. paratuberculosis
gccccagggccucggcgaccgc

SEQ ID NO: 934361 - RNA, 16 nt, Mycobacterium avium subsp. paratuberculosis
gccccagggugcgccg

SEQ ID NO: 934362 - RNA, 14 nt, Mycobacterium avium subsp. paratuberculosis
gccccaggucgggg

SEQ ID NO: 934363 - RNA, 15 nt, Mycobacterium avium subsp. paratuberculosis
gccccaggucggggu

SEQ ID NO: 934364 - RNA, 16 nt, Mycobacterium avium subsp. paratuberculosis
gccccaggucggggug

SEQ ID NO: 934365 - RNA, 19 nt, Mycobacterium avium subsp. paratuberculosis
gccccaggucggggugggc

SEQ ID NO: 934366 - RNA, 15 nt, Mycobacterium avium subsp. paratuberculosis
gccccaggugacgcc

SEQ ID NO: 934367 - RNA, 20 nt, Mycobacterium avium subsp. paratuberculosis
gccccaggugacgccgcacg

SEQ ID NO: 934368 - RNA, 21 nt, Mycobacterium avium subsp. paratuberculosis
gccccaggugacgccgcacga

SEQ ID NO: 934369 - RNA, 14 nt, Mycobacterium avium subsp. paratuberculosis
gccccgcgugacgg

SEQ ID NO: 934370 - RNA, 15 nt, Mycobacterium avium subsp. paratuberculosis
gccccgcgugacggc

SEQ ID NO: 934371 - RNA, 18 nt, Mycobacterium avium subsp. paratuberculosis
gccccggccgggcgacug

SEQ ID NO: 934372 - RNA, 21 nt, Mycobacterium avium subsp. paratuberculosis
gccccggccgggcgacugcgu

SEQ ID NO: 934373 - RNA, 23 nt, Mycobacterium avium subsp. paratuberculosis
gccccggccguucuugcggguga

SEQ ID NO: 934374 - RNA, 23 nt, Mycobacterium avium subsp. paratuberculosis
gccccgcgcgaucaggccggcca

SEQ ID NO: 934375 - RNA, 12 nt, Mycobacterium avium subsp. paratuberculosis
gccccgcgacac

SEQ ID NO: 934376 - RNA, 14 nt, Mycobacterium avium subsp. paratuberculosis
gccccgcgacacgc

SEQ ID NO: 934377 - RNA, 16 nt, Mycobacterium avium subsp. paratuberculosis
gccccgcgacacgccg

SEQ ID NO: 934378 - RNA, 12 nt, Mycobacterium avium subsp. paratuberculosis
gccccgcgaccg

SEQ ID NO: 934379 - RNA, 13 nt, Mycobacterium avium subsp. paratuberculosis
gccccgcgaccgc

SEQ ID NO: 934380 - RNA, 15 nt, Mycobacterium avium subsp. paratuberculosis
gccccgcgaccgcag

SEQ ID NO: 934381 - RNA, 17 nt, Mycobacterium avium subsp. paratuberculosis
gccccgcgaccgcagca

SEQ ID NO: 934382 - RNA, 20 nt, Mycobacterium avium subsp. paratuberculosis
gccccgcgaccgcagcaggc

SEQ ID NO: 934383 - RNA, 20 nt, Mycobacterium avium subsp. paratuberculosis
gccccgccguuucagcagcg

SEQ ID NO: 934384 - RNA, 15 nt, Mycobacterium avium subsp. paratuberculosis
gccccgccggugucg

SEQ ID NO: 934385 - RNA, 18 nt, Mycobacterium avium subsp. paratuberculosis
gccccgccggugucggcg

SEQ ID NO: 934386 - RNA, 19 nt, Mycobacterium avium subsp. paratuberculosis
gccccgccggugucggcga

SEQ ID NO: 934387 - RNA, 18 nt, Mycobacterium avium subsp. paratuberculosis
gcccccugaucggccgca

SEQ ID NO: 934388 - RNA, 15 nt, Mycobacterium avium subsp. paratuberculosis
gcccccugggacagc

SEQ ID NO: 934389 - RNA, 19 nt, Mycobacterium avium subsp. paratuberculosis
gcccccugggacagcgaga

SEQ ID NO: 934390 - RNA, 17 nt, Mycobacterium avium subsp. paratuberculosis
gccccgacagcaacgcc

SEQ ID NO: 934391 - RNA, 21 nt, Mycobacterium avium subsp. paratuberculosis
gccccgacagcaacgccaggg

SEQ ID NO: 934392 - RNA, 17 nt, Mycobacterium avium subsp. paratuberculosis
gccccgaacagcgccag

SEQ ID NO: 934393 - RNA, 15 nt, Mycobacterium avium subsp. paratuberculosis
gccccgacaucgcca

SEQ ID NO: 934394 - RNA, 12 nt, Mycobacterium avium subsp. paratuberculosis
gcccccgcggcg

SEQ ID NO: 934395 - RNA, 15 nt, Mycobacterium avium subsp. paratuberculosis
gcccccgcggcggcc

SEQ ID NO: 934396 - RNA, 18 nt, Mycobacterium avium subsp. paratuberculosis
gcccccgcgggucgucga

SEQ ID NO: 934397 - RNA, 20 nt, Mycobacterium avium subsp. paratuberculosis
gcccccgcgggucgucgacg

SEQ ID NO: 934398 - RNA, 23 nt, Mycobacterium avium subsp. paratuberculosis
gcccccgcgggucgucgacgucg

SEQ ID NO: 934399 - RNA, 13 nt, Mycobacterium avium subsp. paratuberculosis
gcccccgcuggcg

SEQ ID NO: 934400 - RNA, 15 nt, Mycobacterium avium subsp. paratuberculosis
gcccccggaccacgu

SEQ ID NO: 934401 - RNA, 16 nt, Mycobacterium avium subsp. paratuberculosis
gcccccggaccacguc

SEQ ID NO: 934402 - RNA, 21 nt, Mycobacterium avium subsp. paratuberculosis
gcccccggaccacguccccgg

SEQ ID NO: 934403 - RNA, 17 nt, Mycobacterium avium subsp. paratuberculosis
gcccccgcccggccggu

SEQ ID NO: 934404 - RNA, 23 nt, Mycobacterium avium subsp. paratuberculosis
gcccccgcccggccggucgccga

SEQ ID NO: 934405 - RNA, 17 nt, Mycobacterium avium subsp. paratuberculosis
gcccccggcucgaucgc

SEQ ID NO: 934406 - RNA, 16 nt, Mycobacterium avium subsp. paratuberculosis
gccccccgggcaccag

SEQ ID NO: 934407 - RNA, 21 nt, Mycobacterium avium subsp. paratuberculosis
gccccccgggcaccagcgcga

SEQ ID NO: 934408 - RNA, 14 nt, Mycobacterium avium subsp. paratuberculosis
gcccccagcggggc

SEQ ID NO: 934409 - RNA, 15 nt, Mycobacterium avium subsp. paratuberculosis
gccccgucggucccg

SEQ ID NO: 934410 - RNA, 23 nt, Mycobacterium avium subsp. paratuberculosis
gccccgucggucccgacgcggcg

SEQ ID NO: 934411 - RNA, 16 nt, Mycobacterium avium subsp. paratuberculosis
gccccgucggucgggc

SEQ ID NO: 934412 - RNA, 22 nt, Mycobacterium avium subsp. paratuberculosis
gccccgguuccaaccaccgugg

SEQ ID NO: 934413 - RNA, 15 nt, Mycobacterium avium subsp. paratuberculosis
gccccguccggcgcc

SEQ ID NO: 934414 - RNA, 16 nt, Mycobacterium avium subsp. paratuberculosis
gccccguccggcgcca

SEQ ID NO: 934415 - RNA, 16 nt, Mycobacterium avium subsp. paratuberculosis
gccccguacggguugc

SEQ ID NO: 934416 - RNA, 18 nt, Mycobacterium avium subsp. paratuberculosis
gccccguacggguugccg

SEQ ID NO: 934417 - RNA, 22 nt, Mycobacterium avium subsp. paratuberculosis
gccccguacggguugccgucga

SEQ ID NO: 934418 - RNA, 16 nt, Mycobacterium avium subsp. paratuberculosis
gccccgguagccagca

SEQ ID NO: 934419 - RNA, 13 nt, Mycobacterium avium subsp. paratuberculosis
gccccguguggug

SEQ ID NO: 934420 - RNA, 15 nt, Mycobacterium avium subsp. paratuberculosis
gccccgugugguguc

SEQ ID NO: 934421 - RNA, 22 nt, Mycobacterium avium subsp. paratuberculosis
gccccguguggugucgaagucg

SEQ ID NO: 934422 - RNA, 14 nt, Mycobacterium avium subsp. paratuberculosis
gccccuccucgguc

SEQ ID NO: 934423 - RNA, 15 nt, Mycobacterium avium subsp. paratuberculosis
gccccucccaccacg

SEQ ID NO: 934424 - RNA, 18 nt, Mycobacterium avium subsp. paratuberculosis
gccccucccaccacggcc

SEQ ID NO: 934425 - RNA, 19 nt, Mycobacterium avium subsp. paratuberculosis
gccccucccaccacggccg

SEQ ID NO: 934426 - RNA, 20 nt, Mycobacterium avium subsp. paratuberculosis
gccccucccaccacggccga

SEQ ID NO: 934427 - RNA, 22 nt, Mycobacterium avium subsp. paratuberculosis
gccccucauugggaccggugcg

SEQ ID NO: 934428 - RNA, 15 nt, Mycobacterium avium subsp. paratuberculosis
gccccuaccgccgag

SEQ ID NO: 934429 - RNA, 17 nt, Mycobacterium avium subsp. paratuberculosis
gccccuaccgccgagcg

SEQ ID NO: 934430 - RNA, 18 nt, Mycobacterium avium subsp. paratuberculosis
gccccuccagccgccggu

SEQ ID NO: 934431 - RNA, 15 nt, Mycobacterium avium subsp. paratuberculosis
gccccggucccgccg

SEQ ID NO: 934432 - RNA, 18 nt, Mycobacterium avium subsp. paratuberculosis
gccccggucccgccggug

SEQ ID NO: 934433 - RNA, 20 nt, Mycobacterium avium subsp. paratuberculosis
gccccggucccggggcucga

SEQ ID NO: 934434 - RNA, 19 nt, Mycobacterium avium subsp. paratuberculosis
gccccgggggaccagcgca

SEQ ID NO: 934435 - RNA, 21 nt, Mycobacterium avium subsp. paratuberculosis
gccccgggggaccagcgcaac

SEQ ID NO: 934436 - RNA, 21 nt, Mycobacterium avium subsp. paratuberculosis
gccccggggguuucgugugcu

SEQ ID NO: 934437 - RNA, 18 nt, Mycobacterium avium subsp. paratuberculosis
gccccggcguuucgugcu

SEQ ID NO: 934438 - RNA, 16 nt, Mycobacterium avium subsp. paratuberculosis
gccccggcucgggcca

SEQ ID NO: 934439 - RNA, 18 nt, Mycobacterium avium subsp. paratuberculosis
gccccgggaaaugcugca

SEQ ID NO: 934440 - RNA, 18 nt, Mycobacterium avium subsp. paratuberculosis
gccccgggaaccagccca

SEQ ID NO: 934441 - RNA, 22 nt, Mycobacterium avium subsp. paratuberculosis
gccccgggaaccagcccagguc

SEQ ID NO: 934442 - RNA, 18 nt, Mycobacterium avium subsp. paratuberculosis
gccccgggauccgaggcg

SEQ ID NO: 934443 - RNA, 21 nt, Mycobacterium avium subsp. paratuberculosis
gccccgggauccgaggcguca

SEQ ID NO: 934444 - RNA, 16 nt, Mycobacterium avium subsp. paratuberculosis
gccccgggcgcuggcg

SEQ ID NO: 934445 - RNA, 18 nt, Mycobacterium avium subsp. paratuberculosis
gccccgggcgcuggcgau

SEQ ID NO: 934446 - RNA, 21 nt, Mycobacterium avium subsp. paratuberculosis
gccccgggcgcuggcgauggu

SEQ ID NO: 934447 - RNA, 11 nt, Mycobacterium avium subsp. paratuberculosis
gccccggcggg

SEQ ID NO: 934448 - RNA, 13 nt, Mycobacterium avium subsp. paratuberculosis
gccccggcggguc

SEQ ID NO: 934449 - RNA, 14 nt, Mycobacterium avium subsp. paratuberculosis
gccccggcgucgga

SEQ ID NO: 934450 - RNA, 19 nt, Mycobacterium avium subsp. paratuberculosis
gccccggcgcagcgccgcg

SEQ ID NO: 934451 - RNA, 13 nt, Mycobacterium avium subsp. paratuberculosis
gccccggcgccgu

SEQ ID NO: 934452 - RNA, 17 nt, Mycobacterium avium subsp. paratuberculosis
gccccggcgccgucguu

SEQ ID NO: 934453 - RNA, 14 nt, Mycobacterium avium subsp. paratuberculosis
gccccggcggccac

SEQ ID NO: 934454 - RNA, 15 nt, Mycobacterium avium subsp. paratuberculosis
gccccggcggccacg

SEQ ID NO: 934455 - RNA, 22 nt, Mycobacterium avium subsp. paratuberculosis
gccccggcggccacgcaggcgu

SEQ ID NO: 934456 - RNA, 20 nt, Mycobacterium avium subsp. paratuberculosis
gccccggccugauacgucuu

SEQ ID NO: 934457 - RNA, 20 nt, Mycobacterium avium subsp. paratuberculosis
gccccggcgaacgccucggu

SEQ ID NO: 934458 - RNA, 14 nt, Mycobacterium avium subsp. paratuberculosis
gccccggcgacggc

SEQ ID NO: 934459 - RNA, 15 nt, Mycobacterium avium subsp. paratuberculosis
gccccggcgacggcg

SEQ ID NO: 934460 - RNA, 16 nt, Mycobacterium avium subsp. paratuberculosis
gccccggcgacggcgg

SEQ ID NO: 934461 - RNA, 14 nt, Mycobacterium avium subsp. paratuberculosis
gccccggcgacguc

SEQ ID NO: 934462 - RNA, 18 nt, Mycobacterium avium subsp. paratuberculosis
gccccggcgacgucgccg

SEQ ID NO: 934463 - RNA, 21 nt, Mycobacterium avium subsp. paratuberculosis
gccccggcgacgucgccggcc

SEQ ID NO: 934464 - RNA, 13 nt, Mycobacterium avium subsp. paratuberculosis
gcccgcgcguggu

SEQ ID NO: 934465 - RNA, 13 nt, Mycobacterium avium subsp. paratuberculosis
gcccgcgcuggug

SEQ ID NO: 934466 - RNA, 14 nt, Mycobacterium avium subsp. paratuberculosis
gcccgcgcuggugc

SEQ ID NO: 934467 - RNA, 14 nt, Mycobacterium avium subsp. paratuberculosis
gcccgcggaucgcg

SEQ ID NO: 934468 - RNA, 13 nt, Mycobacterium avium subsp. paratuberculosis
gcccgcgcggcgg

SEQ ID NO: 934469 - RNA, 18 nt, Mycobacterium avium subsp. paratuberculosis
gcccgcgcggcggugucg

SEQ ID NO: 934470 - RNA, 20 nt, Mycobacterium avium subsp. paratuberculosis
gcccgcgcggcucacagcgc

SEQ ID NO: 934471 - RNA, 14 nt, Mycobacterium avium subsp. paratuberculosis
gcccgcggcgcccg

SEQ ID NO: 934472 - RNA, 15 nt, Mycobacterium avium subsp. paratuberculosis
gcccgcggcgcgcag

SEQ ID NO: 934473 - RNA, 16 nt, Mycobacterium avium subsp. paratuberculosis
gcccgcggcgcgcagg

SEQ ID NO: 934474 - RNA, 18 nt, Mycobacterium avium subsp. paratuberculosis
gcccgcggccuccagccg

SEQ ID NO: 934475 - RNA, 17 nt, Mycobacterium avium subsp. paratuberculosis
gcccgcggcaucgucgg

SEQ ID NO: 934476 - RNA, 15 nt, Mycobacterium avium subsp. paratuberculosis
gcccgcggccgccgc

SEQ ID NO: 934477 - RNA, 16 nt, Mycobacterium avium subsp. paratuberculosis
gcccgcggccgccgcc

SEQ ID NO: 934478 - RNA, 19 nt, Mycobacterium avium subsp. paratuberculosis
gcccgcggccgccgccgcg

SEQ ID NO: 934479 - RNA, 20 nt, Mycobacterium avium subsp. paratuberculosis
gcccgcggccgccgccgcgg

SEQ ID NO: 934480 - RNA, 15 nt, Mycobacterium avium subsp. paratuberculosis
gcccgcggccaucgc

SEQ ID NO: 934481 - RNA, 17 nt, Mycobacterium avium subsp. paratuberculosis
gcccgcggaucgcguag

SEQ ID NO: 934482 - RNA, 19 nt, Mycobacterium avium subsp. paratuberculosis
gcccgcggcacgcugcgcc

SEQ ID NO: 934483 - RNA, 23 nt, Mycobacterium avium subsp. paratuberculosis
gcccgcggcacgcugcgccagcc

SEQ ID NO: 934484 - RNA, 13 nt, Mycobacterium avium subsp. paratuberculosis
gcccgcggcagcc

SEQ ID NO: 934485 - RNA, 15 nt, Mycobacterium avium subsp. paratuberculosis
gcccgcggcagccag

SEQ ID NO: 934486 - RNA, 16 nt, Mycobacterium avium subsp. paratuberculosis
gcccgcggcagccagc

SEQ ID NO: 934487 - RNA, 22 nt, Mycobacterium avium subsp. paratuberculosis
gcccgcgugggcaccccgauca

SEQ ID NO: 934488 - RNA, 18 nt, Mycobacterium avium subsp. paratuberculosis
gcccgcguaaccggcggc

SEQ ID NO: 934489 - RNA, 18 nt, Mycobacterium avium subsp. paratuberculosis
gcccgcguacagcaguuc

SEQ ID NO: 934490 - RNA, 14 nt, Mycobacterium avium subsp. paratuberculosis
gcccgcguugcggc

SEQ ID NO: 934491 - RNA, 19 nt, Mycobacterium avium subsp. paratuberculosis
gcccgcguugcggcgcagc

SEQ ID NO: 934492 - RNA, 20 nt, Mycobacterium avium subsp. paratuberculosis
gcccgcguugcggcgcagcg

SEQ ID NO: 934493 - RNA, 21 nt, Mycobacterium avium subsp. paratuberculosis
gcccgcgucgcgcagcaacgg

SEQ ID NO: 934494 - RNA, 15 nt, Mycobacterium avium subsp. paratuberculosis
gcccgcguccagcag

SEQ ID NO: 934495 - RNA, 17 nt, Mycobacterium avium subsp. paratuberculosis
gcccgcguccagcagca

SEQ ID NO: 934496 - RNA, 20 nt, Mycobacterium avium subsp. paratuberculosis
gcccgcguccugcagcgccg

SEQ ID NO: 934497 - RNA, 13 nt, Mycobacterium avium subsp. paratuberculosis
gcccgcgucgugg

SEQ ID NO: 934498 - RNA, 20 nt, Mycobacterium avium subsp. paratuberculosis
gcccgcgucguggcccugcu

SEQ ID NO: 934499 - RNA, 19 nt, Mycobacterium avium subsp. paratuberculosis
gcccgcgucguguccgggc

SEQ ID NO: 934500 - RNA, 21 nt, Mycobacterium avium subsp. paratuberculosis
gcccgcgucguguccgggccc

SEQ ID NO: 934501 - RNA, 20 nt, Mycobacterium avium subsp. paratuberculosis
gcccgcggucaugcgcgggc

SEQ ID NO: 934502 - RNA, 20 nt, Mycobacterium avium subsp. paratuberculosis
gcccgcgguggaacccagca

SEQ ID NO: 934503 - RNA, 22 nt, Mycobacterium avium subsp. paratuberculosis
gcccgcgguggaacccagcacc

SEQ ID NO: 934504 - RNA, 13 nt, Mycobacterium avium subsp. paratuberculosis
gcccgcgggccag

SEQ ID NO: 934505 - RNA, 17 nt, Mycobacterium avium subsp. paratuberculosis
gcccgcgggccagacug

SEQ ID NO: 934506 - RNA, 20 nt, Mycobacterium avium subsp. paratuberculosis
gcccgcggggcguacgcgcu

SEQ ID NO: 934507 - RNA, 18 nt, Mycobacterium avium subsp. paratuberculosis
gcccgcggguagcccguc

SEQ ID NO: 934508 - RNA, 19 nt, Mycobacterium avium subsp. paratuberculosis
gcccgcggguagcccgucg

SEQ ID NO: 934509 - RNA, 21 nt, Mycobacterium avium subsp. paratuberculosis
gcccgcggguagcccgucgac

SEQ ID NO: 934510 - RNA, 22 nt, Mycobacterium avium subsp. paratuberculosis
gcccgcggcggauccagcaccg

SEQ ID NO: 934511 - RNA, 15 nt, Mycobacterium avium subsp. paratuberculosis
gcccgcggcgucauc

SEQ ID NO: 934512 - RNA, 19 nt, Mycobacterium avium subsp. paratuberculosis
gcccgcgggacacggcggc

SEQ ID NO: 934513 - RNA, 17 nt, Mycobacterium avium subsp. paratuberculosis
gcccgcgggaucagcgu

SEQ ID NO: 934514 - RNA, 15 nt, Mycobacterium avium subsp. paratuberculosis
gcccgcgaacacgcg

SEQ ID NO: 934515 - RNA, 21 nt, Mycobacterium avium subsp. paratuberculosis
gcccgcgaacacgcgaugauc

SEQ ID NO: 934516 - RNA, 20 nt, Mycobacterium avium subsp. paratuberculosis
gcccgccuuugagcgacaac

SEQ ID NO: 934517 - RNA, 23 nt, Mycobacterium avium subsp. paratuberculosis
gcccgcgacggcgagccgggccg

SEQ ID NO: 934518 - RNA, 13 nt, Mycobacterium avium subsp. paratuberculosis
gcccgcgacgucg

SEQ ID NO: 934519 - RNA, 14 nt, Mycobacterium avium subsp. paratuberculosis
gcccgcgacgucgg

SEQ ID NO: 934520 - RNA, 15 nt, Mycobacterium avium subsp. paratuberculosis
gcccgcgacugucgg

SEQ ID NO: 934521 - RNA, 18 nt, Mycobacterium avium subsp. paratuberculosis
gcccgcgacugucggcgc

SEQ ID NO: 934522 - RNA, 19 nt, Mycobacterium avium subsp. paratuberculosis
gcccgcgacugucggcgcc

SEQ ID NO: 934523 - RNA, 17 nt, Mycobacterium avium subsp. paratuberculosis
gcccgcgacugucggcu

SEQ ID NO: 934524 - RNA, 18 nt, Mycobacterium avium subsp. paratuberculosis
gcccgcgacugucggcuc

SEQ ID NO: 934525 - RNA, 13 nt, Mycobacterium avium subsp. paratuberculosis
gcccgcgcggccg

SEQ ID NO: 934526 - RNA, 14 nt, Mycobacterium avium subsp. paratuberculosis
gcccgcgcggccgc

SEQ ID NO: 934527 - RNA, 15 nt, Mycobacterium avium subsp. paratuberculosis
gcccgcgcggccgcc

SEQ ID NO: 934528 - RNA, 16 nt, Mycobacterium avium subsp. paratuberculosis
gcccgcgcggccgcca

SEQ ID NO: 934529 - RNA, 12 nt, Mycobacterium avium subsp. paratuberculosis
gcccgcgcggcg

SEQ ID NO: 934530 - RNA, 14 nt, Mycobacterium avium subsp. paratuberculosis
gcccgcgcgcucgg

SEQ ID NO: 934531 - RNA, 14 nt, Mycobacterium avium subsp. paratuberculosis
gcccgcgcgaugcg

SEQ ID NO: 934532 - RNA, 14 nt, Mycobacterium avium subsp. paratuberculosis
gcccgcgcgagcgc

SEQ ID NO: 934533 - RNA, 18 nt, Mycobacterium avium subsp. paratuberculosis
gcccgcgaucggcgccac

SEQ ID NO: 934534 - RNA, 20 nt, Mycobacterium avium subsp. paratuberculosis
gcccgcgaucggcgccacga

SEQ ID NO: 934535 - RNA, 12 nt, Mycobacterium avium subsp. paratuberculosis
gcccgcgccggc

SEQ ID NO: 934536 - RNA, 13 nt, Mycobacterium avium subsp. paratuberculosis
gcccgcgccggcg

SEQ ID NO: 934537 - RNA, 15 nt, Mycobacterium avium subsp. paratuberculosis
gcccgcgccggcgug

SEQ ID NO: 934538 - RNA, 16 nt, Mycobacterium avium subsp. paratuberculosis
gcccgcgaggugucga

SEQ ID NO: 934539 - RNA, 19 nt, Mycobacterium avium subsp. paratuberculosis
gcccgcgaggugucgacgc

SEQ ID NO: 934540 - RNA, 20 nt, Mycobacterium avium subsp. paratuberculosis
gcccgcgaggugucgacgcu

SEQ ID NO: 934541 - RNA, 20 nt, Mycobacterium avium subsp. paratuberculosis
gcccgcgaucaacaccgguc

SEQ ID NO: 934542 - RNA, 15 nt, Mycobacterium avium subsp. paratuberculosis
gcccgcgaucgccag

SEQ ID NO: 934543 - RNA, 19 nt, Mycobacterium avium subsp. paratuberculosis
gcccgcgaucgccagcgcg

SEQ ID NO: 934544 - RNA, 22 nt, Mycobacterium avium subsp. paratuberculosis
gcccgcgaucgccagcgcggug

SEQ ID NO: 934545 - RNA, 13 nt, Mycobacterium avium subsp. paratuberculosis
gcccgccgggccg

SEQ ID NO: 934546 - RNA, 15 nt, Mycobacterium avium subsp. paratuberculosis
gcccgccgggccgga

SEQ ID NO: 934547 - RNA, 12 nt, Mycobacterium avium subsp. paratuberculosis
gcccgccgggcg

SEQ ID NO: 934548 - RNA, 15 nt, Mycobacterium avium subsp. paratuberculosis
gcccgccgggcgcca

SEQ ID NO: 934549 - RNA, 14 nt, Mycobacterium avium subsp. paratuberculosis
gcccgccgggcguc

SEQ ID NO: 934550 - RNA, 19 nt, Mycobacterium avium subsp. paratuberculosis
gcccgccgggcgucgcgcu

SEQ ID NO: 934551 - RNA, 16 nt, Mycobacterium avium subsp. paratuberculosis
gcccgccgggcugacc

SEQ ID NO: 934552 - RNA, 19 nt, Mycobacterium avium subsp. paratuberculosis
gcccgccgggcugaccguc

SEQ ID NO: 934553 - RNA, 23 nt, Mycobacterium avium subsp. paratuberculosis
gcccgccgggcugaccgucgacc

SEQ ID NO: 934554 - RNA, 21 nt, Mycobacterium avium subsp. paratuberculosis
gcccgccgguggccgcgaacg

SEQ ID NO: 934555 - RNA, 19 nt, Mycobacterium avium subsp. paratuberculosis
gcccgccgguggccgcgcu

SEQ ID NO: 934556 - RNA, 21 nt, Mycobacterium avium subsp. paratuberculosis
gcccgccgguggccgcgcugg

SEQ ID NO: 934557 - RNA, 15 nt, Mycobacterium avium subsp. paratuberculosis
gcccgccguagcgcc

SEQ ID NO: 934558 - RNA, 17 nt, Mycobacterium avium subsp. paratuberculosis
gcccgccguagcgccgg

SEQ ID NO: 934559 - RNA, 14 nt, Mycobacterium avium subsp. paratuberculosis
gcccgccggagccg

SEQ ID NO: 934560 - RNA, 12 nt, Mycobacterium avium subsp. paratuberculosis
gcccgccggcgg

SEQ ID NO: 934561 - RNA, 13 nt, Mycobacterium avium subsp. paratuberculosis
gcccgccggcggc

SEQ ID NO: 934562 - RNA, 21 nt, Mycobacterium avium subsp. paratuberculosis
gcccgccggcggcgaugaucg

SEQ ID NO: 934563 - RNA, 13 nt, Mycobacterium avium subsp. paratuberculosis
gcccgccggcguc

SEQ ID NO: 934564 - RNA, 16 nt, Mycobacterium avium subsp. paratuberculosis
gcccgccggcgucugc

SEQ ID NO: 934565 - RNA, 14 nt, Mycobacterium avium subsp. paratuberculosis
gcccgccgggaugc

SEQ ID NO: 934566 - RNA, 20 nt, Mycobacterium avium subsp. paratuberculosis
gcccgccgggaugcgccacc

SEQ ID NO: 934567 - RNA, 14 nt, Mycobacterium avium subsp. paratuberculosis
gcccgccgggcacc

SEQ ID NO: 934568 - RNA, 17 nt, Mycobacterium avium subsp. paratuberculosis
gcccgccgggcacccgg

SEQ ID NO: 934569 - RNA, 21 nt, Mycobacterium avium subsp. paratuberculosis
gcccgccgggcacccgggugg

SEQ ID NO: 934570 - RNA, 19 nt, Mycobacterium avium subsp. paratuberculosis
gcccgccggcccagcucca

SEQ ID NO: 934571 - RNA, 20 nt, Mycobacterium avium subsp. paratuberculosis
gcccgccggcccagcuccac

SEQ ID NO: 934572 - RNA, 16 nt, Mycobacterium avium subsp. paratuberculosis
gcccgccccgcccggc

SEQ ID NO: 934573 - RNA, 17 nt, Mycobacterium avium subsp. paratuberculosis
gcccgccccgcccggcg

SEQ ID NO: 934574 - RNA, 18 nt, Mycobacterium avium subsp. paratuberculosis
gcccgccccgcccggcgg

SEQ ID NO: 934575 - RNA, 11 nt, Mycobacterium avium subsp. paratuberculosis
gcccgccggcg

SEQ ID NO: 934576 - RNA, 15 nt, Mycobacterium avium subsp. paratuberculosis
gcccgcccagcgcca

SEQ ID NO: 934577 - RNA, 17 nt, Mycobacterium avium subsp. paratuberculosis
gcccgcccagcgccacg

SEQ ID NO: 934578 - RNA, 19 nt, Mycobacterium avium subsp. paratuberculosis
gcccgcccagcgccacggu

SEQ ID NO: 934579 - RNA, 23 nt, Mycobacterium avium subsp. paratuberculosis
gcccgcccagcgccacgguggcg

SEQ ID NO: 934580 - RNA, 14 nt, Mycobacterium avium subsp. paratuberculosis
gcccgcccaggccg

SEQ ID NO: 934581 - RNA, 16 nt, Mycobacterium avium subsp. paratuberculosis
gcccgcccaggccgcc

SEQ ID NO: 934582 - RNA, 20 nt, Mycobacterium avium subsp. paratuberculosis
gcccgcccaggccgccagcu

SEQ ID NO: 934583 - RNA, 14 nt, Mycobacterium avium subsp. paratuberculosis
gcccgcccacgggu

SEQ ID NO: 934584 - RNA, 22 nt, Mycobacterium avium subsp. paratuberculosis
gcccgcccacgggucgccgauc

SEQ ID NO: 934585 - RNA, 12 nt, Mycobacterium avium subsp. paratuberculosis
gcccgccaucgc

SEQ ID NO: 934586 - RNA, 13 nt, Mycobacterium avium subsp. paratuberculosis
gcccgccccgacg

SEQ ID NO: 934587 - RNA, 22 nt, Mycobacterium avium subsp. paratuberculosis
gcccgccccgacgugcagcgcc

SEQ ID NO: 934588 - RNA, 13 nt, Mycobacterium avium subsp. paratuberculosis
gcccgcaccaccc

SEQ ID NO: 934589 - RNA, 19 nt, Mycobacterium avium subsp. paratuberculosis
gcccgcagcgccucggcgu

SEQ ID NO: 934590 - RNA, 19 nt, Mycobacterium avium subsp. paratuberculosis
gcccgcaacuccacaacca

SEQ ID NO: 934591 - RNA, 16 nt, Mycobacterium avium subsp. paratuberculosis
gcccgauggcggccug

SEQ ID NO: 934592 - RNA, 16 nt, Mycobacterium avium subsp. paratuberculosis
gcccgauucagccggc

SEQ ID NO: 934593 - RNA, 21 nt, Mycobacterium avium subsp. paratuberculosis
gcccgauucagccggcgguuc

SEQ ID NO: 934594 - RNA, 18 nt, Mycobacterium avium subsp. paratuberculosis
gcccgauuccccggcgug

SEQ ID NO: 934595 - RNA, 20 nt, Mycobacterium avium subsp. paratuberculosis
gcccgauucgcuuacugcga

SEQ ID NO: 934596 - RNA, 17 nt, Mycobacterium avium subsp. paratuberculosis
gcccgcaaaucagccga

SEQ ID NO: 934597 - RNA, 19 nt, Mycobacterium avium subsp. paratuberculosis
gcccgcaaaucagccgagc

SEQ ID NO: 934598 - RNA, 21 nt, Mycobacterium avium subsp. paratuberculosis
gcccgaugcuggccaucgccg

SEQ ID NO: 934599 - RNA, 15 nt, Mycobacterium avium subsp. paratuberculosis
gcccgaugcggaccg

SEQ ID NO: 934600 - RNA, 13 nt, Mycobacterium avium subsp. paratuberculosis
gcccgaucggcac

SEQ ID NO: 934601 - RNA, 16 nt, Mycobacterium avium subsp. paratuberculosis
gcccgaucggcacccg

SEQ ID NO: 934602 - RNA, 17 nt, Mycobacterium avium subsp. paratuberculosis
gcccgaucggcacccgc

SEQ ID NO: 934603 - RNA, 23 nt, Mycobacterium avium subsp. paratuberculosis
gcccgaucggcacccgcaacacc

SEQ ID NO: 934604 - RNA, 13 nt, Mycobacterium avium subsp. paratuberculosis
gcccgaucggcgu

SEQ ID NO: 934605 - RNA, 14 nt, Mycobacterium avium subsp. paratuberculosis
gcccgaucggcgug

SEQ ID NO: 934606 - RNA, 21 nt, Mycobacterium avium subsp. paratuberculosis
gcccgaucgugcgcccauccg

SEQ ID NO: 934607 - RNA, 15 nt, Mycobacterium avium subsp. paratuberculosis
gcccgaucucgcgcg

SEQ ID NO: 934608 - RNA, 16 nt, Mycobacterium avium subsp. paratuberculosis
gcccgaucucgcgcgg

SEQ ID NO: 934609 - RNA, 21 nt, Mycobacterium avium subsp. paratuberculosis
gcccgaucucgcgcgggucga

SEQ ID NO: 934610 - RNA, 18 nt, Mycobacterium avium subsp. paratuberculosis
gcccgaucucgcggucga

SEQ ID NO: 934611 - RNA, 17 nt, Mycobacterium avium subsp. paratuberculosis
gcccgaucucgucggug

SEQ ID NO: 934612 - RNA, 23 nt, Mycobacterium avium subsp. paratuberculosis
gcccgaucugauaggucagcucg

SEQ ID NO: 934613 - RNA, 22 nt, Mycobacterium avium subsp. paratuberculosis
gcccgaucugggaucggugcgc

SEQ ID NO: 934614 - RNA, 19 nt, Mycobacterium avium subsp. paratuberculosis
gcccgaugaaguacccggu

SEQ ID NO: 934615 - RNA, 15 nt, Mycobacterium avium subsp. paratuberculosis
gcccgccaucgcccg

SEQ ID NO: 934616 - RNA, 17 nt, Mycobacterium avium subsp. paratuberculosis
gcccgccaucgcccggu

SEQ ID NO: 934617 - RNA, 18 nt, Mycobacterium avium subsp. paratuberculosis
gcccgccaucgcccggug

SEQ ID NO: 934618 - RNA, 17 nt, Mycobacterium avium subsp. paratuberculosis
gcccgcaugcaccggug

SEQ ID NO: 934619 - RNA, 12 nt, Mycobacterium avium subsp. paratuberculosis
gcccgcccacca

SEQ ID NO: 934620 - RNA, 13 nt, Mycobacterium avium subsp. paratuberculosis
gcccgcccaccac

SEQ ID NO: 934621 - RNA, 19 nt, Mycobacterium avium subsp. paratuberculosis
gcccgcccaccacgaacgc

SEQ ID NO: 934622 - RNA, 22 nt, Mycobacterium avium subsp. paratuberculosis
gcccgcauguucucgagcccga

SEQ ID NO: 934623 - RNA, 18 nt, Mycobacterium avium subsp. paratuberculosis
gcccgccaaaacggggug

SEQ ID NO: 934624 - RNA, 18 nt, Mycobacterium avium subsp. paratuberculosis
gcccgcaguucggccgcc

SEQ ID NO: 934625 - RNA, 22 nt, Mycobacterium avium subsp. paratuberculosis
gcccgcaguucggccgccgugc

SEQ ID NO: 934626 - RNA, 20 nt, Mycobacterium avium subsp. paratuberculosis
gcccgcaggaucgagccggc

SEQ ID NO: 934627 - RNA, 23 nt, Mycobacterium avium subsp. paratuberculosis
gcccgcaggaucgagccggccgu

SEQ ID NO: 934628 - RNA, 16 nt, Mycobacterium avium subsp. paratuberculosis
gcccgcaucgcggcga

SEQ ID NO: 934629 - RNA, 17 nt, Mycobacterium avium subsp. paratuberculosis
gcccgcaucgcggcgau

SEQ ID NO: 934630 - RNA, 20 nt, Mycobacterium avium subsp. paratuberculosis
gcccgcaucgcggcgauggu

SEQ ID NO: 934631 - RNA, 14 nt, Mycobacterium avium subsp. paratuberculosis
gcccgcaucgcaca

SEQ ID NO: 934632 - RNA, 15 nt, Mycobacterium avium subsp. paratuberculosis
gcccgcaucgccgaa

SEQ ID NO: 934633 - RNA, 15 nt, Mycobacterium avium subsp. paratuberculosis
gccccugcggggugu

SEQ ID NO: 934634 - RNA, 16 nt, Mycobacterium avium subsp. paratuberculosis
gccccugcgggguguc

SEQ ID NO: 934635 - RNA, 23 nt, Mycobacterium avium subsp. paratuberculosis
gcccgaggucauaucgacggccc

SEQ ID NO: 934636 - RNA, 16 nt, Mycobacterium avium subsp. paratuberculosis
gcccgagguccucgcg

SEQ ID NO: 934637 - RNA, 19 nt, Mycobacterium avium subsp. paratuberculosis
gcccgagguccucgcgcaa

SEQ ID NO: 934638 - RNA, 14 nt, Mycobacterium avium subsp. paratuberculosis
gccccucggggcug

SEQ ID NO: 934639 - RNA, 19 nt, Mycobacterium avium subsp. paratuberculosis
gccccucggggcugcgcgg

SEQ ID NO: 934640 - RNA, 19 nt, Mycobacterium avium subsp. paratuberculosis
gccccucguccaggugcac

SEQ ID NO: 934641 - RNA, 22 nt, Mycobacterium avium subsp. paratuberculosis
gccccucguccaggugcacccg

SEQ ID NO: 934642 - RNA, 18 nt, Mycobacterium avium subsp. paratuberculosis
gccccucgacccgaagcc

SEQ ID NO: 934643 - RNA, 22 nt, Mycobacterium avium subsp. paratuberculosis
gccccucgacguccaggccggc

SEQ ID NO: 934644 - RNA, 23 nt, Mycobacterium avium subsp. paratuberculosis
gccccucgacguccaggccggcg

SEQ ID NO: 934645 - RNA, 19 nt, Mycobacterium avium subsp. paratuberculosis
gccccucgccgggcgucac

SEQ ID NO: 934646 - RNA, 15 nt, Mycobacterium avium subsp. paratuberculosis
gccccugcaccacga

SEQ ID NO: 934647 - RNA, 17 nt, Mycobacterium avium subsp. paratuberculosis
gccccugcaccacgaag

SEQ ID NO: 934648 - RNA, 13 nt, Mycobacterium avium subsp. paratuberculosis
gcccgaucgcggc

SEQ ID NO: 934649 - RNA, 15 nt, Mycobacterium avium subsp. paratuberculosis
gcccgaucgcgucga

SEQ ID NO: 934650 - RNA, 17 nt, Mycobacterium avium subsp. paratuberculosis
gcccgaucgcgucgacg

SEQ ID NO: 934651 - RNA, 19 nt, Mycobacterium avium subsp. paratuberculosis
gcccgaucgcgucgacgau

SEQ ID NO: 934652 - RNA, 21 nt, Mycobacterium avium subsp. paratuberculosis
gcccgaucgcgucgacgaugg

SEQ ID NO: 934653 - RNA, 16 nt, Mycobacterium avium subsp. paratuberculosis
gcccgaucacccccga

SEQ ID NO: 934654 - RNA, 15 nt, Mycobacterium avium subsp. paratuberculosis
gcccgaucaccgccg

SEQ ID NO: 934655 - RNA, 13 nt, Mycobacterium avium subsp. paratuberculosis
gcccgaucagccg

SEQ ID NO: 934656 - RNA, 13 nt, Mycobacterium avium subsp. paratuberculosis
gcccgaucaucuc

SEQ ID NO: 934657 - RNA, 22 nt, Mycobacterium avium subsp. paratuberculosis
gcccgaucaucucaccgacgac

SEQ ID NO: 934658 - RNA, 23 nt, Mycobacterium avium subsp. paratuberculosis
gcccgaucaucucaccgacgacc

SEQ ID NO: 934659 - RNA, 15 nt, Mycobacterium avium subsp. paratuberculosis
gcccgaucccgggcc

SEQ ID NO: 934660 - RNA, 22 nt, Mycobacterium avium subsp. paratuberculosis
gcccgaucccgggccguucagc

SEQ ID NO: 934661 - RNA, 15 nt, Mycobacterium avium subsp. paratuberculosis
gcccgaucaccaggc

SEQ ID NO: 934662 - RNA, 18 nt, Mycobacterium avium subsp. paratuberculosis
gcccgaucaccaggccca

SEQ ID NO: 934663 - RNA, 19 nt, Mycobacterium avium subsp. paratuberculosis
gcccgaucaccaggcccag

SEQ ID NO: 934664 - RNA, 19 nt, Mycobacterium avium subsp. paratuberculosis
gcccgauagcuugagcccc

SEQ ID NO: 934665 - RNA, 18 nt, Mycobacterium avium subsp. paratuberculosis
gcccgauaggccgacugg

SEQ ID NO: 934666 - RNA, 16 nt, Mycobacterium avium subsp. paratuberculosis
gccaagugcggucggu

SEQ ID NO: 934667 - RNA, 23 nt, Mycobacterium avium subsp. paratuberculosis
gccaaguagacucagcgucgaug

SEQ ID NO: 934668 - RNA, 15 nt, Mycobacterium avium subsp. paratuberculosis
gccaauaaagcgggc

SEQ ID NO: 934669 - RNA, 14 nt, Mycobacterium avium subsp. paratuberculosis
gccaauacacuucg

SEQ ID NO: 934670 - RNA, 15 nt, Mycobacterium avium subsp. paratuberculosis
gccaagauugggcca

SEQ ID NO: 934671 - RNA, 23 nt, Mycobacterium avium subsp. paratuberculosis
gccaaggggaacaacgcgcacaa

SEQ ID NO: 934672 - RNA, 16 nt, Mycobacterium avium subsp. paratuberculosis
gccacagcagcaccag

SEQ ID NO: 934673 - RNA, 18 nt, Mycobacterium avium subsp. paratuberculosis
gccacagcagcaccagcg

SEQ ID NO: 934674 - RNA, 20 nt, Mycobacterium avium subsp. paratuberculosis
gccacagcagcaccagcgcg

SEQ ID NO: 934675 - RNA, 23 nt, Mycobacterium avium subsp. paratuberculosis
gccacacuggcgugacgcucggc

SEQ ID NO: 934676 - RNA, 17 nt, Mycobacterium avium subsp. paratuberculosis
gccacagcgccucgcgg

SEQ ID NO: 934677 - RNA, 12 nt, Mycobacterium avium subsp. paratuberculosis
gccacagccgca

SEQ ID NO: 934678 - RNA, 15 nt, Mycobacterium avium subsp. paratuberculosis
gccacagccgcaugu

SEQ ID NO: 934679 - RNA, 16 nt, Mycobacterium avium subsp. paratuberculosis
gccaauuacgcugcgg

SEQ ID NO: 934680 - RNA, 17 nt, Mycobacterium avium subsp. paratuberculosis
gccaauuacgcugcggc

SEQ ID NO: 934681 - RNA, 19 nt, Mycobacterium avium subsp. paratuberculosis
gccaauuacgcugcggcgc

SEQ ID NO: 934682 - RNA, 18 nt, Mycobacterium avium subsp. paratuberculosis
gccaaugguuuucgucga

SEQ ID NO: 934683 - RNA, 15 nt, Mycobacterium avium subsp. paratuberculosis
gccacaaacagcgcg

SEQ ID NO: 934684 - RNA, 18 nt, Mycobacterium avium subsp. paratuberculosis
gccacaaacagcgcggcc

SEQ ID NO: 934685 - RNA, 19 nt, Mycobacterium avium subsp. paratuberculosis
gccacaaacagcgcggccg

SEQ ID NO: 934686 - RNA, 19 nt, Mycobacterium avium subsp. paratuberculosis
gcagucgugacgcggcguc

SEQ ID NO: 934687 - RNA, 21 nt, Mycobacterium avium subsp. paratuberculosis
gcagucuuaucuaucuucggc

SEQ ID NO: 934688 - RNA, 15 nt, Mycobacterium avium subsp. paratuberculosis
gccaacuccggcggc

SEQ ID NO: 934689 - RNA, 16 nt, Mycobacterium avium subsp. paratuberculosis
gccaacuccggcggca

SEQ ID NO: 934690 - RNA, 17 nt, Mycobacterium avium subsp. paratuberculosis
gccaacuccggcggcag

SEQ ID NO: 934691 - RNA, 22 nt, Mycobacterium avium subsp. paratuberculosis
gccaacuccggcggcagccagg

SEQ ID NO: 934692 - RNA, 18 nt, Mycobacterium avium subsp. paratuberculosis
gccaagacguccgcgucg

SEQ ID NO: 934693 - RNA, 19 nt, Mycobacterium avium subsp. paratuberculosis
gccaagacguccgcgucgg

SEQ ID NO: 934694 - RNA, 20 nt, Mycobacterium avium subsp. paratuberculosis
gccaagacguccgcgucggc

SEQ ID NO: 934695 - RNA, 19 nt, Mycobacterium avium subsp. paratuberculosis
gccaacugaauuccuggcc

SEQ ID NO: 934696 - RNA, 22 nt, Mycobacterium avium subsp. paratuberculosis
gccaacugggugggugcggugc

SEQ ID NO: 934697 - RNA, 19 nt, Mycobacterium avium subsp. paratuberculosis
gcaguccggcgaguacccg

SEQ ID NO: 934698 - RNA, 16 nt, Mycobacterium avium subsp. paratuberculosis
gcaguccggcggucag

SEQ ID NO: 934699 - RNA, 20 nt, Mycobacterium avium subsp. paratuberculosis
gcaguccggacacggccagc

SEQ ID NO: 934700 - RNA, 22 nt, Mycobacterium avium subsp. paratuberculosis
gcaguccggacacggccagcgc

SEQ ID NO: 934701 - RNA, 23 nt, Mycobacterium avium subsp. paratuberculosis
gcaguccggacacggccagcgcc

SEQ ID NO: 934702 - RNA, 14 nt, Mycobacterium avium subsp. paratuberculosis
gcaguccgcgccgg

SEQ ID NO: 934703 - RNA, 15 nt, Mycobacterium avium subsp. paratuberculosis
gcaguccgcgccggu

SEQ ID NO: 934704 - RNA, 19 nt, Mycobacterium avium subsp. paratuberculosis
gcaguccgcgccggucccg

SEQ ID NO: 934705 - RNA, 18 nt, Mycobacterium avium subsp. paratuberculosis
gcaguccagggugguggu

SEQ ID NO: 934706 - RNA, 21 nt, Mycobacterium avium subsp. paratuberculosis
gcaguccaaaaacugcgcguc

SEQ ID NO: 934707 - RNA, 14 nt, Mycobacterium avium subsp. paratuberculosis
gcagucgcuggucg

SEQ ID NO: 934708 - RNA, 20 nt, Mycobacterium avium subsp. paratuberculosis
gcagucgcagcagcagcccg

SEQ ID NO: 934709 - RNA, 14 nt, Mycobacterium avium subsp. paratuberculosis
gcagucggccggau

SEQ ID NO: 934710 - RNA, 18 nt, Mycobacterium avium subsp. paratuberculosis
gcagucggccugcagcuc

SEQ ID NO: 934711 - RNA, 22 nt, Mycobacterium avium subsp. paratuberculosis
gcagucggcgucgcggcgcacc

SEQ ID NO: 934712 - RNA, 16 nt, Mycobacterium avium subsp. paratuberculosis
gcagucguucggccag

SEQ ID NO: 934713 - RNA, 17 nt, Mycobacterium avium subsp. paratuberculosis
gcagucgaucaccgaga

SEQ ID NO: 934714 - RNA, 19 nt, Mycobacterium avium subsp. paratuberculosis
gcagucgaucucgucgcac

SEQ ID NO: 934715 - RNA, 16 nt, Mycobacterium avium subsp. paratuberculosis
gcagucgcaggccccg

SEQ ID NO: 934716 - RNA, 18 nt, Mycobacterium avium subsp. paratuberculosis
gcagucgcaggccccgga

SEQ ID NO: 934717 - RNA, 16 nt, Mycobacterium avium subsp. paratuberculosis
gccaccaugucggcgu

SEQ ID NO: 934718 - RNA, 18 nt, Mycobacterium avium subsp. paratuberculosis
gccaccaugucggcgucg

SEQ ID NO: 934719 - RNA, 22 nt, Mycobacterium avium subsp. paratuberculosis
gccaccaugucggcgucgccga

SEQ ID NO: 934720 - RNA, 17 nt, Mycobacterium avium subsp. paratuberculosis
gccaccaucuccgcggc

SEQ ID NO: 934721 - RNA, 21 nt, Mycobacterium avium subsp. paratuberculosis
gccaccaucgaguaggcccag

SEQ ID NO: 934722 - RNA, 23 nt, Mycobacterium avium subsp. paratuberculosis
gccaccaucgaguaggcccaguc

SEQ ID NO: 934723 - RNA, 18 nt, Mycobacterium avium subsp. paratuberculosis
gccaccaucaggccggcc

SEQ ID NO: 934724 - RNA, 23 nt, Mycobacterium avium subsp. paratuberculosis
gccaccagggucucgcgcagcac

SEQ ID NO: 934725 - RNA, 16 nt, Mycobacterium avium subsp. paratuberculosis
gccaccaggucgcaca

SEQ ID NO: 934726 - RNA, 20 nt, Mycobacterium avium subsp. paratuberculosis
gccaccaggucgcacaccag

SEQ ID NO: 934727 - RNA, 21 nt, Mycobacterium avium subsp. paratuberculosis
gccaccccccaguuucccguc

SEQ ID NO: 934728 - RNA, 13 nt, Mycobacterium avium subsp. paratuberculosis
gccaccccgagcu

SEQ ID NO: 934729 - RNA, 18 nt, Mycobacterium avium subsp. paratuberculosis
gccaccccaggcgaugcc

SEQ ID NO: 934730 - RNA, 16 nt, Mycobacterium avium subsp. paratuberculosis
gccaccccgagcucgg

SEQ ID NO: 934731 - RNA, 21 nt, Mycobacterium avium subsp. paratuberculosis
gccaccccgagcucgggcgcg

SEQ ID NO: 934732 - RNA, 15 nt, Mycobacterium avium subsp. paratuberculosis
gccaccagcgcaggu

SEQ ID NO: 934733 - RNA, 13 nt, Mycobacterium avium subsp. paratuberculosis
gccaccagcagcg

SEQ ID NO: 934734 - RNA, 14 nt, Mycobacterium avium subsp. paratuberculosis
gccaccagcagcga

SEQ ID NO: 934735 - RNA, 19 nt, Mycobacterium avium subsp. paratuberculosis
gccaccagcagcgagaccg

SEQ ID NO: 934736 - RNA, 12 nt, Mycobacterium avium subsp. paratuberculosis
gccaccagcgca

SEQ ID NO: 934737 - RNA, 13 nt, Mycobacterium avium subsp. paratuberculosis
gccaccagcgcac

SEQ ID NO: 934738 - RNA, 14 nt, Mycobacterium avium subsp. paratuberculosis
gccaccagaucgug

SEQ ID NO: 934739 - RNA, 23 nt, Mycobacterium avium subsp. paratuberculosis
gccaccagaucguguccgcgccg

SEQ ID NO: 934740 - RNA, 16 nt, Mycobacterium avium subsp. paratuberculosis
gccaccagcaccggga

SEQ ID NO: 934741 - RNA, 13 nt, Mycobacterium avium subsp. paratuberculosis
gccaccagcaggc

SEQ ID NO: 934742 - RNA, 14 nt, Mycobacterium avium subsp. paratuberculosis
gccaccagcaggcc

SEQ ID NO: 934743 - RNA, 16 nt, Mycobacterium avium subsp. paratuberculosis
gccaccagccacaccg

SEQ ID NO: 934744 - RNA, 19 nt, Mycobacterium avium subsp. paratuberculosis
gccaccagccacaccgccg

SEQ ID NO: 934745 - RNA, 21 nt, Mycobacterium avium subsp. paratuberculosis
gccaccagccacaccgccgcg

SEQ ID NO: 934746 - RNA, 15 nt, Mycobacterium avium subsp. paratuberculosis
gccaccagcgcggcc

SEQ ID NO: 934747 - RNA, 18 nt, Mycobacterium avium subsp. paratuberculosis
gccaccaggccgaagacg

SEQ ID NO: 934748 - RNA, 13 nt, Mycobacterium avium subsp. paratuberculosis
gccaccagcggcc

SEQ ID NO: 934749 - RNA, 19 nt, Mycobacterium avium subsp. paratuberculosis
gccaccagggacaugccga

SEQ ID NO: 934750 - RNA, 16 nt, Mycobacterium avium subsp. paratuberculosis
gccaccaggcgguccg

SEQ ID NO: 934751 - RNA, 23 nt, Mycobacterium avium subsp. paratuberculosis
gccaccaggcgguccgacaccgc

SEQ ID NO: 934752 - RNA, 18 nt, Mycobacterium avium subsp. paratuberculosis
gccaccaggcugaacguc

SEQ ID NO: 934753 - RNA, 12 nt, Mycobacterium avium subsp. paratuberculosis
gccaccaggcgc

SEQ ID NO: 934754 - RNA, 15 nt, Mycobacterium avium subsp. paratuberculosis
gccaccaggcgccgu

SEQ ID NO: 934755 - RNA, 17 nt, Mycobacterium avium subsp. paratuberculosis
gccaccaggcgccgucg

SEQ ID NO: 934756 - RNA, 20 nt, Mycobacterium avium subsp. paratuberculosis
gccaccaggcgccgucgaug

SEQ ID NO: 934757 - RNA, 14 nt, Mycobacterium avium subsp. paratuberculosis
gccacagcucgggc

SEQ ID NO: 934758 - RNA, 18 nt, Mycobacterium avium subsp. paratuberculosis
gccaccaacaucgacgug

SEQ ID NO: 934759 - RNA, 15 nt, Mycobacterium avium subsp. paratuberculosis
gccacaggccgaaca

SEQ ID NO: 934760 - RNA, 22 nt, Mycobacterium avium subsp. paratuberculosis
gccacagcgacagggugccgaa

SEQ ID NO: 934761 - RNA, 16 nt, Mycobacterium avium subsp. paratuberculosis
gccacagcggcgacag

SEQ ID NO: 934762 - RNA, 22 nt, Mycobacterium avium subsp. paratuberculosis
gccacagcgucucgaccgcggu

SEQ ID NO: 934763 - RNA, 23 nt, Mycobacterium avium subsp. paratuberculosis
gccacagcgucucgaccgcggug

SEQ ID NO: 934764 - RNA, 14 nt, Mycobacterium avium subsp. paratuberculosis
gccaccacccggcg

SEQ ID NO: 934765 - RNA, 15 nt, Mycobacterium avium subsp. paratuberculosis
gccaccacccggcga

SEQ ID NO: 934766 - RNA, 16 nt, Mycobacterium avium subsp. paratuberculosis
gccaccacccggcgau

SEQ ID NO: 934767 - RNA, 13 nt, Mycobacterium avium subsp. paratuberculosis
gccaccaccgcca

SEQ ID NO: 934768 - RNA, 14 nt, Mycobacterium avium subsp. paratuberculosis
gccaccaccgccac

SEQ ID NO: 934769 - RNA, 14 nt, Mycobacterium avium subsp. paratuberculosis
gccaccacaguggc

SEQ ID NO: 934770 - RNA, 16 nt, Mycobacterium avium subsp. paratuberculosis
gccaccacaguggccg

SEQ ID NO: 934771 - RNA, 21 nt, Mycobacterium avium subsp. paratuberculosis
gccaccacaucgcuggggugc

SEQ ID NO: 934772 - RNA, 17 nt, Mycobacterium avium subsp. paratuberculosis
gccaccacauuggcgac

SEQ ID NO: 934773 - RNA, 20 nt, Mycobacterium avium subsp. paratuberculosis
gccaccacauuggcgaccgc

SEQ ID NO: 934774 - RNA, 21 nt, Mycobacterium avium subsp. paratuberculosis
gccaccacauuggcgaccgcg

SEQ ID NO: 934775 - RNA, 22 nt, Mycobacterium avium subsp. paratuberculosis
gccaccacauuggcgaccgcgg

SEQ ID NO: 934776 - RNA, 20 nt, Mycobacterium avium subsp. paratuberculosis
gccaccaccacggccgccga

SEQ ID NO: 934777 - RNA, 23 nt, Mycobacterium avium subsp. paratuberculosis
gccaccaccacggccgccgaggc

SEQ ID NO: 934778 - RNA, 15 nt, Mycobacterium avium subsp. paratuberculosis
gccaccaccacgggg

SEQ ID NO: 934779 - RNA, 23 nt, Mycobacterium avium subsp. paratuberculosis
gccaccaccacggggcgggucgu

SEQ ID NO: 934780 - RNA, 21 nt, Mycobacterium avium subsp. paratuberculosis
gccaccaccacggagcgcccg

SEQ ID NO: 934781 - RNA, 15 nt, Mycobacterium avium subsp. paratuberculosis
gccaccaccacggcc

SEQ ID NO: 934782 - RNA, 13 nt, Mycobacterium avium subsp. paratuberculosis
gccaccaccagcg

SEQ ID NO: 934783 - RNA, 16 nt, Mycobacterium avium subsp. paratuberculosis
gccaccaccagcgggc

SEQ ID NO: 934784 - RNA, 21 nt, Mycobacterium avium subsp. paratuberculosis
gccaccaccuucaucgccguc

SEQ ID NO: 934785 - RNA, 22 nt, Mycobacterium avium subsp. paratuberculosis
gccaccaccuucaucgccgucg

SEQ ID NO: 934786 - RNA, 17 nt, Mycobacterium avium subsp. paratuberculosis
gccaccacgacgccggg

SEQ ID NO: 934787 - RNA, 16 nt, Mycobacterium avium subsp. paratuberculosis
gccaccacgacgggga

SEQ ID NO: 934788 - RNA, 15 nt, Mycobacterium avium subsp. paratuberculosis
gccaccacgauguug

SEQ ID NO: 934789 - RNA, 21 nt, Mycobacterium avium subsp. paratuberculosis
gccaccaccuccucgcgggcg

SEQ ID NO: 934790 - RNA, 22 nt, Mycobacterium avium subsp. paratuberculosis
gccaccaccuccucgcgggcga

SEQ ID NO: 934791 - RNA, 18 nt, Mycobacterium avium subsp. paratuberculosis
gccaccaccucgcgggcg

SEQ ID NO: 934792 - RNA, 19 nt, Mycobacterium avium subsp. paratuberculosis
gccaccaccucgcgggcga

SEQ ID NO: 934793 - RNA, 13 nt, Mycobacterium avium subsp. paratuberculosis
gccaccaccgcgc

SEQ ID NO: 934794 - RNA, 14 nt, Mycobacterium avium subsp. paratuberculosis
gccaccaccgcgcc

SEQ ID NO: 934795 - RNA, 16 nt, Mycobacterium avium subsp. paratuberculosis
gccaccaccgcgccgu

SEQ ID NO: 934796 - RNA, 17 nt, Mycobacterium avium subsp. paratuberculosis
gccaccaccgcgccguc

SEQ ID NO: 934797 - RNA, 21 nt, Mycobacterium avium subsp. paratuberculosis
gccaccaccgcgccgucgucg

SEQ ID NO: 934798 - RNA, 22 nt, Mycobacterium avium subsp. paratuberculosis
gccaccaccgcgccgucgucgu

SEQ ID NO: 934799 - RNA, 15 nt, Mycobacterium avium subsp. paratuberculosis
gccaccacugcgccg

SEQ ID NO: 934800 - RNA, 22 nt, Mycobacterium avium subsp. paratuberculosis
gccaccacugcgccgucaucga

SEQ ID NO: 934801 - RNA, 22 nt, Mycobacterium avium subsp. paratuberculosis
gccaccacgugcgcguugguca

SEQ ID NO: 934802 - RNA, 17 nt, Mycobacterium avium subsp. paratuberculosis
gccaccagaccggcgaa

SEQ ID NO: 934803 - RNA, 19 nt, Mycobacterium avium subsp. paratuberculosis
gccaccagaccggcgaagc

SEQ ID NO: 934804 - RNA, 22 nt, Mycobacterium avium subsp. paratuberculosis
gccaccacgcccuuguuguucc

SEQ ID NO: 934805 - RNA, 16 nt, Mycobacterium avium subsp. paratuberculosis
gccaccacggcgucgc

SEQ ID NO: 934806 - RNA, 19 nt, Mycobacterium avium subsp. paratuberculosis
gccaccacggcgucgcuga

SEQ ID NO: 934807 - RNA, 20 nt, Mycobacterium avium subsp. paratuberculosis
gccaccacgggucggucggc

SEQ ID NO: 934808 - RNA, 20 nt, Mycobacterium avium subsp. paratuberculosis
gccaccacgguggugucguc

SEQ ID NO: 934809 - RNA, 22 nt, Mycobacterium avium subsp. paratuberculosis
gccaccacgguggugucgucgg

SEQ ID NO: 934810 - RNA, 19 nt, Mycobacterium avium subsp. paratuberculosis
gccacuggcuggucaccca

SEQ ID NO: 934811 - RNA, 14 nt, Mycobacterium avium subsp. paratuberculosis
gccacugggcgucg

SEQ ID NO: 934812 - RNA, 19 nt, Mycobacterium avium subsp. paratuberculosis
gccacugggcgucggcgcc

SEQ ID NO: 934813 - RNA, 14 nt, Mycobacterium avium subsp. paratuberculosis
gccacuggcgccac

SEQ ID NO: 934814 - RNA, 20 nt, Mycobacterium avium subsp. paratuberculosis
gccacuccauccggaacacg

SEQ ID NO: 934815 - RNA, 13 nt, Mycobacterium avium subsp. paratuberculosis
gccacguggucgc

SEQ ID NO: 934816 - RNA, 18 nt, Mycobacterium avium subsp. paratuberculosis
gccacuccaccaccggcc

SEQ ID NO: 934817 - RNA, 20 nt, Mycobacterium avium subsp. paratuberculosis
gccacuccaccaccggccgc

SEQ ID NO: 934818 - RNA, 21 nt, Mycobacterium avium subsp. paratuberculosis
gccacuccaccaccggccgcg

SEQ ID NO: 934819 - RNA, 13 nt, Mycobacterium avium subsp. paratuberculosis
gccacggagucgg

SEQ ID NO: 934820 - RNA, 23 nt, Mycobacterium avium subsp. paratuberculosis
gccacggagucgguuucgaccug

SEQ ID NO: 934821 - RNA, 22 nt, Mycobacterium avium subsp. paratuberculosis
gccacguaguccgacgauccgg

SEQ ID NO: 934822 - RNA, 19 nt, Mycobacterium avium subsp. paratuberculosis
gccacguaucgcgccugca

SEQ ID NO: 934823 - RNA, 17 nt, Mycobacterium avium subsp. paratuberculosis
gccacgguuucgccgua

SEQ ID NO: 934824 - RNA, 18 nt, Mycobacterium avium subsp. paratuberculosis
gccacgguuucgccguac

SEQ ID NO: 934825 - RNA, 16 nt, Mycobacterium avium subsp. paratuberculosis
gccacguacaccggga

SEQ ID NO: 934826 - RNA, 23 nt, Mycobacterium avium subsp. paratuberculosis
gccacgucguucaugaucggcag

SEQ ID NO: 934827 - RNA, 15 nt, Mycobacterium avium subsp. paratuberculosis
gccacgucgaugccg

SEQ ID NO: 934828 - RNA, 17 nt, Mycobacterium avium subsp. paratuberculosis
gccacgucgaugccgaa

SEQ ID NO: 934829 - RNA, 19 nt, Mycobacterium avium subsp. paratuberculosis
gccacgucgaugccgaacc

SEQ ID NO: 934830 - RNA, 19 nt, Mycobacterium avium subsp. paratuberculosis
gccaccucgucccagcgca

SEQ ID NO: 934831 - RNA, 16 nt, Mycobacterium avium subsp. paratuberculosis
gccaccucgucggcgg

SEQ ID NO: 934832 - RNA, 16 nt, Mycobacterium avium subsp. paratuberculosis
gccaccugggcggggc

SEQ ID NO: 934833 - RNA, 23 nt, Mycobacterium avium subsp. paratuberculosis
gccaccuggaagcgcaucgccgg

SEQ ID NO: 934834 - RNA, 14 nt, Mycobacterium avium subsp. paratuberculosis
gccacgccguggcc

SEQ ID NO: 934835 - RNA, 21 nt, Mycobacterium avium subsp. paratuberculosis
gccacgccguggcccgcccag

SEQ ID NO: 934836 - RNA, 15 nt, Mycobacterium avium subsp. paratuberculosis
gccacgccguugggc

SEQ ID NO: 934837 - RNA, 23 nt, Mycobacterium avium subsp. paratuberculosis
gccacgccgggcauccgcccgua

SEQ ID NO: 934838 - RNA, 21 nt, Mycobacterium avium subsp. paratuberculosis
gccacgccggguuuguccggc

SEQ ID NO: 934839 - RNA, 19 nt, Mycobacterium avium subsp. paratuberculosis
gccacgccgcccccgccgc

SEQ ID NO: 934840 - RNA, 20 nt, Mycobacterium avium subsp. paratuberculosis
gccacgccgcccccgccgcg

SEQ ID NO: 934841 - RNA, 21 nt, Mycobacterium avium subsp. paratuberculosis
gccaccuuggacaggcccagc

SEQ ID NO: 934842 - RNA, 16 nt, Mycobacterium avium subsp. paratuberculosis
gccaccuugcgcgggu

SEQ ID NO: 934843 - RNA, 15 nt, Mycobacterium avium subsp. paratuberculosis
gccaccuucaccgcg

SEQ ID NO: 934844 - RNA, 16 nt, Mycobacterium avium subsp. paratuberculosis
gccaccuucaccgcgc

SEQ ID NO: 934845 - RNA, 18 nt, Mycobacterium avium subsp. paratuberculosis
gccaccuucaccgcgccg

SEQ ID NO: 934846 - RNA, 20 nt, Mycobacterium avium subsp. paratuberculosis
gccaccuucaccgcgccggu

SEQ ID NO: 934847 - RNA, 21 nt, Mycobacterium avium subsp. paratuberculosis
gccaccuucaccgcgccgguc

SEQ ID NO: 934848 - RNA, 13 nt, Mycobacterium avium subsp. paratuberculosis
gccacgcucgcca

SEQ ID NO: 934849 - RNA, 15 nt, Mycobacterium avium subsp. paratuberculosis
gccacgcucgccaga

SEQ ID NO: 934850 - RNA, 16 nt, Mycobacterium avium subsp. paratuberculosis
gccacgcucggcggcg

SEQ ID NO: 934851 - RNA, 14 nt, Mycobacterium avium subsp. paratuberculosis
gccacgcuggcguc

SEQ ID NO: 934852 - RNA, 16 nt, Mycobacterium avium subsp. paratuberculosis
gccacgcuggcgucca

SEQ ID NO: 934853 - RNA, 17 nt, Mycobacterium avium subsp. paratuberculosis
gccacgcuggcgugacg

SEQ ID NO: 934854 - RNA, 20 nt, Mycobacterium avium subsp. paratuberculosis
gccacgcuggcgugacgcuc

SEQ ID NO: 934855 - RNA, 23 nt, Mycobacterium avium subsp. paratuberculosis
gccacgcuggcgugacgcucggc

SEQ ID NO: 934856 - RNA, 20 nt, Mycobacterium avium subsp. paratuberculosis
gccacgcuggugugacgcuc

SEQ ID NO: 934857 - RNA, 15 nt, Mycobacterium avium subsp. paratuberculosis
gccacgcgcagggcg

SEQ ID NO: 934858 - RNA, 22 nt, Mycobacterium avium subsp. paratuberculosis
gccacgcgcagggcgaacggcg

SEQ ID NO: 934859 - RNA, 17 nt, Mycobacterium avium subsp. paratuberculosis
gccacgccggcacaccg

SEQ ID NO: 934860 - RNA, 13 nt, Mycobacterium avium subsp. paratuberculosis
gccacgcggcgcg

SEQ ID NO: 934861 - RNA, 22 nt, Mycobacterium avium subsp. paratuberculosis
gccacgcggcgcgcaucgucgc

SEQ ID NO: 934862 - RNA, 16 nt, Mycobacterium avium subsp. paratuberculosis
gccacgccgcgauccg

SEQ ID NO: 934863 - RNA, 15 nt, Mycobacterium avium subsp. paratuberculosis
gccacgcuagcguga

SEQ ID NO: 934864 - RNA, 17 nt, Mycobacterium avium subsp. paratuberculosis
gccacgcuagcgugacg

SEQ ID NO: 934865 - RNA, 18 nt, Mycobacterium avium subsp. paratuberculosis
gccacgcuagcgugacgc

SEQ ID NO: 934866 - RNA, 13 nt, Mycobacterium avium subsp. paratuberculosis
gccaccggccggu

SEQ ID NO: 934867 - RNA, 16 nt, Mycobacterium avium subsp. paratuberculosis
gccaccggccgguccg

SEQ ID NO: 934868 - RNA, 12 nt, Mycobacterium avium subsp. paratuberculosis
gccaccggcgcc

SEQ ID NO: 934869 - RNA, 16 nt, Mycobacterium avium subsp. paratuberculosis
gccaccggcccggccg

SEQ ID NO: 934870 - RNA, 19 nt, Mycobacterium avium subsp. paratuberculosis
gccaccggcccggccggcg

SEQ ID NO: 934871 - RNA, 20 nt, Mycobacterium avium subsp. paratuberculosis
gccaccggcccggccggcgc

SEQ ID NO: 934872 - RNA, 14 nt, Mycobacterium avium subsp. paratuberculosis
gccaccgcugggcg

SEQ ID NO: 934873 - RNA, 19 nt, Mycobacterium avium subsp. paratuberculosis
gccaccgcugggcggcgcg

SEQ ID NO: 934874 - RNA, 15 nt, Mycobacterium avium subsp. paratuberculosis
gccaccgcggucgac

SEQ ID NO: 934875 - RNA, 18 nt, Mycobacterium avium subsp. paratuberculosis
gccaccgcggucgacggg

SEQ ID NO: 934876 - RNA, 13 nt, Mycobacterium avium subsp. paratuberculosis
gccaccgcguccg

SEQ ID NO: 934877 - RNA, 12 nt, Mycobacterium avium subsp. paratuberculosis
gccaccgcgucg

SEQ ID NO: 934878 - RNA, 19 nt, Mycobacterium avium subsp. paratuberculosis
gccaccgcgucgcugccca

SEQ ID NO: 934879 - RNA, 15 nt, Mycobacterium avium subsp. paratuberculosis
gccaccgcggcguug

SEQ ID NO: 934880 - RNA, 22 nt, Mycobacterium avium subsp. paratuberculosis
gccaccgcggcguugcccgggu

SEQ ID NO: 934881 - RNA, 12 nt, Mycobacterium avium subsp. paratuberculosis
gccaccgcgacg

SEQ ID NO: 934882 - RNA, 19 nt, Mycobacterium avium subsp. paratuberculosis
gccaccgcgcaaccgggcc

SEQ ID NO: 934883 - RNA, 23 nt, Mycobacterium avium subsp. paratuberculosis
gccaccgcgcaaccgggccgcac

SEQ ID NO: 934884 - RNA, 21 nt, Mycobacterium avium subsp. paratuberculosis
gccaccgcgccccggcgcagc

SEQ ID NO: 934885 - RNA, 12 nt, Mycobacterium avium subsp. paratuberculosis
gccaccgcgccg

SEQ ID NO: 934886 - RNA, 13 nt, Mycobacterium avium subsp. paratuberculosis
gccaccgcgccgu

SEQ ID NO: 934887 - RNA, 15 nt, Mycobacterium avium subsp. paratuberculosis
gccaccgcgccgugg

SEQ ID NO: 934888 - RNA, 16 nt, Mycobacterium avium subsp. paratuberculosis
gccaccgcgcggcggu

SEQ ID NO: 934889 - RNA, 13 nt, Mycobacterium avium subsp. paratuberculosis
gccaccgcgcggu

SEQ ID NO: 934890 - RNA, 17 nt, Mycobacterium avium subsp. paratuberculosis
gccaccgcggccagcug

SEQ ID NO: 934891 - RNA, 19 nt, Mycobacterium avium subsp. paratuberculosis
gccaccgcggccagcugcg

SEQ ID NO: 934892 - RNA, 18 nt, Mycobacterium avium subsp. paratuberculosis
gccaccgucagcgucagc

SEQ ID NO: 934893 - RNA, 22 nt, Mycobacterium avium subsp. paratuberculosis
gccaccgucaggguggugcccc

SEQ ID NO: 934894 - RNA, 18 nt, Mycobacterium avium subsp. paratuberculosis
gccaccucggcggcaccg

SEQ ID NO: 934895 - RNA, 20 nt, Mycobacterium avium subsp. paratuberculosis
gccaccucggcggcaccgcc

SEQ ID NO: 934896 - RNA, 22 nt, Mycobacterium avium subsp. paratuberculosis
gccaccucggcggcaccgcccg

SEQ ID NO: 934897 - RNA, 16 nt, Mycobacterium avium subsp. paratuberculosis
gccaccggcgcgacgg

SEQ ID NO: 934898 - RNA, 18 nt, Mycobacterium avium subsp. paratuberculosis
gccaccggcgcgacggcg

SEQ ID NO: 934899 - RNA, 19 nt, Mycobacterium avium subsp. paratuberculosis
gccaccggcgcgacggcgg

SEQ ID NO: 934900 - RNA, 23 nt, Mycobacterium avium subsp. paratuberculosis
gccaccggcuccuugcgccgcaa

SEQ ID NO: 934901 - RNA, 15 nt, Mycobacterium avium subsp. paratuberculosis
gccaccggcuggccg

SEQ ID NO: 934902 - RNA, 12 nt, Mycobacterium avium subsp. paratuberculosis
gccaccgggccg

SEQ ID NO: 934903 - RNA, 16 nt, Mycobacterium avium subsp. paratuberculosis
gccaccgggccgagga

SEQ ID NO: 934904 - RNA, 14 nt, Mycobacterium avium subsp. paratuberculosis
gccaccgggcgugg

SEQ ID NO: 934905 - RNA, 12 nt, Mycobacterium avium subsp. paratuberculosis
gccaccgggucg

SEQ ID NO: 934906 - RNA, 20 nt, Mycobacterium avium subsp. paratuberculosis
gccaccgcgaaagcgucggc

SEQ ID NO: 934907 - RNA, 15 nt, Mycobacterium avium subsp. paratuberculosis
gccaccgcgaacguc

SEQ ID NO: 934908 - RNA, 17 nt, Mycobacterium avium subsp. paratuberculosis
gccaccgccugcgcgau

SEQ ID NO: 934909 - RNA, 22 nt, Mycobacterium avium subsp. paratuberculosis
gccaccgccugcgcgaucgccg

SEQ ID NO: 934910 - RNA, 16 nt, Mycobacterium avium subsp. paratuberculosis
gccaccgcccgaaccg

SEQ ID NO: 934911 - RNA, 22 nt, Mycobacterium avium subsp. paratuberculosis
gccaccgcccgaaccgcgucca

SEQ ID NO: 934912 - RNA, 21 nt, Mycobacterium avium subsp. paratuberculosis
gccaccgccgauggcgacggu

SEQ ID NO: 934913 - RNA, 22 nt, Mycobacterium avium subsp. paratuberculosis
gccaccgccgauggcgacgguc

SEQ ID NO: 934914 - RNA, 16 nt, Mycobacterium avium subsp. paratuberculosis
gccaccgccgccagca

SEQ ID NO: 934915 - RNA, 16 nt, Mycobacterium avium subsp. paratuberculosis
gccaccgaugcgggcc

SEQ ID NO: 934916 - RNA, 17 nt, Mycobacterium avium subsp. paratuberculosis
gccaccgaugcgggcca

SEQ ID NO: 934917 - RNA, 18 nt, Mycobacterium avium subsp. paratuberculosis
gccaccgaugcgggccag

SEQ ID NO: 934918 - RNA, 16 nt, Mycobacterium avium subsp. paratuberculosis
gccaccgagucgcgcg

SEQ ID NO: 934919 - RNA, 16 nt, Mycobacterium avium subsp. paratuberculosis
gccaccgcaucgccga

SEQ ID NO: 934920 - RNA, 17 nt, Mycobacterium avium subsp. paratuberculosis
gccaccgaggugacguc

SEQ ID NO: 934921 - RNA, 22 nt, Mycobacterium avium subsp. paratuberculosis
gccaccgaggugacgucgcgcc

SEQ ID NO: 934922 - RNA, 18 nt, Mycobacterium avium subsp. paratuberculosis
gccaccgaagccgacguc

SEQ ID NO: 934923 - RNA, 20 nt, Mycobacterium avium subsp. paratuberculosis
gccaccgacaccaccggccg

SEQ ID NO: 934924 - RNA, 16 nt, Mycobacterium avium subsp. paratuberculosis
gccacccugcgcaccg

SEQ ID NO: 934925 - RNA, 17 nt, Mycobacterium avium subsp. paratuberculosis
gccacccugcgcaccgc

SEQ ID NO: 934926 - RNA, 18 nt, Mycobacterium avium subsp. paratuberculosis
gccacccugcgcaccgcg

SEQ ID NO: 934927 - RNA, 14 nt, Mycobacterium avium subsp. paratuberculosis
gccacccucgccgc

SEQ ID NO: 934928 - RNA, 18 nt, Mycobacterium avium subsp. paratuberculosis
gccacccucgccgccgcc

SEQ ID NO: 934929 - RNA, 15 nt, Mycobacterium avium subsp. paratuberculosis
gccacccgggcgccg

SEQ ID NO: 934930 - RNA, 17 nt, Mycobacterium avium subsp. paratuberculosis
gccacccgggcgccggc

SEQ ID NO: 934931 - RNA, 20 nt, Mycobacterium avium subsp. paratuberculosis
gccacccgggcgccggcgau

SEQ ID NO: 934932 - RNA, 13 nt, Mycobacterium avium subsp. paratuberculosis
gccacccgucggu

SEQ ID NO: 934933 - RNA, 14 nt, Mycobacterium avium subsp. paratuberculosis
gccacccgcgaucg

SEQ ID NO: 934934 - RNA, 20 nt, Mycobacterium avium subsp. paratuberculosis
gccacccgcgaucggauggu

SEQ ID NO: 934935 - RNA, 12 nt, Mycobacterium avium subsp. paratuberculosis
gccaccccggga

SEQ ID NO: 934936 - RNA, 14 nt, Mycobacterium avium subsp. paratuberculosis
gccacccgaggccg

SEQ ID NO: 934937 - RNA, 16 nt, Mycobacterium avium subsp. paratuberculosis
gccacccgcaccucgc

SEQ ID NO: 934938 - RNA, 21 nt, Mycobacterium avium subsp. paratuberculosis
gccacccgcaccucgcuggcg

SEQ ID NO: 934939 - RNA, 14 nt, Mycobacterium avium subsp. paratuberculosis
gccaccccgcgcca

SEQ ID NO: 934940 - RNA, 15 nt, Mycobacterium avium subsp. paratuberculosis
gccaccccgcgccac

SEQ ID NO: 934941 - RNA, 16 nt, Mycobacterium avium subsp. paratuberculosis
gccacuucuccacgcc

SEQ ID NO: 934942 - RNA, 20 nt, Mycobacterium avium subsp. paratuberculosis
gccacuucgacggcagcggc

SEQ ID NO: 934943 - RNA, 19 nt, Mycobacterium avium subsp. paratuberculosis
gccagcaaccccgcggugc

SEQ ID NO: 934944 - RNA, 21 nt, Mycobacterium avium subsp. paratuberculosis
gccagcaaccccgcggugcac

SEQ ID NO: 934945 - RNA, 15 nt, Mycobacterium avium subsp. paratuberculosis
gccagcaaccgccgu

SEQ ID NO: 934946 - RNA, 14 nt, Mycobacterium avium subsp. paratuberculosis
gccagcaaccggaa

SEQ ID NO: 934947 - RNA, 18 nt, Mycobacterium avium subsp. paratuberculosis
gccagcaacgacccggcc

SEQ ID NO: 934948 - RNA, 20 nt, Mycobacterium avium subsp. paratuberculosis
gccagcaacgacccggccac

SEQ ID NO: 934949 - RNA, 12 nt, Mycobacterium avium subsp. paratuberculosis
gccagcaacacc

SEQ ID NO: 934950 - RNA, 16 nt, Mycobacterium avium subsp. paratuberculosis
gccagcaacaccagcu

SEQ ID NO: 934951 - RNA, 19 nt, Mycobacterium avium subsp. paratuberculosis
gccagcaacacccagccgc

SEQ ID NO: 934952 - RNA, 22 nt, Mycobacterium avium subsp. paratuberculosis
gccagcaacacccagccgcuga

SEQ ID NO: 934953 - RNA, 17 nt, Mycobacterium avium subsp. paratuberculosis
gccagcaacagcagcgg

SEQ ID NO: 934954 - RNA, 12 nt, Mycobacterium avium subsp. paratuberculosis
gccagcacccgc

SEQ ID NO: 934955 - RNA, 13 nt, Mycobacterium avium subsp. paratuberculosis
gccagcaccgggc

SEQ ID NO: 934956 - RNA, 16 nt, Mycobacterium avium subsp. paratuberculosis
gccagcaccgggccca

SEQ ID NO: 934957 - RNA, 13 nt, Mycobacterium avium subsp. paratuberculosis
gccagcaccgugc

SEQ ID NO: 934958 - RNA, 14 nt, Mycobacterium avium subsp. paratuberculosis
gccagcacggcggc

SEQ ID NO: 934959 - RNA, 15 nt, Mycobacterium avium subsp. paratuberculosis
gccagcacggcggcg

SEQ ID NO: 934960 - RNA, 16 nt, Mycobacterium avium subsp. paratuberculosis
gccagcacggucagcg

SEQ ID NO: 934961 - RNA, 21 nt, Mycobacterium avium subsp. paratuberculosis
gccagcacggucagcggccag

SEQ ID NO: 934962 - RNA, 17 nt, Mycobacterium avium subsp. paratuberculosis
gccagcaccggcgcgcc

SEQ ID NO: 934963 - RNA, 20 nt, Mycobacterium avium subsp. paratuberculosis
gccagcaccggcgcgccgcg

SEQ ID NO: 934964 - RNA, 13 nt, Mycobacterium avium subsp. paratuberculosis
gccagcacccgcu

SEQ ID NO: 934965 - RNA, 15 nt, Mycobacterium avium subsp. paratuberculosis
gccagcacccgcucg

SEQ ID NO: 934966 - RNA, 19 nt, Mycobacterium avium subsp. paratuberculosis
gccagcacccgcucgcggg

SEQ ID NO: 934967 - RNA, 17 nt, Mycobacterium avium subsp. paratuberculosis
gccagcacccgcugauc

SEQ ID NO: 934968 - RNA, 16 nt, Mycobacterium avium subsp. paratuberculosis
gccagcacccggucgg

SEQ ID NO: 934969 - RNA, 18 nt, Mycobacterium avium subsp. paratuberculosis
gccagcacccggucggug

SEQ ID NO: 934970 - RNA, 19 nt, Mycobacterium avium subsp. paratuberculosis
gccagcacccggucgguga

SEQ ID NO: 934971 - RNA, 14 nt, Mycobacterium avium subsp. paratuberculosis
gccagcaccgacag

SEQ ID NO: 934972 - RNA, 12 nt, Mycobacterium avium subsp. paratuberculosis
gccagcaccgcc

SEQ ID NO: 934973 - RNA, 17 nt, Mycobacterium avium subsp. paratuberculosis
gccagcaccgccaccgg

SEQ ID NO: 934974 - RNA, 18 nt, Mycobacterium avium subsp. paratuberculosis
gccagcaccgccaccggc

SEQ ID NO: 934975 - RNA, 19 nt, Mycobacterium avium subsp. paratuberculosis
gccagcaccgccaccggcc

SEQ ID NO: 934976 - RNA, 14 nt, Mycobacterium avium subsp. paratuberculosis
gccagcaccgccag

SEQ ID NO: 934977 - RNA, 20 nt, Mycobacterium avium subsp. paratuberculosis
gccagcaccgccagcgccgg

SEQ ID NO: 934978 - RNA, 21 nt, Mycobacterium avium subsp. paratuberculosis
gccagcaccgccagcgccggc

SEQ ID NO: 934979 - RNA, 13 nt, Mycobacterium avium subsp. paratuberculosis
gccagcaccgccc

SEQ ID NO: 934980 - RNA, 13 nt, Mycobacterium avium subsp. paratuberculosis
gccagcaccgccu

SEQ ID NO: 934981 - RNA, 14 nt, Mycobacterium avium subsp. paratuberculosis
gccagcaccgccug

SEQ ID NO: 934982 - RNA, 13 nt, Mycobacterium avium subsp. paratuberculosis
gccagcaccgcgg

SEQ ID NO: 934983 - RNA, 15 nt, Mycobacterium avium subsp. paratuberculosis
gccagcaccgcggcc

SEQ ID NO: 934984 - RNA, 16 nt, Mycobacterium avium subsp. paratuberculosis
gccagcaccgcggccg

SEQ ID NO: 934985 - RNA, 19 nt, Mycobacterium avium subsp. paratuberculosis
gccagcaccgcggccgucg

SEQ ID NO: 934986 - RNA, 15 nt, Mycobacterium avium subsp. paratuberculosis
gccagcaccgcgggg

SEQ ID NO: 934987 - RNA, 22 nt, Mycobacterium avium subsp. paratuberculosis
gccagcaccgcgggggcggccg

SEQ ID NO: 934988 - RNA, 14 nt, Mycobacterium avium subsp. paratuberculosis
gccagcaccgcguc

SEQ ID NO: 934989 - RNA, 17 nt, Mycobacterium avium subsp. paratuberculosis
gccagcaccgcgucgau

SEQ ID NO: 934990 - RNA, 18 nt, Mycobacterium avium subsp. paratuberculosis
gccagcaccgcgucgaug

SEQ ID NO: 934991 - RNA, 21 nt, Mycobacterium avium subsp. paratuberculosis
gccagcauccgcuggugcgcg

SEQ ID NO: 934992 - RNA, 22 nt, Mycobacterium avium subsp. paratuberculosis
gccagcauccgcuggugcgcgc

SEQ ID NO: 934993 - RNA, 17 nt, Mycobacterium avium subsp. paratuberculosis
gccagcaucucggcgaa

SEQ ID NO: 934994 - RNA, 21 nt, Mycobacterium avium subsp. paratuberculosis
gccagcaucucggcgaagguc

SEQ ID NO: 934995 - RNA, 17 nt, Mycobacterium avium subsp. paratuberculosis
gccagcaucggaugccg

SEQ ID NO: 934996 - RNA, 22 nt, Mycobacterium avium subsp. paratuberculosis
gccagcaucggaugccggggca

SEQ ID NO: 934997 - RNA, 17 nt, Mycobacterium avium subsp. paratuberculosis
gccagcauggucucgcu

SEQ ID NO: 934998 - RNA, 21 nt, Mycobacterium avium subsp. paratuberculosis
gccagcauggucucgcugauc

SEQ ID NO: 934999 - RNA, 19 nt, Mycobacterium avium subsp. paratuberculosis
gccagcaugguucgugggg

SEQ ID NO: 935000 - RNA, 19 nt, Mycobacterium avium subsp. paratuberculosis
gccagcaugaucaccgcca

SEQ ID NO: 935001 - RNA, 20 nt, Mycobacterium avium subsp. paratuberculosis
gccagcaugaucaccgccag

SEQ ID NO: 935002 - RNA, 22 nt, Mycobacterium avium subsp. paratuberculosis
gccagcaugaucaccgccagcg

SEQ ID NO: 935003 - RNA, 16 nt, Mycobacterium avium subsp. paratuberculosis
gccagcaugcgaugac

SEQ ID NO: 935004 - RNA, 15 nt, Mycobacterium avium subsp. paratuberculosis
gccagcagcagccgc

SEQ ID NO: 935005 - RNA, 19 nt, Mycobacterium avium subsp. paratuberculosis
gccagcagcagccgcgccg

SEQ ID NO: 935006 - RNA, 20 nt, Mycobacterium avium subsp. paratuberculosis
gccagcagcagccgcgccgc

SEQ ID NO: 935007 - RNA, 19 nt, Mycobacterium avium subsp. paratuberculosis
gccagcagcuugacgucgg

SEQ ID NO: 935008 - RNA, 19 nt, Mycobacterium avium subsp. paratuberculosis
gccagcagcucgugguaga

SEQ ID NO: 935009 - RNA, 13 nt, Mycobacterium avium subsp. paratuberculosis
gccagcagcugcg

SEQ ID NO: 935010 - RNA, 18 nt, Mycobacterium avium subsp. paratuberculosis
gccagcagcugcgggacc

SEQ ID NO: 935011 - RNA, 22 nt, Mycobacterium avium subsp. paratuberculosis
gccagcagcagcaggucgucga

SEQ ID NO: 935012 - RNA, 16 nt, Mycobacterium avium subsp. paratuberculosis
gccagcagcagcccgc

SEQ ID NO: 935013 - RNA, 22 nt, Mycobacterium avium subsp. paratuberculosis
gccagcagcagcccgccgaugg

SEQ ID NO: 935014 - RNA, 18 nt, Mycobacterium avium subsp. paratuberculosis
gccagcaggaucuggugc

SEQ ID NO: 935015 - RNA, 21 nt, Mycobacterium avium subsp. paratuberculosis
gccagcaggaucuggugcgcg

SEQ ID NO: 935016 - RNA, 21 nt, Mycobacterium avium subsp. paratuberculosis
gccagcaggaugaugaccgac

SEQ ID NO: 935017 - RNA, 22 nt, Mycobacterium avium subsp. paratuberculosis
gccagcaggaugaugaccgaca

SEQ ID NO: 935018 - RNA, 13 nt, Mycobacterium avium subsp. paratuberculosis
gccagcagcaccg

SEQ ID NO: 935019 - RNA, 14 nt, Mycobacterium avium subsp. paratuberculosis
gccagcagcaccgc

SEQ ID NO: 935020 - RNA, 15 nt, Mycobacterium avium subsp. paratuberculosis
gccagcagcaccgcg

SEQ ID NO: 935021 - RNA, 16 nt, Mycobacterium avium subsp. paratuberculosis
gccagcagcaccgcgu

SEQ ID NO: 935022 - RNA, 20 nt, Mycobacterium avium subsp. paratuberculosis
gccagcagcaccgcguuguc

SEQ ID NO: 935023 - RNA, 12 nt, Mycobacterium avium subsp. paratuberculosis
gccagcagcacg

SEQ ID NO: 935024 - RNA, 16 nt, Mycobacterium avium subsp. paratuberculosis
gccagcagcaacgcgg

SEQ ID NO: 935025 - RNA, 23 nt, Mycobacterium avium subsp. paratuberculosis
gccagcagauacuccucgcgguc

SEQ ID NO: 935026 - RNA, 17 nt, Mycobacterium avium subsp. paratuberculosis
gccagcagaugccgccc

SEQ ID NO: 935027 - RNA, 22 nt, Mycobacterium avium subsp. paratuberculosis
gccagcacgguguugcgcaccc

SEQ ID NO: 935028 - RNA, 18 nt, Mycobacterium avium subsp. paratuberculosis
gccagcacguggccgggc

SEQ ID NO: 935029 - RNA, 19 nt, Mycobacterium avium subsp. paratuberculosis
gccagcacguggccgggcu

SEQ ID NO: 935030 - RNA, 15 nt, Mycobacterium avium subsp. paratuberculosis
gccagccgcccagca

SEQ ID NO: 935031 - RNA, 18 nt, Mycobacterium avium subsp. paratuberculosis
gccagccgaugcgcccgc

SEQ ID NO: 935032 - RNA, 20 nt, Mycobacterium avium subsp. paratuberculosis
gccagccgaugcgcccgcgc

SEQ ID NO: 935033 - RNA, 23 nt, Mycobacterium avium subsp. paratuberculosis
gccagccgaugcgcccgcgccac

SEQ ID NO: 935034 - RNA, 12 nt, Mycobacterium avium subsp. paratuberculosis
gccagccgaagu

SEQ ID NO: 935035 - RNA, 21 nt, Mycobacterium avium subsp. paratuberculosis
gccagccgaaguauccgguca

SEQ ID NO: 935036 - RNA, 16 nt, Mycobacterium avium subsp. paratuberculosis
gccagccgcagcaggc

SEQ ID NO: 935037 - RNA, 13 nt, Mycobacterium avium subsp. paratuberculosis
gccagccgccgcc

SEQ ID NO: 935038 - RNA, 15 nt, Mycobacterium avium subsp. paratuberculosis
gccagccgccgccga

SEQ ID NO: 935039 - RNA, 16 nt, Mycobacterium avium subsp. paratuberculosis
gccagccgccgccgac

SEQ ID NO: 935040 - RNA, 17 nt, Mycobacterium avium subsp. paratuberculosis
gccagccgccggcucag

SEQ ID NO: 935041 - RNA, 20 nt, Mycobacterium avium subsp. paratuberculosis
gccagccgccggcucagcgg

SEQ ID NO: 935042 - RNA, 15 nt, Mycobacterium avium subsp. paratuberculosis
gccagccgcgccgcg

SEQ ID NO: 935043 - RNA, 16 nt, Mycobacterium avium subsp. paratuberculosis
gccagccgcgccgcgc

SEQ ID NO: 935044 - RNA, 18 nt, Mycobacterium avium subsp. paratuberculosis
gccagccgcgccgcgccg

SEQ ID NO: 935045 - RNA, 21 nt, Mycobacterium avium subsp. paratuberculosis
gccagccgcgccgcgccgccu

SEQ ID NO: 935046 - RNA, 21 nt, Mycobacterium avium subsp. paratuberculosis
gccagccgguugcgguggccg

SEQ ID NO: 935047 - RNA, 14 nt, Mycobacterium avium subsp. paratuberculosis
gccagccgucgccg

SEQ ID NO: 935048 - RNA, 15 nt, Mycobacterium avium subsp. paratuberculosis
gccagccgucgccgc

SEQ ID NO: 935049 - RNA, 16 nt, Mycobacterium avium subsp. paratuberculosis
gccagccgucgccgcg

SEQ ID NO: 935050 - RNA, 17 nt, Mycobacterium avium subsp. paratuberculosis
gccagccgucgccgcgc

SEQ ID NO: 935051 - RNA, 21 nt, Mycobacterium avium subsp. paratuberculosis
gccagccgucgccgcgcccgc

SEQ ID NO: 935052 - RNA, 14 nt, Mycobacterium avium subsp. paratuberculosis
gccagccgugcggc

SEQ ID NO: 935053 - RNA, 18 nt, Mycobacterium avium subsp. paratuberculosis
gccagccgugcggcggcg

SEQ ID NO: 935054 - RNA, 13 nt, Mycobacterium avium subsp. paratuberculosis
gccagcgccgccc

SEQ ID NO: 935055 - RNA, 16 nt, Mycobacterium avium subsp. paratuberculosis
gccagcgccgcccggg

SEQ ID NO: 935056 - RNA, 13 nt, Mycobacterium avium subsp. paratuberculosis
gccagcgccgcca

SEQ ID NO: 935057 - RNA, 12 nt, Mycobacterium avium subsp. paratuberculosis
gccagcgccgcc

SEQ ID NO: 935058 - RNA, 16 nt, Mycobacterium avium subsp. paratuberculosis
gccagcgcccgauucg

SEQ ID NO: 935059 - RNA, 12 nt, Mycobacterium avium subsp. paratuberculosis
gccagcgcccgc

SEQ ID NO: 935060 - RNA, 14 nt, Mycobacterium avium subsp. paratuberculosis
gccagcgcccgcgc

SEQ ID NO: 935061 - RNA, 15 nt, Mycobacterium avium subsp. paratuberculosis
gccagcgcccgcgcg

SEQ ID NO: 935062 - RNA, 17 nt, Mycobacterium avium subsp. paratuberculosis
gccagcgcccgcgcgau

SEQ ID NO: 935063 - RNA, 20 nt, Mycobacterium avium subsp. paratuberculosis
gccagcgcccgcgcgaucgg

SEQ ID NO: 935064 - RNA, 18 nt, Mycobacterium avium subsp. paratuberculosis
gccagcgcccgcgcgugg

SEQ ID NO: 935065 - RNA, 21 nt, Mycobacterium avium subsp. paratuberculosis
gccagcgcccgcgggugcagc

SEQ ID NO: 935066 - RNA, 13 nt, Mycobacterium avium subsp. paratuberculosis
gccagcgcccgcu

SEQ ID NO: 935067 - RNA, 18 nt, Mycobacterium avium subsp. paratuberculosis
gccagcgcccgcugcgcg

SEQ ID NO: 935068 - RNA, 14 nt, Mycobacterium avium subsp. paratuberculosis
gccagcgccgcaac

SEQ ID NO: 935069 - RNA, 17 nt, Mycobacterium avium subsp. paratuberculosis
gccagcgccgcaacggc

SEQ ID NO: 935070 - RNA, 21 nt, Mycobacterium avium subsp. paratuberculosis
gccagcgccgcaacggcuccc

SEQ ID NO: 935071 - RNA, 20 nt, Mycobacterium avium subsp. paratuberculosis
gccagcgccaugccgccgac

SEQ ID NO: 935072 - RNA, 21 nt, Mycobacterium avium subsp. paratuberculosis
gccagcgccaugccgccgacc

SEQ ID NO: 935073 - RNA, 23 nt, Mycobacterium avium subsp. paratuberculosis
gccagcgccaugccgccgaccgc

SEQ ID NO: 935074 - RNA, 13 nt, Mycobacterium avium subsp. paratuberculosis
gccagcgccccca

SEQ ID NO: 935075 - RNA, 16 nt, Mycobacterium avium subsp. paratuberculosis
gccagcgcccccagcg

SEQ ID NO: 935076 - RNA, 17 nt, Mycobacterium avium subsp. paratuberculosis
gccagcgcccccagcgg

SEQ ID NO: 935077 - RNA, 15 nt, Mycobacterium avium subsp. paratuberculosis
gccagcgccccgccg

SEQ ID NO: 935078 - RNA, 16 nt, Mycobacterium avium subsp. paratuberculosis
gccagcgccccgccgg

SEQ ID NO: 935079 - RNA, 19 nt, Mycobacterium avium subsp. paratuberculosis
gccagcgccccgccggggg

SEQ ID NO: 935080 - RNA, 16 nt, Mycobacterium avium subsp. paratuberculosis
gccagccuggcggcga

SEQ ID NO: 935081 - RNA, 16 nt, Mycobacterium avium subsp. paratuberculosis
gccagccucuugaacg

SEQ ID NO: 935082 - RNA, 12 nt, Mycobacterium avium subsp. paratuberculosis
gccagccguugu

SEQ ID NO: 935083 - RNA, 11 nt, Mycobacterium avium subsp. paratuberculosis
gccagcgcgcg

SEQ ID NO: 935084 - RNA, 17 nt, Mycobacterium avium subsp. paratuberculosis
gccagcgcgccgccgau

SEQ ID NO: 935085 - RNA, 14 nt, Mycobacterium avium subsp. paratuberculosis
gccagcgcgccgca

SEQ ID NO: 935086 - RNA, 16 nt, Mycobacterium avium subsp. paratuberculosis
gccagcgcgccgcaca

SEQ ID NO: 935087 - RNA, 23 nt, Mycobacterium avium subsp. paratuberculosis
gccagcgcgccgcacagccggcg

SEQ ID NO: 935088 - RNA, 14 nt, Mycobacterium avium subsp. paratuberculosis
gccagcgcgcccgc

SEQ ID NO: 935089 - RNA, 18 nt, Mycobacterium avium subsp. paratuberculosis
gccagcgcgcccgccauc

SEQ ID NO: 935090 - RNA, 20 nt, Mycobacterium avium subsp. paratuberculosis
gccagcgcgcccgccaucug

SEQ ID NO: 935091 - RNA, 16 nt, Mycobacterium avium subsp. paratuberculosis
gccagcgccuucggcg

SEQ ID NO: 935092 - RNA, 22 nt, Mycobacterium avium subsp. paratuberculosis
gccagcgccuucggcgccagcc

SEQ ID NO: 935093 - RNA, 21 nt, Mycobacterium avium subsp. paratuberculosis
gccagcgcgacccgcucgacg

SEQ ID NO: 935094 - RNA, 22 nt, Mycobacterium avium subsp. paratuberculosis
gccagcgcgacccgcucgacgc

SEQ ID NO: 935095 - RNA, 19 nt, Mycobacterium avium subsp. paratuberculosis
gccagcgcgacgcgcaugc

SEQ ID NO: 935096 - RNA, 19 nt, Mycobacterium avium subsp. paratuberculosis
gccagcgcgacggccucgu

SEQ ID NO: 935097 - RNA, 17 nt, Mycobacterium avium subsp. paratuberculosis
gccagcgcgaucgccgg

SEQ ID NO: 935098 - RNA, 23 nt, Mycobacterium avium subsp. paratuberculosis
gccagcgcgaucgccgggauggu

SEQ ID NO: 935099 - RNA, 16 nt, Mycobacterium avium subsp. paratuberculosis
gccagcgccucggcgu

SEQ ID NO: 935100 - RNA, 12 nt, Mycobacterium avium subsp. paratuberculosis
gccagcgccucg

SEQ ID NO: 935101 - RNA, 12 nt, Mycobacterium avium subsp. paratuberculosis
gccagcgccguc

SEQ ID NO: 935102 - RNA, 13 nt, Mycobacterium avium subsp. paratuberculosis
gccagcgccguca

SEQ ID NO: 935103 - RNA, 21 nt, Mycobacterium avium subsp. paratuberculosis
gccagcgccgucaucaccgcc

SEQ ID NO: 935104 - RNA, 15 nt, Mycobacterium avium subsp. paratuberculosis
gccagcgccggcagc

SEQ ID NO: 935105 - RNA, 14 nt, Mycobacterium avium subsp. paratuberculosis
gccagcgccgcgcg

SEQ ID NO: 935106 - RNA, 15 nt, Mycobacterium avium subsp. paratuberculosis
gccagcgccgcgcgc

SEQ ID NO: 935107 - RNA, 21 nt, Mycobacterium avium subsp. paratuberculosis
gccagcgccgcgcgcgcggcc

SEQ ID NO: 935108 - RNA, 16 nt, Mycobacterium avium subsp. paratuberculosis
gccagcgccgccagcc

SEQ ID NO: 935109 - RNA, 18 nt, Mycobacterium avium subsp. paratuberculosis
gccagcgccgccagccgc

SEQ ID NO: 935110 - RNA, 14 nt, Mycobacterium avium subsp. paratuberculosis
gccagcgacggccg

SEQ ID NO: 935111 - RNA, 13 nt, Mycobacterium avium subsp. paratuberculosis
gccagcgcgcggg

SEQ ID NO: 935112 - RNA, 14 nt, Mycobacterium avium subsp. paratuberculosis
gccagcgcgcggcc

SEQ ID NO: 935113 - RNA, 15 nt, Mycobacterium avium subsp. paratuberculosis
gccagcgcgcgggcg

SEQ ID NO: 935114 - RNA, 17 nt, Mycobacterium avium subsp. paratuberculosis
gccagcgcgcgggcgcg

SEQ ID NO: 935115 - RNA, 18 nt, Mycobacterium avium subsp. paratuberculosis
gccagcgcgcgggcgucc

SEQ ID NO: 935116 - RNA, 22 nt, Mycobacterium avium subsp. paratuberculosis
gccagcgcgcgaucagcgccgu

SEQ ID NO: 935117 - RNA, 12 nt, Mycobacterium avium subsp. paratuberculosis
gccagcgcggcg

SEQ ID NO: 935118 - RNA, 16 nt, Mycobacterium avium subsp. paratuberculosis
gccagcgcggccgggc

SEQ ID NO: 935119 - RNA, 23 nt, Mycobacterium avium subsp. paratuberculosis
gccagcgcggccgggcgccccga

SEQ ID NO: 935120 - RNA, 16 nt, Mycobacterium avium subsp. paratuberculosis
gccagcgcggcgauca

SEQ ID NO: 935121 - RNA, 13 nt, Mycobacterium avium subsp. paratuberculosis
gccagcgcggcgg

SEQ ID NO: 935122 - RNA, 17 nt, Mycobacterium avium subsp. paratuberculosis
gccagcgcggcggccag

SEQ ID NO: 935123 - RNA, 13 nt, Mycobacterium avium subsp. paratuberculosis
gccagcggcgccg

SEQ ID NO: 935124 - RNA, 15 nt, Mycobacterium avium subsp. paratuberculosis
gccagcggcgccgaa

SEQ ID NO: 935125 - RNA, 15 nt, Mycobacterium avium subsp. paratuberculosis
gccagcggcgccggg

SEQ ID NO: 935126 - RNA, 16 nt, Mycobacterium avium subsp. paratuberculosis
gccagcggcgccgggu

SEQ ID NO: 935127 - RNA, 23 nt, Mycobacterium avium subsp. paratuberculosis
gccagcggcgccgggucaccgga

SEQ ID NO: 935128 - RNA, 23 nt, Mycobacterium avium subsp. paratuberculosis
gccagcggcuuggccgugcaggg

SEQ ID NO: 935129 - RNA, 23 nt, Mycobacterium avium subsp. paratuberculosis
gccagcgggauacccaugaucgc

SEQ ID NO: 935130 - RNA, 15 nt, Mycobacterium avium subsp. paratuberculosis
gccagcgggccgacc

SEQ ID NO: 935131 - RNA, 15 nt, Mycobacterium avium subsp. paratuberculosis
gccagcgggccgagc

SEQ ID NO: 935132 - RNA, 16 nt, Mycobacterium avium subsp. paratuberculosis
gccagcgggccgagcg

SEQ ID NO: 935133 - RNA, 17 nt, Mycobacterium avium subsp. paratuberculosis
gccagcgggccgagcgu

SEQ ID NO: 935134 - RNA, 22 nt, Mycobacterium avium subsp. paratuberculosis
gccagcgggccgagcguucggc

SEQ ID NO: 935135 - RNA, 18 nt, Mycobacterium avium subsp. paratuberculosis
gccagcgguccagcguga

SEQ ID NO: 935136 - RNA, 21 nt, Mycobacterium avium subsp. paratuberculosis
gccagcguggccagcaccguc

SEQ ID NO: 935137 - RNA, 18 nt, Mycobacterium avium subsp. paratuberculosis
gccagcgugacgccgggc

SEQ ID NO: 935138 - RNA, 19 nt, Mycobacterium avium subsp. paratuberculosis
gccagcgugacgccgggcc

SEQ ID NO: 935139 - RNA, 20 nt, Mycobacterium avium subsp. paratuberculosis
gccagcgugacgccgggccg

SEQ ID NO: 935140 - RNA, 21 nt, Mycobacterium avium subsp. paratuberculosis
gccagcgugacgccgggccgc

SEQ ID NO: 935141 - RNA, 15 nt, Mycobacterium avium subsp. paratuberculosis
gccagcgugacgcuc

SEQ ID NO: 935142 - RNA, 21 nt, Mycobacterium avium subsp. paratuberculosis
gccagcguggcgcgccccggc

SEQ ID NO: 935143 - RNA, 16 nt, Mycobacterium avium subsp. paratuberculosis
gccagcgggccgugcc

SEQ ID NO: 935144 - RNA, 17 nt, Mycobacterium avium subsp. paratuberculosis
gccagcgggccgugccg

SEQ ID NO: 935145 - RNA, 17 nt, Mycobacterium avium subsp. paratuberculosis
gccagcgggcggccccg

SEQ ID NO: 935146 - RNA, 18 nt, Mycobacterium avium subsp. paratuberculosis
gccagcgggugauggccg

SEQ ID NO: 935147 - RNA, 13 nt, Mycobacterium avium subsp. paratuberculosis
gccagcggucacg

SEQ ID NO: 935148 - RNA, 16 nt, Mycobacterium avium subsp. paratuberculosis
gccagcggucacggac

SEQ ID NO: 935149 - RNA, 17 nt, Mycobacterium avium subsp. paratuberculosis
gccagcuccagcagccc

SEQ ID NO: 935150 - RNA, 20 nt, Mycobacterium avium subsp. paratuberculosis
gccagcuccagcagcccggg

SEQ ID NO: 935151 - RNA, 20 nt, Mycobacterium avium subsp. paratuberculosis
gccagcguuuccagcgccgg

SEQ ID NO: 935152 - RNA, 22 nt, Mycobacterium avium subsp. paratuberculosis
gccagcguuuccagcgccggca

SEQ ID NO: 935153 - RNA, 23 nt, Mycobacterium avium subsp. paratuberculosis
gccagcguuuccagcgccggcac

SEQ ID NO: 935154 - RNA, 13 nt, Mycobacterium avium subsp. paratuberculosis
gccagcucaccgg

SEQ ID NO: 935155 - RNA, 14 nt, Mycobacterium avium subsp. paratuberculosis
gccagcucaccggc

SEQ ID NO: 935156 - RNA, 15 nt, Mycobacterium avium subsp. paratuberculosis
gccagcucaccggcc

SEQ ID NO: 935157 - RNA, 16 nt, Mycobacterium avium subsp. paratuberculosis
gccagcucaccggcca

SEQ ID NO: 935158 - RNA, 15 nt, Mycobacterium avium subsp. paratuberculosis
gccagcucgucgcgg

SEQ ID NO: 935159 - RNA, 20 nt, Mycobacterium avium subsp. paratuberculosis
gccagcucggucagccgggc

SEQ ID NO: 935160 - RNA, 23 nt, Mycobacterium avium subsp. paratuberculosis
gccagcucggucagccgggcggc

SEQ ID NO: 935161 - RNA, 13 nt, Mycobacterium avium subsp. paratuberculosis
gccagcucggucg

SEQ ID NO: 935162 - RNA, 22 nt, Mycobacterium avium subsp. paratuberculosis
gccagcucggucgcggucggcg

SEQ ID NO: 935163 - RNA, 23 nt, Mycobacterium avium subsp. paratuberculosis
gccagcucggucgcggucggcgc

SEQ ID NO: 935164 - RNA, 16 nt, Mycobacterium avium subsp. paratuberculosis
gccagcucguccagcg

SEQ ID NO: 935165 - RNA, 21 nt, Mycobacterium avium subsp. paratuberculosis
gccagcucguccagcgugccg

SEQ ID NO: 935166 - RNA, 19 nt, Mycobacterium avium subsp. paratuberculosis
gccagcucgucgagccggc

SEQ ID NO: 935167 - RNA, 22 nt, Mycobacterium avium subsp. paratuberculosis
gccagcucgucgagccggccgg

SEQ ID NO: 935168 - RNA, 14 nt, Mycobacterium avium subsp. paratuberculosis
gccagcucggcggc

SEQ ID NO: 935169 - RNA, 16 nt, Mycobacterium avium subsp. paratuberculosis
gccagcucggcggcca

SEQ ID NO: 935170 - RNA, 18 nt, Mycobacterium avium subsp. paratuberculosis
gccagcucggcggccaug

SEQ ID NO: 935171 - RNA, 16 nt, Mycobacterium avium subsp. paratuberculosis
gccagcucggcggccg

SEQ ID NO: 935172 - RNA, 13 nt, Mycobacterium avium subsp. paratuberculosis
gccagcucggcgu

SEQ ID NO: 935173 - RNA, 14 nt, Mycobacterium avium subsp. paratuberculosis
gccagcucggcgug

SEQ ID NO: 935174 - RNA, 16 nt, Mycobacterium avium subsp. paratuberculosis
gccagcucggcccgcu

SEQ ID NO: 935175 - RNA, 21 nt, Mycobacterium avium subsp. paratuberculosis
gccagcucggcccgcugcgcg

SEQ ID NO: 935176 - RNA, 16 nt, Mycobacterium avium subsp. paratuberculosis
gccagcucgccgccga

SEQ ID NO: 935177 - RNA, 18 nt, Mycobacterium avium subsp. paratuberculosis
gccagcucgccgccgacg

SEQ ID NO: 935178 - RNA, 19 nt, Mycobacterium avium subsp. paratuberculosis
gccagcucgccgccgacga

SEQ ID NO: 935179 - RNA, 20 nt, Mycobacterium avium subsp. paratuberculosis
gccagcucgccgccgacgaa

SEQ ID NO: 935180 - RNA, 15 nt, Mycobacterium avium subsp. paratuberculosis
gccagcucgaccgcg

SEQ ID NO: 935181 - RNA, 16 nt, Mycobacterium avium subsp. paratuberculosis
gccagcucgaccgcgg

SEQ ID NO: 935182 - RNA, 18 nt, Mycobacterium avium subsp. paratuberculosis
gccagcucgaccgcggcg

SEQ ID NO: 935183 - RNA, 17 nt, Mycobacterium avium subsp. paratuberculosis
gccagcucccgggcggc

SEQ ID NO: 935184 - RNA, 18 nt, Mycobacterium avium subsp. paratuberculosis
gccagcucccgggcggcg

SEQ ID NO: 935185 - RNA, 21 nt, Mycobacterium avium subsp. paratuberculosis
gccagcucccgggcggcgccg

SEQ ID NO: 935186 - RNA, 15 nt, Mycobacterium avium subsp. paratuberculosis
gccagcuucgggcgc

SEQ ID NO: 935187 - RNA, 21 nt, Mycobacterium avium subsp. paratuberculosis
gccagcuggugaagcugccga

SEQ ID NO: 935188 - RNA, 15 nt, Mycobacterium avium subsp. paratuberculosis
gccagcuucaccggu

SEQ ID NO: 935189 - RNA, 22 nt, Mycobacterium avium subsp. paratuberculosis
gccagcugcggguugcgggcca

SEQ ID NO: 935190 - RNA, 13 nt, Mycobacterium avium subsp. paratuberculosis
gccagcugcguga

SEQ ID NO: 935191 - RNA, 16 nt, Mycobacterium avium subsp. paratuberculosis
gccagcugcccgccga

SEQ ID NO: 935192 - RNA, 17 nt, Mycobacterium avium subsp. paratuberculosis
gccagcugcccgccgac

SEQ ID NO: 935193 - RNA, 19 nt, Mycobacterium avium subsp. paratuberculosis
gccagcugccgcgacucgg

SEQ ID NO: 935194 - RNA, 19 nt, Mycobacterium avium subsp. paratuberculosis
gccagcugaacacgaaccc

SEQ ID NO: 935195 - RNA, 15 nt, Mycobacterium avium subsp. paratuberculosis
gccagcugcgcgucg

SEQ ID NO: 935196 - RNA, 20 nt, Mycobacterium avium subsp. paratuberculosis
gccagcugcgcgucggccgc

SEQ ID NO: 935197 - RNA, 17 nt, Mycobacterium avium subsp. paratuberculosis
gccagcugauagccgcc

SEQ ID NO: 935198 - RNA, 18 nt, Mycobacterium avium subsp. paratuberculosis
gccagcugauagccgccc

SEQ ID NO: 935199 - RNA, 19 nt, Mycobacterium avium subsp. paratuberculosis
gccagcugauagccgcccu

SEQ ID NO: 935200 - RNA, 13 nt, Mycobacterium avium subsp. paratuberculosis
gccagcugcaccg

SEQ ID NO: 935201 - RNA, 18 nt, Mycobacterium avium subsp. paratuberculosis
gccagcugcaccggggcc

SEQ ID NO: 935202 - RNA, 21 nt, Mycobacterium avium subsp. paratuberculosis
gccagcugcaccggggccggc

SEQ ID NO: 935203 - RNA, 22 nt, Mycobacterium avium subsp. paratuberculosis
gccagcugcaccggggccggcg

SEQ ID NO: 935204 - RNA, 18 nt, Mycobacterium avium subsp. paratuberculosis
gccaggcacagcagggca

SEQ ID NO: 935205 - RNA, 15 nt, Mycobacterium avium subsp. paratuberculosis
gccaggcacggcccg

SEQ ID NO: 935206 - RNA, 22 nt, Mycobacterium avium subsp. paratuberculosis
gccaggcagaagcuccacgccg

SEQ ID NO: 935207 - RNA, 16 nt, Mycobacterium avium subsp. paratuberculosis
gccaggaucgcguuga

SEQ ID NO: 935208 - RNA, 22 nt, Mycobacterium avium subsp. paratuberculosis
gccaggauguacccgcaggcca

SEQ ID NO: 935209 - RNA, 21 nt, Mycobacterium avium subsp. paratuberculosis
gccaggaugucguccucgguc

SEQ ID NO: 935210 - RNA, 18 nt, Mycobacterium avium subsp. paratuberculosis
gccaggauguucaccccg

SEQ ID NO: 935211 - RNA, 20 nt, Mycobacterium avium subsp. paratuberculosis
gccaggauguucaccccggc

SEQ ID NO: 935212 - RNA, 21 nt, Mycobacterium avium subsp. paratuberculosis
gccaggauguucaccccggcg

SEQ ID NO: 935213 - RNA, 22 nt, Mycobacterium avium subsp. paratuberculosis
gccaggauguucaccccggcgc

SEQ ID NO: 935214 - RNA, 19 nt, Mycobacterium avium subsp. paratuberculosis
gccaggaaccacaccccgg

SEQ ID NO: 935215 - RNA, 23 nt, Mycobacterium avium subsp. paratuberculosis
gccaggaaccacaccccggccac

SEQ ID NO: 935216 - RNA, 15 nt, Mycobacterium avium subsp. paratuberculosis
gccaggaaccaccgg

SEQ ID NO: 935217 - RNA, 17 nt, Mycobacterium avium subsp. paratuberculosis
gccaggaaccaccggaa

SEQ ID NO: 935218 - RNA, 16 nt, Mycobacterium avium subsp. paratuberculosis
gccaggaacggcgcca

SEQ ID NO: 935219 - RNA, 17 nt, Mycobacterium avium subsp. paratuberculosis
gccaggaacggcgccau

SEQ ID NO: 935220 - RNA, 19 nt, Mycobacterium avium subsp. paratuberculosis
gccaggaacggcgccaucg

SEQ ID NO: 935221 - RNA, 23 nt, Mycobacterium avium subsp. paratuberculosis
gccaggaagaacuccgcgauggc

SEQ ID NO: 935222 - RNA, 20 nt, Mycobacterium avium subsp. paratuberculosis
gccaggaagacguaggcggc

SEQ ID NO: 935223 - RNA, 17 nt, Mycobacterium avium subsp. paratuberculosis
gccagcuuuccggccgc

SEQ ID NO: 935224 - RNA, 15 nt, Mycobacterium avium subsp. paratuberculosis
gccaggauccgauga

SEQ ID NO: 935225 - RNA, 20 nt, Mycobacterium avium subsp. paratuberculosis
gccaggauccgaugacgcug

SEQ ID NO: 935226 - RNA, 16 nt, Mycobacterium avium subsp. paratuberculosis
gccaggauccgcccgc

SEQ ID NO: 935227 - RNA, 19 nt, Mycobacterium avium subsp. paratuberculosis
gccaggauccgcccgccgg

SEQ ID NO: 935228 - RNA, 16 nt, Mycobacterium avium subsp. paratuberculosis
gccaggaucucgucgg

SEQ ID NO: 935229 - RNA, 18 nt, Mycobacterium avium subsp. paratuberculosis
gccaggaucugcucggcg

SEQ ID NO: 935230 - RNA, 15 nt, Mycobacterium avium subsp. paratuberculosis
gccaggaucuugucg

SEQ ID NO: 935231 - RNA, 19 nt, Mycobacterium avium subsp. paratuberculosis
gccaggaucuugucggcgg

SEQ ID NO: 935232 - RNA, 20 nt, Mycobacterium avium subsp. paratuberculosis
gccaggaucuugucggcggc

SEQ ID NO: 935233 - RNA, 22 nt, Mycobacterium avium subsp. paratuberculosis
gccaggaucuugucggcggccu

SEQ ID NO: 935234 - RNA, 17 nt, Mycobacterium avium subsp. paratuberculosis
gccaggaugaacacccg

SEQ ID NO: 935235 - RNA, 15 nt, Mycobacterium avium subsp. paratuberculosis
gccaggaugaaccgg

SEQ ID NO: 935236 - RNA, 18 nt, Mycobacterium avium subsp. paratuberculosis
gccaggucgacggggucg

SEQ ID NO: 935237 - RNA, 18 nt, Mycobacterium avium subsp. paratuberculosis
gccaggguagaggcggcg

SEQ ID NO: 935238 - RNA, 19 nt, Mycobacterium avium subsp. paratuberculosis
gccaggguagaggcggcga

SEQ ID NO: 935239 - RNA, 23 nt, Mycobacterium avium subsp. paratuberculosis
gccagguaguggugggcgugccg

SEQ ID NO: 935240 - RNA, 16 nt, Mycobacterium avium subsp. paratuberculosis
gccagguccucgcugg

SEQ ID NO: 935241 - RNA, 18 nt, Mycobacterium avium subsp. paratuberculosis
gccagguccucgcuggcg

SEQ ID NO: 935242 - RNA, 19 nt, Mycobacterium avium subsp. paratuberculosis
gccagguccucgcuggcga

SEQ ID NO: 935243 - RNA, 20 nt, Mycobacterium avium subsp. paratuberculosis
gccagguccucgcuggcgau

SEQ ID NO: 935244 - RNA, 20 nt, Mycobacterium avium subsp. paratuberculosis
gccaggucgaagcgcagcac

SEQ ID NO: 935245 - RNA, 21 nt, Mycobacterium avium subsp. paratuberculosis
gccaggucgaagcgcagcacc

SEQ ID NO: 935246 - RNA, 12 nt, Mycobacterium avium subsp. paratuberculosis
gccagguucgcg

SEQ ID NO: 935247 - RNA, 16 nt, Mycobacterium avium subsp. paratuberculosis
gccagguugaccacca

SEQ ID NO: 935248 - RNA, 19 nt, Mycobacterium avium subsp. paratuberculosis
gccagguugaccaccagcg

SEQ ID NO: 935249 - RNA, 18 nt, Mycobacterium avium subsp. paratuberculosis
gccagguugcgccguccg

SEQ ID NO: 935250 - RNA, 23 nt, Mycobacterium avium subsp. paratuberculosis
gccagguugcgccguccggccac

SEQ ID NO: 935251 - RNA, 19 nt, Mycobacterium avium subsp. paratuberculosis
gccaggucgcugacgauga

SEQ ID NO: 935252 - RNA, 15 nt, Mycobacterium avium subsp. paratuberculosis
gccaggucgccgcgc

SEQ ID NO: 935253 - RNA, 18 nt, Mycobacterium avium subsp. paratuberculosis
gccagucgaagaccacga

SEQ ID NO: 935254 - RNA, 15 nt, Mycobacterium avium subsp. paratuberculosis
gccagucgaaguucg

SEQ ID NO: 935255 - RNA, 18 nt, Mycobacterium avium subsp. paratuberculosis
gccaguccggcagcagcg

SEQ ID NO: 935256 - RNA, 19 nt, Mycobacterium avium subsp. paratuberculosis
gccaguccggcagcagcga

SEQ ID NO: 935257 - RNA, 15 nt, Mycobacterium avium subsp. paratuberculosis
gccaguccggcgccg

SEQ ID NO: 935258 - RNA, 20 nt, Mycobacterium avium subsp. paratuberculosis
gccaguccugggccggggcu

SEQ ID NO: 935259 - RNA, 12 nt, Mycobacterium avium subsp. paratuberculosis
gccagucgccgc

SEQ ID NO: 935260 - RNA, 13 nt, Mycobacterium avium subsp. paratuberculosis
gccagucgccgcg

SEQ ID NO: 935261 - RNA, 16 nt, Mycobacterium avium subsp. paratuberculosis
gccagucgccgcgcag

SEQ ID NO: 935262 - RNA, 20 nt, Mycobacterium avium subsp. paratuberculosis
gccagguuggucagcagcag

SEQ ID NO: 935263 - RNA, 22 nt, Mycobacterium avium subsp. paratuberculosis
gccagguuggucagcagcagcg

SEQ ID NO: 935264 - RNA, 16 nt, Mycobacterium avium subsp. paratuberculosis
gccagguuggcggcgg

SEQ ID NO: 935265 - RNA, 20 nt, Mycobacterium avium subsp. paratuberculosis
gccagguuggcggcggcccg

SEQ ID NO: 935266 - RNA, 16 nt, Mycobacterium avium subsp. paratuberculosis
gccagguugucgucgg

SEQ ID NO: 935267 - RNA, 18 nt, Mycobacterium avium subsp. paratuberculosis
gccagguuuugcagcgga

SEQ ID NO: 935268 - RNA, 15 nt, Mycobacterium avium subsp. paratuberculosis
gccaggccgucggcg

SEQ ID NO: 935269 - RNA, 17 nt, Mycobacterium avium subsp. paratuberculosis
gccaggcuggccaggcu

SEQ ID NO: 935270 - RNA, 12 nt, Mycobacterium avium subsp. paratuberculosis
gccaggcuggcg

SEQ ID NO: 935271 - RNA, 14 nt, Mycobacterium avium subsp. paratuberculosis
gccaggcuggcguc

SEQ ID NO: 935272 - RNA, 13 nt, Mycobacterium avium subsp. paratuberculosis
gccaggccggcga

SEQ ID NO: 935273 - RNA, 14 nt, Mycobacterium avium subsp. paratuberculosis
gccaggccggccug

SEQ ID NO: 935274 - RNA, 16 nt, Mycobacterium avium subsp. paratuberculosis
gccaggccggcgacga

SEQ ID NO: 935275 - RNA, 19 nt, Mycobacterium avium subsp. paratuberculosis
gccaggccggcgacgccgg

SEQ ID NO: 935276 - RNA, 21 nt, Mycobacterium avium subsp. paratuberculosis
gccaggccggcgacgccggcg

SEQ ID NO: 935277 - RNA, 13 nt, Mycobacterium avium subsp. paratuberculosis
gccaggccgccgg

SEQ ID NO: 935278 - RNA, 14 nt, Mycobacterium avium subsp. paratuberculosis
gccaggccgccggg

SEQ ID NO: 935279 - RNA, 15 nt, Mycobacterium avium subsp. paratuberculosis
gccaggccgccgggc

SEQ ID NO: 935280 - RNA, 16 nt, Mycobacterium avium subsp. paratuberculosis
gccaggccgccgggcc

SEQ ID NO: 935281 - RNA, 13 nt, Mycobacterium avium subsp. paratuberculosis
gccaggccgcgag

SEQ ID NO: 935282 - RNA, 14 nt, Mycobacterium avium subsp. paratuberculosis
gccaggccgcgagc

SEQ ID NO: 935283 - RNA, 17 nt, Mycobacterium avium subsp. paratuberculosis
gccaggccgcgagcacg

SEQ ID NO: 935284 - RNA, 14 nt, Mycobacterium avium subsp. paratuberculosis
gccagggcagcgcg

SEQ ID NO: 935285 - RNA, 23 nt, Mycobacterium avium subsp. paratuberculosis
gccagggcagcgcgaccagcccg

SEQ ID NO: 935286 - RNA, 22 nt, Mycobacterium avium subsp. paratuberculosis
gccagggccccguuggugcggu

SEQ ID NO: 935287 - RNA, 16 nt, Mycobacterium avium subsp. paratuberculosis
gccagggcccgcagcc

SEQ ID NO: 935288 - RNA, 17 nt, Mycobacterium avium subsp. paratuberculosis
gccagggcccgcagccg

SEQ ID NO: 935289 - RNA, 19 nt, Mycobacterium avium subsp. paratuberculosis
gccagggcccgcagccgcu

SEQ ID NO: 935290 - RNA, 13 nt, Mycobacterium avium subsp. paratuberculosis
gccagggccgccg

SEQ ID NO: 935291 - RNA, 14 nt, Mycobacterium avium subsp. paratuberculosis
gccagggccgccgc

SEQ ID NO: 935292 - RNA, 17 nt, Mycobacterium avium subsp. paratuberculosis
gccagggcgcggcgcac

SEQ ID NO: 935293 - RNA, 18 nt, Mycobacterium avium subsp. paratuberculosis
gccagggcgacgccgcgg

SEQ ID NO: 935294 - RNA, 16 nt, Mycobacterium avium subsp. paratuberculosis
gccagggcgaggacgg

SEQ ID NO: 935295 - RNA, 14 nt, Mycobacterium avium subsp. paratuberculosis
gccagggccgggcg

SEQ ID NO: 935296 - RNA, 15 nt, Mycobacterium avium subsp. paratuberculosis
gccagggccgggcgu

SEQ ID NO: 935297 - RNA, 16 nt, Mycobacterium avium subsp. paratuberculosis
gccagggccgggcgug

SEQ ID NO: 935298 - RNA, 22 nt, Mycobacterium avium subsp. paratuberculosis
gccagggccgggcgugcccggc

SEQ ID NO: 935299 - RNA, 23 nt, Mycobacterium avium subsp. paratuberculosis
gccagggccgggcgugcccggcg

SEQ ID NO: 935300 - RNA, 13 nt, Mycobacterium avium subsp. paratuberculosis
gccagggcggcgc

SEQ ID NO: 935301 - RNA, 15 nt, Mycobacterium avium subsp. paratuberculosis
gccagggcggcgccg

SEQ ID NO: 935302 - RNA, 17 nt, Mycobacterium avium subsp. paratuberculosis
gccagggcggcgccggc

SEQ ID NO: 935303 - RNA, 19 nt, Mycobacterium avium subsp. paratuberculosis
gccagggcggcgccggcac

SEQ ID NO: 935304 - RNA, 20 nt, Mycobacterium avium subsp. paratuberculosis
gccagggcucgugcagccgg

SEQ ID NO: 935305 - RNA, 15 nt, Mycobacterium avium subsp. paratuberculosis
gcuucgcugcgccgg

SEQ ID NO: 935306 - RNA, 16 nt, Mycobacterium avium subsp. paratuberculosis
gcuucgcugcgccggc

SEQ ID NO: 935307 - RNA, 15 nt, Mycobacterium avium subsp. paratuberculosis
gcuucggccagcgcg

SEQ ID NO: 935308 - RNA, 12 nt, Mycobacterium avium subsp. paratuberculosis
gcuucgcgcugu

SEQ ID NO: 935309 - RNA, 13 nt, Mycobacterium avium subsp. paratuberculosis
gcuucggcgccga

SEQ ID NO: 935310 - RNA, 18 nt, Mycobacterium avium subsp. paratuberculosis
gcuucggcgccgagcacg

SEQ ID NO: 935311 - RNA, 13 nt, Mycobacterium avium subsp. paratuberculosis
gcuucggcucggg

SEQ ID NO: 935312 - RNA, 15 nt, Mycobacterium avium subsp. paratuberculosis
gcuucgggcgcgcgc

SEQ ID NO: 935313 - RNA, 19 nt, Mycobacterium avium subsp. paratuberculosis
gcuucguaacacccucggu

SEQ ID NO: 935314 - RNA, 16 nt, Mycobacterium avium subsp. paratuberculosis
gcuucgucgccggccg

SEQ ID NO: 935315 - RNA, 18 nt, Mycobacterium avium subsp. paratuberculosis
gcuucgucgccggccgcc

SEQ ID NO: 935316 - RNA, 13 nt, Mycobacterium avium subsp. paratuberculosis
gcuucgcggaucg

SEQ ID NO: 935317 - RNA, 24 nt, Mycobacterium avium subsp. paratuberculosis
gcuucgccgcgcuugcgaccgccg

SEQ ID NO: 935318 - RNA, 12 nt, Mycobacterium avium subsp. paratuberculosis
gcuucgccgccg

SEQ ID NO: 935319 - RNA, 21 nt, Mycobacterium avium subsp. paratuberculosis
gcuucgcccggcugcgccgcg

SEQ ID NO: 935320 - RNA, 19 nt, Mycobacterium avium subsp. paratuberculosis
gcuucgaacgcccgcacca

SEQ ID NO: 935321 - RNA, 21 nt, Mycobacterium avium subsp. paratuberculosis
gcuuccagaugcgucaacccg

SEQ ID NO: 935322 - RNA, 18 nt, Mycobacterium avium subsp. paratuberculosis
gcuucccacagucgcugg

SEQ ID NO: 935323 - RNA, 13 nt, Mycobacterium avium subsp. paratuberculosis
gcuuccagcgcgg

SEQ ID NO: 935324 - RNA, 17 nt, Mycobacterium avium subsp. paratuberculosis
gcuuccagcgcggcgau

SEQ ID NO: 935325 - RNA, 23 nt, Mycobacterium avium subsp. paratuberculosis
gcuuccagguguaggcguggcag

SEQ ID NO: 935326 - RNA, 19 nt, Mycobacterium avium subsp. paratuberculosis
gcuuccggaugggagcggg

SEQ ID NO: 935327 - RNA, 20 nt, Mycobacterium avium subsp. paratuberculosis
gcuuccggaugggagcgggg

SEQ ID NO: 935328 - RNA, 14 nt, Mycobacterium avium subsp. paratuberculosis
gcuucccggcgguc

SEQ ID NO: 935329 - RNA, 19 nt, Mycobacterium avium subsp. paratuberculosis
gcuucccggcggucgccga

SEQ ID NO: 935330 - RNA, 18 nt, Mycobacterium avium subsp. paratuberculosis
gcuuccgccgagacggcg

SEQ ID NO: 935331 - RNA, 23 nt, Mycobacterium avium subsp. paratuberculosis
gcuuccgccgagacggcguggcu

SEQ ID NO: 935332 - RNA, 23 nt, Mycobacterium avium subsp. paratuberculosis
gcuuccgccgagucgcgccgcgu

SEQ ID NO: 935333 - RNA, 15 nt, Mycobacterium avium subsp. paratuberculosis
gcuucagucccgcga

SEQ ID NO: 935334 - RNA, 19 nt, Mycobacterium avium subsp. paratuberculosis
gcuucauaugacgccggcc

SEQ ID NO: 935335 - RNA, 15 nt, Mycobacterium avium subsp. paratuberculosis
gcuucaugcccgcga

SEQ ID NO: 935336 - RNA, 13 nt, Mycobacterium avium subsp. paratuberculosis
gcuuccaccugcg

SEQ ID NO: 935337 - RNA, 23 nt, Mycobacterium avium subsp. paratuberculosis
gcuucuccucgguacccccgccg

SEQ ID NO: 935338 - RNA, 16 nt, Mycobacterium avium subsp. paratuberculosis
gcuucucggcgucccc

SEQ ID NO: 935339 - RNA, 16 nt, Mycobacterium avium subsp. paratuberculosis
gcuucucggcgugccc

SEQ ID NO: 935340 - RNA, 20 nt, Mycobacterium avium subsp. paratuberculosis
gcuucucggcgugcccgccg

SEQ ID NO: 935341 - RNA, 22 nt, Mycobacterium avium subsp. paratuberculosis
gcuucucggugaucacccgccg

SEQ ID NO: 935342 - RNA, 19 nt, Mycobacterium avium subsp. paratuberculosis
gcuucuggaugcggucguc

SEQ ID NO: 935343 - RNA, 16 nt, Mycobacterium avium subsp. paratuberculosis
gcuucugcccggccag

SEQ ID NO: 935344 - RNA, 18 nt, Mycobacterium avium subsp. paratuberculosis
gcuucugcccggccagca

SEQ ID NO: 935345 - RNA, 18 nt, Mycobacterium avium subsp. paratuberculosis
gcuucuugaagaaccggg

SEQ ID NO: 935346 - RNA, 13 nt, Mycobacterium avium subsp. paratuberculosis
gcuugaccgccag

SEQ ID NO: 935347 - RNA, 18 nt, Mycobacterium avium subsp. paratuberculosis
gcuugaagcccucgucga

SEQ ID NO: 935348 - RNA, 18 nt, Mycobacterium avium subsp. paratuberculosis
gcuugaacagcacccccu

SEQ ID NO: 935349 - RNA, 22 nt, Mycobacterium avium subsp. paratuberculosis
gcuugaacagcacccccucggc

SEQ ID NO: 935350 - RNA, 14 nt, Mycobacterium avium subsp. paratuberculosis
gcuugacgccgccg

SEQ ID NO: 935351 - RNA, 13 nt, Mycobacterium avium subsp. paratuberculosis
gcuugacgucggu

SEQ ID NO: 935352 - RNA, 20 nt, Mycobacterium avium subsp. paratuberculosis
gcuugacggcuuccgcggac

SEQ ID NO: 935353 - RNA, 17 nt, Mycobacterium avium subsp. paratuberculosis
gcuugagcgccagcgcg

SEQ ID NO: 935354 - RNA, 22 nt, Mycobacterium avium subsp. paratuberculosis
gcuugagccggaucggggugga

SEQ ID NO: 935355 - RNA, 16 nt, Mycobacterium avium subsp. paratuberculosis
gcuugagccccgccgg

SEQ ID NO: 935356 - RNA, 22 nt, Mycobacterium avium subsp. paratuberculosis
gcuugagccccgccgggguccg

SEQ ID NO: 935357 - RNA, 15 nt, Mycobacterium avium subsp. paratuberculosis
gcuugagcccgucga

SEQ ID NO: 935358 - RNA, 16 nt, Mycobacterium avium subsp. paratuberculosis
gcuugagcccgucgac

SEQ ID NO: 935359 - RNA, 20 nt, Mycobacterium avium subsp. paratuberculosis
gcuugagcccgucgacgucg

SEQ ID NO: 935360 - RNA, 15 nt, Mycobacterium avium subsp. paratuberculosis
gcuugcgaccgccgc

SEQ ID NO: 935361 - RNA, 19 nt, Mycobacterium avium subsp. paratuberculosis
gcuugcgaccgccgcuaga

SEQ ID NO: 935362 - RNA, 14 nt, Mycobacterium avium subsp. paratuberculosis
gcuugccgaugucg

SEQ ID NO: 935363 - RNA, 14 nt, Mycobacterium avium subsp. paratuberculosis
gcuugcgaucgccg

SEQ ID NO: 935364 - RNA, 13 nt, Mycobacterium avium subsp. paratuberculosis
gcuugccgucgac

SEQ ID NO: 935365 - RNA, 16 nt, Mycobacterium avium subsp. paratuberculosis
gcuugccgucgacgcg

SEQ ID NO: 935366 - RNA, 16 nt, Mycobacterium avium subsp. paratuberculosis
gcuugcccguucgaug

SEQ ID NO: 935367 - RNA, 23 nt, Mycobacterium avium subsp. paratuberculosis
gcuugcccguucgaugaugggcg

SEQ ID NO: 935368 - RNA, 21 nt, Mycobacterium avium subsp. paratuberculosis
gcuugcccugguacgcgccgu

SEQ ID NO: 935369 - RNA, 23 nt, Mycobacterium avium subsp. paratuberculosis
gcuugccgaaguccuugacccgc

SEQ ID NO: 935370 - RNA, 16 nt, Mycobacterium avium subsp. paratuberculosis
gcuugccgccgggcca

SEQ ID NO: 935371 - RNA, 15 nt, Mycobacterium avium subsp. paratuberculosis
gcuugccgcgacccg

SEQ ID NO: 935372 - RNA, 16 nt, Mycobacterium avium subsp. paratuberculosis
gcuugccgcgacccgg

SEQ ID NO: 935373 - RNA, 20 nt, Mycobacterium avium subsp. paratuberculosis
gcuugccgcgacccgggccg

SEQ ID NO: 935374 - RNA, 23 nt, Mycobacterium avium subsp. paratuberculosis
gcuugccggagcccagcuuggcg

SEQ ID NO: 935375 - RNA, 20 nt, Mycobacterium avium subsp. paratuberculosis
gcuugccggauugcgagccg

SEQ ID NO: 935376 - RNA, 18 nt, Mycobacterium avium subsp. paratuberculosis
gcuugauguugccgugcu

SEQ ID NO: 935377 - RNA, 17 nt, Mycobacterium avium subsp. paratuberculosis
gcuugaucgccggggcg

SEQ ID NO: 935378 - RNA, 15 nt, Mycobacterium avium subsp. paratuberculosis
gcuugagcgcgucgu

SEQ ID NO: 935379 - RNA, 18 nt, Mycobacterium avium subsp. paratuberculosis
gcuugaugaacgcguuga

SEQ ID NO: 935380 - RNA, 19 nt, Mycobacterium avium subsp. paratuberculosis
gcuugaugaugccggccgc

SEQ ID NO: 935381 - RNA, 20 nt, Mycobacterium avium subsp. paratuberculosis
gcuugaugaugccggccgcg

SEQ ID NO: 935382 - RNA, 17 nt, Mycobacterium avium subsp. paratuberculosis
gcuugccagccgggccg

SEQ ID NO: 935383 - RNA, 23 nt, Mycobacterium avium subsp. paratuberculosis
gcuugccaacgguuuccaccacc

SEQ ID NO: 935384 - RNA, 18 nt, Mycobacterium avium subsp. paratuberculosis
gcuugcagcuuggcggug

SEQ ID NO: 935385 - RNA, 19 nt, Mycobacterium avium subsp. paratuberculosis
gcuuucgcgucugcucgcg

SEQ ID NO: 935386 - RNA, 20 nt, Mycobacterium avium subsp. paratuberculosis
gcuuucgcguucgcucucgc

SEQ ID NO: 935387 - RNA, 14 nt, Mycobacterium avium subsp. paratuberculosis
gcuuucgccgggcg

SEQ ID NO: 935388 - RNA, 19 nt, Mycobacterium avium subsp. paratuberculosis
gcuuugaucagcucgccga

SEQ ID NO: 935389 - RNA, 18 nt, Mycobacterium avium subsp. paratuberculosis
gcuuuugugucugcucgc

SEQ ID NO: 935390 - RNA, 20 nt, Mycobacterium avium subsp. paratuberculosis
gcuuuugcgucugcucgcgc

SEQ ID NO: 935391 - RNA, 20 nt, Mycobacterium avium subsp. paratuberculosis
gcuuuugcgucugcucgccg

SEQ ID NO: 935392 - RNA, 19 nt, Mycobacterium avium subsp. paratuberculosis
gcuuuugcgucugcucgcg

SEQ ID NO: 935393 - RNA, 20 nt, Mycobacterium avium subsp. paratuberculosis
gcuuuucgucggugcgcgcc

SEQ ID NO: 935394 - RNA, 13 nt, Mycobacterium avium subsp. paratuberculosis
ggaaacgcgucgc

SEQ ID NO: 935395 - RNA, 18 nt, Mycobacterium avium subsp. paratuberculosis
ggaaacgggaugcggucg

SEQ ID NO: 935396 - RNA, 21 nt, Mycobacterium avium subsp. paratuberculosis
ggaaacgacgucgccaccaga

SEQ ID NO: 935397 - RNA, 16 nt, Mycobacterium avium subsp. paratuberculosis
ggaaaggcagcagcca

SEQ ID NO: 935398 - RNA, 16 nt, Mycobacterium avium subsp. paratuberculosis
ggaaagcgcgggcagc

SEQ ID NO: 935399 - RNA, 20 nt, Mycobacterium avium subsp. paratuberculosis
gcuuggucaccagcucgccg

SEQ ID NO: 935400 - RNA, 16 nt, Mycobacterium avium subsp. paratuberculosis
gcuugggucgccgggu

SEQ ID NO: 935401 - RNA, 22 nt, Mycobacterium avium subsp. paratuberculosis
gcuuggucagcgcggcccgcgg

SEQ ID NO: 935402 - RNA, 16 nt, Mycobacterium avium subsp. paratuberculosis
gcuuggucgcggcguu

SEQ ID NO: 935403 - RNA, 20 nt, Mycobacterium avium subsp. paratuberculosis
gcuugggcacguacgcgcug

SEQ ID NO: 935404 - RNA, 17 nt, Mycobacterium avium subsp. paratuberculosis
gcuugggcgccucgccg

SEQ ID NO: 935405 - RNA, 21 nt, Mycobacterium avium subsp. paratuberculosis
gcuugggcgccucgccgaccu

SEQ ID NO: 935406 - RNA, 16 nt, Mycobacterium avium subsp. paratuberculosis
gcuugggcgcgaucgg

SEQ ID NO: 935407 - RNA, 12 nt, Mycobacterium avium subsp. paratuberculosis
gcuuggcgcccu

SEQ ID NO: 935408 - RNA, 15 nt, Mycobacterium avium subsp. paratuberculosis
gcuuggcgggcguca

SEQ ID NO: 935409 - RNA, 12 nt, Mycobacterium avium subsp. paratuberculosis
gcuuggcggucu

SEQ ID NO: 935410 - RNA, 18 nt, Mycobacterium avium subsp. paratuberculosis
gcuuggcgacgaagucga

SEQ ID NO: 935411 - RNA, 15 nt, Mycobacterium avium subsp. paratuberculosis
gcuuggccgggcgga

SEQ ID NO: 935412 - RNA, 15 nt, Mycobacterium avium subsp. paratuberculosis
gcuugcgcucggccg

SEQ ID NO: 935413 - RNA, 15 nt, Mycobacterium avium subsp. paratuberculosis
gcuuggcccgccgcc

SEQ ID NO: 935414 - RNA, 16 nt, Mycobacterium avium subsp. paratuberculosis
gcuuggcccgccgccg

SEQ ID NO: 935415 - RNA, 19 nt, Mycobacterium avium subsp. paratuberculosis
gcuuggccagcucggcggc

SEQ ID NO: 935416 - RNA, 20 nt, Mycobacterium avium subsp. paratuberculosis
gcuuggccagcucggcggcc

SEQ ID NO: 935417 - RNA, 15 nt, Mycobacterium avium subsp. paratuberculosis
gcuuggccacgauga

SEQ ID NO: 935418 - RNA, 19 nt, Mycobacterium avium subsp. paratuberculosis
gcuuuccaccucgagcaac

SEQ ID NO: 935419 - RNA, 16 nt, Mycobacterium avium subsp. paratuberculosis
gcuugucguagcggcg

SEQ ID NO: 935420 - RNA, 19 nt, Mycobacterium avium subsp. paratuberculosis
gcuuggucaugaacgccgg

SEQ ID NO: 935421 - RNA, 18 nt, Mycobacterium avium subsp. paratuberculosis
gcuuggucuccggccccg

SEQ ID NO: 935422 - RNA, 20 nt, Mycobacterium avium subsp. paratuberculosis
gcuuggugggcgccggcguc

SEQ ID NO: 935423 - RNA, 16 nt, Mycobacterium avium subsp. paratuberculosis
gcuucacgcucggcag

SEQ ID NO: 935424 - RNA, 18 nt, Mycobacterium avium subsp. paratuberculosis
gcuucacgcucggcgccg

SEQ ID NO: 935425 - RNA, 13 nt, Mycobacterium avium subsp. paratuberculosis
gcuucacguucgg

SEQ ID NO: 935426 - RNA, 14 nt, Mycobacterium avium subsp. paratuberculosis
gcuucacguucggc

SEQ ID NO: 935427 - RNA, 16 nt, Mycobacterium avium subsp. paratuberculosis
gcuucacguucggcga

SEQ ID NO: 935428 - RNA, 17 nt, Mycobacterium avium subsp. paratuberculosis
gcuucacguucggcgag

SEQ ID NO: 935429 - RNA, 20 nt, Mycobacterium avium subsp. paratuberculosis
gcuucacguucggcgaguga

SEQ ID NO: 935430 - RNA, 21 nt, Mycobacterium avium subsp. paratuberculosis
gcuuagccccucccaccacgg

SEQ ID NO: 935431 - RNA, 22 nt, Mycobacterium avium subsp. paratuberculosis
gcuuagccccucccaccacggc

SEQ ID NO: 935432 - RNA, 23 nt, Mycobacterium avium subsp. paratuberculosis
gcuuaaucgcccaacaacucgac

SEQ ID NO: 935433 - RNA, 20 nt, Mycobacterium avium subsp. paratuberculosis
gcuuaccgaccucgaggccg

SEQ ID NO: 935434 - RNA, 21 nt, Mycobacterium avium subsp. paratuberculosis
gcuuaccggcgggcggcggcg

SEQ ID NO: 935435 - RNA, 23 nt, Mycobacterium avium subsp. paratuberculosis
gcuuaccggcgggcggcggcguu

SEQ ID NO: 935436 - RNA, 15 nt, Mycobacterium avium subsp. paratuberculosis
gcuguugcucggggc

SEQ ID NO: 935437 - RNA, 21 nt, Mycobacterium avium subsp. paratuberculosis
gcuguugcucggggcucgcgg

SEQ ID NO: 935438 - RNA, 20 nt, Mycobacterium avium subsp. paratuberculosis
gcuguuggaaccggccacca

SEQ ID NO: 935439 - RNA, 15 nt, Mycobacterium avium subsp. paratuberculosis
gcuguuaccgucggg

SEQ ID NO: 935440 - RNA, 19 nt, Mycobacterium avium subsp. paratuberculosis
gcuguuccagacgucggcg

SEQ ID NO: 935441 - RNA, 16 nt, Mycobacterium avium subsp. paratuberculosis
gcuguugacgggccgc

SEQ ID NO: 935442 - RNA, 17 nt, Mycobacterium avium subsp. paratuberculosis
gcuguugacgggccgcg

SEQ ID NO: 935443 - RNA, 15 nt, Mycobacterium avium subsp. paratuberculosis
gcuguagcacccggc

SEQ ID NO: 935444 - RNA, 18 nt, Mycobacterium avium subsp. paratuberculosis
gcuguagcacccggccgg

SEQ ID NO: 935445 - RNA, 22 nt, Mycobacterium avium subsp. paratuberculosis
gcuguagcacccggccggcgaa

SEQ ID NO: 935446 - RNA, 23 nt, Mycobacterium avium subsp. paratuberculosis
gcuguagcucacggugucggcgg

SEQ ID NO: 935447 - RNA, 18 nt, Mycobacterium avium subsp. paratuberculosis
gcuguaggccagccggga

SEQ ID NO: 935448 - RNA, 15 nt, Mycobacterium avium subsp. paratuberculosis
gcuguagggccacca

SEQ ID NO: 935449 - RNA, 17 nt, Mycobacterium avium subsp. paratuberculosis
gcugucaauccccgcgg

SEQ ID NO: 935450 - RNA, 23 nt, Mycobacterium avium subsp. paratuberculosis
gcugucaauccccgcgguucgag

SEQ ID NO: 935451 - RNA, 14 nt, Mycobacterium avium subsp. paratuberculosis
gcuguccagcagcg

SEQ ID NO: 935452 - RNA, 23 nt, Mycobacterium avium subsp. paratuberculosis
gcugucgacaggaucgacaacgc

SEQ ID NO: 935453 - RNA, 22 nt, Mycobacterium avium subsp. paratuberculosis
gcugucccagugcgugaccugc

SEQ ID NO: 935454 - RNA, 23 nt, Mycobacterium avium subsp. paratuberculosis
gcuguccucccagcgcccgggcg

SEQ ID NO: 935455 - RNA, 22 nt, Mycobacterium avium subsp. paratuberculosis
gcuguccucgagcgcgucgacc

SEQ ID NO: 935456 - RNA, 15 nt, Mycobacterium avium subsp. paratuberculosis
gcuguccugccgggc

SEQ ID NO: 935457 - RNA, 22 nt, Mycobacterium avium subsp. paratuberculosis
gcuguccugccgggcgucgacg

SEQ ID NO: 935458 - RNA, 14 nt, Mycobacterium avium subsp. paratuberculosis
gcuguccuggucgc

SEQ ID NO: 935459 - RNA, 13 nt, Mycobacterium avium subsp. paratuberculosis
gcuguccgcgugg

SEQ ID NO: 935460 - RNA, 15 nt, Mycobacterium avium subsp. paratuberculosis
gcuguccgcguggcc

SEQ ID NO: 935461 - RNA, 16 nt, Mycobacterium avium subsp. paratuberculosis
gcuguccgcguggccg

SEQ ID NO: 935462 - RNA, 14 nt, Mycobacterium avium subsp. paratuberculosis
gcugucccggccgc

SEQ ID NO: 935463 - RNA, 18 nt, Mycobacterium avium subsp. paratuberculosis
gcugucccggccgcgaca

SEQ ID NO: 935464 - RNA, 20 nt, Mycobacterium avium subsp. paratuberculosis
gcugucccggccgcgacagc

SEQ ID NO: 935465 - RNA, 22 nt, Mycobacterium avium subsp. paratuberculosis
gcugucccggccgcgacagccg

SEQ ID NO: 935466 - RNA, 13 nt, Mycobacterium avium subsp. paratuberculosis
gcugugccgcggu

SEQ ID NO: 935467 - RNA, 19 nt, Mycobacterium avium subsp. paratuberculosis
gcuguggaagggccccggc

SEQ ID NO: 935468 - RNA, 19 nt, Mycobacterium avium subsp. paratuberculosis
gcuguggaugacgcagccg

SEQ ID NO: 935469 - RNA, 20 nt, Mycobacterium avium subsp. paratuberculosis
gcuguggaugacgcagccga

SEQ ID NO: 935470 - RNA, 14 nt, Mycobacterium avium subsp. paratuberculosis
gcugugggccagca

SEQ ID NO: 935471 - RNA, 21 nt, Mycobacterium avium subsp. paratuberculosis
gcugugggccagcagcgucgu

SEQ ID NO: 935472 - RNA, 15 nt, Mycobacterium avium subsp. paratuberculosis
gcuguggugacggcc

SEQ ID NO: 935473 - RNA, 22 nt, Mycobacterium avium subsp. paratuberculosis
gcugugcucgacgaagauggcg

SEQ ID NO: 935474 - RNA, 17 nt, Mycobacterium avium subsp. paratuberculosis
gcugugcggcccggcac

SEQ ID NO: 935475 - RNA, 17 nt, Mycobacterium avium subsp. paratuberculosis
gcugugcgggcggugcu

SEQ ID NO: 935476 - RNA, 22 nt, Mycobacterium avium subsp. paratuberculosis
gcugugcgggugaggccaggcg

SEQ ID NO: 935477 - RNA, 20 nt, Mycobacterium avium subsp. paratuberculosis
gcugucgggcaggccggugc

SEQ ID NO: 935478 - RNA, 22 nt, Mycobacterium avium subsp. paratuberculosis
gcugucgggcaggccggugcug

SEQ ID NO: 935479 - RNA, 13 nt, Mycobacterium avium subsp. paratuberculosis
gcugucggggucg

SEQ ID NO: 935480 - RNA, 16 nt, Mycobacterium avium subsp. paratuberculosis
gcugucggggucgcgg

SEQ ID NO: 935481 - RNA, 15 nt, Mycobacterium avium subsp. paratuberculosis
gcugucgggugccgc

SEQ ID NO: 935482 - RNA, 16 nt, Mycobacterium avium subsp. paratuberculosis
gcugucgggugccgcc

SEQ ID NO: 935483 - RNA, 21 nt, Mycobacterium avium subsp. paratuberculosis
gcugucgggugccgccuuggu

SEQ ID NO: 935484 - RNA, 15 nt, Mycobacterium avium subsp. paratuberculosis
gcugucggguggcag

SEQ ID NO: 935485 - RNA, 21 nt, Mycobacterium avium subsp. paratuberculosis
gcugucggcgaaacaccaagc

SEQ ID NO: 935486 - RNA, 20 nt, Mycobacterium avium subsp. paratuberculosis
gcugucggcgcccagaucgg

SEQ ID NO: 935487 - RNA, 14 nt, Mycobacterium avium subsp. paratuberculosis
gcugucgucgcccu

SEQ ID NO: 935488 - RNA, 22 nt, Mycobacterium avium subsp. paratuberculosis
gcugucggugaaugucgugacc

SEQ ID NO: 935489 - RNA, 17 nt, Mycobacterium avium subsp. paratuberculosis
gcugucguagcggccca

SEQ ID NO: 935490 - RNA, 17 nt, Mycobacterium avium subsp. paratuberculosis
gcugucgcgggcccgcg

SEQ ID NO: 935491 - RNA, 22 nt, Mycobacterium avium subsp. paratuberculosis
gcugucgcgggucuggcucggc

SEQ ID NO: 935492 - RNA, 16 nt, Mycobacterium avium subsp. paratuberculosis
gcugucgccgaggucc

SEQ ID NO: 935493 - RNA, 17 nt, Mycobacterium avium subsp. paratuberculosis
gcugucgcccucgaucg

SEQ ID NO: 935494 - RNA, 20 nt, Mycobacterium avium subsp. paratuberculosis
gcugguagaugccgaagccg

SEQ ID NO: 935495 - RNA, 18 nt, Mycobacterium avium subsp. paratuberculosis
gcugguagaugguggccg

SEQ ID NO: 935496 - RNA, 21 nt, Mycobacterium avium subsp. paratuberculosis
gcugguagaugguggccgucg

SEQ ID NO: 935497 - RNA, 22 nt, Mycobacterium avium subsp. paratuberculosis
gcuggguguuccccgggcgagc

SEQ ID NO: 935498 - RNA, 14 nt, Mycobacterium avium subsp. paratuberculosis
gcuggguuccgcga

SEQ ID NO: 935499 - RNA, 16 nt, Mycobacterium avium subsp. paratuberculosis
gcuggguugcucgccg

SEQ ID NO: 935500 - RNA, 16 nt, Mycobacterium avium subsp. paratuberculosis
gcuggucaacucgacc

SEQ ID NO: 935501 - RNA, 18 nt, Mycobacterium avium subsp. paratuberculosis
gcuggucaacucgacccg

SEQ ID NO: 935502 - RNA, 23 nt, Mycobacterium avium subsp. paratuberculosis
gcuggucacacccuugucgguga

SEQ ID NO: 935503 - RNA, 18 nt, Mycobacterium avium subsp. paratuberculosis
gcuggucacccacuggcg

SEQ ID NO: 935504 - RNA, 18 nt, Mycobacterium avium subsp. paratuberculosis
gcugguaguacaccgggc

SEQ ID NO: 935505 - RNA, 16 nt, Mycobacterium avium subsp. paratuberculosis
gcugguaggcggcgca

SEQ ID NO: 935506 - RNA, 16 nt, Mycobacterium avium subsp. paratuberculosis
gcuggucgaaccgcga

SEQ ID NO: 935507 - RNA, 17 nt, Mycobacterium avium subsp. paratuberculosis
gcuggucgaaccgcgag

SEQ ID NO: 935508 - RNA, 18 nt, Mycobacterium avium subsp. paratuberculosis
gcuggucgaaccgcgagc

SEQ ID NO: 935509 - RNA, 19 nt, Mycobacterium avium subsp. paratuberculosis
gcuggucgaaccgcgagcg

SEQ ID NO: 935510 - RNA, 17 nt, Mycobacterium avium subsp. paratuberculosis
gcuggucgaacgccacc

SEQ ID NO: 935511 - RNA, 14 nt, Mycobacterium avium subsp. paratuberculosis
gcuggucgacguca

SEQ ID NO: 935512 - RNA, 19 nt, Mycobacterium avium subsp. paratuberculosis
gcuggucgacgucauccgg

SEQ ID NO: 935513 - RNA, 15 nt, Mycobacterium avium subsp. paratuberculosis
gcuggucccacagcg

SEQ ID NO: 935514 - RNA, 19 nt, Mycobacterium avium subsp. paratuberculosis
gcugguccggaaccgcgcc

SEQ ID NO: 935515 - RNA, 14 nt, Mycobacterium avium subsp. paratuberculosis
gcugguccggccgg

SEQ ID NO: 935516 - RNA, 17 nt, Mycobacterium avium subsp. paratuberculosis
gcugguccggccggccg

SEQ ID NO: 935517 - RNA, 17 nt, Mycobacterium avium subsp. paratuberculosis
gcuggucaugccgucga

SEQ ID NO: 935518 - RNA, 19 nt, Mycobacterium avium subsp. paratuberculosis
gcuggucaugccgucgacg

SEQ ID NO: 935519 - RNA, 21 nt, Mycobacterium avium subsp. paratuberculosis
gcuggucaugccgucgacgac

SEQ ID NO: 935520 - RNA, 14 nt, Mycobacterium avium subsp. paratuberculosis
gcuggucaggccga

SEQ ID NO: 935521 - RNA, 16 nt, Mycobacterium avium subsp. paratuberculosis
gcugggugaacacccc

SEQ ID NO: 935522 - RNA, 22 nt, Mycobacterium avium subsp. paratuberculosis
gcugggugaacaccccgcggga

SEQ ID NO: 935523 - RNA, 13 nt, Mycobacterium avium subsp. paratuberculosis
gcugggugccgcg

SEQ ID NO: 935524 - RNA, 21 nt, Mycobacterium avium subsp. paratuberculosis
gcuggguggacaccuuggcgg

SEQ ID NO: 935525 - RNA, 18 nt, Mycobacterium avium subsp. paratuberculosis
gcuggguggucaccagcg

SEQ ID NO: 935526 - RNA, 21 nt, Mycobacterium avium subsp. paratuberculosis
gcuggguggucaccagcgcgg

SEQ ID NO: 935527 - RNA, 22 nt, Mycobacterium avium subsp. paratuberculosis
gcuggguggucaccagcgcggu

SEQ ID NO: 935528 - RNA, 23 nt, Mycobacterium avium subsp. paratuberculosis
gcuggguggucaccagcgcgguc

SEQ ID NO: 935529 - RNA, 19 nt, Mycobacterium avium subsp. paratuberculosis
gcuggggguggcgucgacg

SEQ ID NO: 935530 - RNA, 20 nt, Mycobacterium avium subsp. paratuberculosis
gcuggggguggcgucgacgg

SEQ ID NO: 935531 - RNA, 14 nt, Mycobacterium avium subsp. paratuberculosis
gcugggucaccacg

SEQ ID NO: 935532 - RNA, 15 nt, Mycobacterium avium subsp. paratuberculosis
gcugggucaccacgg

SEQ ID NO: 935533 - RNA, 22 nt, Mycobacterium avium subsp. paratuberculosis
gcugggcuggccguccggauag

SEQ ID NO: 935534 - RNA, 20 nt, Mycobacterium avium subsp. paratuberculosis
gcugggcuuccacagcccgu

SEQ ID NO: 935535 - RNA, 13 nt, Mycobacterium avium subsp. paratuberculosis
gcugggcguggug

SEQ ID NO: 935536 - RNA, 17 nt, Mycobacterium avium subsp. paratuberculosis
gcugggcuaccagcccc

SEQ ID NO: 935537 - RNA, 20 nt, Mycobacterium avium subsp. paratuberculosis
gcugggcguacugcucggcg

SEQ ID NO: 935538 - RNA, 18 nt, Mycobacterium avium subsp. paratuberculosis
gcugggcgggcagccgcu

SEQ ID NO: 935539 - RNA, 22 nt, Mycobacterium avium subsp. paratuberculosis
gcugggcgggcagccgcuuggc

SEQ ID NO: 935540 - RNA, 17 nt, Mycobacterium avium subsp. paratuberculosis
gcugggcgcgcaacucg

SEQ ID NO: 935541 - RNA, 19 nt, Mycobacterium avium subsp. paratuberculosis
gcuggucucgggcaccacg

SEQ ID NO: 935542 - RNA, 22 nt, Mycobacterium avium subsp. paratuberculosis
gcuggucucgggcaccacgccg

SEQ ID NO: 935543 - RNA, 17 nt, Mycobacterium avium subsp. paratuberculosis
gcuggucgcgaagcgua

SEQ ID NO: 935544 - RNA, 13 nt, Mycobacterium avium subsp. paratuberculosis
gcuggucggcggc

SEQ ID NO: 935545 - RNA, 14 nt, Mycobacterium avium subsp. paratuberculosis
gcuggucggcgggu

SEQ ID NO: 935546 - RNA, 15 nt, Mycobacterium avium subsp. paratuberculosis
gcuggucggcgggua

SEQ ID NO: 935547 - RNA, 18 nt, Mycobacterium avium subsp. paratuberculosis
gcuggucgcccaccacga

SEQ ID NO: 935548 - RNA, 20 nt, Mycobacterium avium subsp. paratuberculosis
gcuggucgcccaccacgacg

SEQ ID NO: 935549 - RNA, 23 nt, Mycobacterium avium subsp. paratuberculosis
gcuggucuucggugucgcacagc

SEQ ID NO: 935550 - RNA, 20 nt, Mycobacterium avium subsp. paratuberculosis
gcuggucuugccgugcagca

SEQ ID NO: 935551 - RNA, 13 nt, Mycobacterium avium subsp. paratuberculosis
gcuggugacgccg

SEQ ID NO: 935552 - RNA, 16 nt, Mycobacterium avium subsp. paratuberculosis
gcuggugacgccgcug

SEQ ID NO: 935553 - RNA, 20 nt, Mycobacterium avium subsp. paratuberculosis
gcuggugacgugcaccugca

SEQ ID NO: 935554 - RNA, 15 nt, Mycobacterium avium subsp. paratuberculosis
gcuggugaggucgcg

SEQ ID NO: 935555 - RNA, 14 nt, Mycobacterium avium subsp. paratuberculosis
gcuggugcacccga

SEQ ID NO: 935556 - RNA, 20 nt, Mycobacterium avium subsp. paratuberculosis
gcuggugaacucgccgaucg

SEQ ID NO: 935557 - RNA, 14 nt, Mycobacterium avium subsp. paratuberculosis
gcuggugccgccga

SEQ ID NO: 935558 - RNA, 16 nt, Mycobacterium avium subsp. paratuberculosis
gcuggugccgccgaug

SEQ ID NO: 935559 - RNA, 17 nt, Mycobacterium avium subsp. paratuberculosis
gcuggugccgccgauga

SEQ ID NO: 935560 - RNA, 15 nt, Mycobacterium avium subsp. paratuberculosis
gcuggugccgccggc

SEQ ID NO: 935561 - RNA, 16 nt, Mycobacterium avium subsp. paratuberculosis
gcuggugccgccggcg

SEQ ID NO: 935562 - RNA, 19 nt, Mycobacterium avium subsp. paratuberculosis
gcuggugccgccggcgauc

SEQ ID NO: 935563 - RNA, 20 nt, Mycobacterium avium subsp. paratuberculosis
gcuggugcgcagcccgccgg

SEQ ID NO: 935564 - RNA, 20 nt, Mycobacterium avium subsp. paratuberculosis
gcuggugcgcagccgucgca

SEQ ID NO: 935565 - RNA, 16 nt, Mycobacterium avium subsp. paratuberculosis
gcuggugcgcgccggc

SEQ ID NO: 935566 - RNA, 17 nt, Mycobacterium avium subsp. paratuberculosis
gcuggugcgcgccggcg

SEQ ID NO: 935567 - RNA, 17 nt, Mycobacterium avium subsp. paratuberculosis
gcugguugucgacgcug

SEQ ID NO: 935568 - RNA, 15 nt, Mycobacterium avium subsp. paratuberculosis
gcugguuucgggucg

SEQ ID NO: 935569 - RNA, 16 nt, Mycobacterium avium subsp. paratuberculosis
gcugguuucgggucga

SEQ ID NO: 935570 - RNA, 17 nt, Mycobacterium avium subsp. paratuberculosis
gcuggugugacgcucgc

SEQ ID NO: 935571 - RNA, 19 nt, Mycobacterium avium subsp. paratuberculosis
gcuggugugacgcucgcgg

SEQ ID NO: 935572 - RNA, 20 nt, Mycobacterium avium subsp. paratuberculosis
gcugguggugaucacccagc

SEQ ID NO: 935573 - RNA, 17 nt, Mycobacterium avium subsp. paratuberculosis
gcugguggugaucggcc

SEQ ID NO: 935574 - RNA, 16 nt, Mycobacterium avium subsp. paratuberculosis
gcuggugggccaucgc

SEQ ID NO: 935575 - RNA, 20 nt, Mycobacterium avium subsp. paratuberculosis
gcuggugggccaucgccagg

SEQ ID NO: 935576 - RNA, 15 nt, Mycobacterium avium subsp. paratuberculosis
gcugguggccgacgu

SEQ ID NO: 935577 - RNA, 20 nt, Mycobacterium avium subsp. paratuberculosis
gcugguggccgacgugccgg

SEQ ID NO: 935578 - RNA, 21 nt, Mycobacterium avium subsp. paratuberculosis
gcugggccacgauccgcgcgg

SEQ ID NO: 935579 - RNA, 20 nt, Mycobacterium avium subsp. paratuberculosis
gcugggcaucaucggcacgc

SEQ ID NO: 935580 - RNA, 17 nt, Mycobacterium avium subsp. paratuberculosis
gcugggccgcggcgccg

SEQ ID NO: 935581 - RNA, 12 nt, Mycobacterium avium subsp. paratuberculosis
gcugggccggcg

SEQ ID NO: 935582 - RNA, 15 nt, Mycobacterium avium subsp. paratuberculosis
gcugggccggcgccg

SEQ ID NO: 935583 - RNA, 16 nt, Mycobacterium avium subsp. paratuberculosis
gcugggccggcgccga

SEQ ID NO: 935584 - RNA, 17 nt, Mycobacterium avium subsp. paratuberculosis
gcugggccccuccagcc

SEQ ID NO: 935585 - RNA, 13 nt, Mycobacterium avium subsp. paratuberculosis
gcugggcccgcgc

SEQ ID NO: 935586 - RNA, 14 nt, Mycobacterium avium subsp. paratuberculosis
gcugggcccgcgca

SEQ ID NO: 935587 - RNA, 13 nt, Mycobacterium avium subsp. paratuberculosis
gcugggccgccag

SEQ ID NO: 935588 - RNA, 16 nt, Mycobacterium avium subsp. paratuberculosis
gcugggccgccagccg

SEQ ID NO: 935589 - RNA, 20 nt, Mycobacterium avium subsp. paratuberculosis
gcugggccgccagccgguac

SEQ ID NO: 935590 - RNA, 20 nt, Mycobacterium avium subsp. paratuberculosis
gcugggcggcgacaucgccg

SEQ ID NO: 935591 - RNA, 16 nt, Mycobacterium avium subsp. paratuberculosis
gcugggcggcgcgcug

SEQ ID NO: 935592 - RNA, 14 nt, Mycobacterium avium subsp. paratuberculosis
gcugggcggcgcgg

SEQ ID NO: 935593 - RNA, 22 nt, Mycobacterium avium subsp. paratuberculosis
gcugggcgcuagcugcgccggc

SEQ ID NO: 935594 - RNA, 16 nt, Mycobacterium avium subsp. paratuberculosis
gcugggcggauccgcg

SEQ ID NO: 935595 - RNA, 12 nt, Mycobacterium avium subsp. paratuberculosis
gcugggcggcac

SEQ ID NO: 935596 - RNA, 15 nt, Mycobacterium avium subsp. paratuberculosis
gcugggcggcaccac

SEQ ID NO: 935597 - RNA, 18 nt, Mycobacterium avium subsp. paratuberculosis
gcugggcggcaccacccg

SEQ ID NO: 935598 - RNA, 23 nt, Mycobacterium avium subsp. paratuberculosis
gcugggcgccauggcccacgacg

SEQ ID NO: 935599 - RNA, 14 nt, Mycobacterium avium subsp. paratuberculosis
gcugggcgcccaga

SEQ ID NO: 935600 - RNA, 16 nt, Mycobacterium avium subsp. paratuberculosis
gcugggccagcgcggu

SEQ ID NO: 935601 - RNA, 16 nt, Mycobacterium avium subsp. paratuberculosis
gcugggccgggcgguu

SEQ ID NO: 935602 - RNA, 14 nt, Mycobacterium avium subsp. paratuberculosis
gcugggcgaagccg

SEQ ID NO: 935603 - RNA, 18 nt, Mycobacterium avium subsp. paratuberculosis
gcugggcgaagccgaggu

SEQ ID NO: 935604 - RNA, 16 nt, Mycobacterium avium subsp. paratuberculosis
gcuggcugcggccccg

SEQ ID NO: 935605 - RNA, 18 nt, Mycobacterium avium subsp. paratuberculosis
gcuggcugcggccccggu

SEQ ID NO: 935606 - RNA, 13 nt, Mycobacterium avium subsp. paratuberculosis
gcuggcuucgcgg

SEQ ID NO: 935607 - RNA, 22 nt, Mycobacterium avium subsp. paratuberculosis
gcugggacagcgucaccaaugc

SEQ ID NO: 935608 - RNA, 17 nt, Mycobacterium avium subsp. paratuberculosis
gcugggacgggucggcg

SEQ ID NO: 935609 - RNA, 15 nt, Mycobacterium avium subsp. paratuberculosis
gcugggagcacguga

SEQ ID NO: 935610 - RNA, 18 nt, Mycobacterium avium subsp. paratuberculosis
gcugggagcgggccacgc

SEQ ID NO: 935611 - RNA, 16 nt, Mycobacterium avium subsp. paratuberculosis
gcugggcagccgcgcg

SEQ ID NO: 935612 - RNA, 14 nt, Mycobacterium avium subsp. paratuberculosis
gcugggcaccgucg

SEQ ID NO: 935613 - RNA, 23 nt, Mycobacterium avium subsp. paratuberculosis
gcuggcgggcgaucgccucggcc

SEQ ID NO: 935614 - RNA, 22 nt, Mycobacterium avium subsp. paratuberculosis
gcuggcggggcgugcccggcgc

SEQ ID NO: 935615 - RNA, 14 nt, Mycobacterium avium subsp. paratuberculosis
gcuggcggcgcggu

SEQ ID NO: 935616 - RNA, 14 nt, Mycobacterium avium subsp. paratuberculosis
gcuggcggccagcg

SEQ ID NO: 935617 - RNA, 24 nt, Mycobacterium avium subsp. paratuberculosis
gcuggcggcgaucaccgccgcggc

SEQ ID NO: 935618 - RNA, 15 nt, Mycobacterium avium subsp. paratuberculosis
gcugcucuuguccgc

SEQ ID NO: 935619 - RNA, 16 nt, Mycobacterium avium subsp. paratuberculosis
gcugcucuuguccgcg

SEQ ID NO: 935620 - RNA, 20 nt, Mycobacterium avium subsp. paratuberculosis
gcugcucuuguccgcguugg

SEQ ID NO: 935621 - RNA, 14 nt, Mycobacterium avium subsp. paratuberculosis
gcuggcggugucga

SEQ ID NO: 935622 - RNA, 22 nt, Mycobacterium avium subsp. paratuberculosis
gcuggcggugucgaagaccggu

SEQ ID NO: 935623 - RNA, 14 nt, Mycobacterium avium subsp. paratuberculosis
gcuggcgucgaacg

SEQ ID NO: 935624 - RNA, 20 nt, Mycobacterium avium subsp. paratuberculosis
gcuggcguagagccgcucgc

SEQ ID NO: 935625 - RNA, 13 nt, Mycobacterium avium subsp. paratuberculosis
gcuggcgucgauc

SEQ ID NO: 935626 - RNA, 17 nt, Mycobacterium avium subsp. paratuberculosis
gcuggcguugagcacgc

SEQ ID NO: 935627 - RNA, 17 nt, Mycobacterium avium subsp. paratuberculosis
gcuggcguugggcggga

SEQ ID NO: 935628 - RNA, 20 nt, Mycobacterium avium subsp. paratuberculosis
gcuggcgugacgcucgaggc

SEQ ID NO: 935629 - RNA, 17 nt, Mycobacterium avium subsp. paratuberculosis
gcuggcgugacgcucgg

SEQ ID NO: 935630 - RNA, 23 nt, Mycobacterium avium subsp. paratuberculosis
gcuggcgugacgcucggccgugg

SEQ ID NO: 935631 - RNA, 19 nt, Mycobacterium avium subsp. paratuberculosis
gcuggcgugacgcucggcg

SEQ ID NO: 935632 - RNA, 23 nt, Mycobacterium avium subsp. paratuberculosis
gcuggcgugacgcucggcggccg

SEQ ID NO: 935633 - RNA, 19 nt, Mycobacterium avium subsp. paratuberculosis
gcuggcgugcggcgcgguc

SEQ ID NO: 935634 - RNA, 21 nt, Mycobacterium avium subsp. paratuberculosis
gcuggcguggcacccgggcgc

SEQ ID NO: 935635 - RNA, 19 nt, Mycobacterium avium subsp. paratuberculosis
gcuggcguggcgccggcgc

SEQ ID NO: 935636 - RNA, 17 nt, Mycobacterium avium subsp. paratuberculosis
gcuggcguggcucggcc

SEQ ID NO: 935637 - RNA, 20 nt, Mycobacterium avium subsp. paratuberculosis
gcuggcguggcucggcccgc

SEQ ID NO: 935638 - RNA, 14 nt, Mycobacterium avium subsp. paratuberculosis
gcugcucgaaccgc

SEQ ID NO: 935639 - RNA, 17 nt, Mycobacterium avium subsp. paratuberculosis
gcugcucgaaccgcgag

SEQ ID NO: 935640 - RNA, 18 nt, Mycobacterium avium subsp. paratuberculosis
gcugcucgaaccgcgaga

SEQ ID NO: 935641 - RNA, 14 nt, Mycobacterium avium subsp. paratuberculosis
gcugcucccgaaag

SEQ ID NO: 935642 - RNA, 14 nt, Mycobacterium avium subsp. paratuberculosis
gcugcuccgggggc

SEQ ID NO: 935643 - RNA, 21 nt, Mycobacterium avium subsp. paratuberculosis
gcugcuccgggggcaccgcca

SEQ ID NO: 935644 - RNA, 23 nt, Mycobacterium avium subsp. paratuberculosis
gcugcuccggguccgcggugaug

SEQ ID NO: 935645 - RNA, 23 nt, Mycobacterium avium subsp. paratuberculosis
gcugcucguugugcauguggccg

SEQ ID NO: 935646 - RNA, 14 nt, Mycobacterium avium subsp. paratuberculosis
gcugcucugcgcgc

SEQ ID NO: 935647 - RNA, 17 nt, Mycobacterium avium subsp. paratuberculosis
gcugcucugcgcgcggu

SEQ ID NO: 935648 - RNA, 15 nt, Mycobacterium avium subsp. paratuberculosis
gcugcucguccuggc

SEQ ID NO: 935649 - RNA, 16 nt, Mycobacterium avium subsp. paratuberculosis
gcugcucguccuggcg

SEQ ID NO: 935650 - RNA, 13 nt, Mycobacterium avium subsp. paratuberculosis
gcugcucgagggc

SEQ ID NO: 935651 - RNA, 23 nt, Mycobacterium avium subsp. paratuberculosis
gcugcucgagggccuccaccacc

SEQ ID NO: 935652 - RNA, 16 nt, Mycobacterium avium subsp. paratuberculosis
gcugcucgcgcugccg

SEQ ID NO: 935653 - RNA, 22 nt, Mycobacterium avium subsp. paratuberculosis
gcugcucgcgcugccgcgcgcc

SEQ ID NO: 935654 - RNA, 16 nt, Mycobacterium avium subsp. paratuberculosis
gcugcucggccaccgc

SEQ ID NO: 935655 - RNA, 20 nt, Mycobacterium avium subsp. paratuberculosis
gcugcucggccaccgcgcgg

SEQ ID NO: 935656 - RNA, 21 nt, Mycobacterium avium subsp. paratuberculosis
gcugcucggccaccgcgcggu

SEQ ID NO: 935657 - RNA, 13 nt, Mycobacterium avium subsp. paratuberculosis
gcugcucggcggg

SEQ ID NO: 935658 - RNA, 18 nt, Mycobacterium avium subsp. paratuberculosis
gcugaugcccuugcggaa

SEQ ID NO: 935659 - RNA, 20 nt, Mycobacterium avium subsp. paratuberculosis
gcugcaaccgguccgccguc

SEQ ID NO: 935660 - RNA, 18 nt, Mycobacterium avium subsp. paratuberculosis
gcugaucuggaugcggcc

SEQ ID NO: 935661 - RNA, 17 nt, Mycobacterium avium subsp. paratuberculosis
gcugcaacgcgucggcg

SEQ ID NO: 935662 - RNA, 14 nt, Mycobacterium avium subsp. paratuberculosis
gcugcaacggcugg

SEQ ID NO: 935663 - RNA, 16 nt, Mycobacterium avium subsp. paratuberculosis
gcugcaacggcuggcg

SEQ ID NO: 935664 - RNA, 21 nt, Mycobacterium avium subsp. paratuberculosis
gcugcaacggcuggcgcaggu

SEQ ID NO: 935665 - RNA, 12 nt, Mycobacterium avium subsp. paratuberculosis
gcugcaccagcc

SEQ ID NO: 935666 - RNA, 15 nt, Mycobacterium avium subsp. paratuberculosis
gcugcaccagcccgu

SEQ ID NO: 935667 - RNA, 17 nt, Mycobacterium avium subsp. paratuberculosis
gcugcaccagcccgucg

SEQ ID NO: 935668 - RNA, 20 nt, Mycobacterium avium subsp. paratuberculosis
gcugcaccagcccgucggcc

SEQ ID NO: 935669 - RNA, 18 nt, Mycobacterium avium subsp. paratuberculosis
gcugcaccagggcgucga

SEQ ID NO: 935670 - RNA, 15 nt, Mycobacterium avium subsp. paratuberculosis
gcugcacccaccggc

SEQ ID NO: 935671 - RNA, 20 nt, Mycobacterium avium subsp. paratuberculosis
gcugcacccaccggcccagc

SEQ ID NO: 935672 - RNA, 22 nt, Mycobacterium avium subsp. paratuberculosis
gcugcacccaccggcccagccg

SEQ ID NO: 935673 - RNA, 16 nt, Mycobacterium avium subsp. paratuberculosis
gcugcacccaccggcg

SEQ ID NO: 935674 - RNA, 17 nt, Mycobacterium avium subsp. paratuberculosis
gcugcagaccgaacguc

SEQ ID NO: 935675 - RNA, 19 nt, Mycobacterium avium subsp. paratuberculosis
gcugcagauccgcucgccg

SEQ ID NO: 935676 - RNA, 21 nt, Mycobacterium avium subsp. paratuberculosis
gcugcagcagaugcgccucga

SEQ ID NO: 935677 - RNA, 22 nt, Mycobacterium avium subsp. paratuberculosis
gcugcagcagaugcgccucgau

SEQ ID NO: 935678 - RNA, 16 nt, Mycobacterium avium subsp. paratuberculosis
gcugcagcagcccgau

SEQ ID NO: 935679 - RNA, 22 nt, Mycobacterium avium subsp. paratuberculosis
gcugcagcagcccgaucacccc

SEQ ID NO: 935680 - RNA, 14 nt, Mycobacterium avium subsp. paratuberculosis
gcugcagcgcccgg

SEQ ID NO: 935681 - RNA, 15 nt, Mycobacterium avium subsp. paratuberculosis
gcugcagcgcccggg

SEQ ID NO: 935682 - RNA, 20 nt, Mycobacterium avium subsp. paratuberculosis
gcugcagcgccgaggccagc

SEQ ID NO: 935683 - RNA, 19 nt, Mycobacterium avium subsp. paratuberculosis
gcugcauccgcagcaccag

SEQ ID NO: 935684 - RNA, 20 nt, Mycobacterium avium subsp. paratuberculosis
gcugcagcgacuggaccacc

SEQ ID NO: 935685 - RNA, 20 nt, Mycobacterium avium subsp. paratuberculosis
gcugcagcgagaccucccgg

SEQ ID NO: 935686 - RNA, 14 nt, Mycobacterium avium subsp. paratuberculosis
gcugcagccggccg

SEQ ID NO: 935687 - RNA, 15 nt, Mycobacterium avium subsp. paratuberculosis
gcugcagccggccgg

SEQ ID NO: 935688 - RNA, 18 nt, Mycobacterium avium subsp. paratuberculosis
gcugcagccggccggcgg

SEQ ID NO: 935689 - RNA, 21 nt, Mycobacterium avium subsp. paratuberculosis
gcugcagccgggcggcggccu

SEQ ID NO: 935690 - RNA, 16 nt, Mycobacterium avium subsp. paratuberculosis
gcugcagccgguccgg

SEQ ID NO: 935691 - RNA, 15 nt, Mycobacterium avium subsp. paratuberculosis
gcugcagcauccagg

SEQ ID NO: 935692 - RNA, 21 nt, Mycobacterium avium subsp. paratuberculosis
gcugcagcauuuccgagcgac

SEQ ID NO: 935693 - RNA, 19 nt, Mycobacterium avium subsp. paratuberculosis
gcugccaagauugggccac

SEQ ID NO: 935694 - RNA, 18 nt, Mycobacterium avium subsp. paratuberculosis
gcugcaugccggugucgg

SEQ ID NO: 935695 - RNA, 15 nt, Mycobacterium avium subsp. paratuberculosis
gcugcaugccgucga

SEQ ID NO: 935696 - RNA, 14 nt, Mycobacterium avium subsp. paratuberculosis
gcugcaucuccagc

SEQ ID NO: 935697 - RNA, 17 nt, Mycobacterium avium subsp. paratuberculosis
gcugcaucuccagccgc

SEQ ID NO: 935698 - RNA, 19 nt, Mycobacterium avium subsp. paratuberculosis
gcugcaucuccagccgcgg

SEQ ID NO: 935699 - RNA, 20 nt, Mycobacterium avium subsp. paratuberculosis
gcugcaucuccagccgcggc

SEQ ID NO: 935700 - RNA, 21 nt, Mycobacterium avium subsp. paratuberculosis
gcugcaucuccguggacggcg

SEQ ID NO: 935701 - RNA, 20 nt, Mycobacterium avium subsp. paratuberculosis
gcugcccagauacgccgcga

SEQ ID NO: 935702 - RNA, 21 nt, Mycobacterium avium subsp. paratuberculosis
gcugcccagauacgccgcgac

SEQ ID NO: 935703 - RNA, 15 nt, Mycobacterium avium subsp. paratuberculosis
gcugcccagcgcggu

SEQ ID NO: 935704 - RNA, 20 nt, Mycobacterium avium subsp. paratuberculosis
gcugcccagcgcggucgcca

SEQ ID NO: 935705 - RNA, 19 nt, Mycobacterium avium subsp. paratuberculosis
gcugcccaggaucaccggg

SEQ ID NO: 935706 - RNA, 21 nt, Mycobacterium avium subsp. paratuberculosis
gcugcccaggaucaccgggac

SEQ ID NO: 935707 - RNA, 22 nt, Mycobacterium avium subsp. paratuberculosis
gcugcccaggaucaccgggacg

SEQ ID NO: 935708 - RNA, 23 nt, Mycobacterium avium subsp. paratuberculosis
gcugcccaggaucaccgggacgg

SEQ ID NO: 935709 - RNA, 19 nt, Mycobacterium avium subsp. paratuberculosis
gcugcccaacgucgacuug

SEQ ID NO: 935710 - RNA, 13 nt, Mycobacterium avium subsp. paratuberculosis
gcugcccaccacc

SEQ ID NO: 935711 - RNA, 14 nt, Mycobacterium avium subsp. paratuberculosis
gcugcccaccacca

SEQ ID NO: 935712 - RNA, 20 nt, Mycobacterium avium subsp. paratuberculosis
gcugcccaccagcaggucga

SEQ ID NO: 935713 - RNA, 14 nt, Mycobacterium avium subsp. paratuberculosis
gcugccgcaccccg

SEQ ID NO: 935714 - RNA, 14 nt, Mycobacterium avium subsp. paratuberculosis
gcugccgaccucga

SEQ ID NO: 935715 - RNA, 15 nt, Mycobacterium avium subsp. paratuberculosis
gcugccgaacaucag

SEQ ID NO: 935716 - RNA, 16 nt, Mycobacterium avium subsp. paratuberculosis
gcugcccucggucgcc

SEQ ID NO: 935717 - RNA, 20 nt, Mycobacterium avium subsp. paratuberculosis
gcugcccugaagcugggcgc

SEQ ID NO: 935718 - RNA, 23 nt, Mycobacterium avium subsp. paratuberculosis
gcugcccugaagcugggcgccca

SEQ ID NO: 935719 - RNA, 15 nt, Mycobacterium avium subsp. paratuberculosis
gcugcccgugccgca

SEQ ID NO: 935720 - RNA, 13 nt, Mycobacterium avium subsp. paratuberculosis
gcugcccgucgac

SEQ ID NO: 935721 - RNA, 14 nt, Mycobacterium avium subsp. paratuberculosis
gcugcccggcgcgg

SEQ ID NO: 935722 - RNA, 15 nt, Mycobacterium avium subsp. paratuberculosis
gcugcccggcgcgga

SEQ ID NO: 935723 - RNA, 23 nt, Mycobacterium avium subsp. paratuberculosis
gcugcccggcgcggacagcgcgg

SEQ ID NO: 935724 - RNA, 22 nt, Mycobacterium avium subsp. paratuberculosis
gcugcccgggcuguugaccacg

SEQ ID NO: 935725 - RNA, 21 nt, Mycobacterium avium subsp. paratuberculosis
gcugccccagccacagccgca

SEQ ID NO: 935726 - RNA, 13 nt, Mycobacterium avium subsp. paratuberculosis
gcugcccagggcg

SEQ ID NO: 935727 - RNA, 17 nt, Mycobacterium avium subsp. paratuberculosis
gcugcccauccaggcca

SEQ ID NO: 935728 - RNA, 20 nt, Mycobacterium avium subsp. paratuberculosis
gcugcccauccaggccagca

SEQ ID NO: 935729 - RNA, 22 nt, Mycobacterium avium subsp. paratuberculosis
gcugcgccaucuucacgugcgc

SEQ ID NO: 935730 - RNA, 24 nt, Mycobacterium avium subsp. paratuberculosis
gcugcgccaucuucacgugcgcgg

SEQ ID NO: 935731 - RNA, 16 nt, Mycobacterium avium subsp. paratuberculosis
gcugcgcccacgugcc

SEQ ID NO: 935732 - RNA, 13 nt, Mycobacterium avium subsp. paratuberculosis
gcugcgcccagcg

SEQ ID NO: 935733 - RNA, 19 nt, Mycobacterium avium subsp. paratuberculosis
gcugcgcccagcgcgcgau

SEQ ID NO: 935734 - RNA, 24 nt, Mycobacterium avium subsp. paratuberculosis
gcugcgcccagcgcgcgaucgccg

SEQ ID NO: 935735 - RNA, 14 nt, Mycobacterium avium subsp. paratuberculosis
gcugcgcccgccgc

SEQ ID NO: 935736 - RNA, 16 nt, Mycobacterium avium subsp. paratuberculosis
gcugcgcccgccgcca

SEQ ID NO: 935737 - RNA, 18 nt, Mycobacterium avium subsp. paratuberculosis
gcugcgcccgccgccacc

SEQ ID NO: 935738 - RNA, 22 nt, Mycobacterium avium subsp. paratuberculosis
gcugcgcccgccgccaccacgg

SEQ ID NO: 935739 - RNA, 12 nt, Mycobacterium avium subsp. paratuberculosis
gcugcgcccggu

SEQ ID NO: 935740 - RNA, 20 nt, Mycobacterium avium subsp. paratuberculosis
gcugcgccgacuugaucgcg

SEQ ID NO: 935741 - RNA, 15 nt, Mycobacterium avium subsp. paratuberculosis
gcugcgccggcggua

SEQ ID NO: 935742 - RNA, 17 nt, Mycobacterium avium subsp. paratuberculosis
gcugcgccggcgcggcc

SEQ ID NO: 935743 - RNA, 13 nt, Mycobacterium avium subsp. paratuberculosis
gcugcgccggcgg

SEQ ID NO: 935744 - RNA, 12 nt, Mycobacterium avium subsp. paratuberculosis
gcugcgccgcgc

SEQ ID NO: 935745 - RNA, 16 nt, Mycobacterium avium subsp. paratuberculosis
gcugcgccgcgucgac

SEQ ID NO: 935746 - RNA, 19 nt, Mycobacterium avium subsp. paratuberculosis
gcugcgccgcgucgacgcc

SEQ ID NO: 935747 - RNA, 20 nt, Mycobacterium avium subsp. paratuberculosis
gcugcgccgcgucgacgccg

SEQ ID NO: 935748 - RNA, 14 nt, Mycobacterium avium subsp. paratuberculosis
gcugccggcggccg

SEQ ID NO: 935749 - RNA, 20 nt, Mycobacterium avium subsp. paratuberculosis
gcugccggcggccgccggca

SEQ ID NO: 935750 - RNA, 21 nt, Mycobacterium avium subsp. paratuberculosis
gcugccggccggcagcugccc

SEQ ID NO: 935751 - RNA, 13 nt, Mycobacterium avium subsp. paratuberculosis
gcugccggccggg

SEQ ID NO: 935752 - RNA, 16 nt, Mycobacterium avium subsp. paratuberculosis
gcugccggccggggcg

SEQ ID NO: 935753 - RNA, 16 nt, Mycobacterium avium subsp. paratuberculosis
gcugccggcgcacccg

SEQ ID NO: 935754 - RNA, 12 nt, Mycobacterium avium subsp. paratuberculosis
gcugccggccaa

SEQ ID NO: 935755 - RNA, 18 nt, Mycobacterium avium subsp. paratuberculosis
gcugccggacaccccggc

SEQ ID NO: 935756 - RNA, 21 nt, Mycobacterium avium subsp. paratuberculosis
gcugccggacaccccggccag

SEQ ID NO: 935757 - RNA, 17 nt, Mycobacterium avium subsp. paratuberculosis
gcugccggaccucgacc

SEQ ID NO: 935758 - RNA, 18 nt, Mycobacterium avium subsp. paratuberculosis
gcugccgcugcgccggcg

SEQ ID NO: 935759 - RNA, 16 nt, Mycobacterium avium subsp. paratuberculosis
gcugccgcgccccgag

SEQ ID NO: 935760 - RNA, 18 nt, Mycobacterium avium subsp. paratuberculosis
gcugccgcgccccgagca

SEQ ID NO: 935761 - RNA, 21 nt, Mycobacterium avium subsp. paratuberculosis
gcugccgcgccccgagcagcg

SEQ ID NO: 935762 - RNA, 15 nt, Mycobacterium avium subsp. paratuberculosis
gcugccgcgccgcca

SEQ ID NO: 935763 - RNA, 14 nt, Mycobacterium avium subsp. paratuberculosis
gcugccgcgcgccg

SEQ ID NO: 935764 - RNA, 15 nt, Mycobacterium avium subsp. paratuberculosis
gcugccgccgccggc

SEQ ID NO: 935765 - RNA, 13 nt, Mycobacterium avium subsp. paratuberculosis
gcugccgccggcg

SEQ ID NO: 935766 - RNA, 14 nt, Mycobacterium avium subsp. paratuberculosis
gcugccgcccccgc

SEQ ID NO: 935767 - RNA, 14 nt, Mycobacterium avium subsp. paratuberculosis
gcugccgccgccgc

SEQ ID NO: 935768 - RNA, 12 nt, Mycobacterium avium subsp. paratuberculosis
gcugcguucggc

SEQ ID NO: 935769 - RNA, 13 nt, Mycobacterium avium subsp. paratuberculosis
gcugcguucggcg

SEQ ID NO: 935770 - RNA, 18 nt, Mycobacterium avium subsp. paratuberculosis
gcugcguucggcgaucag

SEQ ID NO: 935771 - RNA, 23 nt, Mycobacterium avium subsp. paratuberculosis
gcugcguucggcgaucagcugga

SEQ ID NO: 935772 - RNA, 20 nt, Mycobacterium avium subsp. paratuberculosis
gcugcgucggcaccagcggc

SEQ ID NO: 935773 - RNA, 14 nt, Mycobacterium avium subsp. paratuberculosis
gcugcgguuggccg

SEQ ID NO: 935774 - RNA, 23 nt, Mycobacterium avium subsp. paratuberculosis
gcugcgguuggccggccgggcgg

SEQ ID NO: 935775 - RNA, 20 nt, Mycobacterium avium subsp. paratuberculosis
gcugcgguuccgggcgcucu

SEQ ID NO: 935776 - RNA, 17 nt, Mycobacterium avium subsp. paratuberculosis
gcugcggguugcgggcc

SEQ ID NO: 935777 - RNA, 18 nt, Mycobacterium avium subsp. paratuberculosis
gcugcggguugcgggcca

SEQ ID NO: 935778 - RNA, 19 nt, Mycobacterium avium subsp. paratuberculosis
gcugcggguugcgggccag

SEQ ID NO: 935779 - RNA, 19 nt, Mycobacterium avium subsp. paratuberculosis
gcugcgguacacguggccg

SEQ ID NO: 935780 - RNA, 23 nt, Mycobacterium avium subsp. paratuberculosis
gcugcgguacacguggccgauca

SEQ ID NO: 935781 - RNA, 23 nt, Mycobacterium avium subsp. paratuberculosis
gcugcgcgcgcgaucggugucca

SEQ ID NO: 935782 - RNA, 16 nt, Mycobacterium avium subsp. paratuberculosis
gcugcgcgccccggcc

SEQ ID NO: 935783 - RNA, 21 nt, Mycobacterium avium subsp. paratuberculosis
gcugcgcgccccggcccggcg

SEQ ID NO: 935784 - RNA, 14 nt, Mycobacterium avium subsp. paratuberculosis
gcugcgggucagca

SEQ ID NO: 935785 - RNA, 18 nt, Mycobacterium avium subsp. paratuberculosis
gcugcgggucucgcccac

SEQ ID NO: 935786 - RNA, 23 nt, Mycobacterium avium subsp. paratuberculosis
gcugcgggucucgcccaccuugg

SEQ ID NO: 935787 - RNA, 12 nt, Mycobacterium avium subsp. paratuberculosis
gcugcgcgucga

SEQ ID NO: 935788 - RNA, 15 nt, Mycobacterium avium subsp. paratuberculosis
gcugcgcgucgaaga

SEQ ID NO: 935789 - RNA, 17 nt, Mycobacterium avium subsp. paratuberculosis
gcugcgcggccgaacuc

SEQ ID NO: 935790 - RNA, 13 nt, Mycobacterium avium subsp. paratuberculosis
gcugcgcgccgcc

SEQ ID NO: 935791 - RNA, 16 nt, Mycobacterium avium subsp. paratuberculosis
gcugcgcgccggcggc

SEQ ID NO: 935792 - RNA, 18 nt, Mycobacterium avium subsp. paratuberculosis
gcugcgcgccggcggccg

SEQ ID NO: 935793 - RNA, 14 nt, Mycobacterium avium subsp. paratuberculosis
gcugcgcggcggcg

SEQ ID NO: 935794 - RNA, 15 nt, Mycobacterium avium subsp. paratuberculosis
gcugcgcgggcgcgg

SEQ ID NO: 935795 - RNA, 23 nt, Mycobacterium avium subsp. paratuberculosis
gcugcgcgggcgcggccagcgcg

SEQ ID NO: 935796 - RNA, 21 nt, Mycobacterium avium subsp. paratuberculosis
gcucguugugaauccagccgu

SEQ ID NO: 935797 - RNA, 15 nt, Mycobacterium avium subsp. paratuberculosis
gcucguucucggcga

SEQ ID NO: 935798 - RNA, 13 nt, Mycobacterium avium subsp. paratuberculosis
gcucguugccggc

SEQ ID NO: 935799 - RNA, 15 nt, Mycobacterium avium subsp. paratuberculosis
gcucguugccggcgg

SEQ ID NO: 935800 - RNA, 16 nt, Mycobacterium avium subsp. paratuberculosis
gcucguugccggcggc

SEQ ID NO: 935801 - RNA, 17 nt, Mycobacterium avium subsp. paratuberculosis
gcucguugccggcggcc

SEQ ID NO: 935802 - RNA, 18 nt, Mycobacterium avium subsp. paratuberculosis
gcucguugccggcggcca

SEQ ID NO: 935803 - RNA, 19 nt, Mycobacterium avium subsp. paratuberculosis
gcucguugccggcggccag

SEQ ID NO: 935804 - RNA, 20 nt, Mycobacterium avium subsp. paratuberculosis
gcucuccugcuugaccgugg

SEQ ID NO: 935805 - RNA, 22 nt, Mycobacterium avium subsp. paratuberculosis
gcucgggaacggucagccgcgg

SEQ ID NO: 935806 - RNA, 19 nt, Mycobacterium avium subsp. paratuberculosis
gcucgugguucuccgcgac

SEQ ID NO: 935807 - RNA, 14 nt, Mycobacterium avium subsp. paratuberculosis
gcucggcucggccg

SEQ ID NO: 935808 - RNA, 19 nt, Mycobacterium avium subsp. paratuberculosis
gcucggcucggccggccgg

SEQ ID NO: 935809 - RNA, 14 nt, Mycobacterium avium subsp. paratuberculosis
gcucggcugcaggc

SEQ ID NO: 935810 - RNA, 19 nt, Mycobacterium avium subsp. paratuberculosis
gcucgggcagcccgccgac

SEQ ID NO: 935811 - RNA, 14 nt, Mycobacterium avium subsp. paratuberculosis
gcucgggcagcgug

SEQ ID NO: 935812 - RNA, 17 nt, Mycobacterium avium subsp. paratuberculosis
gcucgggcagcgugucc

SEQ ID NO: 935813 - RNA, 13 nt, Mycobacterium avium subsp. paratuberculosis
gcucgggccauga

SEQ ID NO: 935814 - RNA, 14 nt, Mycobacterium avium subsp. paratuberculosis
gcucgggcccgcgc

SEQ ID NO: 935815 - RNA, 16 nt, Mycobacterium avium subsp. paratuberculosis
gcucgggcccgcgcac

SEQ ID NO: 935816 - RNA, 14 nt, Mycobacterium avium subsp. paratuberculosis
gcucgggccggcgc

SEQ ID NO: 935817 - RNA, 16 nt, Mycobacterium avium subsp. paratuberculosis
gcucgggccggcgccg

SEQ ID NO: 935818 - RNA, 16 nt, Mycobacterium avium subsp. paratuberculosis
gcucggcguuggcgua

SEQ ID NO: 935819 - RNA, 20 nt, Mycobacterium avium subsp. paratuberculosis
gcucggcguuggcguagucg

SEQ ID NO: 935820 - RNA, 18 nt, Mycobacterium avium subsp. paratuberculosis
gcucggcguugagccggc

SEQ ID NO: 935821 - RNA, 20 nt, Mycobacterium avium subsp. paratuberculosis
gcucggcguugagccggcgc

SEQ ID NO: 935822 - RNA, 13 nt, Mycobacterium avium subsp. paratuberculosis
gcucggcgucgua

SEQ ID NO: 935823 - RNA, 14 nt, Mycobacterium avium subsp. paratuberculosis
gcucggcguggcgc

SEQ ID NO: 935824 - RNA, 22 nt, Mycobacterium avium subsp. paratuberculosis
gcucggcguggcgcucagcggc

SEQ ID NO: 935825 - RNA, 14 nt, Mycobacterium avium subsp. paratuberculosis
gcucggcguggucg

SEQ ID NO: 935826 - RNA, 20 nt, Mycobacterium avium subsp. paratuberculosis
gcucggcgggucacucgacc

SEQ ID NO: 935827 - RNA, 20 nt, Mycobacterium avium subsp. paratuberculosis
gcucggcggguugcugagcc

SEQ ID NO: 935828 - RNA, 23 nt, Mycobacterium avium subsp. paratuberculosis
gcucggcggguugcugagccgcc

SEQ ID NO: 935829 - RNA, 17 nt, Mycobacterium avium subsp. paratuberculosis
gcucggcguacaggccg

SEQ ID NO: 935830 - RNA, 21 nt, Mycobacterium avium subsp. paratuberculosis
gcucggcguacaggccgucgg

SEQ ID NO: 935831 - RNA, 22 nt, Mycobacterium avium subsp. paratuberculosis
gcucggcguacaggccgucggg

SEQ ID NO: 935832 - RNA, 23 nt, Mycobacterium avium subsp. paratuberculosis
gcucggcguauucgucgucggcc

SEQ ID NO: 935833 - RNA, 15 nt, Mycobacterium avium subsp. paratuberculosis
gcucggcguccagca

SEQ ID NO: 935834 - RNA, 18 nt, Mycobacterium avium subsp. paratuberculosis
gcucggcgucccgcgcca

SEQ ID NO: 935835 - RNA, 14 nt, Mycobacterium avium subsp. paratuberculosis
gcugaacagcagca

SEQ ID NO: 935836 - RNA, 15 nt, Mycobacterium avium subsp. paratuberculosis
gcugaacagcagcag

SEQ ID NO: 935837 - RNA, 16 nt, Mycobacterium avium subsp. paratuberculosis
gcugaaccaccgcgcc

SEQ ID NO: 935838 - RNA, 21 nt, Mycobacterium avium subsp. paratuberculosis
gcugaaccaccgcgcccaccc

SEQ ID NO: 935839 - RNA, 19 nt, Mycobacterium avium subsp. paratuberculosis
gcugaaccgguagucgucg

SEQ ID NO: 935840 - RNA, 20 nt, Mycobacterium avium subsp. paratuberculosis
gcugaaccgguagucgucga

SEQ ID NO: 935841 - RNA, 21 nt, Mycobacterium avium subsp. paratuberculosis
gcugaacgccugccggcgccg

SEQ ID NO: 935842 - RNA, 21 nt, Mycobacterium avium subsp. paratuberculosis
gcugaagugcacucggcgaug

SEQ ID NO: 935843 - RNA, 22 nt, Mycobacterium avium subsp. paratuberculosis
gcugaagugcacucggcgaugc

SEQ ID NO: 935844 - RNA, 16 nt, Mycobacterium avium subsp. paratuberculosis
gcugaagugcagcgca

SEQ ID NO: 935845 - RNA, 20 nt, Mycobacterium avium subsp. paratuberculosis
gcugaaguucaccaccgcgc

SEQ ID NO: 935846 - RNA, 16 nt, Mycobacterium avium subsp. paratuberculosis
gcugaacagcgcgccg

SEQ ID NO: 935847 - RNA, 19 nt, Mycobacterium avium subsp. paratuberculosis
gcugaaugaacgaccuggu

SEQ ID NO: 935848 - RNA, 22 nt, Mycobacterium avium subsp. paratuberculosis
gcugaacacgaacccggcggcc

SEQ ID NO: 935849 - RNA, 17 nt, Mycobacterium avium subsp. paratuberculosis
gcucucguccucgaaca

SEQ ID NO: 935850 - RNA, 20 nt, Mycobacterium avium subsp. paratuberculosis
gcucucgccggucagcacgu

SEQ ID NO: 935851 - RNA, 14 nt, Mycobacterium avium subsp. paratuberculosis
gcucugcagagcgg

SEQ ID NO: 935852 - RNA, 14 nt, Mycobacterium avium subsp. paratuberculosis
gcugaucucgacgg

SEQ ID NO: 935853 - RNA, 15 nt, Mycobacterium avium subsp. paratuberculosis
gcugaucucgacggu

SEQ ID NO: 935854 - RNA, 20 nt, Mycobacterium avium subsp. paratuberculosis
gcugaucucgacgguggccu

SEQ ID NO: 935855 - RNA, 22 nt, Mycobacterium avium subsp. paratuberculosis
gcugaucucgacgguggccucg

SEQ ID NO: 935856 - RNA, 12 nt, Mycobacterium avium subsp. paratuberculosis
gcugaucggcgu

SEQ ID NO: 935857 - RNA, 19 nt, Mycobacterium avium subsp. paratuberculosis
gcugaucugcggcaccacg

SEQ ID NO: 935858 - RNA, 20 nt, Mycobacterium avium subsp. paratuberculosis
gcugaucugcggcaccacgc

SEQ ID NO: 935859 - RNA, 20 nt, Mycobacterium avium subsp. paratuberculosis
gcugaucgcgauccgggcgc

SEQ ID NO: 935860 - RNA, 22 nt, Mycobacterium avium subsp. paratuberculosis
gcugaucgcgauccgggcgccg

SEQ ID NO: 935861 - RNA, 16 nt, Mycobacterium avium subsp. paratuberculosis
gcugauccgcgacgcc

SEQ ID NO: 935862 - RNA, 13 nt, Mycobacterium avium subsp. paratuberculosis
gcugaucgcggcc

SEQ ID NO: 935863 - RNA, 17 nt, Mycobacterium avium subsp. paratuberculosis
gcugaucgcggccggcg

SEQ ID NO: 935864 - RNA, 18 nt, Mycobacterium avium subsp. paratuberculosis
gcugaucgcggccggcga

SEQ ID NO: 935865 - RNA, 19 nt, Mycobacterium avium subsp. paratuberculosis
gcugaucgcggccggcgag

SEQ ID NO: 935866 - RNA, 19 nt, Mycobacterium avium subsp. paratuberculosis
gcugaucgcgucgacggcg

SEQ ID NO: 935867 - RNA, 20 nt, Mycobacterium avium subsp. paratuberculosis
gcugaucgcgucgacggcgc

SEQ ID NO: 935868 - RNA, 20 nt, Mycobacterium avium subsp. paratuberculosis
gcugaucagccggcgagcgc

SEQ ID NO: 935869 - RNA, 22 nt, Mycobacterium avium subsp. paratuberculosis
gcugaucagcucuucgauggcc

SEQ ID NO: 935870 - RNA, 23 nt, Mycobacterium avium subsp. paratuberculosis
gcugaucagcucuucgauggcca

SEQ ID NO: 935871 - RNA, 14 nt, Mycobacterium avium subsp. paratuberculosis
gcugauccccagcg

SEQ ID NO: 935872 - RNA, 19 nt, Mycobacterium avium subsp. paratuberculosis
gcugauccccagcggcacg

SEQ ID NO: 935873 - RNA, 19 nt, Mycobacterium avium subsp. paratuberculosis
gcugauccgcaggaugccg

SEQ ID NO: 935874 - RNA, 21 nt, Mycobacterium avium subsp. paratuberculosis
gcugauccgcaggaugccgau

SEQ ID NO: 935875 - RNA, 20 nt, Mycobacterium avium subsp. paratuberculosis
gcugagucuacuuggccagc

SEQ ID NO: 935876 - RNA, 23 nt, Mycobacterium avium subsp. paratuberculosis
gcugagucuacuuggccagcugc

SEQ ID NO: 935877 - RNA, 17 nt, Mycobacterium avium subsp. paratuberculosis
gcugauagcccgccgcg

SEQ ID NO: 935878 - RNA, 18 nt, Mycobacterium avium subsp. paratuberculosis
gcugauagcccgccgcgg

SEQ ID NO: 935879 - RNA, 19 nt, Mycobacterium avium subsp. paratuberculosis
gcugauagcccgccgcggc

SEQ ID NO: 935880 - RNA, 13 nt, Mycobacterium avium subsp. paratuberculosis
gcugauagccgcc

SEQ ID NO: 935881 - RNA, 16 nt, Mycobacterium avium subsp. paratuberculosis
gcugauacccgcgcgg

SEQ ID NO: 935882 - RNA, 16 nt, Mycobacterium avium subsp. paratuberculosis
gcugagcugcgcccac

SEQ ID NO: 935883 - RNA, 21 nt, Mycobacterium avium subsp. paratuberculosis
gcugagcuucugcccggccag

SEQ ID NO: 935884 - RNA, 23 nt, Mycobacterium avium subsp. paratuberculosis
gcugagcuucugcccggccagca

SEQ ID NO: 935885 - RNA, 18 nt, Mycobacterium avium subsp. paratuberculosis
gcugaggccgccccggcc

SEQ ID NO: 935886 - RNA, 19 nt, Mycobacterium avium subsp. paratuberculosis
gcugagguagucccgcgcc

SEQ ID NO: 935887 - RNA, 22 nt, Mycobacterium avium subsp. paratuberculosis
gcugagguagucccgcgccugg

SEQ ID NO: 935888 - RNA, 23 nt, Mycobacterium avium subsp. paratuberculosis
gcugagguagucccgcgccuggc

SEQ ID NO: 935889 - RNA, 19 nt, Mycobacterium avium subsp. paratuberculosis
gcugaguaugcagaugaug

SEQ ID NO: 935890 - RNA, 14 nt, Mycobacterium avium subsp. paratuberculosis
gcugagccgccgag

SEQ ID NO: 935891 - RNA, 22 nt, Mycobacterium avium subsp. paratuberculosis
gcugagccgccgagccggcacg

SEQ ID NO: 935892 - RNA, 17 nt, Mycobacterium avium subsp. paratuberculosis
gcugagccgcucgucga

SEQ ID NO: 935893 - RNA, 21 nt, Mycobacterium avium subsp. paratuberculosis
gcugagcggguaaccgcagcc

SEQ ID NO: 935894 - RNA, 15 nt, Mycobacterium avium subsp. paratuberculosis
gcugagcgggucggc

SEQ ID NO: 935895 - RNA, 17 nt, Mycobacterium avium subsp. paratuberculosis
gcugagcgggucggccg

SEQ ID NO: 935896 - RNA, 19 nt, Mycobacterium avium subsp. paratuberculosis
gcugagcgggucggccggc

SEQ ID NO: 935897 - RNA, 21 nt, Mycobacterium avium subsp. paratuberculosis
gcugagcgggucggccggcgg

SEQ ID NO: 935898 - RNA, 22 nt, Mycobacterium avium subsp. paratuberculosis
gcugagcgggucggccggcggg

SEQ ID NO: 935899 - RNA, 17 nt, Mycobacterium avium subsp. paratuberculosis
gcugagcguggugaagc

SEQ ID NO: 935900 - RNA, 16 nt, Mycobacterium avium subsp. paratuberculosis
gcugagcaaccgccga

SEQ ID NO: 935901 - RNA, 21 nt, Mycobacterium avium subsp. paratuberculosis
gcugagcaauucggugacggc

SEQ ID NO: 935902 - RNA, 22 nt, Mycobacterium avium subsp. paratuberculosis
gcugagcacccgcagcucgccg

SEQ ID NO: 935903 - RNA, 23 nt, Mycobacterium avium subsp. paratuberculosis
gcugagcacccgcagcucgccga

SEQ ID NO: 935904 - RNA, 13 nt, Mycobacterium avium subsp. paratuberculosis
gcugagcaccggg

SEQ ID NO: 935905 - RNA, 16 nt, Mycobacterium avium subsp. paratuberculosis
gcugagcagaucaucg

SEQ ID NO: 935906 - RNA, 13 nt, Mycobacterium avium subsp. paratuberculosis
gcugagcagcacc

SEQ ID NO: 935907 - RNA, 14 nt, Mycobacterium avium subsp. paratuberculosis
gcugagcagcaccc

SEQ ID NO: 935908 - RNA, 16 nt, Mycobacterium avium subsp. paratuberculosis
gcugagcagcacccga

SEQ ID NO: 935909 - RNA, 12 nt, Mycobacterium avium subsp. paratuberculosis
gcugagcagcag

SEQ ID NO: 935910 - RNA, 15 nt, Mycobacterium avium subsp. paratuberculosis
gcugagcagcagguc

SEQ ID NO: 935911 - RNA, 13 nt, Mycobacterium avium subsp. paratuberculosis
gcugagcagcccg

SEQ ID NO: 935912 - RNA, 19 nt, Mycobacterium avium subsp. paratuberculosis
gcugagcagcccgaccacc

SEQ ID NO: 935913 - RNA, 16 nt, Mycobacterium avium subsp. paratuberculosis
gcugagcaccgggguc

SEQ ID NO: 935914 - RNA, 17 nt, Mycobacterium avium subsp. paratuberculosis
gcugagcaccggggucu

SEQ ID NO: 935915 - RNA, 15 nt, Mycobacterium avium subsp. paratuberculosis
gcugagcagcucgcg

SEQ ID NO: 935916 - RNA, 16 nt, Mycobacterium avium subsp. paratuberculosis
gcugagcagcucgcgg

SEQ ID NO: 935917 - RNA, 18 nt, Mycobacterium avium subsp. paratuberculosis
gcugagcagcucgcggau

SEQ ID NO: 935918 - RNA, 17 nt, Mycobacterium avium subsp. paratuberculosis
gcugagcagguccucga

SEQ ID NO: 935919 - RNA, 22 nt, Mycobacterium avium subsp. paratuberculosis
gcugagcacggugggcgccggg

SEQ ID NO: 935920 - RNA, 14 nt, Mycobacterium avium subsp. paratuberculosis
gcugaccaccgagg

SEQ ID NO: 935921 - RNA, 14 nt, Mycobacterium avium subsp. paratuberculosis
gcugacccgcccgg

SEQ ID NO: 935922 - RNA, 12 nt, Mycobacterium avium subsp. paratuberculosis
gcugacccagcg

SEQ ID NO: 935923 - RNA, 15 nt, Mycobacterium avium subsp. paratuberculosis
gcugacccagcgcgg

SEQ ID NO: 935924 - RNA, 15 nt, Mycobacterium avium subsp. paratuberculosis
gcugaccccgcucgg

SEQ ID NO: 935925 - RNA, 17 nt, Mycobacterium avium subsp. paratuberculosis
gcugaccccgcucggcg

SEQ ID NO: 935926 - RNA, 23 nt, Mycobacterium avium subsp. paratuberculosis
gcugaccccgcucggcguggcgc

SEQ ID NO: 935927 - RNA, 16 nt, Mycobacterium avium subsp. paratuberculosis
gcugacccgccgcaac

SEQ ID NO: 935928 - RNA, 14 nt, Mycobacterium avium subsp. paratuberculosis
gcugacacccgacg

SEQ ID NO: 935929 - RNA, 20 nt, Mycobacterium avium subsp. paratuberculosis
gcugacacccgacgaagccg

SEQ ID NO: 935930 - RNA, 17 nt, Mycobacterium avium subsp. paratuberculosis
gcugaccaaggccgaca

SEQ ID NO: 935931 - RNA, 12 nt, Mycobacterium avium subsp. paratuberculosis
gcugaccagcgu

SEQ ID NO: 935932 - RNA, 14 nt, Mycobacterium avium subsp. paratuberculosis
gcugaccagcguga

SEQ ID NO: 935933 - RNA, 16 nt, Mycobacterium avium subsp. paratuberculosis
gcugaccagcgugacc

SEQ ID NO: 935934 - RNA, 13 nt, Mycobacterium avium subsp. paratuberculosis
gcugaccaggccg

SEQ ID NO: 935935 - RNA, 19 nt, Mycobacterium avium subsp. paratuberculosis
gcugaccaggccguccacc

SEQ ID NO: 935936 - RNA, 11 nt, Mycobacterium avium subsp. paratuberculosis
gcugaccagcg

SEQ ID NO: 935937 - RNA, 19 nt, Mycobacterium avium subsp. paratuberculosis
gcugaccagcgccucgcgg

SEQ ID NO: 935938 - RNA, 15 nt, Mycobacterium avium subsp. paratuberculosis
gcucgcagucgauca

SEQ ID NO: 935939 - RNA, 18 nt, Mycobacterium avium subsp. paratuberculosis
gcucgcagucgaucagcg

SEQ ID NO: 935940 - RNA, 20 nt, Mycobacterium avium subsp. paratuberculosis
gcucgcaggcgagccgacag

SEQ ID NO: 935941 - RNA, 21 nt, Mycobacterium avium subsp. paratuberculosis
gcucgccaccccgcgccacgc

SEQ ID NO: 935942 - RNA, 23 nt, Mycobacterium avium subsp. paratuberculosis
gcucgccaccccgcgccacgccg

SEQ ID NO: 935943 - RNA, 21 nt, Mycobacterium avium subsp. paratuberculosis
gcucgccagacucacggcggc

SEQ ID NO: 935944 - RNA, 14 nt, Mycobacterium avium subsp. paratuberculosis
gcucgcccagcacc

SEQ ID NO: 935945 - RNA, 16 nt, Mycobacterium avium subsp. paratuberculosis
gcucgcccagcgcggc

SEQ ID NO: 935946 - RNA, 23 nt, Mycobacterium avium subsp. paratuberculosis
gcucgcccgggcuaucgcccggc

SEQ ID NO: 935947 - RNA, 21 nt, Mycobacterium avium subsp. paratuberculosis
gcucgccgucggccagcagcg

SEQ ID NO: 935948 - RNA, 23 nt, Mycobacterium avium subsp. paratuberculosis
gcucgccgucggccagcagcgcg

SEQ ID NO: 935949 - RNA, 21 nt, Mycobacterium avium subsp. paratuberculosis
gcucgcgaagcgcgaugcggc

SEQ ID NO: 935950 - RNA, 17 nt, Mycobacterium avium subsp. paratuberculosis
gcucgcgagggcgggcc

SEQ ID NO: 935951 - RNA, 22 nt, Mycobacterium avium subsp. paratuberculosis
gcucgcgagggcgggccagcuc

SEQ ID NO: 935952 - RNA, 23 nt, Mycobacterium avium subsp. paratuberculosis
gcucgccugacuaagucaccagg

SEQ ID NO: 935953 - RNA, 13 nt, Mycobacterium avium subsp. paratuberculosis
gcucgcgcaccgg

SEQ ID NO: 935954 - RNA, 14 nt, Mycobacterium avium subsp. paratuberculosis
gcucgcgcaccggg

SEQ ID NO: 935955 - RNA, 16 nt, Mycobacterium avium subsp. paratuberculosis
gcucgcgcaccgggac

SEQ ID NO: 935956 - RNA, 23 nt, Mycobacterium avium subsp. paratuberculosis
gcucgcgcagcagcugcacccgc

SEQ ID NO: 935957 - RNA, 20 nt, Mycobacterium avium subsp. paratuberculosis
gcucgcgggugcgcugcagc

SEQ ID NO: 935958 - RNA, 15 nt, Mycobacterium avium subsp. paratuberculosis
gcucgcgggugcggc

SEQ ID NO: 935959 - RNA, 19 nt, Mycobacterium avium subsp. paratuberculosis
gcucgcgggccacagcggc

SEQ ID NO: 935960 - RNA, 20 nt, Mycobacterium avium subsp. paratuberculosis
gcucgcgggccacagcggcg

SEQ ID NO: 935961 - RNA, 22 nt, Mycobacterium avium subsp. paratuberculosis
gcucgcgggccacagcggcgac

SEQ ID NO: 935962 - RNA, 14 nt, Mycobacterium avium subsp. paratuberculosis
gcucgcgggcccgc

SEQ ID NO: 935963 - RNA, 16 nt, Mycobacterium avium subsp. paratuberculosis
gcucgcgggcccgcgc

SEQ ID NO: 935964 - RNA, 19 nt, Mycobacterium avium subsp. paratuberculosis
gcucgcgggcccgcgccgc

SEQ ID NO: 935965 - RNA, 10 nt, Mycobacterium avium subsp. paratuberculosis
gcucgcgggc

SEQ ID NO: 935966 - RNA, 14 nt, Mycobacterium avium subsp. paratuberculosis
gcucgcgggggccg

SEQ ID NO: 935967 - RNA, 22 nt, Mycobacterium avium subsp. paratuberculosis
gcucgcggccguagccggaccg

SEQ ID NO: 935968 - RNA, 15 nt, Mycobacterium avium subsp. paratuberculosis
gcucgcggccugcgg

SEQ ID NO: 935969 - RNA, 21 nt, Mycobacterium avium subsp. paratuberculosis
gcucgcggccugcgggcgccg

SEQ ID NO: 935970 - RNA, 23 nt, Mycobacterium avium subsp. paratuberculosis
gcucgcggccugcgggcgccggc

SEQ ID NO: 935971 - RNA, 15 nt, Mycobacterium avium subsp. paratuberculosis
gcucgcgcagccggc

SEQ ID NO: 935972 - RNA, 17 nt, Mycobacterium avium subsp. paratuberculosis
gcucgcgcagccggccg

SEQ ID NO: 935973 - RNA, 19 nt, Mycobacterium avium subsp. paratuberculosis
gcucgcgcagccggccgac

SEQ ID NO: 935974 - RNA, 17 nt, Mycobacterium avium subsp. paratuberculosis
gcucgcggauccgcagc

SEQ ID NO: 935975 - RNA, 17 nt, Mycobacterium avium subsp. paratuberculosis
gcucgcggauccgggcc

SEQ ID NO: 935976 - RNA, 14 nt, Mycobacterium avium subsp. paratuberculosis
gcucgcggcgcagc

SEQ ID NO: 935977 - RNA, 17 nt, Mycobacterium avium subsp. paratuberculosis
gcucgcggcgcagcucg

SEQ ID NO: 935978 - RNA, 18 nt, Mycobacterium avium subsp. paratuberculosis
gcucgcggcgcagcucgc

SEQ ID NO: 935979 - RNA, 20 nt, Mycobacterium avium subsp. paratuberculosis
gcucgcggcguaggcggcca

SEQ ID NO: 935980 - RNA, 16 nt, Mycobacterium avium subsp. paratuberculosis
gcucgcuugccagccg

SEQ ID NO: 935981 - RNA, 20 nt, Mycobacterium avium subsp. paratuberculosis
gcucgcuugccagccgggcc

SEQ ID NO: 935982 - RNA, 22 nt, Mycobacterium avium subsp. paratuberculosis
gcucggaaugaacugccgcggc

SEQ ID NO: 935983 - RNA, 17 nt, Mycobacterium avium subsp. paratuberculosis
gcucgcggugcgcgcgc

SEQ ID NO: 935984 - RNA, 20 nt, Mycobacterium avium subsp. paratuberculosis
gcucgcggugcgcgcgcgcu

SEQ ID NO: 935985 - RNA, 14 nt, Mycobacterium avium subsp. paratuberculosis
gcucgcgguguggg

SEQ ID NO: 935986 - RNA, 19 nt, Mycobacterium avium subsp. paratuberculosis
gcucgcgguugggccgccg

SEQ ID NO: 935987 - RNA, 18 nt, Mycobacterium avium subsp. paratuberculosis
gcucgcgguugggccggc

SEQ ID NO: 935988 - RNA, 20 nt, Mycobacterium avium subsp. paratuberculosis
gcucgcgguugggccggcgc

SEQ ID NO: 935989 - RNA, 21 nt, Mycobacterium avium subsp. paratuberculosis
gcucgcguacgaccguagccg

SEQ ID NO: 935990 - RNA, 13 nt, Mycobacterium avium subsp. paratuberculosis
gcucgcgucgacg

SEQ ID NO: 935991 - RNA, 12 nt, Mycobacterium avium subsp. paratuberculosis
gcucggccgaug

SEQ ID NO: 935992 - RNA, 23 nt, Mycobacterium avium subsp. paratuberculosis
gcucggcccgccgggcgccacgc

SEQ ID NO: 935993 - RNA, 20 nt, Mycobacterium avium subsp. paratuberculosis
gcucggcccgcugcgcggcc

SEQ ID NO: 935994 - RNA, 14 nt, Mycobacterium avium subsp. paratuberculosis
gcucggccaccagc

SEQ ID NO: 935995 - RNA, 17 nt, Mycobacterium avium subsp. paratuberculosis
gcucggccaccagcgcc

SEQ ID NO: 935996 - RNA, 14 nt, Mycobacterium avium subsp. paratuberculosis
gcucggccaccgcg

SEQ ID NO: 935997 - RNA, 18 nt, Mycobacterium avium subsp. paratuberculosis
gcucggccaccgcgcggu

SEQ ID NO: 935998 - RNA, 20 nt, Mycobacterium avium subsp. paratuberculosis
gcucggccaccgcgcggugc

SEQ ID NO: 935999 - RNA, 18 nt, Mycobacterium avium subsp. paratuberculosis
gcucggccacgacgcgcc

SEQ ID NO: 936000 - RNA, 21 nt, Mycobacterium avium subsp. paratuberculosis
gcucggccacgacgcgccacg

SEQ ID NO: 936001 - RNA, 22 nt, Mycobacterium avium subsp. paratuberculosis
gcucggaguaguccagcaccgc

SEQ ID NO: 936002 - RNA, 17 nt, Mycobacterium avium subsp. paratuberculosis
gcucggaguucgcccgc

SEQ ID NO: 936003 - RNA, 19 nt, Mycobacterium avium subsp. paratuberculosis
gcucggaguugcgcagccg

SEQ ID NO: 936004 - RNA, 22 nt, Mycobacterium avium subsp. paratuberculosis
gcucggaguugcgcagccgggc

SEQ ID NO: 936005 - RNA, 16 nt, Mycobacterium avium subsp. paratuberculosis
gcucggcaccagagcg

SEQ ID NO: 936006 - RNA, 20 nt, Mycobacterium avium subsp. paratuberculosis
gcucggcaccagagcgccgg

SEQ ID NO: 936007 - RNA, 14 nt, Mycobacterium avium subsp. paratuberculosis
gcucggcagccggc

SEQ ID NO: 936008 - RNA, 12 nt, Mycobacterium avium subsp. paratuberculosis
gcucggcggccu

SEQ ID NO: 936009 - RNA, 12 nt, Mycobacterium avium subsp. paratuberculosis
gcucggcggccg

SEQ ID NO: 936010 - RNA, 16 nt, Mycobacterium avium subsp. paratuberculosis
gcucggcggccgccag

SEQ ID NO: 936011 - RNA, 17 nt, Mycobacterium avium subsp. paratuberculosis
gcucggcggccgccagc

SEQ ID NO: 936012 - RNA, 14 nt, Mycobacterium avium subsp. paratuberculosis
gcucggcggcccgc

SEQ ID NO: 936013 - RNA, 15 nt, Mycobacterium avium subsp. paratuberculosis
gcucggcggcccgcc

SEQ ID NO: 936014 - RNA, 16 nt, Mycobacterium avium subsp. paratuberculosis
gcucggcggcccgccg

SEQ ID NO: 936015 - RNA, 17 nt, Mycobacterium avium subsp. paratuberculosis
gcucggcggcccgccgg

SEQ ID NO: 936016 - RNA, 18 nt, Mycobacterium avium subsp. paratuberculosis
gcucggcggcccgccgga

SEQ ID NO: 936017 - RNA, 15 nt, Mycobacterium avium subsp. paratuberculosis
gcucggcgacaacag

SEQ ID NO: 936018 - RNA, 19 nt, Mycobacterium avium subsp. paratuberculosis
gcucggcgacaacagcgcc

SEQ ID NO: 936019 - RNA, 13 nt, Mycobacterium avium subsp. paratuberculosis
gcucggcgaccgc

SEQ ID NO: 936020 - RNA, 18 nt, Mycobacterium avium subsp. paratuberculosis
gcucggcgaccgccggug

SEQ ID NO: 936021 - RNA, 17 nt, Mycobacterium avium subsp. paratuberculosis
gcucggcggccucgccg

SEQ ID NO: 936022 - RNA, 13 nt, Mycobacterium avium subsp. paratuberculosis
gcucggcggcgac

SEQ ID NO: 936023 - RNA, 15 nt, Mycobacterium avium subsp. paratuberculosis
gcucggcggcgacgg

SEQ ID NO: 936024 - RNA, 21 nt, Mycobacterium avium subsp. paratuberculosis
gcucggcggcgacgguguccg

SEQ ID NO: 936025 - RNA, 14 nt, Mycobacterium avium subsp. paratuberculosis
gcucggcggcgcag

SEQ ID NO: 936026 - RNA, 22 nt, Mycobacterium avium subsp. paratuberculosis
gcucggcggcgcaggcgcgcac

SEQ ID NO: 936027 - RNA, 13 nt, Mycobacterium avium subsp. paratuberculosis
gcucggcggcgcc

SEQ ID NO: 936028 - RNA, 14 nt, Mycobacterium avium subsp. paratuberculosis
gcucggcggcgccg

SEQ ID NO: 936029 - RNA, 18 nt, Mycobacterium avium subsp. paratuberculosis
gcucggcgggcucccucg

SEQ ID NO: 936030 - RNA, 14 nt, Mycobacterium avium subsp. paratuberculosis
gcucggcgggcucg

SEQ ID NO: 936031 - RNA, 23 nt, Mycobacterium avium subsp. paratuberculosis
gcucggcgggcucgcgcuggcgg

SEQ ID NO: 936032 - RNA, 16 nt, Mycobacterium avium subsp. paratuberculosis
gcucggcggcgggguc

SEQ ID NO: 936033 - RNA, 22 nt, Mycobacterium avium subsp. paratuberculosis
gcucggcggcucagcaacccgc

SEQ ID NO: 936034 - RNA, 18 nt, Mycobacterium avium subsp. paratuberculosis
gcucggccuucggggugg

SEQ ID NO: 936035 - RNA, 19 nt, Mycobacterium avium subsp. paratuberculosis
gcucggccuugagccgguc

SEQ ID NO: 936036 - RNA, 20 nt, Mycobacterium avium subsp. paratuberculosis
gcucggccuugagccggucg

SEQ ID NO: 936037 - RNA, 14 nt, Mycobacterium avium subsp. paratuberculosis
gcucggccgccgac

SEQ ID NO: 936038 - RNA, 20 nt, Mycobacterium avium subsp. paratuberculosis
gcucggccgccgacaccacc

SEQ ID NO: 936039 - RNA, 18 nt, Mycobacterium avium subsp. paratuberculosis
gcucggccggccggccgu

SEQ ID NO: 936040 - RNA, 16 nt, Mycobacterium avium subsp. paratuberculosis
gcucggccggggcgac

SEQ ID NO: 936041 - RNA, 15 nt, Mycobacterium avium subsp. paratuberculosis
gcucggccguggccg

SEQ ID NO: 936042 - RNA, 20 nt, Mycobacterium avium subsp. paratuberculosis
gcucggccguggccgucacg

SEQ ID NO: 936043 - RNA, 23 nt, Mycobacterium avium subsp. paratuberculosis
gcucggccguggccgucacgcug

SEQ ID NO: 936044 - RNA, 16 nt, Mycobacterium avium subsp. paratuberculosis
gcucggccucaggcgu

SEQ ID NO: 936045 - RNA, 14 nt, Mycobacterium avium subsp. paratuberculosis
gcuccgacgcggug

SEQ ID NO: 936046 - RNA, 16 nt, Mycobacterium avium subsp. paratuberculosis
gcuccgacgcgguggc

SEQ ID NO: 936047 - RNA, 15 nt, Mycobacterium avium subsp. paratuberculosis
gcuccgcggcgggcg

SEQ ID NO: 936048 - RNA, 16 nt, Mycobacterium avium subsp. paratuberculosis
gcuccgcgggcagcga

SEQ ID NO: 936049 - RNA, 21 nt, Mycobacterium avium subsp. paratuberculosis
gcuccgcggugcugcagcgcg

SEQ ID NO: 936050 - RNA, 21 nt, Mycobacterium avium subsp. paratuberculosis
gcuccgcguucgaccuccacg

SEQ ID NO: 936051 - RNA, 15 nt, Mycobacterium avium subsp. paratuberculosis
gcuccggccgcgccg

SEQ ID NO: 936052 - RNA, 16 nt, Mycobacterium avium subsp. paratuberculosis
gcuccggccgcgccgg

SEQ ID NO: 936053 - RNA, 17 nt, Mycobacterium avium subsp. paratuberculosis
gcuccggccgcgccggc

SEQ ID NO: 936054 - RNA, 21 nt, Mycobacterium avium subsp. paratuberculosis
gcuccggcggacccagcuccu

SEQ ID NO: 936055 - RNA, 22 nt, Mycobacterium avium subsp. paratuberculosis
gcucccggcagaucgcggcccg

SEQ ID NO: 936056 - RNA, 14 nt, Mycobacterium avium subsp. paratuberculosis
gcucccgcucgcca

SEQ ID NO: 936057 - RNA, 12 nt, Mycobacterium avium subsp. paratuberculosis
gcucccgggcgg

SEQ ID NO: 936058 - RNA, 16 nt, Mycobacterium avium subsp. paratuberculosis
gcucccgggcggcgcc

SEQ ID NO: 936059 - RNA, 17 nt, Mycobacterium avium subsp. paratuberculosis
gcucccgggcggcgccg

SEQ ID NO: 936060 - RNA, 18 nt, Mycobacterium avium subsp. paratuberculosis
gcucccgggcggcgccga

SEQ ID NO: 936061 - RNA, 13 nt, Mycobacterium avium subsp. paratuberculosis
gcucccggcgccg

SEQ ID NO: 936062 - RNA, 15 nt, Mycobacterium avium subsp. paratuberculosis
gcucccggcgccgcc

SEQ ID NO: 936063 - RNA, 18 nt, Mycobacterium avium subsp. paratuberculosis
gcucccgggacagcccga

SEQ ID NO: 936064 - RNA, 21 nt, Mycobacterium avium subsp. paratuberculosis
gcucccgccaauaagaucgug

SEQ ID NO: 936065 - RNA, 22 nt, Mycobacterium avium subsp. paratuberculosis
gcucgaacgcgccgaucgagac

SEQ ID NO: 936066 - RNA, 16 nt, Mycobacterium avium subsp. paratuberculosis
gcucgaacaacccggc

SEQ ID NO: 936067 - RNA, 19 nt, Mycobacterium avium subsp. paratuberculosis
gcucgaacaacccggccgc

SEQ ID NO: 936068 - RNA, 21 nt, Mycobacterium avium subsp. paratuberculosis
gcucgaacaacccggccgcga

SEQ ID NO: 936069 - RNA, 15 nt, Mycobacterium avium subsp. paratuberculosis
gcucgaacacccggc

SEQ ID NO: 936070 - RNA, 21 nt, Mycobacterium avium subsp. paratuberculosis
gcucgaaccgcgagacccggu

SEQ ID NO: 936071 - RNA, 15 nt, Mycobacterium avium subsp. paratuberculosis
gcucgaaccuggagg

SEQ ID NO: 936072 - RNA, 14 nt, Mycobacterium avium subsp. paratuberculosis
gcuccuugcgccgc

SEQ ID NO: 936073 - RNA, 15 nt, Mycobacterium avium subsp. paratuberculosis
gcuccugccguucgg

SEQ ID NO: 936074 - RNA, 16 nt, Mycobacterium avium subsp. paratuberculosis
gcuccggguccgcggu

SEQ ID NO: 936075 - RNA, 17 nt, Mycobacterium avium subsp. paratuberculosis
gcucgacaggcagcccg

SEQ ID NO: 936076 - RNA, 21 nt, Mycobacterium avium subsp. paratuberculosis
gcucgaaaugccuuggcggcg

SEQ ID NO: 936077 - RNA, 20 nt, Mycobacterium avium subsp. paratuberculosis
gcucgacacgauguugaugu

SEQ ID NO: 936078 - RNA, 12 nt, Mycobacterium avium subsp. paratuberculosis
gcucgaccagcc

SEQ ID NO: 936079 - RNA, 14 nt, Mycobacterium avium subsp. paratuberculosis
gcucgaccagcccc

SEQ ID NO: 936080 - RNA, 19 nt, Mycobacterium avium subsp. paratuberculosis
gcucgaccagcccccgcgg

SEQ ID NO: 936081 - RNA, 21 nt, Mycobacterium avium subsp. paratuberculosis
gcucgaccagcccccgcgggu

SEQ ID NO: 936082 - RNA, 14 nt, Mycobacterium avium subsp. paratuberculosis
gcucgaccagccgg

SEQ ID NO: 936083 - RNA, 20 nt, Mycobacterium avium subsp. paratuberculosis
gcucgaccagccggguccgc

SEQ ID NO: 936084 - RNA, 15 nt, Mycobacterium avium subsp. paratuberculosis
gcucgaccagcgccg

SEQ ID NO: 936085 - RNA, 16 nt, Mycobacterium avium subsp. paratuberculosis
gcucgaccagcgccga

SEQ ID NO: 936086 - RNA, 17 nt, Mycobacterium avium subsp. paratuberculosis
gcucgaccagcgccgag

SEQ ID NO: 936087 - RNA, 19 nt, Mycobacterium avium subsp. paratuberculosis
gcucgaccagcgccgaggu

SEQ ID NO: 936088 - RNA, 15 nt, Mycobacterium avium subsp. paratuberculosis
gcucgaaggugcccg

SEQ ID NO: 936089 - RNA, 17 nt, Mycobacterium avium subsp. paratuberculosis
gcucgaaggugcccgca

SEQ ID NO: 936090 - RNA, 11 nt, Mycobacterium avium subsp. paratuberculosis
gcucgaaggca

SEQ ID NO: 936091 - RNA, 16 nt, Mycobacterium avium subsp. paratuberculosis
gcucgaaggcaacucg

SEQ ID NO: 936092 - RNA, 17 nt, Mycobacterium avium subsp. paratuberculosis
gcucgaacucaccggug

SEQ ID NO: 936093 - RNA, 21 nt, Mycobacterium avium subsp. paratuberculosis
gcucgaacucaccgguggccg

SEQ ID NO: 936094 - RNA, 14 nt, Mycobacterium avium subsp. paratuberculosis
gcucgagcucggcg

SEQ ID NO: 936095 - RNA, 17 nt, Mycobacterium avium subsp. paratuberculosis
gcucgagcaucuccagc

SEQ ID NO: 936096 - RNA, 15 nt, Mycobacterium avium subsp. paratuberculosis
gcucgagcucggcga

SEQ ID NO: 936097 - RNA, 15 nt, Mycobacterium avium subsp. paratuberculosis
gcucgagcucgucgg

SEQ ID NO: 936098 - RNA, 17 nt, Mycobacterium avium subsp. paratuberculosis
gcucgagcucgucgggu

SEQ ID NO: 936099 - RNA, 14 nt, Mycobacterium avium subsp. paratuberculosis
gcucgaccacgccg

SEQ ID NO: 936100 - RNA, 16 nt, Mycobacterium avium subsp. paratuberculosis
gcucgaccacgccgua

SEQ ID NO: 936101 - RNA, 18 nt, Mycobacterium avium subsp. paratuberculosis
gcucgaugcgcaccugcg

SEQ ID NO: 936102 - RNA, 14 nt, Mycobacterium avium subsp. paratuberculosis
gcucgauggcgccg

SEQ ID NO: 936103 - RNA, 12 nt, Mycobacterium avium subsp. paratuberculosis
gcucgaugcgcg

SEQ ID NO: 936104 - RNA, 21 nt, Mycobacterium avium subsp. paratuberculosis
gcucgaugcgcgccagcagcg

SEQ ID NO: 936105 - RNA, 15 nt, Mycobacterium avium subsp. paratuberculosis
gcucgaugcggcccu

SEQ ID NO: 936106 - RNA, 18 nt, Mycobacterium avium subsp. paratuberculosis
gcucgaugcggcccuggu

SEQ ID NO: 936107 - RNA, 21 nt, Mycobacterium avium subsp. paratuberculosis
gcucgauggaauucgucggcg

SEQ ID NO: 936108 - RNA, 18 nt, Mycobacterium avium subsp. paratuberculosis
gcucgauggacgccagca

SEQ ID NO: 936109 - RNA, 20 nt, Mycobacterium avium subsp. paratuberculosis
gcucgauggacgccagcaug

SEQ ID NO: 936110 - RNA, 13 nt, Mycobacterium avium subsp. paratuberculosis
gcucgauggccag

SEQ ID NO: 936111 - RNA, 15 nt, Mycobacterium avium subsp. paratuberculosis
gcucgauggccagcg

SEQ ID NO: 936112 - RNA, 19 nt, Mycobacterium avium subsp. paratuberculosis
gcucgauggccagcgcguc

SEQ ID NO: 936113 - RNA, 21 nt, Mycobacterium avium subsp. paratuberculosis
gcucgauggccagcgcgucgc

SEQ ID NO: 936114 - RNA, 19 nt, Mycobacterium avium subsp. paratuberculosis
gcucgauuugucggauccc

SEQ ID NO: 936115 - RNA, 20 nt, Mycobacterium avium subsp. paratuberculosis
gcucgcaaacgaaucgagcc

SEQ ID NO: 936116 - RNA, 21 nt, Mycobacterium avium subsp. paratuberculosis
gcucgcaaacgaaucgagccg

SEQ ID NO: 936117 - RNA, 22 nt, Mycobacterium avium subsp. paratuberculosis
gcucgcaaacgaaucgagccgc

SEQ ID NO: 936118 - RNA, 21 nt, Mycobacterium avium subsp. paratuberculosis
gcucgauggugccgucggcgg

SEQ ID NO: 936119 - RNA, 14 nt, Mycobacterium avium subsp. paratuberculosis
gcucgagggcggcg

SEQ ID NO: 936120 - RNA, 16 nt, Mycobacterium avium subsp. paratuberculosis
gcucgagggcggcgac

SEQ ID NO: 936121 - RNA, 18 nt, Mycobacterium avium subsp. paratuberculosis
gcucgagggccuccacca

SEQ ID NO: 936122 - RNA, 20 nt, Mycobacterium avium subsp. paratuberculosis
gcucgagggccuccaccacc

SEQ ID NO: 936123 - RNA, 14 nt, Mycobacterium avium subsp. paratuberculosis
gcucgagugccggc

SEQ ID NO: 936124 - RNA, 17 nt, Mycobacterium avium subsp. paratuberculosis
gcucgagugccggcagc

SEQ ID NO: 936125 - RNA, 20 nt, Mycobacterium avium subsp. paratuberculosis
gcucgagugccggcagcccg

SEQ ID NO: 936126 - RNA, 19 nt, Mycobacterium avium subsp. paratuberculosis
gcucgaugccguucgcgcc

SEQ ID NO: 936127 - RNA, 23 nt, Mycobacterium avium subsp. paratuberculosis
gcucgaugcgacgcaccucggcc

SEQ ID NO: 936128 - RNA, 14 nt, Mycobacterium avium subsp. paratuberculosis
gcucgaggccgcgg

SEQ ID NO: 936129 - RNA, 16 nt, Mycobacterium avium subsp. paratuberculosis
gcucgaggccgcgggc

SEQ ID NO: 936130 - RNA, 15 nt, Mycobacterium avium subsp. paratuberculosis
gcucgaggccccgcg

SEQ ID NO: 936131 - RNA, 18 nt, Mycobacterium avium subsp. paratuberculosis
gcucgaggccccgcguga

SEQ ID NO: 936132 - RNA, 23 nt, Mycobacterium avium subsp. paratuberculosis
gcucgaggccccgcgugacggcc

SEQ ID NO: 936133 - RNA, 15 nt, Mycobacterium avium subsp. paratuberculosis
gcuccagcggccaca

SEQ ID NO: 936134 - RNA, 13 nt, Mycobacterium avium subsp. paratuberculosis
gcuccagcgggcg

SEQ ID NO: 936135 - RNA, 16 nt, Mycobacterium avium subsp. paratuberculosis
gcuccagcgggcggcg

SEQ ID NO: 936136 - RNA, 17 nt, Mycobacterium avium subsp. paratuberculosis
gcuccagcgggcggcgg

SEQ ID NO: 936137 - RNA, 18 nt, Mycobacterium avium subsp. paratuberculosis
gcuccagcgggcggcggu

SEQ ID NO: 936138 - RNA, 19 nt, Mycobacterium avium subsp. paratuberculosis
gcuccagcgggcggcggug

SEQ ID NO: 936139 - RNA, 18 nt, Mycobacterium avium subsp. paratuberculosis
gcuccagcgaguuggcca

SEQ ID NO: 936140 - RNA, 12 nt, Mycobacterium avium subsp. paratuberculosis
gcuccagcgccc

SEQ ID NO: 936141 - RNA, 13 nt, Mycobacterium avium subsp. paratuberculosis
gcuccagcgcccg

SEQ ID NO: 936142 - RNA, 14 nt, Mycobacterium avium subsp. paratuberculosis
gcuccagcgcccgc

SEQ ID NO: 936143 - RNA, 16 nt, Mycobacterium avium subsp. paratuberculosis
gcuccagcgcccgccg

SEQ ID NO: 936144 - RNA, 18 nt, Mycobacterium avium subsp. paratuberculosis
gcuccagcgcccgccgca

SEQ ID NO: 936145 - RNA, 23 nt, Mycobacterium avium subsp. paratuberculosis
gcuccagcgcccgccgcaacgcg

SEQ ID NO: 936146 - RNA, 16 nt, Mycobacterium avium subsp. paratuberculosis
gcucccgcagcggggc

SEQ ID NO: 936147 - RNA, 17 nt, Mycobacterium avium subsp. paratuberculosis
gcucccgcagcggggcg

SEQ ID NO: 936148 - RNA, 19 nt, Mycobacterium avium subsp. paratuberculosis
gcucccgcagcggggcgcu

SEQ ID NO: 936149 - RNA, 14 nt, Mycobacterium avium subsp. paratuberculosis
gcuccccguugauc

SEQ ID NO: 936150 - RNA, 18 nt, Mycobacterium avium subsp. paratuberculosis
gcucccgagcaucgccga

SEQ ID NO: 936151 - RNA, 19 nt, Mycobacterium avium subsp. paratuberculosis
gcuccaugaaccggucguu

SEQ ID NO: 936152 - RNA, 21 nt, Mycobacterium avium subsp. paratuberculosis
gcucccagcucagacugccga

SEQ ID NO: 936153 - RNA, 16 nt, Mycobacterium avium subsp. paratuberculosis
gcucccccgacaccgc

SEQ ID NO: 936154 - RNA, 19 nt, Mycobacterium avium subsp. paratuberculosis
gcucccccggaccugccgg

SEQ ID NO: 936155 - RNA, 23 nt, Mycobacterium avium subsp. paratuberculosis
gcucccccggaccugccggcgau

SEQ ID NO: 936156 - RNA, 14 nt, Mycobacterium avium subsp. paratuberculosis
gcucccccggcgug

SEQ ID NO: 936157 - RNA, 14 nt, Mycobacterium avium subsp. paratuberculosis
gcucccccgucggg

SEQ ID NO: 936158 - RNA, 20 nt, Mycobacterium avium subsp. paratuberculosis
gcuccccgaccacaccggcg

SEQ ID NO: 936159 - RNA, 15 nt, Mycobacterium avium subsp. paratuberculosis
gcuccccgagcacgu

SEQ ID NO: 936160 - RNA, 17 nt, Mycobacterium avium subsp. paratuberculosis
gcuccauguucggggcg

SEQ ID NO: 936161 - RNA, 18 nt, Mycobacterium avium subsp. paratuberculosis
gcuccauguucggggcgg

SEQ ID NO: 936162 - RNA, 17 nt, Mycobacterium avium subsp. paratuberculosis
gcucccaggcgucgucg

SEQ ID NO: 936163 - RNA, 18 nt, Mycobacterium avium subsp. paratuberculosis
gcucccaggcgucgucgu

SEQ ID NO: 936164 - RNA, 19 nt, Mycobacterium avium subsp. paratuberculosis
gcucaugcccgccacggcc

SEQ ID NO: 936165 - RNA, 13 nt, Mycobacterium avium subsp. paratuberculosis
gcucaucgucguu

SEQ ID NO: 936166 - RNA, 18 nt, Mycobacterium avium subsp. paratuberculosis
gcucaucgucguuggcgc

SEQ ID NO: 936167 - RNA, 19 nt, Mycobacterium avium subsp. paratuberculosis
gcucaucguguccagcaug

SEQ ID NO: 936168 - RNA, 19 nt, Mycobacterium avium subsp. paratuberculosis
gcucaucuacgucgucgcc

SEQ ID NO: 936169 - RNA, 20 nt, Mycobacterium avium subsp. paratuberculosis
gcucaucuacgucgucgccg

SEQ ID NO: 936170 - RNA, 21 nt, Mycobacterium avium subsp. paratuberculosis
gcucaucuacgucgucgccgg

SEQ ID NO: 936171 - RNA, 22 nt, Mycobacterium avium subsp. paratuberculosis
gcucauguugugcaggcagccg

SEQ ID NO: 936172 - RNA, 19 nt, Mycobacterium avium subsp. paratuberculosis
gcuccaccgcguccugcag

SEQ ID NO: 936173 - RNA, 17 nt, Mycobacterium avium subsp. paratuberculosis
gcuccacgaugcccguc

SEQ ID NO: 936174 - RNA, 20 nt, Mycobacterium avium subsp. paratuberculosis
gcuccacgaugcccgucacg

SEQ ID NO: 936175 - RNA, 15 nt, Mycobacterium avium subsp. paratuberculosis
gcuccacgccgccgg

SEQ ID NO: 936176 - RNA, 15 nt, Mycobacterium avium subsp. paratuberculosis
gcuccaccagguucg

SEQ ID NO: 936177 - RNA, 19 nt, Mycobacterium avium subsp. paratuberculosis
gcuccaccgcgccggcggc

SEQ ID NO: 936178 - RNA, 18 nt, Mycobacterium avium subsp. paratuberculosis
gcuccagaugcgguggug

SEQ ID NO: 936179 - RNA, 16 nt, Mycobacterium avium subsp. paratuberculosis
gcuccagcagcccggg

SEQ ID NO: 936180 - RNA, 13 nt, Mycobacterium avium subsp. paratuberculosis
gcuccagcaggcg

SEQ ID NO: 936181 - RNA, 19 nt, Mycobacterium avium subsp. paratuberculosis
gcuccagcaggcgcgccga

SEQ ID NO: 936182 - RNA, 22 nt, Mycobacterium avium subsp. paratuberculosis
gcuccagcaggcgcgccgagcg

SEQ ID NO: 936183 - RNA, 17 nt, Mycobacterium avium subsp. paratuberculosis
gcucagggugcgcuggc

SEQ ID NO: 936184 - RNA, 19 nt, Mycobacterium avium subsp. paratuberculosis
gcucagggugcgcuggccg

SEQ ID NO: 936185 - RNA, 15 nt, Mycobacterium avium subsp. paratuberculosis
gcucaggucggccgc

SEQ ID NO: 936186 - RNA, 18 nt, Mycobacterium avium subsp. paratuberculosis
gcucaggucggccgcggc

SEQ ID NO: 936187 - RNA, 15 nt, Mycobacterium avium subsp. paratuberculosis
gcucaggugcgacgc

SEQ ID NO: 936188 - RNA, 14 nt, Mycobacterium avium subsp. paratuberculosis
gcucagguugcgca

SEQ ID NO: 936189 - RNA, 21 nt, Mycobacterium avium subsp. paratuberculosis
gcucagugucacugcgguaga

SEQ ID NO: 936190 - RNA, 18 nt, Mycobacterium avium subsp. paratuberculosis
gcucaggcguccagccag

SEQ ID NO: 936191 - RNA, 14 nt, Mycobacterium avium subsp. paratuberculosis
gcucaggccggugg

SEQ ID NO: 936192 - RNA, 16 nt, Mycobacterium avium subsp. paratuberculosis
gcucaggaucagcagc

SEQ ID NO: 936193 - RNA, 20 nt, Mycobacterium avium subsp. paratuberculosis
gcucaggaugauuucggcgu

SEQ ID NO: 936194 - RNA, 21 nt, Mycobacterium avium subsp. paratuberculosis
gcucaggaugauuucggcgug

SEQ ID NO: 936195 - RNA, 14 nt, Mycobacterium avium subsp. paratuberculosis
gcucaggaacggcc

SEQ ID NO: 936196 - RNA, 17 nt, Mycobacterium avium subsp. paratuberculosis
gcucaggaacggccgga

SEQ ID NO: 936197 - RNA, 20 nt, Mycobacterium avium subsp. paratuberculosis
gcucaggacgaacgcuggcg

SEQ ID NO: 936198 - RNA, 17 nt, Mycobacterium avium subsp. paratuberculosis
gcucagcugcugcgcgg

SEQ ID NO: 936199 - RNA, 19 nt, Mycobacterium avium subsp. paratuberculosis
gcucagcugcugcgcggcg

SEQ ID NO: 936200 - RNA, 22 nt, Mycobacterium avium subsp. paratuberculosis
gcucagcugcugcgcggcggcg

SEQ ID NO: 936201 - RNA, 18 nt, Mycobacterium avium subsp. paratuberculosis
gcucaucgaggucgaacc

SEQ ID NO: 936202 - RNA, 21 nt, Mycobacterium avium subsp. paratuberculosis
gcucaucgaggucgaaccacg

SEQ ID NO: 936203 - RNA, 16 nt, Mycobacterium avium subsp. paratuberculosis
gcucaucaggcggccg

SEQ ID NO: 936204 - RNA, 20 nt, Mycobacterium avium subsp. paratuberculosis
gcucaucccgaugucggcga

SEQ ID NO: 936205 - RNA, 14 nt, Mycobacterium avium subsp. paratuberculosis
gcucaucccuagcg

SEQ ID NO: 936206 - RNA, 19 nt, Mycobacterium avium subsp. paratuberculosis
gcucaucccuagcgugccg

SEQ ID NO: 936207 - RNA, 18 nt, Mycobacterium avium subsp. paratuberculosis
gcucagugcacgcucggc

SEQ ID NO: 936208 - RNA, 22 nt, Mycobacterium avium subsp. paratuberculosis
gcucauacagcggcgcgcgccg

SEQ ID NO: 936209 - RNA, 15 nt, Mycobacterium avium subsp. paratuberculosis
gcucauacggcggcu

SEQ ID NO: 936210 - RNA, 17 nt, Mycobacterium avium subsp. paratuberculosis
gcucauacggcggcucg

SEQ ID NO: 936211 - RNA, 14 nt, Mycobacterium avium subsp. paratuberculosis
gcguucacgucgau

SEQ ID NO: 936212 - RNA, 13 nt, Mycobacterium avium subsp. paratuberculosis
gcguucagcagcg

SEQ ID NO: 936213 - RNA, 17 nt, Mycobacterium avium subsp. paratuberculosis
gcguucagccggagccg

SEQ ID NO: 936214 - RNA, 18 nt, Mycobacterium avium subsp. paratuberculosis
gcguucagccggagccgg

SEQ ID NO: 936215 - RNA, 19 nt, Mycobacterium avium subsp. paratuberculosis
gcguucagccggagccggc

SEQ ID NO: 936216 - RNA, 15 nt, Mycobacterium avium subsp. paratuberculosis
gcguucaucaccugg

SEQ ID NO: 936217 - RNA, 17 nt, Mycobacterium avium subsp. paratuberculosis
gcguucaucaccugguc

SEQ ID NO: 936218 - RNA, 16 nt, Mycobacterium avium subsp. paratuberculosis
gcguucagcggcaccg

SEQ ID NO: 936219 - RNA, 18 nt, Mycobacterium avium subsp. paratuberculosis
gcguucagcggcaccguc

SEQ ID NO: 936220 - RNA, 23 nt, Mycobacterium avium subsp. paratuberculosis
gcguucaucguccacaccgggaa

SEQ ID NO: 936221 - RNA, 21 nt, Mycobacterium avium subsp. paratuberculosis
gcguucaucgugccgaacgug

SEQ ID NO: 936222 - RNA, 15 nt, Mycobacterium avium subsp. paratuberculosis
gcguuccagcacccg

SEQ ID NO: 936223 - RNA, 17 nt, Mycobacterium avium subsp. paratuberculosis
gcucagagcugcaccgg

SEQ ID NO: 936224 - RNA, 18 nt, Mycobacterium avium subsp. paratuberculosis
gcucagagcugcaccggg

SEQ ID NO: 936225 - RNA, 20 nt, Mycobacterium avium subsp. paratuberculosis
gcucagcaacccgccgagcg

SEQ ID NO: 936226 - RNA, 22 nt, Mycobacterium avium subsp. paratuberculosis
gcucagcaacccgccgagcgug

SEQ ID NO: 936227 - RNA, 22 nt, Mycobacterium avium subsp. paratuberculosis
gcucagcccggcgcucaccgcg

SEQ ID NO: 936228 - RNA, 17 nt, Mycobacterium avium subsp. paratuberculosis
gcucagccgaagccggc

SEQ ID NO: 936229 - RNA, 19 nt, Mycobacterium avium subsp. paratuberculosis
gcucagccgaagccggcgc

SEQ ID NO: 936230 - RNA, 11 nt, Mycobacterium avium subsp. paratuberculosis
gcucagcccgg

SEQ ID NO: 936231 - RNA, 14 nt, Mycobacterium avium subsp. paratuberculosis
gcucagccccagcg

SEQ ID NO: 936232 - RNA, 16 nt, Mycobacterium avium subsp. paratuberculosis
gcucagcccgauucag

SEQ ID NO: 936233 - RNA, 21 nt, Mycobacterium avium subsp. paratuberculosis
gcucagcccgauucagccggc

SEQ ID NO: 936234 - RNA, 23 nt, Mycobacterium avium subsp. paratuberculosis
gcucagcacgcggaucgcgcuga

SEQ ID NO: 936235 - RNA, 14 nt, Mycobacterium avium subsp. paratuberculosis
gcucagcagcaccg

SEQ ID NO: 936236 - RNA, 16 nt, Mycobacterium avium subsp. paratuberculosis
gcucagcagcaccgca

SEQ ID NO: 936237 - RNA, 13 nt, Mycobacterium avium subsp. paratuberculosis
gcucagcaccaca

SEQ ID NO: 936238 - RNA, 16 nt, Mycobacterium avium subsp. paratuberculosis
gcucagcgcggccaca

SEQ ID NO: 936239 - RNA, 23 nt, Mycobacterium avium subsp. paratuberculosis
gcucagccguucgcugcccucgg

SEQ ID NO: 936240 - RNA, 21 nt, Mycobacterium avium subsp. paratuberculosis
gcucagccuagccuuggccgc

SEQ ID NO: 936241 - RNA, 16 nt, Mycobacterium avium subsp. paratuberculosis
gcucagcgcgacgugc

SEQ ID NO: 936242 - RNA, 20 nt, Mycobacterium avium subsp. paratuberculosis
gcucagcgcgacgugccggc

SEQ ID NO: 936243 - RNA, 15 nt, Mycobacterium avium subsp. paratuberculosis
gcucagcgcggcggg

SEQ ID NO: 936244 - RNA, 16 nt, Mycobacterium avium subsp. paratuberculosis
gcucagcgcggcgggc

SEQ ID NO: 936245 - RNA, 20 nt, Mycobacterium avium subsp. paratuberculosis
gcucagcggaaccgacaccu

SEQ ID NO: 936246 - RNA, 23 nt, Mycobacterium avium subsp. paratuberculosis
gcucagcggaaccgacaccucgc

SEQ ID NO: 936247 - RNA, 17 nt, Mycobacterium avium subsp. paratuberculosis
gcucagcgggaagccga

SEQ ID NO: 936248 - RNA, 16 nt, Mycobacterium avium subsp. paratuberculosis
gcucagcgggcggcca

SEQ ID NO: 936249 - RNA, 22 nt, Mycobacterium avium subsp. paratuberculosis
gcucagcgggcggccagccgcu

SEQ ID NO: 936250 - RNA, 17 nt, Mycobacterium avium subsp. paratuberculosis
gcucagcucccgagcau

SEQ ID NO: 936251 - RNA, 16 nt, Mycobacterium avium subsp. paratuberculosis
gcucagccgccuggcg

SEQ ID NO: 936252 - RNA, 18 nt, Mycobacterium avium subsp. paratuberculosis
gcucagcgauugcggccg

SEQ ID NO: 936253 - RNA, 14 nt, Mycobacterium avium subsp. paratuberculosis
gcucagcgcaccgc

SEQ ID NO: 936254 - RNA, 17 nt, Mycobacterium avium subsp. paratuberculosis
gcucagcgcaccgccgu

SEQ ID NO: 936255 - RNA, 13 nt, Mycobacterium avium subsp. paratuberculosis
gcguaaccggcgg

SEQ ID NO: 936256 - RNA, 19 nt, Mycobacterium avium subsp. paratuberculosis
gcguacagcaauccgcuga

SEQ ID NO: 936257 - RNA, 13 nt, Mycobacterium avium subsp. paratuberculosis
gcguacagcagcu

SEQ ID NO: 936258 - RNA, 17 nt, Mycobacterium avium subsp. paratuberculosis
gcguacagcagcugccc

SEQ ID NO: 936259 - RNA, 17 nt, Mycobacterium avium subsp. paratuberculosis
gcguacagccagcccgu

SEQ ID NO: 936260 - RNA, 17 nt, Mycobacterium avium subsp. paratuberculosis
gcguacagcccgcggau

SEQ ID NO: 936261 - RNA, 21 nt, Mycobacterium avium subsp. paratuberculosis
gcguacagcccgcggaucgcg

SEQ ID NO: 936262 - RNA, 20 nt, Mycobacterium avium subsp. paratuberculosis
gcguacaccagggugccgcc

SEQ ID NO: 936263 - RNA, 14 nt, Mycobacterium avium subsp. paratuberculosis
gcguacaccggcug

SEQ ID NO: 936264 - RNA, 18 nt, Mycobacterium avium subsp. paratuberculosis
gcguacaccggcugaccg

SEQ ID NO: 936265 - RNA, 22 nt, Mycobacterium avium subsp. paratuberculosis
gcguacaccggcugaccggcgg

SEQ ID NO: 936266 - RNA, 15 nt, Mycobacterium avium subsp. paratuberculosis
gcguacacggcccgc

SEQ ID NO: 936267 - RNA, 18 nt, Mycobacterium avium subsp. paratuberculosis
gcguacacguagaaggcg

SEQ ID NO: 936268 - RNA, 23 nt, Mycobacterium avium subsp. paratuberculosis
gcguacacguagaaggcgccguc

SEQ ID NO: 936269 - RNA, 16 nt, Mycobacterium avium subsp. paratuberculosis
gcguacccgcgcggcg

SEQ ID NO: 936270 - RNA, 22 nt, Mycobacterium avium subsp. paratuberculosis
gcguacccgcgcggcgucggcc

SEQ ID NO: 936271 - RNA, 16 nt, Mycobacterium avium subsp. paratuberculosis
gcguaccgcggcggcg

SEQ ID NO: 936272 - RNA, 17 nt, Mycobacterium avium subsp. paratuberculosis
gcguacccaggucggcg

SEQ ID NO: 936273 - RNA, 18 nt, Mycobacterium avium subsp. paratuberculosis
gcguacccaggucggcgu

SEQ ID NO: 936274 - RNA, 16 nt, Mycobacterium avium subsp. paratuberculosis
gcguacccgcccaugc

SEQ ID NO: 936275 - RNA, 19 nt, Mycobacterium avium subsp. paratuberculosis
gcguacgaccguagccggu

SEQ ID NO: 936276 - RNA, 22 nt, Mycobacterium avium subsp. paratuberculosis
gcguacgccgccuugacgccgg

SEQ ID NO: 936277 - RNA, 13 nt, Mycobacterium avium subsp. paratuberculosis
gcguacgcgcugc

SEQ ID NO: 936278 - RNA, 17 nt, Mycobacterium avium subsp. paratuberculosis
gcguacagggcgucgga

SEQ ID NO: 936279 - RNA, 16 nt, Mycobacterium avium subsp. paratuberculosis
gcguacagcgcccgga

SEQ ID NO: 936280 - RNA, 19 nt, Mycobacterium avium subsp. paratuberculosis
gcguacagcgggucguugg

SEQ ID NO: 936281 - RNA, 18 nt, Mycobacterium avium subsp. paratuberculosis
gcgguugaucacaccguc

SEQ ID NO: 936282 - RNA, 19 nt, Mycobacterium avium subsp. paratuberculosis
gcgguugaucacaccgucg

SEQ ID NO: 936283 - RNA, 23 nt, Mycobacterium avium subsp. paratuberculosis
gcgguugaucacaccgucggcga

SEQ ID NO: 936284 - RNA, 16 nt, Mycobacterium avium subsp. paratuberculosis
gcgguugacguccgcg

SEQ ID NO: 936285 - RNA, 17 nt, Mycobacterium avium subsp. paratuberculosis
gcgguugagcaccagcc

SEQ ID NO: 936286 - RNA, 21 nt, Mycobacterium avium subsp. paratuberculosis
gcgguugagcaccagcccggc

SEQ ID NO: 936287 - RNA, 20 nt, Mycobacterium avium subsp. paratuberculosis
gcgguugccccaccccggac

SEQ ID NO: 936288 - RNA, 13 nt, Mycobacterium avium subsp. paratuberculosis
gcgguugcccgca

SEQ ID NO: 936289 - RNA, 12 nt, Mycobacterium avium subsp. paratuberculosis
gcgguugaccgc

SEQ ID NO: 936290 - RNA, 17 nt, Mycobacterium avium subsp. paratuberculosis
gcgguugaccgccgaca

SEQ ID NO: 936291 - RNA, 21 nt, Mycobacterium avium subsp. paratuberculosis
gcgguugaccgccgacaccac

SEQ ID NO: 936292 - RNA, 22 nt, Mycobacterium avium subsp. paratuberculosis
gcgguugaccgccgacaccacc

SEQ ID NO: 936293 - RNA, 15 nt, Mycobacterium avium subsp. paratuberculosis
gcgguucgucgcggc

SEQ ID NO: 936294 - RNA, 22 nt, Mycobacterium avium subsp. paratuberculosis
gcgguuccugcgcuaccaggcg

SEQ ID NO: 936295 - RNA, 17 nt, Mycobacterium avium subsp. paratuberculosis
gcgguuccagaccggcg

SEQ ID NO: 936296 - RNA, 18 nt, Mycobacterium avium subsp. paratuberculosis
gcgguuccagaccggcgg

SEQ ID NO: 936297 - RNA, 20 nt, Mycobacterium avium subsp. paratuberculosis
gcgguuccagaccggcggcg

SEQ ID NO: 936298 - RNA, 21 nt, Mycobacterium avium subsp. paratuberculosis
gcgguuccggcgugcagcacg

SEQ ID NO: 936299 - RNA, 15 nt, Mycobacterium avium subsp. paratuberculosis
gcgguuccgguggcg

SEQ ID NO: 936300 - RNA, 23 nt, Mycobacterium avium subsp. paratuberculosis
gcgguucgauaccguccgcgccc

SEQ ID NO: 936301 - RNA, 18 nt, Mycobacterium avium subsp. paratuberculosis
gcgguucgaucuccucgg

SEQ ID NO: 936302 - RNA, 22 nt, Mycobacterium avium subsp. paratuberculosis
gcgguucggaguccaccggcgg

SEQ ID NO: 936303 - RNA, 14 nt, Mycobacterium avium subsp. paratuberculosis
gcgguucggcgacg

SEQ ID NO: 936304 - RNA, 18 nt, Mycobacterium avium subsp. paratuberculosis
gcgguucggcgacgcugg

SEQ ID NO: 936305 - RNA, 15 nt, Mycobacterium avium subsp. paratuberculosis
gcgguucgggcccca

SEQ ID NO: 936306 - RNA, 14 nt, Mycobacterium avium subsp. paratuberculosis
gcgguugucgguca

SEQ ID NO: 936307 - RNA, 22 nt, Mycobacterium avium subsp. paratuberculosis
gcgguugucguugaacaguucg

SEQ ID NO: 936308 - RNA, 21 nt, Mycobacterium avium subsp. paratuberculosis
gcgguuggucaccaggucgcg

SEQ ID NO: 936309 - RNA, 22 nt, Mycobacterium avium subsp. paratuberculosis
gcgguuggucaccaggucgcgg

SEQ ID NO: 936310 - RNA, 14 nt, Mycobacterium avium subsp. paratuberculosis
gcgguugggccgcc

SEQ ID NO: 936311 - RNA, 19 nt, Mycobacterium avium subsp. paratuberculosis
gcgguugggccgccggccg

SEQ ID NO: 936312 - RNA, 20 nt, Mycobacterium avium subsp. paratuberculosis
gcgguugggccgccggccgc

SEQ ID NO: 936313 - RNA, 21 nt, Mycobacterium avium subsp. paratuberculosis
gcgguugggccgccggccgcu

SEQ ID NO: 936314 - RNA, 15 nt, Mycobacterium avium subsp. paratuberculosis
gcgguugggccggcg

SEQ ID NO: 936315 - RNA, 16 nt, Mycobacterium avium subsp. paratuberculosis
gcgguugggccggcgc

SEQ ID NO: 936316 - RNA, 20 nt, Mycobacterium avium subsp. paratuberculosis
gcgguugggccggcgcccgu

SEQ ID NO: 936317 - RNA, 16 nt, Mycobacterium avium subsp. paratuberculosis
gcgguuggcccgcggc

SEQ ID NO: 936318 - RNA, 17 nt, Mycobacterium avium subsp. paratuberculosis
gcgguuggcccgcggcg

SEQ ID NO: 936319 - RNA, 20 nt, Mycobacterium avium subsp. paratuberculosis
gcgguuggcccgcggcgccc

SEQ ID NO: 936320 - RNA, 22 nt, Mycobacterium avium subsp. paratuberculosis
gcgguuggcccuucgaccucga

SEQ ID NO: 936321 - RNA, 17 nt, Mycobacterium avium subsp. paratuberculosis
gcgguuggccggaaucg

SEQ ID NO: 936322 - RNA, 15 nt, Mycobacterium avium subsp. paratuberculosis
gcgguuggccggccg

SEQ ID NO: 936323 - RNA, 16 nt, Mycobacterium avium subsp. paratuberculosis
gcgguuggccggccgg

SEQ ID NO: 936324 - RNA, 21 nt, Mycobacterium avium subsp. paratuberculosis
gcgguugcggguggcggccgg

SEQ ID NO: 936325 - RNA, 13 nt, Mycobacterium avium subsp. paratuberculosis
gcgguugcgguug

SEQ ID NO: 936326 - RNA, 17 nt, Mycobacterium avium subsp. paratuberculosis
gcgguugcucgucggcc

SEQ ID NO: 936327 - RNA, 18 nt, Mycobacterium avium subsp. paratuberculosis
gcgguugcucgucggccg

SEQ ID NO: 936328 - RNA, 18 nt, Mycobacterium avium subsp. paratuberculosis
gcgguuggacaggccggc

SEQ ID NO: 936329 - RNA, 19 nt, Mycobacterium avium subsp. paratuberculosis
gcgguuggacaggccggcg

SEQ ID NO: 936330 - RNA, 20 nt, Mycobacterium avium subsp. paratuberculosis
gcgguuggacaggccggcga

SEQ ID NO: 936331 - RNA, 22 nt, Mycobacterium avium subsp. paratuberculosis
gcgguuuccggcgauucgauca

SEQ ID NO: 936332 - RNA, 16 nt, Mycobacterium avium subsp. paratuberculosis
gcgguuucaccgugcg

SEQ ID NO: 936333 - RNA, 19 nt, Mycobacterium avium subsp. paratuberculosis
gcgguuucaccgugcgcgc

SEQ ID NO: 936334 - RNA, 17 nt, Mycobacterium avium subsp. paratuberculosis
gcgguuucggcgucgcc

SEQ ID NO: 936335 - RNA, 16 nt, Mycobacterium avium subsp. paratuberculosis
gcgguuucggugccgg

SEQ ID NO: 936336 - RNA, 20 nt, Mycobacterium avium subsp. paratuberculosis
gcgguuucggugccggccca

SEQ ID NO: 936337 - RNA, 15 nt, Mycobacterium avium subsp. paratuberculosis
gcgguuuggucagcg

SEQ ID NO: 936338 - RNA, 17 nt, Mycobacterium avium subsp. paratuberculosis
gcgguuuggucagcgcc

SEQ ID NO: 936339 - RNA, 17 nt, Mycobacterium avium subsp. paratuberculosis
gcggugccgggccaggu

SEQ ID NO: 936340 - RNA, 19 nt, Mycobacterium avium subsp. paratuberculosis
gcggugccguccucggccg

SEQ ID NO: 936341 - RNA, 17 nt, Mycobacterium avium subsp. paratuberculosis
gcggugccgcggcggcg

SEQ ID NO: 936342 - RNA, 24 nt, Mycobacterium avium subsp. paratuberculosis
gcggugccgcggcggcgccgacgg

SEQ ID NO: 936343 - RNA, 13 nt, Mycobacterium avium subsp. paratuberculosis
gcggugccggcca

SEQ ID NO: 936344 - RNA, 14 nt, Mycobacterium avium subsp. paratuberculosis
gcggugccggccag

SEQ ID NO: 936345 - RNA, 17 nt, Mycobacterium avium subsp. paratuberculosis
gcggugccggccagauc

SEQ ID NO: 936346 - RNA, 18 nt, Mycobacterium avium subsp. paratuberculosis
gcggugccggccagaucg

SEQ ID NO: 936347 - RNA, 13 nt, Mycobacterium avium subsp. paratuberculosis
gcggugccgcggc

SEQ ID NO: 936348 - RNA, 15 nt, Mycobacterium avium subsp. paratuberculosis
gcggugccgaaccgg

SEQ ID NO: 936349 - RNA, 13 nt, Mycobacterium avium subsp. paratuberculosis
gcggugccgaccu

SEQ ID NO: 936350 - RNA, 22 nt, Mycobacterium avium subsp. paratuberculosis
gcggugccgaccugggcggcca

SEQ ID NO: 936351 - RNA, 19 nt, Mycobacterium avium subsp. paratuberculosis
gcggugccgagcccgccgg

SEQ ID NO: 936352 - RNA, 17 nt, Mycobacterium avium subsp. paratuberculosis
gcggugccgcagcucga

SEQ ID NO: 936353 - RNA, 13 nt, Mycobacterium avium subsp. paratuberculosis
gcggugccgcagg

SEQ ID NO: 936354 - RNA, 21 nt, Mycobacterium avium subsp. paratuberculosis
gcggugcgggugguguggcgu

SEQ ID NO: 936355 - RNA, 15 nt, Mycobacterium avium subsp. paratuberculosis
gcggugcggucgcgc

SEQ ID NO: 936356 - RNA, 23 nt, Mycobacterium avium subsp. paratuberculosis
gcggugcggucgcgcagccgggc

SEQ ID NO: 936357 - RNA, 15 nt, Mycobacterium avium subsp. paratuberculosis
gcggugcggugcgcc

SEQ ID NO: 936358 - RNA, 16 nt, Mycobacterium avium subsp. paratuberculosis
gcggugcgucgaauca

SEQ ID NO: 936359 - RNA, 21 nt, Mycobacterium avium subsp. paratuberculosis
gcggugcgucgggcgccggcg

SEQ ID NO: 936360 - RNA, 13 nt, Mycobacterium avium subsp. paratuberculosis
gcggugcggcccg

SEQ ID NO: 936361 - RNA, 15 nt, Mycobacterium avium subsp. paratuberculosis
gcggugcggccgcgc

SEQ ID NO: 936362 - RNA, 13 nt, Mycobacterium avium subsp. paratuberculosis
gcggugcggcucg

SEQ ID NO: 936363 - RNA, 17 nt, Mycobacterium avium subsp. paratuberculosis
gcggugcggggccgcgg

SEQ ID NO: 936364 - RNA, 14 nt, Mycobacterium avium subsp. paratuberculosis
gcggugcgccacgc

SEQ ID NO: 936365 - RNA, 16 nt, Mycobacterium avium subsp. paratuberculosis
gcggugcgccagcgcc

SEQ ID NO: 936366 - RNA, 17 nt, Mycobacterium avium subsp. paratuberculosis
gcggugcgccgacagcu

SEQ ID NO: 936367 - RNA, 13 nt, Mycobacterium avium subsp. paratuberculosis
gcggugcgcagcc

SEQ ID NO: 936368 - RNA, 18 nt, Mycobacterium avium subsp. paratuberculosis
gcggugcgcagccgcugc

SEQ ID NO: 936369 - RNA, 12 nt, Mycobacterium avium subsp. paratuberculosis
gcgguggcggcg

SEQ ID NO: 936370 - RNA, 14 nt, Mycobacterium avium subsp. paratuberculosis
gcgguggcggcgaa

SEQ ID NO: 936371 - RNA, 23 nt, Mycobacterium avium subsp. paratuberculosis
gcgguggcgcacaacccggacag

SEQ ID NO: 936372 - RNA, 14 nt, Mycobacterium avium subsp. paratuberculosis
gcgguggcgcccgc

SEQ ID NO: 936373 - RNA, 22 nt, Mycobacterium avium subsp. paratuberculosis
gcgguggcgccgcgggcggucg

SEQ ID NO: 936374 - RNA, 17 nt, Mycobacterium avium subsp. paratuberculosis
gcgguggcgccggggcg

SEQ ID NO: 936375 - RNA, 21 nt, Mycobacterium avium subsp. paratuberculosis
gcgguggcgccggggcgggcg

SEQ ID NO: 936376 - RNA, 12 nt, Mycobacterium avium subsp. paratuberculosis
gcgguggccggg

SEQ ID NO: 936377 - RNA, 12 nt, Mycobacterium avium subsp. paratuberculosis
gcgguggccugc

SEQ ID NO: 936378 - RNA, 17 nt, Mycobacterium avium subsp. paratuberculosis
gcgguggccugcccggc

SEQ ID NO: 936379 - RNA, 19 nt, Mycobacterium avium subsp. paratuberculosis
gcgguggccuggucgaaca

SEQ ID NO: 936380 - RNA, 18 nt, Mycobacterium avium subsp. paratuberculosis
gcgguggccuggucggcg

SEQ ID NO: 936381 - RNA, 15 nt, Mycobacterium avium subsp. paratuberculosis
gcgguggcguagcgg

SEQ ID NO: 936382 - RNA, 22 nt, Mycobacterium avium subsp. paratuberculosis
gcggugggcaccagcagcgcga

SEQ ID NO: 936383 - RNA, 23 nt, Mycobacterium avium subsp. paratuberculosis
gcggugggcgcauaaaccugguu

SEQ ID NO: 936384 - RNA, 17 nt, Mycobacterium avium subsp. paratuberculosis
gcggugggcgcgggccg

SEQ ID NO: 936385 - RNA, 19 nt, Mycobacterium avium subsp. paratuberculosis
gcggugggcgcgggccgcg

SEQ ID NO: 936386 - RNA, 13 nt, Mycobacterium avium subsp. paratuberculosis
gcggugggcucgg

SEQ ID NO: 936387 - RNA, 22 nt, Mycobacterium avium subsp. paratuberculosis
gcggugggcucggcgccgaccu

SEQ ID NO: 936388 - RNA, 16 nt, Mycobacterium avium subsp. paratuberculosis
gcggugggcucgucga

SEQ ID NO: 936389 - RNA, 16 nt, Mycobacterium avium subsp. paratuberculosis
gcggugggcugggcga

SEQ ID NO: 936390 - RNA, 16 nt, Mycobacterium avium subsp. paratuberculosis
gcgguggggccgaagc

SEQ ID NO: 936391 - RNA, 19 nt, Mycobacterium avium subsp. paratuberculosis
gcgguggggccgaagccga

SEQ ID NO: 936392 - RNA, 12 nt, Mycobacterium avium subsp. paratuberculosis
gcgguggccagc

SEQ ID NO: 936393 - RNA, 13 nt, Mycobacterium avium subsp. paratuberculosis
gcgguggccagca

SEQ ID NO: 936394 - RNA, 14 nt, Mycobacterium avium subsp. paratuberculosis
gcgguggccacggc

SEQ ID NO: 936395 - RNA, 15 nt, Mycobacterium avium subsp. paratuberculosis
gcgguggccacggcg

SEQ ID NO: 936396 - RNA, 17 nt, Mycobacterium avium subsp. paratuberculosis
gcggugcugcagcgcga

SEQ ID NO: 936397 - RNA, 18 nt, Mycobacterium avium subsp. paratuberculosis
gcggugcugccgugccga

SEQ ID NO: 936398 - RNA, 18 nt, Mycobacterium avium subsp. paratuberculosis
gcggugcuuaccggccgg

SEQ ID NO: 936399 - RNA, 21 nt, Mycobacterium avium subsp. paratuberculosis
gcggugcuuaccggccggccg

SEQ ID NO: 936400 - RNA, 22 nt, Mycobacterium avium subsp. paratuberculosis
gcggugcuuaccggccggccgc

SEQ ID NO: 936401 - RNA, 15 nt, Mycobacterium avium subsp. paratuberculosis
gcgguggaacccagc

SEQ ID NO: 936402 - RNA, 15 nt, Mycobacterium avium subsp. paratuberculosis
gcggugcucgcccug

SEQ ID NO: 936403 - RNA, 14 nt, Mycobacterium avium subsp. paratuberculosis
gcggugcucgcgcc

SEQ ID NO: 936404 - RNA, 15 nt, Mycobacterium avium subsp. paratuberculosis
gcggugcucgcgccg

SEQ ID NO: 936405 - RNA, 16 nt, Mycobacterium avium subsp. paratuberculosis
gcggugcucgcgccgg

SEQ ID NO: 936406 - RNA, 19 nt, Mycobacterium avium subsp. paratuberculosis
gcggugcucgcgccgggcg

SEQ ID NO: 936407 - RNA, 13 nt, Mycobacterium avium subsp. paratuberculosis
gcggugcucggcg

SEQ ID NO: 936408 - RNA, 15 nt, Mycobacterium avium subsp. paratuberculosis
gcggugcucggcgcg

SEQ ID NO: 936409 - RNA, 18 nt, Mycobacterium avium subsp. paratuberculosis
gcggugcucgucgagcau

SEQ ID NO: 936410 - RNA, 19 nt, Mycobacterium avium subsp. paratuberculosis
gcggugcucgucgagcauc

SEQ ID NO: 936411 - RNA, 24 nt, Mycobacterium avium subsp. paratuberculosis
gcggugcucgucgagcauccggcg

SEQ ID NO: 936412 - RNA, 19 nt, Mycobacterium avium subsp. paratuberculosis
gcggugcucucgucgucgg

SEQ ID NO: 936413 - RNA, 20 nt, Mycobacterium avium subsp. paratuberculosis
gcggugcucucgucgucggc

SEQ ID NO: 936414 - RNA, 16 nt, Mycobacterium avium subsp. paratuberculosis
gcggugucgagaugac

SEQ ID NO: 936415 - RNA, 12 nt, Mycobacterium avium subsp. paratuberculosis
gcggugucgccc

SEQ ID NO: 936416 - RNA, 13 nt, Mycobacterium avium subsp. paratuberculosis
gcggugucgccca

SEQ ID NO: 936417 - RNA, 12 nt, Mycobacterium avium subsp. paratuberculosis
gcggugucggcg

SEQ ID NO: 936418 - RNA, 18 nt, Mycobacterium avium subsp. paratuberculosis
gcggugucggcgccccgg

SEQ ID NO: 936419 - RNA, 19 nt, Mycobacterium avium subsp. paratuberculosis
gcggugucggcgccccggc

SEQ ID NO: 936420 - RNA, 20 nt, Mycobacterium avium subsp. paratuberculosis
gcggugucggcgccccggcg

SEQ ID NO: 936421 - RNA, 14 nt, Mycobacterium avium subsp. paratuberculosis
gcggugucggcggc

SEQ ID NO: 936422 - RNA, 15 nt, Mycobacterium avium subsp. paratuberculosis
gcggugucggugccg

SEQ ID NO: 936423 - RNA, 16 nt, Mycobacterium avium subsp. paratuberculosis
gcgguggucagcggcg

SEQ ID NO: 936424 - RNA, 22 nt, Mycobacterium avium subsp. paratuberculosis
gcgguggucagcggcgccaccg

SEQ ID NO: 936425 - RNA, 23 nt, Mycobacterium avium subsp. paratuberculosis
gcgguguccacgaugcggugccg

SEQ ID NO: 936426 - RNA, 24 nt, Mycobacterium avium subsp. paratuberculosis
gcgguguccacgaugcggugccgg

SEQ ID NO: 936427 - RNA, 14 nt, Mycobacterium avium subsp. paratuberculosis
gcggugucaccgac

SEQ ID NO: 936428 - RNA, 21 nt, Mycobacterium avium subsp. paratuberculosis
gcggugucgaaggccggggug

SEQ ID NO: 936429 - RNA, 20 nt, Mycobacterium avium subsp. paratuberculosis
gcgguggcccgguacagcgc

SEQ ID NO: 936430 - RNA, 13 nt, Mycobacterium avium subsp. paratuberculosis
gcgguggguccgc

SEQ ID NO: 936431 - RNA, 19 nt, Mycobacterium avium subsp. paratuberculosis
gcgguggguccgccgggcg

SEQ ID NO: 936432 - RNA, 14 nt, Mycobacterium avium subsp. paratuberculosis
gcggugguccgcgc

SEQ ID NO: 936433 - RNA, 16 nt, Mycobacterium avium subsp. paratuberculosis
gcggugguccgcgcga

SEQ ID NO: 936434 - RNA, 23 nt, Mycobacterium avium subsp. paratuberculosis
gcgguggucgaaaucgcagacgu

SEQ ID NO: 936435 - RNA, 14 nt, Mycobacterium avium subsp. paratuberculosis
gcgguggucgaaca

SEQ ID NO: 936436 - RNA, 12 nt, Mycobacterium avium subsp. paratuberculosis
gcgguggucggg

SEQ ID NO: 936437 - RNA, 14 nt, Mycobacterium avium subsp. paratuberculosis
gcgguggucggggu

SEQ ID NO: 936438 - RNA, 22 nt, Mycobacterium avium subsp. paratuberculosis
gcgguggugaacgcgucgguca

SEQ ID NO: 936439 - RNA, 23 nt, Mycobacterium avium subsp. paratuberculosis
gcgguggugcucgccccgcccga

SEQ ID NO: 936440 - RNA, 11 nt, Mycobacterium avium subsp. paratuberculosis
gcggugguggg

SEQ ID NO: 936441 - RNA, 13 nt, Mycobacterium avium subsp. paratuberculosis
gcgguggugggcg

SEQ ID NO: 936442 - RNA, 17 nt, Mycobacterium avium subsp. paratuberculosis
gcgguggugggcgcggu

SEQ ID NO: 936443 - RNA, 21 nt, Mycobacterium avium subsp. paratuberculosis
gcgguguaaccguggcaggcg

SEQ ID NO: 936444 - RNA, 15 nt, Mycobacterium avium subsp. paratuberculosis
gcgguguacagcgcg

SEQ ID NO: 936445 - RNA, 17 nt, Mycobacterium avium subsp. paratuberculosis
gcgguguacagcgcgcc

SEQ ID NO: 936446 - RNA, 19 nt, Mycobacterium avium subsp. paratuberculosis
gcgguguacagcgcgccgc

SEQ ID NO: 936447 - RNA, 14 nt, Mycobacterium avium subsp. paratuberculosis
gcgguguuuggccg

SEQ ID NO: 936448 - RNA, 18 nt, Mycobacterium avium subsp. paratuberculosis
gcgguguuuggccgcgca

SEQ ID NO: 936449 - RNA, 16 nt, Mycobacterium avium subsp. paratuberculosis
gcggugugggcgaugg

SEQ ID NO: 936450 - RNA, 21 nt, Mycobacterium avium subsp. paratuberculosis
gcggugugggcggacugcccg

SEQ ID NO: 936451 - RNA, 15 nt, Mycobacterium avium subsp. paratuberculosis
gcgguguuggcggcg

SEQ ID NO: 936452 - RNA, 20 nt, Mycobacterium avium subsp. paratuberculosis
gcgguguuggcggcgucguc

SEQ ID NO: 936453 - RNA, 16 nt, Mycobacterium avium subsp. paratuberculosis
gcgguguucgagggcg

SEQ ID NO: 936454 - RNA, 17 nt, Mycobacterium avium subsp. paratuberculosis
gcgguguucgagggcgc

SEQ ID NO: 936455 - RNA, 20 nt, Mycobacterium avium subsp. paratuberculosis
gcgguguucgagggcgcggc

SEQ ID NO: 936456 - RNA, 21 nt, Mycobacterium avium subsp. paratuberculosis
gcgguguucgagggcgcggcg

SEQ ID NO: 936457 - RNA, 16 nt, Mycobacterium avium subsp. paratuberculosis
gcggugugcuggccag

SEQ ID NO: 936458 - RNA, 17 nt, Mycobacterium avium subsp. paratuberculosis
gcggugugcuggccagc

SEQ ID NO: 936459 - RNA, 18 nt, Mycobacterium avium subsp. paratuberculosis
gcggugugcuggccagca

SEQ ID NO: 936460 - RNA, 14 nt, Mycobacterium avium subsp. paratuberculosis
gcgguguggccgcg

SEQ ID NO: 936461 - RNA, 16 nt, Mycobacterium avium subsp. paratuberculosis
gcgguucacgcggcug

SEQ ID NO: 936462 - RNA, 15 nt, Mycobacterium avium subsp. paratuberculosis
gcggucugcgccagc

SEQ ID NO: 936463 - RNA, 16 nt, Mycobacterium avium subsp. paratuberculosis
gcggucugcgcccgau

SEQ ID NO: 936464 - RNA, 21 nt, Mycobacterium avium subsp. paratuberculosis
gcggucugcgcccgaucggcg

SEQ ID NO: 936465 - RNA, 17 nt, Mycobacterium avium subsp. paratuberculosis
gcggucugcggugcgcc

SEQ ID NO: 936466 - RNA, 20 nt, Mycobacterium avium subsp. paratuberculosis
gcggucugcggugcgcccag

SEQ ID NO: 936467 - RNA, 22 nt, Mycobacterium avium subsp. paratuberculosis
gcggucucgaucugcaccagcg

SEQ ID NO: 936468 - RNA, 24 nt, Mycobacterium avium subsp. paratuberculosis
gcggucucgaucugcaccagcgcg

SEQ ID NO: 936469 - RNA, 12 nt, Mycobacterium avium subsp. paratuberculosis
gcggucggcggu

SEQ ID NO: 936470 - RNA, 13 nt, Mycobacterium avium subsp. paratuberculosis
gcggucggcgguu

SEQ ID NO: 936471 - RNA, 21 nt, Mycobacterium avium subsp. paratuberculosis
gcggucggcgguucgauaccg

SEQ ID NO: 936472 - RNA, 13 nt, Mycobacterium avium subsp. paratuberculosis
gcggucggcgucg

SEQ ID NO: 936473 - RNA, 22 nt, Mycobacterium avium subsp. paratuberculosis
gcggucggggaauuccggcgcg

SEQ ID NO: 936474 - RNA, 13 nt, Mycobacterium avium subsp. paratuberculosis
gcggucggugcgc

SEQ ID NO: 936475 - RNA, 16 nt, Mycobacterium avium subsp. paratuberculosis
gcggucggugcgcagc

SEQ ID NO: 936476 - RNA, 20 nt, Mycobacterium avium subsp. paratuberculosis
gcggucggugcgcagcacgu

SEQ ID NO: 936477 - RNA, 13 nt, Mycobacterium avium subsp. paratuberculosis
gcggucgguggcg

SEQ ID NO: 936478 - RNA, 18 nt, Mycobacterium avium subsp. paratuberculosis
gcggucgguggcggugcc

SEQ ID NO: 936479 - RNA, 19 nt, Mycobacterium avium subsp. paratuberculosis
gcggucgguggcggugccg

SEQ ID NO: 936480 - RNA, 13 nt, Mycobacterium avium subsp. paratuberculosis
gcggucgucgccc

SEQ ID NO: 936481 - RNA, 22 nt, Mycobacterium avium subsp. paratuberculosis
gcggucgucgcccaccgacgcg

SEQ ID NO: 936482 - RNA, 14 nt, Mycobacterium avium subsp. paratuberculosis
gcggucgucgcccg

SEQ ID NO: 936483 - RNA, 16 nt, Mycobacterium avium subsp. paratuberculosis
gcggucgucgcccguc

SEQ ID NO: 936484 - RNA, 19 nt, Mycobacterium avium subsp. paratuberculosis
gcggucgucgucgucggug

SEQ ID NO: 936485 - RNA, 20 nt, Mycobacterium avium subsp. paratuberculosis
gcggucgucgucgucgguga

SEQ ID NO: 936486 - RNA, 19 nt, Mycobacterium avium subsp. paratuberculosis
gcggucgucuucuuggccg

SEQ ID NO: 936487 - RNA, 20 nt, Mycobacterium avium subsp. paratuberculosis
gcggucgucuucuuggccgc

SEQ ID NO: 936488 - RNA, 22 nt, Mycobacterium avium subsp. paratuberculosis
gcggucgucuucuuggccgcgg

SEQ ID NO: 936489 - RNA, 12 nt, Mycobacterium avium subsp. paratuberculosis
gcggucgucgcc

SEQ ID NO: 936490 - RNA, 19 nt, Mycobacterium avium subsp. paratuberculosis
gcggucgugcggcugccca

SEQ ID NO: 936491 - RNA, 20 nt, Mycobacterium avium subsp. paratuberculosis
gcggucgugcggcugcccag

SEQ ID NO: 936492 - RNA, 21 nt, Mycobacterium avium subsp. paratuberculosis
gcggucgugcgggaugccgag

SEQ ID NO: 936493 - RNA, 13 nt, Mycobacterium avium subsp. paratuberculosis
gcggucgccgccc

SEQ ID NO: 936494 - RNA, 16 nt, Mycobacterium avium subsp. paratuberculosis
gcggucgccccggccg

SEQ ID NO: 936495 - RNA, 18 nt, Mycobacterium avium subsp. paratuberculosis
gcggucgccccggccgcg

SEQ ID NO: 936496 - RNA, 21 nt, Mycobacterium avium subsp. paratuberculosis
gcggucgcgcagccgccgggc

SEQ ID NO: 936497 - RNA, 17 nt, Mycobacterium avium subsp. paratuberculosis
gcggucgcgcagccggg

SEQ ID NO: 936498 - RNA, 19 nt, Mycobacterium avium subsp. paratuberculosis
gcggucgcgcagccgggcg

SEQ ID NO: 936499 - RNA, 22 nt, Mycobacterium avium subsp. paratuberculosis
gcggucgcgcagccgggcggcg

SEQ ID NO: 936500 - RNA, 13 nt, Mycobacterium avium subsp. paratuberculosis
gcggucgcgccag

SEQ ID NO: 936501 - RNA, 17 nt, Mycobacterium avium subsp. paratuberculosis
gcggucgcgccagacgu

SEQ ID NO: 936502 - RNA, 20 nt, Mycobacterium avium subsp. paratuberculosis
gcggucgcgccagacgucca

SEQ ID NO: 936503 - RNA, 18 nt, Mycobacterium avium subsp. paratuberculosis
gcggucgccaccaccagc

SEQ ID NO: 936504 - RNA, 14 nt, Mycobacterium avium subsp. paratuberculosis
gcggucgcgcgccg

SEQ ID NO: 936505 - RNA, 15 nt, Mycobacterium avium subsp. paratuberculosis
gcggucgcgcgccgg

SEQ ID NO: 936506 - RNA, 16 nt, Mycobacterium avium subsp. paratuberculosis
gcggucgcggaaccgg

SEQ ID NO: 936507 - RNA, 19 nt, Mycobacterium avium subsp. paratuberculosis
gcggucgcggaaccggccg

SEQ ID NO: 936508 - RNA, 20 nt, Mycobacterium avium subsp. paratuberculosis
gcggucgcggaaccggccgg

SEQ ID NO: 936509 - RNA, 21 nt, Mycobacterium avium subsp. paratuberculosis
gcggucgcggaaccggccggg

SEQ ID NO: 936510 - RNA, 17 nt, Mycobacterium avium subsp. paratuberculosis
gcggucggcgcggggcc

SEQ ID NO: 936511 - RNA, 11 nt, Mycobacterium avium subsp. paratuberculosis
gcggucggcgg

SEQ ID NO: 936512 - RNA, 12 nt, Mycobacterium avium subsp. paratuberculosis
gcggucggcggc

SEQ ID NO: 936513 - RNA, 13 nt, Mycobacterium avium subsp. paratuberculosis
gcggucggcgccc

SEQ ID NO: 936514 - RNA, 14 nt, Mycobacterium avium subsp. paratuberculosis
gcggucggcgcccg

SEQ ID NO: 936515 - RNA, 19 nt, Mycobacterium avium subsp. paratuberculosis
gcggucggcgcccggccca

SEQ ID NO: 936516 - RNA, 20 nt, Mycobacterium avium subsp. paratuberculosis
gcggucggcgccgaucacgc

SEQ ID NO: 936517 - RNA, 13 nt, Mycobacterium avium subsp. paratuberculosis
gcggucggcgcgg

SEQ ID NO: 936518 - RNA, 13 nt, Mycobacterium avium subsp. paratuberculosis
gcggucggcauag

SEQ ID NO: 936519 - RNA, 20 nt, Mycobacterium avium subsp. paratuberculosis
gcggucggcauagcgccgcu

SEQ ID NO: 936520 - RNA, 22 nt, Mycobacterium avium subsp. paratuberculosis
gcggucggcauagcgccgcucg

SEQ ID NO: 936521 - RNA, 23 nt, Mycobacterium avium subsp. paratuberculosis
gcggucggcauagcgccgcucgg

SEQ ID NO: 936522 - RNA, 16 nt, Mycobacterium avium subsp. paratuberculosis
gcggucgcggcgccgg

SEQ ID NO: 936523 - RNA, 15 nt, Mycobacterium avium subsp. paratuberculosis
gcggucgcggugccc

SEQ ID NO: 936524 - RNA, 17 nt, Mycobacterium avium subsp. paratuberculosis
gcggucgcggugcccag

SEQ ID NO: 936525 - RNA, 21 nt, Mycobacterium avium subsp. paratuberculosis
gcggucgcggugcccagccgc

SEQ ID NO: 936526 - RNA, 19 nt, Mycobacterium avium subsp. paratuberculosis
gcggucgcgucgucggcgg

SEQ ID NO: 936527 - RNA, 22 nt, Mycobacterium avium subsp. paratuberculosis
gcggucgcugaccccgcucggc

SEQ ID NO: 936528 - RNA, 23 nt, Mycobacterium avium subsp. paratuberculosis
gcggucgcugaccccgcucggcg

SEQ ID NO: 936529 - RNA, 16 nt, Mycobacterium avium subsp. paratuberculosis
gcggucgcugacccgc

SEQ ID NO: 936530 - RNA, 18 nt, Mycobacterium avium subsp. paratuberculosis
gcggucgcugacccgccg

SEQ ID NO: 936531 - RNA, 18 nt, Mycobacterium avium subsp. paratuberculosis
gcggucgcugcagcggcg

SEQ ID NO: 936532 - RNA, 22 nt, Mycobacterium avium subsp. paratuberculosis
gcggucgcugcagcggcggcca

SEQ ID NO: 936533 - RNA, 17 nt, Mycobacterium avium subsp. paratuberculosis
gcggucggcaacccgac

SEQ ID NO: 936534 - RNA, 15 nt, Mycobacterium avium subsp. paratuberculosis
gcggugaagucggug

SEQ ID NO: 936535 - RNA, 22 nt, Mycobacterium avium subsp. paratuberculosis
gcggugaaguugccgccgccgg

SEQ ID NO: 936536 - RNA, 13 nt, Mycobacterium avium subsp. paratuberculosis
gcggugacaucgc

SEQ ID NO: 936537 - RNA, 17 nt, Mycobacterium avium subsp. paratuberculosis
gcggugacaucgccacc

SEQ ID NO: 936538 - RNA, 20 nt, Mycobacterium avium subsp. paratuberculosis
gcggucuucuuggccgcgcc

SEQ ID NO: 936539 - RNA, 21 nt, Mycobacterium avium subsp. paratuberculosis
gcggucuucuuggccgcgccg

SEQ ID NO: 936540 - RNA, 17 nt, Mycobacterium avium subsp. paratuberculosis
gcggucuuggcggccag

SEQ ID NO: 936541 - RNA, 18 nt, Mycobacterium avium subsp. paratuberculosis
gcggucuuggcggccagc

SEQ ID NO: 936542 - RNA, 14 nt, Mycobacterium avium subsp. paratuberculosis
gcggucugucgcgc

SEQ ID NO: 936543 - RNA, 15 nt, Mycobacterium avium subsp. paratuberculosis
gcggucugucgcgcg

SEQ ID NO: 936544 - RNA, 13 nt, Mycobacterium avium subsp. paratuberculosis
gcggugaccacgc

SEQ ID NO: 936545 - RNA, 16 nt, Mycobacterium avium subsp. paratuberculosis
gcggugaccacgccgu

SEQ ID NO: 936546 - RNA, 21 nt, Mycobacterium avium subsp. paratuberculosis
gcggugaccucgagcaccggc

SEQ ID NO: 936547 - RNA, 13 nt, Mycobacterium avium subsp. paratuberculosis
gcggugaccuugc

SEQ ID NO: 936548 - RNA, 21 nt, Mycobacterium avium subsp. paratuberculosis
gcggugacgaacccgccgcgg

SEQ ID NO: 936549 - RNA, 12 nt, Mycobacterium avium subsp. paratuberculosis
gcggugacgcgc

SEQ ID NO: 936550 - RNA, 13 nt, Mycobacterium avium subsp. paratuberculosis
gcggugacgcgcc

SEQ ID NO: 936551 - RNA, 19 nt, Mycobacterium avium subsp. paratuberculosis
gcggugacgcgccggccca

SEQ ID NO: 936552 - RNA, 18 nt, Mycobacterium avium subsp. paratuberculosis
gcggugaccgcccgcucg

SEQ ID NO: 936553 - RNA, 14 nt, Mycobacterium avium subsp. paratuberculosis
gcggugaccgccgc

SEQ ID NO: 936554 - RNA, 16 nt, Mycobacterium avium subsp. paratuberculosis
gcggugaccgccgcca

SEQ ID NO: 936555 - RNA, 21 nt, Mycobacterium avium subsp. paratuberculosis
gcggugaccgccgccauccgc

SEQ ID NO: 936556 - RNA, 15 nt, Mycobacterium avium subsp. paratuberculosis
gcggugaccgcgccg

SEQ ID NO: 936557 - RNA, 16 nt, Mycobacterium avium subsp. paratuberculosis
gcggugaccgcgccgc

SEQ ID NO: 936558 - RNA, 18 nt, Mycobacterium avium subsp. paratuberculosis
gcggugaccgcgccgcgg

SEQ ID NO: 936559 - RNA, 13 nt, Mycobacterium avium subsp. paratuberculosis
gcggugaccgcgg

SEQ ID NO: 936560 - RNA, 14 nt, Mycobacterium avium subsp. paratuberculosis
gcggugaccgcggc

SEQ ID NO: 936561 - RNA, 18 nt, Mycobacterium avium subsp. paratuberculosis
gcggugaccgcggccucg

SEQ ID NO: 936562 - RNA, 19 nt, Mycobacterium avium subsp. paratuberculosis
gcggugaccgcggccucgu

SEQ ID NO: 936563 - RNA, 20 nt, Mycobacterium avium subsp. paratuberculosis
gcggugaccggaucggccag

SEQ ID NO: 936564 - RNA, 21 nt, Mycobacterium avium subsp. paratuberculosis
gcggugaccggaucggccagc

SEQ ID NO: 936565 - RNA, 17 nt, Mycobacterium avium subsp. paratuberculosis
gcggugagcagcaugcc

SEQ ID NO: 936566 - RNA, 22 nt, Mycobacterium avium subsp. paratuberculosis
gcggugagcagcaugccgagca

SEQ ID NO: 936567 - RNA, 13 nt, Mycobacterium avium subsp. paratuberculosis
gcggugagccgcc

SEQ ID NO: 936568 - RNA, 21 nt, Mycobacterium avium subsp. paratuberculosis
gcggugagccgccacagcgcc

SEQ ID NO: 936569 - RNA, 16 nt, Mycobacterium avium subsp. paratuberculosis
gcggugagcgcgccgg

SEQ ID NO: 936570 - RNA, 21 nt, Mycobacterium avium subsp. paratuberculosis
gcggugagcgcgccggcccga

SEQ ID NO: 936571 - RNA, 16 nt, Mycobacterium avium subsp. paratuberculosis
gcggugagcguagccc

SEQ ID NO: 936572 - RNA, 18 nt, Mycobacterium avium subsp. paratuberculosis
gcggugacguuccagccg

SEQ ID NO: 936573 - RNA, 18 nt, Mycobacterium avium subsp. paratuberculosis
gcggugaugccgaguucc

SEQ ID NO: 936574 - RNA, 21 nt, Mycobacterium avium subsp. paratuberculosis
gcggugaugcgcgccgacgac

SEQ ID NO: 936575 - RNA, 14 nt, Mycobacterium avium subsp. paratuberculosis
gcggugaugcgcgg

SEQ ID NO: 936576 - RNA, 19 nt, Mycobacterium avium subsp. paratuberculosis
gcggugaugcgcggcgacg

SEQ ID NO: 936577 - RNA, 16 nt, Mycobacterium avium subsp. paratuberculosis
gcggugauggacaucu

SEQ ID NO: 936578 - RNA, 17 nt, Mycobacterium avium subsp. paratuberculosis
gcggugauccgcccggc

SEQ ID NO: 936579 - RNA, 20 nt, Mycobacterium avium subsp. paratuberculosis
gcggugauccgcccggcccg

SEQ ID NO: 936580 - RNA, 18 nt, Mycobacterium avium subsp. paratuberculosis
gcggugaucgccggaucg

SEQ ID NO: 936581 - RNA, 16 nt, Mycobacterium avium subsp. paratuberculosis
gcggugaucucgucgg

SEQ ID NO: 936582 - RNA, 18 nt, Mycobacterium avium subsp. paratuberculosis
gcggugaucucgucggcg

SEQ ID NO: 936583 - RNA, 22 nt, Mycobacterium avium subsp. paratuberculosis
gcggugaguucaucgacgucga

SEQ ID NO: 936584 - RNA, 22 nt, Mycobacterium avium subsp. paratuberculosis
gcggugaucaggcccucgucgg

SEQ ID NO: 936585 - RNA, 22 nt, Mycobacterium avium subsp. paratuberculosis
gcggugcaacgccgccgacagc

SEQ ID NO: 936586 - RNA, 13 nt, Mycobacterium avium subsp. paratuberculosis
gcggugcaccacc

SEQ ID NO: 936587 - RNA, 16 nt, Mycobacterium avium subsp. paratuberculosis
gcggugcaccaccgug

SEQ ID NO: 936588 - RNA, 15 nt, Mycobacterium avium subsp. paratuberculosis
gcggugcaccaggac

SEQ ID NO: 936589 - RNA, 16 nt, Mycobacterium avium subsp. paratuberculosis
gcggugcaccgcggcg

SEQ ID NO: 936590 - RNA, 19 nt, Mycobacterium avium subsp. paratuberculosis
gcggugcaccgcggcgcgc

SEQ ID NO: 936591 - RNA, 16 nt, Mycobacterium avium subsp. paratuberculosis
gcggugcagccccgca

SEQ ID NO: 936592 - RNA, 18 nt, Mycobacterium avium subsp. paratuberculosis
gcggugcagccgggugcg

SEQ ID NO: 936593 - RNA, 22 nt, Mycobacterium avium subsp. paratuberculosis
gcggugcacggucagcucgcgc

SEQ ID NO: 936594 - RNA, 20 nt, Mycobacterium avium subsp. paratuberculosis
gcggugcagucggucgguca

SEQ ID NO: 936595 - RNA, 15 nt, Mycobacterium avium subsp. paratuberculosis
gcggugcccagccag

SEQ ID NO: 936596 - RNA, 21 nt, Mycobacterium avium subsp. paratuberculosis
gcggugcccagccaggccgcc

SEQ ID NO: 936597 - RNA, 15 nt, Mycobacterium avium subsp. paratuberculosis
gcggugcccagccgc

SEQ ID NO: 936598 - RNA, 16 nt, Mycobacterium avium subsp. paratuberculosis
gcggugcccagccgca

SEQ ID NO: 936599 - RNA, 22 nt, Mycobacterium avium subsp. paratuberculosis
gcggugcccagccgcaggugca

SEQ ID NO: 936600 - RNA, 15 nt, Mycobacterium avium subsp. paratuberculosis
gcggugcaucgucgc

SEQ ID NO: 936601 - RNA, 16 nt, Mycobacterium avium subsp. paratuberculosis
gcggugcaucgucgcg

SEQ ID NO: 936602 - RNA, 22 nt, Mycobacterium avium subsp. paratuberculosis
gcgguaaagucuucggcgaugc

SEQ ID NO: 936603 - RNA, 15 nt, Mycobacterium avium subsp. paratuberculosis
gcgggcgcggccagc

SEQ ID NO: 936604 - RNA, 18 nt, Mycobacterium avium subsp. paratuberculosis
gcgggcgcggccagcgcg

SEQ ID NO: 936605 - RNA, 17 nt, Mycobacterium avium subsp. paratuberculosis
gcgggcgcgcgccgccc

SEQ ID NO: 936606 - RNA, 14 nt, Mycobacterium avium subsp. paratuberculosis
gcgggcgcgccguc

SEQ ID NO: 936607 - RNA, 16 nt, Mycobacterium avium subsp. paratuberculosis
gcgggcgcgccguccc

SEQ ID NO: 936608 - RNA, 23 nt, Mycobacterium avium subsp. paratuberculosis
gcgggcgcgccgucccagccgga

SEQ ID NO: 936609 - RNA, 13 nt, Mycobacterium avium subsp. paratuberculosis
gcgggcgcgccgg

SEQ ID NO: 936610 - RNA, 18 nt, Mycobacterium avium subsp. paratuberculosis
gcgggcgcgccggcgcgc

SEQ ID NO: 936611 - RNA, 22 nt, Mycobacterium avium subsp. paratuberculosis
gcgggcgaaguagccggcgauc

SEQ ID NO: 936612 - RNA, 12 nt, Mycobacterium avium subsp. paratuberculosis
gcgggcgccggc

SEQ ID NO: 936613 - RNA, 14 nt, Mycobacterium avium subsp. paratuberculosis
gcgggcgcgcagcc

SEQ ID NO: 936614 - RNA, 13 nt, Mycobacterium avium subsp. paratuberculosis
gcgggcgccggcu

SEQ ID NO: 936615 - RNA, 22 nt, Mycobacterium avium subsp. paratuberculosis
gcgggcgccguaggccgcgcug

SEQ ID NO: 936616 - RNA, 15 nt, Mycobacterium avium subsp. paratuberculosis
gcgggcgccgucggg

SEQ ID NO: 936617 - RNA, 17 nt, Mycobacterium avium subsp. paratuberculosis
gcgggccuuggcgaggu

SEQ ID NO: 936618 - RNA, 13 nt, Mycobacterium avium subsp. paratuberculosis
gcgguagcguggg

SEQ ID NO: 936619 - RNA, 18 nt, Mycobacterium avium subsp. paratuberculosis
gcgguaggugccggccgc

SEQ ID NO: 936620 - RNA, 19 nt, Mycobacterium avium subsp. paratuberculosis
gcgguaggugccggccgcg

SEQ ID NO: 936621 - RNA, 22 nt, Mycobacterium avium subsp. paratuberculosis
gcgguagggcagauaggcggcg

SEQ ID NO: 936622 - RNA, 17 nt, Mycobacterium avium subsp. paratuberculosis
gcgguacaucccgccgg

SEQ ID NO: 936623 - RNA, 19 nt, Mycobacterium avium subsp. paratuberculosis
gcgguacaucccgccgggc

SEQ ID NO: 936624 - RNA, 12 nt, Mycobacterium avium subsp. paratuberculosis
gcgguaccgccg

SEQ ID NO: 936625 - RNA, 13 nt, Mycobacterium avium subsp. paratuberculosis
gcgguaccgccga

SEQ ID NO: 936626 - RNA, 19 nt, Mycobacterium avium subsp. paratuberculosis
gcggucaccggucggugcc

SEQ ID NO: 936627 - RNA, 15 nt, Mycobacterium avium subsp. paratuberculosis
gcggucaccaaggcg

SEQ ID NO: 936628 - RNA, 19 nt, Mycobacterium avium subsp. paratuberculosis
gcggucagcucgaucgccg

SEQ ID NO: 936629 - RNA, 13 nt, Mycobacterium avium subsp. paratuberculosis
gcggucagguucg

SEQ ID NO: 936630 - RNA, 18 nt, Mycobacterium avium subsp. paratuberculosis
gcggucagguucgccacg

SEQ ID NO: 936631 - RNA, 19 nt, Mycobacterium avium subsp. paratuberculosis
gcggucagguucgccacga

SEQ ID NO: 936632 - RNA, 22 nt, Mycobacterium avium subsp. paratuberculosis
gcggucaggccgucucgagccg

SEQ ID NO: 936633 - RNA, 22 nt, Mycobacterium avium subsp. paratuberculosis
gcggucagcccgcccuuggccg

SEQ ID NO: 936634 - RNA, 17 nt, Mycobacterium avium subsp. paratuberculosis
gcggucagccggcucgg

SEQ ID NO: 936635 - RNA, 18 nt, Mycobacterium avium subsp. paratuberculosis
gcggucagccggcucggu

SEQ ID NO: 936636 - RNA, 20 nt, Mycobacterium avium subsp. paratuberculosis
gcggucagcauggcgaugac

SEQ ID NO: 936637 - RNA, 21 nt, Mycobacterium avium subsp. paratuberculosis
gcggucagcauggcgaugacg

SEQ ID NO: 936638 - RNA, 23 nt, Mycobacterium avium subsp. paratuberculosis
gcggucagcauggcgaugacguc

SEQ ID NO: 936639 - RNA, 16 nt, Mycobacterium avium subsp. paratuberculosis
gcggucgaugacgccg

SEQ ID NO: 936640 - RNA, 15 nt, Mycobacterium avium subsp. paratuberculosis
gcggucgccacucgg

SEQ ID NO: 936641 - RNA, 18 nt, Mycobacterium avium subsp. paratuberculosis
gcggucgccacucgggcg

SEQ ID NO: 936642 - RNA, 15 nt, Mycobacterium avium subsp. paratuberculosis
gcggucgccagcgcc

SEQ ID NO: 936643 - RNA, 16 nt, Mycobacterium avium subsp. paratuberculosis
gcggucgccagcgcca

SEQ ID NO: 936644 - RNA, 22 nt, Mycobacterium avium subsp. paratuberculosis
gcggucgccagcgccacgcuca

SEQ ID NO: 936645 - RNA, 18 nt, Mycobacterium avium subsp. paratuberculosis
gcgguccgcuccaccagc

SEQ ID NO: 936646 - RNA, 19 nt, Mycobacterium avium subsp. paratuberculosis
gcgguccgcuccaccagcg

SEQ ID NO: 936647 - RNA, 22 nt, Mycobacterium avium subsp. paratuberculosis
gcgguccgcuccaccagcgcgg

SEQ ID NO: 936648 - RNA, 17 nt, Mycobacterium avium subsp. paratuberculosis
gcggucgcaggccgccc

SEQ ID NO: 936649 - RNA, 23 nt, Mycobacterium avium subsp. paratuberculosis
gcggucgcaggccgcccggccca

SEQ ID NO: 936650 - RNA, 18 nt, Mycobacterium avium subsp. paratuberculosis
gcggucgcaggcgagccg

SEQ ID NO: 936651 - RNA, 19 nt, Mycobacterium avium subsp. paratuberculosis
gcggucgcaggcgagccgg

SEQ ID NO: 936652 - RNA, 16 nt, Mycobacterium avium subsp. paratuberculosis
gcgguccgcccggacc

SEQ ID NO: 936653 - RNA, 20 nt, Mycobacterium avium subsp. paratuberculosis
gcgguccgcccggaccaggg

SEQ ID NO: 936654 - RNA, 19 nt, Mycobacterium avium subsp. paratuberculosis
gcgguccgccgcagcggcg

SEQ ID NO: 936655 - RNA, 24 nt, Mycobacterium avium subsp. paratuberculosis
gcgguccgccgcagcggcgccgca

SEQ ID NO: 936656 - RNA, 12 nt, Mycobacterium avium subsp. paratuberculosis
gcgguccgacac

SEQ ID NO: 936657 - RNA, 14 nt, Mycobacterium avium subsp. paratuberculosis
gcgguccgacaccg

SEQ ID NO: 936658 - RNA, 19 nt, Mycobacterium avium subsp. paratuberculosis
gcggucccgcauguccggg

SEQ ID NO: 936659 - RNA, 12 nt, Mycobacterium avium subsp. paratuberculosis
gcggucccgcgg

SEQ ID NO: 936660 - RNA, 13 nt, Mycobacterium avium subsp. paratuberculosis
gcggucccgcggg

SEQ ID NO: 936661 - RNA, 14 nt, Mycobacterium avium subsp. paratuberculosis
gcggucccggcgga

SEQ ID NO: 936662 - RNA, 14 nt, Mycobacterium avium subsp. paratuberculosis
gcggucccggucga

SEQ ID NO: 936663 - RNA, 19 nt, Mycobacterium avium subsp. paratuberculosis
gcggucccggucgaacauc

SEQ ID NO: 936664 - RNA, 15 nt, Mycobacterium avium subsp. paratuberculosis
gcggucccgugcgcc

SEQ ID NO: 936665 - RNA, 19 nt, Mycobacterium avium subsp. paratuberculosis
gcgguccaggauccgcacc

SEQ ID NO: 936666 - RNA, 18 nt, Mycobacterium avium subsp. paratuberculosis
gcgguccaguacaccgcg

SEQ ID NO: 936667 - RNA, 20 nt, Mycobacterium avium subsp. paratuberculosis
gcgguccaguacaccgcgag

SEQ ID NO: 936668 - RNA, 17 nt, Mycobacterium avium subsp. paratuberculosis
gcgguccauccagcgcc

SEQ ID NO: 936669 - RNA, 21 nt, Mycobacterium avium subsp. paratuberculosis
gcgguccauccagcgccgcag

SEQ ID NO: 936670 - RNA, 16 nt, Mycobacterium avium subsp. paratuberculosis
gcgguccaucuccagc

SEQ ID NO: 936671 - RNA, 17 nt, Mycobacterium avium subsp. paratuberculosis
gcgguccagcgugaacg

SEQ ID NO: 936672 - RNA, 15 nt, Mycobacterium avium subsp. paratuberculosis
gcgguccagcgagcc

SEQ ID NO: 936673 - RNA, 12 nt, Mycobacterium avium subsp. paratuberculosis
gcgguccagcgu

SEQ ID NO: 936674 - RNA, 16 nt, Mycobacterium avium subsp. paratuberculosis
gcgugaccucgacggu

SEQ ID NO: 936675 - RNA, 14 nt, Mycobacterium avium subsp. paratuberculosis
gcgugaccugcugg

SEQ ID NO: 936676 - RNA, 14 nt, Mycobacterium avium subsp. paratuberculosis
gcgugaacaccgcg

SEQ ID NO: 936677 - RNA, 21 nt, Mycobacterium avium subsp. paratuberculosis
gcgugaacagcgcccggccgu

SEQ ID NO: 936678 - RNA, 16 nt, Mycobacterium avium subsp. paratuberculosis
gcgugaccggcggugc

SEQ ID NO: 936679 - RNA, 19 nt, Mycobacterium avium subsp. paratuberculosis
gcgugaccggcggugcgga

SEQ ID NO: 936680 - RNA, 13 nt, Mycobacterium avium subsp. paratuberculosis
gcgugaccggcug

SEQ ID NO: 936681 - RNA, 13 nt, Mycobacterium avium subsp. paratuberculosis
gcgugacgcccgg

SEQ ID NO: 936682 - RNA, 17 nt, Mycobacterium avium subsp. paratuberculosis
gcgugacgcccggcgcc

SEQ ID NO: 936683 - RNA, 18 nt, Mycobacterium avium subsp. paratuberculosis
gcgugacgccgcugcgug

SEQ ID NO: 936684 - RNA, 22 nt, Mycobacterium avium subsp. paratuberculosis
gcgugacgccgcugcgugcccg

SEQ ID NO: 936685 - RNA, 12 nt, Mycobacterium avium subsp. paratuberculosis
gcgugacgccgg

SEQ ID NO: 936686 - RNA, 13 nt, Mycobacterium avium subsp. paratuberculosis
gcgugacgcgcgu

SEQ ID NO: 936687 - RNA, 12 nt, Mycobacterium avium subsp. paratuberculosis
gcgugacgcucg

SEQ ID NO: 936688 - RNA, 13 nt, Mycobacterium avium subsp. paratuberculosis
gcgugacgcucga

SEQ ID NO: 936689 - RNA, 20 nt, Mycobacterium avium subsp. paratuberculosis
gcgugacgcucgacggccgg

SEQ ID NO: 936690 - RNA, 21 nt, Mycobacterium avium subsp. paratuberculosis
gcgugacgcucgaggccccgc

SEQ ID NO: 936691 - RNA, 13 nt, Mycobacterium avium subsp. paratuberculosis
gcgugacgcucgc

SEQ ID NO: 936692 - RNA, 22 nt, Mycobacterium avium subsp. paratuberculosis
gcgugacgcucgccggcggccg

SEQ ID NO: 936693 - RNA, 17 nt, Mycobacterium avium subsp. paratuberculosis
gcgugacgcucgcgugg

SEQ ID NO: 936694 - RNA, 14 nt, Mycobacterium avium subsp. paratuberculosis
gcgugacgcucggc

SEQ ID NO: 936695 - RNA, 18 nt, Mycobacterium avium subsp. paratuberculosis
gcgugacgcucggcgccg

SEQ ID NO: 936696 - RNA, 20 nt, Mycobacterium avium subsp. paratuberculosis
gcgugacgcucggcgccggc

SEQ ID NO: 936697 - RNA, 21 nt, Mycobacterium avium subsp. paratuberculosis
gcgugacgcucggcgcgucgu

SEQ ID NO: 936698 - RNA, 23 nt, Mycobacterium avium subsp. paratuberculosis
gcgugacgcucggcgcgucgucc

SEQ ID NO: 936699 - RNA, 21 nt, Mycobacterium avium subsp. paratuberculosis
gcgugacgcucgggcuucggc

SEQ ID NO: 936700 - RNA, 16 nt, Mycobacterium avium subsp. paratuberculosis
gcgucuugacgaacuc

SEQ ID NO: 936701 - RNA, 14 nt, Mycobacterium avium subsp. paratuberculosis
gcgucuugcccagc

SEQ ID NO: 936702 - RNA, 20 nt, Mycobacterium avium subsp. paratuberculosis
gcgucuugcccagcggggcg

SEQ ID NO: 936703 - RNA, 18 nt, Mycobacterium avium subsp. paratuberculosis
gcgucuucuucucgccgu

SEQ ID NO: 936704 - RNA, 21 nt, Mycobacterium avium subsp. paratuberculosis
gcgucuucuucucgccguccc

SEQ ID NO: 936705 - RNA, 16 nt, Mycobacterium avium subsp. paratuberculosis
gcgucuuggacgcccg

SEQ ID NO: 936706 - RNA, 17 nt, Mycobacterium avium subsp. paratuberculosis
gcgucuuggacgcccgc

SEQ ID NO: 936707 - RNA, 18 nt, Mycobacterium avium subsp. paratuberculosis
gcgucuuggacgcccggu

SEQ ID NO: 936708 - RNA, 16 nt, Mycobacterium avium subsp. paratuberculosis
gcgugaaaucguggcu

SEQ ID NO: 936709 - RNA, 20 nt, Mycobacterium avium subsp. paratuberculosis
gcgugaaacuagcuucacgc

SEQ ID NO: 936710 - RNA, 22 nt, Mycobacterium avium subsp. paratuberculosis
gcgucuuuucccacacgcucgg

SEQ ID NO: 936711 - RNA, 23 nt, Mycobacterium avium subsp. paratuberculosis
gcgucuuuucccacacgcucggc

SEQ ID NO: 936712 - RNA, 11 nt, Mycobacterium avium subsp. paratuberculosis
gcgugagcgag

SEQ ID NO: 936713 - RNA, 21 nt, Mycobacterium avium subsp. paratuberculosis
gcgugagcucaaccgguccaa

SEQ ID NO: 936714 - RNA, 19 nt, Mycobacterium avium subsp. paratuberculosis
gcgugaucccgauccucgc

SEQ ID NO: 936715 - RNA, 17 nt, Mycobacterium avium subsp. paratuberculosis
gcgugaucggugcccgc

SEQ ID NO: 936716 - RNA, 19 nt, Mycobacterium avium subsp. paratuberculosis
gcgugaucggugcccgcgg

SEQ ID NO: 936717 - RNA, 17 nt, Mycobacterium avium subsp. paratuberculosis
gcgugaucuguucggcg

SEQ ID NO: 936718 - RNA, 20 nt, Mycobacterium avium subsp. paratuberculosis
gcgugaucuguucggcggcg

SEQ ID NO: 936719 - RNA, 21 nt, Mycobacterium avium subsp. paratuberculosis
gcgugaugaccagggccucgu

SEQ ID NO: 936720 - RNA, 23 nt, Mycobacterium avium subsp. paratuberculosis
gcgugaugacggcggcggugccg

SEQ ID NO: 936721 - RNA, 18 nt, Mycobacterium avium subsp. paratuberculosis
gcgugacuugucgggccg

SEQ ID NO: 936722 - RNA, 21 nt, Mycobacterium avium subsp. paratuberculosis
gcgugacuugucgggccgcac

SEQ ID NO: 936723 - RNA, 15 nt, Mycobacterium avium subsp. paratuberculosis
gcgugacgucgacgu

SEQ ID NO: 936724 - RNA, 18 nt, Mycobacterium avium subsp. paratuberculosis
gcgugacgucgacguucg

SEQ ID NO: 936725 - RNA, 12 nt, Mycobacterium avium subsp. paratuberculosis
gcgugacguucg

SEQ ID NO: 936726 - RNA, 14 nt, Mycobacterium avium subsp. paratuberculosis
gcgugacguucguc

SEQ ID NO: 936727 - RNA, 20 nt, Mycobacterium avium subsp. paratuberculosis
gcgugacggaugugacgcgg

SEQ ID NO: 936728 - RNA, 19 nt, Mycobacterium avium subsp. paratuberculosis
gcgucguagucgcucggcg

SEQ ID NO: 936729 - RNA, 21 nt, Mycobacterium avium subsp. paratuberculosis
gcgucguagucgcucggcggc

SEQ ID NO: 936730 - RNA, 23 nt, Mycobacterium avium subsp. paratuberculosis
gcgucguagucgcucggcggcga

SEQ ID NO: 936731 - RNA, 18 nt, Mycobacterium avium subsp. paratuberculosis
gcgucguaguugcggccg

SEQ ID NO: 936732 - RNA, 21 nt, Mycobacterium avium subsp. paratuberculosis
gcgucguaguugcggccggcg

SEQ ID NO: 936733 - RNA, 23 nt, Mycobacterium avium subsp. paratuberculosis
gcgucguaguugcggccggcggu

SEQ ID NO: 936734 - RNA, 16 nt, Mycobacterium avium subsp. paratuberculosis
gcgucguagccggcac

SEQ ID NO: 936735 - RNA, 19 nt, Mycobacterium avium subsp. paratuberculosis
gcgucguagccggcacgca

SEQ ID NO: 936736 - RNA, 17 nt, Mycobacterium avium subsp. paratuberculosis
gcgucguagagcugacg

SEQ ID NO: 936737 - RNA, 23 nt, Mycobacterium avium subsp. paratuberculosis
gcgucguagagcugacgggaccg

SEQ ID NO: 936738 - RNA, 13 nt, Mycobacterium avium subsp. paratuberculosis
gcgucguccaugc

SEQ ID NO: 936739 - RNA, 16 nt, Mycobacterium avium subsp. paratuberculosis
gcgucguccgacacca

SEQ ID NO: 936740 - RNA, 19 nt, Mycobacterium avium subsp. paratuberculosis
gcgucguccgacaccaccu

SEQ ID NO: 936741 - RNA, 20 nt, Mycobacterium avium subsp. paratuberculosis
gcgucgucgagcaccggcag

SEQ ID NO: 936742 - RNA, 23 nt, Mycobacterium avium subsp. paratuberculosis
gcgucgucgagcaccggcagccg

SEQ ID NO: 936743 - RNA, 14 nt, Mycobacterium avium subsp. paratuberculosis
gcgucgucgaggcg

SEQ ID NO: 936744 - RNA, 15 nt, Mycobacterium avium subsp. paratuberculosis
gcgucguacaccucg

SEQ ID NO: 936745 - RNA, 19 nt, Mycobacterium avium subsp. paratuberculosis
gcgucguacaccucggucg

SEQ ID NO: 936746 - RNA, 22 nt, Mycobacterium avium subsp. paratuberculosis
gcgucgguggcggcggcgacga

SEQ ID NO: 936747 - RNA, 18 nt, Mycobacterium avium subsp. paratuberculosis
gcgucggugucccgcgcc

SEQ ID NO: 936748 - RNA, 16 nt, Mycobacterium avium subsp. paratuberculosis
gcgucggucagcgcca

SEQ ID NO: 936749 - RNA, 18 nt, Mycobacterium avium subsp. paratuberculosis
gcgucggucagcggcguc

SEQ ID NO: 936750 - RNA, 13 nt, Mycobacterium avium subsp. paratuberculosis
gcgucggucucga

SEQ ID NO: 936751 - RNA, 19 nt, Mycobacterium avium subsp. paratuberculosis
gcgucggucucgacguugg

SEQ ID NO: 936752 - RNA, 18 nt, Mycobacterium avium subsp. paratuberculosis
gcgucggugaacucgucc

SEQ ID NO: 936753 - RNA, 13 nt, Mycobacterium avium subsp. paratuberculosis
gcgucggugaugc

SEQ ID NO: 936754 - RNA, 16 nt, Mycobacterium avium subsp. paratuberculosis
gcgucggugaugucgg

SEQ ID NO: 936755 - RNA, 14 nt, Mycobacterium avium subsp. paratuberculosis
gcgucuggccggag

SEQ ID NO: 936756 - RNA, 21 nt, Mycobacterium avium subsp. paratuberculosis
gcgucuggccggagcggugcg

SEQ ID NO: 936757 - RNA, 18 nt, Mycobacterium avium subsp. paratuberculosis
gcgucuggcagccggccg

SEQ ID NO: 936758 - RNA, 20 nt, Mycobacterium avium subsp. paratuberculosis
gcgucuggcagccggccggc

SEQ ID NO: 936759 - RNA, 14 nt, Mycobacterium avium subsp. paratuberculosis
gcgucugcucgcgg

SEQ ID NO: 936760 - RNA, 17 nt, Mycobacterium avium subsp. paratuberculosis
gcgucugcucgcgguuc

SEQ ID NO: 936761 - RNA, 13 nt, Mycobacterium avium subsp. paratuberculosis
gcgucugcucggc

SEQ ID NO: 936762 - RNA, 14 nt, Mycobacterium avium subsp. paratuberculosis
gcgucugcucggcg

SEQ ID NO: 936763 - RNA, 15 nt, Mycobacterium avium subsp. paratuberculosis
gcgucugcucggcgg

SEQ ID NO: 936764 - RNA, 16 nt, Mycobacterium avium subsp. paratuberculosis
gcgucugcucggcggc

SEQ ID NO: 936765 - RNA, 21 nt, Mycobacterium avium subsp. paratuberculosis
gcgucugcuggauggucucgc

SEQ ID NO: 936766 - RNA, 15 nt, Mycobacterium avium subsp. paratuberculosis
gcgucugugguggcg

SEQ ID NO: 936767 - RNA, 17 nt, Mycobacterium avium subsp. paratuberculosis
gcguguuggacgcccgc

SEQ ID NO: 936768 - RNA, 15 nt, Mycobacterium avium subsp. paratuberculosis
gcguuacacccgcgg

SEQ ID NO: 936769 - RNA, 19 nt, Mycobacterium avium subsp. paratuberculosis
gcguuauuugugcgcuggc

SEQ ID NO: 936770 - RNA, 23 nt, Mycobacterium avium subsp. paratuberculosis
gcguguuccuugcggccgccgau

SEQ ID NO: 936771 - RNA, 22 nt, Mycobacterium avium subsp. paratuberculosis
gcguggggacccccucgucgau

SEQ ID NO: 936772 - RNA, 12 nt, Mycobacterium avium subsp. paratuberculosis
gcgugggccgca

SEQ ID NO: 936773 - RNA, 22 nt, Mycobacterium avium subsp. paratuberculosis
gcgugggagagcgggaccgagg

SEQ ID NO: 936774 - RNA, 17 nt, Mycobacterium avium subsp. paratuberculosis
gcgugggauccgagggu

SEQ ID NO: 936775 - RNA, 15 nt, Mycobacterium avium subsp. paratuberculosis
gcgugggcaccccga

SEQ ID NO: 936776 - RNA, 20 nt, Mycobacterium avium subsp. paratuberculosis
gcguggcgucggugaacucg

SEQ ID NO: 936777 - RNA, 21 nt, Mycobacterium avium subsp. paratuberculosis
gcguggcucggcccgccgggc

SEQ ID NO: 936778 - RNA, 15 nt, Mycobacterium avium subsp. paratuberculosis
gcguggcccagccgg

SEQ ID NO: 936779 - RNA, 18 nt, Mycobacterium avium subsp. paratuberculosis
gcguggcccagccggugc

SEQ ID NO: 936780 - RNA, 14 nt, Mycobacterium avium subsp. paratuberculosis
gcguggauggccgg

SEQ ID NO: 936781 - RNA, 15 nt, Mycobacterium avium subsp. paratuberculosis
gcguggauggccggc

SEQ ID NO: 936782 - RNA, 18 nt, Mycobacterium avium subsp. paratuberculosis
gcguggauggccggccgg

SEQ ID NO: 936783 - RNA, 20 nt, Mycobacterium avium subsp. paratuberculosis
gcguggauggccggccgggu

SEQ ID NO: 936784 - RNA, 16 nt, Mycobacterium avium subsp. paratuberculosis
gcguggacaccgcacc

SEQ ID NO: 936785 - RNA, 21 nt, Mycobacterium avium subsp. paratuberculosis
gcguggcagcggucggcggcu

SEQ ID NO: 936786 - RNA, 13 nt, Mycobacterium avium subsp. paratuberculosis
gcguggcacccgg

SEQ ID NO: 936787 - RNA, 15 nt, Mycobacterium avium subsp. paratuberculosis
gcguggcacccgggc

SEQ ID NO: 936788 - RNA, 13 nt, Mycobacterium avium subsp. paratuberculosis
gcgugcuugaacg

SEQ ID NO: 936789 - RNA, 19 nt, Mycobacterium avium subsp. paratuberculosis
gcgugcuugaacgccgccc

SEQ ID NO: 936790 - RNA, 23 nt, Mycobacterium avium subsp. paratuberculosis
gcgugcuugaacgccgcccccgc

SEQ ID NO: 936791 - RNA, 21 nt, Mycobacterium avium subsp. paratuberculosis
gcgugcuguugcaggugcgcg

SEQ ID NO: 936792 - RNA, 17 nt, Mycobacterium avium subsp. paratuberculosis
gcgugcugggcaccguc

SEQ ID NO: 936793 - RNA, 19 nt, Mycobacterium avium subsp. paratuberculosis
gcgugcugggcaccgucga

SEQ ID NO: 936794 - RNA, 21 nt, Mycobacterium avium subsp. paratuberculosis
gcgugcugacgucgucgccca

SEQ ID NO: 936795 - RNA, 21 nt, Mycobacterium avium subsp. paratuberculosis
gcgugcugccggacaccccgg

SEQ ID NO: 936796 - RNA, 15 nt, Mycobacterium avium subsp. paratuberculosis
gcgugcugcgcagca

SEQ ID NO: 936797 - RNA, 19 nt, Mycobacterium avium subsp. paratuberculosis
gcgugcucggccacgacgc

SEQ ID NO: 936798 - RNA, 21 nt, Mycobacterium avium subsp. paratuberculosis
gcgugcucggccacgacgcgc

SEQ ID NO: 936799 - RNA, 15 nt, Mycobacterium avium subsp. paratuberculosis
gcgugcuccagcagg

SEQ ID NO: 936800 - RNA, 16 nt, Mycobacterium avium subsp. paratuberculosis
gcgugcucgucgcgga

SEQ ID NO: 936801 - RNA, 19 nt, Mycobacterium avium subsp. paratuberculosis
gcgugcucgucgcggagga

SEQ ID NO: 936802 - RNA, 13 nt, Mycobacterium avium subsp. paratuberculosis
gcgugcucgaucg

SEQ ID NO: 936803 - RNA, 21 nt, Mycobacterium avium subsp. paratuberculosis
gcgugcucgaucgcguucugc

SEQ ID NO: 936804 - RNA, 13 nt, Mycobacterium avium subsp. paratuberculosis
gcgugcucgauga

SEQ ID NO: 936805 - RNA, 18 nt, Mycobacterium avium subsp. paratuberculosis
gcgugcgggucgcgcggc

SEQ ID NO: 936806 - RNA, 11 nt, Mycobacterium avium subsp. paratuberculosis
gcgugcgggug

SEQ ID NO: 936807 - RNA, 13 nt, Mycobacterium avium subsp. paratuberculosis
gcgugcagcccgc

SEQ ID NO: 936808 - RNA, 12 nt, Mycobacterium avium subsp. paratuberculosis
gcgugcagccga

SEQ ID NO: 936809 - RNA, 16 nt, Mycobacterium avium subsp. paratuberculosis
gcgugcagccgggcgg

SEQ ID NO: 936810 - RNA, 13 nt, Mycobacterium avium subsp. paratuberculosis
gcgugcagcacgc

SEQ ID NO: 936811 - RNA, 15 nt, Mycobacterium avium subsp. paratuberculosis
gcgugcagcacgccc

SEQ ID NO: 936812 - RNA, 20 nt, Mycobacterium avium subsp. paratuberculosis
gcgugcagcacgcccucggc

SEQ ID NO: 936813 - RNA, 18 nt, Mycobacterium avium subsp. paratuberculosis
gcgugcagcacggggacg

SEQ ID NO: 936814 - RNA, 13 nt, Mycobacterium avium subsp. paratuberculosis
gcgugcacccggu

SEQ ID NO: 936815 - RNA, 13 nt, Mycobacterium avium subsp. paratuberculosis
gcgugcaccgccc

SEQ ID NO: 936816 - RNA, 20 nt, Mycobacterium avium subsp. paratuberculosis
gcgugcacgaacgcggccag

SEQ ID NO: 936817 - RNA, 17 nt, Mycobacterium avium subsp. paratuberculosis
gcgugcaacugcguggc

SEQ ID NO: 936818 - RNA, 15 nt, Mycobacterium avium subsp. paratuberculosis
gcgugcacaccggcc

SEQ ID NO: 936819 - RNA, 16 nt, Mycobacterium avium subsp. paratuberculosis
gcgugcacaggccgcc

SEQ ID NO: 936820 - RNA, 18 nt, Mycobacterium avium subsp. paratuberculosis
gcgugcacaggccgccgc

SEQ ID NO: 936821 - RNA, 18 nt, Mycobacterium avium subsp. paratuberculosis
gcgugauccggaaugcgg

SEQ ID NO: 936822 - RNA, 13 nt, Mycobacterium avium subsp. paratuberculosis
gcguagaccagcg

SEQ ID NO: 936823 - RNA, 18 nt, Mycobacterium avium subsp. paratuberculosis
gcguagaccagcgacgcc

SEQ ID NO: 936824 - RNA, 16 nt, Mycobacterium avium subsp. paratuberculosis
gcguacugcucggcgc

SEQ ID NO: 936825 - RNA, 18 nt, Mycobacterium avium subsp. paratuberculosis
gcguacugcucggcgcgg

SEQ ID NO: 936826 - RNA, 16 nt, Mycobacterium avium subsp. paratuberculosis
gcguagagccgcucgc

SEQ ID NO: 936827 - RNA, 17 nt, Mycobacterium avium subsp. paratuberculosis
gcguagcagucggccug

SEQ ID NO: 936828 - RNA, 22 nt, Mycobacterium avium subsp. paratuberculosis
gcguagucgauggccucgucgc

SEQ ID NO: 936829 - RNA, 15 nt, Mycobacterium avium subsp. paratuberculosis
gcguagucgccggug

SEQ ID NO: 936830 - RNA, 13 nt, Mycobacterium avium subsp. paratuberculosis
gcguagucggcgc

SEQ ID NO: 936831 - RNA, 19 nt, Mycobacterium avium subsp. paratuberculosis
gcguagucggcgcagcgca

SEQ ID NO: 936832 - RNA, 18 nt, Mycobacterium avium subsp. paratuberculosis
gcguagucggcgucggcc

SEQ ID NO: 936833 - RNA, 15 nt, Mycobacterium avium subsp. paratuberculosis
gcguagucggugcag

SEQ ID NO: 936834 - RNA, 12 nt, Mycobacterium avium subsp. paratuberculosis
gcguagucgucg

SEQ ID NO: 936835 - RNA, 13 nt, Mycobacterium avium subsp. paratuberculosis
gcguagucgucga

SEQ ID NO: 936836 - RNA, 14 nt, Mycobacterium avium subsp. paratuberculosis
gcguaguccagcac

SEQ ID NO: 936837 - RNA, 19 nt, Mycobacterium avium subsp. paratuberculosis
gcguaguccagcacggcga

SEQ ID NO: 936838 - RNA, 19 nt, Mycobacterium avium subsp. paratuberculosis
gcguaggugggcagcgcgg

SEQ ID NO: 936839 - RNA, 20 nt, Mycobacterium avium subsp. paratuberculosis
gcguagugggucggcggcug

SEQ ID NO: 936840 - RNA, 15 nt, Mycobacterium avium subsp. paratuberculosis
gcguagugcgcccag

SEQ ID NO: 936841 - RNA, 21 nt, Mycobacterium avium subsp. paratuberculosis
gcguagucguugucggcgguc

SEQ ID NO: 936842 - RNA, 20 nt, Mycobacterium avium subsp. paratuberculosis
gcgucaacccguuccacauc

SEQ ID NO: 936843 - RNA, 20 nt, Mycobacterium avium subsp. paratuberculosis
gcgucaccccaccgagcagc

SEQ ID NO: 936844 - RNA, 21 nt, Mycobacterium avium subsp. paratuberculosis
gcgucaccaggcugcucggcg

SEQ ID NO: 936845 - RNA, 22 nt, Mycobacterium avium subsp. paratuberculosis
gcgucaccaggcugcucggcgg

SEQ ID NO: 936846 - RNA, 18 nt, Mycobacterium avium subsp. paratuberculosis
gcgucacauccgucacgc

SEQ ID NO: 936847 - RNA, 21 nt, Mycobacterium avium subsp. paratuberculosis
gcgucaauugccaacugcagc

SEQ ID NO: 936848 - RNA, 20 nt, Mycobacterium avium subsp. paratuberculosis
gcgucaccaaugcgccggcg

SEQ ID NO: 936849 - RNA, 14 nt, Mycobacterium avium subsp. paratuberculosis
gcgucaacucgucg

SEQ ID NO: 936850 - RNA, 15 nt, Mycobacterium avium subsp. paratuberculosis
gcgucaacucgucgg

SEQ ID NO: 936851 - RNA, 18 nt, Mycobacterium avium subsp. paratuberculosis
gcgucaacucgucggcga

SEQ ID NO: 936852 - RNA, 14 nt, Mycobacterium avium subsp. paratuberculosis
gcgucagcaucgcc

SEQ ID NO: 936853 - RNA, 16 nt, Mycobacterium avium subsp. paratuberculosis
gcgucagcaucgccgu

SEQ ID NO: 936854 - RNA, 20 nt, Mycobacterium avium subsp. paratuberculosis
gcgucagcaucgccgucguc

SEQ ID NO: 936855 - RNA, 21 nt, Mycobacterium avium subsp. paratuberculosis
gcgucagcaucgccgucguca

SEQ ID NO: 936856 - RNA, 21 nt, Mycobacterium avium subsp. paratuberculosis
gcgucagccccgaguccacga

SEQ ID NO: 936857 - RNA, 16 nt, Mycobacterium avium subsp. paratuberculosis
gcgucagccgucgucg

SEQ ID NO: 936858 - RNA, 19 nt, Mycobacterium avium subsp. paratuberculosis
gcguccagcugcgcgccgg

SEQ ID NO: 936859 - RNA, 20 nt, Mycobacterium avium subsp. paratuberculosis
gcguccagcugcgcgccggc

SEQ ID NO: 936860 - RNA, 14 nt, Mycobacterium avium subsp. paratuberculosis
gcguccagcgcggu

SEQ ID NO: 936861 - RNA, 16 nt, Mycobacterium avium subsp. paratuberculosis
gcguccagcgcgucgc

SEQ ID NO: 936862 - RNA, 19 nt, Mycobacterium avium subsp. paratuberculosis
gcguccagcggguugccgc

SEQ ID NO: 936863 - RNA, 17 nt, Mycobacterium avium subsp. paratuberculosis
gcgucagggguuggcgc

SEQ ID NO: 936864 - RNA, 19 nt, Mycobacterium avium subsp. paratuberculosis
gcgucagggguuggcgcgc

SEQ ID NO: 936865 - RNA, 20 nt, Mycobacterium avium subsp. paratuberculosis
gcgucagggguuggcgcgca

SEQ ID NO: 936866 - RNA, 22 nt, Mycobacterium avium subsp. paratuberculosis
gcgucaggcgcugggugcgggc

SEQ ID NO: 936867 - RNA, 14 nt, Mycobacterium avium subsp. paratuberculosis
gcgucaggcgucgu

SEQ ID NO: 936868 - RNA, 14 nt, Mycobacterium avium subsp. paratuberculosis
gcgucagggcgacu

SEQ ID NO: 936869 - RNA, 17 nt, Mycobacterium avium subsp. paratuberculosis
gcgucagggcgacuccg

SEQ ID NO: 936870 - RNA, 18 nt, Mycobacterium avium subsp. paratuberculosis
gcgucagggcgacuccgg

SEQ ID NO: 936871 - RNA, 15 nt, Mycobacterium avium subsp. paratuberculosis
gcgucaggucaccga

SEQ ID NO: 936872 - RNA, 17 nt, Mycobacterium avium subsp. paratuberculosis
gcguccauggucgagcc

SEQ ID NO: 936873 - RNA, 18 nt, Mycobacterium avium subsp. paratuberculosis
gcguccaguagccgccgg

SEQ ID NO: 936874 - RNA, 21 nt, Mycobacterium avium subsp. paratuberculosis
gcguccaguagccgccgggcg

SEQ ID NO: 936875 - RNA, 16 nt, Mycobacterium avium subsp. paratuberculosis
gcguccaggcgcaccg

SEQ ID NO: 936876 - RNA, 17 nt, Mycobacterium avium subsp. paratuberculosis
gcguccagggccaccgc

SEQ ID NO: 936877 - RNA, 14 nt, Mycobacterium avium subsp. paratuberculosis
gcguccaguccggc

SEQ ID NO: 936878 - RNA, 20 nt, Mycobacterium avium subsp. paratuberculosis
gcguccagugcaugccggcc

SEQ ID NO: 936879 - RNA, 18 nt, Mycobacterium avium subsp. paratuberculosis
gcguccaguucggccagc

SEQ ID NO: 936880 - RNA, 19 nt, Mycobacterium avium subsp. paratuberculosis
gcguccaguucggccagcg

SEQ ID NO: 936881 - RNA, 21 nt, Mycobacterium avium subsp. paratuberculosis
gcguccaguucggccagcgcg

SEQ ID NO: 936882 - RNA, 22 nt, Mycobacterium avium subsp. paratuberculosis
gcguccaguugcggcacgccga

SEQ ID NO: 936883 - RNA, 13 nt, Mycobacterium avium subsp. paratuberculosis
gcgucccgcgccg

SEQ ID NO: 936884 - RNA, 19 nt, Mycobacterium avium subsp. paratuberculosis
gcgucccggcgucucggcg

SEQ ID NO: 936885 - RNA, 13 nt, Mycobacterium avium subsp. paratuberculosis
gcgucccgggccu

SEQ ID NO: 936886 - RNA, 21 nt, Mycobacterium avium subsp. paratuberculosis
gcgucccguccugggccuggc

SEQ ID NO: 936887 - RNA, 14 nt, Mycobacterium avium subsp. paratuberculosis
gcgucccgucggcc

SEQ ID NO: 936888 - RNA, 21 nt, Mycobacterium avium subsp. paratuberculosis
gcgucccguuggcgccggucg

SEQ ID NO: 936889 - RNA, 19 nt, Mycobacterium avium subsp. paratuberculosis
gcgucccagugcucgacca

SEQ ID NO: 936890 - RNA, 13 nt, Mycobacterium avium subsp. paratuberculosis
gcgucccacaucu

SEQ ID NO: 936891 - RNA, 16 nt, Mycobacterium avium subsp. paratuberculosis
gcgucccacgugguga

SEQ ID NO: 936892 - RNA, 13 nt, Mycobacterium avium subsp. paratuberculosis
gcguccccgcgcc

SEQ ID NO: 936893 - RNA, 16 nt, Mycobacterium avium subsp. paratuberculosis
gcgucgaugucgucgu

SEQ ID NO: 936894 - RNA, 18 nt, Mycobacterium avium subsp. paratuberculosis
gcgucgaugucgucguug

SEQ ID NO: 936895 - RNA, 15 nt, Mycobacterium avium subsp. paratuberculosis
gcgucgaugucgccc

SEQ ID NO: 936896 - RNA, 18 nt, Mycobacterium avium subsp. paratuberculosis
gcgucgaugucgcccggc

SEQ ID NO: 936897 - RNA, 17 nt, Mycobacterium avium subsp. paratuberculosis
gcgucgcagaucccgcc

SEQ ID NO: 936898 - RNA, 18 nt, Mycobacterium avium subsp. paratuberculosis
gcgucgcagaucccgccg

SEQ ID NO: 936899 - RNA, 20 nt, Mycobacterium avium subsp. paratuberculosis
gcgucgcagaucccgccggc

SEQ ID NO: 936900 - RNA, 23 nt, Mycobacterium avium subsp. paratuberculosis
gcgucgcagaucccgccggcggc

SEQ ID NO: 936901 - RNA, 15 nt, Mycobacterium avium subsp. paratuberculosis
gcgucgcacagcgcc

SEQ ID NO: 936902 - RNA, 15 nt, Mycobacterium avium subsp. paratuberculosis
gcgucgcacguggug

SEQ ID NO: 936903 - RNA, 18 nt, Mycobacterium avium subsp. paratuberculosis
gcgucgacgucgggcacg

SEQ ID NO: 936904 - RNA, 16 nt, Mycobacterium avium subsp. paratuberculosis
gcgucgacgugcgcgg

SEQ ID NO: 936905 - RNA, 20 nt, Mycobacterium avium subsp. paratuberculosis
gcgucgacgugcgcggcguu

SEQ ID NO: 936906 - RNA, 20 nt, Mycobacterium avium subsp. paratuberculosis
gcgucgacguucgccgccag

SEQ ID NO: 936907 - RNA, 12 nt, Mycobacterium avium subsp. paratuberculosis
gcgucgacgcgg

SEQ ID NO: 936908 - RNA, 16 nt, Mycobacterium avium subsp. paratuberculosis
gcgucgacgcggucga

SEQ ID NO: 936909 - RNA, 17 nt, Mycobacterium avium subsp. paratuberculosis
gcgucgacggcgccgga

SEQ ID NO: 936910 - RNA, 16 nt, Mycobacterium avium subsp. paratuberculosis
gcgucgacggcgugga

SEQ ID NO: 936911 - RNA, 12 nt, Mycobacterium avium subsp. paratuberculosis
gcgucgacgggc

SEQ ID NO: 936912 - RNA, 14 nt, Mycobacterium avium subsp. paratuberculosis
gcgucgacgacggc

SEQ ID NO: 936913 - RNA, 24 nt, Mycobacterium avium subsp. paratuberculosis
gcgucgacgacggcgccgcgucgg

SEQ ID NO: 936914 - RNA, 16 nt, Mycobacterium avium subsp. paratuberculosis
gcgucgaccgccccgc

SEQ ID NO: 936915 - RNA, 20 nt, Mycobacterium avium subsp. paratuberculosis
gcgucgaccgccccgccggu

SEQ ID NO: 936916 - RNA, 21 nt, Mycobacterium avium subsp. paratuberculosis
gcgucgaccgccccgccggug

SEQ ID NO: 936917 - RNA, 12 nt, Mycobacterium avium subsp. paratuberculosis
gcgucgaccacc

SEQ ID NO: 936918 - RNA, 13 nt, Mycobacterium avium subsp. paratuberculosis
gcgucgaccaccg

SEQ ID NO: 936919 - RNA, 17 nt, Mycobacterium avium subsp. paratuberculosis
gcgucgaccaccgccgg

SEQ ID NO: 936920 - RNA, 21 nt, Mycobacterium avium subsp. paratuberculosis
gcgucgaccaccgccggcccg

SEQ ID NO: 936921 - RNA, 22 nt, Mycobacterium avium subsp. paratuberculosis
gcgucgaccaccgccggcccgg

SEQ ID NO: 936922 - RNA, 18 nt, Mycobacterium avium subsp. paratuberculosis
gcgucgaccagccgcauc

SEQ ID NO: 936923 - RNA, 15 nt, Mycobacterium avium subsp. paratuberculosis
gcguccugcggggag

SEQ ID NO: 936924 - RNA, 13 nt, Mycobacterium avium subsp. paratuberculosis
gcguccucgucgg

SEQ ID NO: 936925 - RNA, 14 nt, Mycobacterium avium subsp. paratuberculosis
gcguccucgucggc

SEQ ID NO: 936926 - RNA, 19 nt, Mycobacterium avium subsp. paratuberculosis
gcguccugcagcagccgga

SEQ ID NO: 936927 - RNA, 16 nt, Mycobacterium avium subsp. paratuberculosis
gcgucgacagccgguc

SEQ ID NO: 936928 - RNA, 20 nt, Mycobacterium avium subsp. paratuberculosis
gcgucgacagccggucgcgc

SEQ ID NO: 936929 - RNA, 23 nt, Mycobacterium avium subsp. paratuberculosis
gcgucgacagccggucgcgcauc

SEQ ID NO: 936930 - RNA, 17 nt, Mycobacterium avium subsp. paratuberculosis
gcguccgugccguccgg

SEQ ID NO: 936931 - RNA, 19 nt, Mycobacterium avium subsp. paratuberculosis
gcguccgugccguccggcc

SEQ ID NO: 936932 - RNA, 20 nt, Mycobacterium avium subsp. paratuberculosis
gcguccgugccguccggccg

SEQ ID NO: 936933 - RNA, 16 nt, Mycobacterium avium subsp. paratuberculosis
gcguccuccucguccg

SEQ ID NO: 936934 - RNA, 20 nt, Mycobacterium avium subsp. paratuberculosis
gcguccuccucguccgcggc

SEQ ID NO: 936935 - RNA, 21 nt, Mycobacterium avium subsp. paratuberculosis
gcguccuccucguccgcggcg

SEQ ID NO: 936936 - RNA, 22 nt, Mycobacterium avium subsp. paratuberculosis
gcguccuccucguccgcggcgg

SEQ ID NO: 936937 - RNA, 15 nt, Mycobacterium avium subsp. paratuberculosis
gcguccucgaccacc

SEQ ID NO: 936938 - RNA, 22 nt, Mycobacterium avium subsp. paratuberculosis
gcguccucgaccacccgcuggu

SEQ ID NO: 936939 - RNA, 23 nt, Mycobacterium avium subsp. paratuberculosis
gcguccucgaccacccgcugguc

SEQ ID NO: 936940 - RNA, 12 nt, Mycobacterium avium subsp. paratuberculosis
gcguccucgacg

SEQ ID NO: 936941 - RNA, 18 nt, Mycobacterium avium subsp. paratuberculosis
gcguccucgacgccgcgc

SEQ ID NO: 936942 - RNA, 13 nt, Mycobacterium avium subsp. paratuberculosis
gcguccucgacgg

SEQ ID NO: 936943 - RNA, 14 nt, Mycobacterium avium subsp. paratuberculosis
gcguccucgaugac

SEQ ID NO: 936944 - RNA, 15 nt, Mycobacterium avium subsp. paratuberculosis
gcguccucgaugacg

SEQ ID NO: 936945 - RNA, 22 nt, Mycobacterium avium subsp. paratuberculosis
gcguccucgccguacgcgccgg

SEQ ID NO: 936946 - RNA, 18 nt, Mycobacterium avium subsp. paratuberculosis
gcguccguagugcucggc

SEQ ID NO: 936947 - RNA, 21 nt, Mycobacterium avium subsp. paratuberculosis
gcguccguagugcucggcguc

SEQ ID NO: 936948 - RNA, 18 nt, Mycobacterium avium subsp. paratuberculosis
gcguccgagcagcagccg

SEQ ID NO: 936949 - RNA, 23 nt, Mycobacterium avium subsp. paratuberculosis
gcguccgaggcgguuccgguggc

SEQ ID NO: 936950 - RNA, 15 nt, Mycobacterium avium subsp. paratuberculosis
gcguccggucugcuc

SEQ ID NO: 936951 - RNA, 17 nt, Mycobacterium avium subsp. paratuberculosis
gcguccggucugcuccg

SEQ ID NO: 936952 - RNA, 16 nt, Mycobacterium avium subsp. paratuberculosis
gcgucccuggcgauga

SEQ ID NO: 936953 - RNA, 22 nt, Mycobacterium avium subsp. paratuberculosis
gcgucccuggcgaugaucaaca

SEQ ID NO: 936954 - RNA, 20 nt, Mycobacterium avium subsp. paratuberculosis
gcguccgagaagggccgccg

SEQ ID NO: 936955 - RNA, 17 nt, Mycobacterium avium subsp. paratuberculosis
gcguccgauaccagccg

SEQ ID NO: 936956 - RNA, 13 nt, Mycobacterium avium subsp. paratuberculosis
gcgucgccagccg

SEQ ID NO: 936957 - RNA, 14 nt, Mycobacterium avium subsp. paratuberculosis
gcgucgccaccacc

SEQ ID NO: 936958 - RNA, 16 nt, Mycobacterium avium subsp. paratuberculosis
gcgucgccaauccggc

SEQ ID NO: 936959 - RNA, 18 nt, Mycobacterium avium subsp. paratuberculosis
gcgucgccaauccggcgg

SEQ ID NO: 936960 - RNA, 18 nt, Mycobacterium avium subsp. paratuberculosis
gcgucgccaugccgucgc

SEQ ID NO: 936961 - RNA, 21 nt, Mycobacterium avium subsp. paratuberculosis
gcgucgccaugccgucgcgca

SEQ ID NO: 936962 - RNA, 16 nt, Mycobacterium avium subsp. paratuberculosis
gcgucgcccacgccgg

SEQ ID NO: 936963 - RNA, 15 nt, Mycobacterium avium subsp. paratuberculosis
gcgucgcccgccgac

SEQ ID NO: 936964 - RNA, 16 nt, Mycobacterium avium subsp. paratuberculosis
gcgucgcgcgguuccg

SEQ ID NO: 936965 - RNA, 21 nt, Mycobacterium avium subsp. paratuberculosis
gcgucgcgcgguuccggcgug

SEQ ID NO: 936966 - RNA, 22 nt, Mycobacterium avium subsp. paratuberculosis
gcgucgcgcgguuccggcgugc

SEQ ID NO: 936967 - RNA, 13 nt, Mycobacterium avium subsp. paratuberculosis
gcgucgcgccagc

SEQ ID NO: 936968 - RNA, 13 nt, Mycobacterium avium subsp. paratuberculosis
gcgucgcugaacg

SEQ ID NO: 936969 - RNA, 14 nt, Mycobacterium avium subsp. paratuberculosis
gcgucgcugcccag

SEQ ID NO: 936970 - RNA, 20 nt, Mycobacterium avium subsp. paratuberculosis
gcgucgcugccguagcgcug

SEQ ID NO: 936971 - RNA, 23 nt, Mycobacterium avium subsp. paratuberculosis
gcgucgcucauguugugcaggca

SEQ ID NO: 936972 - RNA, 14 nt, Mycobacterium avium subsp. paratuberculosis
gcgucgcggcgcgg

SEQ ID NO: 936973 - RNA, 14 nt, Mycobacterium avium subsp. paratuberculosis
gcgucgcguggcaa

SEQ ID NO: 936974 - RNA, 22 nt, Mycobacterium avium subsp. paratuberculosis
gcgucgcgguaguuguccccga

SEQ ID NO: 936975 - RNA, 14 nt, Mycobacterium avium subsp. paratuberculosis
gcgucgcggucggc

SEQ ID NO: 936976 - RNA, 17 nt, Mycobacterium avium subsp. paratuberculosis
gcgucgcggucggcguc

SEQ ID NO: 936977 - RNA, 11 nt, Mycobacterium avium subsp. paratuberculosis
gcgucgcggug

SEQ ID NO: 936978 - RNA, 21 nt, Mycobacterium avium subsp. paratuberculosis
gcgucgcggugaaguugccgc

SEQ ID NO: 936979 - RNA, 14 nt, Mycobacterium avium subsp. paratuberculosis
gcgucgcgggcccg

SEQ ID NO: 936980 - RNA, 15 nt, Mycobacterium avium subsp. paratuberculosis
gcgucgcggccggga

SEQ ID NO: 936981 - RNA, 21 nt, Mycobacterium avium subsp. paratuberculosis
gcgucgggccgggggcggcgg

SEQ ID NO: 936982 - RNA, 14 nt, Mycobacterium avium subsp. paratuberculosis
gcgucgggcucggc

SEQ ID NO: 936983 - RNA, 16 nt, Mycobacterium avium subsp. paratuberculosis
gcgucgggcucggccg

SEQ ID NO: 936984 - RNA, 18 nt, Mycobacterium avium subsp. paratuberculosis
gcgucgggcucggccgcc

SEQ ID NO: 936985 - RNA, 19 nt, Mycobacterium avium subsp. paratuberculosis
gcgucgggcucggccgccg

SEQ ID NO: 936986 - RNA, 16 nt, Mycobacterium avium subsp. paratuberculosis
gcgucgggcuugcgca

SEQ ID NO: 936987 - RNA, 11 nt, Mycobacterium avium subsp. paratuberculosis
gcgucgggggu

SEQ ID NO: 936988 - RNA, 15 nt, Mycobacterium avium subsp. paratuberculosis
gcgucgggggugccg

SEQ ID NO: 936989 - RNA, 16 nt, Mycobacterium avium subsp. paratuberculosis
gcgucgggggugccgc

SEQ ID NO: 936990 - RNA, 18 nt, Mycobacterium avium subsp. paratuberculosis
gcgucggguagggcgccg

SEQ ID NO: 936991 - RNA, 23 nt, Mycobacterium avium subsp. paratuberculosis
gcgucggguagggcgccgucggc

SEQ ID NO: 936992 - RNA, 15 nt, Mycobacterium avium subsp. paratuberculosis
gcgucgguagguguc

SEQ ID NO: 936993 - RNA, 17 nt, Mycobacterium avium subsp. paratuberculosis
gcgucgguaggugucga

SEQ ID NO: 936994 - RNA, 16 nt, Mycobacterium avium subsp. paratuberculosis
gcgucgggcagcagcu

SEQ ID NO: 936995 - RNA, 15 nt, Mycobacterium avium subsp. paratuberculosis
gcgucgggcgccggc

SEQ ID NO: 936996 - RNA, 16 nt, Mycobacterium avium subsp. paratuberculosis
gcgucgggcgccggcg

SEQ ID NO: 936997 - RNA, 19 nt, Mycobacterium avium subsp. paratuberculosis
gcgucgggcgccggcgcgu

SEQ ID NO: 936998 - RNA, 20 nt, Mycobacterium avium subsp. paratuberculosis
gcgucgggcgccggcgcguc

SEQ ID NO: 936999 - RNA, 16 nt, Mycobacterium avium subsp. paratuberculosis
gcgucgggcgggugga

SEQ ID NO: 937000 - RNA, 22 nt, Mycobacterium avium subsp. paratuberculosis
gcgucgggcucgccucggggau

SEQ ID NO: 937001 - RNA, 21 nt, Mycobacterium avium subsp. paratuberculosis
gcgucgggaccgucgcgcagc

SEQ ID NO: 937002 - RNA, 20 nt, Mycobacterium avium subsp. paratuberculosis
gcgucgggcaccugauaggg

SEQ ID NO: 937003 - RNA, 18 nt, Mycobacterium avium subsp. paratuberculosis
gcgucggcguagggcagc

SEQ ID NO: 937004 - RNA, 12 nt, Mycobacterium avium subsp. paratuberculosis
gcgucggcgucg

SEQ ID NO: 937005 - RNA, 13 nt, Mycobacterium avium subsp. paratuberculosis
gcgucggcgucga

SEQ ID NO: 937006 - RNA, 16 nt, Mycobacterium avium subsp. paratuberculosis
gcgucggcgucgaacg

SEQ ID NO: 937007 - RNA, 13 nt, Mycobacterium avium subsp. paratuberculosis
gcgucggcggcgg

SEQ ID NO: 937008 - RNA, 15 nt, Mycobacterium avium subsp. paratuberculosis
gcgucggcggcggcg

SEQ ID NO: 937009 - RNA, 15 nt, Mycobacterium avium subsp. paratuberculosis
gcgucggcgcgugcc

SEQ ID NO: 937010 - RNA, 17 nt, Mycobacterium avium subsp. paratuberculosis
gcgucggcgcuggccag

SEQ ID NO: 937011 - RNA, 14 nt, Mycobacterium avium subsp. paratuberculosis
gcgucggcgcgcac

SEQ ID NO: 937012 - RNA, 16 nt, Mycobacterium avium subsp. paratuberculosis
gcgucggcgcgcaccg

SEQ ID NO: 937013 - RNA, 18 nt, Mycobacterium avium subsp. paratuberculosis
gcgucggcgcgcaccgcg

SEQ ID NO: 937014 - RNA, 13 nt, Mycobacterium avium subsp. paratuberculosis
gcgucggcgggcg

SEQ ID NO: 937015 - RNA, 15 nt, Mycobacterium avium subsp. paratuberculosis
gcgucggcgggcgug

SEQ ID NO: 937016 - RNA, 19 nt, Mycobacterium avium subsp. paratuberculosis
gcgucggcggucgccagcg

SEQ ID NO: 937017 - RNA, 20 nt, Mycobacterium avium subsp. paratuberculosis
gcgucggcggucgccagcgc

SEQ ID NO: 937018 - RNA, 23 nt, Mycobacterium avium subsp. paratuberculosis
gcgucggcggucgccagcgccac

SEQ ID NO: 937019 - RNA, 17 nt, Mycobacterium avium subsp. paratuberculosis
gcgucggcggugguccg

SEQ ID NO: 937020 - RNA, 18 nt, Mycobacterium avium subsp. paratuberculosis
gcgucggcggugguccgc

SEQ ID NO: 937021 - RNA, 23 nt, Mycobacterium avium subsp. paratuberculosis
gcgucggcggugguccgcgcgac

SEQ ID NO: 937022 - RNA, 17 nt, Mycobacterium avium subsp. paratuberculosis
gcgucggcgucgggcgg

SEQ ID NO: 937023 - RNA, 16 nt, Mycobacterium avium subsp. paratuberculosis
gcgucggcgugcccgc

SEQ ID NO: 937024 - RNA, 17 nt, Mycobacterium avium subsp. paratuberculosis
gcgucggcgugcccgcc

SEQ ID NO: 937025 - RNA, 18 nt, Mycobacterium avium subsp. paratuberculosis
gcgucggcgugcccgccg

SEQ ID NO: 937026 - RNA, 23 nt, Mycobacterium avium subsp. paratuberculosis
gcgucggcgugcccgccgaccag

SEQ ID NO: 937027 - RNA, 20 nt, Mycobacterium avium subsp. paratuberculosis
gcggcggugguuaccagcuc

SEQ ID NO: 937028 - RNA, 17 nt, Mycobacterium avium subsp. paratuberculosis
gcggcgguugcucgucg

SEQ ID NO: 937029 - RNA, 18 nt, Mycobacterium avium subsp. paratuberculosis
gcggcgguugcucgucgg

SEQ ID NO: 937030 - RNA, 21 nt, Mycobacterium avium subsp. paratuberculosis
gcggcgguugcucgucggccg

SEQ ID NO: 937031 - RNA, 23 nt, Mycobacterium avium subsp. paratuberculosis
gcggcgguugcucgucggccgac

SEQ ID NO: 937032 - RNA, 14 nt, Mycobacterium avium subsp. paratuberculosis
gcggcgguggcgau

SEQ ID NO: 937033 - RNA, 18 nt, Mycobacterium avium subsp. paratuberculosis
gcggcggugggcugggcg

SEQ ID NO: 937034 - RNA, 14 nt, Mycobacterium avium subsp. paratuberculosis
gcggcggugucgcc

SEQ ID NO: 937035 - RNA, 13 nt, Mycobacterium avium subsp. paratuberculosis
gcggcggugucgg

SEQ ID NO: 937036 - RNA, 20 nt, Mycobacterium avium subsp. paratuberculosis
gcggcggugucggcgccccg

SEQ ID NO: 937037 - RNA, 21 nt, Mycobacterium avium subsp. paratuberculosis
gcggcggugucggcgccccgg

SEQ ID NO: 937038 - RNA, 22 nt, Mycobacterium avium subsp. paratuberculosis
gcggcggugucggcgccccggc

SEQ ID NO: 937039 - RNA, 15 nt, Mycobacterium avium subsp. paratuberculosis
gcggcggugucggug

SEQ ID NO: 937040 - RNA, 16 nt, Mycobacterium avium subsp. paratuberculosis
gcggcggugucggugc

SEQ ID NO: 937041 - RNA, 17 nt, Mycobacterium avium subsp. paratuberculosis
gcggcggugucggugcc

SEQ ID NO: 937042 - RNA, 20 nt, Mycobacterium avium subsp. paratuberculosis
gcggcggugucggugcccag

SEQ ID NO: 937043 - RNA, 11 nt, Mycobacterium avium subsp. paratuberculosis
gcggcgguguu

SEQ ID NO: 937044 - RNA, 22 nt, Mycobacterium avium subsp. paratuberculosis
gcggcguagccgccgguugauc

SEQ ID NO: 937045 - RNA, 22 nt, Mycobacterium avium subsp. paratuberculosis
gcggcguaggugggcagcgcgg

SEQ ID NO: 937046 - RNA, 23 nt, Mycobacterium avium subsp. paratuberculosis
gcggcguaggugggcagcgcggc

SEQ ID NO: 937047 - RNA, 15 nt, Mycobacterium avium subsp. paratuberculosis
gcggcguagucggcg

SEQ ID NO: 937048 - RNA, 18 nt, Mycobacterium avium subsp. paratuberculosis
gcggcguagucggcgcag

SEQ ID NO: 937049 - RNA, 15 nt, Mycobacterium avium subsp. paratuberculosis
gcggcguaggcggcc

SEQ ID NO: 937050 - RNA, 16 nt, Mycobacterium avium subsp. paratuberculosis
gcggcguaggcggcca

SEQ ID NO: 937051 - RNA, 17 nt, Mycobacterium avium subsp. paratuberculosis
gcggcguaggcggccau

SEQ ID NO: 937052 - RNA, 19 nt, Mycobacterium avium subsp. paratuberculosis
gcggcguaccgcggcggcg

SEQ ID NO: 937053 - RNA, 18 nt, Mycobacterium avium subsp. paratuberculosis
gcggcguacgcgauggcg

SEQ ID NO: 937054 - RNA, 19 nt, Mycobacterium avium subsp. paratuberculosis
gcggcgugcaacugcgugg

SEQ ID NO: 937055 - RNA, 21 nt, Mycobacterium avium subsp. paratuberculosis
gcggcgugcaacugcguggcc

SEQ ID NO: 937056 - RNA, 14 nt, Mycobacterium avium subsp. paratuberculosis
gcggcgugcaccgc

SEQ ID NO: 937057 - RNA, 17 nt, Mycobacterium avium subsp. paratuberculosis
gcggcgugcaccgcccg

SEQ ID NO: 937058 - RNA, 18 nt, Mycobacterium avium subsp. paratuberculosis
gcggcgugccagggcagc

SEQ ID NO: 937059 - RNA, 14 nt, Mycobacterium avium subsp. paratuberculosis
gcggcgugcccgcu

SEQ ID NO: 937060 - RNA, 12 nt, Mycobacterium avium subsp. paratuberculosis
gcggcgugcgcc

SEQ ID NO: 937061 - RNA, 15 nt, Mycobacterium avium subsp. paratuberculosis
gcggcgugcggucgc

SEQ ID NO: 937062 - RNA, 17 nt, Mycobacterium avium subsp. paratuberculosis
gcggcgugcggucgcgg

SEQ ID NO: 937063 - RNA, 20 nt, Mycobacterium avium subsp. paratuberculosis
gcggcgugcugcgcagcagc

SEQ ID NO: 937064 - RNA, 16 nt, Mycobacterium avium subsp. paratuberculosis
gcggcgucccacgugg

SEQ ID NO: 937065 - RNA, 17 nt, Mycobacterium avium subsp. paratuberculosis
gcggcgucccagugcuc

SEQ ID NO: 937066 - RNA, 14 nt, Mycobacterium avium subsp. paratuberculosis
gcggcgucgugacc

SEQ ID NO: 937067 - RNA, 18 nt, Mycobacterium avium subsp. paratuberculosis
gcggcgucaucccccgca

SEQ ID NO: 937068 - RNA, 23 nt, Mycobacterium avium subsp. paratuberculosis
gcggcgucaucccccgcagcuuc

SEQ ID NO: 937069 - RNA, 18 nt, Mycobacterium avium subsp. paratuberculosis
gcggcgucaggggugcca

SEQ ID NO: 937070 - RNA, 17 nt, Mycobacterium avium subsp. paratuberculosis
gcggcgucagguccgcg

SEQ ID NO: 937071 - RNA, 16 nt, Mycobacterium avium subsp. paratuberculosis
gcggcguacugcgcga

SEQ ID NO: 937072 - RNA, 15 nt, Mycobacterium avium subsp. paratuberculosis
gcggcgucaggaugg

SEQ ID NO: 937073 - RNA, 17 nt, Mycobacterium avium subsp. paratuberculosis
gcggcggggucguugca

SEQ ID NO: 937074 - RNA, 22 nt, Mycobacterium avium subsp. paratuberculosis
gcggcggggucguugcacacca

SEQ ID NO: 937075 - RNA, 20 nt, Mycobacterium avium subsp. paratuberculosis
gcggcggggugacggucacg

SEQ ID NO: 937076 - RNA, 19 nt, Mycobacterium avium subsp. paratuberculosis
gcggcgggguuccgucgaa

SEQ ID NO: 937077 - RNA, 20 nt, Mycobacterium avium subsp. paratuberculosis
gcggcgggguuccgucgaac

SEQ ID NO: 937078 - RNA, 21 nt, Mycobacterium avium subsp. paratuberculosis
gcggcgggguuccgucgaaca

SEQ ID NO: 937079 - RNA, 20 nt, Mycobacterium avium subsp. paratuberculosis
gcggcgggcgcgucgagguc

SEQ ID NO: 937080 - RNA, 21 nt, Mycobacterium avium subsp. paratuberculosis
gcggcgguaucgguggauccg

SEQ ID NO: 937081 - RNA, 23 nt, Mycobacterium avium subsp. paratuberculosis
gcggcgguaucgguggauccggu

SEQ ID NO: 937082 - RNA, 14 nt, Mycobacterium avium subsp. paratuberculosis
gcggcggugcgucg

SEQ ID NO: 937083 - RNA, 17 nt, Mycobacterium avium subsp. paratuberculosis
gcggcggugcucgcgcc

SEQ ID NO: 937084 - RNA, 21 nt, Mycobacterium avium subsp. paratuberculosis
gcggcggugcucgcgccgggc

SEQ ID NO: 937085 - RNA, 21 nt, Mycobacterium avium subsp. paratuberculosis
gcggcggugcucucgucgucg

SEQ ID NO: 937086 - RNA, 18 nt, Mycobacterium avium subsp. paratuberculosis
gcggcgguauucgucacc

SEQ ID NO: 937087 - RNA, 13 nt, Mycobacterium avium subsp. paratuberculosis
gcggcgguggccu

SEQ ID NO: 937088 - RNA, 16 nt, Mycobacterium avium subsp. paratuberculosis
gcggcgguggccugcc

SEQ ID NO: 937089 - RNA, 15 nt, Mycobacterium avium subsp. paratuberculosis
gcggcgggcgugcga

SEQ ID NO: 937090 - RNA, 14 nt, Mycobacterium avium subsp. paratuberculosis
gcggcgggcucgga

SEQ ID NO: 937091 - RNA, 16 nt, Mycobacterium avium subsp. paratuberculosis
gcggcgggcucggacg

SEQ ID NO: 937092 - RNA, 19 nt, Mycobacterium avium subsp. paratuberculosis
gcggcgggcucggacgacu

SEQ ID NO: 937093 - RNA, 12 nt, Mycobacterium avium subsp. paratuberculosis
gcggcggggccu

SEQ ID NO: 937094 - RNA, 15 nt, Mycobacterium avium subsp. paratuberculosis
gcggcggggccucga

SEQ ID NO: 937095 - RNA, 20 nt, Mycobacterium avium subsp. paratuberculosis
gcggcggggcugcccagguc

SEQ ID NO: 937096 - RNA, 23 nt, Mycobacterium avium subsp. paratuberculosis
gcggcgggggcgagaccgucggu

SEQ ID NO: 937097 - RNA, 13 nt, Mycobacterium avium subsp. paratuberculosis
gcggcggcgggcc

SEQ ID NO: 937098 - RNA, 15 nt, Mycobacterium avium subsp. paratuberculosis
gcggcgggcgagccg

SEQ ID NO: 937099 - RNA, 19 nt, Mycobacterium avium subsp. paratuberculosis
gcggcgggcgagccgaagc

SEQ ID NO: 937100 - RNA, 13 nt, Mycobacterium avium subsp. paratuberculosis
gcggcggcggccg

SEQ ID NO: 937101 - RNA, 16 nt, Mycobacterium avium subsp. paratuberculosis
gcggcggcggccgcgu

SEQ ID NO: 937102 - RNA, 14 nt, Mycobacterium avium subsp. paratuberculosis
gcggcggcgggaag

SEQ ID NO: 937103 - RNA, 13 nt, Mycobacterium avium subsp. paratuberculosis
gcggcggcgcugg

SEQ ID NO: 937104 - RNA, 12 nt, Mycobacterium avium subsp. paratuberculosis
gcggcggcggcc

SEQ ID NO: 937105 - RNA, 19 nt, Mycobacterium avium subsp. paratuberculosis
gcggcggccuggccgucgc

SEQ ID NO: 937106 - RNA, 18 nt, Mycobacterium avium subsp. paratuberculosis
gcggcggcagucgcagca

SEQ ID NO: 937107 - RNA, 15 nt, Mycobacterium avium subsp. paratuberculosis
gcggcggccaacgcg

SEQ ID NO: 937108 - RNA, 12 nt, Mycobacterium avium subsp. paratuberculosis
gcggcggccaau

SEQ ID NO: 937109 - RNA, 19 nt, Mycobacterium avium subsp. paratuberculosis
gcggcggccaaucgcugug

SEQ ID NO: 937110 - RNA, 13 nt, Mycobacterium avium subsp. paratuberculosis
gcggcggccaccg

SEQ ID NO: 937111 - RNA, 13 nt, Mycobacterium avium subsp. paratuberculosis
gcggcggccaccu

SEQ ID NO: 937112 - RNA, 14 nt, Mycobacterium avium subsp. paratuberculosis
gcggcggccaccuc

SEQ ID NO: 937113 - RNA, 15 nt, Mycobacterium avium subsp. paratuberculosis
gcggcggccaccucg

SEQ ID NO: 937114 - RNA, 12 nt, Mycobacterium avium subsp. paratuberculosis
gcggcggcaccc

SEQ ID NO: 937115 - RNA, 14 nt, Mycobacterium avium subsp. paratuberculosis
gcggcggcacccag

SEQ ID NO: 937116 - RNA, 21 nt, Mycobacterium avium subsp. paratuberculosis
gcggcggcacccaggucaccg

SEQ ID NO: 937117 - RNA, 16 nt, Mycobacterium avium subsp. paratuberculosis
gcggcggcaaccagcu

SEQ ID NO: 937118 - RNA, 20 nt, Mycobacterium avium subsp. paratuberculosis
gcggcggaucagcaccgacg

SEQ ID NO: 937119 - RNA, 21 nt, Mycobacterium avium subsp. paratuberculosis
gcggcggauccagcaccgcca

SEQ ID NO: 937120 - RNA, 18 nt, Mycobacterium avium subsp. paratuberculosis
gcggcggaugggugcggu

SEQ ID NO: 937121 - RNA, 20 nt, Mycobacterium avium subsp. paratuberculosis
gcggcggaugggugcgguug

SEQ ID NO: 937122 - RNA, 21 nt, Mycobacterium avium subsp. paratuberculosis
gcggcggaugggugcgguuga

SEQ ID NO: 937123 - RNA, 13 nt, Mycobacterium avium subsp. paratuberculosis
gcggcggaugucc

SEQ ID NO: 937124 - RNA, 15 nt, Mycobacterium avium subsp. paratuberculosis
gcggcggcgcgccgg

SEQ ID NO: 937125 - RNA, 20 nt, Mycobacterium avium subsp. paratuberculosis
gcggcggcgcgccggccgga

SEQ ID NO: 937126 - RNA, 17 nt, Mycobacterium avium subsp. paratuberculosis
gcggcggcgcgggcgcc

SEQ ID NO: 937127 - RNA, 13 nt, Mycobacterium avium subsp. paratuberculosis
gcggcggcgcgug

SEQ ID NO: 937128 - RNA, 21 nt, Mycobacterium avium subsp. paratuberculosis
gcggcggccuucuuggccgga

SEQ ID NO: 937129 - RNA, 15 nt, Mycobacterium avium subsp. paratuberculosis
gcggcggcgacgucg

SEQ ID NO: 937130 - RNA, 13 nt, Mycobacterium avium subsp. paratuberculosis
gcggcggcgacga

SEQ ID NO: 937131 - RNA, 13 nt, Mycobacterium avium subsp. paratuberculosis
gcggcggcgccga

SEQ ID NO: 937132 - RNA, 14 nt, Mycobacterium avium subsp. paratuberculosis
gcggcggcgccgca

SEQ ID NO: 937133 - RNA, 15 nt, Mycobacterium avium subsp. paratuberculosis
gcggcggcgccgcag

SEQ ID NO: 937134 - RNA, 16 nt, Mycobacterium avium subsp. paratuberculosis
gcggcggcgccgcagc

SEQ ID NO: 937135 - RNA, 12 nt, Mycobacterium avium subsp. paratuberculosis
gcggcggcgccg

SEQ ID NO: 937136 - RNA, 15 nt, Mycobacterium avium subsp. paratuberculosis
gcggcggcgccgggg

SEQ ID NO: 937137 - RNA, 13 nt, Mycobacterium avium subsp. paratuberculosis
gcggcggcgccgu

SEQ ID NO: 937138 - RNA, 16 nt, Mycobacterium avium subsp. paratuberculosis
aagcggugcaccaccg

SEQ ID NO: 937139 - RNA, 23 nt, Mycobacterium avium subsp. paratuberculosis
aagcggucgcggaaccggccggg

SEQ ID NO: 937140 - RNA, 18 nt, Mycobacterium avium subsp. paratuberculosis
gcggcgcggagccggccg

SEQ ID NO: 937141 - RNA, 15 nt, Mycobacterium avium subsp. paratuberculosis
gcggcgcgacaccgc

SEQ ID NO: 937142 - RNA, 16 nt, Mycobacterium avium subsp. paratuberculosis
gcggcgcgacaccgcg

SEQ ID NO: 937143 - RNA, 17 nt, Mycobacterium avium subsp. paratuberculosis
gcggcgcgacaccgcgg

SEQ ID NO: 937144 - RNA, 18 nt, Mycobacterium avium subsp. paratuberculosis
gcggcgcgacaccgcggc

SEQ ID NO: 937145 - RNA, 22 nt, Mycobacterium avium subsp. paratuberculosis
gcggcgcgacaccgcggcgacg

SEQ ID NO: 937146 - RNA, 15 nt, Mycobacterium avium subsp. paratuberculosis
gcggcgccuugccgg

SEQ ID NO: 937147 - RNA, 13 nt, Mycobacterium avium subsp. paratuberculosis
gcggcgcugcagc

SEQ ID NO: 937148 - RNA, 17 nt, Mycobacterium avium subsp. paratuberculosis
gcggcgcugcagcagcc

SEQ ID NO: 937149 - RNA, 15 nt, Mycobacterium avium subsp. paratuberculosis
gcggcgcugccccag

SEQ ID NO: 937150 - RNA, 17 nt, Mycobacterium avium subsp. paratuberculosis
gcggcgcugccccagcc

SEQ ID NO: 937151 - RNA, 13 nt, Mycobacterium avium subsp. paratuberculosis
gcggcgcugccgc

SEQ ID NO: 937152 - RNA, 16 nt, Mycobacterium avium subsp. paratuberculosis
gcggcgcugccgccgg

SEQ ID NO: 937153 - RNA, 17 nt, Mycobacterium avium subsp. paratuberculosis
gcggcgcugccgccggc

SEQ ID NO: 937154 - RNA, 18 nt, Mycobacterium avium subsp. paratuberculosis
gcggcgcugccgccggcc

SEQ ID NO: 937155 - RNA, 20 nt, Mycobacterium avium subsp. paratuberculosis
gcggcgcugccgccggccuc

SEQ ID NO: 937156 - RNA, 15 nt, Mycobacterium avium subsp. paratuberculosis
gcggcgcugccggcg

SEQ ID NO: 937157 - RNA, 16 nt, Mycobacterium avium subsp. paratuberculosis
gcggcgcugccggcgc

SEQ ID NO: 937158 - RNA, 18 nt, Mycobacterium avium subsp. paratuberculosis
gcggcgcugccggcgcac

SEQ ID NO: 937159 - RNA, 13 nt, Mycobacterium avium subsp. paratuberculosis
gcggcgcugcgcc

SEQ ID NO: 937160 - RNA, 13 nt, Mycobacterium avium subsp. paratuberculosis
gcggcggaggccu

SEQ ID NO: 937161 - RNA, 16 nt, Mycobacterium avium subsp. paratuberculosis
gcggcggaggccugcg

SEQ ID NO: 937162 - RNA, 20 nt, Mycobacterium avium subsp. paratuberculosis
gcggcggaggccugcgcggc

SEQ ID NO: 937163 - RNA, 22 nt, Mycobacterium avium subsp. paratuberculosis
gcggcggaggccugcgcggccg

SEQ ID NO: 937164 - RNA, 19 nt, Mycobacterium avium subsp. paratuberculosis
gcggcggaccgucgguguc

SEQ ID NO: 937165 - RNA, 16 nt, Mycobacterium avium subsp. paratuberculosis
gcggcgcucagcgcgg

SEQ ID NO: 937166 - RNA, 13 nt, Mycobacterium avium subsp. paratuberculosis
gcggcgcucggug

SEQ ID NO: 937167 - RNA, 16 nt, Mycobacterium avium subsp. paratuberculosis
gcggcgcgugcgccgc

SEQ ID NO: 937168 - RNA, 17 nt, Mycobacterium avium subsp. paratuberculosis
gcggcgcgugcgccgcg

SEQ ID NO: 937169 - RNA, 20 nt, Mycobacterium avium subsp. paratuberculosis
gcggcgcgugcgccgcggcg

SEQ ID NO: 937170 - RNA, 15 nt, Mycobacterium avium subsp. paratuberculosis
gcggcgcgucgcugg

SEQ ID NO: 937171 - RNA, 14 nt, Mycobacterium avium subsp. paratuberculosis
gcggcgcuaaagcc

SEQ ID NO: 937172 - RNA, 18 nt, Mycobacterium avium subsp. paratuberculosis
gcggcgcuaaagccacca

SEQ ID NO: 937173 - RNA, 20 nt, Mycobacterium avium subsp. paratuberculosis
gcggcgcuaaagccaccagc

SEQ ID NO: 937174 - RNA, 16 nt, Mycobacterium avium subsp. paratuberculosis
gcggcgccugcacgca

SEQ ID NO: 937175 - RNA, 16 nt, Mycobacterium avium subsp. paratuberculosis
gcggcgccgucgaaca

SEQ ID NO: 937176 - RNA, 14 nt, Mycobacterium avium subsp. paratuberculosis
gcggcgccgucgac

SEQ ID NO: 937177 - RNA, 15 nt, Mycobacterium avium subsp. paratuberculosis
gcggcgccgucgacc

SEQ ID NO: 937178 - RNA, 16 nt, Mycobacterium avium subsp. paratuberculosis
gcggcgccgucgacca

SEQ ID NO: 937179 - RNA, 21 nt, Mycobacterium avium subsp. paratuberculosis
gcggcgccguugaccggccgg

SEQ ID NO: 937180 - RNA, 22 nt, Mycobacterium avium subsp. paratuberculosis
gcggcgccguugaccggccggu

SEQ ID NO: 937181 - RNA, 13 nt, Mycobacterium avium subsp. paratuberculosis
gcggcgccgucga

SEQ ID NO: 937182 - RNA, 15 nt, Mycobacterium avium subsp. paratuberculosis
gcggcgcccucgccg

SEQ ID NO: 937183 - RNA, 16 nt, Mycobacterium avium subsp. paratuberculosis
gcggcgcccucgccgg

SEQ ID NO: 937184 - RNA, 17 nt, Mycobacterium avium subsp. paratuberculosis
gcggcgcccucgccggc

SEQ ID NO: 937185 - RNA, 17 nt, Mycobacterium avium subsp. paratuberculosis
gcggcgccgggcggccc

SEQ ID NO: 937186 - RNA, 18 nt, Mycobacterium avium subsp. paratuberculosis
gcggcgccgggcggcccg

SEQ ID NO: 937187 - RNA, 21 nt, Mycobacterium avium subsp. paratuberculosis
gcggcgcccgcggccuccagc

SEQ ID NO: 937188 - RNA, 15 nt, Mycobacterium avium subsp. paratuberculosis
gcggcgcccggcgcc

SEQ ID NO: 937189 - RNA, 16 nt, Mycobacterium avium subsp. paratuberculosis
gcggcgcccccgcgac

SEQ ID NO: 937190 - RNA, 17 nt, Mycobacterium avium subsp. paratuberculosis
gcggcgcccccgcgacg

SEQ ID NO: 937191 - RNA, 21 nt, Mycobacterium avium subsp. paratuberculosis
gcggcgcccccgcgacgucca

SEQ ID NO: 937192 - RNA, 18 nt, Mycobacterium avium subsp. paratuberculosis
gcggcgcccacggccacc

SEQ ID NO: 937193 - RNA, 19 nt, Mycobacterium avium subsp. paratuberculosis
gcggcgcccacggccacca

SEQ ID NO: 937194 - RNA, 18 nt, Mycobacterium avium subsp. paratuberculosis
gcggcgacggcgucggcg

SEQ ID NO: 937195 - RNA, 19 nt, Mycobacterium avium subsp. paratuberculosis
gcggcgacggcgucggcgg

SEQ ID NO: 937196 - RNA, 16 nt, Mycobacterium avium subsp. paratuberculosis
gcggcgacggcgucgg

SEQ ID NO: 937197 - RNA, 17 nt, Mycobacterium avium subsp. paratuberculosis
gcggcgacggccguccg

SEQ ID NO: 937198 - RNA, 18 nt, Mycobacterium avium subsp. paratuberculosis
gcggcgacggccguccgg

SEQ ID NO: 937199 - RNA, 12 nt, Mycobacterium avium subsp. paratuberculosis
gcggcgacggcg

SEQ ID NO: 937200 - RNA, 15 nt, Mycobacterium avium subsp. paratuberculosis
gcggcgacggcgacc

SEQ ID NO: 937201 - RNA, 14 nt, Mycobacterium avium subsp. paratuberculosis
gcggcgacgguguc

SEQ ID NO: 937202 - RNA, 16 nt, Mycobacterium avium subsp. paratuberculosis
gcggcgacgguguccg

SEQ ID NO: 937203 - RNA, 16 nt, Mycobacterium avium subsp. paratuberculosis
gcggcgacgucgacgg

SEQ ID NO: 937204 - RNA, 17 nt, Mycobacterium avium subsp. paratuberculosis
gcggcgacgucgacggc

SEQ ID NO: 937205 - RNA, 18 nt, Mycobacterium avium subsp. paratuberculosis
gcggcgacgugaucggcg

SEQ ID NO: 937206 - RNA, 12 nt, Mycobacterium avium subsp. paratuberculosis
gcggcgccaccg

SEQ ID NO: 937207 - RNA, 15 nt, Mycobacterium avium subsp. paratuberculosis
gcggcgccaccggcu

SEQ ID NO: 937208 - RNA, 16 nt, Mycobacterium avium subsp. paratuberculosis
gcggcgccaccggcug

SEQ ID NO: 937209 - RNA, 17 nt, Mycobacterium avium subsp. paratuberculosis
gcggcgccaccggcugg

SEQ ID NO: 937210 - RNA, 22 nt, Mycobacterium avium subsp. paratuberculosis
gcggcgccaccggcuggccgga

SEQ ID NO: 937211 - RNA, 15 nt, Mycobacterium avium subsp. paratuberculosis
gcggcgccaccggga

SEQ ID NO: 937212 - RNA, 22 nt, Mycobacterium avium subsp. paratuberculosis
gcggcgccaccgggaccugcug

SEQ ID NO: 937213 - RNA, 15 nt, Mycobacterium avium subsp. paratuberculosis
gcggcgacggcaccg

SEQ ID NO: 937214 - RNA, 19 nt, Mycobacterium avium subsp. paratuberculosis
gcggcgacggcaccgccgg

SEQ ID NO: 937215 - RNA, 13 nt, Mycobacterium avium subsp. paratuberculosis
gcggcgacggccg

SEQ ID NO: 937216 - RNA, 16 nt, Mycobacterium avium subsp. paratuberculosis
gcggcgacgaacgccg

SEQ ID NO: 937217 - RNA, 21 nt, Mycobacterium avium subsp. paratuberculosis
gcggcgacgaacgccggcauc

SEQ ID NO: 937218 - RNA, 13 nt, Mycobacterium avium subsp. paratuberculosis
gcggcgacgauca

SEQ ID NO: 937219 - RNA, 16 nt, Mycobacterium avium subsp. paratuberculosis
gcggcgaacaacgcca

SEQ ID NO: 937220 - RNA, 17 nt, Mycobacterium avium subsp. paratuberculosis
gcggcgaacaacgccac

SEQ ID NO: 937221 - RNA, 14 nt, Mycobacterium avium subsp. paratuberculosis
gcggcgaacaccag

SEQ ID NO: 937222 - RNA, 15 nt, Mycobacterium avium subsp. paratuberculosis
gcggcgaacaccagc

SEQ ID NO: 937223 - RNA, 17 nt, Mycobacterium avium subsp. paratuberculosis
gcggcgaacaccagcac

SEQ ID NO: 937224 - RNA, 21 nt, Mycobacterium avium subsp. paratuberculosis
gcggcgaacaccagcacccag

SEQ ID NO: 937225 - RNA, 14 nt, Mycobacterium avium subsp. paratuberculosis
gcggcgaacaccuc

SEQ ID NO: 937226 - RNA, 23 nt, Mycobacterium avium subsp. paratuberculosis
gcggcgaaaucgcuccucgauca

SEQ ID NO: 937227 - RNA, 16 nt, Mycobacterium avium subsp. paratuberculosis
gcgggaucugcgccgc

SEQ ID NO: 937228 - RNA, 19 nt, Mycobacterium avium subsp. paratuberculosis
gcgggaugaaggcacccag

SEQ ID NO: 937229 - RNA, 23 nt, Mycobacterium avium subsp. paratuberculosis
gcgggaugccgagcagcucggcg

SEQ ID NO: 937230 - RNA, 17 nt, Mycobacterium avium subsp. paratuberculosis
gcgggaagcccaccgcg

SEQ ID NO: 937231 - RNA, 18 nt, Mycobacterium avium subsp. paratuberculosis
gcgggaagcccaccgcgg

SEQ ID NO: 937232 - RNA, 12 nt, Mycobacterium avium subsp. paratuberculosis
gcgggaagccga

SEQ ID NO: 937233 - RNA, 20 nt, Mycobacterium avium subsp. paratuberculosis
gcgggaagccgaggucgccg

SEQ ID NO: 937234 - RNA, 15 nt, Mycobacterium avium subsp. paratuberculosis
gcgggaagccgccgc

SEQ ID NO: 937235 - RNA, 16 nt, Mycobacterium avium subsp. paratuberculosis
gcgggaagggcccggg

SEQ ID NO: 937236 - RNA, 20 nt, Mycobacterium avium subsp. paratuberculosis
gcgggaaguagugcaucggc

SEQ ID NO: 937237 - RNA, 23 nt, Mycobacterium avium subsp. paratuberculosis
gcgggaaguagugcaucggcagu

SEQ ID NO: 937238 - RNA, 19 nt, Mycobacterium avium subsp. paratuberculosis
gcgggauucgcgcaccuuc

SEQ ID NO: 937239 - RNA, 16 nt, Mycobacterium avium subsp. paratuberculosis
gcgggauguagccggu

SEQ ID NO: 937240 - RNA, 17 nt, Mycobacterium avium subsp. paratuberculosis
gcgggauguagccgguc

SEQ ID NO: 937241 - RNA, 15 nt, Mycobacterium avium subsp. paratuberculosis
gcgggauuggcgcca

SEQ ID NO: 937242 - RNA, 22 nt, Mycobacterium avium subsp. paratuberculosis
gcgggauuggcgccacugccgc

SEQ ID NO: 937243 - RNA, 16 nt, Mycobacterium avium subsp. paratuberculosis
gcgggcaccccaucgg

SEQ ID NO: 937244 - RNA, 22 nt, Mycobacterium avium subsp. paratuberculosis
gcgggaacaccacgucguccag

SEQ ID NO: 937245 - RNA, 23 nt, Mycobacterium avium subsp. paratuberculosis
gcgggaacaccacgucguccagc

SEQ ID NO: 937246 - RNA, 17 nt, Mycobacterium avium subsp. paratuberculosis
gcgggaacagcgggaac

SEQ ID NO: 937247 - RNA, 15 nt, Mycobacterium avium subsp. paratuberculosis
gcgggaacgcgucga

SEQ ID NO: 937248 - RNA, 20 nt, Mycobacterium avium subsp. paratuberculosis
gcgggaacgucauggccagc

SEQ ID NO: 937249 - RNA, 22 nt, Mycobacterium avium subsp. paratuberculosis
gcgggaacgucauggccagcuc

SEQ ID NO: 937250 - RNA, 17 nt, Mycobacterium avium subsp. paratuberculosis
gcggcuuuuggcgucgu

SEQ ID NO: 937251 - RNA, 19 nt, Mycobacterium avium subsp. paratuberculosis
gcggcuucauaugacgccg

SEQ ID NO: 937252 - RNA, 20 nt, Mycobacterium avium subsp. paratuberculosis
gcggcuucauaugacgccgg

SEQ ID NO: 937253 - RNA, 22 nt, Mycobacterium avium subsp. paratuberculosis
gcggcuucauaugacgccggcc

SEQ ID NO: 937254 - RNA, 23 nt, Mycobacterium avium subsp. paratuberculosis
gcgggccugggcaauggccgcga

SEQ ID NO: 937255 - RNA, 14 nt, Mycobacterium avium subsp. paratuberculosis
gcgggccugcucgu

SEQ ID NO: 937256 - RNA, 17 nt, Mycobacterium avium subsp. paratuberculosis
gcgggccugcucgucgg

SEQ ID NO: 937257 - RNA, 18 nt, Mycobacterium avium subsp. paratuberculosis
gcgggccugcucgucggg

SEQ ID NO: 937258 - RNA, 21 nt, Mycobacterium avium subsp. paratuberculosis
gcgggccugcucgucggggca

SEQ ID NO: 937259 - RNA, 13 nt, Mycobacterium avium subsp. paratuberculosis
gcgggccucgccg

SEQ ID NO: 937260 - RNA, 16 nt, Mycobacterium avium subsp. paratuberculosis
gcgggccucgccgcuu

SEQ ID NO: 937261 - RNA, 17 nt, Mycobacterium avium subsp. paratuberculosis
gcgggccucgccgcuuc

SEQ ID NO: 937262 - RNA, 19 nt, Mycobacterium avium subsp. paratuberculosis
gcgggccuaggaccccggc

SEQ ID NO: 937263 - RNA, 19 nt, Mycobacterium avium subsp. paratuberculosis
gcgggccguugccgguccc

SEQ ID NO: 937264 - RNA, 19 nt, Mycobacterium avium subsp. paratuberculosis
gcgggccuucuucucgacg

SEQ ID NO: 937265 - RNA, 18 nt, Mycobacterium avium subsp. paratuberculosis
gcgggccuugagcaccgc

SEQ ID NO: 937266 - RNA, 19 nt, Mycobacterium avium subsp. paratuberculosis
gcgggccuugagcaccgcg

SEQ ID NO: 937267 - RNA, 22 nt, Mycobacterium avium subsp. paratuberculosis
gcgggccuugagcaccgcgucg

SEQ ID NO: 937268 - RNA, 19 nt, Mycobacterium avium subsp. paratuberculosis
gcgggcgaaaucgcgggcc

SEQ ID NO: 937269 - RNA, 17 nt, Mycobacterium avium subsp. paratuberculosis
gcgggcgaacgaccggg

SEQ ID NO: 937270 - RNA, 16 nt, Mycobacterium avium subsp. paratuberculosis
gcgggccgugccgcca

SEQ ID NO: 937271 - RNA, 23 nt, Mycobacterium avium subsp. paratuberculosis
gcgggccgugccgccauacccac

SEQ ID NO: 937272 - RNA, 18 nt, Mycobacterium avium subsp. paratuberculosis
gcgggccguggcaccggg

SEQ ID NO: 937273 - RNA, 14 nt, Mycobacterium avium subsp. paratuberculosis
gcgggccggcgccg

SEQ ID NO: 937274 - RNA, 17 nt, Mycobacterium avium subsp. paratuberculosis
gcgggccggcgccggug

SEQ ID NO: 937275 - RNA, 18 nt, Mycobacterium avium subsp. paratuberculosis
gcgggccgcuucgaggug

SEQ ID NO: 937276 - RNA, 16 nt, Mycobacterium avium subsp. paratuberculosis
gcgggccggcacccgg

SEQ ID NO: 937277 - RNA, 14 nt, Mycobacterium avium subsp. paratuberculosis
gcgggccgcccggc

SEQ ID NO: 937278 - RNA, 18 nt, Mycobacterium avium subsp. paratuberculosis
gcgggccgcccggcgcgc

SEQ ID NO: 937279 - RNA, 12 nt, Mycobacterium avium subsp. paratuberculosis
gcgggccgccgg

SEQ ID NO: 937280 - RNA, 14 nt, Mycobacterium avium subsp. paratuberculosis
gcgggccgccgggu

SEQ ID NO: 937281 - RNA, 17 nt, Mycobacterium avium subsp. paratuberculosis
gcgggccgccggguggc

SEQ ID NO: 937282 - RNA, 16 nt, Mycobacterium avium subsp. paratuberculosis
gcgggccgcagcgcgc

SEQ ID NO: 937283 - RNA, 18 nt, Mycobacterium avium subsp. paratuberculosis
gcgggccgcagcgcgcgg

SEQ ID NO: 937284 - RNA, 13 nt, Mycobacterium avium subsp. paratuberculosis
gcgggccgccagg

SEQ ID NO: 937285 - RNA, 18 nt, Mycobacterium avium subsp. paratuberculosis
gcgggccgaucagugccg

SEQ ID NO: 937286 - RNA, 21 nt, Mycobacterium avium subsp. paratuberculosis
gcgggccgaucagugccgcgc

SEQ ID NO: 937287 - RNA, 20 nt, Mycobacterium avium subsp. paratuberculosis
gcgggccgacagcacgccgg

SEQ ID NO: 937288 - RNA, 17 nt, Mycobacterium avium subsp. paratuberculosis
gcgggccgacccggccg

SEQ ID NO: 937289 - RNA, 18 nt, Mycobacterium avium subsp. paratuberculosis
gcgggccgacccggccga

SEQ ID NO: 937290 - RNA, 17 nt, Mycobacterium avium subsp. paratuberculosis
gcgggccgaccgucagc

SEQ ID NO: 937291 - RNA, 23 nt, Mycobacterium avium subsp. paratuberculosis
gcgggccgagcguucggcgcgga

SEQ ID NO: 937292 - RNA, 18 nt, Mycobacterium avium subsp. paratuberculosis
gcgggcccgggccacccg

SEQ ID NO: 937293 - RNA, 19 nt, Mycobacterium avium subsp. paratuberculosis
gcgggcccgggccacccgc

SEQ ID NO: 937294 - RNA, 20 nt, Mycobacterium avium subsp. paratuberculosis
gcgggcccgggccacccgcg

SEQ ID NO: 937295 - RNA, 15 nt, Mycobacterium avium subsp. paratuberculosis
gcgggcccgggcgcu

SEQ ID NO: 937296 - RNA, 17 nt, Mycobacterium avium subsp. paratuberculosis
gcgggcccgucgccggc

SEQ ID NO: 937297 - RNA, 21 nt, Mycobacterium avium subsp. paratuberculosis
gcgggcccgucgccggcgcgc

SEQ ID NO: 937298 - RNA, 21 nt, Mycobacterium avium subsp. paratuberculosis
gcgggccagacugcgcaccgc

SEQ ID NO: 937299 - RNA, 22 nt, Mycobacterium avium subsp. paratuberculosis
gcgggccagauggucgagggcg

SEQ ID NO: 937300 - RNA, 12 nt, Mycobacterium avium subsp. paratuberculosis
gcgggccagcac

SEQ ID NO: 937301 - RNA, 14 nt, Mycobacterium avium subsp. paratuberculosis
gcgggccagcacga

SEQ ID NO: 937302 - RNA, 19 nt, Mycobacterium avium subsp. paratuberculosis
gcgggccagcacgaccccg

SEQ ID NO: 937303 - RNA, 20 nt, Mycobacterium avium subsp. paratuberculosis
gcgggccagcgcaucgguca

SEQ ID NO: 937304 - RNA, 23 nt, Mycobacterium avium subsp. paratuberculosis
gcgggccagcgccuucggcgcca

SEQ ID NO: 937305 - RNA, 19 nt, Mycobacterium avium subsp. paratuberculosis
gcgggccagcagccgcgcg

SEQ ID NO: 937306 - RNA, 18 nt, Mycobacterium avium subsp. paratuberculosis
gcgggccagcagccgggu

SEQ ID NO: 937307 - RNA, 20 nt, Mycobacterium avium subsp. paratuberculosis
gcgggccagcagccggguca

SEQ ID NO: 937308 - RNA, 13 nt, Mycobacterium avium subsp. paratuberculosis
gcgggccaccggc

SEQ ID NO: 937309 - RNA, 14 nt, Mycobacterium avium subsp. paratuberculosis
gcgggccaccggcg

SEQ ID NO: 937310 - RNA, 15 nt, Mycobacterium avium subsp. paratuberculosis
gcgggccaccggcgc

SEQ ID NO: 937311 - RNA, 19 nt, Mycobacterium avium subsp. paratuberculosis
gcgggccaccggcgccagg

SEQ ID NO: 937312 - RNA, 17 nt, Mycobacterium avium subsp. paratuberculosis
gcgggccaccgucccgg

SEQ ID NO: 937313 - RNA, 22 nt, Mycobacterium avium subsp. paratuberculosis
gcgggcaaucgcugcgcccgcc

SEQ ID NO: 937314 - RNA, 22 nt, Mycobacterium avium subsp. paratuberculosis
gcgggccaccacaguggccgcc

SEQ ID NO: 937315 - RNA, 18 nt, Mycobacterium avium subsp. paratuberculosis
gcggcugcgcguucggcg

SEQ ID NO: 937316 - RNA, 22 nt, Mycobacterium avium subsp. paratuberculosis
gcggcugcgcguucggcgccac

SEQ ID NO: 937317 - RNA, 15 nt, Mycobacterium avium subsp. paratuberculosis
gcggcugccucgacg

SEQ ID NO: 937318 - RNA, 20 nt, Mycobacterium avium subsp. paratuberculosis
gcggcugcgcacguagccca

SEQ ID NO: 937319 - RNA, 17 nt, Mycobacterium avium subsp. paratuberculosis
gcggcugcugcagcgcc

SEQ ID NO: 937320 - RNA, 18 nt, Mycobacterium avium subsp. paratuberculosis
gcggcugcugcagcgccc

SEQ ID NO: 937321 - RNA, 18 nt, Mycobacterium avium subsp. paratuberculosis
gcggcugcucgaaccgcg

SEQ ID NO: 937322 - RNA, 19 nt, Mycobacterium avium subsp. paratuberculosis
gcggcugcuggucgacguc

SEQ ID NO: 937323 - RNA, 15 nt, Mycobacterium avium subsp. paratuberculosis
gcggcugccggccaa

SEQ ID NO: 937324 - RNA, 14 nt, Mycobacterium avium subsp. paratuberculosis
gcggcugccggugc

SEQ ID NO: 937325 - RNA, 14 nt, Mycobacterium avium subsp. paratuberculosis
gcggcugcccagga

SEQ ID NO: 937326 - RNA, 22 nt, Mycobacterium avium subsp. paratuberculosis
gcggcugcccaggaucaccggg

SEQ ID NO: 937327 - RNA, 23 nt, Mycobacterium avium subsp. paratuberculosis
gcggcugcccaggaucaccggga

SEQ ID NO: 937328 - RNA, 16 nt, Mycobacterium avium subsp. paratuberculosis
gcggcugcaucaugcc

SEQ ID NO: 937329 - RNA, 13 nt, Mycobacterium avium subsp. paratuberculosis
gcggcugacccgc

SEQ ID NO: 937330 - RNA, 13 nt, Mycobacterium avium subsp. paratuberculosis
gcggcugaccgag

SEQ ID NO: 937331 - RNA, 15 nt, Mycobacterium avium subsp. paratuberculosis
gcggcugaccgagcg

SEQ ID NO: 937332 - RNA, 17 nt, Mycobacterium avium subsp. paratuberculosis
gcggcugaccgagcggc

SEQ ID NO: 937333 - RNA, 12 nt, Mycobacterium avium subsp. paratuberculosis
gcggcugucgua

SEQ ID NO: 937334 - RNA, 19 nt, Mycobacterium avium subsp. paratuberculosis
gcggcugugaucgcugacg

SEQ ID NO: 937335 - RNA, 17 nt, Mycobacterium avium subsp. paratuberculosis
gcggcuguagcacccgg

SEQ ID NO: 937336 - RNA, 20 nt, Mycobacterium avium subsp. paratuberculosis
gcggcuguagcacccggccg

SEQ ID NO: 937337 - RNA, 23 nt, Mycobacterium avium subsp. paratuberculosis
gcggcuguagcacccggccggcg

SEQ ID NO: 937338 - RNA, 21 nt, Mycobacterium avium subsp. paratuberculosis
gcggcugguagaugccgaagc

SEQ ID NO: 937339 - RNA, 19 nt, Mycobacterium avium subsp. paratuberculosis
gcggcuggugccgccggcg

SEQ ID NO: 937340 - RNA, 20 nt, Mycobacterium avium subsp. paratuberculosis
gcggcuggugccgccggcga

SEQ ID NO: 937341 - RNA, 17 nt, Mycobacterium avium subsp. paratuberculosis
gcggcugggucgguccc

SEQ ID NO: 937342 - RNA, 22 nt, Mycobacterium avium subsp. paratuberculosis
gcggcugggucggucccgacag

SEQ ID NO: 937343 - RNA, 14 nt, Mycobacterium avium subsp. paratuberculosis
gcggcugggccgcg

SEQ ID NO: 937344 - RNA, 17 nt, Mycobacterium avium subsp. paratuberculosis
gcggcugggccgcggcg

SEQ ID NO: 937345 - RNA, 14 nt, Mycobacterium avium subsp. paratuberculosis
gcggcuggccgcgg

SEQ ID NO: 937346 - RNA, 23 nt, Mycobacterium avium subsp. paratuberculosis
gcggcuggccgcggcgaucggcg

SEQ ID NO: 937347 - RNA, 16 nt, Mycobacterium avium subsp. paratuberculosis
gcggcuggcccggcgc

SEQ ID NO: 937348 - RNA, 14 nt, Mycobacterium avium subsp. paratuberculosis
gcggcuggcgggug

SEQ ID NO: 937349 - RNA, 21 nt, Mycobacterium avium subsp. paratuberculosis
gcggcgugggguucccggccg

SEQ ID NO: 937350 - RNA, 22 nt, Mycobacterium avium subsp. paratuberculosis
gcggcgugggguucccggccgg

SEQ ID NO: 937351 - RNA, 24 nt, Mycobacterium avium subsp. paratuberculosis
gcggcgugggguucccggccggug

SEQ ID NO: 937352 - RNA, 15 nt, Mycobacterium avium subsp. paratuberculosis
gcggcgugguagccg

SEQ ID NO: 937353 - RNA, 15 nt, Mycobacterium avium subsp. paratuberculosis
gcggcguucggugcc

SEQ ID NO: 937354 - RNA, 16 nt, Mycobacterium avium subsp. paratuberculosis
gcggcguucggugccc

SEQ ID NO: 937355 - RNA, 22 nt, Mycobacterium avium subsp. paratuberculosis
gcggcguucggugcccgggguc

SEQ ID NO: 937356 - RNA, 15 nt, Mycobacterium avium subsp. paratuberculosis
gcggcguucuccagc

SEQ ID NO: 937357 - RNA, 16 nt, Mycobacterium avium subsp. paratuberculosis
gcggcguucuccagca

SEQ ID NO: 937358 - RNA, 17 nt, Mycobacterium avium subsp. paratuberculosis
gcggcguucuccagcac

SEQ ID NO: 937359 - RNA, 22 nt, Mycobacterium avium subsp. paratuberculosis
gcggcguucuccagcacccgca

SEQ ID NO: 937360 - RNA, 16 nt, Mycobacterium avium subsp. paratuberculosis
gcggcguucagccgga

SEQ ID NO: 937361 - RNA, 18 nt, Mycobacterium avium subsp. paratuberculosis
gcggcguucagccggagc

SEQ ID NO: 937362 - RNA, 15 nt, Mycobacterium avium subsp. paratuberculosis
gcggcucccaccgug

SEQ ID NO: 937363 - RNA, 16 nt, Mycobacterium avium subsp. paratuberculosis
gcggcuccacgaaguc

SEQ ID NO: 937364 - RNA, 17 nt, Mycobacterium avium subsp. paratuberculosis
gcggcuccagcagcggc

SEQ ID NO: 937365 - RNA, 22 nt, Mycobacterium avium subsp. paratuberculosis
gcggcuccgaucuccugguguc

SEQ ID NO: 937366 - RNA, 12 nt, Mycobacterium avium subsp. paratuberculosis
gcggcguugcgg

SEQ ID NO: 937367 - RNA, 14 nt, Mycobacterium avium subsp. paratuberculosis
gcggcguuggccgc

SEQ ID NO: 937368 - RNA, 17 nt, Mycobacterium avium subsp. paratuberculosis
gcggcguugcgggugga

SEQ ID NO: 937369 - RNA, 20 nt, Mycobacterium avium subsp. paratuberculosis
gcggcguugaggcguugcgg

SEQ ID NO: 937370 - RNA, 14 nt, Mycobacterium avium subsp. paratuberculosis
gcggcguugcccgc

SEQ ID NO: 937371 - RNA, 15 nt, Mycobacterium avium subsp. paratuberculosis
gcggcguugcccgcu

SEQ ID NO: 937372 - RNA, 22 nt, Mycobacterium avium subsp. paratuberculosis
gcggcguugcccgcugcggcaa

SEQ ID NO: 937373 - RNA, 15 nt, Mycobacterium avium subsp. paratuberculosis
gcggcguugccgccg

SEQ ID NO: 937374 - RNA, 16 nt, Mycobacterium avium subsp. paratuberculosis
gcggcguugccgccgg

SEQ ID NO: 937375 - RNA, 19 nt, Mycobacterium avium subsp. paratuberculosis
gcggcguugccgccggcgc

SEQ ID NO: 937376 - RNA, 16 nt, Mycobacterium avium subsp. paratuberculosis
gcggcugaagcgcugg

SEQ ID NO: 937377 - RNA, 21 nt, Mycobacterium avium subsp. paratuberculosis
gcggcugaaccaccgcgccca

SEQ ID NO: 937378 - RNA, 15 nt, Mycobacterium avium subsp. paratuberculosis
gcggcucgggcggug

SEQ ID NO: 937379 - RNA, 14 nt, Mycobacterium avium subsp. paratuberculosis
gcggcucgggggug

SEQ ID NO: 937380 - RNA, 15 nt, Mycobacterium avium subsp. paratuberculosis
gcggcucggucgcga

SEQ ID NO: 937381 - RNA, 20 nt, Mycobacterium avium subsp. paratuberculosis
gcggcucggucgcgaagacg

SEQ ID NO: 937382 - RNA, 23 nt, Mycobacterium avium subsp. paratuberculosis
gcggcucguccagcccggucacc

SEQ ID NO: 937383 - RNA, 12 nt, Mycobacterium avium subsp. paratuberculosis
gcggcucgucgg

SEQ ID NO: 937384 - RNA, 15 nt, Mycobacterium avium subsp. paratuberculosis
gcggcucgucggcga

SEQ ID NO: 937385 - RNA, 20 nt, Mycobacterium avium subsp. paratuberculosis
gcggcucgccggcgucuuga

SEQ ID NO: 937386 - RNA, 18 nt, Mycobacterium avium subsp. paratuberculosis
gcggcucguugagcacac

SEQ ID NO: 937387 - RNA, 13 nt, Mycobacterium avium subsp. paratuberculosis
gcggcucgcgacg

SEQ ID NO: 937388 - RNA, 16 nt, Mycobacterium avium subsp. paratuberculosis
gcggcucgcgacgcgg

SEQ ID NO: 937389 - RNA, 11 nt, Mycobacterium avium subsp. paratuberculosis
gcggcucgcgg

SEQ ID NO: 937390 - RNA, 18 nt, Mycobacterium avium subsp. paratuberculosis
gcggcucgcgggcgaugc

SEQ ID NO: 937391 - RNA, 18 nt, Mycobacterium avium subsp. paratuberculosis
gcggcucgcgggugcggc

SEQ ID NO: 937392 - RNA, 21 nt, Mycobacterium avium subsp. paratuberculosis
gcggcucgcgggugcggcgcu

SEQ ID NO: 937393 - RNA, 14 nt, Mycobacterium avium subsp. paratuberculosis
gcggcucggcggcg

SEQ ID NO: 937394 - RNA, 13 nt, Mycobacterium avium subsp. paratuberculosis
gcggcuccggccg

SEQ ID NO: 937395 - RNA, 15 nt, Mycobacterium avium subsp. paratuberculosis
gcggcuccggccgcg

SEQ ID NO: 937396 - RNA, 20 nt, Mycobacterium avium subsp. paratuberculosis
gcggcuccggccgcgccggc

SEQ ID NO: 937397 - RNA, 22 nt, Mycobacterium avium subsp. paratuberculosis
gcggcuccggccgcgccggccu

SEQ ID NO: 937398 - RNA, 14 nt, Mycobacterium avium subsp. paratuberculosis
aagcgcuuucgccg

SEQ ID NO: 937399 - RNA, 16 nt, Mycobacterium avium subsp. paratuberculosis
gcggccccggcucggg

SEQ ID NO: 937400 - RNA, 20 nt, Mycobacterium avium subsp. paratuberculosis
gcggccccggcucgggccaa

SEQ ID NO: 937401 - RNA, 18 nt, Mycobacterium avium subsp. paratuberculosis
gcggccccgguagccagc

SEQ ID NO: 937402 - RNA, 20 nt, Mycobacterium avium subsp. paratuberculosis
gcggccccgguagccagcac

SEQ ID NO: 937403 - RNA, 22 nt, Mycobacterium avium subsp. paratuberculosis
gcggccccgguggaugggcucg

SEQ ID NO: 937404 - RNA, 14 nt, Mycobacterium avium subsp. paratuberculosis
aagcgggugaccga

SEQ ID NO: 937405 - RNA, 15 nt, Mycobacterium avium subsp. paratuberculosis
gcggccccugcgggg

SEQ ID NO: 937406 - RNA, 18 nt, Mycobacterium avium subsp. paratuberculosis
gcggcccgaacacccaga

SEQ ID NO: 937407 - RNA, 15 nt, Mycobacterium avium subsp. paratuberculosis
gcggcccgaccagcg

SEQ ID NO: 937408 - RNA, 16 nt, Mycobacterium avium subsp. paratuberculosis
gcggcccgaccagcgg

SEQ ID NO: 937409 - RNA, 21 nt, Mycobacterium avium subsp. paratuberculosis
gcggcccgaccagcgggccga

SEQ ID NO: 937410 - RNA, 13 nt, Mycobacterium avium subsp. paratuberculosis
gcggcccgacccg

SEQ ID NO: 937411 - RNA, 14 nt, Mycobacterium avium subsp. paratuberculosis
gcggcccgaucacc

SEQ ID NO: 937412 - RNA, 20 nt, Mycobacterium avium subsp. paratuberculosis
gcggcccgaucaccaggccc

SEQ ID NO: 937413 - RNA, 22 nt, Mycobacterium avium subsp. paratuberculosis
gcggcccgaucaccaggcccag

SEQ ID NO: 937414 - RNA, 15 nt, Mycobacterium avium subsp. paratuberculosis
gcggcccgaucaccg

SEQ ID NO: 937415 - RNA, 18 nt, Mycobacterium avium subsp. paratuberculosis
gcggcccgaucaccgccg

SEQ ID NO: 937416 - RNA, 13 nt, Mycobacterium avium subsp. paratuberculosis
gcggcccgcaccg

SEQ ID NO: 937417 - RNA, 14 nt, Mycobacterium avium subsp. paratuberculosis
gcggcccgcaccga

SEQ ID NO: 937418 - RNA, 13 nt, Mycobacterium avium subsp. paratuberculosis
gcggcccggcucg

SEQ ID NO: 937419 - RNA, 15 nt, Mycobacterium avium subsp. paratuberculosis
gcggcccggcucgga

SEQ ID NO: 937420 - RNA, 14 nt, Mycobacterium avium subsp. paratuberculosis
gcggcccguccgcc

SEQ ID NO: 937421 - RNA, 18 nt, Mycobacterium avium subsp. paratuberculosis
gcggcccguccgccccgc

SEQ ID NO: 937422 - RNA, 18 nt, Mycobacterium avium subsp. paratuberculosis
gcggcccgucgccaccac

SEQ ID NO: 937423 - RNA, 19 nt, Mycobacterium avium subsp. paratuberculosis
gcggcccgucgccaccacg

SEQ ID NO: 937424 - RNA, 19 nt, Mycobacterium avium subsp. paratuberculosis
gcggcccgucgccgaucag

SEQ ID NO: 937425 - RNA, 20 nt, Mycobacterium avium subsp. paratuberculosis
gcggcccguugagcaccgcg

SEQ ID NO: 937426 - RNA, 15 nt, Mycobacterium avium subsp. paratuberculosis
gcggcccggccacca

SEQ ID NO: 937427 - RNA, 16 nt, Mycobacterium avium subsp. paratuberculosis
gcggcccggccaccag

SEQ ID NO: 937428 - RNA, 14 nt, Mycobacterium avium subsp. paratuberculosis
gcggcccggccacu

SEQ ID NO: 937429 - RNA, 17 nt, Mycobacterium avium subsp. paratuberculosis
gcggcccggccacucgc

SEQ ID NO: 937430 - RNA, 19 nt, Mycobacterium avium subsp. paratuberculosis
gcggcccggccacucgccg

SEQ ID NO: 937431 - RNA, 12 nt, Mycobacterium avium subsp. paratuberculosis
gcggcccggccc

SEQ ID NO: 937432 - RNA, 19 nt, Mycobacterium avium subsp. paratuberculosis
gcggcccggcccgcuggcc

SEQ ID NO: 937433 - RNA, 14 nt, Mycobacterium avium subsp. paratuberculosis
gcggcccgcucgau

SEQ ID NO: 937434 - RNA, 17 nt, Mycobacterium avium subsp. paratuberculosis
gcggcccgcucgauguc

SEQ ID NO: 937435 - RNA, 17 nt, Mycobacterium avium subsp. paratuberculosis
gcggcccggcacuggcg

SEQ ID NO: 937436 - RNA, 19 nt, Mycobacterium avium subsp. paratuberculosis
gcggcccgcggcaucgucg

SEQ ID NO: 937437 - RNA, 13 nt, Mycobacterium avium subsp. paratuberculosis
gcggcccgcggcg

SEQ ID NO: 937438 - RNA, 16 nt, Mycobacterium avium subsp. paratuberculosis
gcggcccgcggcguca

SEQ ID NO: 937439 - RNA, 14 nt, Mycobacterium avium subsp. paratuberculosis
gcggcccgcggggc

SEQ ID NO: 937440 - RNA, 19 nt, Mycobacterium avium subsp. paratuberculosis
gcggcccgccucggcggcc

SEQ ID NO: 937441 - RNA, 23 nt, Mycobacterium avium subsp. paratuberculosis
gcggcccgccucggcggccgccu

SEQ ID NO: 937442 - RNA, 15 nt, Mycobacterium avium subsp. paratuberculosis
gcggcccgcgccggc

SEQ ID NO: 937443 - RNA, 13 nt, Mycobacterium avium subsp. paratuberculosis
gcggcccgcgcgg

SEQ ID NO: 937444 - RNA, 14 nt, Mycobacterium avium subsp. paratuberculosis
gcggcccgcgcggg

SEQ ID NO: 937445 - RNA, 15 nt, Mycobacterium avium subsp. paratuberculosis
gcggcccgcaggauc

SEQ ID NO: 937446 - RNA, 15 nt, Mycobacterium avium subsp. paratuberculosis
gcggcccgcaucgac

SEQ ID NO: 937447 - RNA, 15 nt, Mycobacterium avium subsp. paratuberculosis
gcggcccgccgaacg

SEQ ID NO: 937448 - RNA, 22 nt, Mycobacterium avium subsp. paratuberculosis
gcggcccgccgaacgccuccgc

SEQ ID NO: 937449 - RNA, 23 nt, Mycobacterium avium subsp. paratuberculosis
gcggcccgccgaacgccuccgcc

SEQ ID NO: 937450 - RNA, 16 nt, Mycobacterium avium subsp. paratuberculosis
gcggcccgccgcgccc

SEQ ID NO: 937451 - RNA, 19 nt, Mycobacterium avium subsp. paratuberculosis
gcggcccgccgcgcccggc

SEQ ID NO: 937452 - RNA, 23 nt, Mycobacterium avium subsp. paratuberculosis
gcggcccgccgcucaccgccgag

SEQ ID NO: 937453 - RNA, 13 nt, Mycobacterium avium subsp. paratuberculosis
gcggcccgccgga

SEQ ID NO: 937454 - RNA, 22 nt, Mycobacterium avium subsp. paratuberculosis
gcggcccgccggaacucggccg

SEQ ID NO: 937455 - RNA, 13 nt, Mycobacterium avium subsp. paratuberculosis
gcggcccgccggg

SEQ ID NO: 937456 - RNA, 14 nt, Mycobacterium avium subsp. paratuberculosis
gcggcccgccgggc

SEQ ID NO: 937457 - RNA, 15 nt, Mycobacterium avium subsp. paratuberculosis
gcggcccgccgggcg

SEQ ID NO: 937458 - RNA, 17 nt, Mycobacterium avium subsp. paratuberculosis
gcggcccgccgggcguc

SEQ ID NO: 937459 - RNA, 20 nt, Mycobacterium avium subsp. paratuberculosis
gcggcccgccgggcgucgcg

SEQ ID NO: 937460 - RNA, 21 nt, Mycobacterium avium subsp. paratuberculosis
gcggcccgccgggcgucgcgc

SEQ ID NO: 937461 - RNA, 16 nt, Mycobacterium avium subsp. paratuberculosis
gcggcccgccucggcg

SEQ ID NO: 937462 - RNA, 17 nt, Mycobacterium avium subsp. paratuberculosis
gcggcccgccucggcgg

SEQ ID NO: 937463 - RNA, 17 nt, Mycobacterium avium subsp. paratuberculosis
aagcgcuugucgcagac

SEQ ID NO: 937464 - RNA, 15 nt, Mycobacterium avium subsp. paratuberculosis
gcggccaucgccgcc

SEQ ID NO: 937465 - RNA, 15 nt, Mycobacterium avium subsp. paratuberculosis
gcggccccgccagca

SEQ ID NO: 937466 - RNA, 20 nt, Mycobacterium avium subsp. paratuberculosis
gcggcccccacgcagcggug

SEQ ID NO: 937467 - RNA, 14 nt, Mycobacterium avium subsp. paratuberculosis
gcggccccccgcac

SEQ ID NO: 937468 - RNA, 20 nt, Mycobacterium avium subsp. paratuberculosis
gcggccccccgcacaccggc

SEQ ID NO: 937469 - RNA, 21 nt, Mycobacterium avium subsp. paratuberculosis
gcggccccccgcacaccggcc

SEQ ID NO: 937470 - RNA, 21 nt, Mycobacterium avium subsp. paratuberculosis
gcggcccccugaucggccgca

SEQ ID NO: 937471 - RNA, 12 nt, Mycobacterium avium subsp. paratuberculosis
gcggcccagcgu

SEQ ID NO: 937472 - RNA, 13 nt, Mycobacterium avium subsp. paratuberculosis
gcggcccagcgua

SEQ ID NO: 937473 - RNA, 13 nt, Mycobacterium avium subsp. paratuberculosis
gcggcccagcguc

SEQ ID NO: 937474 - RNA, 12 nt, Mycobacterium avium subsp. paratuberculosis
gcggcccagcuc

SEQ ID NO: 937475 - RNA, 16 nt, Mycobacterium avium subsp. paratuberculosis
gcggcccagcucggug

SEQ ID NO: 937476 - RNA, 21 nt, Mycobacterium avium subsp. paratuberculosis
gcggcccagguucuccggccc

SEQ ID NO: 937477 - RNA, 23 nt, Mycobacterium avium subsp. paratuberculosis
gcggcccagguucuccggcccgc

SEQ ID NO: 937478 - RNA, 21 nt, Mycobacterium avium subsp. paratuberculosis
gcggcccaguucgcaccccac

SEQ ID NO: 937479 - RNA, 13 nt, Mycobacterium avium subsp. paratuberculosis
gcggcccagaucg

SEQ ID NO: 937480 - RNA, 14 nt, Mycobacterium avium subsp. paratuberculosis
gcggcccagcccgg

SEQ ID NO: 937481 - RNA, 18 nt, Mycobacterium avium subsp. paratuberculosis
gcggcccagcccggccag

SEQ ID NO: 937482 - RNA, 19 nt, Mycobacterium avium subsp. paratuberculosis
gcggcccagcccggccagc

SEQ ID NO: 937483 - RNA, 23 nt, Mycobacterium avium subsp. paratuberculosis
gcggcccagcccggccagcaccc

SEQ ID NO: 937484 - RNA, 23 nt, Mycobacterium avium subsp. paratuberculosis
gcggcccaauucguaggcgagga

SEQ ID NO: 937485 - RNA, 14 nt, Mycobacterium avium subsp. paratuberculosis
gcggcccacccgca

SEQ ID NO: 937486 - RNA, 16 nt, Mycobacterium avium subsp. paratuberculosis
gcggcccaccgcgacc

SEQ ID NO: 937487 - RNA, 17 nt, Mycobacterium avium subsp. paratuberculosis
gcggcccaccgcgaccc

SEQ ID NO: 937488 - RNA, 18 nt, Mycobacterium avium subsp. paratuberculosis
gcggcccaccgcgacccg

SEQ ID NO: 937489 - RNA, 19 nt, Mycobacterium avium subsp. paratuberculosis
gcggcccaccgcgucgcag

SEQ ID NO: 937490 - RNA, 17 nt, Mycobacterium avium subsp. paratuberculosis
gcggccauguccccgcc

SEQ ID NO: 937491 - RNA, 21 nt, Mycobacterium avium subsp. paratuberculosis
gcggccauguccccgccggug

SEQ ID NO: 937492 - RNA, 24 nt, Mycobacterium avium subsp. paratuberculosis
gcggccauguccccgccgguggcg

SEQ ID NO: 937493 - RNA, 17 nt, Mycobacterium avium subsp. paratuberculosis
gcggccauucaucgcgc

SEQ ID NO: 937494 - RNA, 22 nt, Mycobacterium avium subsp. paratuberculosis
gcggccauucaucgcgcaccag

SEQ ID NO: 937495 - RNA, 23 nt, Mycobacterium avium subsp. paratuberculosis
gcggccauucaucgcgcaccagg

SEQ ID NO: 937496 - RNA, 16 nt, Mycobacterium avium subsp. paratuberculosis
gcggcccaacacgccc

SEQ ID NO: 937497 - RNA, 21 nt, Mycobacterium avium subsp. paratuberculosis
gcggcccaacacgcccugcag

SEQ ID NO: 937498 - RNA, 20 nt, Mycobacterium avium subsp. paratuberculosis
gcggcccaaccggaucggcu

SEQ ID NO: 937499 - RNA, 16 nt, Mycobacterium avium subsp. paratuberculosis
gcggccauggucgcgg

SEQ ID NO: 937500 - RNA, 20 nt, Mycobacterium avium subsp. paratuberculosis
gcggccauggucgcggccgu

SEQ ID NO: 937501 - RNA, 19 nt, Mycobacterium avium subsp. paratuberculosis
gcggccaucgccgccaucg

SEQ ID NO: 937502 - RNA, 18 nt, Mycobacterium avium subsp. paratuberculosis
gcggccaucgccgcggug

SEQ ID NO: 937503 - RNA, 15 nt, Mycobacterium avium subsp. paratuberculosis
gcggccaucgccuga

SEQ ID NO: 937504 - RNA, 16 nt, Mycobacterium avium subsp. paratuberculosis
gcggccaucucgugcc

SEQ ID NO: 937505 - RNA, 21 nt, Mycobacterium avium subsp. paratuberculosis
gcggccaucucgugcccgggc

SEQ ID NO: 937506 - RNA, 23 nt, Mycobacterium avium subsp. paratuberculosis
gcggccaucucgugcccgggccc

SEQ ID NO: 937507 - RNA, 13 nt, Mycobacterium avium subsp. paratuberculosis
gcggccaucgccg

SEQ ID NO: 937508 - RNA, 17 nt, Mycobacterium avium subsp. paratuberculosis
gcggccaguugacguug

SEQ ID NO: 937509 - RNA, 17 nt, Mycobacterium avium subsp. paratuberculosis
gcggccaguucgagcgc

SEQ ID NO: 937510 - RNA, 19 nt, Mycobacterium avium subsp. paratuberculosis
gcggccaguucgagcgccg

SEQ ID NO: 937511 - RNA, 17 nt, Mycobacterium avium subsp. paratuberculosis
gcggcgaaaacgccugc

SEQ ID NO: 937512 - RNA, 22 nt, Mycobacterium avium subsp. paratuberculosis
gcggcgaaaacgccugcgccgc

SEQ ID NO: 937513 - RNA, 18 nt, Mycobacterium avium subsp. paratuberculosis
gcggccuuuuccggcgac

SEQ ID NO: 937514 - RNA, 22 nt, Mycobacterium avium subsp. paratuberculosis
gcggccuuuuccggcgacaccg

SEQ ID NO: 937515 - RNA, 23 nt, Mycobacterium avium subsp. paratuberculosis
gcggccuuuuccggcgacaccgc

SEQ ID NO: 937516 - RNA, 18 nt, Mycobacterium avium subsp. paratuberculosis
gcggccuuuuucugcgcc

SEQ ID NO: 937517 - RNA, 20 nt, Mycobacterium avium subsp. paratuberculosis
gcggccuuuuucugcgcccg

SEQ ID NO: 937518 - RNA, 21 nt, Mycobacterium avium subsp. paratuberculosis
gcggccuucuucugccacucg

SEQ ID NO: 937519 - RNA, 21 nt, Mycobacterium avium subsp. paratuberculosis
gcggccuugcgcaccggagcc

SEQ ID NO: 937520 - RNA, 14 nt, Mycobacterium avium subsp. paratuberculosis
gcggccuugcgggc

SEQ ID NO: 937521 - RNA, 21 nt, Mycobacterium avium subsp. paratuberculosis
gcggccuugcgggccggagcc

SEQ ID NO: 937522 - RNA, 14 nt, Mycobacterium avium subsp. paratuberculosis
gcggccuugcgagc

SEQ ID NO: 937523 - RNA, 16 nt, Mycobacterium avium subsp. paratuberculosis
gcggccuugcgagccg

SEQ ID NO: 937524 - RNA, 17 nt, Mycobacterium avium subsp. paratuberculosis
gcggccuugcgagccgg

SEQ ID NO: 937525 - RNA, 18 nt, Mycobacterium avium subsp. paratuberculosis
gcggccuugcgagccgga

SEQ ID NO: 937526 - RNA, 20 nt, Mycobacterium avium subsp. paratuberculosis
gcggccuugcgagccggagc

SEQ ID NO: 937527 - RNA, 21 nt, Mycobacterium avium subsp. paratuberculosis
gcggccuugcgagccggagcc

SEQ ID NO: 937528 - RNA, 16 nt, Mycobacterium avium subsp. paratuberculosis
gcggccuucuuggccg

SEQ ID NO: 937529 - RNA, 18 nt, Mycobacterium avium subsp. paratuberculosis
gcggccuucuuggccgga

SEQ ID NO: 937530 - RNA, 19 nt, Mycobacterium avium subsp. paratuberculosis
gcggccuucuuggccggag

SEQ ID NO: 937531 - RNA, 21 nt, Mycobacterium avium subsp. paratuberculosis
gcggccuucuuggccggagcc

SEQ ID NO: 937532 - RNA, 16 nt, Mycobacterium avium subsp. paratuberculosis
gcggccuugaacgcgu

SEQ ID NO: 937533 - RNA, 21 nt, Mycobacterium avium subsp. paratuberculosis
gcggccuugaacgcguccgac

SEQ ID NO: 937534 - RNA, 16 nt, Mycobacterium avium subsp. paratuberculosis
gcggccugggugaccg

SEQ ID NO: 937535 - RNA, 15 nt, Mycobacterium avium subsp. paratuberculosis
gcggccuggccgucg

SEQ ID NO: 937536 - RNA, 16 nt, Mycobacterium avium subsp. paratuberculosis
gcggccugcuugaccg

SEQ ID NO: 937537 - RNA, 19 nt, Mycobacterium avium subsp. paratuberculosis
gcggccugcuugaccgcca

SEQ ID NO: 937538 - RNA, 20 nt, Mycobacterium avium subsp. paratuberculosis
gcggccugcuugaccgccag

SEQ ID NO: 937539 - RNA, 12 nt, Mycobacterium avium subsp. paratuberculosis
gcggccucgaag

SEQ ID NO: 937540 - RNA, 15 nt, Mycobacterium avium subsp. paratuberculosis
gcggccugcucgaag

SEQ ID NO: 937541 - RNA, 20 nt, Mycobacterium avium subsp. paratuberculosis
gcggccugcgcgucgucgcc

SEQ ID NO: 937542 - RNA, 13 nt, Mycobacterium avium subsp. paratuberculosis
gcggccugcggcg

SEQ ID NO: 937543 - RNA, 15 nt, Mycobacterium avium subsp. paratuberculosis
gcggccugcggcggc

SEQ ID NO: 937544 - RNA, 17 nt, Mycobacterium avium subsp. paratuberculosis
gcggccugcggcggcaa

SEQ ID NO: 937545 - RNA, 16 nt, Mycobacterium avium subsp. paratuberculosis
gcggccugcgggcgcc

SEQ ID NO: 937546 - RNA, 19 nt, Mycobacterium avium subsp. paratuberculosis
gcggccugcgggcgccggc

SEQ ID NO: 937547 - RNA, 23 nt, Mycobacterium avium subsp. paratuberculosis
gcggccugcgggcgccggcugcc

SEQ ID NO: 937548 - RNA, 13 nt, Mycobacterium avium subsp. paratuberculosis
gcggccugcucga

SEQ ID NO: 937549 - RNA, 17 nt, Mycobacterium avium subsp. paratuberculosis
gcggccuccggauggcg

SEQ ID NO: 937550 - RNA, 16 nt, Mycobacterium avium subsp. paratuberculosis
gcggccuaugcgcccg

SEQ ID NO: 937551 - RNA, 18 nt, Mycobacterium avium subsp. paratuberculosis
gcggccuaugcgcccggg

SEQ ID NO: 937552 - RNA, 13 nt, Mycobacterium avium subsp. paratuberculosis
gcggccuccagcc

SEQ ID NO: 937553 - RNA, 17 nt, Mycobacterium avium subsp. paratuberculosis
gcggccuccagccgcgc

SEQ ID NO: 937554 - RNA, 20 nt, Mycobacterium avium subsp. paratuberculosis
gcggccuccagccgcgcggc

SEQ ID NO: 937555 - RNA, 16 nt, Mycobacterium avium subsp. paratuberculosis
gcggccuccagccgcu

SEQ ID NO: 937556 - RNA, 22 nt, Mycobacterium avium subsp. paratuberculosis
gcggccuccagccgcuccgcgg

SEQ ID NO: 937557 - RNA, 23 nt, Mycobacterium avium subsp. paratuberculosis
gcggccuccagccgcuccgcggc

SEQ ID NO: 937558 - RNA, 14 nt, Mycobacterium avium subsp. paratuberculosis
gcggccucaccgcg

SEQ ID NO: 937559 - RNA, 15 nt, Mycobacterium avium subsp. paratuberculosis
gcggccucaccgcgg

SEQ ID NO: 937560 - RNA, 18 nt, Mycobacterium avium subsp. paratuberculosis
gcggccucaccgcgggcc

SEQ ID NO: 937561 - RNA, 20 nt, Mycobacterium avium subsp. paratuberculosis
gcggccucaccgcgggccag

SEQ ID NO: 937562 - RNA, 16 nt, Mycobacterium avium subsp. paratuberculosis
gcggccuaggacgccg

SEQ ID NO: 937563 - RNA, 18 nt, Mycobacterium avium subsp. paratuberculosis
gcggccuaggacgccgcc

SEQ ID NO: 937564 - RNA, 16 nt, Mycobacterium avium subsp. paratuberculosis
gcggccguggucgaug

SEQ ID NO: 937565 - RNA, 17 nt, Mycobacterium avium subsp. paratuberculosis
gcggccguggucgauga

SEQ ID NO: 937566 - RNA, 21 nt, Mycobacterium avium subsp. paratuberculosis
gcggccgucuugcccggcgag

SEQ ID NO: 937567 - RNA, 22 nt, Mycobacterium avium subsp. paratuberculosis
gcggccgucuugcccggcgagc

SEQ ID NO: 937568 - RNA, 12 nt, Mycobacterium avium subsp. paratuberculosis
gcggccgucggg

SEQ ID NO: 937569 - RNA, 22 nt, Mycobacterium avium subsp. paratuberculosis
gcggccgggccggaacgcccga

SEQ ID NO: 937570 - RNA, 15 nt, Mycobacterium avium subsp. paratuberculosis
gcggccgggcgcccc

SEQ ID NO: 937571 - RNA, 16 nt, Mycobacterium avium subsp. paratuberculosis
gcggccgggcgccccg

SEQ ID NO: 937572 - RNA, 17 nt, Mycobacterium avium subsp. paratuberculosis
gcggccgggcgccccga

SEQ ID NO: 937573 - RNA, 17 nt, Mycobacterium avium subsp. paratuberculosis
gcggccgggcggccgga

SEQ ID NO: 937574 - RNA, 19 nt, Mycobacterium avium subsp. paratuberculosis
gcggccgggcggccggagc

SEQ ID NO: 937575 - RNA, 21 nt, Mycobacterium avium subsp. paratuberculosis
gcggccgggaucuggccggug

SEQ ID NO: 937576 - RNA, 22 nt, Mycobacterium avium subsp. paratuberculosis
gcggccgggaucuggccgguga

SEQ ID NO: 937577 - RNA, 13 nt, Mycobacterium avium subsp. paratuberculosis
gcggccgggaugc

SEQ ID NO: 937578 - RNA, 13 nt, Mycobacterium avium subsp. paratuberculosis
gcggccgggccgc

SEQ ID NO: 937579 - RNA, 13 nt, Mycobacterium avium subsp. paratuberculosis
gcggccgcguccu

SEQ ID NO: 937580 - RNA, 16 nt, Mycobacterium avium subsp. paratuberculosis
gcggccggcgccggcg

SEQ ID NO: 937581 - RNA, 15 nt, Mycobacterium avium subsp. paratuberculosis
gcggccggcggcguc

SEQ ID NO: 937582 - RNA, 21 nt, Mycobacterium avium subsp. paratuberculosis
gcggccggcggcgucgugacc

SEQ ID NO: 937583 - RNA, 22 nt, Mycobacterium avium subsp. paratuberculosis
gcggccggcggcgucgugaccg

SEQ ID NO: 937584 - RNA, 17 nt, Mycobacterium avium subsp. paratuberculosis
gcggccggcgggcagca

SEQ ID NO: 937585 - RNA, 16 nt, Mycobacterium avium subsp. paratuberculosis
gcggccggcggugucg

SEQ ID NO: 937586 - RNA, 13 nt, Mycobacterium avium subsp. paratuberculosis
gcggccggcgccg

SEQ ID NO: 937587 - RNA, 16 nt, Mycobacterium avium subsp. paratuberculosis
gcggccggcgccgacc

SEQ ID NO: 937588 - RNA, 15 nt, Mycobacterium avium subsp. paratuberculosis
gcggccggccggccu

SEQ ID NO: 937589 - RNA, 16 nt, Mycobacterium avium subsp. paratuberculosis
gcggccggccggccug

SEQ ID NO: 937590 - RNA, 12 nt, Mycobacterium avium subsp. paratuberculosis
gcggccggcgca

SEQ ID NO: 937591 - RNA, 18 nt, Mycobacterium avium subsp. paratuberculosis
gcggccggccgcgcccau

SEQ ID NO: 937592 - RNA, 16 nt, Mycobacterium avium subsp. paratuberculosis
gcggccggccgcgcgc

SEQ ID NO: 937593 - RNA, 13 nt, Mycobacterium avium subsp. paratuberculosis
gcggccggccgcg

SEQ ID NO: 937594 - RNA, 14 nt, Mycobacterium avium subsp. paratuberculosis
gcggccggccgcgc

SEQ ID NO: 937595 - RNA, 15 nt, Mycobacterium avium subsp. paratuberculosis
gcggccggccgcgcc

SEQ ID NO: 937596 - RNA, 13 nt, Mycobacterium avium subsp. paratuberculosis
gcggccgcgucgg

SEQ ID NO: 937597 - RNA, 14 nt, Mycobacterium avium subsp. paratuberculosis
gcggccgcgucggc

SEQ ID NO: 937598 - RNA, 15 nt, Mycobacterium avium subsp. paratuberculosis
gcggccgcgucggcg

SEQ ID NO: 937599 - RNA, 16 nt, Mycobacterium avium subsp. paratuberculosis
gcggccgcgucggcgg

SEQ ID NO: 937600 - RNA, 16 nt, Mycobacterium avium subsp. paratuberculosis
gcggccgcggacccga

SEQ ID NO: 937601 - RNA, 13 nt, Mycobacterium avium subsp. paratuberculosis
gcggccgcgcgcc

SEQ ID NO: 937602 - RNA, 22 nt, Mycobacterium avium subsp. paratuberculosis
gcggccgcgcgcccgucgucgg

SEQ ID NO: 937603 - RNA, 13 nt, Mycobacterium avium subsp. paratuberculosis
gcggccgcggcgg

SEQ ID NO: 937604 - RNA, 14 nt, Mycobacterium avium subsp. paratuberculosis
gcggccgcggcggg

SEQ ID NO: 937605 - RNA, 15 nt, Mycobacterium avium subsp. paratuberculosis
gcggccgcggcgggc

SEQ ID NO: 937606 - RNA, 20 nt, Mycobacterium avium subsp. paratuberculosis
gcggccgcgaucgccaacgc

SEQ ID NO: 937607 - RNA, 12 nt, Mycobacterium avium subsp. paratuberculosis
gcggccgcgaug

SEQ ID NO: 937608 - RNA, 13 nt, Mycobacterium avium subsp. paratuberculosis
gcggccgcgcagc

SEQ ID NO: 937609 - RNA, 14 nt, Mycobacterium avium subsp. paratuberculosis
gcggccgcgcagcu

SEQ ID NO: 937610 - RNA, 16 nt, Mycobacterium avium subsp. paratuberculosis
gcggccgcgcagcucg

SEQ ID NO: 937611 - RNA, 19 nt, Mycobacterium avium subsp. paratuberculosis
gcggccgcgcagcucgacg

SEQ ID NO: 937612 - RNA, 15 nt, Mycobacterium avium subsp. paratuberculosis
gcggccgcgacgcgc

SEQ ID NO: 937613 - RNA, 16 nt, Mycobacterium avium subsp. paratuberculosis
gcggccgcgacggacc

SEQ ID NO: 937614 - RNA, 18 nt, Mycobacterium avium subsp. paratuberculosis
gcggccgcgacugcaccc

SEQ ID NO: 937615 - RNA, 20 nt, Mycobacterium avium subsp. paratuberculosis
gcggccgcgagcccggcgac

SEQ ID NO: 937616 - RNA, 12 nt, Mycobacterium avium subsp. paratuberculosis
gcggcccuggcg

SEQ ID NO: 937617 - RNA, 17 nt, Mycobacterium avium subsp. paratuberculosis
gcggccgacccugcguc

SEQ ID NO: 937618 - RNA, 20 nt, Mycobacterium avium subsp. paratuberculosis
gcggccgacccugcguccgg

SEQ ID NO: 937619 - RNA, 21 nt, Mycobacterium avium subsp. paratuberculosis
gcggccgacccugcguccggc

SEQ ID NO: 937620 - RNA, 23 nt, Mycobacterium avium subsp. paratuberculosis
gcggccgacccugcguccggccc

SEQ ID NO: 937621 - RNA, 12 nt, Mycobacterium avium subsp. paratuberculosis
gcggccgacgcg

SEQ ID NO: 937622 - RNA, 14 nt, Mycobacterium avium subsp. paratuberculosis
gcggccgacgcgcc

SEQ ID NO: 937623 - RNA, 15 nt, Mycobacterium avium subsp. paratuberculosis
gcggccgacagcgcg

SEQ ID NO: 937624 - RNA, 16 nt, Mycobacterium avium subsp. paratuberculosis
gcggccgacagcgcgu

SEQ ID NO: 937625 - RNA, 21 nt, Mycobacterium avium subsp. paratuberculosis
gcggccgacagcgcgucggcg

SEQ ID NO: 937626 - RNA, 19 nt, Mycobacterium avium subsp. paratuberculosis
gcggcccuguucgccgucg

SEQ ID NO: 937627 - RNA, 19 nt, Mycobacterium avium subsp. paratuberculosis
gcggcccuguuugcaggcg

SEQ ID NO: 937628 - RNA, 20 nt, Mycobacterium avium subsp. paratuberculosis
gcggcccuguuugcaggcga

SEQ ID NO: 937629 - RNA, 22 nt, Mycobacterium avium subsp. paratuberculosis
gcggcccuguuugcaggcgauc

SEQ ID NO: 937630 - RNA, 14 nt, Mycobacterium avium subsp. paratuberculosis
gcggcccugcagcg

SEQ ID NO: 937631 - RNA, 16 nt, Mycobacterium avium subsp. paratuberculosis
gcggcccugcagcgcc

SEQ ID NO: 937632 - RNA, 23 nt, Mycobacterium avium subsp. paratuberculosis
gcggcccugcagcgccuugaccg

SEQ ID NO: 937633 - RNA, 13 nt, Mycobacterium avium subsp. paratuberculosis
gcggcccugcgcg

SEQ ID NO: 937634 - RNA, 16 nt, Mycobacterium avium subsp. paratuberculosis
gcggcccuugcggccg

SEQ ID NO: 937635 - RNA, 16 nt, Mycobacterium avium subsp. paratuberculosis
gcggccgaauccggcc

SEQ ID NO: 937636 - RNA, 18 nt, Mycobacterium avium subsp. paratuberculosis
gcggccgaauccggccgg

SEQ ID NO: 937637 - RNA, 20 nt, Mycobacterium avium subsp. paratuberculosis
gcggccgaauccggccggag

SEQ ID NO: 937638 - RNA, 21 nt, Mycobacterium avium subsp. paratuberculosis
aagcgacgaggugaugccguc

SEQ ID NO: 937639 - RNA, 21 nt, Mycobacterium avium subsp. paratuberculosis
aagcgaauaccaucaacccga

SEQ ID NO: 937640 - RNA, 14 nt, Mycobacterium avium subsp. paratuberculosis
gcggcacgucgccg

SEQ ID NO: 937641 - RNA, 15 nt, Mycobacterium avium subsp. paratuberculosis
gcggcacgucgccgu

SEQ ID NO: 937642 - RNA, 17 nt, Mycobacterium avium subsp. paratuberculosis
gcggcacgguuggccgg

SEQ ID NO: 937643 - RNA, 18 nt, Mycobacterium avium subsp. paratuberculosis
gcggcacgguuggccggc

SEQ ID NO: 937644 - RNA, 20 nt, Mycobacterium avium subsp. paratuberculosis
gcggcacgguuggccggccc

SEQ ID NO: 937645 - RNA, 17 nt, Mycobacterium avium subsp. paratuberculosis
gcggcacggugcgggug

SEQ ID NO: 937646 - RNA, 20 nt, Mycobacterium avium subsp. paratuberculosis
gcggcacggugcgggugccg

SEQ ID NO: 937647 - RNA, 16 nt, Mycobacterium avium subsp. paratuberculosis
gcggcagaccgguggc

SEQ ID NO: 937648 - RNA, 17 nt, Mycobacterium avium subsp. paratuberculosis
gcggcagaccgguggcg

SEQ ID NO: 937649 - RNA, 13 nt, Mycobacterium avium subsp. paratuberculosis
gcggcagaccguc

SEQ ID NO: 937650 - RNA, 13 nt, Mycobacterium avium subsp. paratuberculosis
gcgcucgcaccag

SEQ ID NO: 937651 - RNA, 15 nt, Mycobacterium avium subsp. paratuberculosis
gcgcucgcaccagcg

SEQ ID NO: 937652 - RNA, 16 nt, Mycobacterium avium subsp. paratuberculosis
gcgcucgacgaugucg

SEQ ID NO: 937653 - RNA, 21 nt, Mycobacterium avium subsp. paratuberculosis
gcgcucgacgaugucgacgcc

SEQ ID NO: 937654 - RNA, 16 nt, Mycobacterium avium subsp. paratuberculosis
gcgcucgacggccugc

SEQ ID NO: 937655 - RNA, 17 nt, Mycobacterium avium subsp. paratuberculosis
gcgcucgaacucaccgg

SEQ ID NO: 937656 - RNA, 20 nt, Mycobacterium avium subsp. paratuberculosis
gcgcucgaacucaccggugg

SEQ ID NO: 937657 - RNA, 23 nt, Mycobacterium avium subsp. paratuberculosis
gcgcucgaacucaccgguggccg

SEQ ID NO: 937658 - RNA, 18 nt, Mycobacterium avium subsp. paratuberculosis
gcgcucgaccucggcggc

SEQ ID NO: 937659 - RNA, 21 nt, Mycobacterium avium subsp. paratuberculosis
gcgcucgaccucggcggccag

SEQ ID NO: 937660 - RNA, 22 nt, Mycobacterium avium subsp. paratuberculosis
gcgcucgaccucggcggccagc

SEQ ID NO: 937661 - RNA, 19 nt, Mycobacterium avium subsp. paratuberculosis
gcgcucgacgaggcgggcg

SEQ ID NO: 937662 - RNA, 20 nt, Mycobacterium avium subsp. paratuberculosis
gcggcacgggcaccgacgag

SEQ ID NO: 937663 - RNA, 16 nt, Mycobacterium avium subsp. paratuberculosis
gcggcacgggccguuc

SEQ ID NO: 937664 - RNA, 15 nt, Mycobacterium avium subsp. paratuberculosis
gcggcacgcugcgcc

SEQ ID NO: 937665 - RNA, 17 nt, Mycobacterium avium subsp. paratuberculosis
gcggcacgcugcgccag

SEQ ID NO: 937666 - RNA, 18 nt, Mycobacterium avium subsp. paratuberculosis
gcggcacgcugcgccagc

SEQ ID NO: 937667 - RNA, 15 nt, Mycobacterium avium subsp. paratuberculosis
gcggcacgcgucacc

SEQ ID NO: 937668 - RNA, 17 nt, Mycobacterium avium subsp. paratuberculosis
gcggcacgcgucaccgg

SEQ ID NO: 937669 - RNA, 14 nt, Mycobacterium avium subsp. paratuberculosis
gcgcucgccgcgcg

SEQ ID NO: 937670 - RNA, 13 nt, Mycobacterium avium subsp. paratuberculosis
gcgcucgccgucg

SEQ ID NO: 937671 - RNA, 12 nt, Mycobacterium avium subsp. paratuberculosis
gcgcucgccguc

SEQ ID NO: 937672 - RNA, 16 nt, Mycobacterium avium subsp. paratuberculosis
gcggcagggccaccgu

SEQ ID NO: 937673 - RNA, 17 nt, Mycobacterium avium subsp. paratuberculosis
gcggcagggccaccguc

SEQ ID NO: 937674 - RNA, 15 nt, Mycobacterium avium subsp. paratuberculosis
gcggcagugcgccgu

SEQ ID NO: 937675 - RNA, 17 nt, Mycobacterium avium subsp. paratuberculosis
gcggcagugcgccgucc

SEQ ID NO: 937676 - RNA, 19 nt, Mycobacterium avium subsp. paratuberculosis
gcggcauaguccagcucgc

SEQ ID NO: 937677 - RNA, 16 nt, Mycobacterium avium subsp. paratuberculosis
gcggcauccccagcug

SEQ ID NO: 937678 - RNA, 21 nt, Mycobacterium avium subsp. paratuberculosis
gcggcauccccagcugggccg

SEQ ID NO: 937679 - RNA, 23 nt, Mycobacterium avium subsp. paratuberculosis
gcggcaucccuggugaccgacga

SEQ ID NO: 937680 - RNA, 14 nt, Mycobacterium avium subsp. paratuberculosis
gcggcaucgccgcc

SEQ ID NO: 937681 - RNA, 13 nt, Mycobacterium avium subsp. paratuberculosis
gcggcaucgcgcc

SEQ ID NO: 937682 - RNA, 15 nt, Mycobacterium avium subsp. paratuberculosis
gcggcaucgcgccgc

SEQ ID NO: 937683 - RNA, 14 nt, Mycobacterium avium subsp. paratuberculosis
gcggcaucgaggac

SEQ ID NO: 937684 - RNA, 19 nt, Mycobacterium avium subsp. paratuberculosis
gcggcaucgaggaccggcg

SEQ ID NO: 937685 - RNA, 20 nt, Mycobacterium avium subsp. paratuberculosis
gcggcaucgaggaccggcgc

SEQ ID NO: 937686 - RNA, 23 nt, Mycobacterium avium subsp. paratuberculosis
gcggcaucgaggaccggcgccgg

SEQ ID NO: 937687 - RNA, 16 nt, Mycobacterium avium subsp. paratuberculosis
gcggcaggcgccccag

SEQ ID NO: 937688 - RNA, 19 nt, Mycobacterium avium subsp. paratuberculosis
gcggcaggcgccccagcuc

SEQ ID NO: 937689 - RNA, 15 nt, Mycobacterium avium subsp. paratuberculosis
gcggcagcucggcgg

SEQ ID NO: 937690 - RNA, 16 nt, Mycobacterium avium subsp. paratuberculosis
gcggcagcucggcggc

SEQ ID NO: 937691 - RNA, 19 nt, Mycobacterium avium subsp. paratuberculosis
gcggcagcucggcggcccg

SEQ ID NO: 937692 - RNA, 16 nt, Mycobacterium avium subsp. paratuberculosis
gcggcagccacggcag

SEQ ID NO: 937693 - RNA, 18 nt, Mycobacterium avium subsp. paratuberculosis
gcggcagccagccuggcg

SEQ ID NO: 937694 - RNA, 20 nt, Mycobacterium avium subsp. paratuberculosis
gcggcagccagccuggcggc

SEQ ID NO: 937695 - RNA, 16 nt, Mycobacterium avium subsp. paratuberculosis
gcggcagccaggcguu

SEQ ID NO: 937696 - RNA, 23 nt, Mycobacterium avium subsp. paratuberculosis
gcggcagccagguacuccgguac

SEQ ID NO: 937697 - RNA, 15 nt, Mycobacterium avium subsp. paratuberculosis
gcggcaggaaccggg

SEQ ID NO: 937698 - RNA, 22 nt, Mycobacterium avium subsp. paratuberculosis
aagcgcgcaucgcgggccaccg

SEQ ID NO: 937699 - RNA, 21 nt, Mycobacterium avium subsp. paratuberculosis
gcggccaagugcggucgguuc

SEQ ID NO: 937700 - RNA, 13 nt, Mycobacterium avium subsp. paratuberculosis
gcggccaauccca

SEQ ID NO: 937701 - RNA, 18 nt, Mycobacterium avium subsp. paratuberculosis
gcggccaccaccacggcc

SEQ ID NO: 937702 - RNA, 22 nt, Mycobacterium avium subsp. paratuberculosis
gcggccaccaccacggccaugc

SEQ ID NO: 937703 - RNA, 16 nt, Mycobacterium avium subsp. paratuberculosis
gcggccacaccgauca

SEQ ID NO: 937704 - RNA, 18 nt, Mycobacterium avium subsp. paratuberculosis
gcggccacaccgaucagc

SEQ ID NO: 937705 - RNA, 19 nt, Mycobacterium avium subsp. paratuberculosis
gcggccacaccgaucagca

SEQ ID NO: 937706 - RNA, 18 nt, Mycobacterium avium subsp. paratuberculosis
gcggccacaccggggcca

SEQ ID NO: 937707 - RNA, 19 nt, Mycobacterium avium subsp. paratuberculosis
gcggccacacuggccaugc

SEQ ID NO: 937708 - RNA, 16 nt, Mycobacterium avium subsp. paratuberculosis
gcggccacacuggcgu

SEQ ID NO: 937709 - RNA, 21 nt, Mycobacterium avium subsp. paratuberculosis
gcggccacacuggcgugacgc

SEQ ID NO: 937710 - RNA, 17 nt, Mycobacterium avium subsp. paratuberculosis
aagcgcaucgccggcgc

SEQ ID NO: 937711 - RNA, 14 nt, Mycobacterium avium subsp. paratuberculosis
gcggccagcaccag

SEQ ID NO: 937712 - RNA, 20 nt, Mycobacterium avium subsp. paratuberculosis
gcggccacgcuagcgugacg

SEQ ID NO: 937713 - RNA, 14 nt, Mycobacterium avium subsp. paratuberculosis
gcggccacgcucgg

SEQ ID NO: 937714 - RNA, 16 nt, Mycobacterium avium subsp. paratuberculosis
gcggccaccugggcgg

SEQ ID NO: 937715 - RNA, 19 nt, Mycobacterium avium subsp. paratuberculosis
gcggccaccugggcggggc

SEQ ID NO: 937716 - RNA, 14 nt, Mycobacterium avium subsp. paratuberculosis
gcggccacgacggc

SEQ ID NO: 937717 - RNA, 15 nt, Mycobacterium avium subsp. paratuberculosis
gcggccacgacggcg

SEQ ID NO: 937718 - RNA, 22 nt, Mycobacterium avium subsp. paratuberculosis
gcggccacgacggcgcuggccg

SEQ ID NO: 937719 - RNA, 15 nt, Mycobacterium avium subsp. paratuberculosis
gcggccacgaucgcg

SEQ ID NO: 937720 - RNA, 22 nt, Mycobacterium avium subsp. paratuberculosis
gcggccacgaucgcgaucgccg

SEQ ID NO: 937721 - RNA, 16 nt, Mycobacterium avium subsp. paratuberculosis
gcggccacgaucgcgg

SEQ ID NO: 937722 - RNA, 19 nt, Mycobacterium avium subsp. paratuberculosis
gcggccacgaucgcggcca

SEQ ID NO: 937723 - RNA, 17 nt, Mycobacterium avium subsp. paratuberculosis
gcggccacgcccuggcc

SEQ ID NO: 937724 - RNA, 18 nt, Mycobacterium avium subsp. paratuberculosis
gcggccacgcccuggccg

SEQ ID NO: 937725 - RNA, 20 nt, Mycobacterium avium subsp. paratuberculosis
gcggccacgcccuggccgcc

SEQ ID NO: 937726 - RNA, 12 nt, Mycobacterium avium subsp. paratuberculosis
gcggccaccucg

SEQ ID NO: 937727 - RNA, 14 nt, Mycobacterium avium subsp. paratuberculosis
gcggccaccucgcc

SEQ ID NO: 937728 - RNA, 15 nt, Mycobacterium avium subsp. paratuberculosis
gcggccaccucgccg

SEQ ID NO: 937729 - RNA, 16 nt, Mycobacterium avium subsp. paratuberculosis
gcggccaccucgccgc

SEQ ID NO: 937730 - RNA, 18 nt, Mycobacterium avium subsp. paratuberculosis
gcggccaccucgccgcag

SEQ ID NO: 937731 - RNA, 22 nt, Mycobacterium avium subsp. paratuberculosis
gcggccaccgcgccccggcgca

SEQ ID NO: 937732 - RNA, 15 nt, Mycobacterium avium subsp. paratuberculosis
gcggccaccgcgccg

SEQ ID NO: 937733 - RNA, 16 nt, Mycobacterium avium subsp. paratuberculosis
gcggccaccgcgccgu

SEQ ID NO: 937734 - RNA, 14 nt, Mycobacterium avium subsp. paratuberculosis
gcggccaccgcgcg

SEQ ID NO: 937735 - RNA, 13 nt, Mycobacterium avium subsp. paratuberculosis
gcggccaccgcgg

SEQ ID NO: 937736 - RNA, 14 nt, Mycobacterium avium subsp. paratuberculosis
gcggccaccgcggc

SEQ ID NO: 937737 - RNA, 15 nt, Mycobacterium avium subsp. paratuberculosis
gcggccaccgcggcc

SEQ ID NO: 937738 - RNA, 17 nt, Mycobacterium avium subsp. paratuberculosis
gcggccaccgcggccag

SEQ ID NO: 937739 - RNA, 21 nt, Mycobacterium avium subsp. paratuberculosis
gcggccaccgggaccgucggg

SEQ ID NO: 937740 - RNA, 15 nt, Mycobacterium avium subsp. paratuberculosis
gcggccaccgggucg

SEQ ID NO: 937741 - RNA, 23 nt, Mycobacterium avium subsp. paratuberculosis
gcggccaccgggucguccgcgac

SEQ ID NO: 937742 - RNA, 17 nt, Mycobacterium avium subsp. paratuberculosis
gcggccaccaugccggc

SEQ ID NO: 937743 - RNA, 18 nt, Mycobacterium avium subsp. paratuberculosis
gcggccaccaugccggcg

SEQ ID NO: 937744 - RNA, 22 nt, Mycobacterium avium subsp. paratuberculosis
gcggccaccaugccggcgucca

SEQ ID NO: 937745 - RNA, 23 nt, Mycobacterium avium subsp. paratuberculosis
gcggccaccaugccggcguccag

SEQ ID NO: 937746 - RNA, 21 nt, Mycobacterium avium subsp. paratuberculosis
gcggccaccaugggcgggacg

SEQ ID NO: 937747 - RNA, 17 nt, Mycobacterium avium subsp. paratuberculosis
gcggccaccccggugac

SEQ ID NO: 937748 - RNA, 18 nt, Mycobacterium avium subsp. paratuberculosis
gcggccaccccggugacc

SEQ ID NO: 937749 - RNA, 18 nt, Mycobacterium avium subsp. paratuberculosis
gcggccaccaccgccacg

SEQ ID NO: 937750 - RNA, 21 nt, Mycobacterium avium subsp. paratuberculosis
gcggccaccaccgccacggcg

SEQ ID NO: 937751 - RNA, 14 nt, Mycobacterium avium subsp. paratuberculosis
gcggccaccaccgg

SEQ ID NO: 937752 - RNA, 13 nt, Mycobacterium avium subsp. paratuberculosis
gcggccaccacga

SEQ ID NO: 937753 - RNA, 15 nt, Mycobacterium avium subsp. paratuberculosis
gcggccaccagccgg

SEQ ID NO: 937754 - RNA, 16 nt, Mycobacterium avium subsp. paratuberculosis
gcggccaccagccggc

SEQ ID NO: 937755 - RNA, 17 nt, Mycobacterium avium subsp. paratuberculosis
gcggccaccagccggcc

SEQ ID NO: 937756 - RNA, 18 nt, Mycobacterium avium subsp. paratuberculosis
gcggccaccagccggccg

SEQ ID NO: 937757 - RNA, 19 nt, Mycobacterium avium subsp. paratuberculosis
gcggccaccagccggccgg

SEQ ID NO: 937758 - RNA, 17 nt, Mycobacterium avium subsp. paratuberculosis
gcggccaccagcgcggc

SEQ ID NO: 937759 - RNA, 20 nt, Mycobacterium avium subsp. paratuberculosis
gcggccaccagcgcggccac

SEQ ID NO: 937760 - RNA, 21 nt, Mycobacterium avium subsp. paratuberculosis
gcggccaggguagaggcggcg

SEQ ID NO: 937761 - RNA, 15 nt, Mycobacterium avium subsp. paratuberculosis
gcggccagugccggg

SEQ ID NO: 937762 - RNA, 17 nt, Mycobacterium avium subsp. paratuberculosis
gcggccagugccgggcc

SEQ ID NO: 937763 - RNA, 14 nt, Mycobacterium avium subsp. paratuberculosis
gcggccaggguguc

SEQ ID NO: 937764 - RNA, 17 nt, Mycobacterium avium subsp. paratuberculosis
gcggccaggguguccca

SEQ ID NO: 937765 - RNA, 19 nt, Mycobacterium avium subsp. paratuberculosis
gcggccagggugucccagc

SEQ ID NO: 937766 - RNA, 22 nt, Mycobacterium avium subsp. paratuberculosis
gcggccagggugucccagcgcc

SEQ ID NO: 937767 - RNA, 18 nt, Mycobacterium avium subsp. paratuberculosis
gcggccagggcggcgccg

SEQ ID NO: 937768 - RNA, 19 nt, Mycobacterium avium subsp. paratuberculosis
gcggccagggcggcgccgg

SEQ ID NO: 937769 - RNA, 19 nt, Mycobacterium avium subsp. paratuberculosis
gcggccagcucggcccgcu

SEQ ID NO: 937770 - RNA, 18 nt, Mycobacterium avium subsp. paratuberculosis
gcggccagcucggucgcg

SEQ ID NO: 937771 - RNA, 14 nt, Mycobacterium avium subsp. paratuberculosis
gcggccagcugccc

SEQ ID NO: 937772 - RNA, 14 nt, Mycobacterium avium subsp. paratuberculosis
gcggccaggccggc

SEQ ID NO: 937773 - RNA, 18 nt, Mycobacterium avium subsp. paratuberculosis
gcggccaggccggcgacg

SEQ ID NO: 937774 - RNA, 16 nt, Mycobacterium avium subsp. paratuberculosis
gcggccagcggcgccg

SEQ ID NO: 937775 - RNA, 13 nt, Mycobacterium avium subsp. paratuberculosis
gcggccagcuccc

SEQ ID NO: 937776 - RNA, 15 nt, Mycobacterium avium subsp. paratuberculosis
gcggccagcucccgg

SEQ ID NO: 937777 - RNA, 19 nt, Mycobacterium avium subsp. paratuberculosis
gcggccagcucccgggcgg

SEQ ID NO: 937778 - RNA, 20 nt, Mycobacterium avium subsp. paratuberculosis
gcggccagcucccgggcggc

SEQ ID NO: 937779 - RNA, 14 nt, Mycobacterium avium subsp. paratuberculosis
gcggccagcgggcc

SEQ ID NO: 937780 - RNA, 20 nt, Mycobacterium avium subsp. paratuberculosis
gcggccagcgggccguugcc

SEQ ID NO: 937781 - RNA, 16 nt, Mycobacterium avium subsp. paratuberculosis
gcggccagcgucuuga

SEQ ID NO: 937782 - RNA, 21 nt, Mycobacterium avium subsp. paratuberculosis
gcggccagcgugaacaccgcg

SEQ ID NO: 937783 - RNA, 16 nt, Mycobacterium avium subsp. paratuberculosis
gcggccagcguggcgc

SEQ ID NO: 937784 - RNA, 15 nt, Mycobacterium avium subsp. paratuberculosis
gcggccagcgcgcgg

SEQ ID NO: 937785 - RNA, 17 nt, Mycobacterium avium subsp. paratuberculosis
gcggccagcgcgcgggc

SEQ ID NO: 937786 - RNA, 21 nt, Mycobacterium avium subsp. paratuberculosis
gcggccagcgccuucuccagc

SEQ ID NO: 937787 - RNA, 14 nt, Mycobacterium avium subsp. paratuberculosis
gcggccagcgcgac

SEQ ID NO: 937788 - RNA, 17 nt, Mycobacterium avium subsp. paratuberculosis
gcggccagcgcgccgcc

SEQ ID NO: 937789 - RNA, 24 nt, Mycobacterium avium subsp. paratuberculosis
gcggccagcgagaagucgcucagc

SEQ ID NO: 937790 - RNA, 14 nt, Mycobacterium avium subsp. paratuberculosis
gcggccagcgagga

SEQ ID NO: 937791 - RNA, 16 nt, Mycobacterium avium subsp. paratuberculosis
gcggccagcgaggacc

SEQ ID NO: 937792 - RNA, 18 nt, Mycobacterium avium subsp. paratuberculosis
gcggccagcgagucgaug

SEQ ID NO: 937793 - RNA, 15 nt, Mycobacterium avium subsp. paratuberculosis
gcggccagcgccccg

SEQ ID NO: 937794 - RNA, 17 nt, Mycobacterium avium subsp. paratuberculosis
gcggccagcgccccgcc

SEQ ID NO: 937795 - RNA, 16 nt, Mycobacterium avium subsp. paratuberculosis
gcggccagcgcccgcg

SEQ ID NO: 937796 - RNA, 19 nt, Mycobacterium avium subsp. paratuberculosis
gcggccagcaucggaugcc

SEQ ID NO: 937797 - RNA, 13 nt, Mycobacterium avium subsp. paratuberculosis
gcggccagcaucg

SEQ ID NO: 937798 - RNA, 13 nt, Mycobacterium avium subsp. paratuberculosis
gcggccagcagca

SEQ ID NO: 937799 - RNA, 14 nt, Mycobacterium avium subsp. paratuberculosis
gcggccagcagcac

SEQ ID NO: 937800 - RNA, 20 nt, Mycobacterium avium subsp. paratuberculosis
gcggccagcagcaccagaug

SEQ ID NO: 937801 - RNA, 21 nt, Mycobacterium avium subsp. paratuberculosis
gcggccagcccaucccgaucc

SEQ ID NO: 937802 - RNA, 16 nt, Mycobacterium avium subsp. paratuberculosis
gcggccagccccggga

SEQ ID NO: 937803 - RNA, 15 nt, Mycobacterium avium subsp. paratuberculosis
gcggccagcccgcgg

SEQ ID NO: 937804 - RNA, 23 nt, Mycobacterium avium subsp. paratuberculosis
gcggccagcccgcggcagccagc

SEQ ID NO: 937805 - RNA, 16 nt, Mycobacterium avium subsp. paratuberculosis
gcggccagccgcgcgg

SEQ ID NO: 937806 - RNA, 21 nt, Mycobacterium avium subsp. paratuberculosis
gcggccagccgcgcggcgucg

SEQ ID NO: 937807 - RNA, 13 nt, Mycobacterium avium subsp. paratuberculosis
gcggccagccgcu

SEQ ID NO: 937808 - RNA, 18 nt, Mycobacterium avium subsp. paratuberculosis
gcggccagccgcucccgg

SEQ ID NO: 937809 - RNA, 20 nt, Mycobacterium avium subsp. paratuberculosis
gcggccagccgcucccggcg

SEQ ID NO: 937810 - RNA, 12 nt, Mycobacterium avium subsp. paratuberculosis
gcggccagccgg

SEQ ID NO: 937811 - RNA, 13 nt, Mycobacterium avium subsp. paratuberculosis
gcggccagccggu

SEQ ID NO: 937812 - RNA, 17 nt, Mycobacterium avium subsp. paratuberculosis
gcggccagccggucguc

SEQ ID NO: 937813 - RNA, 16 nt, Mycobacterium avium subsp. paratuberculosis
gcggccagccgguugc

SEQ ID NO: 937814 - RNA, 20 nt, Mycobacterium avium subsp. paratuberculosis
gcggccagccgguugcggug

SEQ ID NO: 937815 - RNA, 23 nt, Mycobacterium avium subsp. paratuberculosis
gcggccagccgguugcgguggcc

SEQ ID NO: 937816 - RNA, 15 nt, Mycobacterium avium subsp. paratuberculosis
gccuuguugcggcgc

SEQ ID NO: 937817 - RNA, 15 nt, Mycobacterium avium subsp. paratuberculosis
gccuugucgugucga

SEQ ID NO: 937818 - RNA, 16 nt, Mycobacterium avium subsp. paratuberculosis
gcgaaaauaccgccgg

SEQ ID NO: 937819 - RNA, 18 nt, Mycobacterium avium subsp. paratuberculosis
gcgaaaauaccgccggcc

SEQ ID NO: 937820 - RNA, 16 nt, Mycobacterium avium subsp. paratuberculosis
gcgaaacacagcagca

SEQ ID NO: 937821 - RNA, 18 nt, Mycobacterium avium subsp. paratuberculosis
gcgaaacacagcagcacg

SEQ ID NO: 937822 - RNA, 19 nt, Mycobacterium avium subsp. paratuberculosis
gcgaaacacagcagcacgc

SEQ ID NO: 937823 - RNA, 21 nt, Mycobacterium avium subsp. paratuberculosis
gcgaaacacagcagcacgccc

SEQ ID NO: 937824 - RNA, 20 nt, Mycobacterium avium subsp. paratuberculosis
gcgaaaacgccugcgccgcc

SEQ ID NO: 937825 - RNA, 15 nt, Mycobacterium avium subsp. paratuberculosis
gcgaaacucaccgcg

SEQ ID NO: 937826 - RNA, 14 nt, Mycobacterium avium subsp. paratuberculosis
gcgaaagcacccga

SEQ ID NO: 937827 - RNA, 19 nt, Mycobacterium avium subsp. paratuberculosis
gcgaaaauggcugcccggc

SEQ ID NO: 937828 - RNA, 16 nt, Mycobacterium avium subsp. paratuberculosis
gccuugcgguuggccg

SEQ ID NO: 937829 - RNA, 19 nt, Mycobacterium avium subsp. paratuberculosis
gccuugcugacgccgcggu

SEQ ID NO: 937830 - RNA, 14 nt, Mycobacterium avium subsp. paratuberculosis
gccuugcugauccc

SEQ ID NO: 937831 - RNA, 21 nt, Mycobacterium avium subsp. paratuberculosis
gccuugcugauccccagcggc

SEQ ID NO: 937832 - RNA, 18 nt, Mycobacterium avium subsp. paratuberculosis
gccuuggcccgcgcccgc

SEQ ID NO: 937833 - RNA, 16 nt, Mycobacterium avium subsp. paratuberculosis
gccuuggcccgcgcgg

SEQ ID NO: 937834 - RNA, 17 nt, Mycobacterium avium subsp. paratuberculosis
gccuuggcccgcgcggc

SEQ ID NO: 937835 - RNA, 21 nt, Mycobacterium avium subsp. paratuberculosis
gccuuggcccgcgcggccgcc

SEQ ID NO: 937836 - RNA, 12 nt, Mycobacterium avium subsp. paratuberculosis
gccuuggccgca

SEQ ID NO: 937837 - RNA, 16 nt, Mycobacterium avium subsp. paratuberculosis
gccuuggccaccgccu

SEQ ID NO: 937838 - RNA, 13 nt, Mycobacterium avium subsp. paratuberculosis
gccuugucggcga

SEQ ID NO: 937839 - RNA, 17 nt, Mycobacterium avium subsp. paratuberculosis
gccuuggugauccgggg

SEQ ID NO: 937840 - RNA, 18 nt, Mycobacterium avium subsp. paratuberculosis
gccuuggcgcgcucggug

SEQ ID NO: 937841 - RNA, 14 nt, Mycobacterium avium subsp. paratuberculosis
gccuugcagccgcu

SEQ ID NO: 937842 - RNA, 15 nt, Mycobacterium avium subsp. paratuberculosis
gccuugcagccgcug

SEQ ID NO: 937843 - RNA, 23 nt, Mycobacterium avium subsp. paratuberculosis
gccuugaugaacgccucgagcgc

SEQ ID NO: 937844 - RNA, 14 nt, Mycobacterium avium subsp. paratuberculosis
gccugccaccgcga

SEQ ID NO: 937845 - RNA, 22 nt, Mycobacterium avium subsp. paratuberculosis
gccugugcgacggcgucggcga

SEQ ID NO: 937846 - RNA, 21 nt, Mycobacterium avium subsp. paratuberculosis
gccugcagugucggaaucggc

SEQ ID NO: 937847 - RNA, 22 nt, Mycobacterium avium subsp. paratuberculosis
gccugcagcgcggucaucguca

SEQ ID NO: 937848 - RNA, 21 nt, Mycobacterium avium subsp. paratuberculosis
gccugcaggaacgccuugacc

SEQ ID NO: 937849 - RNA, 16 nt, Mycobacterium avium subsp. paratuberculosis
gccugcaccggcgacg

SEQ ID NO: 937850 - RNA, 18 nt, Mycobacterium avium subsp. paratuberculosis
gccugcaccggcgacggc

SEQ ID NO: 937851 - RNA, 22 nt, Mycobacterium avium subsp. paratuberculosis
gccugcaccggcgacggcgguu

SEQ ID NO: 937852 - RNA, 20 nt, Mycobacterium avium subsp. paratuberculosis
gccugcaccuugcccgucgc

SEQ ID NO: 937853 - RNA, 22 nt, Mycobacterium avium subsp. paratuberculosis
gccugcaccuugcccgucgcgu

SEQ ID NO: 937854 - RNA, 21 nt, Mycobacterium avium subsp. paratuberculosis
gccugcacgaaauaaccgcgc

SEQ ID NO: 937855 - RNA, 14 nt, Mycobacterium avium subsp. paratuberculosis
gccugcacgaaguc

SEQ ID NO: 937856 - RNA, 19 nt, Mycobacterium avium subsp. paratuberculosis
gccugcacggugcgccggc

SEQ ID NO: 937857 - RNA, 22 nt, Mycobacterium avium subsp. paratuberculosis
gccugcacggugcgccggcagc

SEQ ID NO: 937858 - RNA, 16 nt, Mycobacterium avium subsp. paratuberculosis
gccugcaccucgggau

SEQ ID NO: 937859 - RNA, 14 nt, Mycobacterium avium subsp. paratuberculosis
gccugcagccgccg

SEQ ID NO: 937860 - RNA, 16 nt, Mycobacterium avium subsp. paratuberculosis
gccugcagccgccgcg

SEQ ID NO: 937861 - RNA, 22 nt, Mycobacterium avium subsp. paratuberculosis
gccugcagccgccgcgccaccg

SEQ ID NO: 937862 - RNA, 16 nt, Mycobacterium avium subsp. paratuberculosis
gccugcagcaccaggc

SEQ ID NO: 937863 - RNA, 14 nt, Mycobacterium avium subsp. paratuberculosis
gccugcagcaccga

SEQ ID NO: 937864 - RNA, 19 nt, Mycobacterium avium subsp. paratuberculosis
gccugcagcaccgaaccgg

SEQ ID NO: 937865 - RNA, 13 nt, Mycobacterium avium subsp. paratuberculosis
gccugcagcacca

SEQ ID NO: 937866 - RNA, 15 nt, Mycobacterium avium subsp. paratuberculosis
gccuucacgaccggc

SEQ ID NO: 937867 - RNA, 14 nt, Mycobacterium avium subsp. paratuberculosis
gccuucucgcgcac

SEQ ID NO: 937868 - RNA, 18 nt, Mycobacterium avium subsp. paratuberculosis
gccuucucgcgcaccgcg

SEQ ID NO: 937869 - RNA, 19 nt, Mycobacterium avium subsp. paratuberculosis
gccuucucgcgcaccgcgg

SEQ ID NO: 937870 - RNA, 18 nt, Mycobacterium avium subsp. paratuberculosis
gccuucuuggccgcgccc

SEQ ID NO: 937871 - RNA, 15 nt, Mycobacterium avium subsp. paratuberculosis
gccuucuuggccgga

SEQ ID NO: 937872 - RNA, 15 nt, Mycobacterium avium subsp. paratuberculosis
gccuucuuggcggcg

SEQ ID NO: 937873 - RNA, 16 nt, Mycobacterium avium subsp. paratuberculosis
gccuucuuggcggcgg

SEQ ID NO: 937874 - RNA, 22 nt, Mycobacterium avium subsp. paratuberculosis
gccuucuuucguucgaugucgg

SEQ ID NO: 937875 - RNA, 17 nt, Mycobacterium avium subsp. paratuberculosis
gccuucuugaccgcagc

SEQ ID NO: 937876 - RNA, 22 nt, Mycobacterium avium subsp. paratuberculosis
gccuucuugcgcggcgcgaagc

SEQ ID NO: 937877 - RNA, 14 nt, Mycobacterium avium subsp. paratuberculosis
gccuucuugcugcc

SEQ ID NO: 937878 - RNA, 15 nt, Mycobacterium avium subsp. paratuberculosis
gccuucuucucgacg

SEQ ID NO: 937879 - RNA, 18 nt, Mycobacterium avium subsp. paratuberculosis
gccuugaacucggccagg

SEQ ID NO: 937880 - RNA, 14 nt, Mycobacterium avium subsp. paratuberculosis
gccuugaccacggu

SEQ ID NO: 937881 - RNA, 19 nt, Mycobacterium avium subsp. paratuberculosis
gccuugaccgcguuggcgc

SEQ ID NO: 937882 - RNA, 16 nt, Mycobacterium avium subsp. paratuberculosis
gccuugagcaccgcgu

SEQ ID NO: 937883 - RNA, 19 nt, Mycobacterium avium subsp. paratuberculosis
gccuugacguagaagucga

SEQ ID NO: 937884 - RNA, 22 nt, Mycobacterium avium subsp. paratuberculosis
gccuugagaacgucgcguccga

SEQ ID NO: 937885 - RNA, 14 nt, Mycobacterium avium subsp. paratuberculosis
gccuugacgacggc

SEQ ID NO: 937886 - RNA, 15 nt, Mycobacterium avium subsp. paratuberculosis
gccuugacgacggcc

SEQ ID NO: 937887 - RNA, 23 nt, Mycobacterium avium subsp. paratuberculosis
gccuugacgacggccaccgcgac

SEQ ID NO: 937888 - RNA, 14 nt, Mycobacterium avium subsp. paratuberculosis
gcgaacccgagcac

SEQ ID NO: 937889 - RNA, 20 nt, Mycobacterium avium subsp. paratuberculosis
gcgaacccgagcaccccggc

SEQ ID NO: 937890 - RNA, 21 nt, Mycobacterium avium subsp. paratuberculosis
gcgaacccgagcaccccggcg

SEQ ID NO: 937891 - RNA, 13 nt, Mycobacterium avium subsp. paratuberculosis
gcgaacccggcgc

SEQ ID NO: 937892 - RNA, 19 nt, Mycobacterium avium subsp. paratuberculosis
gcgaacccggcgcccggcc

SEQ ID NO: 937893 - RNA, 20 nt, Mycobacterium avium subsp. paratuberculosis
gcgaacccggcgcccggccg

SEQ ID NO: 937894 - RNA, 20 nt, Mycobacterium avium subsp. paratuberculosis
gcgaaccacgggucgcugug

SEQ ID NO: 937895 - RNA, 14 nt, Mycobacterium avium subsp. paratuberculosis
gcgaaccagcgccc

SEQ ID NO: 937896 - RNA, 24 nt, Mycobacterium avium subsp. paratuberculosis
gcgaacaucuuggucagccgcggc

SEQ ID NO: 937897 - RNA, 16 nt, Mycobacterium avium subsp. paratuberculosis
gcgaacaucgccagca

SEQ ID NO: 937898 - RNA, 20 nt, Mycobacterium avium subsp. paratuberculosis
gcgaacaucgccagcaacga

SEQ ID NO: 937899 - RNA, 17 nt, Mycobacterium avium subsp. paratuberculosis
gcgaacauggcggccag

SEQ ID NO: 937900 - RNA, 21 nt, Mycobacterium avium subsp. paratuberculosis
gcgaacauggcggccagccgg

SEQ ID NO: 937901 - RNA, 22 nt, Mycobacterium avium subsp. paratuberculosis
gcgaacaugguggucgaacugg

SEQ ID NO: 937902 - RNA, 23 nt, Mycobacterium avium subsp. paratuberculosis
gcgaacgagacgaaguccgagcc

SEQ ID NO: 937903 - RNA, 13 nt, Mycobacterium avium subsp. paratuberculosis
gcgaacgaggccg

SEQ ID NO: 937904 - RNA, 19 nt, Mycobacterium avium subsp. paratuberculosis
gcgaacgaggccgacgugg

SEQ ID NO: 937905 - RNA, 19 nt, Mycobacterium avium subsp. paratuberculosis
gcgaaccguucgucgucgc

SEQ ID NO: 937906 - RNA, 13 nt, Mycobacterium avium subsp. paratuberculosis
gcgaacgcccggu

SEQ ID NO: 937907 - RNA, 19 nt, Mycobacterium avium subsp. paratuberculosis
gcgaacgcccggucgauga

SEQ ID NO: 937908 - RNA, 12 nt, Mycobacterium avium subsp. paratuberculosis
gcgaacgccgcc

SEQ ID NO: 937909 - RNA, 14 nt, Mycobacterium avium subsp. paratuberculosis
gcgaacgccgccgu

SEQ ID NO: 937910 - RNA, 14 nt, Mycobacterium avium subsp. paratuberculosis
gcgaacgccucggc

SEQ ID NO: 937911 - RNA, 15 nt, Mycobacterium avium subsp. paratuberculosis
gcgaacgccucggcg

SEQ ID NO: 937912 - RNA, 17 nt, Mycobacterium avium subsp. paratuberculosis
gcgaacgccucggcgag

SEQ ID NO: 937913 - RNA, 14 nt, Mycobacterium avium subsp. paratuberculosis
gcgaacgccucggu

SEQ ID NO: 937914 - RNA, 13 nt, Mycobacterium avium subsp. paratuberculosis
gcgaacgccucgu

SEQ ID NO: 937915 - RNA, 19 nt, Mycobacterium avium subsp. paratuberculosis
gcgaacgccucguuggcca

SEQ ID NO: 937916 - RNA, 21 nt, Mycobacterium avium subsp. paratuberculosis
gcgaacgccucguuggccagc

SEQ ID NO: 937917 - RNA, 14 nt, Mycobacterium avium subsp. paratuberculosis
gcgaacggccgcga

SEQ ID NO: 937918 - RNA, 13 nt, Mycobacterium avium subsp. paratuberculosis
gcgaacggccagu

SEQ ID NO: 937919 - RNA, 14 nt, Mycobacterium avium subsp. paratuberculosis
gcgaacgcgccggu

SEQ ID NO: 937920 - RNA, 16 nt, Mycobacterium avium subsp. paratuberculosis
gcgaacgcgccgguga

SEQ ID NO: 937921 - RNA, 13 nt, Mycobacterium avium subsp. paratuberculosis
gcgaacgcgcggu

SEQ ID NO: 937922 - RNA, 14 nt, Mycobacterium avium subsp. paratuberculosis
gcgaacagcgccga

SEQ ID NO: 937923 - RNA, 15 nt, Mycobacterium avium subsp. paratuberculosis
gcgaacagcgccgac

SEQ ID NO: 937924 - RNA, 15 nt, Mycobacterium avium subsp. paratuberculosis
gcgaacagcgcggcc

SEQ ID NO: 937925 - RNA, 18 nt, Mycobacterium avium subsp. paratuberculosis
gcgaacagcagcacccgg

SEQ ID NO: 937926 - RNA, 12 nt, Mycobacterium avium subsp. paratuberculosis
gcgaacagccga

SEQ ID NO: 937927 - RNA, 22 nt, Mycobacterium avium subsp. paratuberculosis
gcgaacagccgaccgaucagcg

SEQ ID NO: 937928 - RNA, 16 nt, Mycobacterium avium subsp. paratuberculosis
gcgaacaggcccugcu

SEQ ID NO: 937929 - RNA, 21 nt, Mycobacterium avium subsp. paratuberculosis
gcgaacagguccuugcccagc

SEQ ID NO: 937930 - RNA, 22 nt, Mycobacterium avium subsp. paratuberculosis
gcgaacagguccuugcccagca

SEQ ID NO: 937931 - RNA, 15 nt, Mycobacterium avium subsp. paratuberculosis
gcgaacacgcgauga

SEQ ID NO: 937932 - RNA, 14 nt, Mycobacterium avium subsp. paratuberculosis
gcgaacaccucggc

SEQ ID NO: 937933 - RNA, 15 nt, Mycobacterium avium subsp. paratuberculosis
gcgaacaccucggcg

SEQ ID NO: 937934 - RNA, 13 nt, Mycobacterium avium subsp. paratuberculosis
gcgaacaccugcu

SEQ ID NO: 937935 - RNA, 15 nt, Mycobacterium avium subsp. paratuberculosis
gcgaacacgugcagc

SEQ ID NO: 937936 - RNA, 16 nt, Mycobacterium avium subsp. paratuberculosis
gcgaacacgugcagcu

SEQ ID NO: 937937 - RNA, 14 nt, Mycobacterium avium subsp. paratuberculosis
gcgaacacgucggc

SEQ ID NO: 937938 - RNA, 15 nt, Mycobacterium avium subsp. paratuberculosis
gcgaacacgucggcc

SEQ ID NO: 937939 - RNA, 13 nt, Mycobacterium avium subsp. paratuberculosis
gcgaacagcacgu

SEQ ID NO: 937940 - RNA, 17 nt, Mycobacterium avium subsp. paratuberculosis
gcgaacaccagaugccg

SEQ ID NO: 937941 - RNA, 23 nt, Mycobacterium avium subsp. paratuberculosis
gcgaacaccagaugccgcucggc

SEQ ID NO: 937942 - RNA, 13 nt, Mycobacterium avium subsp. paratuberculosis
gcgaacaccagca

SEQ ID NO: 937943 - RNA, 19 nt, Mycobacterium avium subsp. paratuberculosis
gcgaacaccagcacccagc

SEQ ID NO: 937944 - RNA, 21 nt, Mycobacterium avium subsp. paratuberculosis
gcgaacaauuccucugcgcgc

SEQ ID NO: 937945 - RNA, 13 nt, Mycobacterium avium subsp. paratuberculosis
gcgaacaccacgg

SEQ ID NO: 937946 - RNA, 21 nt, Mycobacterium avium subsp. paratuberculosis
gcgaacaccacgguccccgcg

SEQ ID NO: 937947 - RNA, 14 nt, Mycobacterium avium subsp. paratuberculosis
gcgaacaacgccac

SEQ ID NO: 937948 - RNA, 15 nt, Mycobacterium avium subsp. paratuberculosis
gcgaaaucgcgggcc

SEQ ID NO: 937949 - RNA, 16 nt, Mycobacterium avium subsp. paratuberculosis
gcgaaaucgcgggccu

SEQ ID NO: 937950 - RNA, 18 nt, Mycobacterium avium subsp. paratuberculosis
gcgaaagcagcguucggu

SEQ ID NO: 937951 - RNA, 22 nt, Mycobacterium avium subsp. paratuberculosis
gcgaaagcagcguucggucagc

SEQ ID NO: 937952 - RNA, 19 nt, Mycobacterium avium subsp. paratuberculosis
gcgaaagcccaggcccggc

SEQ ID NO: 937953 - RNA, 18 nt, Mycobacterium avium subsp. paratuberculosis
gcgaaagcgucggcuagc

SEQ ID NO: 937954 - RNA, 23 nt, Mycobacterium avium subsp. paratuberculosis
gcgaaagucccccaaaacccggc

SEQ ID NO: 937955 - RNA, 20 nt, Mycobacterium avium subsp. paratuberculosis
gcgaaagugcaacugccgac

SEQ ID NO: 937956 - RNA, 17 nt, Mycobacterium avium subsp. paratuberculosis
gcgaaauaacccacccc

SEQ ID NO: 937957 - RNA, 19 nt, Mycobacterium avium subsp. paratuberculosis
gcgaaauaacccaccccga

SEQ ID NO: 937958 - RNA, 14 nt, Mycobacterium avium subsp. paratuberculosis
gcgaagccggcguc

SEQ ID NO: 937959 - RNA, 15 nt, Mycobacterium avium subsp. paratuberculosis
gcgaagccggccccg

SEQ ID NO: 937960 - RNA, 22 nt, Mycobacterium avium subsp. paratuberculosis
gcgaagcaggggucguuguugu

SEQ ID NO: 937961 - RNA, 15 nt, Mycobacterium avium subsp. paratuberculosis
gcgaagacgcuggcc

SEQ ID NO: 937962 - RNA, 18 nt, Mycobacterium avium subsp. paratuberculosis
gcgaagacgcuggccacg

SEQ ID NO: 937963 - RNA, 14 nt, Mycobacterium avium subsp. paratuberculosis
gcgaagaccagcgu

SEQ ID NO: 937964 - RNA, 16 nt, Mycobacterium avium subsp. paratuberculosis
gcgaagaccagcgugu

SEQ ID NO: 937965 - RNA, 22 nt, Mycobacterium avium subsp. paratuberculosis
gcgaagaccagcgugucgccgg

SEQ ID NO: 937966 - RNA, 17 nt, Mycobacterium avium subsp. paratuberculosis
gcgaacuuggccgacac

SEQ ID NO: 937967 - RNA, 18 nt, Mycobacterium avium subsp. paratuberculosis
gcgaacuuggccgacacg

SEQ ID NO: 937968 - RNA, 19 nt, Mycobacterium avium subsp. paratuberculosis
gcgaagaacgacgccaccg

SEQ ID NO: 937969 - RNA, 16 nt, Mycobacterium avium subsp. paratuberculosis
gcgaagaacgacgcca

SEQ ID NO: 937970 - RNA, 19 nt, Mycobacterium avium subsp. paratuberculosis
gcgaagaacggugucacgu

SEQ ID NO: 937971 - RNA, 14 nt, Mycobacterium avium subsp. paratuberculosis
gcgaacugcaccag

SEQ ID NO: 937972 - RNA, 19 nt, Mycobacterium avium subsp. paratuberculosis
gcgaacugcaccagcacga

SEQ ID NO: 937973 - RNA, 13 nt, Mycobacterium avium subsp. paratuberculosis
gcgaacucgucga

SEQ ID NO: 937974 - RNA, 15 nt, Mycobacterium avium subsp. paratuberculosis
gcgaacucgucgacg

SEQ ID NO: 937975 - RNA, 16 nt, Mycobacterium avium subsp. paratuberculosis
gcgaacucgucgacgc

SEQ ID NO: 937976 - RNA, 17 nt, Mycobacterium avium subsp. paratuberculosis
gcgaacucgucgacgcc

SEQ ID NO: 937977 - RNA, 16 nt, Mycobacterium avium subsp. paratuberculosis
gcgaacucgucgaugc

SEQ ID NO: 937978 - RNA, 16 nt, Mycobacterium avium subsp. paratuberculosis
gcgaacgucucgcggg

SEQ ID NO: 937979 - RNA, 18 nt, Mycobacterium avium subsp. paratuberculosis
gcgaacucaggcgcgcac

SEQ ID NO: 937980 - RNA, 22 nt, Mycobacterium avium subsp. paratuberculosis
gcgaacucaggcgcgcacguug

SEQ ID NO: 937981 - RNA, 20 nt, Mycobacterium avium subsp. paratuberculosis
gcgaacuccagaucgccgcc

SEQ ID NO: 937982 - RNA, 21 nt, Mycobacterium avium subsp. paratuberculosis
gcgaacuccagaucgccgccc

SEQ ID NO: 937983 - RNA, 22 nt, Mycobacterium avium subsp. paratuberculosis
gcgaacuccagaucgccgccca

SEQ ID NO: 937984 - RNA, 23 nt, Mycobacterium avium subsp. paratuberculosis
gcgaacgguucgggaaccuggcc

SEQ ID NO: 937985 - RNA, 18 nt, Mycobacterium avium subsp. paratuberculosis
gcgaacgcgccccgccgg

SEQ ID NO: 937986 - RNA, 20 nt, Mycobacterium avium subsp. paratuberculosis
gcgaacgggugaccggcggc

SEQ ID NO: 937987 - RNA, 21 nt, Mycobacterium avium subsp. paratuberculosis
gcgaacgggugaccggcggcc

SEQ ID NO: 937988 - RNA, 23 nt, Mycobacterium avium subsp. paratuberculosis
gcgaacgggugaccggcggccag

SEQ ID NO: 937989 - RNA, 23 nt, Mycobacterium avium subsp. paratuberculosis
gcgaacgggugaguaacacgugg

SEQ ID NO: 937990 - RNA, 16 nt, Mycobacterium avium subsp. paratuberculosis
gcgaaguugcgguuga

SEQ ID NO: 937991 - RNA, 23 nt, Mycobacterium avium subsp. paratuberculosis
gcgaaguuggucaccaccaacgc

SEQ ID NO: 937992 - RNA, 16 nt, Mycobacterium avium subsp. paratuberculosis
gcgaauaaggggguag

SEQ ID NO: 937993 - RNA, 18 nt, Mycobacterium avium subsp. paratuberculosis
gcgaauaccagggcgagg

SEQ ID NO: 937994 - RNA, 23 nt, Mycobacterium avium subsp. paratuberculosis
gcgaauaccaucaacccgagcac

SEQ ID NO: 937995 - RNA, 14 nt, Mycobacterium avium subsp. paratuberculosis
gcgaauacccgccc

SEQ ID NO: 937996 - RNA, 18 nt, Mycobacterium avium subsp. paratuberculosis
gcgaaggugccgcgaugc

SEQ ID NO: 937997 - RNA, 14 nt, Mycobacterium avium subsp. paratuberculosis
gcgaaucagcagcu

SEQ ID NO: 937998 - RNA, 17 nt, Mycobacterium avium subsp. paratuberculosis
gcgaauccgaccggcuc

SEQ ID NO: 937999 - RNA, 19 nt, Mycobacterium avium subsp. paratuberculosis
gcgaauccgaccggcucag

SEQ ID NO: 938000 - RNA, 22 nt, Mycobacterium avium subsp. paratuberculosis
gcgaaggacaauucguuguagc

SEQ ID NO: 938001 - RNA, 22 nt, Mycobacterium avium subsp. paratuberculosis
gcgaaggcaugggcgugccggc

SEQ ID NO: 938002 - RNA, 23 nt, Mycobacterium avium subsp. paratuberculosis
gcgaaggcaugggcgugccggcc

SEQ ID NO: 938003 - RNA, 21 nt, Mycobacterium avium subsp. paratuberculosis
gcgaagcguuucagcaacccg

SEQ ID NO: 938004 - RNA, 15 nt, Mycobacterium avium subsp. paratuberculosis
gcgaaggcggcgucg

SEQ ID NO: 938005 - RNA, 16 nt, Mycobacterium avium subsp. paratuberculosis
gcgaaggcggcgucga

SEQ ID NO: 938006 - RNA, 23 nt, Mycobacterium avium subsp. paratuberculosis
gcgaaguagccggcgaucgucgc

SEQ ID NO: 938007 - RNA, 20 nt, Mycobacterium avium subsp. paratuberculosis
gcgaaguagcgggcguuggc

SEQ ID NO: 938008 - RNA, 16 nt, Mycobacterium avium subsp. paratuberculosis
gcgaaguagucggcgu

SEQ ID NO: 938009 - RNA, 16 nt, Mycobacterium avium subsp. paratuberculosis
gcgaaguagacgagcu

SEQ ID NO: 938010 - RNA, 21 nt, Mycobacterium avium subsp. paratuberculosis
gcgaaguagacgagcucaccg

SEQ ID NO: 938011 - RNA, 18 nt, Mycobacterium avium subsp. paratuberculosis
gcgaagguggcacgccac

SEQ ID NO: 938012 - RNA, 17 nt, Mycobacterium avium subsp. paratuberculosis
gcgaagguggcgccggu

SEQ ID NO: 938013 - RNA, 17 nt, Mycobacterium avium subsp. paratuberculosis
gcgaagguggcgucggc

SEQ ID NO: 938014 - RNA, 22 nt, Mycobacterium avium subsp. paratuberculosis
gcgaaggugggcagcgccacca

SEQ ID NO: 938015 - RNA, 16 nt, Mycobacterium avium subsp. paratuberculosis
gcgaagguguccucga

SEQ ID NO: 938016 - RNA, 17 nt, Mycobacterium avium subsp. paratuberculosis
gcgaagucaucaccggg

SEQ ID NO: 938017 - RNA, 21 nt, Mycobacterium avium subsp. paratuberculosis
gcgaaguccgacgagucgacg

SEQ ID NO: 938018 - RNA, 23 nt, Mycobacterium avium subsp. paratuberculosis
gcgaaguccgacgagucgacgcu

SEQ ID NO: 938019 - RNA, 18 nt, Mycobacterium avium subsp. paratuberculosis
gcgaagucgccgcccggg

SEQ ID NO: 938020 - RNA, 17 nt, Mycobacterium avium subsp. paratuberculosis
gcgaagucgccggccag

SEQ ID NO: 938021 - RNA, 18 nt, Mycobacterium avium subsp. paratuberculosis
gcgaagucgccggccagg

SEQ ID NO: 938022 - RNA, 21 nt, Mycobacterium avium subsp. paratuberculosis
gcgagugccggccagcucgcc

SEQ ID NO: 938023 - RNA, 23 nt, Mycobacterium avium subsp. paratuberculosis
gcgagugccggccagcucgccgc

SEQ ID NO: 938024 - RNA, 15 nt, Mycobacterium avium subsp. paratuberculosis
gcgagucgaugaccu

SEQ ID NO: 938025 - RNA, 23 nt, Mycobacterium avium subsp. paratuberculosis
gcgagucgaugaccucgcgcccg

SEQ ID NO: 938026 - RNA, 13 nt, Mycobacterium avium subsp. paratuberculosis
gcgagugaggccg

SEQ ID NO: 938027 - RNA, 18 nt, Mycobacterium avium subsp. paratuberculosis
gcgagugaggccgaggcg

SEQ ID NO: 938028 - RNA, 22 nt, Mycobacterium avium subsp. paratuberculosis
gcgaguucgaugacgucgcgcu

SEQ ID NO: 938029 - RNA, 21 nt, Mycobacterium avium subsp. paratuberculosis
gcgaguucgaccuccacccgc

SEQ ID NO: 938030 - RNA, 23 nt, Mycobacterium avium subsp. paratuberculosis
gcgaguucgaccuccacccgcuc

SEQ ID NO: 938031 - RNA, 19 nt, Mycobacterium avium subsp. paratuberculosis
gcgaguuaugccgucaccc

SEQ ID NO: 938032 - RNA, 20 nt, Mycobacterium avium subsp. paratuberculosis
gcgaguuaugccgucaccca

SEQ ID NO: 938033 - RNA, 19 nt, Mycobacterium avium subsp. paratuberculosis
gcgaguucagaagucgccc

SEQ ID NO: 938034 - RNA, 20 nt, Mycobacterium avium subsp. paratuberculosis
gcgaguucagaagucgcccg

SEQ ID NO: 938035 - RNA, 22 nt, Mycobacterium avium subsp. paratuberculosis
gcgaguucagaagucgcccgcg

SEQ ID NO: 938036 - RNA, 20 nt, Mycobacterium avium subsp. paratuberculosis
gcgaguggaagucagcgcgu

SEQ ID NO: 938037 - RNA, 17 nt, Mycobacterium avium subsp. paratuberculosis
gcgaguccgcggaggcg

SEQ ID NO: 938038 - RNA, 18 nt, Mycobacterium avium subsp. paratuberculosis
gcgaguccggccaggucg

SEQ ID NO: 938039 - RNA, 13 nt, Mycobacterium avium subsp. paratuberculosis
gcgagucgaagcc

SEQ ID NO: 938040 - RNA, 19 nt, Mycobacterium avium subsp. paratuberculosis
gcgagucgaagccguccag

SEQ ID NO: 938041 - RNA, 14 nt, Mycobacterium avium subsp. paratuberculosis
gcgagucgaaggcg

SEQ ID NO: 938042 - RNA, 17 nt, Mycobacterium avium subsp. paratuberculosis
gcgagucgagcaccgcg

SEQ ID NO: 938043 - RNA, 20 nt, Mycobacterium avium subsp. paratuberculosis
gcgagucgagcaccgcgacc

SEQ ID NO: 938044 - RNA, 19 nt, Mycobacterium avium subsp. paratuberculosis
gcgagucgagguugaugcc

SEQ ID NO: 938045 - RNA, 13 nt, Mycobacterium avium subsp. paratuberculosis
gcgaguacccgcc

SEQ ID NO: 938046 - RNA, 15 nt, Mycobacterium avium subsp. paratuberculosis
gcgaguacccgccgc

SEQ ID NO: 938047 - RNA, 20 nt, Mycobacterium avium subsp. paratuberculosis
gcgaguacccgccgcaccuc

SEQ ID NO: 938048 - RNA, 15 nt, Mycobacterium avium subsp. paratuberculosis
gcgaguaggcgaaga

SEQ ID NO: 938049 - RNA, 14 nt, Mycobacterium avium subsp. paratuberculosis
gcgagucaccggcu

SEQ ID NO: 938050 - RNA, 23 nt, Mycobacterium avium subsp. paratuberculosis
gcgagucaucgccacccgcaccu

SEQ ID NO: 938051 - RNA, 17 nt, Mycobacterium avium subsp. paratuberculosis
gcgaggcguccagcgcg

SEQ ID NO: 938052 - RNA, 17 nt, Mycobacterium avium subsp. paratuberculosis
gcgagggccguugcggc

SEQ ID NO: 938053 - RNA, 15 nt, Mycobacterium avium subsp. paratuberculosis
gcgagggcgggccag

SEQ ID NO: 938054 - RNA, 21 nt, Mycobacterium avium subsp. paratuberculosis
gcgagggcucaacaggcgagu

SEQ ID NO: 938055 - RNA, 18 nt, Mycobacterium avium subsp. paratuberculosis
gcgaguaaggccgaggcg

SEQ ID NO: 938056 - RNA, 21 nt, Mycobacterium avium subsp. paratuberculosis
gcgaguaaggccgaggcgagu

SEQ ID NO: 938057 - RNA, 15 nt, Mycobacterium avium subsp. paratuberculosis
gcgaguacaccucga

SEQ ID NO: 938058 - RNA, 12 nt, Mycobacterium avium subsp. paratuberculosis
gcgaggcggcca

SEQ ID NO: 938059 - RNA, 13 nt, Mycobacterium avium subsp. paratuberculosis
gcgaggcggccag

SEQ ID NO: 938060 - RNA, 14 nt, Mycobacterium avium subsp. paratuberculosis
gcgaggcggccagc

SEQ ID NO: 938061 - RNA, 16 nt, Mycobacterium avium subsp. paratuberculosis
gcgaggcggucggcgg

SEQ ID NO: 938062 - RNA, 15 nt, Mycobacterium avium subsp. paratuberculosis
gcgaggcgcggggcg

SEQ ID NO: 938063 - RNA, 15 nt, Mycobacterium avium subsp. paratuberculosis
gcgaggccucgccgc

SEQ ID NO: 938064 - RNA, 13 nt, Mycobacterium avium subsp. paratuberculosis
gcgaggcgcgcag

SEQ ID NO: 938065 - RNA, 13 nt, Mycobacterium avium subsp. paratuberculosis
gcgaggccgccau

SEQ ID NO: 938066 - RNA, 13 nt, Mycobacterium avium subsp. paratuberculosis
gcgagcgucgccg

SEQ ID NO: 938067 - RNA, 14 nt, Mycobacterium avium subsp. paratuberculosis
gcgagcgucgccgc

SEQ ID NO: 938068 - RNA, 17 nt, Mycobacterium avium subsp. paratuberculosis
gcgagcgucgccgcgug

SEQ ID NO: 938069 - RNA, 22 nt, Mycobacterium avium subsp. paratuberculosis
gcgagcgguucgaucucgucgg

SEQ ID NO: 938070 - RNA, 20 nt, Mycobacterium avium subsp. paratuberculosis
gcgagcgguuggcgacgcug

SEQ ID NO: 938071 - RNA, 16 nt, Mycobacterium avium subsp. paratuberculosis
gcgagcgucacgcugg

SEQ ID NO: 938072 - RNA, 19 nt, Mycobacterium avium subsp. paratuberculosis
gcgagcgucacgcuggcgu

SEQ ID NO: 938073 - RNA, 21 nt, Mycobacterium avium subsp. paratuberculosis
gcgagcgucacgcuggcguga

SEQ ID NO: 938074 - RNA, 17 nt, Mycobacterium avium subsp. paratuberculosis
gcgagcgggcacgccgc

SEQ ID NO: 938075 - RNA, 20 nt, Mycobacterium avium subsp. paratuberculosis
gcgagcgggcacgccgccgc

SEQ ID NO: 938076 - RNA, 21 nt, Mycobacterium avium subsp. paratuberculosis
gcgagcgggcacgccgccgcg

SEQ ID NO: 938077 - RNA, 14 nt, Mycobacterium avium subsp. paratuberculosis
gcgagcggcccugc

SEQ ID NO: 938078 - RNA, 18 nt, Mycobacterium avium subsp. paratuberculosis
gcgagcggcccugcgcgg

SEQ ID NO: 938079 - RNA, 13 nt, Mycobacterium avium subsp. paratuberculosis
gcgagcuggccgc

SEQ ID NO: 938080 - RNA, 16 nt, Mycobacterium avium subsp. paratuberculosis
gcgagcuggccgccca

SEQ ID NO: 938081 - RNA, 22 nt, Mycobacterium avium subsp. paratuberculosis
gcgagcuggccgcccaccacga

SEQ ID NO: 938082 - RNA, 14 nt, Mycobacterium avium subsp. paratuberculosis
gcgagcugcgggug

SEQ ID NO: 938083 - RNA, 16 nt, Mycobacterium avium subsp. paratuberculosis
gcgagcugcuucgucg

SEQ ID NO: 938084 - RNA, 17 nt, Mycobacterium avium subsp. paratuberculosis
gcgagcugcuucgucgc

SEQ ID NO: 938085 - RNA, 22 nt, Mycobacterium avium subsp. paratuberculosis
gcgagcugcuucgucgccgggc

SEQ ID NO: 938086 - RNA, 19 nt, Mycobacterium avium subsp. paratuberculosis
gcgagcugccccuucgcga

SEQ ID NO: 938087 - RNA, 15 nt, Mycobacterium avium subsp. paratuberculosis
gcgagcugccggcgg

SEQ ID NO: 938088 - RNA, 16 nt, Mycobacterium avium subsp. paratuberculosis
gcgagcugccggcggc

SEQ ID NO: 938089 - RNA, 18 nt, Mycobacterium avium subsp. paratuberculosis
gcgagcugccggcggccg

SEQ ID NO: 938090 - RNA, 19 nt, Mycobacterium avium subsp. paratuberculosis
gcgagcugccggcggccgc

SEQ ID NO: 938091 - RNA, 17 nt, Mycobacterium avium subsp. paratuberculosis
gcgagcucaggccggcc

SEQ ID NO: 938092 - RNA, 17 nt, Mycobacterium avium subsp. paratuberculosis
gcgagcucgcggccgua

SEQ ID NO: 938093 - RNA, 21 nt, Mycobacterium avium subsp. paratuberculosis
gcgagcucguucucggcgaac

SEQ ID NO: 938094 - RNA, 21 nt, Mycobacterium avium subsp. paratuberculosis
gcgagcugaccggccaccucg

SEQ ID NO: 938095 - RNA, 18 nt, Mycobacterium avium subsp. paratuberculosis
gcgagcugaucggcguug

SEQ ID NO: 938096 - RNA, 20 nt, Mycobacterium avium subsp. paratuberculosis
gcgagcugaucggcguuggc

SEQ ID NO: 938097 - RNA, 21 nt, Mycobacterium avium subsp. paratuberculosis
gcgagcugaucggcguuggcg

SEQ ID NO: 938098 - RNA, 14 nt, Mycobacterium avium subsp. paratuberculosis
gcgagcgcgcggug

SEQ ID NO: 938099 - RNA, 21 nt, Mycobacterium avium subsp. paratuberculosis
gcgagcgcgugcacgaacgcg

SEQ ID NO: 938100 - RNA, 13 nt, Mycobacterium avium subsp. paratuberculosis
gcgagcgcgcugu

SEQ ID NO: 938101 - RNA, 12 nt, Mycobacterium avium subsp. paratuberculosis
gcgagcgcagca

SEQ ID NO: 938102 - RNA, 20 nt, Mycobacterium avium subsp. paratuberculosis
gcgagcagacgcaaaaaccc

SEQ ID NO: 938103 - RNA, 15 nt, Mycobacterium avium subsp. paratuberculosis
gcgagcgcaccagau

SEQ ID NO: 938104 - RNA, 18 nt, Mycobacterium avium subsp. paratuberculosis
gcgagcaaggcgagcacg

SEQ ID NO: 938105 - RNA, 15 nt, Mycobacterium avium subsp. paratuberculosis
gcgagcacagcggcg

SEQ ID NO: 938106 - RNA, 21 nt, Mycobacterium avium subsp. paratuberculosis
gcgagcacggcacgcccguuc

SEQ ID NO: 938107 - RNA, 16 nt, Mycobacterium avium subsp. paratuberculosis
gcgagcacgacgucga

SEQ ID NO: 938108 - RNA, 19 nt, Mycobacterium avium subsp. paratuberculosis
gcgagcacgacgucgacgu

SEQ ID NO: 938109 - RNA, 14 nt, Mycobacterium avium subsp. paratuberculosis
gcgagcacgccgcc

SEQ ID NO: 938110 - RNA, 15 nt, Mycobacterium avium subsp. paratuberculosis
gcgagcaccgcgauc

SEQ ID NO: 938111 - RNA, 14 nt, Mycobacterium avium subsp. paratuberculosis
gcgacgcggcucgc

SEQ ID NO: 938112 - RNA, 18 nt, Mycobacterium avium subsp. paratuberculosis
gcgacgcggcucgcgcgg

SEQ ID NO: 938113 - RNA, 19 nt, Mycobacterium avium subsp. paratuberculosis
gcgacgcggcucgcgcggu

SEQ ID NO: 938114 - RNA, 20 nt, Mycobacterium avium subsp. paratuberculosis
gcgacgcgggauugccgagc

SEQ ID NO: 938115 - RNA, 12 nt, Mycobacterium avium subsp. paratuberculosis
gcgacgcgcggu

SEQ ID NO: 938116 - RNA, 14 nt, Mycobacterium avium subsp. paratuberculosis
gcgacgcgcucggc

SEQ ID NO: 938117 - RNA, 16 nt, Mycobacterium avium subsp. paratuberculosis
gcgacgcgcucggcga

SEQ ID NO: 938118 - RNA, 17 nt, Mycobacterium avium subsp. paratuberculosis
gcgacgcgcucggcgac

SEQ ID NO: 938119 - RNA, 20 nt, Mycobacterium avium subsp. paratuberculosis
gcgacgcgcucggcgaccgc

SEQ ID NO: 938120 - RNA, 14 nt, Mycobacterium avium subsp. paratuberculosis
gcgacgcugagcgc

SEQ ID NO: 938121 - RNA, 19 nt, Mycobacterium avium subsp. paratuberculosis
gcgacgcugagcgccaggc

SEQ ID NO: 938122 - RNA, 20 nt, Mycobacterium avium subsp. paratuberculosis
gcgacgcugagcgccaggcc

SEQ ID NO: 938123 - RNA, 15 nt, Mycobacterium avium subsp. paratuberculosis
gcgacgcugauggcg

SEQ ID NO: 938124 - RNA, 13 nt, Mycobacterium avium subsp. paratuberculosis
gcgacgcugccgg

SEQ ID NO: 938125 - RNA, 14 nt, Mycobacterium avium subsp. paratuberculosis
gcgacgcugccggu

SEQ ID NO: 938126 - RNA, 16 nt, Mycobacterium avium subsp. paratuberculosis
gcgacgcugccggugg

SEQ ID NO: 938127 - RNA, 20 nt, Mycobacterium avium subsp. paratuberculosis
gcgacgcucaggcguccagc

SEQ ID NO: 938128 - RNA, 22 nt, Mycobacterium avium subsp. paratuberculosis
gcgacgcggugagcgcgccggc

SEQ ID NO: 938129 - RNA, 23 nt, Mycobacterium avium subsp. paratuberculosis
gcgacgcggugagcgcgccggcc

SEQ ID NO: 938130 - RNA, 19 nt, Mycobacterium avium subsp. paratuberculosis
gcgacggucgugcugggcc

SEQ ID NO: 938131 - RNA, 20 nt, Mycobacterium avium subsp. paratuberculosis
gcgacggucgugcugggccg

SEQ ID NO: 938132 - RNA, 19 nt, Mycobacterium avium subsp. paratuberculosis
gcgacguacagcgagccgu

SEQ ID NO: 938133 - RNA, 12 nt, Mycobacterium avium subsp. paratuberculosis
gcgacggugagc

SEQ ID NO: 938134 - RNA, 13 nt, Mycobacterium avium subsp. paratuberculosis
gcgacggugagca

SEQ ID NO: 938135 - RNA, 16 nt, Mycobacterium avium subsp. paratuberculosis
gcgacggugcaugcgc

SEQ ID NO: 938136 - RNA, 15 nt, Mycobacterium avium subsp. paratuberculosis
gcgacgguggacccg

SEQ ID NO: 938137 - RNA, 17 nt, Mycobacterium avium subsp. paratuberculosis
gcgacgguggcgcccag

SEQ ID NO: 938138 - RNA, 20 nt, Mycobacterium avium subsp. paratuberculosis
gcgacgguggcgcccagcga

SEQ ID NO: 938139 - RNA, 19 nt, Mycobacterium avium subsp. paratuberculosis
gcgacgguggcggcgaugu

SEQ ID NO: 938140 - RNA, 23 nt, Mycobacterium avium subsp. paratuberculosis
gcgacgguggcggcgaugucguc

SEQ ID NO: 938141 - RNA, 17 nt, Mycobacterium avium subsp. paratuberculosis
gcgacgguggcgggccg

SEQ ID NO: 938142 - RNA, 18 nt, Mycobacterium avium subsp. paratuberculosis
gcgacgguggcgggccgc

SEQ ID NO: 938143 - RNA, 19 nt, Mycobacterium avium subsp. paratuberculosis
gcgacgguggcgggccgcc

SEQ ID NO: 938144 - RNA, 23 nt, Mycobacterium avium subsp. paratuberculosis
gcgacgguggcgggccgccgggu

SEQ ID NO: 938145 - RNA, 17 nt, Mycobacterium avium subsp. paratuberculosis
gcgacgguguccgcggc

SEQ ID NO: 938146 - RNA, 21 nt, Mycobacterium avium subsp. paratuberculosis
gcgacgguguccgcggcgucg

SEQ ID NO: 938147 - RNA, 12 nt, Mycobacterium avium subsp. paratuberculosis
gcgacgggccgg

SEQ ID NO: 938148 - RNA, 18 nt, Mycobacterium avium subsp. paratuberculosis
gcgacgggccgggcacgu

SEQ ID NO: 938149 - RNA, 15 nt, Mycobacterium avium subsp. paratuberculosis
gcgacgggcguccga

SEQ ID NO: 938150 - RNA, 15 nt, Mycobacterium avium subsp. paratuberculosis
gcgacgggcucggcg

SEQ ID NO: 938151 - RNA, 18 nt, Mycobacterium avium subsp. paratuberculosis
gcgacgggcugucccggc

SEQ ID NO: 938152 - RNA, 19 nt, Mycobacterium avium subsp. paratuberculosis
gcgacgggcugucccggcc

SEQ ID NO: 938153 - RNA, 20 nt, Mycobacterium avium subsp. paratuberculosis
gcgacgggcugucccggccg

SEQ ID NO: 938154 - RNA, 18 nt, Mycobacterium avium subsp. paratuberculosis
gcgacgggcacccgcgcg

SEQ ID NO: 938155 - RNA, 22 nt, Mycobacterium avium subsp. paratuberculosis
gcgacgggcacccgcgcgucgc

SEQ ID NO: 938156 - RNA, 13 nt, Mycobacterium avium subsp. paratuberculosis
gcgacgggcaugc

SEQ ID NO: 938157 - RNA, 12 nt, Mycobacterium avium subsp. paratuberculosis
gcgacgggccga

SEQ ID NO: 938158 - RNA, 15 nt, Mycobacterium avium subsp. paratuberculosis
gcgacgggccgauca

SEQ ID NO: 938159 - RNA, 20 nt, Mycobacterium avium subsp. paratuberculosis
gcgacggggugguucguccg

SEQ ID NO: 938160 - RNA, 17 nt, Mycobacterium avium subsp. paratuberculosis
gcgacggguugcggauc

SEQ ID NO: 938161 - RNA, 18 nt, Mycobacterium avium subsp. paratuberculosis
gcgacggucacgcuggcg

SEQ ID NO: 938162 - RNA, 21 nt, Mycobacterium avium subsp. paratuberculosis
gcgacggucacgcuggcguga

SEQ ID NO: 938163 - RNA, 17 nt, Mycobacterium avium subsp. paratuberculosis
gcgacucguuggccggc

SEQ ID NO: 938164 - RNA, 19 nt, Mycobacterium avium subsp. paratuberculosis
gcgacgucggagaucaggg

SEQ ID NO: 938165 - RNA, 16 nt, Mycobacterium avium subsp. paratuberculosis
gcgacuccggcgccgg

SEQ ID NO: 938166 - RNA, 18 nt, Mycobacterium avium subsp. paratuberculosis
gcgacuccggcgccgguc

SEQ ID NO: 938167 - RNA, 20 nt, Mycobacterium avium subsp. paratuberculosis
gcgacuccggcgccggucag

SEQ ID NO: 938168 - RNA, 14 nt, Mycobacterium avium subsp. paratuberculosis
gcgacuccugacgc

SEQ ID NO: 938169 - RNA, 21 nt, Mycobacterium avium subsp. paratuberculosis
gcgacuccugacgcaccucgc

SEQ ID NO: 938170 - RNA, 18 nt, Mycobacterium avium subsp. paratuberculosis
gcgacuccugguccucga

SEQ ID NO: 938171 - RNA, 21 nt, Mycobacterium avium subsp. paratuberculosis
gcgacuccugguccucgaucc

SEQ ID NO: 938172 - RNA, 23 nt, Mycobacterium avium subsp. paratuberculosis
gcgacgucggggucgucgcgguc

SEQ ID NO: 938173 - RNA, 15 nt, Mycobacterium avium subsp. paratuberculosis
gcgacgucggucggc

SEQ ID NO: 938174 - RNA, 22 nt, Mycobacterium avium subsp. paratuberculosis
gcgacgucgguguagucggcga

SEQ ID NO: 938175 - RNA, 13 nt, Mycobacterium avium subsp. paratuberculosis
gcgacgucgucga

SEQ ID NO: 938176 - RNA, 14 nt, Mycobacterium avium subsp. paratuberculosis
gcgacgucgucgau

SEQ ID NO: 938177 - RNA, 15 nt, Mycobacterium avium subsp. paratuberculosis
gcgacuccagcgcga

SEQ ID NO: 938178 - RNA, 17 nt, Mycobacterium avium subsp. paratuberculosis
gcgacuccagcgcgauc

SEQ ID NO: 938179 - RNA, 19 nt, Mycobacterium avium subsp. paratuberculosis
gcgacuccagcgcgaucaa

SEQ ID NO: 938180 - RNA, 15 nt, Mycobacterium avium subsp. paratuberculosis
gcgacguccggucag

SEQ ID NO: 938181 - RNA, 21 nt, Mycobacterium avium subsp. paratuberculosis
gcgacgucaggucgaccggcu

SEQ ID NO: 938182 - RNA, 12 nt, Mycobacterium avium subsp. paratuberculosis
gcgacgucgacc

SEQ ID NO: 938183 - RNA, 14 nt, Mycobacterium avium subsp. paratuberculosis
gcgacgucgaccgc

SEQ ID NO: 938184 - RNA, 16 nt, Mycobacterium avium subsp. paratuberculosis
gcgacgucgaccgcga

SEQ ID NO: 938185 - RNA, 17 nt, Mycobacterium avium subsp. paratuberculosis
gcgacgucgacggcagc

SEQ ID NO: 938186 - RNA, 13 nt, Mycobacterium avium subsp. paratuberculosis
gcgacgucgccgg

SEQ ID NO: 938187 - RNA, 18 nt, Mycobacterium avium subsp. paratuberculosis
gcgacgucgccggccugc

SEQ ID NO: 938188 - RNA, 21 nt, Mycobacterium avium subsp. paratuberculosis
gcgacgguuguucagcccggu

SEQ ID NO: 938189 - RNA, 15 nt, Mycobacterium avium subsp. paratuberculosis
gcgagaagucgccga

SEQ ID NO: 938190 - RNA, 20 nt, Mycobacterium avium subsp. paratuberculosis
gcgagauuggauuccagauc

SEQ ID NO: 938191 - RNA, 23 nt, Mycobacterium avium subsp. paratuberculosis
gcgagaugaucagccgcccgauc

SEQ ID NO: 938192 - RNA, 16 nt, Mycobacterium avium subsp. paratuberculosis
gcgagaugcccacccg

SEQ ID NO: 938193 - RNA, 17 nt, Mycobacterium avium subsp. paratuberculosis
gcgagaugcccacccgc

SEQ ID NO: 938194 - RNA, 22 nt, Mycobacterium avium subsp. paratuberculosis
gcgagaugcccacccgcucggc

SEQ ID NO: 938195 - RNA, 12 nt, Mycobacterium avium subsp. paratuberculosis
gcgagaaccggc

SEQ ID NO: 938196 - RNA, 15 nt, Mycobacterium avium subsp. paratuberculosis
gcgacuugccgccgg

SEQ ID NO: 938197 - RNA, 16 nt, Mycobacterium avium subsp. paratuberculosis
gcgacuugccgccggc

SEQ ID NO: 938198 - RNA, 19 nt, Mycobacterium avium subsp. paratuberculosis
gcgacuugccgccggcgca

SEQ ID NO: 938199 - RNA, 13 nt, Mycobacterium avium subsp. paratuberculosis
gcgacuugcgcgc

SEQ ID NO: 938200 - RNA, 14 nt, Mycobacterium avium subsp. paratuberculosis
gcgacuugcgcgcc

SEQ ID NO: 938201 - RNA, 20 nt, Mycobacterium avium subsp. paratuberculosis
gcgacuugcgcgccgugacg

SEQ ID NO: 938202 - RNA, 24 nt, Mycobacterium avium subsp. paratuberculosis
gcgacacugcaacuacgcacccga

SEQ ID NO: 938203 - RNA, 20 nt, Mycobacterium avium subsp. paratuberculosis
gcgacacgucgacacgccgg

SEQ ID NO: 938204 - RNA, 21 nt, Mycobacterium avium subsp. paratuberculosis
gcgacacgucgacacgccggc

SEQ ID NO: 938205 - RNA, 20 nt, Mycobacterium avium subsp. paratuberculosis
gcgacacggaaaccgcugcg

SEQ ID NO: 938206 - RNA, 16 nt, Mycobacterium avium subsp. paratuberculosis
gcgacagcagcguggu

SEQ ID NO: 938207 - RNA, 15 nt, Mycobacterium avium subsp. paratuberculosis
gcgacaucggcgccg

SEQ ID NO: 938208 - RNA, 23 nt, Mycobacterium avium subsp. paratuberculosis
gcgacaucggugaccgucgccga

SEQ ID NO: 938209 - RNA, 18 nt, Mycobacterium avium subsp. paratuberculosis
gcgacagccgggaaucga

SEQ ID NO: 938210 - RNA, 15 nt, Mycobacterium avium subsp. paratuberculosis
gcgacagccgcccgg

SEQ ID NO: 938211 - RNA, 19 nt, Mycobacterium avium subsp. paratuberculosis
gcgacagccgcccggcgcc

SEQ ID NO: 938212 - RNA, 14 nt, Mycobacterium avium subsp. paratuberculosis
gcgacagcgcgucg

SEQ ID NO: 938213 - RNA, 22 nt, Mycobacterium avium subsp. paratuberculosis
gcgacaucaccgcgggcgcgcc

SEQ ID NO: 938214 - RNA, 16 nt, Mycobacterium avium subsp. paratuberculosis
gcgacaucgccgcggc

SEQ ID NO: 938215 - RNA, 17 nt, Mycobacterium avium subsp. paratuberculosis
gcgacaucgccgcggcc

SEQ ID NO: 938216 - RNA, 20 nt, Mycobacterium avium subsp. paratuberculosis
gcgacaucgccgcggccgga

SEQ ID NO: 938217 - RNA, 16 nt, Mycobacterium avium subsp. paratuberculosis
gcgacaucgccggcga

SEQ ID NO: 938218 - RNA, 16 nt, Mycobacterium avium subsp. paratuberculosis
gcgacaucggcacacg

SEQ ID NO: 938219 - RNA, 16 nt, Mycobacterium avium subsp. paratuberculosis
gcgacauggucgggcg

SEQ ID NO: 938220 - RNA, 21 nt, Mycobacterium avium subsp. paratuberculosis
gcgacauggucgggcgcacca

SEQ ID NO: 938221 - RNA, 22 nt, Mycobacterium avium subsp. paratuberculosis
gcgacauguccgggauggacga

SEQ ID NO: 938222 - RNA, 23 nt, Mycobacterium avium subsp. paratuberculosis
gcgacaucucggugaggugggcg

SEQ ID NO: 938223 - RNA, 19 nt, Mycobacterium avium subsp. paratuberculosis
gcgacaugaccaccgcguc

SEQ ID NO: 938224 - RNA, 13 nt, Mycobacterium avium subsp. paratuberculosis
gcgacaugcccgc

SEQ ID NO: 938225 - RNA, 15 nt, Mycobacterium avium subsp. paratuberculosis
gcgacaugcccgcgg

SEQ ID NO: 938226 - RNA, 19 nt, Mycobacterium avium subsp. paratuberculosis
gcgacauuggccgcgcgca

SEQ ID NO: 938227 - RNA, 21 nt, Mycobacterium avium subsp. paratuberculosis
gcgacauuggccgcgcgcagg

SEQ ID NO: 938228 - RNA, 15 nt, Mycobacterium avium subsp. paratuberculosis
gcgacaugcgcagcg

SEQ ID NO: 938229 - RNA, 16 nt, Mycobacterium avium subsp. paratuberculosis
gcgaccacgaacaccg

SEQ ID NO: 938230 - RNA, 18 nt, Mycobacterium avium subsp. paratuberculosis
gcgaccacgaacaccggc

SEQ ID NO: 938231 - RNA, 19 nt, Mycobacterium avium subsp. paratuberculosis
gcgaccacgaacaccggcg

SEQ ID NO: 938232 - RNA, 13 nt, Mycobacterium avium subsp. paratuberculosis
aagccccaggccc

SEQ ID NO: 938233 - RNA, 21 nt, Mycobacterium avium subsp. paratuberculosis
aagccccgguuccaaccaccg

SEQ ID NO: 938234 - RNA, 14 nt, Mycobacterium avium subsp. paratuberculosis
gcgaauuguucugc

SEQ ID NO: 938235 - RNA, 22 nt, Mycobacterium avium subsp. paratuberculosis
gcgaauucgcagguucgacacg

SEQ ID NO: 938236 - RNA, 17 nt, Mycobacterium avium subsp. paratuberculosis
gcgaauuccucagcgcc

SEQ ID NO: 938237 - RNA, 18 nt, Mycobacterium avium subsp. paratuberculosis
gcgaauuccucagcgccc

SEQ ID NO: 938238 - RNA, 21 nt, Mycobacterium avium subsp. paratuberculosis
gcgaauuccucagcgccccaa

SEQ ID NO: 938239 - RNA, 19 nt, Mycobacterium avium subsp. paratuberculosis
gcgacaaaggaggggcgcg

SEQ ID NO: 938240 - RNA, 15 nt, Mycobacterium avium subsp. paratuberculosis
gcgacaacagcacga

SEQ ID NO: 938241 - RNA, 15 nt, Mycobacterium avium subsp. paratuberculosis
gcgacaacgggccgc

SEQ ID NO: 938242 - RNA, 17 nt, Mycobacterium avium subsp. paratuberculosis
gcgacaacgggccgccu

SEQ ID NO: 938243 - RNA, 21 nt, Mycobacterium avium subsp. paratuberculosis
gcgacaacguggugugcacca

SEQ ID NO: 938244 - RNA, 20 nt, Mycobacterium avium subsp. paratuberculosis
gcgacaaggucgaccgcgca

SEQ ID NO: 938245 - RNA, 21 nt, Mycobacterium avium subsp. paratuberculosis
gcgacaaggucgaccgcgcac

SEQ ID NO: 938246 - RNA, 22 nt, Mycobacterium avium subsp. paratuberculosis
gcgacacgccgacgauccgcgc

SEQ ID NO: 938247 - RNA, 15 nt, Mycobacterium avium subsp. paratuberculosis
gcgacaacggccccc

SEQ ID NO: 938248 - RNA, 20 nt, Mycobacterium avium subsp. paratuberculosis
gcgacaacggcccccacgag

SEQ ID NO: 938249 - RNA, 13 nt, Mycobacterium avium subsp. paratuberculosis
gcgacaacagcgc

SEQ ID NO: 938250 - RNA, 17 nt, Mycobacterium avium subsp. paratuberculosis
gcgacaacagcgccgag

SEQ ID NO: 938251 - RNA, 17 nt, Mycobacterium avium subsp. paratuberculosis
gcgacaacaggcgaccu

SEQ ID NO: 938252 - RNA, 14 nt, Mycobacterium avium subsp. paratuberculosis
gcgaaucgaccggg

SEQ ID NO: 938253 - RNA, 20 nt, Mycobacterium avium subsp. paratuberculosis
gcgaaucgaccggguuggcg

SEQ ID NO: 938254 - RNA, 17 nt, Mycobacterium avium subsp. paratuberculosis
gcgaauccgggugucga

SEQ ID NO: 938255 - RNA, 20 nt, Mycobacterium avium subsp. paratuberculosis
gcgaauccggucaacgccgc

SEQ ID NO: 938256 - RNA, 21 nt, Mycobacterium avium subsp. paratuberculosis
gcgaauccggucaacgccgcg

SEQ ID NO: 938257 - RNA, 22 nt, Mycobacterium avium subsp. paratuberculosis
gcgaauccggucaacgccgcgc

SEQ ID NO: 938258 - RNA, 13 nt, Mycobacterium avium subsp. paratuberculosis
gcgaaucccggcc

SEQ ID NO: 938259 - RNA, 17 nt, Mycobacterium avium subsp. paratuberculosis
gcgaaucgguccggcga

SEQ ID NO: 938260 - RNA, 15 nt, Mycobacterium avium subsp. paratuberculosis
gcgaaucgucggcga

SEQ ID NO: 938261 - RNA, 18 nt, Mycobacterium avium subsp. paratuberculosis
gcgaaucugucgauggcg

SEQ ID NO: 938262 - RNA, 18 nt, Mycobacterium avium subsp. paratuberculosis
gcgaccagcgcgccggcc

SEQ ID NO: 938263 - RNA, 21 nt, Mycobacterium avium subsp. paratuberculosis
gcgaccagcgcgccggccagc

SEQ ID NO: 938264 - RNA, 15 nt, Mycobacterium avium subsp. paratuberculosis
gcgaccagcggcagc

SEQ ID NO: 938265 - RNA, 19 nt, Mycobacterium avium subsp. paratuberculosis
gcgaccagguucucggugg

SEQ ID NO: 938266 - RNA, 18 nt, Mycobacterium avium subsp. paratuberculosis
gcgaccaguaccgggccu

SEQ ID NO: 938267 - RNA, 20 nt, Mycobacterium avium subsp. paratuberculosis
gcgaccaguagaaguggccg

SEQ ID NO: 938268 - RNA, 15 nt, Mycobacterium avium subsp. paratuberculosis
gcgaccagucggcgu

SEQ ID NO: 938269 - RNA, 22 nt, Mycobacterium avium subsp. paratuberculosis
gcgaccagugcaccucgacgaa

SEQ ID NO: 938270 - RNA, 17 nt, Mycobacterium avium subsp. paratuberculosis
gcgaccaggcccagcgg

SEQ ID NO: 938271 - RNA, 18 nt, Mycobacterium avium subsp. paratuberculosis
gcgaccaggcccagcgga

SEQ ID NO: 938272 - RNA, 15 nt, Mycobacterium avium subsp. paratuberculosis
gcgaccaucagcccg

SEQ ID NO: 938273 - RNA, 16 nt, Mycobacterium avium subsp. paratuberculosis
gcgaccaucagcccgg

SEQ ID NO: 938274 - RNA, 19 nt, Mycobacterium avium subsp. paratuberculosis
gcgaccaucagcccgguga

SEQ ID NO: 938275 - RNA, 22 nt, Mycobacterium avium subsp. paratuberculosis
gcgaccaucagcccggugacga

SEQ ID NO: 938276 - RNA, 22 nt, Mycobacterium avium subsp. paratuberculosis
gcgaccaucagccugcggugau

SEQ ID NO: 938277 - RNA, 17 nt, Mycobacterium avium subsp. paratuberculosis
gcgaccauccacucggg

SEQ ID NO: 938278 - RNA, 18 nt, Mycobacterium avium subsp. paratuberculosis
gcgacccgcucgacgcgc

SEQ ID NO: 938279 - RNA, 19 nt, Mycobacterium avium subsp. paratuberculosis
gcgacccgcuucgcccggc

SEQ ID NO: 938280 - RNA, 22 nt, Mycobacterium avium subsp. paratuberculosis
gcgacccgcuucgcccggcugc

SEQ ID NO: 938281 - RNA, 19 nt, Mycobacterium avium subsp. paratuberculosis
gcgaccggccccaacggcg

SEQ ID NO: 938282 - RNA, 12 nt, Mycobacterium avium subsp. paratuberculosis
gcgaccgguccg

SEQ ID NO: 938283 - RNA, 16 nt, Mycobacterium avium subsp. paratuberculosis
gcgaccgguccgugcc

SEQ ID NO: 938284 - RNA, 22 nt, Mycobacterium avium subsp. paratuberculosis
gcgaccgguccgugccacggcc

SEQ ID NO: 938285 - RNA, 23 nt, Mycobacterium avium subsp. paratuberculosis
gcgaccgguccgugccacggccg

SEQ ID NO: 938286 - RNA, 23 nt, Mycobacterium avium subsp. paratuberculosis
gcgaccgcggaugacgggugcuc

SEQ ID NO: 938287 - RNA, 19 nt, Mycobacterium avium subsp. paratuberculosis
gcgaccgcggccgcgacgg

SEQ ID NO: 938288 - RNA, 12 nt, Mycobacterium avium subsp. paratuberculosis
gcgaccgcgcag

SEQ ID NO: 938289 - RNA, 15 nt, Mycobacterium avium subsp. paratuberculosis
gcgaccgcgcgcggc

SEQ ID NO: 938290 - RNA, 19 nt, Mycobacterium avium subsp. paratuberculosis
gcgaccgcgcgcggcgccg

SEQ ID NO: 938291 - RNA, 15 nt, Mycobacterium avium subsp. paratuberculosis
gcgaccgcgucgacg

SEQ ID NO: 938292 - RNA, 18 nt, Mycobacterium avium subsp. paratuberculosis
gcgaccgcgucgacggcg

SEQ ID NO: 938293 - RNA, 16 nt, Mycobacterium avium subsp. paratuberculosis
gcgaccgcgaucaggg

SEQ ID NO: 938294 - RNA, 13 nt, Mycobacterium avium subsp. paratuberculosis
gcgacccggccga

SEQ ID NO: 938295 - RNA, 23 nt, Mycobacterium avium subsp. paratuberculosis
gcgacccggccgagcgcgccgag

SEQ ID NO: 938296 - RNA, 17 nt, Mycobacterium avium subsp. paratuberculosis
gcgacccgggccgccac

SEQ ID NO: 938297 - RNA, 18 nt, Mycobacterium avium subsp. paratuberculosis
gcgacccgggccgccacg

SEQ ID NO: 938298 - RNA, 23 nt, Mycobacterium avium subsp. paratuberculosis
gcgaccuguuugaacaccucgaa

SEQ ID NO: 938299 - RNA, 20 nt, Mycobacterium avium subsp. paratuberculosis
gcgaccuguuuggccagcca

SEQ ID NO: 938300 - RNA, 21 nt, Mycobacterium avium subsp. paratuberculosis
gcgaccuguuuggccagccag

SEQ ID NO: 938301 - RNA, 18 nt, Mycobacterium avium subsp. paratuberculosis
gcgaccugguccaccgcg

SEQ ID NO: 938302 - RNA, 19 nt, Mycobacterium avium subsp. paratuberculosis
gcgaccugguccaccgcgg

SEQ ID NO: 938303 - RNA, 20 nt, Mycobacterium avium subsp. paratuberculosis
gcgaccugguccaccgcggc

SEQ ID NO: 938304 - RNA, 22 nt, Mycobacterium avium subsp. paratuberculosis
gcgaccuggugcucgaugcgac

SEQ ID NO: 938305 - RNA, 15 nt, Mycobacterium avium subsp. paratuberculosis
gcgaccgucgggacg

SEQ ID NO: 938306 - RNA, 15 nt, Mycobacterium avium subsp. paratuberculosis
gcgaccuggacgccg

SEQ ID NO: 938307 - RNA, 18 nt, Mycobacterium avium subsp. paratuberculosis
gcgaccuggacgccgcac

SEQ ID NO: 938308 - RNA, 22 nt, Mycobacterium avium subsp. paratuberculosis
gcgaccuugcgcagccggcagc

SEQ ID NO: 938309 - RNA, 17 nt, Mycobacterium avium subsp. paratuberculosis
gcgaccuugcggcgcga

SEQ ID NO: 938310 - RNA, 23 nt, Mycobacterium avium subsp. paratuberculosis
gcgacgaaaaugcccagugucgc

SEQ ID NO: 938311 - RNA, 16 nt, Mycobacterium avium subsp. paratuberculosis
gcgacgaacagcaccg

SEQ ID NO: 938312 - RNA, 19 nt, Mycobacterium avium subsp. paratuberculosis
gcgacgaacagcaccgcca

SEQ ID NO: 938313 - RNA, 21 nt, Mycobacterium avium subsp. paratuberculosis
gcgacgaacagcaccgccacg

SEQ ID NO: 938314 - RNA, 17 nt, Mycobacterium avium subsp. paratuberculosis
gcgacgaccucgcccgc

SEQ ID NO: 938315 - RNA, 19 nt, Mycobacterium avium subsp. paratuberculosis
gcgacgaccucgcccgccg

SEQ ID NO: 938316 - RNA, 23 nt, Mycobacterium avium subsp. paratuberculosis
gcgacgagagcggaucggcggcg

SEQ ID NO: 938317 - RNA, 14 nt, Mycobacterium avium subsp. paratuberculosis
gcgacgagcgggcc

SEQ ID NO: 938318 - RNA, 20 nt, Mycobacterium avium subsp. paratuberculosis
gcgacgaucagcagccgggc

SEQ ID NO: 938319 - RNA, 22 nt, Mycobacterium avium subsp. paratuberculosis
gcgacgaucagcagccgggccu

SEQ ID NO: 938320 - RNA, 15 nt, Mycobacterium avium subsp. paratuberculosis
gcgacgauaucggcc

SEQ ID NO: 938321 - RNA, 19 nt, Mycobacterium avium subsp. paratuberculosis
gcgacgccaugucgauguc

SEQ ID NO: 938322 - RNA, 12 nt, Mycobacterium avium subsp. paratuberculosis
gcgacgcccaga

SEQ ID NO: 938323 - RNA, 19 nt, Mycobacterium avium subsp. paratuberculosis
gcgacgcccagaacgacgc

SEQ ID NO: 938324 - RNA, 13 nt, Mycobacterium avium subsp. paratuberculosis
gcgacgccgccgc

SEQ ID NO: 938325 - RNA, 16 nt, Mycobacterium avium subsp. paratuberculosis
gcgacgccgccgccga

SEQ ID NO: 938326 - RNA, 17 nt, Mycobacterium avium subsp. paratuberculosis
gcgacgccgccgccgag

SEQ ID NO: 938327 - RNA, 19 nt, Mycobacterium avium subsp. paratuberculosis
gcgacgccgccgucguagc

SEQ ID NO: 938328 - RNA, 17 nt, Mycobacterium avium subsp. paratuberculosis
gcgacgccgcgcuggcc

SEQ ID NO: 938329 - RNA, 18 nt, Mycobacterium avium subsp. paratuberculosis
gcgacgccgcgcuggccg

SEQ ID NO: 938330 - RNA, 21 nt, Mycobacterium avium subsp. paratuberculosis
gcgacgccgcgcuggccgggu

SEQ ID NO: 938331 - RNA, 14 nt, Mycobacterium avium subsp. paratuberculosis
gcgacgccgcggaa

SEQ ID NO: 938332 - RNA, 23 nt, Mycobacterium avium subsp. paratuberculosis
gcgacgccgacgcccagcgcggc

SEQ ID NO: 938333 - RNA, 14 nt, Mycobacterium avium subsp. paratuberculosis
gcgacgccgcgcag

SEQ ID NO: 938334 - RNA, 14 nt, Mycobacterium avium subsp. paratuberculosis
gcgacgccgcgcug

SEQ ID NO: 938335 - RNA, 12 nt, Mycobacterium avium subsp. paratuberculosis
gcgacgccguca

SEQ ID NO: 938336 - RNA, 15 nt, Mycobacterium avium subsp. paratuberculosis
gcgacgccgucgggg

SEQ ID NO: 938337 - RNA, 13 nt, Mycobacterium avium subsp. paratuberculosis
aagccacccgcgc

SEQ ID NO: 938338 - RNA, 12 nt, Mycobacterium avium subsp. paratuberculosis
gccuccggagug

SEQ ID NO: 938339 - RNA, 22 nt, Mycobacterium avium subsp. paratuberculosis
gccuccggagugacgucgcgcg

SEQ ID NO: 938340 - RNA, 23 nt, Mycobacterium avium subsp. paratuberculosis
gccuccggagugacgucgcgcgg

SEQ ID NO: 938341 - RNA, 22 nt, Mycobacterium avium subsp. paratuberculosis
gccucaugccagacgcgcaccg

SEQ ID NO: 938342 - RNA, 19 nt, Mycobacterium avium subsp. paratuberculosis
gccuccgggaaggcggccg

SEQ ID NO: 938343 - RNA, 15 nt, Mycobacterium avium subsp. paratuberculosis
gccuccgggcugccg

SEQ ID NO: 938344 - RNA, 18 nt, Mycobacterium avium subsp. paratuberculosis
gccuccgguuugcgccgg

SEQ ID NO: 938345 - RNA, 19 nt, Mycobacterium avium subsp. paratuberculosis
gccuccgguuugcgccggc

SEQ ID NO: 938346 - RNA, 20 nt, Mycobacterium avium subsp. paratuberculosis
gccuccgguuugcgccggcu

SEQ ID NO: 938347 - RNA, 23 nt, Mycobacterium avium subsp. paratuberculosis
gccuccgguuugcgccggcucca

SEQ ID NO: 938348 - RNA, 16 nt, Mycobacterium avium subsp. paratuberculosis
gccuccgucagcgccg

SEQ ID NO: 938349 - RNA, 17 nt, Mycobacterium avium subsp. paratuberculosis
gccuccgucagcgccgc

SEQ ID NO: 938350 - RNA, 16 nt, Mycobacterium avium subsp. paratuberculosis
gccuccgugcuggccg

SEQ ID NO: 938351 - RNA, 19 nt, Mycobacterium avium subsp. paratuberculosis
gccuccucggugaccucga

SEQ ID NO: 938352 - RNA, 21 nt, Mycobacterium avium subsp. paratuberculosis
gccuccucggugaccucgaag

SEQ ID NO: 938353 - RNA, 15 nt, Mycobacterium avium subsp. paratuberculosis
gccuccucggugagc

SEQ ID NO: 938354 - RNA, 13 nt, Mycobacterium avium subsp. paratuberculosis
gccuccuccucgc

SEQ ID NO: 938355 - RNA, 17 nt, Mycobacterium avium subsp. paratuberculosis
gccuccuccucgcugcc

SEQ ID NO: 938356 - RNA, 20 nt, Mycobacterium avium subsp. paratuberculosis
gccuccuccucgcugccggc

SEQ ID NO: 938357 - RNA, 15 nt, Mycobacterium avium subsp. paratuberculosis
gccuccucgaugucg

SEQ ID NO: 938358 - RNA, 16 nt, Mycobacterium avium subsp. paratuberculosis
gccuccucgaugucgg

SEQ ID NO: 938359 - RNA, 20 nt, Mycobacterium avium subsp. paratuberculosis
gccuccugcuggcgcugcca

SEQ ID NO: 938360 - RNA, 17 nt, Mycobacterium avium subsp. paratuberculosis
gccucgaagucgccggc

SEQ ID NO: 938361 - RNA, 18 nt, Mycobacterium avium subsp. paratuberculosis
gccucgaagucgccggcc

SEQ ID NO: 938362 - RNA, 18 nt, Mycobacterium avium subsp. paratuberculosis
gccuccuguuggcccugc

SEQ ID NO: 938363 - RNA, 15 nt, Mycobacterium avium subsp. paratuberculosis
gccucgaacaucggc

SEQ ID NO: 938364 - RNA, 18 nt, Mycobacterium avium subsp. paratuberculosis
gccucgaacaucggcacg

SEQ ID NO: 938365 - RNA, 21 nt, Mycobacterium avium subsp. paratuberculosis
gccuccccauccgcggccacc

SEQ ID NO: 938366 - RNA, 15 nt, Mycobacterium avium subsp. paratuberculosis
gccucccacagcgga

SEQ ID NO: 938367 - RNA, 20 nt, Mycobacterium avium subsp. paratuberculosis
gccucccacucgucgaucga

SEQ ID NO: 938368 - RNA, 22 nt, Mycobacterium avium subsp. paratuberculosis
gccuccagguagacgaugccca

SEQ ID NO: 938369 - RNA, 21 nt, Mycobacterium avium subsp. paratuberculosis
gccuccauucgggccagcgcc

SEQ ID NO: 938370 - RNA, 22 nt, Mycobacterium avium subsp. paratuberculosis
gccuccaggcugaaucccuccg

SEQ ID NO: 938371 - RNA, 20 nt, Mycobacterium avium subsp. paratuberculosis
gccuccagcuguugacgggc

SEQ ID NO: 938372 - RNA, 15 nt, Mycobacterium avium subsp. paratuberculosis
gccuccagccggcgg

SEQ ID NO: 938373 - RNA, 12 nt, Mycobacterium avium subsp. paratuberculosis
gccuccgcgcgc

SEQ ID NO: 938374 - RNA, 15 nt, Mycobacterium avium subsp. paratuberculosis
gccuccgcgaucagc

SEQ ID NO: 938375 - RNA, 18 nt, Mycobacterium avium subsp. paratuberculosis
gccuccgcgaucagcucg

SEQ ID NO: 938376 - RNA, 21 nt, Mycobacterium avium subsp. paratuberculosis
gccucccgguaggcggcgaga

SEQ ID NO: 938377 - RNA, 19 nt, Mycobacterium avium subsp. paratuberculosis
gccuccgcccgggugcagg

SEQ ID NO: 938378 - RNA, 13 nt, Mycobacterium avium subsp. paratuberculosis
gccuccgccgccc

SEQ ID NO: 938379 - RNA, 15 nt, Mycobacterium avium subsp. paratuberculosis
gccucccgcagcgcc

SEQ ID NO: 938380 - RNA, 18 nt, Mycobacterium avium subsp. paratuberculosis
gccucccgcagcgccagc

SEQ ID NO: 938381 - RNA, 13 nt, Mycobacterium avium subsp. paratuberculosis
gccucccggacca

SEQ ID NO: 938382 - RNA, 18 nt, Mycobacterium avium subsp. paratuberculosis
gccuccgacagccgcacc

SEQ ID NO: 938383 - RNA, 14 nt, Mycobacterium avium subsp. paratuberculosis
gccuccgaccagcc

SEQ ID NO: 938384 - RNA, 15 nt, Mycobacterium avium subsp. paratuberculosis
gccuccgaccagccg

SEQ ID NO: 938385 - RNA, 16 nt, Mycobacterium avium subsp. paratuberculosis
gccuccgaccagccgg

SEQ ID NO: 938386 - RNA, 18 nt, Mycobacterium avium subsp. paratuberculosis
gccuccgaccagccgguc

SEQ ID NO: 938387 - RNA, 12 nt, Mycobacterium avium subsp. paratuberculosis
gccuccgacccg

SEQ ID NO: 938388 - RNA, 20 nt, Mycobacterium avium subsp. paratuberculosis
gccuccgacccguccagcgu

SEQ ID NO: 938389 - RNA, 13 nt, Mycobacterium avium subsp. paratuberculosis
gccuccgagcggc

SEQ ID NO: 938390 - RNA, 17 nt, Mycobacterium avium subsp. paratuberculosis
gccuccgagcggcgcag

SEQ ID NO: 938391 - RNA, 23 nt, Mycobacterium avium subsp. paratuberculosis
gccucagugucguggcgacaucg

SEQ ID NO: 938392 - RNA, 14 nt, Mycobacterium avium subsp. paratuberculosis
gccucaggcgucgg

SEQ ID NO: 938393 - RNA, 16 nt, Mycobacterium avium subsp. paratuberculosis
gccucaggcgucgguc

SEQ ID NO: 938394 - RNA, 18 nt, Mycobacterium avium subsp. paratuberculosis
gccucaggcgucggucag

SEQ ID NO: 938395 - RNA, 19 nt, Mycobacterium avium subsp. paratuberculosis
gccucagggcgcgcugucg

SEQ ID NO: 938396 - RNA, 20 nt, Mycobacterium avium subsp. paratuberculosis
gccucagggcgcgcugucga

SEQ ID NO: 938397 - RNA, 22 nt, Mycobacterium avium subsp. paratuberculosis
gccucagggcgcgcugucgacg

SEQ ID NO: 938398 - RNA, 15 nt, Mycobacterium avium subsp. paratuberculosis
gccucaggcgagcac

SEQ ID NO: 938399 - RNA, 19 nt, Mycobacterium avium subsp. paratuberculosis
gccucaggcgagcacccgg

SEQ ID NO: 938400 - RNA, 15 nt, Mycobacterium avium subsp. paratuberculosis
gccucagcgcgcaac

SEQ ID NO: 938401 - RNA, 24 nt, Mycobacterium avium subsp. paratuberculosis
gccuccagccagcgcgcgaucagc

SEQ ID NO: 938402 - RNA, 17 nt, Mycobacterium avium subsp. paratuberculosis
gccuccagccgcgcggc

SEQ ID NO: 938403 - RNA, 16 nt, Mycobacterium avium subsp. paratuberculosis
gccuccagccgcuccg

SEQ ID NO: 938404 - RNA, 14 nt, Mycobacterium avium subsp. paratuberculosis
gccuccagccggcg

SEQ ID NO: 938405 - RNA, 16 nt, Mycobacterium avium subsp. paratuberculosis
gccuccacgucaccga

SEQ ID NO: 938406 - RNA, 13 nt, Mycobacterium avium subsp. paratuberculosis
gccuccagcacgu

SEQ ID NO: 938407 - RNA, 16 nt, Mycobacterium avium subsp. paratuberculosis
gccuccagcacgucgg

SEQ ID NO: 938408 - RNA, 20 nt, Mycobacterium avium subsp. paratuberculosis
gccuccagcacgucggggug

SEQ ID NO: 938409 - RNA, 21 nt, Mycobacterium avium subsp. paratuberculosis
gccuccagcacgucggggugg

SEQ ID NO: 938410 - RNA, 17 nt, Mycobacterium avium subsp. paratuberculosis
gccuccaccaccauguc

SEQ ID NO: 938411 - RNA, 22 nt, Mycobacterium avium subsp. paratuberculosis
gccuccaccaccaugucguuga

SEQ ID NO: 938412 - RNA, 15 nt, Mycobacterium avium subsp. paratuberculosis
gccuccaccagcggc

SEQ ID NO: 938413 - RNA, 17 nt, Mycobacterium avium subsp. paratuberculosis
gccucacagcgacaacg

SEQ ID NO: 938414 - RNA, 19 nt, Mycobacterium avium subsp. paratuberculosis
gccuaggggagcagcacga

SEQ ID NO: 938415 - RNA, 18 nt, Mycobacterium avium subsp. paratuberculosis
gccuacuugcggccgcga

SEQ ID NO: 938416 - RNA, 15 nt, Mycobacterium avium subsp. paratuberculosis
gccuaugccgcguga

SEQ ID NO: 938417 - RNA, 14 nt, Mycobacterium avium subsp. paratuberculosis
gccuaugcgcccgg

SEQ ID NO: 938418 - RNA, 15 nt, Mycobacterium avium subsp. paratuberculosis
gccuaugcgcccggg

SEQ ID NO: 938419 - RNA, 14 nt, Mycobacterium avium subsp. paratuberculosis
gccucgccgcuggg

SEQ ID NO: 938420 - RNA, 16 nt, Mycobacterium avium subsp. paratuberculosis
gccucgucgaccgcgg

SEQ ID NO: 938421 - RNA, 20 nt, Mycobacterium avium subsp. paratuberculosis
gccucgucgaccgcggccug

SEQ ID NO: 938422 - RNA, 13 nt, Mycobacterium avium subsp. paratuberculosis
gccucgucgccgc

SEQ ID NO: 938423 - RNA, 14 nt, Mycobacterium avium subsp. paratuberculosis
gccucgucgacguc

SEQ ID NO: 938424 - RNA, 13 nt, Mycobacterium avium subsp. paratuberculosis
gccucgucgagca

SEQ ID NO: 938425 - RNA, 19 nt, Mycobacterium avium subsp. paratuberculosis
gccucgucgagcagcgccc

SEQ ID NO: 938426 - RNA, 16 nt, Mycobacterium avium subsp. paratuberculosis
gccucgucgagccggg

SEQ ID NO: 938427 - RNA, 17 nt, Mycobacterium avium subsp. paratuberculosis
gccucgucgagccgggc

SEQ ID NO: 938428 - RNA, 19 nt, Mycobacterium avium subsp. paratuberculosis
gccucgucgagccgggccc

SEQ ID NO: 938429 - RNA, 23 nt, Mycobacterium avium subsp. paratuberculosis
gccucgucgagccgggcccgggu

SEQ ID NO: 938430 - RNA, 14 nt, Mycobacterium avium subsp. paratuberculosis
gccucgucgagcuc

SEQ ID NO: 938431 - RNA, 21 nt, Mycobacterium avium subsp. paratuberculosis
gccucguugaccgggucgccg

SEQ ID NO: 938432 - RNA, 20 nt, Mycobacterium avium subsp. paratuberculosis
gccucguugagcacaaagcc

SEQ ID NO: 938433 - RNA, 16 nt, Mycobacterium avium subsp. paratuberculosis
gccucguuggccagcu

SEQ ID NO: 938434 - RNA, 23 nt, Mycobacterium avium subsp. paratuberculosis
gccucgucgaugucggcggcccg

SEQ ID NO: 938435 - RNA, 15 nt, Mycobacterium avium subsp. paratuberculosis
gccucgucgaagguc

SEQ ID NO: 938436 - RNA, 14 nt, Mycobacterium avium subsp. paratuberculosis
gccucgucggcgag

SEQ ID NO: 938437 - RNA, 18 nt, Mycobacterium avium subsp. paratuberculosis
gccucgucggcgccgucg

SEQ ID NO: 938438 - RNA, 22 nt, Mycobacterium avium subsp. paratuberculosis
gccucgucggcgccgucgcggg

SEQ ID NO: 938439 - RNA, 13 nt, Mycobacterium avium subsp. paratuberculosis
gccucgucgucgu

SEQ ID NO: 938440 - RNA, 16 nt, Mycobacterium avium subsp. paratuberculosis
gccucgucgucgucga

SEQ ID NO: 938441 - RNA, 19 nt, Mycobacterium avium subsp. paratuberculosis
gccucgguggucgacgagc

SEQ ID NO: 938442 - RNA, 16 nt, Mycobacterium avium subsp. paratuberculosis
gccucgguggucgcgu

SEQ ID NO: 938443 - RNA, 13 nt, Mycobacterium avium subsp. paratuberculosis
gccucggucgcgu

SEQ ID NO: 938444 - RNA, 17 nt, Mycobacterium avium subsp. paratuberculosis
gccucggugaagccgcg

SEQ ID NO: 938445 - RNA, 21 nt, Mycobacterium avium subsp. paratuberculosis
gccucggugcggaacaccgcc

SEQ ID NO: 938446 - RNA, 17 nt, Mycobacterium avium subsp. paratuberculosis
gccucgguggcgguggc

SEQ ID NO: 938447 - RNA, 21 nt, Mycobacterium avium subsp. paratuberculosis
gccucggggaucgccaggcgu

SEQ ID NO: 938448 - RNA, 22 nt, Mycobacterium avium subsp. paratuberculosis
gccucgggguugcuguacuggg

SEQ ID NO: 938449 - RNA, 14 nt, Mycobacterium avium subsp. paratuberculosis
gccucgccgggccc

SEQ ID NO: 938450 - RNA, 15 nt, Mycobacterium avium subsp. paratuberculosis
gccucgccggcgccg

SEQ ID NO: 938451 - RNA, 20 nt, Mycobacterium avium subsp. paratuberculosis
gccucgccggcgccgggcgg

SEQ ID NO: 938452 - RNA, 12 nt, Mycobacterium avium subsp. paratuberculosis
gccucgccgacc

SEQ ID NO: 938453 - RNA, 17 nt, Mycobacterium avium subsp. paratuberculosis
gccucgccgaccuuggc

SEQ ID NO: 938454 - RNA, 22 nt, Mycobacterium avium subsp. paratuberculosis
gccucgccgaccuuggcguugu

SEQ ID NO: 938455 - RNA, 14 nt, Mycobacterium avium subsp. paratuberculosis
gccucgcccagcgc

SEQ ID NO: 938456 - RNA, 16 nt, Mycobacterium avium subsp. paratuberculosis
gccucgcccagcgccg

SEQ ID NO: 938457 - RNA, 21 nt, Mycobacterium avium subsp. paratuberculosis
gccucgcccagcgccgcggcg

SEQ ID NO: 938458 - RNA, 22 nt, Mycobacterium avium subsp. paratuberculosis
gccucgcccagcgccgcggcga

SEQ ID NO: 938459 - RNA, 21 nt, Mycobacterium avium subsp. paratuberculosis
gccucgccacugggcgucggc

SEQ ID NO: 938460 - RNA, 15 nt, Mycobacterium avium subsp. paratuberculosis
gccucgccagcccca

SEQ ID NO: 938461 - RNA, 21 nt, Mycobacterium avium subsp. paratuberculosis
gccucgccagccccaccggcc

SEQ ID NO: 938462 - RNA, 23 nt, Mycobacterium avium subsp. paratuberculosis
gccucgccagccccaccggccac

SEQ ID NO: 938463 - RNA, 19 nt, Mycobacterium avium subsp. paratuberculosis
gccucgaugcggccgucgg

SEQ ID NO: 938464 - RNA, 20 nt, Mycobacterium avium subsp. paratuberculosis
gccucgaugcggccgucggg

SEQ ID NO: 938465 - RNA, 22 nt, Mycobacterium avium subsp. paratuberculosis
gccucgaucugguucaccgcca

SEQ ID NO: 938466 - RNA, 21 nt, Mycobacterium avium subsp. paratuberculosis
gccucgauggcccgcucgguc

SEQ ID NO: 938467 - RNA, 14 nt, Mycobacterium avium subsp. paratuberculosis
gccucgcagcgaca

SEQ ID NO: 938468 - RNA, 18 nt, Mycobacterium avium subsp. paratuberculosis
gccugcacaggggcgcgu

SEQ ID NO: 938469 - RNA, 19 nt, Mycobacterium avium subsp. paratuberculosis
gccugcacaggggcgcgua

SEQ ID NO: 938470 - RNA, 12 nt, Mycobacterium avium subsp. paratuberculosis
gccucucgucga

SEQ ID NO: 938471 - RNA, 14 nt, Mycobacterium avium subsp. paratuberculosis
gccucucgucgacg

SEQ ID NO: 938472 - RNA, 14 nt, Mycobacterium avium subsp. paratuberculosis
gccucuucgucggc

SEQ ID NO: 938473 - RNA, 20 nt, Mycobacterium avium subsp. paratuberculosis
gccucgugcaugugcucggc

SEQ ID NO: 938474 - RNA, 19 nt, Mycobacterium avium subsp. paratuberculosis
gccucuucggcgcgccggc

SEQ ID NO: 938475 - RNA, 20 nt, Mycobacterium avium subsp. paratuberculosis
gccucuucggcgcgccggcg

SEQ ID NO: 938476 - RNA, 13 nt, Mycobacterium avium subsp. paratuberculosis
gccugaaccagcu

SEQ ID NO: 938477 - RNA, 18 nt, Mycobacterium avium subsp. paratuberculosis
gccugaaccagcucgugc

SEQ ID NO: 938478 - RNA, 23 nt, Mycobacterium avium subsp. paratuberculosis
gccuacgacauccugcgcaucga

SEQ ID NO: 938479 - RNA, 15 nt, Mycobacterium avium subsp. paratuberculosis
gccuaggaccccggc

SEQ ID NO: 938480 - RNA, 18 nt, Mycobacterium avium subsp. paratuberculosis
gccuaggaccccggcugc

SEQ ID NO: 938481 - RNA, 15 nt, Mycobacterium avium subsp. paratuberculosis
gccuaggacgccgcc

SEQ ID NO: 938482 - RNA, 18 nt, Mycobacterium avium subsp. paratuberculosis
gccguuuugccgccgagc

SEQ ID NO: 938483 - RNA, 21 nt, Mycobacterium avium subsp. paratuberculosis
gccguugucgaagacggcgag

SEQ ID NO: 938484 - RNA, 17 nt, Mycobacterium avium subsp. paratuberculosis
gccguuguaggccgcgc

SEQ ID NO: 938485 - RNA, 21 nt, Mycobacterium avium subsp. paratuberculosis
gccguuguaggccgcgcggug

SEQ ID NO: 938486 - RNA, 21 nt, Mycobacterium avium subsp. paratuberculosis
gccguucguagggacugcgcc

SEQ ID NO: 938487 - RNA, 15 nt, Mycobacterium avium subsp. paratuberculosis
gccguucggccagcg

SEQ ID NO: 938488 - RNA, 20 nt, Mycobacterium avium subsp. paratuberculosis
gccguucggccagcgccgcc

SEQ ID NO: 938489 - RNA, 21 nt, Mycobacterium avium subsp. paratuberculosis
gccguucggccagcgccgcca

SEQ ID NO: 938490 - RNA, 15 nt, Mycobacterium avium subsp. paratuberculosis
gccguucccggcaga

SEQ ID NO: 938491 - RNA, 17 nt, Mycobacterium avium subsp. paratuberculosis
gccguuccgaugaagaa

SEQ ID NO: 938492 - RNA, 22 nt, Mycobacterium avium subsp. paratuberculosis
gccguuccaucgggcccagcag

SEQ ID NO: 938493 - RNA, 13 nt, Mycobacterium avium subsp. paratuberculosis
gccguucgccggc

SEQ ID NO: 938494 - RNA, 16 nt, Mycobacterium avium subsp. paratuberculosis
gccguucgccggccag

SEQ ID NO: 938495 - RNA, 14 nt, Mycobacterium avium subsp. paratuberculosis
gccguucgccggcg

SEQ ID NO: 938496 - RNA, 16 nt, Mycobacterium avium subsp. paratuberculosis
gccguucgccgguacc

SEQ ID NO: 938497 - RNA, 20 nt, Mycobacterium avium subsp. paratuberculosis
gccguucgccgguaccgccg

SEQ ID NO: 938498 - RNA, 21 nt, Mycobacterium avium subsp. paratuberculosis
gccguucgccgguaccgccgg

SEQ ID NO: 938499 - RNA, 23 nt, Mycobacterium avium subsp. paratuberculosis
gccguucgccgguaccgccggcc

SEQ ID NO: 938500 - RNA, 15 nt, Mycobacterium avium subsp. paratuberculosis
gccguucgcgcacgg

SEQ ID NO: 938501 - RNA, 16 nt, Mycobacterium avium subsp. paratuberculosis
gccguucgcgcacggc

SEQ ID NO: 938502 - RNA, 15 nt, Mycobacterium avium subsp. paratuberculosis
gccguucgcgccgag

SEQ ID NO: 938503 - RNA, 19 nt, Mycobacterium avium subsp. paratuberculosis
gccguucgcgccguagcgg

SEQ ID NO: 938504 - RNA, 19 nt, Mycobacterium avium subsp. paratuberculosis
gccguucgcugcccucggu

SEQ ID NO: 938505 - RNA, 21 nt, Mycobacterium avium subsp. paratuberculosis
gccguucgcugcccucggucg

SEQ ID NO: 938506 - RNA, 19 nt, Mycobacterium avium subsp. paratuberculosis
gccguuccagccggcccgc

SEQ ID NO: 938507 - RNA, 13 nt, Mycobacterium avium subsp. paratuberculosis
gccguucaggucg

SEQ ID NO: 938508 - RNA, 15 nt, Mycobacterium avium subsp. paratuberculosis
gccguucagcgcggc

SEQ ID NO: 938509 - RNA, 17 nt, Mycobacterium avium subsp. paratuberculosis
gccguucagcgcggcca

SEQ ID NO: 938510 - RNA, 18 nt, Mycobacterium avium subsp. paratuberculosis
gccguucagcgcggccac

SEQ ID NO: 938511 - RNA, 20 nt, Mycobacterium avium subsp. paratuberculosis
gccguucagcgcggccaccu

SEQ ID NO: 938512 - RNA, 17 nt, Mycobacterium avium subsp. paratuberculosis
gccgugcaggaugaccg

SEQ ID NO: 938513 - RNA, 21 nt, Mycobacterium avium subsp. paratuberculosis
gccgugcaggaugaccgcguc

SEQ ID NO: 938514 - RNA, 22 nt, Mycobacterium avium subsp. paratuberculosis
gccgugcaggaugaccgcgucg

SEQ ID NO: 938515 - RNA, 17 nt, Mycobacterium avium subsp. paratuberculosis
gccgugcagggggcgca

SEQ ID NO: 938516 - RNA, 19 nt, Mycobacterium avium subsp. paratuberculosis
gccgugcagggggcgcagc

SEQ ID NO: 938517 - RNA, 20 nt, Mycobacterium avium subsp. paratuberculosis
gccgugcagggggcgcagcc

SEQ ID NO: 938518 - RNA, 22 nt, Mycobacterium avium subsp. paratuberculosis
gccgugcagggggcgcagccga

SEQ ID NO: 938519 - RNA, 18 nt, Mycobacterium avium subsp. paratuberculosis
gccgugcagaacagcacg

SEQ ID NO: 938520 - RNA, 19 nt, Mycobacterium avium subsp. paratuberculosis
gccgugcagaacagcacga

SEQ ID NO: 938521 - RNA, 15 nt, Mycobacterium avium subsp. paratuberculosis
gccgugcauccagcc

SEQ ID NO: 938522 - RNA, 16 nt, Mycobacterium avium subsp. paratuberculosis
gccgugcauccagccg

SEQ ID NO: 938523 - RNA, 13 nt, Mycobacterium avium subsp. paratuberculosis
gccgugcaucggg

SEQ ID NO: 938524 - RNA, 16 nt, Mycobacterium avium subsp. paratuberculosis
gccgugcaucgggcgc

SEQ ID NO: 938525 - RNA, 17 nt, Mycobacterium avium subsp. paratuberculosis
gccgugcaucgggcgcu

SEQ ID NO: 938526 - RNA, 16 nt, Mycobacterium avium subsp. paratuberculosis
gccgugccagccggcc

SEQ ID NO: 938527 - RNA, 18 nt, Mycobacterium avium subsp. paratuberculosis
gccgugccagccggccgc

SEQ ID NO: 938528 - RNA, 13 nt, Mycobacterium avium subsp. paratuberculosis
gccguggccguca

SEQ ID NO: 938529 - RNA, 14 nt, Mycobacterium avium subsp. paratuberculosis
gccguggccugcga

SEQ ID NO: 938530 - RNA, 17 nt, Mycobacterium avium subsp. paratuberculosis
gccguggcccgcccagc

SEQ ID NO: 938531 - RNA, 19 nt, Mycobacterium avium subsp. paratuberculosis
gccguggcccgcccagcgc

SEQ ID NO: 938532 - RNA, 16 nt, Mycobacterium avium subsp. paratuberculosis
gccguggcccggucgg

SEQ ID NO: 938533 - RNA, 16 nt, Mycobacterium avium subsp. paratuberculosis
gccguggccgaacggc

SEQ ID NO: 938534 - RNA, 17 nt, Mycobacterium avium subsp. paratuberculosis
gccgugcccgcgggaca

SEQ ID NO: 938535 - RNA, 14 nt, Mycobacterium avium subsp. paratuberculosis
gccgugcccggcgc

SEQ ID NO: 938536 - RNA, 16 nt, Mycobacterium avium subsp. paratuberculosis
gccguggcaggcacga

SEQ ID NO: 938537 - RNA, 19 nt, Mycobacterium avium subsp. paratuberculosis
gccguggcaggcacgagcg

SEQ ID NO: 938538 - RNA, 21 nt, Mycobacterium avium subsp. paratuberculosis
gccguggcaggcacgagcgaa

SEQ ID NO: 938539 - RNA, 16 nt, Mycobacterium avium subsp. paratuberculosis
gccguggcagggccag

SEQ ID NO: 938540 - RNA, 18 nt, Mycobacterium avium subsp. paratuberculosis
gccguggcagggccagca

SEQ ID NO: 938541 - RNA, 15 nt, Mycobacterium avium subsp. paratuberculosis
gccgugccgcgcggc

SEQ ID NO: 938542 - RNA, 23 nt, Mycobacterium avium subsp. paratuberculosis
gccguggcaccgggugggccgac

SEQ ID NO: 938543 - RNA, 16 nt, Mycobacterium avium subsp. paratuberculosis
gccgugccccaggucg

SEQ ID NO: 938544 - RNA, 20 nt, Mycobacterium avium subsp. paratuberculosis
gccgugccccaggucggggu

SEQ ID NO: 938545 - RNA, 22 nt, Mycobacterium avium subsp. paratuberculosis
gccgugccccaggucggggugg

SEQ ID NO: 938546 - RNA, 17 nt, Mycobacterium avium subsp. paratuberculosis
gccguggcggcgguguc

SEQ ID NO: 938547 - RNA, 21 nt, Mycobacterium avium subsp. paratuberculosis
gccguggcggcgggccagcuc

SEQ ID NO: 938548 - RNA, 17 nt, Mycobacterium avium subsp. paratuberculosis
gccguggcggcccgacc

SEQ ID NO: 938549 - RNA, 21 nt, Mycobacterium avium subsp. paratuberculosis
gccguggcggcccgaccagcg

SEQ ID NO: 938550 - RNA, 22 nt, Mycobacterium avium subsp. paratuberculosis
gccguggcggcccgaccagcgg

SEQ ID NO: 938551 - RNA, 18 nt, Mycobacterium avium subsp. paratuberculosis
gccgucacccagaucgcc

SEQ ID NO: 938552 - RNA, 19 nt, Mycobacterium avium subsp. paratuberculosis
gccgucacccagaucgccc

SEQ ID NO: 938553 - RNA, 20 nt, Mycobacterium avium subsp. paratuberculosis
gccgucacccagaucgcccg

SEQ ID NO: 938554 - RNA, 21 nt, Mycobacterium avium subsp. paratuberculosis
gccgucacccagaucgcccgg

SEQ ID NO: 938555 - RNA, 13 nt, Mycobacterium avium subsp. paratuberculosis
gccgucaccgcca

SEQ ID NO: 938556 - RNA, 15 nt, Mycobacterium avium subsp. paratuberculosis
gccgucaccggcugc

SEQ ID NO: 938557 - RNA, 16 nt, Mycobacterium avium subsp. paratuberculosis
gccgucaccggcugcc

SEQ ID NO: 938558 - RNA, 13 nt, Mycobacterium avium subsp. paratuberculosis
gccgucaccggcc

SEQ ID NO: 938559 - RNA, 16 nt, Mycobacterium avium subsp. paratuberculosis
gccgucaccggccauc

SEQ ID NO: 938560 - RNA, 18 nt, Mycobacterium avium subsp. paratuberculosis
gccgucaccggccauccg

SEQ ID NO: 938561 - RNA, 19 nt, Mycobacterium avium subsp. paratuberculosis
gccgucaccggccauccgc

SEQ ID NO: 938562 - RNA, 13 nt, Mycobacterium avium subsp. paratuberculosis
gccgucaccggcu

SEQ ID NO: 938563 - RNA, 18 nt, Mycobacterium avium subsp. paratuberculosis
gccgucacgcuggcguga

SEQ ID NO: 938564 - RNA, 19 nt, Mycobacterium avium subsp. paratuberculosis
gccgucacgcuggcgugac

SEQ ID NO: 938565 - RNA, 22 nt, Mycobacterium avium subsp. paratuberculosis
gccgucacgcuggcgugacgcu

SEQ ID NO: 938566 - RNA, 20 nt, Mycobacterium avium subsp. paratuberculosis
gccgucacggaucgcccacc

SEQ ID NO: 938567 - RNA, 17 nt, Mycobacterium avium subsp. paratuberculosis
gccgucgaggcgcugca

SEQ ID NO: 938568 - RNA, 18 nt, Mycobacterium avium subsp. paratuberculosis
gccgucgaggcgcugcag

SEQ ID NO: 938569 - RNA, 19 nt, Mycobacterium avium subsp. paratuberculosis
gccgucgaggcgcugcagc

SEQ ID NO: 938570 - RNA, 15 nt, Mycobacterium avium subsp. paratuberculosis
gccgucgagccuggu

SEQ ID NO: 938571 - RNA, 22 nt, Mycobacterium avium subsp. paratuberculosis
gccgucgagcagggugacgcga

SEQ ID NO: 938572 - RNA, 12 nt, Mycobacterium avium subsp. paratuberculosis
gccgucaccucg

SEQ ID NO: 938573 - RNA, 18 nt, Mycobacterium avium subsp. paratuberculosis
gccgucacguagcgcggc

SEQ ID NO: 938574 - RNA, 20 nt, Mycobacterium avium subsp. paratuberculosis
gccgucacguagcgcggccg

SEQ ID NO: 938575 - RNA, 21 nt, Mycobacterium avium subsp. paratuberculosis
gccgucacguagcgcggccgc

SEQ ID NO: 938576 - RNA, 22 nt, Mycobacterium avium subsp. paratuberculosis
gccgucacgucauuucggucgg

SEQ ID NO: 938577 - RNA, 23 nt, Mycobacterium avium subsp. paratuberculosis
gccgucacgucauuucggucggc

SEQ ID NO: 938578 - RNA, 18 nt, Mycobacterium avium subsp. paratuberculosis
gccgucacguucaccacc

SEQ ID NO: 938579 - RNA, 20 nt, Mycobacterium avium subsp. paratuberculosis
gccgucacugcacgcacggc

SEQ ID NO: 938580 - RNA, 17 nt, Mycobacterium avium subsp. paratuberculosis
gccgucgcggcgaucgc

SEQ ID NO: 938581 - RNA, 21 nt, Mycobacterium avium subsp. paratuberculosis
gccgucgcggcgaucgcgagc

SEQ ID NO: 938582 - RNA, 15 nt, Mycobacterium avium subsp. paratuberculosis
gccgucgcgggagag

SEQ ID NO: 938583 - RNA, 21 nt, Mycobacterium avium subsp. paratuberculosis
gccgucgcgggagagcgcggg

SEQ ID NO: 938584 - RNA, 23 nt, Mycobacterium avium subsp. paratuberculosis
gccgucgcgggcgucgggcagca

SEQ ID NO: 938585 - RNA, 15 nt, Mycobacterium avium subsp. paratuberculosis
gccgucgcgaucgcg

SEQ ID NO: 938586 - RNA, 17 nt, Mycobacterium avium subsp. paratuberculosis
gccgucgcgaucgcggu

SEQ ID NO: 938587 - RNA, 13 nt, Mycobacterium avium subsp. paratuberculosis
gccgucgcgcagc

SEQ ID NO: 938588 - RNA, 14 nt, Mycobacterium avium subsp. paratuberculosis
gccgucgcgcagcc

SEQ ID NO: 938589 - RNA, 14 nt, Mycobacterium avium subsp. paratuberculosis
gccgucgcgccagg

SEQ ID NO: 938590 - RNA, 20 nt, Mycobacterium avium subsp. paratuberculosis
gccgucgcgccaggaccagc

SEQ ID NO: 938591 - RNA, 22 nt, Mycobacterium avium subsp. paratuberculosis
gccgucgcgccaggaccagcgg

SEQ ID NO: 938592 - RNA, 15 nt, Mycobacterium avium subsp. paratuberculosis
gccgucgcgcaccac

SEQ ID NO: 938593 - RNA, 16 nt, Mycobacterium avium subsp. paratuberculosis
gccgucgcgcaccacc

SEQ ID NO: 938594 - RNA, 23 nt, Mycobacterium avium subsp. paratuberculosis
gccgucgcgcaccaccucgaucg

SEQ ID NO: 938595 - RNA, 20 nt, Mycobacterium avium subsp. paratuberculosis
gccgucgccucgcccucggu

SEQ ID NO: 938596 - RNA, 15 nt, Mycobacterium avium subsp. paratuberculosis
gccgucgccgggcgg

SEQ ID NO: 938597 - RNA, 13 nt, Mycobacterium avium subsp. paratuberculosis
gccgucgccgguc

SEQ ID NO: 938598 - RNA, 13 nt, Mycobacterium avium subsp. paratuberculosis
gccgucgcaccgc

SEQ ID NO: 938599 - RNA, 15 nt, Mycobacterium avium subsp. paratuberculosis
gccgucgcaccgccu

SEQ ID NO: 938600 - RNA, 22 nt, Mycobacterium avium subsp. paratuberculosis
gccgucgcacuagguccggcgc

SEQ ID NO: 938601 - RNA, 23 nt, Mycobacterium avium subsp. paratuberculosis
gccgucgcacuagguccggcgcg

SEQ ID NO: 938602 - RNA, 17 nt, Mycobacterium avium subsp. paratuberculosis
gccgucgaucgcccgcu

SEQ ID NO: 938603 - RNA, 23 nt, Mycobacterium avium subsp. paratuberculosis
gccgucgaucgcccgcuccgcgg

SEQ ID NO: 938604 - RNA, 17 nt, Mycobacterium avium subsp. paratuberculosis
gccgucgaugacgcgcu

SEQ ID NO: 938605 - RNA, 16 nt, Mycobacterium avium subsp. paratuberculosis
gccgucgaugccggcg

SEQ ID NO: 938606 - RNA, 19 nt, Mycobacterium avium subsp. paratuberculosis
gccgucgaugccggcgacg

SEQ ID NO: 938607 - RNA, 18 nt, Mycobacterium avium subsp. paratuberculosis
gccgucgauggcgcggcc

SEQ ID NO: 938608 - RNA, 20 nt, Mycobacterium avium subsp. paratuberculosis
gccgucgauggcgcggccca

SEQ ID NO: 938609 - RNA, 20 nt, Mycobacterium avium subsp. paratuberculosis
gccgucgaucaccugcgggc

SEQ ID NO: 938610 - RNA, 21 nt, Mycobacterium avium subsp. paratuberculosis
gccgucgaucaccugcgggcg

SEQ ID NO: 938611 - RNA, 13 nt, Mycobacterium avium subsp. paratuberculosis
gccgugcagcacc

SEQ ID NO: 938612 - RNA, 16 nt, Mycobacterium avium subsp. paratuberculosis
gccgugcagcaccucg

SEQ ID NO: 938613 - RNA, 17 nt, Mycobacterium avium subsp. paratuberculosis
gccgugcagcaccucga

SEQ ID NO: 938614 - RNA, 14 nt, Mycobacterium avium subsp. paratuberculosis
gccgugcagcacgc

SEQ ID NO: 938615 - RNA, 17 nt, Mycobacterium avium subsp. paratuberculosis
gccgugcagcacgccgc

SEQ ID NO: 938616 - RNA, 18 nt, Mycobacterium avium subsp. paratuberculosis
gccgugcagcacgccgcg

SEQ ID NO: 938617 - RNA, 14 nt, Mycobacterium avium subsp. paratuberculosis
gccgugcagcgccc

SEQ ID NO: 938618 - RNA, 15 nt, Mycobacterium avium subsp. paratuberculosis
gccgugcagcgccca

SEQ ID NO: 938619 - RNA, 20 nt, Mycobacterium avium subsp. paratuberculosis
gccgugcagcgcccagccga

SEQ ID NO: 938620 - RNA, 13 nt, Mycobacterium avium subsp. paratuberculosis
gccgugcaccguc

SEQ ID NO: 938621 - RNA, 19 nt, Mycobacterium avium subsp. paratuberculosis
gccgugcaccgucgccggc

SEQ ID NO: 938622 - RNA, 19 nt, Mycobacterium avium subsp. paratuberculosis
gccgugcacgccgucgugc

SEQ ID NO: 938623 - RNA, 23 nt, Mycobacterium avium subsp. paratuberculosis
gccgugcacgccgucgugcucgg

SEQ ID NO: 938624 - RNA, 15 nt, Mycobacterium avium subsp. paratuberculosis
gccgugaugccgggc

SEQ ID NO: 938625 - RNA, 16 nt, Mycobacterium avium subsp. paratuberculosis
gccgugaugccgggca

SEQ ID NO: 938626 - RNA, 22 nt, Mycobacterium avium subsp. paratuberculosis
gccgugaugcgcaagcaccggc

SEQ ID NO: 938627 - RNA, 23 nt, Mycobacterium avium subsp. paratuberculosis
gccgugaugcgcaagcaccggcu

SEQ ID NO: 938628 - RNA, 13 nt, Mycobacterium avium subsp. paratuberculosis
gccgugaugcgcc

SEQ ID NO: 938629 - RNA, 16 nt, Mycobacterium avium subsp. paratuberculosis
gccgugaugcgccggc

SEQ ID NO: 938630 - RNA, 17 nt, Mycobacterium avium subsp. paratuberculosis
gccgugaugcgccggcg

SEQ ID NO: 938631 - RNA, 19 nt, Mycobacterium avium subsp. paratuberculosis
gccgugaugggccgucagg

SEQ ID NO: 938632 - RNA, 16 nt, Mycobacterium avium subsp. paratuberculosis
gccgugaucggccagc

SEQ ID NO: 938633 - RNA, 22 nt, Mycobacterium avium subsp. paratuberculosis
gccgugaucucgugccgcaccc

SEQ ID NO: 938634 - RNA, 13 nt, Mycobacterium avium subsp. paratuberculosis
gccgugaucuggu

SEQ ID NO: 938635 - RNA, 22 nt, Mycobacterium avium subsp. paratuberculosis
gccgugaucuggugggcgggca

SEQ ID NO: 938636 - RNA, 17 nt, Mycobacterium avium subsp. paratuberculosis
gccgugaucuucgugcu

SEQ ID NO: 938637 - RNA, 15 nt, Mycobacterium avium subsp. paratuberculosis
gccgucucgaccacc

SEQ ID NO: 938638 - RNA, 17 nt, Mycobacterium avium subsp. paratuberculosis
gccgucucgaccacccg

SEQ ID NO: 938639 - RNA, 21 nt, Mycobacterium avium subsp. paratuberculosis
gccgucucgaccacccggcgg

SEQ ID NO: 938640 - RNA, 14 nt, Mycobacterium avium subsp. paratuberculosis
gccgucucgacccg

SEQ ID NO: 938641 - RNA, 18 nt, Mycobacterium avium subsp. paratuberculosis
gccgucucgacccgggcc

SEQ ID NO: 938642 - RNA, 21 nt, Mycobacterium avium subsp. paratuberculosis
gccgucucgacccgggccagc

SEQ ID NO: 938643 - RNA, 16 nt, Mycobacterium avium subsp. paratuberculosis
gccgucucgagccggc

SEQ ID NO: 938644 - RNA, 17 nt, Mycobacterium avium subsp. paratuberculosis
gccgucucgagccggcg

SEQ ID NO: 938645 - RNA, 21 nt, Mycobacterium avium subsp. paratuberculosis
gccgucuccucgaccagcgcg

SEQ ID NO: 938646 - RNA, 22 nt, Mycobacterium avium subsp. paratuberculosis
gccgucuccucgaccagcgcgc

SEQ ID NO: 938647 - RNA, 21 nt, Mycobacterium avium subsp. paratuberculosis
gccgucguucuccauccgggc

SEQ ID NO: 938648 - RNA, 23 nt, Mycobacterium avium subsp. paratuberculosis
gccgucguucuccauccgggcgg

SEQ ID NO: 938649 - RNA, 20 nt, Mycobacterium avium subsp. paratuberculosis
gccgucucggagcggugucg

SEQ ID NO: 938650 - RNA, 17 nt, Mycobacterium avium subsp. paratuberculosis
gccgucucgucggccgc

SEQ ID NO: 938651 - RNA, 18 nt, Mycobacterium avium subsp. paratuberculosis
gccgucucgucggccgcg

SEQ ID NO: 938652 - RNA, 19 nt, Mycobacterium avium subsp. paratuberculosis
gccgucucgucggccgcga

SEQ ID NO: 938653 - RNA, 21 nt, Mycobacterium avium subsp. paratuberculosis
gccgugaguguugaagccgcg

SEQ ID NO: 938654 - RNA, 22 nt, Mycobacterium avium subsp. paratuberculosis
gccgucguugaucaggugcagc

SEQ ID NO: 938655 - RNA, 15 nt, Mycobacterium avium subsp. paratuberculosis
gccgucgugcucgag

SEQ ID NO: 938656 - RNA, 21 nt, Mycobacterium avium subsp. paratuberculosis
gccgucgugcucgagcaucuc

SEQ ID NO: 938657 - RNA, 16 nt, Mycobacterium avium subsp. paratuberculosis
gccgucgugcucggcg

SEQ ID NO: 938658 - RNA, 20 nt, Mycobacterium avium subsp. paratuberculosis
gccgucguggguauccgccg

SEQ ID NO: 938659 - RNA, 16 nt, Mycobacterium avium subsp. paratuberculosis
gccgucgugguggccg

SEQ ID NO: 938660 - RNA, 17 nt, Mycobacterium avium subsp. paratuberculosis
gccgucgugguggccgc

SEQ ID NO: 938661 - RNA, 14 nt, Mycobacterium avium subsp. paratuberculosis
gccgucggcgcggc

SEQ ID NO: 938662 - RNA, 17 nt, Mycobacterium avium subsp. paratuberculosis
gccgucggcgcggccgg

SEQ ID NO: 938663 - RNA, 12 nt, Mycobacterium avium subsp. paratuberculosis
gccgucggcgga

SEQ ID NO: 938664 - RNA, 13 nt, Mycobacterium avium subsp. paratuberculosis
gccgucggcggag

SEQ ID NO: 938665 - RNA, 12 nt, Mycobacterium avium subsp. paratuberculosis
gccgucggcggc

SEQ ID NO: 938666 - RNA, 13 nt, Mycobacterium avium subsp. paratuberculosis
gccgucggcggcc

SEQ ID NO: 938667 - RNA, 15 nt, Mycobacterium avium subsp. paratuberculosis
gccgucggcggccuu

SEQ ID NO: 938668 - RNA, 23 nt, Mycobacterium avium subsp. paratuberculosis
gccgucggcggccuugaacgcgu

SEQ ID NO: 938669 - RNA, 21 nt, Mycobacterium avium subsp. paratuberculosis
gccgucggcgaugcggugguc

SEQ ID NO: 938670 - RNA, 22 nt, Mycobacterium avium subsp. paratuberculosis
gccgucggcgauggugaacucc

SEQ ID NO: 938671 - RNA, 15 nt, Mycobacterium avium subsp. paratuberculosis
gccgucggcgcccgg

SEQ ID NO: 938672 - RNA, 15 nt, Mycobacterium avium subsp. paratuberculosis
gccgucggcgccgcc

SEQ ID NO: 938673 - RNA, 16 nt, Mycobacterium avium subsp. paratuberculosis
gccgucggcgccgccg

SEQ ID NO: 938674 - RNA, 15 nt, Mycobacterium avium subsp. paratuberculosis
gccgucggccugcgc

SEQ ID NO: 938675 - RNA, 12 nt, Mycobacterium avium subsp. paratuberculosis
gccgucggccgc

SEQ ID NO: 938676 - RNA, 14 nt, Mycobacterium avium subsp. paratuberculosis
gccgucggccgccg

SEQ ID NO: 938677 - RNA, 15 nt, Mycobacterium avium subsp. paratuberculosis
gccgucggccgccga

SEQ ID NO: 938678 - RNA, 16 nt, Mycobacterium avium subsp. paratuberculosis
gccgucggccgccgac

SEQ ID NO: 938679 - RNA, 22 nt, Mycobacterium avium subsp. paratuberculosis
gccgucggccagcagcgcgucg

SEQ ID NO: 938680 - RNA, 15 nt, Mycobacterium avium subsp. paratuberculosis
gccgucggaucgaag

SEQ ID NO: 938681 - RNA, 20 nt, Mycobacterium avium subsp. paratuberculosis
gccgggaaguuggccuccca

SEQ ID NO: 938682 - RNA, 21 nt, Mycobacterium avium subsp. paratuberculosis
gccgggaaucgagggcgcgca

SEQ ID NO: 938683 - RNA, 22 nt, Mycobacterium avium subsp. paratuberculosis
gccgggaaucgagggcgcgcag

SEQ ID NO: 938684 - RNA, 12 nt, Mycobacterium avium subsp. paratuberculosis
gccgggacgcgg

SEQ ID NO: 938685 - RNA, 21 nt, Mycobacterium avium subsp. paratuberculosis
gccgggacagguagcgcagcc

SEQ ID NO: 938686 - RNA, 21 nt, Mycobacterium avium subsp. paratuberculosis
gccgggagauacggucgcacc

SEQ ID NO: 938687 - RNA, 20 nt, Mycobacterium avium subsp. paratuberculosis
gccgggagugcuggacggcc

SEQ ID NO: 938688 - RNA, 22 nt, Mycobacterium avium subsp. paratuberculosis
gccgggagugcuggacggcccg

SEQ ID NO: 938689 - RNA, 13 nt, Mycobacterium avium subsp. paratuberculosis
gccgggcaccacc

SEQ ID NO: 938690 - RNA, 14 nt, Mycobacterium avium subsp. paratuberculosis
gccgggcaccacca

SEQ ID NO: 938691 - RNA, 18 nt, Mycobacterium avium subsp. paratuberculosis
gccgggcacgaauucggu

SEQ ID NO: 938692 - RNA, 22 nt, Mycobacterium avium subsp. paratuberculosis
gccgggcacgaauucgguggcg

SEQ ID NO: 938693 - RNA, 14 nt, Mycobacterium avium subsp. paratuberculosis
gccgggcacgucga

SEQ ID NO: 938694 - RNA, 16 nt, Mycobacterium avium subsp. paratuberculosis
gccgggcacgucgacg

SEQ ID NO: 938695 - RNA, 18 nt, Mycobacterium avium subsp. paratuberculosis
gccgggcacgucgacgcc

SEQ ID NO: 938696 - RNA, 22 nt, Mycobacterium avium subsp. paratuberculosis
gccgggcacgucgacgcccugc

SEQ ID NO: 938697 - RNA, 13 nt, Mycobacterium avium subsp. paratuberculosis
gccgggcaccgcg

SEQ ID NO: 938698 - RNA, 18 nt, Mycobacterium avium subsp. paratuberculosis
gccgggcaccgcgcccgc

SEQ ID NO: 938699 - RNA, 16 nt, Mycobacterium avium subsp. paratuberculosis
gccgggcaccucggcg

SEQ ID NO: 938700 - RNA, 20 nt, Mycobacterium avium subsp. paratuberculosis
gccgggcaccucggcgucgg

SEQ ID NO: 938701 - RNA, 21 nt, Mycobacterium avium subsp. paratuberculosis
gccgggcaccaccaccgacac

SEQ ID NO: 938702 - RNA, 15 nt, Mycobacterium avium subsp. paratuberculosis
gccgggcaccagcga

SEQ ID NO: 938703 - RNA, 16 nt, Mycobacterium avium subsp. paratuberculosis
gccgggcaccagcgac

SEQ ID NO: 938704 - RNA, 18 nt, Mycobacterium avium subsp. paratuberculosis
gccgggcaccagcgacag

SEQ ID NO: 938705 - RNA, 13 nt, Mycobacterium avium subsp. paratuberculosis
gccgggcagcgcg

SEQ ID NO: 938706 - RNA, 14 nt, Mycobacterium avium subsp. paratuberculosis
gccgggcagcgcga

SEQ ID NO: 938707 - RNA, 14 nt, Mycobacterium avium subsp. paratuberculosis
gccgggcagcgcgc

SEQ ID NO: 938708 - RNA, 16 nt, Mycobacterium avium subsp. paratuberculosis
gccgggcagcggcccc

SEQ ID NO: 938709 - RNA, 17 nt, Mycobacterium avium subsp. paratuberculosis
gccgggcagcggcccca

SEQ ID NO: 938710 - RNA, 16 nt, Mycobacterium avium subsp. paratuberculosis
gccgggcagcccgccg

SEQ ID NO: 938711 - RNA, 19 nt, Mycobacterium avium subsp. paratuberculosis
gccgggcagcccgccgcgg

SEQ ID NO: 938712 - RNA, 16 nt, Mycobacterium avium subsp. paratuberculosis
gccggcuggcgggcga

SEQ ID NO: 938713 - RNA, 16 nt, Mycobacterium avium subsp. paratuberculosis
gccggcuugccccggu

SEQ ID NO: 938714 - RNA, 15 nt, Mycobacterium avium subsp. paratuberculosis
gccggcuucucggcg

SEQ ID NO: 938715 - RNA, 17 nt, Mycobacterium avium subsp. paratuberculosis
gccggcuucucggcgug

SEQ ID NO: 938716 - RNA, 19 nt, Mycobacterium avium subsp. paratuberculosis
gccggcuugaucucgaccu

SEQ ID NO: 938717 - RNA, 15 nt, Mycobacterium avium subsp. paratuberculosis
gccggcuuccucgcg

SEQ ID NO: 938718 - RNA, 16 nt, Mycobacterium avium subsp. paratuberculosis
gccggcuuccucgcgg

SEQ ID NO: 938719 - RNA, 21 nt, Mycobacterium avium subsp. paratuberculosis
gccggcuuccucgcggaaccg

SEQ ID NO: 938720 - RNA, 15 nt, Mycobacterium avium subsp. paratuberculosis
gccggcuucggccaa

SEQ ID NO: 938721 - RNA, 18 nt, Mycobacterium avium subsp. paratuberculosis
gccgggaaacccucgacg

SEQ ID NO: 938722 - RNA, 20 nt, Mycobacterium avium subsp. paratuberculosis
gccgggaacagcgacgccca

SEQ ID NO: 938723 - RNA, 17 nt, Mycobacterium avium subsp. paratuberculosis
gccgggaagcgaagcgg

SEQ ID NO: 938724 - RNA, 21 nt, Mycobacterium avium subsp. paratuberculosis
gccggcuuucgaagagccggc

SEQ ID NO: 938725 - RNA, 22 nt, Mycobacterium avium subsp. paratuberculosis
gccggcuuucgaagagccggcg

SEQ ID NO: 938726 - RNA, 17 nt, Mycobacterium avium subsp. paratuberculosis
gccggcuugggcgaauc

SEQ ID NO: 938727 - RNA, 13 nt, Mycobacterium avium subsp. paratuberculosis
gccggcuccaccg

SEQ ID NO: 938728 - RNA, 14 nt, Mycobacterium avium subsp. paratuberculosis
gccggcuccaccgc

SEQ ID NO: 938729 - RNA, 15 nt, Mycobacterium avium subsp. paratuberculosis
gccggcuccaccgcg

SEQ ID NO: 938730 - RNA, 16 nt, Mycobacterium avium subsp. paratuberculosis
gccggcuccaccgcgc

SEQ ID NO: 938731 - RNA, 18 nt, Mycobacterium avium subsp. paratuberculosis
gccggcuggaacaucccg

SEQ ID NO: 938732 - RNA, 15 nt, Mycobacterium avium subsp. paratuberculosis
gccggcucagggugc

SEQ ID NO: 938733 - RNA, 19 nt, Mycobacterium avium subsp. paratuberculosis
gccggcucagggugcgcug

SEQ ID NO: 938734 - RNA, 23 nt, Mycobacterium avium subsp. paratuberculosis
gccggcucagggugcgcuggccg

SEQ ID NO: 938735 - RNA, 16 nt, Mycobacterium avium subsp. paratuberculosis
gccggcguuguccagg

SEQ ID NO: 938736 - RNA, 15 nt, Mycobacterium avium subsp. paratuberculosis
gccggcuaccggcgc

SEQ ID NO: 938737 - RNA, 18 nt, Mycobacterium avium subsp. paratuberculosis
gccggcuaccggcgcugg

SEQ ID NO: 938738 - RNA, 19 nt, Mycobacterium avium subsp. paratuberculosis
gccggcuaccggcgcugga

SEQ ID NO: 938739 - RNA, 15 nt, Mycobacterium avium subsp. paratuberculosis
gccggcuaccgcgcg

SEQ ID NO: 938740 - RNA, 17 nt, Mycobacterium avium subsp. paratuberculosis
gccggcuaccgcgcgga

SEQ ID NO: 938741 - RNA, 13 nt, Mycobacterium avium subsp. paratuberculosis
gccggcguugacg

SEQ ID NO: 938742 - RNA, 22 nt, Mycobacterium avium subsp. paratuberculosis
gccggcguugacgaugacgcgg

SEQ ID NO: 938743 - RNA, 14 nt, Mycobacterium avium subsp. paratuberculosis
gccggcgucgacgu

SEQ ID NO: 938744 - RNA, 16 nt, Mycobacterium avium subsp. paratuberculosis
gccggcgucgacgucg

SEQ ID NO: 938745 - RNA, 15 nt, Mycobacterium avium subsp. paratuberculosis
gccggcgucgaugau

SEQ ID NO: 938746 - RNA, 17 nt, Mycobacterium avium subsp. paratuberculosis
gccggcgucgccgcugg

SEQ ID NO: 938747 - RNA, 14 nt, Mycobacterium avium subsp. paratuberculosis
gccggcgucgcggu

SEQ ID NO: 938748 - RNA, 17 nt, Mycobacterium avium subsp. paratuberculosis
gccggcgucaauugcca

SEQ ID NO: 938749 - RNA, 22 nt, Mycobacterium avium subsp. paratuberculosis
gccggcguccaggcgcaccgcc

SEQ ID NO: 938750 - RNA, 23 nt, Mycobacterium avium subsp. paratuberculosis
gccggcguccaggcgcaccgcca

SEQ ID NO: 938751 - RNA, 18 nt, Mycobacterium avium subsp. paratuberculosis
gccggcguccaguucggc

SEQ ID NO: 938752 - RNA, 24 nt, Mycobacterium avium subsp. paratuberculosis
gccggcguccaguucggccagcgc

SEQ ID NO: 938753 - RNA, 16 nt, Mycobacterium avium subsp. paratuberculosis
gccggcgguucggcgg

SEQ ID NO: 938754 - RNA, 20 nt, Mycobacterium avium subsp. paratuberculosis
gccggcgguucggcgggccu

SEQ ID NO: 938755 - RNA, 22 nt, Mycobacterium avium subsp. paratuberculosis
gccggcguacucgcacagccgg

SEQ ID NO: 938756 - RNA, 24 nt, Mycobacterium avium subsp. paratuberculosis
gccggcguacucgcacagccggcg

SEQ ID NO: 938757 - RNA, 18 nt, Mycobacterium avium subsp. paratuberculosis
gccggcguagaccagcga

SEQ ID NO: 938758 - RNA, 19 nt, Mycobacterium avium subsp. paratuberculosis
gccggcguagaccagcgac

SEQ ID NO: 938759 - RNA, 21 nt, Mycobacterium avium subsp. paratuberculosis
gccggcguagaccagcgacgc

SEQ ID NO: 938760 - RNA, 22 nt, Mycobacterium avium subsp. paratuberculosis
gccggcgguguccacgaugcgg

SEQ ID NO: 938761 - RNA, 16 nt, Mycobacterium avium subsp. paratuberculosis
gccggcggugucgaga

SEQ ID NO: 938762 - RNA, 19 nt, Mycobacterium avium subsp. paratuberculosis
gccggcggugucguaguug

SEQ ID NO: 938763 - RNA, 15 nt, Mycobacterium avium subsp. paratuberculosis
gccgcugcagcgccg

SEQ ID NO: 938764 - RNA, 19 nt, Mycobacterium avium subsp. paratuberculosis
gccgcugcagcgccgcccg

SEQ ID NO: 938765 - RNA, 15 nt, Mycobacterium avium subsp. paratuberculosis
gccgcugcagcugcu

SEQ ID NO: 938766 - RNA, 18 nt, Mycobacterium avium subsp. paratuberculosis
gccgcugcagcugcucgu

SEQ ID NO: 938767 - RNA, 23 nt, Mycobacterium avium subsp. paratuberculosis
gccgcugaucaaaaacccguuga

SEQ ID NO: 938768 - RNA, 16 nt, Mycobacterium avium subsp. paratuberculosis
gccgcugagcuucugc

SEQ ID NO: 938769 - RNA, 22 nt, Mycobacterium avium subsp. paratuberculosis
gccgcugagcuucugcccggcc

SEQ ID NO: 938770 - RNA, 14 nt, Mycobacterium avium subsp. paratuberculosis
gccgcucuucgacg

SEQ ID NO: 938771 - RNA, 15 nt, Mycobacterium avium subsp. paratuberculosis
gccgcucuucgacga

SEQ ID NO: 938772 - RNA, 17 nt, Mycobacterium avium subsp. paratuberculosis
gccgcucuucgacgacc

SEQ ID NO: 938773 - RNA, 19 nt, Mycobacterium avium subsp. paratuberculosis
gccgcucuucgacgacccg

SEQ ID NO: 938774 - RNA, 21 nt, Mycobacterium avium subsp. paratuberculosis
gccgcucuucgacgacccgau

SEQ ID NO: 938775 - RNA, 21 nt, Mycobacterium avium subsp. paratuberculosis
gccgcugacgauggcgaccgc

SEQ ID NO: 938776 - RNA, 22 nt, Mycobacterium avium subsp. paratuberculosis
gccgcugacgauggcgaccgcg

SEQ ID NO: 938777 - RNA, 23 nt, Mycobacterium avium subsp. paratuberculosis
gccgcugacgauggcgaccgcgc

SEQ ID NO: 938778 - RNA, 21 nt, Mycobacterium avium subsp. paratuberculosis
gccgcugacgcggcgggcaua

SEQ ID NO: 938779 - RNA, 13 nt, Mycobacterium avium subsp. paratuberculosis
gccgcugacgguc

SEQ ID NO: 938780 - RNA, 16 nt, Mycobacterium avium subsp. paratuberculosis
gccgcugacggucgcc

SEQ ID NO: 938781 - RNA, 17 nt, Mycobacterium avium subsp. paratuberculosis
gccgcugacggucgccg

SEQ ID NO: 938782 - RNA, 18 nt, Mycobacterium avium subsp. paratuberculosis
gccgcugacggucgccga

SEQ ID NO: 938783 - RNA, 19 nt, Mycobacterium avium subsp. paratuberculosis
gccgcugacggucgccgac

SEQ ID NO: 938784 - RNA, 23 nt, Mycobacterium avium subsp. paratuberculosis
gccgggcaucucguugucgucgg

SEQ ID NO: 938785 - RNA, 17 nt, Mycobacterium avium subsp. paratuberculosis
gccgggcaugccguuca

SEQ ID NO: 938786 - RNA, 15 nt, Mycobacterium avium subsp. paratuberculosis
gccgggcauccgccc

SEQ ID NO: 938787 - RNA, 17 nt, Mycobacterium avium subsp. paratuberculosis
gccgggcauccgcccgu

SEQ ID NO: 938788 - RNA, 15 nt, Mycobacterium avium subsp. paratuberculosis
gccgggcauccgggc

SEQ ID NO: 938789 - RNA, 19 nt, Mycobacterium avium subsp. paratuberculosis
gccgggcauccgggccgcc

SEQ ID NO: 938790 - RNA, 22 nt, Mycobacterium avium subsp. paratuberculosis
gccgggcauccgggccgccgcg

SEQ ID NO: 938791 - RNA, 14 nt, Mycobacterium avium subsp. paratuberculosis
gccgggcagugcgc

SEQ ID NO: 938792 - RNA, 13 nt, Mycobacterium avium subsp. paratuberculosis
gccgggcacccgg

SEQ ID NO: 938793 - RNA, 15 nt, Mycobacterium avium subsp. paratuberculosis
gccgggcacccgggu

SEQ ID NO: 938794 - RNA, 23 nt, Mycobacterium avium subsp. paratuberculosis
gccgggccaauuacgcugcggcg

SEQ ID NO: 938795 - RNA, 20 nt, Mycobacterium avium subsp. paratuberculosis
gccgggcagugcgcggcguc

SEQ ID NO: 938796 - RNA, 17 nt, Mycobacterium avium subsp. paratuberculosis
gccgggccagcaacagc

SEQ ID NO: 938797 - RNA, 15 nt, Mycobacterium avium subsp. paratuberculosis
gccgggccagcagcu

SEQ ID NO: 938798 - RNA, 16 nt, Mycobacterium avium subsp. paratuberculosis
gccgggccagcagcuu

SEQ ID NO: 938799 - RNA, 18 nt, Mycobacterium avium subsp. paratuberculosis
gccgggccagcagcuuga

SEQ ID NO: 938800 - RNA, 13 nt, Mycobacterium avium subsp. paratuberculosis
gccgggccagccg

SEQ ID NO: 938801 - RNA, 14 nt, Mycobacterium avium subsp. paratuberculosis
gccgggccagccgg

SEQ ID NO: 938802 - RNA, 15 nt, Mycobacterium avium subsp. paratuberculosis
gccgggccagccggc

SEQ ID NO: 938803 - RNA, 16 nt, Mycobacterium avium subsp. paratuberculosis
gccgggccagccggcc

SEQ ID NO: 938804 - RNA, 21 nt, Mycobacterium avium subsp. paratuberculosis
gccgggccagccggcccucca

SEQ ID NO: 938805 - RNA, 13 nt, Mycobacterium avium subsp. paratuberculosis
gccgggccgcccg

SEQ ID NO: 938806 - RNA, 18 nt, Mycobacterium avium subsp. paratuberculosis
gccgggccgcccgcgcgu

SEQ ID NO: 938807 - RNA, 20 nt, Mycobacterium avium subsp. paratuberculosis
gccgggccgcccgcgcgugg

SEQ ID NO: 938808 - RNA, 15 nt, Mycobacterium avium subsp. paratuberculosis
gccgggccacgccga

SEQ ID NO: 938809 - RNA, 12 nt, Mycobacterium avium subsp. paratuberculosis
gccgggcccgcu

SEQ ID NO: 938810 - RNA, 20 nt, Mycobacterium avium subsp. paratuberculosis
gccgggcccgcucaccugcg

SEQ ID NO: 938811 - RNA, 13 nt, Mycobacterium avium subsp. paratuberculosis
gccgggcccgggu

SEQ ID NO: 938812 - RNA, 23 nt, Mycobacterium avium subsp. paratuberculosis
gccgggcgcgaauuccucagcgc

SEQ ID NO: 938813 - RNA, 13 nt, Mycobacterium avium subsp. paratuberculosis
gccgggcgcccga

SEQ ID NO: 938814 - RNA, 13 nt, Mycobacterium avium subsp. paratuberculosis
gccgggcgcccgc

SEQ ID NO: 938815 - RNA, 15 nt, Mycobacterium avium subsp. paratuberculosis
gccgggcgcccgcgg

SEQ ID NO: 938816 - RNA, 14 nt, Mycobacterium avium subsp. paratuberculosis
gccgggcgccaccc

SEQ ID NO: 938817 - RNA, 19 nt, Mycobacterium avium subsp. paratuberculosis
gccgggcgccacccgcaug

SEQ ID NO: 938818 - RNA, 19 nt, Mycobacterium avium subsp. paratuberculosis
gccgggcgccacgcuggcg

SEQ ID NO: 938819 - RNA, 20 nt, Mycobacterium avium subsp. paratuberculosis
gccgggcgccacgcuggcgu

SEQ ID NO: 938820 - RNA, 23 nt, Mycobacterium avium subsp. paratuberculosis
gccgggcgaucucuucgaugccg

SEQ ID NO: 938821 - RNA, 19 nt, Mycobacterium avium subsp. paratuberculosis
gccgggcgaagucgccggc

SEQ ID NO: 938822 - RNA, 20 nt, Mycobacterium avium subsp. paratuberculosis
gccgggcgaagucgccggcc

SEQ ID NO: 938823 - RNA, 21 nt, Mycobacterium avium subsp. paratuberculosis
gccgggcgaagucgccggcca

SEQ ID NO: 938824 - RNA, 23 nt, Mycobacterium avium subsp. paratuberculosis
gccgggcgaagucgccggccagg

SEQ ID NO: 938825 - RNA, 14 nt, Mycobacterium avium subsp. paratuberculosis
gccgggccugucca

SEQ ID NO: 938826 - RNA, 17 nt, Mycobacterium avium subsp. paratuberculosis
gccgggccugcagcaac

SEQ ID NO: 938827 - RNA, 20 nt, Mycobacterium avium subsp. paratuberculosis
gccgggccugcagcaacucg

SEQ ID NO: 938828 - RNA, 23 nt, Mycobacterium avium subsp. paratuberculosis
gccgggccgccgaugcgcccgcu

SEQ ID NO: 938829 - RNA, 13 nt, Mycobacterium avium subsp. paratuberculosis
gccgggccgccgc

SEQ ID NO: 938830 - RNA, 19 nt, Mycobacterium avium subsp. paratuberculosis
gccgggccgccgcggccac

SEQ ID NO: 938831 - RNA, 14 nt, Mycobacterium avium subsp. paratuberculosis
gccgggccgcggcg

SEQ ID NO: 938832 - RNA, 17 nt, Mycobacterium avium subsp. paratuberculosis
gccgggccgcggcggua

SEQ ID NO: 938833 - RNA, 19 nt, Mycobacterium avium subsp. paratuberculosis
gccgggccggaacgcccga

SEQ ID NO: 938834 - RNA, 20 nt, Mycobacterium avium subsp. paratuberculosis
gccgggccggaacgcccgau

SEQ ID NO: 938835 - RNA, 16 nt, Mycobacterium avium subsp. paratuberculosis
gccgggccggaucgcg

SEQ ID NO: 938836 - RNA, 15 nt, Mycobacterium avium subsp. paratuberculosis
gccgggccggccggu

SEQ ID NO: 938837 - RNA, 13 nt, Mycobacterium avium subsp. paratuberculosis
gccgggccggcgg

SEQ ID NO: 938838 - RNA, 14 nt, Mycobacterium avium subsp. paratuberculosis
gccgggccggcggc

SEQ ID NO: 938839 - RNA, 16 nt, Mycobacterium avium subsp. paratuberculosis
gccgggccggcggcca

SEQ ID NO: 938840 - RNA, 17 nt, Mycobacterium avium subsp. paratuberculosis
gccgggccggcggccag

SEQ ID NO: 938841 - RNA, 18 nt, Mycobacterium avium subsp. paratuberculosis
gccggggaaacgggaugc

SEQ ID NO: 938842 - RNA, 21 nt, Mycobacterium avium subsp. paratuberculosis
gccggggaacaccggcgaggu

SEQ ID NO: 938843 - RNA, 22 nt, Mycobacterium avium subsp. paratuberculosis
gccggggaacaccggcgaggug

SEQ ID NO: 938844 - RNA, 14 nt, Mycobacterium avium subsp. paratuberculosis
gccggggacgacgg

SEQ ID NO: 938845 - RNA, 18 nt, Mycobacterium avium subsp. paratuberculosis
gccggggacgacggcggg

SEQ ID NO: 938846 - RNA, 23 nt, Mycobacterium avium subsp. paratuberculosis
gccggggacgacggcggggaugc

SEQ ID NO: 938847 - RNA, 13 nt, Mycobacterium avium subsp. paratuberculosis
gccggggaucgcg

SEQ ID NO: 938848 - RNA, 22 nt, Mycobacterium avium subsp. paratuberculosis
gccggggaucgcgcagccgcgg

SEQ ID NO: 938849 - RNA, 17 nt, Mycobacterium avium subsp. paratuberculosis
gccgggcuuccccaacc

SEQ ID NO: 938850 - RNA, 24 nt, Mycobacterium avium subsp. paratuberculosis
gccgggcuuccccaaccuggacgg

SEQ ID NO: 938851 - RNA, 16 nt, Mycobacterium avium subsp. paratuberculosis
gccgggcugguccgga

SEQ ID NO: 938852 - RNA, 20 nt, Mycobacterium avium subsp. paratuberculosis
gccgggcugguccggaaccg

SEQ ID NO: 938853 - RNA, 20 nt, Mycobacterium avium subsp. paratuberculosis
gccgggcuggccgucggcga

SEQ ID NO: 938854 - RNA, 22 nt, Mycobacterium avium subsp. paratuberculosis
gccgggcuggccgucggcgaug

SEQ ID NO: 938855 - RNA, 16 nt, Mycobacterium avium subsp. paratuberculosis
gccgggcuggcgcugg

SEQ ID NO: 938856 - RNA, 14 nt, Mycobacterium avium subsp. paratuberculosis
gccgggcugcacgc

SEQ ID NO: 938857 - RNA, 12 nt, Mycobacterium avium subsp. paratuberculosis
gccgggcucgcc

SEQ ID NO: 938858 - RNA, 12 nt, Mycobacterium avium subsp. paratuberculosis
gccgggcugacc

SEQ ID NO: 938859 - RNA, 20 nt, Mycobacterium avium subsp. paratuberculosis
gccgggcugaccgucgacca

SEQ ID NO: 938860 - RNA, 22 nt, Mycobacterium avium subsp. paratuberculosis
gccgggcugaccgucgaccaac

SEQ ID NO: 938861 - RNA, 22 nt, Mycobacterium avium subsp. paratuberculosis
gccgggcugagcugugccgcgg

SEQ ID NO: 938862 - RNA, 13 nt, Mycobacterium avium subsp. paratuberculosis
gccgggcucgagg

SEQ ID NO: 938863 - RNA, 18 nt, Mycobacterium avium subsp. paratuberculosis
gccgggcuccgcguucga

SEQ ID NO: 938864 - RNA, 19 nt, Mycobacterium avium subsp. paratuberculosis
gccgggcuccgcguucgac

SEQ ID NO: 938865 - RNA, 13 nt, Mycobacterium avium subsp. paratuberculosis
gccgggcucccgc

SEQ ID NO: 938866 - RNA, 17 nt, Mycobacterium avium subsp. paratuberculosis
gccgggcucccgcucca

SEQ ID NO: 938867 - RNA, 13 nt, Mycobacterium avium subsp. paratuberculosis
gccgggcgucgac

SEQ ID NO: 938868 - RNA, 14 nt, Mycobacterium avium subsp. paratuberculosis
gccgggcgucgacg

SEQ ID NO: 938869 - RNA, 14 nt, Mycobacterium avium subsp. paratuberculosis
gccgggcgucgcgc

SEQ ID NO: 938870 - RNA, 16 nt, Mycobacterium avium subsp. paratuberculosis
gccgggcgugcccggc

SEQ ID NO: 938871 - RNA, 18 nt, Mycobacterium avium subsp. paratuberculosis
gccgggcgugcccggcgc

SEQ ID NO: 938872 - RNA, 20 nt, Mycobacterium avium subsp. paratuberculosis
gccgggcguugcccgccgcg

SEQ ID NO: 938873 - RNA, 21 nt, Mycobacterium avium subsp. paratuberculosis
gccgggcguugcccgccgcgg

SEQ ID NO: 938874 - RNA, 23 nt, Mycobacterium avium subsp. paratuberculosis
gccgggcguugcccgccgcggcg

SEQ ID NO: 938875 - RNA, 13 nt, Mycobacterium avium subsp. paratuberculosis
gccgggcggcguc

SEQ ID NO: 938876 - RNA, 18 nt, Mycobacterium avium subsp. paratuberculosis
gccgggcggcgacgucgu

SEQ ID NO: 938877 - RNA, 14 nt, Mycobacterium avium subsp. paratuberculosis
gccgggcggcgccg

SEQ ID NO: 938878 - RNA, 21 nt, Mycobacterium avium subsp. paratuberculosis
gccgggcggcgccgaaccggg

SEQ ID NO: 938879 - RNA, 13 nt, Mycobacterium avium subsp. paratuberculosis
gccgggcgaucau

SEQ ID NO: 938880 - RNA, 19 nt, Mycobacterium avium subsp. paratuberculosis
gccgggcggcccgccucgg

SEQ ID NO: 938881 - RNA, 18 nt, Mycobacterium avium subsp. paratuberculosis
gccgggcggccggagccg

SEQ ID NO: 938882 - RNA, 15 nt, Mycobacterium avium subsp. paratuberculosis
gccgggcgcuggccg

SEQ ID NO: 938883 - RNA, 22 nt, Mycobacterium avium subsp. paratuberculosis
gccgggcggacggcaccgacgg

SEQ ID NO: 938884 - RNA, 14 nt, Mycobacterium avium subsp. paratuberculosis
gccgggcggcagca

SEQ ID NO: 938885 - RNA, 16 nt, Mycobacterium avium subsp. paratuberculosis
gccgggcggcagcagc

SEQ ID NO: 938886 - RNA, 18 nt, Mycobacterium avium subsp. paratuberculosis
gccgggcggcagcagcug

SEQ ID NO: 938887 - RNA, 20 nt, Mycobacterium avium subsp. paratuberculosis
gccgggcggcagcagcugcg

SEQ ID NO: 938888 - RNA, 14 nt, Mycobacterium avium subsp. paratuberculosis
gccgggcggccagc

SEQ ID NO: 938889 - RNA, 16 nt, Mycobacterium avium subsp. paratuberculosis
gccgggcggccagcgu

SEQ ID NO: 938890 - RNA, 14 nt, Mycobacterium avium subsp. paratuberculosis
gccgggcgggcacc

SEQ ID NO: 938891 - RNA, 13 nt, Mycobacterium avium subsp. paratuberculosis
gccgggcgggccg

SEQ ID NO: 938892 - RNA, 14 nt, Mycobacterium avium subsp. paratuberculosis
gccgggcgggccgc

SEQ ID NO: 938893 - RNA, 15 nt, Mycobacterium avium subsp. paratuberculosis
gccgggcgggccgca

SEQ ID NO: 938894 - RNA, 17 nt, Mycobacterium avium subsp. paratuberculosis
gccgggcgggccgcagc

SEQ ID NO: 938895 - RNA, 21 nt, Mycobacterium avium subsp. paratuberculosis
gccgggcgggccgcagcacca

SEQ ID NO: 938896 - RNA, 19 nt, Mycobacterium avium subsp. paratuberculosis
gccgggcgggggcugucca

SEQ ID NO: 938897 - RNA, 14 nt, Mycobacterium avium subsp. paratuberculosis
gccgggcguagucg

SEQ ID NO: 938898 - RNA, 16 nt, Mycobacterium avium subsp. paratuberculosis
gccgggcguagucgau

SEQ ID NO: 938899 - RNA, 19 nt, Mycobacterium avium subsp. paratuberculosis
gccgggcguagucgauggc

SEQ ID NO: 938900 - RNA, 20 nt, Mycobacterium avium subsp. paratuberculosis
gccgggcgucacgccagcgu

SEQ ID NO: 938901 - RNA, 22 nt, Mycobacterium avium subsp. paratuberculosis
gccgggcgucacgccagcguga

SEQ ID NO: 938902 - RNA, 22 nt, Mycobacterium avium subsp. paratuberculosis
gccgggcgucacucuggcguga

SEQ ID NO: 938903 - RNA, 16 nt, Mycobacterium avium subsp. paratuberculosis
gccggguggcccgccc

SEQ ID NO: 938904 - RNA, 15 nt, Mycobacterium avium subsp. paratuberculosis
gccggguggcccgcg

SEQ ID NO: 938905 - RNA, 17 nt, Mycobacterium avium subsp. paratuberculosis
gccggguggcccgcgcg

SEQ ID NO: 938906 - RNA, 22 nt, Mycobacterium avium subsp. paratuberculosis
gccggguggccgccacguccgg

SEQ ID NO: 938907 - RNA, 23 nt, Mycobacterium avium subsp. paratuberculosis
gccgggugcugaacgccugccgg

SEQ ID NO: 938908 - RNA, 19 nt, Mycobacterium avium subsp. paratuberculosis
gccgggucuuccacgccgg

SEQ ID NO: 938909 - RNA, 15 nt, Mycobacterium avium subsp. paratuberculosis
gccgguaccgccggc

SEQ ID NO: 938910 - RNA, 16 nt, Mycobacterium avium subsp. paratuberculosis
gccgguaccgccggcc

SEQ ID NO: 938911 - RNA, 17 nt, Mycobacterium avium subsp. paratuberculosis
gccgguaccgccggcca

SEQ ID NO: 938912 - RNA, 21 nt, Mycobacterium avium subsp. paratuberculosis
gccgguaccgccggccaggcg

SEQ ID NO: 938913 - RNA, 14 nt, Mycobacterium avium subsp. paratuberculosis
gccgguagagcgcc

SEQ ID NO: 938914 - RNA, 14 nt, Mycobacterium avium subsp. paratuberculosis
gccgguagaucagc

SEQ ID NO: 938915 - RNA, 17 nt, Mycobacterium avium subsp. paratuberculosis
gccgguagaucagcgcc

SEQ ID NO: 938916 - RNA, 21 nt, Mycobacterium avium subsp. paratuberculosis
gccgguagaucagcgccuggu

SEQ ID NO: 938917 - RNA, 21 nt, Mycobacterium avium subsp. paratuberculosis
gccgguagccgcucgcccagc

SEQ ID NO: 938918 - RNA, 22 nt, Mycobacterium avium subsp. paratuberculosis
gccgguagccgcucgcccagcg

SEQ ID NO: 938919 - RNA, 15 nt, Mycobacterium avium subsp. paratuberculosis
gccgguacggccgac

SEQ ID NO: 938920 - RNA, 15 nt, Mycobacterium avium subsp. paratuberculosis
gccggucgccgggcc

SEQ ID NO: 938921 - RNA, 16 nt, Mycobacterium avium subsp. paratuberculosis
gccggucgccgggccg

SEQ ID NO: 938922 - RNA, 21 nt, Mycobacterium avium subsp. paratuberculosis
gccggucgccgggccggccgg

SEQ ID NO: 938923 - RNA, 22 nt, Mycobacterium avium subsp. paratuberculosis
gccggucgcgcaucgccucggc

SEQ ID NO: 938924 - RNA, 23 nt, Mycobacterium avium subsp. paratuberculosis
gccggucgcgcaucgccucggcg

SEQ ID NO: 938925 - RNA, 16 nt, Mycobacterium avium subsp. paratuberculosis
gccgguccagugccgg

SEQ ID NO: 938926 - RNA, 18 nt, Mycobacterium avium subsp. paratuberculosis
gccgguccagugccggcg

SEQ ID NO: 938927 - RNA, 20 nt, Mycobacterium avium subsp. paratuberculosis
gccggucauaggccgcgcag

SEQ ID NO: 938928 - RNA, 21 nt, Mycobacterium avium subsp. paratuberculosis
gccggucauaggccgcgcaga

SEQ ID NO: 938929 - RNA, 17 nt, Mycobacterium avium subsp. paratuberculosis
gccggucauccgggcca

SEQ ID NO: 938930 - RNA, 22 nt, Mycobacterium avium subsp. paratuberculosis
gccggucauccgggccaccacc

SEQ ID NO: 938931 - RNA, 12 nt, Mycobacterium avium subsp. paratuberculosis
gccgggugaugc

SEQ ID NO: 938932 - RNA, 19 nt, Mycobacterium avium subsp. paratuberculosis
gccgguccagccgccgcgu

SEQ ID NO: 938933 - RNA, 15 nt, Mycobacterium avium subsp. paratuberculosis
gccgguaggcggcca

SEQ ID NO: 938934 - RNA, 16 nt, Mycobacterium avium subsp. paratuberculosis
gccgguaggcggccag

SEQ ID NO: 938935 - RNA, 22 nt, Mycobacterium avium subsp. paratuberculosis
gccggucaggcauuccaccgcg

SEQ ID NO: 938936 - RNA, 23 nt, Mycobacterium avium subsp. paratuberculosis
gccggucaggcauuccaccgcgc

SEQ ID NO: 938937 - RNA, 17 nt, Mycobacterium avium subsp. paratuberculosis
gccgguacggaucgccg

SEQ ID NO: 938938 - RNA, 18 nt, Mycobacterium avium subsp. paratuberculosis
gccgguacggaucgccgg

SEQ ID NO: 938939 - RNA, 14 nt, Mycobacterium avium subsp. paratuberculosis
gccgguaggccgcg

SEQ ID NO: 938940 - RNA, 20 nt, Mycobacterium avium subsp. paratuberculosis
gccgguaggccgcgccgauc

SEQ ID NO: 938941 - RNA, 14 nt, Mycobacterium avium subsp. paratuberculosis
gccgguaggcggcc

SEQ ID NO: 938942 - RNA, 18 nt, Mycobacterium avium subsp. paratuberculosis
gccgguaggcggccagcg

SEQ ID NO: 938943 - RNA, 21 nt, Mycobacterium avium subsp. paratuberculosis
gccgguaggcggccagcgccc

SEQ ID NO: 938944 - RNA, 14 nt, Mycobacterium avium subsp. paratuberculosis
gccggucagcgcga

SEQ ID NO: 938945 - RNA, 19 nt, Mycobacterium avium subsp. paratuberculosis
gccggucagcgcgacaucg

SEQ ID NO: 938946 - RNA, 20 nt, Mycobacterium avium subsp. paratuberculosis
gccggucagcgcuccuggcc

SEQ ID NO: 938947 - RNA, 23 nt, Mycobacterium avium subsp. paratuberculosis
gccggucagcgcuccuggccgga

SEQ ID NO: 938948 - RNA, 21 nt, Mycobacterium avium subsp. paratuberculosis
gccggucagcggcaacacgcc

SEQ ID NO: 938949 - RNA, 22 nt, Mycobacterium avium subsp. paratuberculosis
gccggucagcggcaacacgccg

SEQ ID NO: 938950 - RNA, 13 nt, Mycobacterium avium subsp. paratuberculosis
gccgggguccgca

SEQ ID NO: 938951 - RNA, 16 nt, Mycobacterium avium subsp. paratuberculosis
gccgggguccgcaacg

SEQ ID NO: 938952 - RNA, 17 nt, Mycobacterium avium subsp. paratuberculosis
gccggggugcagcacca

SEQ ID NO: 938953 - RNA, 20 nt, Mycobacterium avium subsp. paratuberculosis
gccggggugcagcaccacga

SEQ ID NO: 938954 - RNA, 18 nt, Mycobacterium avium subsp. paratuberculosis
gccggggugcccgggccg

SEQ ID NO: 938955 - RNA, 19 nt, Mycobacterium avium subsp. paratuberculosis
gccggggugcccgggccgc

SEQ ID NO: 938956 - RNA, 13 nt, Mycobacterium avium subsp. paratuberculosis
gccggggucgcgc

SEQ ID NO: 938957 - RNA, 17 nt, Mycobacterium avium subsp. paratuberculosis
gccggggucgcgcgcga

SEQ ID NO: 938958 - RNA, 17 nt, Mycobacterium avium subsp. paratuberculosis
gccgggguuuucguggu

SEQ ID NO: 938959 - RNA, 14 nt, Mycobacterium avium subsp. paratuberculosis
gccgggucaguucg

SEQ ID NO: 938960 - RNA, 18 nt, Mycobacterium avium subsp. paratuberculosis
gccgggucaguucgcggc

SEQ ID NO: 938961 - RNA, 17 nt, Mycobacterium avium subsp. paratuberculosis
gccgggucauccagccg

SEQ ID NO: 938962 - RNA, 20 nt, Mycobacterium avium subsp. paratuberculosis
gccggguaucgacagucccg

SEQ ID NO: 938963 - RNA, 15 nt, Mycobacterium avium subsp. paratuberculosis
gccgggucgccgucg

SEQ ID NO: 938964 - RNA, 16 nt, Mycobacterium avium subsp. paratuberculosis
gccgggucgccgucga

SEQ ID NO: 938965 - RNA, 13 nt, Mycobacterium avium subsp. paratuberculosis
gccgggucgcggu

SEQ ID NO: 938966 - RNA, 23 nt, Mycobacterium avium subsp. paratuberculosis
gccgggucgcggugggcucggcg

SEQ ID NO: 938967 - RNA, 14 nt, Mycobacterium avium subsp. paratuberculosis
gccgggucgagcgc

SEQ ID NO: 938968 - RNA, 17 nt, Mycobacterium avium subsp. paratuberculosis
gccgggucgagcgcgcc

SEQ ID NO: 938969 - RNA, 13 nt, Mycobacterium avium subsp. paratuberculosis
gccgggucgacgc

SEQ ID NO: 938970 - RNA, 16 nt, Mycobacterium avium subsp. paratuberculosis
gccgggucgcacgccg

SEQ ID NO: 938971 - RNA, 13 nt, Mycobacterium avium subsp. paratuberculosis
gccgggucgcagc

SEQ ID NO: 938972 - RNA, 18 nt, Mycobacterium avium subsp. paratuberculosis
gccggguccuggaaggcg

SEQ ID NO: 938973 - RNA, 15 nt, Mycobacterium avium subsp. paratuberculosis
gccggguccuugcgc

SEQ ID NO: 938974 - RNA, 21 nt, Mycobacterium avium subsp. paratuberculosis
gccggguccuugcgccccggc

SEQ ID NO: 938975 - RNA, 16 nt, Mycobacterium avium subsp. paratuberculosis
gccggguccagccgcg

SEQ ID NO: 938976 - RNA, 20 nt, Mycobacterium avium subsp. paratuberculosis
gccggguccagccgcgguuc

SEQ ID NO: 938977 - RNA, 16 nt, Mycobacterium avium subsp. paratuberculosis
gccgggucccagugcc

SEQ ID NO: 938978 - RNA, 23 nt, Mycobacterium avium subsp. paratuberculosis
gccgggucccuuugcuguucguc

SEQ ID NO: 938979 - RNA, 17 nt, Mycobacterium avium subsp. paratuberculosis
gccggguccgcacccgg

SEQ ID NO: 938980 - RNA, 12 nt, Mycobacterium avium subsp. paratuberculosis
gccggggccggc

SEQ ID NO: 938981 - RNA, 13 nt, Mycobacterium avium subsp. paratuberculosis
gccggggccggcg

SEQ ID NO: 938982 - RNA, 15 nt, Mycobacterium avium subsp. paratuberculosis
gccggggccggcgau

SEQ ID NO: 938983 - RNA, 20 nt, Mycobacterium avium subsp. paratuberculosis
gccggggcgcugagcagguc

SEQ ID NO: 938984 - RNA, 12 nt, Mycobacterium avium subsp. paratuberculosis
gccggggcgcag

SEQ ID NO: 938985 - RNA, 13 nt, Mycobacterium avium subsp. paratuberculosis
gccggggcgccac

SEQ ID NO: 938986 - RNA, 16 nt, Mycobacterium avium subsp. paratuberculosis
gccggggcgccgccga

SEQ ID NO: 938987 - RNA, 22 nt, Mycobacterium avium subsp. paratuberculosis
gccggggcccucgcucaacccg

SEQ ID NO: 938988 - RNA, 22 nt, Mycobacterium avium subsp. paratuberculosis
gccggggacggugcagccgggg

SEQ ID NO: 938989 - RNA, 15 nt, Mycobacterium avium subsp. paratuberculosis
gccggggcagacccg

SEQ ID NO: 938990 - RNA, 21 nt, Mycobacterium avium subsp. paratuberculosis
gccggggcagacccgcgucga

SEQ ID NO: 938991 - RNA, 22 nt, Mycobacterium avium subsp. paratuberculosis
gccggggcagacccgcgucgau

SEQ ID NO: 938992 - RNA, 13 nt, Mycobacterium avium subsp. paratuberculosis
gccggggcagcac

SEQ ID NO: 938993 - RNA, 15 nt, Mycobacterium avium subsp. paratuberculosis
gccggggcagcaccc

SEQ ID NO: 938994 - RNA, 19 nt, Mycobacterium avium subsp. paratuberculosis
gccggggcagcacccgcac

SEQ ID NO: 938995 - RNA, 17 nt, Mycobacterium avium subsp. paratuberculosis
gccggggcagcugcugg

SEQ ID NO: 938996 - RNA, 14 nt, Mycobacterium avium subsp. paratuberculosis
gccgggggcggcgg

SEQ ID NO: 938997 - RNA, 16 nt, Mycobacterium avium subsp. paratuberculosis
gccgggggcggcggcg

SEQ ID NO: 938998 - RNA, 13 nt, Mycobacterium avium subsp. paratuberculosis
gccgggggcggug

SEQ ID NO: 938999 - RNA, 16 nt, Mycobacterium avium subsp. paratuberculosis
gccgggggcggugcag

SEQ ID NO: 939000 - RNA, 17 nt, Mycobacterium avium subsp. paratuberculosis
gccgggggcggugcagc

SEQ ID NO: 939001 - RNA, 18 nt, Mycobacterium avium subsp. paratuberculosis
gccgggggcggugcagcc

SEQ ID NO: 939002 - RNA, 20 nt, Mycobacterium avium subsp. paratuberculosis
gccgggggcggugcagccgg

SEQ ID NO: 939003 - RNA, 19 nt, Mycobacterium avium subsp. paratuberculosis
gccggggcucauacggcgg

SEQ ID NO: 939004 - RNA, 19 nt, Mycobacterium avium subsp. paratuberculosis
gccggggccuucuuggcgg

SEQ ID NO: 939005 - RNA, 14 nt, Mycobacterium avium subsp. paratuberculosis
gccgggggucggcu

SEQ ID NO: 939006 - RNA, 22 nt, Mycobacterium avium subsp. paratuberculosis
gccgggguagaggccgcggauc

SEQ ID NO: 939007 - RNA, 19 nt, Mycobacterium avium subsp. paratuberculosis
gccgggguagggcggcggg

SEQ ID NO: 939008 - RNA, 23 nt, Mycobacterium avium subsp. paratuberculosis
gccgggguagggcggcgggguuc

SEQ ID NO: 939009 - RNA, 21 nt, Mycobacterium avium subsp. paratuberculosis
gccggggcgggcacgucgcgc

SEQ ID NO: 939010 - RNA, 17 nt, Mycobacterium avium subsp. paratuberculosis
gccggggcgggcggcgg

SEQ ID NO: 939011 - RNA, 20 nt, Mycobacterium avium subsp. paratuberculosis
gccggggcuucgaacgcccg

SEQ ID NO: 939012 - RNA, 23 nt, Mycobacterium avium subsp. paratuberculosis
gccggggcuucgaacgcccgcac

SEQ ID NO: 939013 - RNA, 16 nt, Mycobacterium avium subsp. paratuberculosis
gccgguucgcuggcgg

SEQ ID NO: 939014 - RNA, 20 nt, Mycobacterium avium subsp. paratuberculosis
gccgguucgcuggcggccag

SEQ ID NO: 939015 - RNA, 22 nt, Mycobacterium avium subsp. paratuberculosis
gccgguucgcuggcggccagcg

SEQ ID NO: 939016 - RNA, 23 nt, Mycobacterium avium subsp. paratuberculosis
gccgguucgcuggcggccagcgu

SEQ ID NO: 939017 - RNA, 18 nt, Mycobacterium avium subsp. paratuberculosis
gccgguguucaagccggc

SEQ ID NO: 939018 - RNA, 19 nt, Mycobacterium avium subsp. paratuberculosis
gccgguguucaagccggcg

SEQ ID NO: 939019 - RNA, 20 nt, Mycobacterium avium subsp. paratuberculosis
gccgguguucaagccggcgu

SEQ ID NO: 939020 - RNA, 21 nt, Mycobacterium avium subsp. paratuberculosis
gccgguguucaagccggcgug

SEQ ID NO: 939021 - RNA, 23 nt, Mycobacterium avium subsp. paratuberculosis
gccgguguucaagccggcgugga

SEQ ID NO: 939022 - RNA, 13 nt, Mycobacterium avium subsp. paratuberculosis
gccgguguucggc

SEQ ID NO: 939023 - RNA, 17 nt, Mycobacterium avium subsp. paratuberculosis
gccgguguucggcgcca

SEQ ID NO: 939024 - RNA, 15 nt, Mycobacterium avium subsp. paratuberculosis
gccgguguugccgac

SEQ ID NO: 939025 - RNA, 17 nt, Mycobacterium avium subsp. paratuberculosis
gccgguguugccgacgg

SEQ ID NO: 939026 - RNA, 21 nt, Mycobacterium avium subsp. paratuberculosis
gccggugcgcgucagccgucg

SEQ ID NO: 939027 - RNA, 22 nt, Mycobacterium avium subsp. paratuberculosis
gccggugcgcgucagccgucgu

SEQ ID NO: 939028 - RNA, 15 nt, Mycobacterium avium subsp. paratuberculosis
gccggugcgagccgc

SEQ ID NO: 939029 - RNA, 14 nt, Mycobacterium avium subsp. paratuberculosis
gccggugcgccgac

SEQ ID NO: 939030 - RNA, 17 nt, Mycobacterium avium subsp. paratuberculosis
gccggugcgccgaccgc

SEQ ID NO: 939031 - RNA, 18 nt, Mycobacterium avium subsp. paratuberculosis
gccggugcgccgaccgcg

SEQ ID NO: 939032 - RNA, 22 nt, Mycobacterium avium subsp. paratuberculosis
gccggugcgccgaccgcgaucg

SEQ ID NO: 939033 - RNA, 15 nt, Mycobacterium avium subsp. paratuberculosis
gccggugugaucgag

SEQ ID NO: 939034 - RNA, 20 nt, Mycobacterium avium subsp. paratuberculosis
gccggugugaucgagcacca

SEQ ID NO: 939035 - RNA, 22 nt, Mycobacterium avium subsp. paratuberculosis
gccggugugaucgagcaccagc

SEQ ID NO: 939036 - RNA, 19 nt, Mycobacterium avium subsp. paratuberculosis
gccggugugcagccacccg

SEQ ID NO: 939037 - RNA, 21 nt, Mycobacterium avium subsp. paratuberculosis
gccggugccgacgaugagggc

SEQ ID NO: 939038 - RNA, 12 nt, Mycobacterium avium subsp. paratuberculosis
gccggugccgcc

SEQ ID NO: 939039 - RNA, 14 nt, Mycobacterium avium subsp. paratuberculosis
gccggugccgccgg

SEQ ID NO: 939040 - RNA, 16 nt, Mycobacterium avium subsp. paratuberculosis
gccggugccgccggcg

SEQ ID NO: 939041 - RNA, 17 nt, Mycobacterium avium subsp. paratuberculosis
gccggugccgccggcgc

SEQ ID NO: 939042 - RNA, 15 nt, Mycobacterium avium subsp. paratuberculosis
gccggucugggcgac

SEQ ID NO: 939043 - RNA, 20 nt, Mycobacterium avium subsp. paratuberculosis
gccggucugggcgaccaugc

SEQ ID NO: 939044 - RNA, 23 nt, Mycobacterium avium subsp. paratuberculosis
gccggucugggcgaccaugccgc

SEQ ID NO: 939045 - RNA, 14 nt, Mycobacterium avium subsp. paratuberculosis
gccggucucgaaca

SEQ ID NO: 939046 - RNA, 22 nt, Mycobacterium avium subsp. paratuberculosis
gccggucguuacgacucggccu

SEQ ID NO: 939047 - RNA, 15 nt, Mycobacterium avium subsp. paratuberculosis
gccggucggcccgcu

SEQ ID NO: 939048 - RNA, 12 nt, Mycobacterium avium subsp. paratuberculosis
gccggucguagc

SEQ ID NO: 939049 - RNA, 12 nt, Mycobacterium avium subsp. paratuberculosis
gccggucgucgg

SEQ ID NO: 939050 - RNA, 13 nt, Mycobacterium avium subsp. paratuberculosis
gccggucgucggg

SEQ ID NO: 939051 - RNA, 15 nt, Mycobacterium avium subsp. paratuberculosis
gccggucggcggaac

SEQ ID NO: 939052 - RNA, 22 nt, Mycobacterium avium subsp. paratuberculosis
gccggucgggauggcggcguug

SEQ ID NO: 939053 - RNA, 17 nt, Mycobacterium avium subsp. paratuberculosis
gccggucggucagucgc

SEQ ID NO: 939054 - RNA, 19 nt, Mycobacterium avium subsp. paratuberculosis
gccggucggucagucgcgc

SEQ ID NO: 939055 - RNA, 21 nt, Mycobacterium avium subsp. paratuberculosis
gccggucggucagucgcgccg

SEQ ID NO: 939056 - RNA, 22 nt, Mycobacterium avium subsp. paratuberculosis
gccggucggucagucgcgccgc

SEQ ID NO: 939057 - RNA, 17 nt, Mycobacterium avium subsp. paratuberculosis
gccggucggucggccgc

SEQ ID NO: 939058 - RNA, 20 nt, Mycobacterium avium subsp. paratuberculosis
gccggucggucggccgcacg

SEQ ID NO: 939059 - RNA, 22 nt, Mycobacterium avium subsp. paratuberculosis
gccggucggucggccgcacguc

SEQ ID NO: 939060 - RNA, 14 nt, Mycobacterium avium subsp. paratuberculosis
gccguacacggcgg

SEQ ID NO: 939061 - RNA, 15 nt, Mycobacterium avium subsp. paratuberculosis
gccguacacggcggc

SEQ ID NO: 939062 - RNA, 19 nt, Mycobacterium avium subsp. paratuberculosis
gccguacacggcggcgaag

SEQ ID NO: 939063 - RNA, 15 nt, Mycobacterium avium subsp. paratuberculosis
gccguacagcugguc

SEQ ID NO: 939064 - RNA, 21 nt, Mycobacterium avium subsp. paratuberculosis
gccguacagcugguccggccg

SEQ ID NO: 939065 - RNA, 21 nt, Mycobacterium avium subsp. paratuberculosis
gccguacauggugaccagcgu

SEQ ID NO: 939066 - RNA, 16 nt, Mycobacterium avium subsp. paratuberculosis
gccguagccggcggug

SEQ ID NO: 939067 - RNA, 16 nt, Mycobacterium avium subsp. paratuberculosis
gccguagcgcaacacc

SEQ ID NO: 939068 - RNA, 18 nt, Mycobacterium avium subsp. paratuberculosis
gccguagcgcaacaccga

SEQ ID NO: 939069 - RNA, 13 nt, Mycobacterium avium subsp. paratuberculosis
gccguagguggcc

SEQ ID NO: 939070 - RNA, 22 nt, Mycobacterium avium subsp. paratuberculosis
gccguaggaguagcaggcaucg

SEQ ID NO: 939071 - RNA, 15 nt, Mycobacterium avium subsp. paratuberculosis
gccguagcgagcgcu

SEQ ID NO: 939072 - RNA, 15 nt, Mycobacterium avium subsp. paratuberculosis
gccguaggccgcgcu

SEQ ID NO: 939073 - RNA, 16 nt, Mycobacterium avium subsp. paratuberculosis
gccguagcggcucgcc

SEQ ID NO: 939074 - RNA, 19 nt, Mycobacterium avium subsp. paratuberculosis
gccguagcggcucgccacc

SEQ ID NO: 939075 - RNA, 22 nt, Mycobacterium avium subsp. paratuberculosis
gccguagcggcucgccaccucg

SEQ ID NO: 939076 - RNA, 13 nt, Mycobacterium avium subsp. paratuberculosis
gccguagcggucg

SEQ ID NO: 939077 - RNA, 15 nt, Mycobacterium avium subsp. paratuberculosis
gccguagcggucgcc

SEQ ID NO: 939078 - RNA, 18 nt, Mycobacterium avium subsp. paratuberculosis
gccguagcggucgcccca

SEQ ID NO: 939079 - RNA, 21 nt, Mycobacterium avium subsp. paratuberculosis
gccguagcgcugggugaacac

SEQ ID NO: 939080 - RNA, 19 nt, Mycobacterium avium subsp. paratuberculosis
gccgguuuucggcgugucg

SEQ ID NO: 939081 - RNA, 18 nt, Mycobacterium avium subsp. paratuberculosis
gccguaaguggcgccgcg

SEQ ID NO: 939082 - RNA, 18 nt, Mycobacterium avium subsp. paratuberculosis
gccguaaccgccguuggc

SEQ ID NO: 939083 - RNA, 17 nt, Mycobacterium avium subsp. paratuberculosis
gccgguuuccaggacga

SEQ ID NO: 939084 - RNA, 22 nt, Mycobacterium avium subsp. paratuberculosis
gccgguugacccucagcagggc

SEQ ID NO: 939085 - RNA, 17 nt, Mycobacterium avium subsp. paratuberculosis
gccgguucgucgugucg

SEQ ID NO: 939086 - RNA, 22 nt, Mycobacterium avium subsp. paratuberculosis
gccgguugccuuuccgcgcggc

SEQ ID NO: 939087 - RNA, 15 nt, Mycobacterium avium subsp. paratuberculosis
gccgguuggugcgcc

SEQ ID NO: 939088 - RNA, 17 nt, Mycobacterium avium subsp. paratuberculosis
gccgguuggugcgccgu

SEQ ID NO: 939089 - RNA, 18 nt, Mycobacterium avium subsp. paratuberculosis
gccgguuggugcgccguc

SEQ ID NO: 939090 - RNA, 19 nt, Mycobacterium avium subsp. paratuberculosis
gccgguuggugcgccguca

SEQ ID NO: 939091 - RNA, 18 nt, Mycobacterium avium subsp. paratuberculosis
gccgguuguugcggucca

SEQ ID NO: 939092 - RNA, 17 nt, Mycobacterium avium subsp. paratuberculosis
gcgcagcgcgucgcgcc

SEQ ID NO: 939093 - RNA, 14 nt, Mycobacterium avium subsp. paratuberculosis
gcgcagcgccucgg

SEQ ID NO: 939094 - RNA, 17 nt, Mycobacterium avium subsp. paratuberculosis
gcgcagcgccucggcgg

SEQ ID NO: 939095 - RNA, 15 nt, Mycobacterium avium subsp. paratuberculosis
gcgcagcgcgucggg

SEQ ID NO: 939096 - RNA, 16 nt, Mycobacterium avium subsp. paratuberculosis
gcgcagcgcgucgggc

SEQ ID NO: 939097 - RNA, 18 nt, Mycobacterium avium subsp. paratuberculosis
gcgcagcgcgucgggcuc

SEQ ID NO: 939098 - RNA, 16 nt, Mycobacterium avium subsp. paratuberculosis
gcgcagcgcgucgucg

SEQ ID NO: 939099 - RNA, 19 nt, Mycobacterium avium subsp. paratuberculosis
gcgcagcgcgucgucgguc

SEQ ID NO: 939100 - RNA, 13 nt, Mycobacterium avium subsp. paratuberculosis
gcgcagcgcccag

SEQ ID NO: 939101 - RNA, 15 nt, Mycobacterium avium subsp. paratuberculosis
gcgcagcucgacgac

SEQ ID NO: 939102 - RNA, 22 nt, Mycobacterium avium subsp. paratuberculosis
gcgcagcucgacgaccucgccg

SEQ ID NO: 939103 - RNA, 24 nt, Mycobacterium avium subsp. paratuberculosis
gcgcagcucgacgaccucgccgac

SEQ ID NO: 939104 - RNA, 14 nt, Mycobacterium avium subsp. paratuberculosis
gcgcagcucgcgca

SEQ ID NO: 939105 - RNA, 18 nt, Mycobacterium avium subsp. paratuberculosis
gcgcagcucgcgcagccg

SEQ ID NO: 939106 - RNA, 20 nt, Mycobacterium avium subsp. paratuberculosis
gcgcagcucgcgcagccggc

SEQ ID NO: 939107 - RNA, 17 nt, Mycobacterium avium subsp. paratuberculosis
gcgcagcucgcgcagcu

SEQ ID NO: 939108 - RNA, 16 nt, Mycobacterium avium subsp. paratuberculosis
gcgcagcucggggucg

SEQ ID NO: 939109 - RNA, 20 nt, Mycobacterium avium subsp. paratuberculosis
gcgcagcucggggucggcgu

SEQ ID NO: 939110 - RNA, 13 nt, Mycobacterium avium subsp. paratuberculosis
gcgcagcgugucg

SEQ ID NO: 939111 - RNA, 21 nt, Mycobacterium avium subsp. paratuberculosis
gcgcagcgucaucgcguagug

SEQ ID NO: 939112 - RNA, 15 nt, Mycobacterium avium subsp. paratuberculosis
gcgcagcgucggcgu

SEQ ID NO: 939113 - RNA, 21 nt, Mycobacterium avium subsp. paratuberculosis
gcgcagcgucggcgugcccgc

SEQ ID NO: 939114 - RNA, 16 nt, Mycobacterium avium subsp. paratuberculosis
gcgcagcgucucccgg

SEQ ID NO: 939115 - RNA, 21 nt, Mycobacterium avium subsp. paratuberculosis
gcgcagcgucucccgggugcg

SEQ ID NO: 939116 - RNA, 22 nt, Mycobacterium avium subsp. paratuberculosis
gcgcagcgucuccucgaccgcc

SEQ ID NO: 939117 - RNA, 17 nt, Mycobacterium avium subsp. paratuberculosis
gcgcagcgucucgaucg

SEQ ID NO: 939118 - RNA, 21 nt, Mycobacterium avium subsp. paratuberculosis
gcgcagcgucucgaucgacga

SEQ ID NO: 939119 - RNA, 22 nt, Mycobacterium avium subsp. paratuberculosis
gcgcagcgucuugcccagcggg

SEQ ID NO: 939120 - RNA, 14 nt, Mycobacterium avium subsp. paratuberculosis
gcgcaggccgccga

SEQ ID NO: 939121 - RNA, 17 nt, Mycobacterium avium subsp. paratuberculosis
gcgcaggccgccgacga

SEQ ID NO: 939122 - RNA, 20 nt, Mycobacterium avium subsp. paratuberculosis
gcgcaggccgccgacgacgg

SEQ ID NO: 939123 - RNA, 16 nt, Mycobacterium avium subsp. paratuberculosis
gcgcaggccccggcgc

SEQ ID NO: 939124 - RNA, 15 nt, Mycobacterium avium subsp. paratuberculosis
gcgcaggccccgggg

SEQ ID NO: 939125 - RNA, 18 nt, Mycobacterium avium subsp. paratuberculosis
gcgcaggaugcccagcac

SEQ ID NO: 939126 - RNA, 21 nt, Mycobacterium avium subsp. paratuberculosis
gcgcaggaugcccagcaccac

SEQ ID NO: 939127 - RNA, 18 nt, Mycobacterium avium subsp. paratuberculosis
gcgcaggaggcggccaac

SEQ ID NO: 939128 - RNA, 17 nt, Mycobacterium avium subsp. paratuberculosis
gcgcaggaacuccagca

SEQ ID NO: 939129 - RNA, 15 nt, Mycobacterium avium subsp. paratuberculosis
gcgcaggaacagcga

SEQ ID NO: 939130 - RNA, 17 nt, Mycobacterium avium subsp. paratuberculosis
gcgcagcugcgccgcgu

SEQ ID NO: 939131 - RNA, 20 nt, Mycobacterium avium subsp. paratuberculosis
gcgcagcugcgccgcgucga

SEQ ID NO: 939132 - RNA, 22 nt, Mycobacterium avium subsp. paratuberculosis
gcgcagcugcgccgcgucgacg

SEQ ID NO: 939133 - RNA, 13 nt, Mycobacterium avium subsp. paratuberculosis
gcgcagcuggccg

SEQ ID NO: 939134 - RNA, 14 nt, Mycobacterium avium subsp. paratuberculosis
gcgcagcuggccgu

SEQ ID NO: 939135 - RNA, 22 nt, Mycobacterium avium subsp. paratuberculosis
gcgcagcuggccgugcaccguc

SEQ ID NO: 939136 - RNA, 17 nt, Mycobacterium avium subsp. paratuberculosis
gcgcagcugcagcuccu

SEQ ID NO: 939137 - RNA, 22 nt, Mycobacterium avium subsp. paratuberculosis
gcgcagcugcagcuccucggcg

SEQ ID NO: 939138 - RNA, 16 nt, Mycobacterium avium subsp. paratuberculosis
gcgcagcucgucgugg

SEQ ID NO: 939139 - RNA, 22 nt, Mycobacterium avium subsp. paratuberculosis
gcgcaggcgcugagcggguaac

SEQ ID NO: 939140 - RNA, 14 nt, Mycobacterium avium subsp. paratuberculosis
gcgcaggcgcgcgg

SEQ ID NO: 939141 - RNA, 17 nt, Mycobacterium avium subsp. paratuberculosis
gcgcaggcgcgcggcca

SEQ ID NO: 939142 - RNA, 14 nt, Mycobacterium avium subsp. paratuberculosis
gcgcaggcgcacca

SEQ ID NO: 939143 - RNA, 16 nt, Mycobacterium avium subsp. paratuberculosis
gcgcaggcgcgcacca

SEQ ID NO: 939144 - RNA, 16 nt, Mycobacterium avium subsp. paratuberculosis
gcgcaggccguccagc

SEQ ID NO: 939145 - RNA, 20 nt, Mycobacterium avium subsp. paratuberculosis
gcgcaggccguccagcagca

SEQ ID NO: 939146 - RNA, 14 nt, Mycobacterium avium subsp. paratuberculosis
gcgcaggccguugu

SEQ ID NO: 939147 - RNA, 22 nt, Mycobacterium avium subsp. paratuberculosis
gcgcaggccguuguggccaccc

SEQ ID NO: 939148 - RNA, 21 nt, Mycobacterium avium subsp. paratuberculosis
gcgcaggcuggcaucgucggc

SEQ ID NO: 939149 - RNA, 22 nt, Mycobacterium avium subsp. paratuberculosis
gcgcaggcuggcaucgucggcg

SEQ ID NO: 939150 - RNA, 23 nt, Mycobacterium avium subsp. paratuberculosis
gcgcaggcuggcaucgucggcgc

SEQ ID NO: 939151 - RNA, 15 nt, Mycobacterium avium subsp. paratuberculosis
gcgcaggcggcgacg

SEQ ID NO: 939152 - RNA, 14 nt, Mycobacterium avium subsp. paratuberculosis
gcgcaggcggcgcg

SEQ ID NO: 939153 - RNA, 20 nt, Mycobacterium avium subsp. paratuberculosis
gcgcaggcggcgcgcagccg

SEQ ID NO: 939154 - RNA, 22 nt, Mycobacterium avium subsp. paratuberculosis
gcgcaggcggcgcgcagccggc

SEQ ID NO: 939155 - RNA, 23 nt, Mycobacterium avium subsp. paratuberculosis
gcgcaggcggcgcgcagccggcc

SEQ ID NO: 939156 - RNA, 14 nt, Mycobacterium avium subsp. paratuberculosis
gcgcagggcggccg

SEQ ID NO: 939157 - RNA, 19 nt, Mycobacterium avium subsp. paratuberculosis
gcgcagguacgcggcguug

SEQ ID NO: 939158 - RNA, 13 nt, Mycobacterium avium subsp. paratuberculosis
gcgcagucggcgu

SEQ ID NO: 939159 - RNA, 14 nt, Mycobacterium avium subsp. paratuberculosis
gcgcagucggcguc

SEQ ID NO: 939160 - RNA, 15 nt, Mycobacterium avium subsp. paratuberculosis
gcgcagucggcgucg

SEQ ID NO: 939161 - RNA, 22 nt, Mycobacterium avium subsp. paratuberculosis
gcgcaggucacccuccucgcgg

SEQ ID NO: 939162 - RNA, 14 nt, Mycobacterium avium subsp. paratuberculosis
gcgcagguccaccc

SEQ ID NO: 939163 - RNA, 19 nt, Mycobacterium avium subsp. paratuberculosis
gcgcagguccggcagcgcg

SEQ ID NO: 939164 - RNA, 20 nt, Mycobacterium avium subsp. paratuberculosis
gcgcagguccggcagcgcgc

SEQ ID NO: 939165 - RNA, 21 nt, Mycobacterium avium subsp. paratuberculosis
gcgcagguccggcagcgcgcc

SEQ ID NO: 939166 - RNA, 22 nt, Mycobacterium avium subsp. paratuberculosis
gcgcagguccggcagcgcgccc

SEQ ID NO: 939167 - RNA, 16 nt, Mycobacterium avium subsp. paratuberculosis
gcgcagguccguggug

SEQ ID NO: 939168 - RNA, 21 nt, Mycobacterium avium subsp. paratuberculosis
gcgcagguccguggugaucgc

SEQ ID NO: 939169 - RNA, 17 nt, Mycobacterium avium subsp. paratuberculosis
gcgcagggcguucgacg

SEQ ID NO: 939170 - RNA, 16 nt, Mycobacterium avium subsp. paratuberculosis
gcgcagggucagcgcu

SEQ ID NO: 939171 - RNA, 17 nt, Mycobacterium avium subsp. paratuberculosis
gcgcagggcggccggcc

SEQ ID NO: 939172 - RNA, 17 nt, Mycobacterium avium subsp. paratuberculosis
gcgcagggcgaacggcg

SEQ ID NO: 939173 - RNA, 23 nt, Mycobacterium avium subsp. paratuberculosis
gcgcagggcgaacuugcuggccg

SEQ ID NO: 939174 - RNA, 20 nt, Mycobacterium avium subsp. paratuberculosis
gcgcagggccagcgccucgg

SEQ ID NO: 939175 - RNA, 22 nt, Mycobacterium avium subsp. paratuberculosis
gcgcagggccagcgccucggcg

SEQ ID NO: 939176 - RNA, 21 nt, Mycobacterium avium subsp. paratuberculosis
gcgccacagcgucucgaccgc

SEQ ID NO: 939177 - RNA, 24 nt, Mycobacterium avium subsp. paratuberculosis
gcgccacagcgucucgaccgcggu

SEQ ID NO: 939178 - RNA, 15 nt, Mycobacterium avium subsp. paratuberculosis
gcgccacagccgggg

SEQ ID NO: 939179 - RNA, 23 nt, Mycobacterium avium subsp. paratuberculosis
gcgccacagccggggaucgcgca

SEQ ID NO: 939180 - RNA, 24 nt, Mycobacterium avium subsp. paratuberculosis
gcgccacagccggggaucgcgcag

SEQ ID NO: 939181 - RNA, 21 nt, Mycobacterium avium subsp. paratuberculosis
gcgccacagcagcaccagcgc

SEQ ID NO: 939182 - RNA, 14 nt, Mycobacterium avium subsp. paratuberculosis
gcgccaccagccac

SEQ ID NO: 939183 - RNA, 19 nt, Mycobacterium avium subsp. paratuberculosis
gcgccaccagccacaccgc

SEQ ID NO: 939184 - RNA, 22 nt, Mycobacterium avium subsp. paratuberculosis
gcgccaccagccacaccgccgc

SEQ ID NO: 939185 - RNA, 13 nt, Mycobacterium avium subsp. paratuberculosis
gcgccaccaggcg

SEQ ID NO: 939186 - RNA, 17 nt, Mycobacterium avium subsp. paratuberculosis
gcgccaccagcaccggg

SEQ ID NO: 939187 - RNA, 17 nt, Mycobacterium avium subsp. paratuberculosis
gcgccacaucagcucgg

SEQ ID NO: 939188 - RNA, 19 nt, Mycobacterium avium subsp. paratuberculosis
gcgccacaucagcucggcg

SEQ ID NO: 939189 - RNA, 22 nt, Mycobacterium avium subsp. paratuberculosis
gcgccacaucagcucggcggcc

SEQ ID NO: 939190 - RNA, 13 nt, Mycobacterium avium subsp. paratuberculosis
gcgccacugccgc

SEQ ID NO: 939191 - RNA, 14 nt, Mycobacterium avium subsp. paratuberculosis
gcgccacugccgcc

SEQ ID NO: 939192 - RNA, 17 nt, Mycobacterium avium subsp. paratuberculosis
gcgccacugccgccgcc

SEQ ID NO: 939193 - RNA, 20 nt, Mycobacterium avium subsp. paratuberculosis
gcgccacugccgccgcccag

SEQ ID NO: 939194 - RNA, 12 nt, Mycobacterium avium subsp. paratuberculosis
gcgccaccgggu

SEQ ID NO: 939195 - RNA, 13 nt, Mycobacterium avium subsp. paratuberculosis
gcgccaccgggua

SEQ ID NO: 939196 - RNA, 17 nt, Mycobacterium avium subsp. paratuberculosis
gcgccacguaucgcgcc

SEQ ID NO: 939197 - RNA, 13 nt, Mycobacterium avium subsp. paratuberculosis
gcgccacgguggc

SEQ ID NO: 939198 - RNA, 24 nt, Mycobacterium avium subsp. paratuberculosis
gcgccacgguggcggucaggguca

SEQ ID NO: 939199 - RNA, 19 nt, Mycobacterium avium subsp. paratuberculosis
gcgccaccgggaccugcug

SEQ ID NO: 939200 - RNA, 17 nt, Mycobacterium avium subsp. paratuberculosis
gcgccaccgaggccagc

SEQ ID NO: 939201 - RNA, 14 nt, Mycobacterium avium subsp. paratuberculosis
gcgccaccgcgggg

SEQ ID NO: 939202 - RNA, 21 nt, Mycobacterium avium subsp. paratuberculosis
gcgccaccgcggggcugggcg

SEQ ID NO: 939203 - RNA, 14 nt, Mycobacterium avium subsp. paratuberculosis
gcgccaccccggga

SEQ ID NO: 939204 - RNA, 17 nt, Mycobacterium avium subsp. paratuberculosis
gcgccaccccgggaacg

SEQ ID NO: 939205 - RNA, 14 nt, Mycobacterium avium subsp. paratuberculosis
gcgccacccgacga

SEQ ID NO: 939206 - RNA, 14 nt, Mycobacterium avium subsp. paratuberculosis
gcgccaccccgaac

SEQ ID NO: 939207 - RNA, 21 nt, Mycobacterium avium subsp. paratuberculosis
gcgccaccccgaacccggcca

SEQ ID NO: 939208 - RNA, 23 nt, Mycobacterium avium subsp. paratuberculosis
gcgccaccccgaacccggccagc

SEQ ID NO: 939209 - RNA, 16 nt, Mycobacterium avium subsp. paratuberculosis
gcgccaccgacaccac

SEQ ID NO: 939210 - RNA, 20 nt, Mycobacterium avium subsp. paratuberculosis
gcgccaccgacaccaccggc

SEQ ID NO: 939211 - RNA, 22 nt, Mycobacterium avium subsp. paratuberculosis
gcgccaccgacaccaccggccg

SEQ ID NO: 939212 - RNA, 15 nt, Mycobacterium avium subsp. paratuberculosis
gcgcauucaccagcu

SEQ ID NO: 939213 - RNA, 16 nt, Mycobacterium avium subsp. paratuberculosis
gcgcauucaccagcug

SEQ ID NO: 939214 - RNA, 12 nt, Mycobacterium avium subsp. paratuberculosis
gcgcaugacggc

SEQ ID NO: 939215 - RNA, 22 nt, Mycobacterium avium subsp. paratuberculosis
gcgcauucggcgacgcucaggc

SEQ ID NO: 939216 - RNA, 17 nt, Mycobacterium avium subsp. paratuberculosis
gcgcaugaccgauccgc

SEQ ID NO: 939217 - RNA, 21 nt, Mycobacterium avium subsp. paratuberculosis
gcgcaugaccgauccgccggc

SEQ ID NO: 939218 - RNA, 17 nt, Mycobacterium avium subsp. paratuberculosis
gcgcauguaggacaccc

SEQ ID NO: 939219 - RNA, 15 nt, Mycobacterium avium subsp. paratuberculosis
gcgcaucguugccgg

SEQ ID NO: 939220 - RNA, 16 nt, Mycobacterium avium subsp. paratuberculosis
gcgcaucguugccggc

SEQ ID NO: 939221 - RNA, 20 nt, Mycobacterium avium subsp. paratuberculosis
gcgcaucguugccggcggcg

SEQ ID NO: 939222 - RNA, 17 nt, Mycobacterium avium subsp. paratuberculosis
gcgcaucugcucggcgu

SEQ ID NO: 939223 - RNA, 15 nt, Mycobacterium avium subsp. paratuberculosis
gcgcaucggucacca

SEQ ID NO: 939224 - RNA, 19 nt, Mycobacterium avium subsp. paratuberculosis
gcgcaucggucaccagcuc

SEQ ID NO: 939225 - RNA, 18 nt, Mycobacterium avium subsp. paratuberculosis
gcgcaucggucagcaaca

SEQ ID NO: 939226 - RNA, 20 nt, Mycobacterium avium subsp. paratuberculosis
gcgcaucggucagcaacagc

SEQ ID NO: 939227 - RNA, 17 nt, Mycobacterium avium subsp. paratuberculosis
gcgcaucgucgcggcgc

SEQ ID NO: 939228 - RNA, 16 nt, Mycobacterium avium subsp. paratuberculosis
gcgcaguugcgcggcg

SEQ ID NO: 939229 - RNA, 20 nt, Mycobacterium avium subsp. paratuberculosis
gcgcaguugcgcggcgggcg

SEQ ID NO: 939230 - RNA, 16 nt, Mycobacterium avium subsp. paratuberculosis
gcgcaguuaccggcgu

SEQ ID NO: 939231 - RNA, 15 nt, Mycobacterium avium subsp. paratuberculosis
gcgcaguucaccgaa

SEQ ID NO: 939232 - RNA, 22 nt, Mycobacterium avium subsp. paratuberculosis
gcgcaguucgggaucgucgccg

SEQ ID NO: 939233 - RNA, 16 nt, Mycobacterium avium subsp. paratuberculosis
gcgcaguucgaccggc

SEQ ID NO: 939234 - RNA, 17 nt, Mycobacterium avium subsp. paratuberculosis
gcgcaguucgaccggca

SEQ ID NO: 939235 - RNA, 20 nt, Mycobacterium avium subsp. paratuberculosis
gcgcaguucgaccggcacca

SEQ ID NO: 939236 - RNA, 16 nt, Mycobacterium avium subsp. paratuberculosis
gcgcauaccagcgcug

SEQ ID NO: 939237 - RNA, 22 nt, Mycobacterium avium subsp. paratuberculosis
gcgcauaaaccugguuggcgac

SEQ ID NO: 939238 - RNA, 14 nt, Mycobacterium avium subsp. paratuberculosis
gcgcaucgcgggcc

SEQ ID NO: 939239 - RNA, 15 nt, Mycobacterium avium subsp. paratuberculosis
gcgcaucgcgggcca

SEQ ID NO: 939240 - RNA, 19 nt, Mycobacterium avium subsp. paratuberculosis
gcgcaucgcgggccaccgg

SEQ ID NO: 939241 - RNA, 21 nt, Mycobacterium avium subsp. paratuberculosis
gcgcaucgcgggccaccggcg

SEQ ID NO: 939242 - RNA, 16 nt, Mycobacterium avium subsp. paratuberculosis
gcgcaucggcgacgcc

SEQ ID NO: 939243 - RNA, 22 nt, Mycobacterium avium subsp. paratuberculosis
gcgcaucggcgacgccgccguc

SEQ ID NO: 939244 - RNA, 22 nt, Mycobacterium avium subsp. paratuberculosis
gcgcaucgccggcgaugcgcgc

SEQ ID NO: 939245 - RNA, 23 nt, Mycobacterium avium subsp. paratuberculosis
gcgcaucgccggcgaugcgcgcc

SEQ ID NO: 939246 - RNA, 16 nt, Mycobacterium avium subsp. paratuberculosis
gcgcaucgccggcgcg

SEQ ID NO: 939247 - RNA, 18 nt, Mycobacterium avium subsp. paratuberculosis
gcgcaucgccguccacgg

SEQ ID NO: 939248 - RNA, 21 nt, Mycobacterium avium subsp. paratuberculosis
gcgcaucgccucggcggccgc

SEQ ID NO: 939249 - RNA, 23 nt, Mycobacterium avium subsp. paratuberculosis
gcgcaucgccucggcggccgccc

SEQ ID NO: 939250 - RNA, 17 nt, Mycobacterium avium subsp. paratuberculosis
gcgcagcgcccaggcgu

SEQ ID NO: 939251 - RNA, 12 nt, Mycobacterium avium subsp. paratuberculosis
gcgcagcgccag

SEQ ID NO: 939252 - RNA, 15 nt, Mycobacterium avium subsp. paratuberculosis
gcgcagccgggcggc

SEQ ID NO: 939253 - RNA, 13 nt, Mycobacterium avium subsp. paratuberculosis
gcgcagcgcagca

SEQ ID NO: 939254 - RNA, 16 nt, Mycobacterium avium subsp. paratuberculosis
gcgcagcgaagcgagg

SEQ ID NO: 939255 - RNA, 17 nt, Mycobacterium avium subsp. paratuberculosis
gcgcagcgagucggcga

SEQ ID NO: 939256 - RNA, 19 nt, Mycobacterium avium subsp. paratuberculosis
gcgcagcgagucggcgaag

SEQ ID NO: 939257 - RNA, 23 nt, Mycobacterium avium subsp. paratuberculosis
gcgcagcgaaacucguugccagc

SEQ ID NO: 939258 - RNA, 13 nt, Mycobacterium avium subsp. paratuberculosis
gcgcagccggccg

SEQ ID NO: 939259 - RNA, 23 nt, Mycobacterium avium subsp. paratuberculosis
gcgcagccgucgcaucagcucgg

SEQ ID NO: 939260 - RNA, 12 nt, Mycobacterium avium subsp. paratuberculosis
gcgcagccgcgg

SEQ ID NO: 939261 - RNA, 14 nt, Mycobacterium avium subsp. paratuberculosis
gcgcagccgcggug

SEQ ID NO: 939262 - RNA, 18 nt, Mycobacterium avium subsp. paratuberculosis
gcgcagccgcgguggcgg

SEQ ID NO: 939263 - RNA, 14 nt, Mycobacterium avium subsp. paratuberculosis
gcgcagccgcugca

SEQ ID NO: 939264 - RNA, 17 nt, Mycobacterium avium subsp. paratuberculosis
gcgcagccgcugcagcg

SEQ ID NO: 939265 - RNA, 18 nt, Mycobacterium avium subsp. paratuberculosis
gcgcagccgcugcagcgc

SEQ ID NO: 939266 - RNA, 20 nt, Mycobacterium avium subsp. paratuberculosis
gcgcagccgcugcagcgccg

SEQ ID NO: 939267 - RNA, 23 nt, Mycobacterium avium subsp. paratuberculosis
gcgcagccgcugcagcgccgccc

SEQ ID NO: 939268 - RNA, 14 nt, Mycobacterium avium subsp. paratuberculosis
gcgcagccggcagc

SEQ ID NO: 939269 - RNA, 14 nt, Mycobacterium avium subsp. paratuberculosis
gcgcagccggccac

SEQ ID NO: 939270 - RNA, 15 nt, Mycobacterium avium subsp. paratuberculosis
gcgcagccggccacc

SEQ ID NO: 939271 - RNA, 16 nt, Mycobacterium avium subsp. paratuberculosis
gcgcagccggccaccg

SEQ ID NO: 939272 - RNA, 21 nt, Mycobacterium avium subsp. paratuberculosis
gcgcagccggccaccgcccca

SEQ ID NO: 939273 - RNA, 17 nt, Mycobacterium avium subsp. paratuberculosis
gcgcagccgaucgacga

SEQ ID NO: 939274 - RNA, 13 nt, Mycobacterium avium subsp. paratuberculosis
gcgcagccgccgg

SEQ ID NO: 939275 - RNA, 15 nt, Mycobacterium avium subsp. paratuberculosis
gcgcagcccccggac

SEQ ID NO: 939276 - RNA, 20 nt, Mycobacterium avium subsp. paratuberculosis
gcgcagcccgaucgccagcg

SEQ ID NO: 939277 - RNA, 23 nt, Mycobacterium avium subsp. paratuberculosis
gcgcagcccgaucgccagcgccc

SEQ ID NO: 939278 - RNA, 13 nt, Mycobacterium avium subsp. paratuberculosis
gcgcagcccgccg

SEQ ID NO: 939279 - RNA, 12 nt, Mycobacterium avium subsp. paratuberculosis
gcgcagcccggc

SEQ ID NO: 939280 - RNA, 15 nt, Mycobacterium avium subsp. paratuberculosis
gcgcagcccggcggu

SEQ ID NO: 939281 - RNA, 18 nt, Mycobacterium avium subsp. paratuberculosis
gcgcagcccggcgguuga

SEQ ID NO: 939282 - RNA, 16 nt, Mycobacterium avium subsp. paratuberculosis
gcgcagcccagccagc

SEQ ID NO: 939283 - RNA, 15 nt, Mycobacterium avium subsp. paratuberculosis
gcgcagccagcgccg

SEQ ID NO: 939284 - RNA, 22 nt, Mycobacterium avium subsp. paratuberculosis
gcgcagccagaccucgccgacg

SEQ ID NO: 939285 - RNA, 15 nt, Mycobacterium avium subsp. paratuberculosis
gcgcagccagcucgg

SEQ ID NO: 939286 - RNA, 16 nt, Mycobacterium avium subsp. paratuberculosis
gcgcagccagcucggc

SEQ ID NO: 939287 - RNA, 11 nt, Mycobacterium avium subsp. paratuberculosis
gcgcagccagg

SEQ ID NO: 939288 - RNA, 17 nt, Mycobacterium avium subsp. paratuberculosis
gcgcagccaccgcccga

SEQ ID NO: 939289 - RNA, 22 nt, Mycobacterium avium subsp. paratuberculosis
gcgcagccacgagcccagccgu

SEQ ID NO: 939290 - RNA, 22 nt, Mycobacterium avium subsp. paratuberculosis
gcgcagcauggcccacaggacg

SEQ ID NO: 939291 - RNA, 18 nt, Mycobacterium avium subsp. paratuberculosis
gcgcagcaucucuugaug

SEQ ID NO: 939292 - RNA, 21 nt, Mycobacterium avium subsp. paratuberculosis
gcgcagcagguaaaccagcag

SEQ ID NO: 939293 - RNA, 22 nt, Mycobacterium avium subsp. paratuberculosis
gcgcagcagguaaaccagcagc

SEQ ID NO: 939294 - RNA, 13 nt, Mycobacterium avium subsp. paratuberculosis
gcgcagcaucacg

SEQ ID NO: 939295 - RNA, 16 nt, Mycobacterium avium subsp. paratuberculosis
gcgcagcaucacgucg

SEQ ID NO: 939296 - RNA, 21 nt, Mycobacterium avium subsp. paratuberculosis
gcgcagcaucacgucggcgag

SEQ ID NO: 939297 - RNA, 14 nt, Mycobacterium avium subsp. paratuberculosis
gcgcagcauccgca

SEQ ID NO: 939298 - RNA, 17 nt, Mycobacterium avium subsp. paratuberculosis
gcgcagcauccgcacca

SEQ ID NO: 939299 - RNA, 13 nt, Mycobacterium avium subsp. paratuberculosis
gcgcagcaucggc

SEQ ID NO: 939300 - RNA, 15 nt, Mycobacterium avium subsp. paratuberculosis
gcgcagcaucggcag

SEQ ID NO: 939301 - RNA, 17 nt, Mycobacterium avium subsp. paratuberculosis
gcgcagcaucggcagau

SEQ ID NO: 939302 - RNA, 19 nt, Mycobacterium avium subsp. paratuberculosis
gcgcagcaucuccgagucg

SEQ ID NO: 939303 - RNA, 21 nt, Mycobacterium avium subsp. paratuberculosis
gcgcagcaucuccgagucggc

SEQ ID NO: 939304 - RNA, 23 nt, Mycobacterium avium subsp. paratuberculosis
gcgcagcaucuccgagucggcgu

SEQ ID NO: 939305 - RNA, 17 nt, Mycobacterium avium subsp. paratuberculosis
gcgcagcaggcgccggu

SEQ ID NO: 939306 - RNA, 16 nt, Mycobacterium avium subsp. paratuberculosis
gcgcagcagcgccagc

SEQ ID NO: 939307 - RNA, 17 nt, Mycobacterium avium subsp. paratuberculosis
gcgcagcagcgccagca

SEQ ID NO: 939308 - RNA, 22 nt, Mycobacterium avium subsp. paratuberculosis
gcgcagcagcgccagcagcggc

SEQ ID NO: 939309 - RNA, 13 nt, Mycobacterium avium subsp. paratuberculosis
gcgcagcagcggc

SEQ ID NO: 939310 - RNA, 14 nt, Mycobacterium avium subsp. paratuberculosis
gcgcagcagcggga

SEQ ID NO: 939311 - RNA, 13 nt, Mycobacterium avium subsp. paratuberculosis
gcgcagcagcucg

SEQ ID NO: 939312 - RNA, 22 nt, Mycobacterium avium subsp. paratuberculosis
gcgcagcagcucgucguacucg

SEQ ID NO: 939313 - RNA, 19 nt, Mycobacterium avium subsp. paratuberculosis
gcgcagcagcugcacccgc

SEQ ID NO: 939314 - RNA, 14 nt, Mycobacterium avium subsp. paratuberculosis
gcgcagcagcgcca

SEQ ID NO: 939315 - RNA, 15 nt, Mycobacterium avium subsp. paratuberculosis
gcgcagcagcgccag

SEQ ID NO: 939316 - RNA, 12 nt, Mycobacterium avium subsp. paratuberculosis
gcgcagcaccgu

SEQ ID NO: 939317 - RNA, 14 nt, Mycobacterium avium subsp. paratuberculosis
gcgcagcaccguca

SEQ ID NO: 939318 - RNA, 21 nt, Mycobacterium avium subsp. paratuberculosis
gcgcagcaccuccgacagccc

SEQ ID NO: 939319 - RNA, 19 nt, Mycobacterium avium subsp. paratuberculosis
gcgcagcagcaggucggcc

SEQ ID NO: 939320 - RNA, 13 nt, Mycobacterium avium subsp. paratuberculosis
gcgcagcagccag

SEQ ID NO: 939321 - RNA, 23 nt, Mycobacterium avium subsp. paratuberculosis
gcgcagcagccaggacagcguca

SEQ ID NO: 939322 - RNA, 11 nt, Mycobacterium avium subsp. paratuberculosis
gcgcagcacga

SEQ ID NO: 939323 - RNA, 22 nt, Mycobacterium avium subsp. paratuberculosis
gcgcagcacgaugaucccgagg

SEQ ID NO: 939324 - RNA, 19 nt, Mycobacterium avium subsp. paratuberculosis
gcgcagcacguguucggga

SEQ ID NO: 939325 - RNA, 17 nt, Mycobacterium avium subsp. paratuberculosis
gcgcagcacugagcggc

SEQ ID NO: 939326 - RNA, 15 nt, Mycobacterium avium subsp. paratuberculosis
gcgcagcacggccac

SEQ ID NO: 939327 - RNA, 17 nt, Mycobacterium avium subsp. paratuberculosis
gcgcagcacggccacug

SEQ ID NO: 939328 - RNA, 13 nt, Mycobacterium avium subsp. paratuberculosis
gcgcagcaccgac

SEQ ID NO: 939329 - RNA, 12 nt, Mycobacterium avium subsp. paratuberculosis
gcgcagcaccgc

SEQ ID NO: 939330 - RNA, 14 nt, Mycobacterium avium subsp. paratuberculosis
gcgcagcaccgcgu

SEQ ID NO: 939331 - RNA, 16 nt, Mycobacterium avium subsp. paratuberculosis
gcgcagcaccgcgucg

SEQ ID NO: 939332 - RNA, 15 nt, Mycobacterium avium subsp. paratuberculosis
gcgcagcaacgguac

SEQ ID NO: 939333 - RNA, 15 nt, Mycobacterium avium subsp. paratuberculosis
gcgcacggcgcccag

SEQ ID NO: 939334 - RNA, 12 nt, Mycobacterium avium subsp. paratuberculosis
gcgcacggcgcg

SEQ ID NO: 939335 - RNA, 20 nt, Mycobacterium avium subsp. paratuberculosis
gcgcacggcgcgcaccgcgg

SEQ ID NO: 939336 - RNA, 16 nt, Mycobacterium avium subsp. paratuberculosis
gcgcagaagcuaacgc

SEQ ID NO: 939337 - RNA, 21 nt, Mycobacterium avium subsp. paratuberculosis
gcgcagaagcuaacgccagcu

SEQ ID NO: 939338 - RNA, 22 nt, Mycobacterium avium subsp. paratuberculosis
gcgcagaagcuaacgccagcug

SEQ ID NO: 939339 - RNA, 18 nt, Mycobacterium avium subsp. paratuberculosis
gcgcagacccgguggccg

SEQ ID NO: 939340 - RNA, 15 nt, Mycobacterium avium subsp. paratuberculosis
gcgcagaucgccagc

SEQ ID NO: 939341 - RNA, 17 nt, Mycobacterium avium subsp. paratuberculosis
gcgcagaucgccagcac

SEQ ID NO: 939342 - RNA, 19 nt, Mycobacterium avium subsp. paratuberculosis
gcgcagaucgccagcaccg

SEQ ID NO: 939343 - RNA, 16 nt, Mycobacterium avium subsp. paratuberculosis
gcgcagaucgucgacc

SEQ ID NO: 939344 - RNA, 23 nt, Mycobacterium avium subsp. paratuberculosis
gcgcagaucgucgaccugcucgu

SEQ ID NO: 939345 - RNA, 18 nt, Mycobacterium avium subsp. paratuberculosis
gcgcaccggcugccccag

SEQ ID NO: 939346 - RNA, 19 nt, Mycobacterium avium subsp. paratuberculosis
gcgcaccugaaccgcgcac

SEQ ID NO: 939347 - RNA, 14 nt, Mycobacterium avium subsp. paratuberculosis
gcgcaccugcggcc

SEQ ID NO: 939348 - RNA, 19 nt, Mycobacterium avium subsp. paratuberculosis
gcgcaccuggcgcagcacc

SEQ ID NO: 939349 - RNA, 20 nt, Mycobacterium avium subsp. paratuberculosis
gcgcaccuggcgcagcaccg

SEQ ID NO: 939350 - RNA, 22 nt, Mycobacterium avium subsp. paratuberculosis
gcgcaccuggcgcagcaccgac

SEQ ID NO: 939351 - RNA, 15 nt, Mycobacterium avium subsp. paratuberculosis
gcgcacgcuggccgg

SEQ ID NO: 939352 - RNA, 15 nt, Mycobacterium avium subsp. paratuberculosis
gcgcaccuggucggu

SEQ ID NO: 939353 - RNA, 21 nt, Mycobacterium avium subsp. paratuberculosis
gcgcacgcucgcggugcgcgc

SEQ ID NO: 939354 - RNA, 16 nt, Mycobacterium avium subsp. paratuberculosis
gcgcagaaccgcaccc

SEQ ID NO: 939355 - RNA, 17 nt, Mycobacterium avium subsp. paratuberculosis
gcgcacguagcccagcg

SEQ ID NO: 939356 - RNA, 19 nt, Mycobacterium avium subsp. paratuberculosis
gcgcacguagcccagcgcg

SEQ ID NO: 939357 - RNA, 13 nt, Mycobacterium avium subsp. paratuberculosis
gcgcacggugccc

SEQ ID NO: 939358 - RNA, 16 nt, Mycobacterium avium subsp. paratuberculosis
gcgcacggugcccguc

SEQ ID NO: 939359 - RNA, 16 nt, Mycobacterium avium subsp. paratuberculosis
gcgcacguaccgguac

SEQ ID NO: 939360 - RNA, 20 nt, Mycobacterium avium subsp. paratuberculosis
gcgcacguaccgguacagcg

SEQ ID NO: 939361 - RNA, 23 nt, Mycobacterium avium subsp. paratuberculosis
gcgcacguaccgguacagcgacu

SEQ ID NO: 939362 - RNA, 14 nt, Mycobacterium avium subsp. paratuberculosis
gcgcacgcugcugg

SEQ ID NO: 939363 - RNA, 18 nt, Mycobacterium avium subsp. paratuberculosis
gcgcacgcuuuuucgcga

SEQ ID NO: 939364 - RNA, 14 nt, Mycobacterium avium subsp. paratuberculosis
gcgcaccgagucgg

SEQ ID NO: 939365 - RNA, 19 nt, Mycobacterium avium subsp. paratuberculosis
gcgcaccgagucggugacc

SEQ ID NO: 939366 - RNA, 12 nt, Mycobacterium avium subsp. paratuberculosis
gcgcacccgcac

SEQ ID NO: 939367 - RNA, 14 nt, Mycobacterium avium subsp. paratuberculosis
gcgcacccgcacgu

SEQ ID NO: 939368 - RNA, 24 nt, Mycobacterium avium subsp. paratuberculosis
gcgcacccgcacgugcgcgccgac

SEQ ID NO: 939369 - RNA, 13 nt, Mycobacterium avium subsp. paratuberculosis
gcgcaccgagccc

SEQ ID NO: 939370 - RNA, 15 nt, Mycobacterium avium subsp. paratuberculosis
gcgcaccgucaucgc

SEQ ID NO: 939371 - RNA, 17 nt, Mycobacterium avium subsp. paratuberculosis
gcgcaccgucaucgcgg

SEQ ID NO: 939372 - RNA, 15 nt, Mycobacterium avium subsp. paratuberculosis
gcgcaccgugccgcc

SEQ ID NO: 939373 - RNA, 20 nt, Mycobacterium avium subsp. paratuberculosis
gcgcaccgugccgcccgucg

SEQ ID NO: 939374 - RNA, 18 nt, Mycobacterium avium subsp. paratuberculosis
gcgcaccgugucgucgcu

SEQ ID NO: 939375 - RNA, 19 nt, Mycobacterium avium subsp. paratuberculosis
gcgcaccgggaccagcgcg

SEQ ID NO: 939376 - RNA, 23 nt, Mycobacterium avium subsp. paratuberculosis
gcgcaccgggaccagcgcggugc

SEQ ID NO: 939377 - RNA, 19 nt, Mycobacterium avium subsp. paratuberculosis
gcgcaccgggacgggucgg

SEQ ID NO: 939378 - RNA, 20 nt, Mycobacterium avium subsp. paratuberculosis
gcgcaccgggacgggucggu

SEQ ID NO: 939379 - RNA, 21 nt, Mycobacterium avium subsp. paratuberculosis
gcgcaccgggacgggucggug

SEQ ID NO: 939380 - RNA, 16 nt, Mycobacterium avium subsp. paratuberculosis
gcgcaccgggcccgcc

SEQ ID NO: 939381 - RNA, 19 nt, Mycobacterium avium subsp. paratuberculosis
gcgcaccgggcccgcccgc

SEQ ID NO: 939382 - RNA, 16 nt, Mycobacterium avium subsp. paratuberculosis
gcgcaccggcgaugca

SEQ ID NO: 939383 - RNA, 22 nt, Mycobacterium avium subsp. paratuberculosis
gcgcaccggcgaugcagaucac

SEQ ID NO: 939384 - RNA, 16 nt, Mycobacterium avium subsp. paratuberculosis
gcgcaccggcgcuggu

SEQ ID NO: 939385 - RNA, 13 nt, Mycobacterium avium subsp. paratuberculosis
gcgcacccgcggg

SEQ ID NO: 939386 - RNA, 14 nt, Mycobacterium avium subsp. paratuberculosis
gcgcacccgcgggu

SEQ ID NO: 939387 - RNA, 22 nt, Mycobacterium avium subsp. paratuberculosis
gcgcaccccguugccgccggcg

SEQ ID NO: 939388 - RNA, 19 nt, Mycobacterium avium subsp. paratuberculosis
gcgcacccgcgggucgucg

SEQ ID NO: 939389 - RNA, 20 nt, Mycobacterium avium subsp. paratuberculosis
gcgcacccgcgggucgucgg

SEQ ID NO: 939390 - RNA, 19 nt, Mycobacterium avium subsp. paratuberculosis
gcgcacccggccacgccgg

SEQ ID NO: 939391 - RNA, 17 nt, Mycobacterium avium subsp. paratuberculosis
gcgcacccgggaccggu

SEQ ID NO: 939392 - RNA, 21 nt, Mycobacterium avium subsp. paratuberculosis
gcgcacccguaacacgaucac

SEQ ID NO: 939393 - RNA, 13 nt, Mycobacterium avium subsp. paratuberculosis
gcgcaccccggca

SEQ ID NO: 939394 - RNA, 17 nt, Mycobacterium avium subsp. paratuberculosis
gcgcacccccggggccu

SEQ ID NO: 939395 - RNA, 23 nt, Mycobacterium avium subsp. paratuberculosis
gcgcacccccggggccuccagcc

SEQ ID NO: 939396 - RNA, 21 nt, Mycobacterium avium subsp. paratuberculosis
gcgcacccccuucuccacgcu

SEQ ID NO: 939397 - RNA, 12 nt, Mycobacterium avium subsp. paratuberculosis
gcgcaccccgaa

SEQ ID NO: 939398 - RNA, 19 nt, Mycobacterium avium subsp. paratuberculosis
gcgcaccccgaaccgcccg

SEQ ID NO: 939399 - RNA, 20 nt, Mycobacterium avium subsp. paratuberculosis
gcgcaccccgaaccgcccgc

SEQ ID NO: 939400 - RNA, 12 nt, Mycobacterium avium subsp. paratuberculosis
gcgcacccagcc

SEQ ID NO: 939401 - RNA, 15 nt, Mycobacterium avium subsp. paratuberculosis
gcgauagggccggcc

SEQ ID NO: 939402 - RNA, 16 nt, Mycobacterium avium subsp. paratuberculosis
gcgauagggccggccg

SEQ ID NO: 939403 - RNA, 14 nt, Mycobacterium avium subsp. paratuberculosis
gcgauaggcggcca

SEQ ID NO: 939404 - RNA, 15 nt, Mycobacterium avium subsp. paratuberculosis
gcgauaggcggccag

SEQ ID NO: 939405 - RNA, 16 nt, Mycobacterium avium subsp. paratuberculosis
gcgauaggcggccagc

SEQ ID NO: 939406 - RNA, 21 nt, Mycobacterium avium subsp. paratuberculosis
gcgauaggcggccagcucccg

SEQ ID NO: 939407 - RNA, 18 nt, Mycobacterium avium subsp. paratuberculosis
gcgaguucggcggcccgc

SEQ ID NO: 939408 - RNA, 16 nt, Mycobacterium avium subsp. paratuberculosis
gcgaguuggccaucgu

SEQ ID NO: 939409 - RNA, 23 nt, Mycobacterium avium subsp. paratuberculosis
gcgaguuguacccuucggccgcu

SEQ ID NO: 939410 - RNA, 17 nt, Mycobacterium avium subsp. paratuberculosis
gcgaguucgcgcacgcu

SEQ ID NO: 939411 - RNA, 22 nt, Mycobacterium avium subsp. paratuberculosis
gcgaguucgcgcacgcuggccg

SEQ ID NO: 939412 - RNA, 23 nt, Mycobacterium avium subsp. paratuberculosis
gcgaguucgcgcacgcuggccgg

SEQ ID NO: 939413 - RNA, 20 nt, Mycobacterium avium subsp. paratuberculosis
gcgaguucugguaggcggcc

SEQ ID NO: 939414 - RNA, 22 nt, Mycobacterium avium subsp. paratuberculosis
gcgauagaccucacggucggcg

SEQ ID NO: 939415 - RNA, 23 nt, Mycobacterium avium subsp. paratuberculosis
gcgauagaccucacggucggcgu

SEQ ID NO: 939416 - RNA, 18 nt, Mycobacterium avium subsp. paratuberculosis
gcgcacagcgccacaccg

SEQ ID NO: 939417 - RNA, 19 nt, Mycobacterium avium subsp. paratuberculosis
gcgcacagcuaggucgugg

SEQ ID NO: 939418 - RNA, 20 nt, Mycobacterium avium subsp. paratuberculosis
gcgcacagcuaggucguggc

SEQ ID NO: 939419 - RNA, 19 nt, Mycobacterium avium subsp. paratuberculosis
gcgcacagaucgucucggc

SEQ ID NO: 939420 - RNA, 23 nt, Mycobacterium avium subsp. paratuberculosis
gcgcacagaucgucucggccagc

SEQ ID NO: 939421 - RNA, 17 nt, Mycobacterium avium subsp. paratuberculosis
gcgcaccauccgcgacg

SEQ ID NO: 939422 - RNA, 18 nt, Mycobacterium avium subsp. paratuberculosis
gcgcacaucacgguggcc

SEQ ID NO: 939423 - RNA, 15 nt, Mycobacterium avium subsp. paratuberculosis
gcgcacaucguggcg

SEQ ID NO: 939424 - RNA, 12 nt, Mycobacterium avium subsp. paratuberculosis
gcgcaaugccgc

SEQ ID NO: 939425 - RNA, 17 nt, Mycobacterium avium subsp. paratuberculosis
gcgcaaugccgccgcga

SEQ ID NO: 939426 - RNA, 19 nt, Mycobacterium avium subsp. paratuberculosis
gcgcaaugccgccgcgacg

SEQ ID NO: 939427 - RNA, 22 nt, Mycobacterium avium subsp. paratuberculosis
gcgcacaacccggacagcgcga

SEQ ID NO: 939428 - RNA, 15 nt, Mycobacterium avium subsp. paratuberculosis
gcgcacaacgaggcc

SEQ ID NO: 939429 - RNA, 13 nt, Mycobacterium avium subsp. paratuberculosis
gcgcacacaccgu

SEQ ID NO: 939430 - RNA, 15 nt, Mycobacterium avium subsp. paratuberculosis
gcgcacacagcagca

SEQ ID NO: 939431 - RNA, 22 nt, Mycobacterium avium subsp. paratuberculosis
gcgcacacagcagcagcaccag

SEQ ID NO: 939432 - RNA, 24 nt, Mycobacterium avium subsp. paratuberculosis
gcgcacacagcagcagcaccaggc

SEQ ID NO: 939433 - RNA, 13 nt, Mycobacterium avium subsp. paratuberculosis
gcgccgcgcagcc

SEQ ID NO: 939434 - RNA, 15 nt, Mycobacterium avium subsp. paratuberculosis
gcgccgcgcagccag

SEQ ID NO: 939435 - RNA, 13 nt, Mycobacterium avium subsp. paratuberculosis
gcgccgcgacccc

SEQ ID NO: 939436 - RNA, 14 nt, Mycobacterium avium subsp. paratuberculosis
gcgccgcgaccccg

SEQ ID NO: 939437 - RNA, 18 nt, Mycobacterium avium subsp. paratuberculosis
gcgccgcgacgucggugu

SEQ ID NO: 939438 - RNA, 14 nt, Mycobacterium avium subsp. paratuberculosis
gcgccgcgagcgca

SEQ ID NO: 939439 - RNA, 20 nt, Mycobacterium avium subsp. paratuberculosis
gcgccgccuucuugcgcggc

SEQ ID NO: 939440 - RNA, 22 nt, Mycobacterium avium subsp. paratuberculosis
gcgccgccuucuugcgcggcgc

SEQ ID NO: 939441 - RNA, 18 nt, Mycobacterium avium subsp. paratuberculosis
gcgccgccguucgccggc

SEQ ID NO: 939442 - RNA, 23 nt, Mycobacterium avium subsp. paratuberculosis
gcgccgccggucgcccccucggc

SEQ ID NO: 939443 - RNA, 13 nt, Mycobacterium avium subsp. paratuberculosis
gcgccgccggggc

SEQ ID NO: 939444 - RNA, 19 nt, Mycobacterium avium subsp. paratuberculosis
gcgccgccggggcgucgga

SEQ ID NO: 939445 - RNA, 16 nt, Mycobacterium avium subsp. paratuberculosis
gcgccgcggcggcucg

SEQ ID NO: 939446 - RNA, 18 nt, Mycobacterium avium subsp. paratuberculosis
gcgccgcggcggcucggc

SEQ ID NO: 939447 - RNA, 21 nt, Mycobacterium avium subsp. paratuberculosis
gcgccgcggcggcucggcggc

SEQ ID NO: 939448 - RNA, 13 nt, Mycobacterium avium subsp. paratuberculosis
gcgccgcggcgcu

SEQ ID NO: 939449 - RNA, 16 nt, Mycobacterium avium subsp. paratuberculosis
gcgccgcggcgcuuga

SEQ ID NO: 939450 - RNA, 14 nt, Mycobacterium avium subsp. paratuberculosis
gcgccgcgaugauc

SEQ ID NO: 939451 - RNA, 12 nt, Mycobacterium avium subsp. paratuberculosis
gcgccgcggcgc

SEQ ID NO: 939452 - RNA, 14 nt, Mycobacterium avium subsp. paratuberculosis
gcgccgcggcgccg

SEQ ID NO: 939453 - RNA, 15 nt, Mycobacterium avium subsp. paratuberculosis
gcgccgcggccggug

SEQ ID NO: 939454 - RNA, 23 nt, Mycobacterium avium subsp. paratuberculosis
gcgccgcggccguugcucucggc

SEQ ID NO: 939455 - RNA, 22 nt, Mycobacterium avium subsp. paratuberculosis
gcgccgcgcuugcgaucgccgc

SEQ ID NO: 939456 - RNA, 13 nt, Mycobacterium avium subsp. paratuberculosis
gcgccgcggcccu

SEQ ID NO: 939457 - RNA, 15 nt, Mycobacterium avium subsp. paratuberculosis
gcgccgcggcccugc

SEQ ID NO: 939458 - RNA, 13 nt, Mycobacterium avium subsp. paratuberculosis
gcgccgcggccag

SEQ ID NO: 939459 - RNA, 14 nt, Mycobacterium avium subsp. paratuberculosis
gcgccgcggccagc

SEQ ID NO: 939460 - RNA, 15 nt, Mycobacterium avium subsp. paratuberculosis
gcgccgcggccagcc

SEQ ID NO: 939461 - RNA, 18 nt, Mycobacterium avium subsp. paratuberculosis
gcgccgcggccagcgccc

SEQ ID NO: 939462 - RNA, 13 nt, Mycobacterium avium subsp. paratuberculosis
gcgccgcgcuggc

SEQ ID NO: 939463 - RNA, 14 nt, Mycobacterium avium subsp. paratuberculosis
gcgccgcgcuggcc

SEQ ID NO: 939464 - RNA, 15 nt, Mycobacterium avium subsp. paratuberculosis
gcgccgcgcuggccg

SEQ ID NO: 939465 - RNA, 17 nt, Mycobacterium avium subsp. paratuberculosis
gcgccgcgcgcgcggcc

SEQ ID NO: 939466 - RNA, 18 nt, Mycobacterium avium subsp. paratuberculosis
gcgccgcgcgccagcgcg

SEQ ID NO: 939467 - RNA, 14 nt, Mycobacterium avium subsp. paratuberculosis
gcgccgcgccggca

SEQ ID NO: 939468 - RNA, 14 nt, Mycobacterium avium subsp. paratuberculosis
gcgccgcgccgacc

SEQ ID NO: 939469 - RNA, 13 nt, Mycobacterium avium subsp. paratuberculosis
gcgccgcagcucg

SEQ ID NO: 939470 - RNA, 23 nt, Mycobacterium avium subsp. paratuberculosis
gcgccgcaggagaucggcgcgga

SEQ ID NO: 939471 - RNA, 17 nt, Mycobacterium avium subsp. paratuberculosis
gcgccgcagcggcgccg

SEQ ID NO: 939472 - RNA, 15 nt, Mycobacterium avium subsp. paratuberculosis
gcgccgcagcgguga

SEQ ID NO: 939473 - RNA, 20 nt, Mycobacterium avium subsp. paratuberculosis
gcgccgccaucgccucgucc

SEQ ID NO: 939474 - RNA, 13 nt, Mycobacterium avium subsp. paratuberculosis
gcgccgcccgcac

SEQ ID NO: 939475 - RNA, 17 nt, Mycobacterium avium subsp. paratuberculosis
gcgccgcccgcaccugc

SEQ ID NO: 939476 - RNA, 20 nt, Mycobacterium avium subsp. paratuberculosis
gcgccgcccgcaccugcgcg

SEQ ID NO: 939477 - RNA, 15 nt, Mycobacterium avium subsp. paratuberculosis
gcgccgcccgcaguu

SEQ ID NO: 939478 - RNA, 21 nt, Mycobacterium avium subsp. paratuberculosis
gcgccgcccgcaguucggccg

SEQ ID NO: 939479 - RNA, 13 nt, Mycobacterium avium subsp. paratuberculosis
gcgccgcccagcg

SEQ ID NO: 939480 - RNA, 15 nt, Mycobacterium avium subsp. paratuberculosis
gcgccgcccagcggc

SEQ ID NO: 939481 - RNA, 21 nt, Mycobacterium avium subsp. paratuberculosis
gcgccgcccagcggccccggc

SEQ ID NO: 939482 - RNA, 17 nt, Mycobacterium avium subsp. paratuberculosis
gcgccgcccagcgguga

SEQ ID NO: 939483 - RNA, 14 nt, Mycobacterium avium subsp. paratuberculosis
gcgccgcccaccag

SEQ ID NO: 939484 - RNA, 21 nt, Mycobacterium avium subsp. paratuberculosis
gcgccgcccaccagcacaccg

SEQ ID NO: 939485 - RNA, 14 nt, Mycobacterium avium subsp. paratuberculosis
gcgccgccgcgcag

SEQ ID NO: 939486 - RNA, 23 nt, Mycobacterium avium subsp. paratuberculosis
gcgccgccgccgcccacgccgcc

SEQ ID NO: 939487 - RNA, 13 nt, Mycobacterium avium subsp. paratuberculosis
gcgccgccggcgu

SEQ ID NO: 939488 - RNA, 22 nt, Mycobacterium avium subsp. paratuberculosis
gcgccgccgcgucgugccgagc

SEQ ID NO: 939489 - RNA, 15 nt, Mycobacterium avium subsp. paratuberculosis
gcgccgcccggcgau

SEQ ID NO: 939490 - RNA, 13 nt, Mycobacterium avium subsp. paratuberculosis
gcgccgcccgggc

SEQ ID NO: 939491 - RNA, 14 nt, Mycobacterium avium subsp. paratuberculosis
gcgccgcccgggcc

SEQ ID NO: 939492 - RNA, 16 nt, Mycobacterium avium subsp. paratuberculosis
gcgccgcccgggcccg

SEQ ID NO: 939493 - RNA, 12 nt, Mycobacterium avium subsp. paratuberculosis
gcgccgcccaca

SEQ ID NO: 939494 - RNA, 13 nt, Mycobacterium avium subsp. paratuberculosis
gcgccgccgccag

SEQ ID NO: 939495 - RNA, 15 nt, Mycobacterium avium subsp. paratuberculosis
gcgccgccgccagcc

SEQ ID NO: 939496 - RNA, 21 nt, Mycobacterium avium subsp. paratuberculosis
gcgccgccgccagccagccgg

SEQ ID NO: 939497 - RNA, 15 nt, Mycobacterium avium subsp. paratuberculosis
gcgccgcccgggcgg

SEQ ID NO: 939498 - RNA, 16 nt, Mycobacterium avium subsp. paratuberculosis
gcgccgcccgggcggc

SEQ ID NO: 939499 - RNA, 12 nt, Mycobacterium avium subsp. paratuberculosis
gcgccgcccguc

SEQ ID NO: 939500 - RNA, 15 nt, Mycobacterium avium subsp. paratuberculosis
gcgccgcccguccag

SEQ ID NO: 939501 - RNA, 19 nt, Mycobacterium avium subsp. paratuberculosis
gcgccgcccguccagcgca

SEQ ID NO: 939502 - RNA, 14 nt, Mycobacterium avium subsp. paratuberculosis
gcgccgcccucgcc

SEQ ID NO: 939503 - RNA, 16 nt, Mycobacterium avium subsp. paratuberculosis
gcgccgcccucgccga

SEQ ID NO: 939504 - RNA, 17 nt, Mycobacterium avium subsp. paratuberculosis
gcgccgcccucgccgaa

SEQ ID NO: 939505 - RNA, 22 nt, Mycobacterium avium subsp. paratuberculosis
gcgccgcccucgccgaaccggg

SEQ ID NO: 939506 - RNA, 21 nt, Mycobacterium avium subsp. paratuberculosis
gcgccgccgaacagcagcgcg

SEQ ID NO: 939507 - RNA, 12 nt, Mycobacterium avium subsp. paratuberculosis
gcgccgccgacc

SEQ ID NO: 939508 - RNA, 15 nt, Mycobacterium avium subsp. paratuberculosis
gcgccgccgaccacg

SEQ ID NO: 939509 - RNA, 12 nt, Mycobacterium avium subsp. paratuberculosis
gcgccgccgagc

SEQ ID NO: 939510 - RNA, 23 nt, Mycobacterium avium subsp. paratuberculosis
gcgccgccgagcaacagcccgac

SEQ ID NO: 939511 - RNA, 19 nt, Mycobacterium avium subsp. paratuberculosis
gcgccgccgagccgcgggu

SEQ ID NO: 939512 - RNA, 21 nt, Mycobacterium avium subsp. paratuberculosis
gcgccggugaagaucgcccgc

SEQ ID NO: 939513 - RNA, 16 nt, Mycobacterium avium subsp. paratuberculosis
gcgccggugaagcggg

SEQ ID NO: 939514 - RNA, 16 nt, Mycobacterium avium subsp. paratuberculosis
gcgccggugaccccgu

SEQ ID NO: 939515 - RNA, 22 nt, Mycobacterium avium subsp. paratuberculosis
gcgccgggucauccccgugcgg

SEQ ID NO: 939516 - RNA, 20 nt, Mycobacterium avium subsp. paratuberculosis
gcgccggguccagccgcggu

SEQ ID NO: 939517 - RNA, 12 nt, Mycobacterium avium subsp. paratuberculosis
gcgccggguggc

SEQ ID NO: 939518 - RNA, 23 nt, Mycobacterium avium subsp. paratuberculosis
gcgccggugcaguacgcaucggc

SEQ ID NO: 939519 - RNA, 16 nt, Mycobacterium avium subsp. paratuberculosis
gcgccggugcccacgc

SEQ ID NO: 939520 - RNA, 11 nt, Mycobacterium avium subsp. paratuberculosis
gcgccgggucg

SEQ ID NO: 939521 - RNA, 16 nt, Mycobacterium avium subsp. paratuberculosis
gcgccgggucgcggug

SEQ ID NO: 939522 - RNA, 19 nt, Mycobacterium avium subsp. paratuberculosis
gcgccgggguccucucggc

SEQ ID NO: 939523 - RNA, 20 nt, Mycobacterium avium subsp. paratuberculosis
gcgccgggguccucucggcg

SEQ ID NO: 939524 - RNA, 21 nt, Mycobacterium avium subsp. paratuberculosis
gcgccgggguccucucggcgc

SEQ ID NO: 939525 - RNA, 23 nt, Mycobacterium avium subsp. paratuberculosis
gcgccgggguccucucggcgccg

SEQ ID NO: 939526 - RNA, 20 nt, Mycobacterium avium subsp. paratuberculosis
gcgccgggguguccagcggg

SEQ ID NO: 939527 - RNA, 19 nt, Mycobacterium avium subsp. paratuberculosis
gcgccgguucgcuggcggc

SEQ ID NO: 939528 - RNA, 21 nt, Mycobacterium avium subsp. paratuberculosis
gcgccgguucgcuggcggcca

SEQ ID NO: 939529 - RNA, 18 nt, Mycobacterium avium subsp. paratuberculosis
gcgccgguuuccaggacg

SEQ ID NO: 939530 - RNA, 16 nt, Mycobacterium avium subsp. paratuberculosis
gcgccgguuccuccga

SEQ ID NO: 939531 - RNA, 21 nt, Mycobacterium avium subsp. paratuberculosis
gcgccgguuccuccgacuuac

SEQ ID NO: 939532 - RNA, 14 nt, Mycobacterium avium subsp. paratuberculosis
gcgccgguuucguc

SEQ ID NO: 939533 - RNA, 17 nt, Mycobacterium avium subsp. paratuberculosis
gcgccgguuuucggcgu

SEQ ID NO: 939534 - RNA, 22 nt, Mycobacterium avium subsp. paratuberculosis
gcgccgguuuucggcgugucgu

SEQ ID NO: 939535 - RNA, 19 nt, Mycobacterium avium subsp. paratuberculosis
gcgccgguguucggcgcca

SEQ ID NO: 939536 - RNA, 20 nt, Mycobacterium avium subsp. paratuberculosis
gcgccgguguucggcgccag

SEQ ID NO: 939537 - RNA, 21 nt, Mycobacterium avium subsp. paratuberculosis
gcgccgguguucggcgccagc

SEQ ID NO: 939538 - RNA, 20 nt, Mycobacterium avium subsp. paratuberculosis
gcgccggugccgcagccguc

SEQ ID NO: 939539 - RNA, 22 nt, Mycobacterium avium subsp. paratuberculosis
gcgccgucgucgagcaccaccc

SEQ ID NO: 939540 - RNA, 18 nt, Mycobacterium avium subsp. paratuberculosis
gcgccgucgucggacacc

SEQ ID NO: 939541 - RNA, 22 nt, Mycobacterium avium subsp. paratuberculosis
gcgccgucgucggacaccagca

SEQ ID NO: 939542 - RNA, 15 nt, Mycobacterium avium subsp. paratuberculosis
gcgccgucgucgucg

SEQ ID NO: 939543 - RNA, 18 nt, Mycobacterium avium subsp. paratuberculosis
gcgccgucgucgucggcc

SEQ ID NO: 939544 - RNA, 19 nt, Mycobacterium avium subsp. paratuberculosis
gcgccgucgucgucggccg

SEQ ID NO: 939545 - RNA, 23 nt, Mycobacterium avium subsp. paratuberculosis
gcgccgucguucuccauccgggc

SEQ ID NO: 939546 - RNA, 14 nt, Mycobacterium avium subsp. paratuberculosis
gcgccgucccggac

SEQ ID NO: 939547 - RNA, 13 nt, Mycobacterium avium subsp. paratuberculosis
gcgccgucggcgu

SEQ ID NO: 939548 - RNA, 14 nt, Mycobacterium avium subsp. paratuberculosis
gcgccgucggcguu

SEQ ID NO: 939549 - RNA, 21 nt, Mycobacterium avium subsp. paratuberculosis
gcgccgucggcguucagcggc

SEQ ID NO: 939550 - RNA, 22 nt, Mycobacterium avium subsp. paratuberculosis
gcgccgucggcguucagcggca

SEQ ID NO: 939551 - RNA, 23 nt, Mycobacterium avium subsp. paratuberculosis
gcgccgucggcguucagcggcac

SEQ ID NO: 939552 - RNA, 22 nt, Mycobacterium avium subsp. paratuberculosis
gcgccgucggggcugaguucgg

SEQ ID NO: 939553 - RNA, 19 nt, Mycobacterium avium subsp. paratuberculosis
gcgccgucaucaccgccga

SEQ ID NO: 939554 - RNA, 13 nt, Mycobacterium avium subsp. paratuberculosis
gcgccgucggugg

SEQ ID NO: 939555 - RNA, 22 nt, Mycobacterium avium subsp. paratuberculosis
gcgccgucggugggggccaggc

SEQ ID NO: 939556 - RNA, 21 nt, Mycobacterium avium subsp. paratuberculosis
gcgccguccagcucgcguucg

SEQ ID NO: 939557 - RNA, 14 nt, Mycobacterium avium subsp. paratuberculosis
gcgccgucccagcc

SEQ ID NO: 939558 - RNA, 15 nt, Mycobacterium avium subsp. paratuberculosis
gcgccgucccagccg

SEQ ID NO: 939559 - RNA, 19 nt, Mycobacterium avium subsp. paratuberculosis
gcgccgucccagccggaca

SEQ ID NO: 939560 - RNA, 14 nt, Mycobacterium avium subsp. paratuberculosis
gcgccgucaccggc

SEQ ID NO: 939561 - RNA, 15 nt, Mycobacterium avium subsp. paratuberculosis
gcgccgucaccggcu

SEQ ID NO: 939562 - RNA, 16 nt, Mycobacterium avium subsp. paratuberculosis
gcgccgucaccggcug

SEQ ID NO: 939563 - RNA, 19 nt, Mycobacterium avium subsp. paratuberculosis
gcgccgucaccggcugccc

SEQ ID NO: 939564 - RNA, 22 nt, Mycobacterium avium subsp. paratuberculosis
gcgccgucaccggcugcccgac

SEQ ID NO: 939565 - RNA, 17 nt, Mycobacterium avium subsp. paratuberculosis
gcgccguagcggcccag

SEQ ID NO: 939566 - RNA, 19 nt, Mycobacterium avium subsp. paratuberculosis
gcgccguagcggcccaggu

SEQ ID NO: 939567 - RNA, 16 nt, Mycobacterium avium subsp. paratuberculosis
gcgccguagguggcca

SEQ ID NO: 939568 - RNA, 19 nt, Mycobacterium avium subsp. paratuberculosis
gcgccguagguggccauga

SEQ ID NO: 939569 - RNA, 15 nt, Mycobacterium avium subsp. paratuberculosis
gcgccguagucgaau

SEQ ID NO: 939570 - RNA, 19 nt, Mycobacterium avium subsp. paratuberculosis
gcgccguauuggcaggcga

SEQ ID NO: 939571 - RNA, 22 nt, Mycobacterium avium subsp. paratuberculosis
gcgccguauuggcaggcgaugu

SEQ ID NO: 939572 - RNA, 14 nt, Mycobacterium avium subsp. paratuberculosis
gcgccggggcgggc

SEQ ID NO: 939573 - RNA, 20 nt, Mycobacterium avium subsp. paratuberculosis
gcgccgggcgggcgcaggug

SEQ ID NO: 939574 - RNA, 16 nt, Mycobacterium avium subsp. paratuberculosis
gcgccggggccgcggc

SEQ ID NO: 939575 - RNA, 18 nt, Mycobacterium avium subsp. paratuberculosis
gcgccggggccgcggcuc

SEQ ID NO: 939576 - RNA, 15 nt, Mycobacterium avium subsp. paratuberculosis
gcgccggcgucggug

SEQ ID NO: 939577 - RNA, 20 nt, Mycobacterium avium subsp. paratuberculosis
gcgccgggcggccucggcgu

SEQ ID NO: 939578 - RNA, 11 nt, Mycobacterium avium subsp. paratuberculosis
gcgccggcguc

SEQ ID NO: 939579 - RNA, 14 nt, Mycobacterium avium subsp. paratuberculosis
gcgccggcguccag

SEQ ID NO: 939580 - RNA, 17 nt, Mycobacterium avium subsp. paratuberculosis
gcgccggcguccagcgc

SEQ ID NO: 939581 - RNA, 19 nt, Mycobacterium avium subsp. paratuberculosis
gcgccggcguccagcgccg

SEQ ID NO: 939582 - RNA, 20 nt, Mycobacterium avium subsp. paratuberculosis
gcgccggcguccagcgccgc

SEQ ID NO: 939583 - RNA, 21 nt, Mycobacterium avium subsp. paratuberculosis
gcgccggcguccagcgccgcc

SEQ ID NO: 939584 - RNA, 17 nt, Mycobacterium avium subsp. paratuberculosis
gcgccggcggccgcgac

SEQ ID NO: 939585 - RNA, 12 nt, Mycobacterium avium subsp. paratuberculosis
gcgccggcgguc

SEQ ID NO: 939586 - RNA, 15 nt, Mycobacterium avium subsp. paratuberculosis
gcgccggcggucgac

SEQ ID NO: 939587 - RNA, 18 nt, Mycobacterium avium subsp. paratuberculosis
gcgccggcggucgacacg

SEQ ID NO: 939588 - RNA, 14 nt, Mycobacterium avium subsp. paratuberculosis
gcgccggcgguguc

SEQ ID NO: 939589 - RNA, 20 nt, Mycobacterium avium subsp. paratuberculosis
gcgccggcggugucgagaug

SEQ ID NO: 939590 - RNA, 15 nt, Mycobacterium avium subsp. paratuberculosis
gcgccggcggccgcc

SEQ ID NO: 939591 - RNA, 15 nt, Mycobacterium avium subsp. paratuberculosis
gcgccggcggccgcg

SEQ ID NO: 939592 - RNA, 13 nt, Mycobacterium avium subsp. paratuberculosis
gcgccggcggcca

SEQ ID NO: 939593 - RNA, 15 nt, Mycobacterium avium subsp. paratuberculosis
gcgccggcacucguc

SEQ ID NO: 939594 - RNA, 20 nt, Mycobacterium avium subsp. paratuberculosis
gcgccggcacugcugcccgc

SEQ ID NO: 939595 - RNA, 21 nt, Mycobacterium avium subsp. paratuberculosis
gcgccggcagauugguucggc

SEQ ID NO: 939596 - RNA, 18 nt, Mycobacterium avium subsp. paratuberculosis
gcgccggcgcgggcauga

SEQ ID NO: 939597 - RNA, 15 nt, Mycobacterium avium subsp. paratuberculosis
gcgccggaugcugcg

SEQ ID NO: 939598 - RNA, 16 nt, Mycobacterium avium subsp. paratuberculosis
gcgccggaugccagca

SEQ ID NO: 939599 - RNA, 17 nt, Mycobacterium avium subsp. paratuberculosis
gcgccggaugccagcag

SEQ ID NO: 939600 - RNA, 23 nt, Mycobacterium avium subsp. paratuberculosis
gcgccggacucgaagaucgccug

SEQ ID NO: 939601 - RNA, 16 nt, Mycobacterium avium subsp. paratuberculosis
gcgccggauugucgcu

SEQ ID NO: 939602 - RNA, 18 nt, Mycobacterium avium subsp. paratuberculosis
gcgccggauugucgcugu

SEQ ID NO: 939603 - RNA, 18 nt, Mycobacterium avium subsp. paratuberculosis
gcgccggcaacaacgcca

SEQ ID NO: 939604 - RNA, 17 nt, Mycobacterium avium subsp. paratuberculosis
gcgccggcaacuggccg

SEQ ID NO: 939605 - RNA, 19 nt, Mycobacterium avium subsp. paratuberculosis
gcgccggcaacuggccgcc

SEQ ID NO: 939606 - RNA, 16 nt, Mycobacterium avium subsp. paratuberculosis
gcgccggcaccagcag

SEQ ID NO: 939607 - RNA, 13 nt, Mycobacterium avium subsp. paratuberculosis
gcgccggaggcca

SEQ ID NO: 939608 - RNA, 19 nt, Mycobacterium avium subsp. paratuberculosis
gcgccggaggccagcucga

SEQ ID NO: 939609 - RNA, 17 nt, Mycobacterium avium subsp. paratuberculosis
gcgccggaggggcgacg

SEQ ID NO: 939610 - RNA, 22 nt, Mycobacterium avium subsp. paratuberculosis
gcgccggaggggcgacgggccg

SEQ ID NO: 939611 - RNA, 23 nt, Mycobacterium avium subsp. paratuberculosis
gcgccggaggggcgacgggccga

SEQ ID NO: 939612 - RNA, 21 nt, Mycobacterium avium subsp. paratuberculosis
gcgccggaguugccgauggcg

SEQ ID NO: 939613 - RNA, 16 nt, Mycobacterium avium subsp. paratuberculosis
gcgccggacggcccgc

SEQ ID NO: 939614 - RNA, 18 nt, Mycobacterium avium subsp. paratuberculosis
gcgccggaccgauccggc

SEQ ID NO: 939615 - RNA, 14 nt, Mycobacterium avium subsp. paratuberculosis
gcgccgcgggcgcc

SEQ ID NO: 939616 - RNA, 17 nt, Mycobacterium avium subsp. paratuberculosis
gcgccgcgggcgccgua

SEQ ID NO: 939617 - RNA, 20 nt, Mycobacterium avium subsp. paratuberculosis
gcgccgcgggcggucgcgca

SEQ ID NO: 939618 - RNA, 22 nt, Mycobacterium avium subsp. paratuberculosis
gcgccgcgggcggucgcgcagc

SEQ ID NO: 939619 - RNA, 17 nt, Mycobacterium avium subsp. paratuberculosis
gcgcccgccccgacgug

SEQ ID NO: 939620 - RNA, 23 nt, Mycobacterium avium subsp. paratuberculosis
gcgcccgccccgacgugcagcgc

SEQ ID NO: 939621 - RNA, 16 nt, Mycobacterium avium subsp. paratuberculosis
gcgcccgcccggcccg

SEQ ID NO: 939622 - RNA, 18 nt, Mycobacterium avium subsp. paratuberculosis
gcgcccgcccggcccggc

SEQ ID NO: 939623 - RNA, 20 nt, Mycobacterium avium subsp. paratuberculosis
gcgcccgcccggcccggcgc

SEQ ID NO: 939624 - RNA, 22 nt, Mycobacterium avium subsp. paratuberculosis
gcgcccgcccggcccggcgcgg

SEQ ID NO: 939625 - RNA, 19 nt, Mycobacterium avium subsp. paratuberculosis
gcgcccgccgaacaccggc

SEQ ID NO: 939626 - RNA, 17 nt, Mycobacterium avium subsp. paratuberculosis
gcgcccgccgcaacgcg

SEQ ID NO: 939627 - RNA, 13 nt, Mycobacterium avium subsp. paratuberculosis
gcgcccgcccgga

SEQ ID NO: 939628 - RNA, 13 nt, Mycobacterium avium subsp. paratuberculosis
gcgcccgcccggc

SEQ ID NO: 939629 - RNA, 19 nt, Mycobacterium avium subsp. paratuberculosis
gcgcccgccgccaccacgg

SEQ ID NO: 939630 - RNA, 12 nt, Mycobacterium avium subsp. paratuberculosis
gcgcccggaaug

SEQ ID NO: 939631 - RNA, 21 nt, Mycobacterium avium subsp. paratuberculosis
gcgcccggagcugucggugac

SEQ ID NO: 939632 - RNA, 19 nt, Mycobacterium avium subsp. paratuberculosis
gcgcccggaugucgggcga

SEQ ID NO: 939633 - RNA, 13 nt, Mycobacterium avium subsp. paratuberculosis
gcgcccggcaccg

SEQ ID NO: 939634 - RNA, 17 nt, Mycobacterium avium subsp. paratuberculosis
gcgcccggcaccgcggc

SEQ ID NO: 939635 - RNA, 15 nt, Mycobacterium avium subsp. paratuberculosis
gcgcccggcaccggg

SEQ ID NO: 939636 - RNA, 16 nt, Mycobacterium avium subsp. paratuberculosis
gcgcccggcaccggga

SEQ ID NO: 939637 - RNA, 16 nt, Mycobacterium avium subsp. paratuberculosis
gcgcccggcagccgcu

SEQ ID NO: 939638 - RNA, 21 nt, Mycobacterium avium subsp. paratuberculosis
gcgcccggcagccgcuccggc

SEQ ID NO: 939639 - RNA, 12 nt, Mycobacterium avium subsp. paratuberculosis
gcgcccggccag

SEQ ID NO: 939640 - RNA, 20 nt, Mycobacterium avium subsp. paratuberculosis
gcgcccgcauguucucgagc

SEQ ID NO: 939641 - RNA, 15 nt, Mycobacterium avium subsp. paratuberculosis
gcgcccgcaggccgc

SEQ ID NO: 939642 - RNA, 20 nt, Mycobacterium avium subsp. paratuberculosis
gcgcccgcaggccgcgagcc

SEQ ID NO: 939643 - RNA, 13 nt, Mycobacterium avium subsp. paratuberculosis
gcgcccgagccgc

SEQ ID NO: 939644 - RNA, 14 nt, Mycobacterium avium subsp. paratuberculosis
gcgcccgagccgca

SEQ ID NO: 939645 - RNA, 16 nt, Mycobacterium avium subsp. paratuberculosis
gcgcccgagccgcaca

SEQ ID NO: 939646 - RNA, 13 nt, Mycobacterium avium subsp. paratuberculosis
gcgcccgaucggc

SEQ ID NO: 939647 - RNA, 14 nt, Mycobacterium avium subsp. paratuberculosis
gcgcccgaucggca

SEQ ID NO: 939648 - RNA, 19 nt, Mycobacterium avium subsp. paratuberculosis
gcgcccgauggaggugccg

SEQ ID NO: 939649 - RNA, 18 nt, Mycobacterium avium subsp. paratuberculosis
gcgcccgauuccccggcg

SEQ ID NO: 939650 - RNA, 19 nt, Mycobacterium avium subsp. paratuberculosis
gcgcccgauuccccggcgu

SEQ ID NO: 939651 - RNA, 17 nt, Mycobacterium avium subsp. paratuberculosis
gcgcccgauucgcggcc

SEQ ID NO: 939652 - RNA, 23 nt, Mycobacterium avium subsp. paratuberculosis
gcgcccuugccgaugccggcguu

SEQ ID NO: 939653 - RNA, 19 nt, Mycobacterium avium subsp. paratuberculosis
gcgccgaaaaacgcgacgg

SEQ ID NO: 939654 - RNA, 20 nt, Mycobacterium avium subsp. paratuberculosis
gcgccgaacaacggcggacc

SEQ ID NO: 939655 - RNA, 21 nt, Mycobacterium avium subsp. paratuberculosis
gcgccgaacaacggcggaccg

SEQ ID NO: 939656 - RNA, 23 nt, Mycobacterium avium subsp. paratuberculosis
gcgccgaacaacggcggaccggc

SEQ ID NO: 939657 - RNA, 18 nt, Mycobacterium avium subsp. paratuberculosis
gcgccgaacaacugaccg

SEQ ID NO: 939658 - RNA, 15 nt, Mycobacterium avium subsp. paratuberculosis
gcgcccuucggcgcc

SEQ ID NO: 939659 - RNA, 17 nt, Mycobacterium avium subsp. paratuberculosis
gcgcccuucggcgcccg

SEQ ID NO: 939660 - RNA, 18 nt, Mycobacterium avium subsp. paratuberculosis
gcgcccuucggcgcccgc

SEQ ID NO: 939661 - RNA, 16 nt, Mycobacterium avium subsp. paratuberculosis
gcgcccuucccggucg

SEQ ID NO: 939662 - RNA, 18 nt, Mycobacterium avium subsp. paratuberculosis
gcgcccuucccggucggc

SEQ ID NO: 939663 - RNA, 19 nt, Mycobacterium avium subsp. paratuberculosis
gcgcccuugagcucggccu

SEQ ID NO: 939664 - RNA, 22 nt, Mycobacterium avium subsp. paratuberculosis
gcgcccuugagcuucccggcgg

SEQ ID NO: 939665 - RNA, 23 nt, Mycobacterium avium subsp. paratuberculosis
gcgcccuugagcuucccggcggu

SEQ ID NO: 939666 - RNA, 13 nt, Mycobacterium avium subsp. paratuberculosis
gcgcccggccggu

SEQ ID NO: 939667 - RNA, 14 nt, Mycobacterium avium subsp. paratuberculosis
gcgcccggccguga

SEQ ID NO: 939668 - RNA, 14 nt, Mycobacterium avium subsp. paratuberculosis
gcgcccggcgcccg

SEQ ID NO: 939669 - RNA, 20 nt, Mycobacterium avium subsp. paratuberculosis
gcgcccuggugcaacaccga

SEQ ID NO: 939670 - RNA, 16 nt, Mycobacterium avium subsp. paratuberculosis
gcgcccggccagccgg

SEQ ID NO: 939671 - RNA, 16 nt, Mycobacterium avium subsp. paratuberculosis
gcgcccggcccagccg

SEQ ID NO: 939672 - RNA, 18 nt, Mycobacterium avium subsp. paratuberculosis
gcgcccggcccagccgcu

SEQ ID NO: 939673 - RNA, 14 nt, Mycobacterium avium subsp. paratuberculosis
gcgcccggccggcc

SEQ ID NO: 939674 - RNA, 18 nt, Mycobacterium avium subsp. paratuberculosis
gcgcccggccggccccua

SEQ ID NO: 939675 - RNA, 12 nt, Mycobacterium avium subsp. paratuberculosis
gcgcccggcgac

SEQ ID NO: 939676 - RNA, 15 nt, Mycobacterium avium subsp. paratuberculosis
gcgcccggcgacgcg

SEQ ID NO: 939677 - RNA, 17 nt, Mycobacterium avium subsp. paratuberculosis
gcgcccggcgacgcggc

SEQ ID NO: 939678 - RNA, 14 nt, Mycobacterium avium subsp. paratuberculosis
gcgcccggcgaucg

SEQ ID NO: 939679 - RNA, 11 nt, Mycobacterium avium subsp. paratuberculosis
gcgcccggcgc

SEQ ID NO: 939680 - RNA, 19 nt, Mycobacterium avium subsp. paratuberculosis
gcgccgaaccgggugacga

SEQ ID NO: 939681 - RNA, 22 nt, Mycobacterium avium subsp. paratuberculosis
gcgccgaaccgggugacgacca

SEQ ID NO: 939682 - RNA, 18 nt, Mycobacterium avium subsp. paratuberculosis
gcgccgaacaccugcggc

SEQ ID NO: 939683 - RNA, 22 nt, Mycobacterium avium subsp. paratuberculosis
gcgccgaacaccugcggcggca

SEQ ID NO: 939684 - RNA, 16 nt, Mycobacterium avium subsp. paratuberculosis
gcgccgaacaccacgc

SEQ ID NO: 939685 - RNA, 20 nt, Mycobacterium avium subsp. paratuberculosis
gcgccgaacaccacgccgag

SEQ ID NO: 939686 - RNA, 16 nt, Mycobacterium avium subsp. paratuberculosis
gcgccgaccagcgcgu

SEQ ID NO: 939687 - RNA, 18 nt, Mycobacterium avium subsp. paratuberculosis
gcgccgaccagcgcguug

SEQ ID NO: 939688 - RNA, 14 nt, Mycobacterium avium subsp. paratuberculosis
gcgccgaccgcgau

SEQ ID NO: 939689 - RNA, 16 nt, Mycobacterium avium subsp. paratuberculosis
gcgccgaccgcgaucg

SEQ ID NO: 939690 - RNA, 23 nt, Mycobacterium avium subsp. paratuberculosis
gcgccgacccccgccgcgucggu

SEQ ID NO: 939691 - RNA, 21 nt, Mycobacterium avium subsp. paratuberculosis
gcgccgacccgcccgccgggc

SEQ ID NO: 939692 - RNA, 15 nt, Mycobacterium avium subsp. paratuberculosis
gcgccgaccgagggc

SEQ ID NO: 939693 - RNA, 15 nt, Mycobacterium avium subsp. paratuberculosis
gcgccgacgcccaca

SEQ ID NO: 939694 - RNA, 21 nt, Mycobacterium avium subsp. paratuberculosis
gcgccgacgcccacagcgcca

SEQ ID NO: 939695 - RNA, 17 nt, Mycobacterium avium subsp. paratuberculosis
gcgccgaggucaccgcg

SEQ ID NO: 939696 - RNA, 18 nt, Mycobacterium avium subsp. paratuberculosis
gcgccgaggucaccgcgg

SEQ ID NO: 939697 - RNA, 13 nt, Mycobacterium avium subsp. paratuberculosis
gcgccgagguggc

SEQ ID NO: 939698 - RNA, 15 nt, Mycobacterium avium subsp. paratuberculosis
gcgccgagguggccc

SEQ ID NO: 939699 - RNA, 19 nt, Mycobacterium avium subsp. paratuberculosis
gcgccgagguggccgccag

SEQ ID NO: 939700 - RNA, 20 nt, Mycobacterium avium subsp. paratuberculosis
gcgccgagguggccgccagc

SEQ ID NO: 939701 - RNA, 23 nt, Mycobacterium avium subsp. paratuberculosis
gcgccgagguggccgccagcacc

SEQ ID NO: 939702 - RNA, 13 nt, Mycobacterium avium subsp. paratuberculosis
gcgccgacgaucc

SEQ ID NO: 939703 - RNA, 14 nt, Mycobacterium avium subsp. paratuberculosis
gcgccgacgauccc

SEQ ID NO: 939704 - RNA, 17 nt, Mycobacterium avium subsp. paratuberculosis
gcgccgacgaucccggc

SEQ ID NO: 939705 - RNA, 19 nt, Mycobacterium avium subsp. paratuberculosis
gcgccgacgaucccggcga

SEQ ID NO: 939706 - RNA, 18 nt, Mycobacterium avium subsp. paratuberculosis
gcgccgacgacgucgcgc

SEQ ID NO: 939707 - RNA, 22 nt, Mycobacterium avium subsp. paratuberculosis
gcgccgaccucgucggcggugc

SEQ ID NO: 939708 - RNA, 23 nt, Mycobacterium avium subsp. paratuberculosis
gcgccgaccucgucggcggugcc

SEQ ID NO: 939709 - RNA, 14 nt, Mycobacterium avium subsp. paratuberculosis
gcgccgaccugguc

SEQ ID NO: 939710 - RNA, 20 nt, Mycobacterium avium subsp. paratuberculosis
gcgccgaccuggucgccgaa

SEQ ID NO: 939711 - RNA, 22 nt, Mycobacterium avium subsp. paratuberculosis
gcgccgaccuggucgccgaacg

SEQ ID NO: 939712 - RNA, 14 nt, Mycobacterium avium subsp. paratuberculosis
gcgccgaucacgaa

SEQ ID NO: 939713 - RNA, 15 nt, Mycobacterium avium subsp. paratuberculosis
gcgccgaucacgccg

SEQ ID NO: 939714 - RNA, 16 nt, Mycobacterium avium subsp. paratuberculosis
gcgccgaucacgccgg

SEQ ID NO: 939715 - RNA, 15 nt, Mycobacterium avium subsp. paratuberculosis
gcgccgaucugcucg

SEQ ID NO: 939716 - RNA, 15 nt, Mycobacterium avium subsp. paratuberculosis
gcgccgauccggcuc

SEQ ID NO: 939717 - RNA, 15 nt, Mycobacterium avium subsp. paratuberculosis
gcgccgaucgcccag

SEQ ID NO: 939718 - RNA, 12 nt, Mycobacterium avium subsp. paratuberculosis
gcgccgaucgcg

SEQ ID NO: 939719 - RNA, 13 nt, Mycobacterium avium subsp. paratuberculosis
gcgccgcagcacg

SEQ ID NO: 939720 - RNA, 23 nt, Mycobacterium avium subsp. paratuberculosis
gcgccgcagcaggugcaucgcca

SEQ ID NO: 939721 - RNA, 20 nt, Mycobacterium avium subsp. paratuberculosis
gcgccgcagcgcgcgcucgg

SEQ ID NO: 939722 - RNA, 13 nt, Mycobacterium avium subsp. paratuberculosis
gcgccgcaccucg

SEQ ID NO: 939723 - RNA, 14 nt, Mycobacterium avium subsp. paratuberculosis
gcgccgcaccucgc

SEQ ID NO: 939724 - RNA, 16 nt, Mycobacterium avium subsp. paratuberculosis
gcgccgcaccucgccg

SEQ ID NO: 939725 - RNA, 18 nt, Mycobacterium avium subsp. paratuberculosis
gcgccgcaccucgccgau

SEQ ID NO: 939726 - RNA, 20 nt, Mycobacterium avium subsp. paratuberculosis
gcgccgcacagccggcggcg

SEQ ID NO: 939727 - RNA, 16 nt, Mycobacterium avium subsp. paratuberculosis
gcgccagacguccagc

SEQ ID NO: 939728 - RNA, 18 nt, Mycobacterium avium subsp. paratuberculosis
gcgccagacguccagcgc

SEQ ID NO: 939729 - RNA, 20 nt, Mycobacterium avium subsp. paratuberculosis
gcgccagacguccagcgccg

SEQ ID NO: 939730 - RNA, 22 nt, Mycobacterium avium subsp. paratuberculosis
gcgccagacguccagcgccgcc

SEQ ID NO: 939731 - RNA, 17 nt, Mycobacterium avium subsp. paratuberculosis
gcgccagagacaaccgc

SEQ ID NO: 939732 - RNA, 20 nt, Mycobacterium avium subsp. paratuberculosis
gcgccagaucagcgugguca

SEQ ID NO: 939733 - RNA, 15 nt, Mycobacterium avium subsp. paratuberculosis
gcgccagaucgcuga

SEQ ID NO: 939734 - RNA, 19 nt, Mycobacterium avium subsp. paratuberculosis
gcgccaguaguggaucagc

SEQ ID NO: 939735 - RNA, 18 nt, Mycobacterium avium subsp. paratuberculosis
gcgccacguggucgagca

SEQ ID NO: 939736 - RNA, 19 nt, Mycobacterium avium subsp. paratuberculosis
gcgccacuucuccacgccg

SEQ ID NO: 939737 - RNA, 20 nt, Mycobacterium avium subsp. paratuberculosis
gcgccacuucuccacgccga

SEQ ID NO: 939738 - RNA, 17 nt, Mycobacterium avium subsp. paratuberculosis
gcgccacuuguccacca

SEQ ID NO: 939739 - RNA, 16 nt, Mycobacterium avium subsp. paratuberculosis
gcgccaguuugccguc

SEQ ID NO: 939740 - RNA, 21 nt, Mycobacterium avium subsp. paratuberculosis
gcgccaguuugccgucgggac

SEQ ID NO: 939741 - RNA, 22 nt, Mycobacterium avium subsp. paratuberculosis
gcgccaguuugccgucgggacg

SEQ ID NO: 939742 - RNA, 15 nt, Mycobacterium avium subsp. paratuberculosis
gcgccaguugcucgg

SEQ ID NO: 939743 - RNA, 18 nt, Mycobacterium avium subsp. paratuberculosis
gcgccaguugcucgggug

SEQ ID NO: 939744 - RNA, 14 nt, Mycobacterium avium subsp. paratuberculosis
gcgccauccccgcu

SEQ ID NO: 939745 - RNA, 19 nt, Mycobacterium avium subsp. paratuberculosis
gcgccauccccgcuucggc

SEQ ID NO: 939746 - RNA, 21 nt, Mycobacterium avium subsp. paratuberculosis
gcgccauccccgcuucggcuc

SEQ ID NO: 939747 - RNA, 23 nt, Mycobacterium avium subsp. paratuberculosis
gcgccauccccgcuucggcucgg

SEQ ID NO: 939748 - RNA, 22 nt, Mycobacterium avium subsp. paratuberculosis
gcgccauccgcagcccgucgau

SEQ ID NO: 939749 - RNA, 19 nt, Mycobacterium avium subsp. paratuberculosis
gcgccauccgccgguucgu

SEQ ID NO: 939750 - RNA, 15 nt, Mycobacterium avium subsp. paratuberculosis
gcgccaugaacggcg

SEQ ID NO: 939751 - RNA, 16 nt, Mycobacterium avium subsp. paratuberculosis
gcgccaugaacggcgg

SEQ ID NO: 939752 - RNA, 21 nt, Mycobacterium avium subsp. paratuberculosis
gcgccaugaacggcggggccu

SEQ ID NO: 939753 - RNA, 15 nt, Mycobacterium avium subsp. paratuberculosis
gcgccaucguggccg

SEQ ID NO: 939754 - RNA, 14 nt, Mycobacterium avium subsp. paratuberculosis
gcgcccaggcccga

SEQ ID NO: 939755 - RNA, 18 nt, Mycobacterium avium subsp. paratuberculosis
gcgcccagguccaccagg

SEQ ID NO: 939756 - RNA, 19 nt, Mycobacterium avium subsp. paratuberculosis
gcgcccagguacuccucgg

SEQ ID NO: 939757 - RNA, 21 nt, Mycobacterium avium subsp. paratuberculosis
gcgcccagguacuccucggug

SEQ ID NO: 939758 - RNA, 15 nt, Mycobacterium avium subsp. paratuberculosis
gcgccccgcccgcga

SEQ ID NO: 939759 - RNA, 13 nt, Mycobacterium avium subsp. paratuberculosis
gcgccccggcccg

SEQ ID NO: 939760 - RNA, 14 nt, Mycobacterium avium subsp. paratuberculosis
gcgccccggcccgg

SEQ ID NO: 939761 - RNA, 14 nt, Mycobacterium avium subsp. paratuberculosis
gcgccccggcccgu

SEQ ID NO: 939762 - RNA, 16 nt, Mycobacterium avium subsp. paratuberculosis
gcgcccauccggcgcc

SEQ ID NO: 939763 - RNA, 17 nt, Mycobacterium avium subsp. paratuberculosis
gcgcccauccggcgccg

SEQ ID NO: 939764 - RNA, 15 nt, Mycobacterium avium subsp. paratuberculosis
gcgcccaucgcggcc

SEQ ID NO: 939765 - RNA, 16 nt, Mycobacterium avium subsp. paratuberculosis
gcgcccaucgcggccg

SEQ ID NO: 939766 - RNA, 22 nt, Mycobacterium avium subsp. paratuberculosis
gcgcccaucgcggccgcccggu

SEQ ID NO: 939767 - RNA, 21 nt, Mycobacterium avium subsp. paratuberculosis
gcgcccaugaacgcgucgccg

SEQ ID NO: 939768 - RNA, 18 nt, Mycobacterium avium subsp. paratuberculosis
gcgcccaggggagcggcg

SEQ ID NO: 939769 - RNA, 13 nt, Mycobacterium avium subsp. paratuberculosis
gcgcccgacgaug

SEQ ID NO: 939770 - RNA, 16 nt, Mycobacterium avium subsp. paratuberculosis
gcgcccgacgccggac

SEQ ID NO: 939771 - RNA, 14 nt, Mycobacterium avium subsp. paratuberculosis
gcgccccgcuggua

SEQ ID NO: 939772 - RNA, 13 nt, Mycobacterium avium subsp. paratuberculosis
gcgccccggccug

SEQ ID NO: 939773 - RNA, 15 nt, Mycobacterium avium subsp. paratuberculosis
gcgccccggcgcuga

SEQ ID NO: 939774 - RNA, 12 nt, Mycobacterium avium subsp. paratuberculosis
gcgccccggcgg

SEQ ID NO: 939775 - RNA, 13 nt, Mycobacterium avium subsp. paratuberculosis
gcgccccggcggc

SEQ ID NO: 939776 - RNA, 15 nt, Mycobacterium avium subsp. paratuberculosis
gcgccccggcggcca

SEQ ID NO: 939777 - RNA, 17 nt, Mycobacterium avium subsp. paratuberculosis
gcgccccggcggccacg

SEQ ID NO: 939778 - RNA, 19 nt, Mycobacterium avium subsp. paratuberculosis
gcgccccggcgggcggccg

SEQ ID NO: 939779 - RNA, 20 nt, Mycobacterium avium subsp. paratuberculosis
gcgccccggcgggcggccga

SEQ ID NO: 939780 - RNA, 13 nt, Mycobacterium avium subsp. paratuberculosis
gcgccccggcguc

SEQ ID NO: 939781 - RNA, 18 nt, Mycobacterium avium subsp. paratuberculosis
gcgccccggcgucgauga

SEQ ID NO: 939782 - RNA, 19 nt, Mycobacterium avium subsp. paratuberculosis
gcgccccgggauccgaggc

SEQ ID NO: 939783 - RNA, 20 nt, Mycobacterium avium subsp. paratuberculosis
gcgccccgggauccgaggcg

SEQ ID NO: 939784 - RNA, 14 nt, Mycobacterium avium subsp. paratuberculosis
gcgccccggucccg

SEQ ID NO: 939785 - RNA, 21 nt, Mycobacterium avium subsp. paratuberculosis
gcgccccggucccgccgguga

SEQ ID NO: 939786 - RNA, 14 nt, Mycobacterium avium subsp. paratuberculosis
gcgcccacagcagg

SEQ ID NO: 939787 - RNA, 19 nt, Mycobacterium avium subsp. paratuberculosis
gcgcccacagguccagcgu

SEQ ID NO: 939788 - RNA, 20 nt, Mycobacterium avium subsp. paratuberculosis
gcgcccacaguccgcccagc

SEQ ID NO: 939789 - RNA, 20 nt, Mycobacterium avium subsp. paratuberculosis
gcgcccacccgaugaccggc

SEQ ID NO: 939790 - RNA, 13 nt, Mycobacterium avium subsp. paratuberculosis
gcgcccacccgcg

SEQ ID NO: 939791 - RNA, 12 nt, Mycobacterium avium subsp. paratuberculosis
gcgcccaggcgu

SEQ ID NO: 939792 - RNA, 12 nt, Mycobacterium avium subsp. paratuberculosis
gcgcccaggccc

SEQ ID NO: 939793 - RNA, 12 nt, Mycobacterium avium subsp. paratuberculosis
gcgcccaccgcg

SEQ ID NO: 939794 - RNA, 15 nt, Mycobacterium avium subsp. paratuberculosis
gcgcccagcgugguc

SEQ ID NO: 939795 - RNA, 21 nt, Mycobacterium avium subsp. paratuberculosis
gcgcccagcguggucacccgc

SEQ ID NO: 939796 - RNA, 20 nt, Mycobacterium avium subsp. paratuberculosis
gcgcccaggaacgcgccggc

SEQ ID NO: 939797 - RNA, 21 nt, Mycobacterium avium subsp. paratuberculosis
gcgcccaggaacgcgccggcg

SEQ ID NO: 939798 - RNA, 22 nt, Mycobacterium avium subsp. paratuberculosis
gcgcccaggaacgcgccggcgc

SEQ ID NO: 939799 - RNA, 16 nt, Mycobacterium avium subsp. paratuberculosis
gcgcccaggaacuggu

SEQ ID NO: 939800 - RNA, 19 nt, Mycobacterium avium subsp. paratuberculosis
gcgcccacccgcgcacgcu

SEQ ID NO: 939801 - RNA, 15 nt, Mycobacterium avium subsp. paratuberculosis
gcgcccacccgcgcc

SEQ ID NO: 939802 - RNA, 16 nt, Mycobacterium avium subsp. paratuberculosis
gcgcccacccgcgccg

SEQ ID NO: 939803 - RNA, 18 nt, Mycobacterium avium subsp. paratuberculosis
gcgcccacccgcgccggc

SEQ ID NO: 939804 - RNA, 22 nt, Mycobacterium avium subsp. paratuberculosis
gcgcccacccguuggcaggccc

SEQ ID NO: 939805 - RNA, 17 nt, Mycobacterium avium subsp. paratuberculosis
gcgcgcguagcgcagcu

SEQ ID NO: 939806 - RNA, 20 nt, Mycobacterium avium subsp. paratuberculosis
gcgcgcguagcgcagcucca

SEQ ID NO: 939807 - RNA, 18 nt, Mycobacterium avium subsp. paratuberculosis
gcgcgcggugcgccagcg

SEQ ID NO: 939808 - RNA, 12 nt, Mycobacterium avium subsp. paratuberculosis
gcgcgcggggug

SEQ ID NO: 939809 - RNA, 20 nt, Mycobacterium avium subsp. paratuberculosis
gcgcgcggggugucgcggcu

SEQ ID NO: 939810 - RNA, 19 nt, Mycobacterium avium subsp. paratuberculosis
gcgcgcggggccggcgcgg

SEQ ID NO: 939811 - RNA, 21 nt, Mycobacterium avium subsp. paratuberculosis
gcgcgcggggccggcgcggug

SEQ ID NO: 939812 - RNA, 21 nt, Mycobacterium avium subsp. paratuberculosis
gcgcgcgggcgcgcgccgccc

SEQ ID NO: 939813 - RNA, 13 nt, Mycobacterium avium subsp. paratuberculosis
gcgcgcgggcguc

SEQ ID NO: 939814 - RNA, 16 nt, Mycobacterium avium subsp. paratuberculosis
gcgcgcgggccagcgu

SEQ ID NO: 939815 - RNA, 16 nt, Mycobacterium avium subsp. paratuberculosis
gcgcgcggccagcccc

SEQ ID NO: 939816 - RNA, 14 nt, Mycobacterium avium subsp. paratuberculosis
gcgcgcggcguggu

SEQ ID NO: 939817 - RNA, 18 nt, Mycobacterium avium subsp. paratuberculosis
gcgcgcggcgcggagccg

SEQ ID NO: 939818 - RNA, 20 nt, Mycobacterium avium subsp. paratuberculosis
gcgcgcggcgucaggggugc

SEQ ID NO: 939819 - RNA, 14 nt, Mycobacterium avium subsp. paratuberculosis
gcgcgcggcggaug

SEQ ID NO: 939820 - RNA, 21 nt, Mycobacterium avium subsp. paratuberculosis
gcgcgcggcggauguccuggu

SEQ ID NO: 939821 - RNA, 16 nt, Mycobacterium avium subsp. paratuberculosis
gcgcgcggcggccacc

SEQ ID NO: 939822 - RNA, 13 nt, Mycobacterium avium subsp. paratuberculosis
gcgcgcggcgccg

SEQ ID NO: 939823 - RNA, 15 nt, Mycobacterium avium subsp. paratuberculosis
gcgcgcggcgacggu

SEQ ID NO: 939824 - RNA, 20 nt, Mycobacterium avium subsp. paratuberculosis
gcgcgcggccaccgcgcgcu

SEQ ID NO: 939825 - RNA, 12 nt, Mycobacterium avium subsp. paratuberculosis
gcgcgcggcacg

SEQ ID NO: 939826 - RNA, 13 nt, Mycobacterium avium subsp. paratuberculosis
gcgcgcggcacgg

SEQ ID NO: 939827 - RNA, 16 nt, Mycobacterium avium subsp. paratuberculosis
gcgcgcggccuccagc

SEQ ID NO: 939828 - RNA, 23 nt, Mycobacterium avium subsp. paratuberculosis
gcgcgcggccuccagccgcgcgg

SEQ ID NO: 939829 - RNA, 23 nt, Mycobacterium avium subsp. paratuberculosis
gcgcgcgcuggugcgggccagca

SEQ ID NO: 939830 - RNA, 12 nt, Mycobacterium avium subsp. paratuberculosis
gcgcgcgcucgg

SEQ ID NO: 939831 - RNA, 14 nt, Mycobacterium avium subsp. paratuberculosis
gcgcgcgcucggcg

SEQ ID NO: 939832 - RNA, 13 nt, Mycobacterium avium subsp. paratuberculosis
gcgcgcgcggccu

SEQ ID NO: 939833 - RNA, 15 nt, Mycobacterium avium subsp. paratuberculosis
gcgcgcgcgcucggc

SEQ ID NO: 939834 - RNA, 13 nt, Mycobacterium avium subsp. paratuberculosis
gcgcgcgcgccac

SEQ ID NO: 939835 - RNA, 14 nt, Mycobacterium avium subsp. paratuberculosis
gcgcgcgcgccacg

SEQ ID NO: 939836 - RNA, 12 nt, Mycobacterium avium subsp. paratuberculosis
gcgcgcgccggg

SEQ ID NO: 939837 - RNA, 14 nt, Mycobacterium avium subsp. paratuberculosis
gcgcgcgccagcgu

SEQ ID NO: 939838 - RNA, 12 nt, Mycobacterium avium subsp. paratuberculosis
gcgcgcgccgau

SEQ ID NO: 939839 - RNA, 12 nt, Mycobacterium avium subsp. paratuberculosis
gcgcgcgccgcc

SEQ ID NO: 939840 - RNA, 13 nt, Mycobacterium avium subsp. paratuberculosis
gcgcgcgccgcag

SEQ ID NO: 939841 - RNA, 13 nt, Mycobacterium avium subsp. paratuberculosis
gcgcgcgccacga

SEQ ID NO: 939842 - RNA, 12 nt, Mycobacterium avium subsp. paratuberculosis
gcgcgcgcaccu

SEQ ID NO: 939843 - RNA, 20 nt, Mycobacterium avium subsp. paratuberculosis
gcgcgcgauggacagcagcc

SEQ ID NO: 939844 - RNA, 14 nt, Mycobacterium avium subsp. paratuberculosis
gcgcgcgaucgccg

SEQ ID NO: 939845 - RNA, 16 nt, Mycobacterium avium subsp. paratuberculosis
gcgcgcgaucgguguc

SEQ ID NO: 939846 - RNA, 12 nt, Mycobacterium avium subsp. paratuberculosis
gcgcgcgaucag

SEQ ID NO: 939847 - RNA, 14 nt, Mycobacterium avium subsp. paratuberculosis
gcgcgcgaucagcg

SEQ ID NO: 939848 - RNA, 16 nt, Mycobacterium avium subsp. paratuberculosis
gcgcgcgaucagcgcc

SEQ ID NO: 939849 - RNA, 18 nt, Mycobacterium avium subsp. paratuberculosis
gcgcgcgagcgucacgcu

SEQ ID NO: 939850 - RNA, 14 nt, Mycobacterium avium subsp. paratuberculosis
gcgcgcgacggcgc

SEQ ID NO: 939851 - RNA, 20 nt, Mycobacterium avium subsp. paratuberculosis
gcgcgcgaaaaaacggcggc

SEQ ID NO: 939852 - RNA, 23 nt, Mycobacterium avium subsp. paratuberculosis
gcgcgcgaaaaaacggcggcgga

SEQ ID NO: 939853 - RNA, 16 nt, Mycobacterium avium subsp. paratuberculosis
gcgcgccugcgcggcg

SEQ ID NO: 939854 - RNA, 13 nt, Mycobacterium avium subsp. paratuberculosis
gcgcgccgucggc

SEQ ID NO: 939855 - RNA, 14 nt, Mycobacterium avium subsp. paratuberculosis
gcgcgccgucggcg

SEQ ID NO: 939856 - RNA, 20 nt, Mycobacterium avium subsp. paratuberculosis
gcgcgccgucggcgaugcgg

SEQ ID NO: 939857 - RNA, 15 nt, Mycobacterium avium subsp. paratuberculosis
gcgcgccgucggcgu

SEQ ID NO: 939858 - RNA, 14 nt, Mycobacterium avium subsp. paratuberculosis
gcgcgccgugacgc

SEQ ID NO: 939859 - RNA, 15 nt, Mycobacterium avium subsp. paratuberculosis
gcgcgccguuggugg

SEQ ID NO: 939860 - RNA, 21 nt, Mycobacterium avium subsp. paratuberculosis
gcgcgccgguaaugggcgauc

SEQ ID NO: 939861 - RNA, 13 nt, Mycobacterium avium subsp. paratuberculosis
gcgcgccguaccg

SEQ ID NO: 939862 - RNA, 16 nt, Mycobacterium avium subsp. paratuberculosis
gcgcgccgucccagcc

SEQ ID NO: 939863 - RNA, 17 nt, Mycobacterium avium subsp. paratuberculosis
gcgcgccgucccagccg

SEQ ID NO: 939864 - RNA, 13 nt, Mycobacterium avium subsp. paratuberculosis
gcgcgccgggcag

SEQ ID NO: 939865 - RNA, 14 nt, Mycobacterium avium subsp. paratuberculosis
gcgcgccgggcagc

SEQ ID NO: 939866 - RNA, 15 nt, Mycobacterium avium subsp. paratuberculosis
gcgcgccgggcagcc

SEQ ID NO: 939867 - RNA, 18 nt, Mycobacterium avium subsp. paratuberculosis
gcgcgccgggcagcccgc

SEQ ID NO: 939868 - RNA, 15 nt, Mycobacterium avium subsp. paratuberculosis
gcgcgccggcgucgg

SEQ ID NO: 939869 - RNA, 16 nt, Mycobacterium avium subsp. paratuberculosis
gcgcgccggcggccgc

SEQ ID NO: 939870 - RNA, 22 nt, Mycobacterium avium subsp. paratuberculosis
gcgcgccggcggccgccgcccg

SEQ ID NO: 939871 - RNA, 12 nt, Mycobacterium avium subsp. paratuberculosis
gcgcgccggcgc

SEQ ID NO: 939872 - RNA, 15 nt, Mycobacterium avium subsp. paratuberculosis
gcgcgccggcgcagc

SEQ ID NO: 939873 - RNA, 12 nt, Mycobacterium avium subsp. paratuberculosis
gcgcgccggcga

SEQ ID NO: 939874 - RNA, 15 nt, Mycobacterium avium subsp. paratuberculosis
gcgcggaaugcucga

SEQ ID NO: 939875 - RNA, 12 nt, Mycobacterium avium subsp. paratuberculosis
gcgcggaccgca

SEQ ID NO: 939876 - RNA, 17 nt, Mycobacterium avium subsp. paratuberculosis
gcgcggacagcgcggug

SEQ ID NO: 939877 - RNA, 14 nt, Mycobacterium avium subsp. paratuberculosis
gcgcggacagcugc

SEQ ID NO: 939878 - RNA, 18 nt, Mycobacterium avium subsp. paratuberculosis
gcgcggacagcugcgcgg

SEQ ID NO: 939879 - RNA, 15 nt, Mycobacterium avium subsp. paratuberculosis
gcgcggagaucaccc

SEQ ID NO: 939880 - RNA, 22 nt, Mycobacterium avium subsp. paratuberculosis
gcgcggagaucaccccuggcgg

SEQ ID NO: 939881 - RNA, 13 nt, Mycobacterium avium subsp. paratuberculosis
gcgcggagccggc

SEQ ID NO: 939882 - RNA, 15 nt, Mycobacterium avium subsp. paratuberculosis
gcgcggagccggccg

SEQ ID NO: 939883 - RNA, 17 nt, Mycobacterium avium subsp. paratuberculosis
gcgcggagccggccgcc

SEQ ID NO: 939884 - RNA, 20 nt, Mycobacterium avium subsp. paratuberculosis
gcgcggagccggccgccgaa

SEQ ID NO: 939885 - RNA, 23 nt, Mycobacterium avium subsp. paratuberculosis
gcgcggaaacuccuggccccgau

SEQ ID NO: 939886 - RNA, 15 nt, Mycobacterium avium subsp. paratuberculosis
gcgcggacgcggcgg

SEQ ID NO: 939887 - RNA, 13 nt, Mycobacterium avium subsp. paratuberculosis
gcgcggaccgcac

SEQ ID NO: 939888 - RNA, 15 nt, Mycobacterium avium subsp. paratuberculosis
gcgcggaccgcaccc

SEQ ID NO: 939889 - RNA, 23 nt, Mycobacterium avium subsp. paratuberculosis
gcgcggaccggcgauuucggccg

SEQ ID NO: 939890 - RNA, 17 nt, Mycobacterium avium subsp. paratuberculosis
gcgcggaacgcgccggg

SEQ ID NO: 939891 - RNA, 20 nt, Mycobacterium avium subsp. paratuberculosis
gcgcgcuuaauacagcgcgu

SEQ ID NO: 939892 - RNA, 14 nt, Mycobacterium avium subsp. paratuberculosis
gcgcgcuugcgcuc

SEQ ID NO: 939893 - RNA, 17 nt, Mycobacterium avium subsp. paratuberculosis
gcgcgcuugcgcucggu

SEQ ID NO: 939894 - RNA, 21 nt, Mycobacterium avium subsp. paratuberculosis
gcgcgcuggugcgggccagca

SEQ ID NO: 939895 - RNA, 22 nt, Mycobacterium avium subsp. paratuberculosis
gcgcgcuguaggucgcguacgg

SEQ ID NO: 939896 - RNA, 19 nt, Mycobacterium avium subsp. paratuberculosis
gcgcgcugucgacgcguug

SEQ ID NO: 939897 - RNA, 18 nt, Mycobacterium avium subsp. paratuberculosis
gcgcgcugugcgccaugu

SEQ ID NO: 939898 - RNA, 12 nt, Mycobacterium avium subsp. paratuberculosis
gcgcgcucggcg

SEQ ID NO: 939899 - RNA, 16 nt, Mycobacterium avium subsp. paratuberculosis
gcgcgcugccgcgccc

SEQ ID NO: 939900 - RNA, 17 nt, Mycobacterium avium subsp. paratuberculosis
gcgcgcugaagcgcgac

SEQ ID NO: 939901 - RNA, 18 nt, Mycobacterium avium subsp. paratuberculosis
gcgcgcugaagcgcgacc

SEQ ID NO: 939902 - RNA, 19 nt, Mycobacterium avium subsp. paratuberculosis
gcgcgcugaagcgcgaccc

SEQ ID NO: 939903 - RNA, 20 nt, Mycobacterium avium subsp. paratuberculosis
gcgcgcugaagcgcgacccc

SEQ ID NO: 939904 - RNA, 16 nt, Mycobacterium avium subsp. paratuberculosis
gcgcgcucgggggugc

SEQ ID NO: 939905 - RNA, 21 nt, Mycobacterium avium subsp. paratuberculosis
gcgcgcucgggggugcccggc

SEQ ID NO: 939906 - RNA, 13 nt, Mycobacterium avium subsp. paratuberculosis
gcgcgcucgucgu

SEQ ID NO: 939907 - RNA, 15 nt, Mycobacterium avium subsp. paratuberculosis
gcgcgcucgucgucg

SEQ ID NO: 939908 - RNA, 22 nt, Mycobacterium avium subsp. paratuberculosis
gcgcgcucgucgucggugaacg

SEQ ID NO: 939909 - RNA, 13 nt, Mycobacterium avium subsp. paratuberculosis
gcgcgcucggcgu

SEQ ID NO: 939910 - RNA, 14 nt, Mycobacterium avium subsp. paratuberculosis
gcgcgcucggcguu

SEQ ID NO: 939911 - RNA, 17 nt, Mycobacterium avium subsp. paratuberculosis
gcgcgcucaaccgccca

SEQ ID NO: 939912 - RNA, 17 nt, Mycobacterium avium subsp. paratuberculosis
gcgcggcagggccaggc

SEQ ID NO: 939913 - RNA, 22 nt, Mycobacterium avium subsp. paratuberculosis
gcgcggcagggccaggccguga

SEQ ID NO: 939914 - RNA, 17 nt, Mycobacterium avium subsp. paratuberculosis
gcgcggcacgguggcca

SEQ ID NO: 939915 - RNA, 22 nt, Mycobacterium avium subsp. paratuberculosis
gcgcggcaggaauuccagcgac

SEQ ID NO: 939916 - RNA, 19 nt, Mycobacterium avium subsp. paratuberculosis
gcgcggcaugccgcccggg

SEQ ID NO: 939917 - RNA, 18 nt, Mycobacterium avium subsp. paratuberculosis
gcgcggcauggcuggcgg

SEQ ID NO: 939918 - RNA, 21 nt, Mycobacterium avium subsp. paratuberculosis
gcgcggcauggcuggcggcaa

SEQ ID NO: 939919 - RNA, 22 nt, Mycobacterium avium subsp. paratuberculosis
gcgcggcagguugcgcuggaug

SEQ ID NO: 939920 - RNA, 21 nt, Mycobacterium avium subsp. paratuberculosis
gcgcggccacaccgaucagca

SEQ ID NO: 939921 - RNA, 13 nt, Mycobacterium avium subsp. paratuberculosis
gcgcggccaccac

SEQ ID NO: 939922 - RNA, 14 nt, Mycobacterium avium subsp. paratuberculosis
gcgcggccaccacc

SEQ ID NO: 939923 - RNA, 15 nt, Mycobacterium avium subsp. paratuberculosis
gcgcggccaccacca

SEQ ID NO: 939924 - RNA, 18 nt, Mycobacterium avium subsp. paratuberculosis
gcgcggccaccaccacgg

SEQ ID NO: 939925 - RNA, 21 nt, Mycobacterium avium subsp. paratuberculosis
gcgcggccaccaccacggcca

SEQ ID NO: 939926 - RNA, 18 nt, Mycobacterium avium subsp. paratuberculosis
gcgcggccaccacgacgg

SEQ ID NO: 939927 - RNA, 19 nt, Mycobacterium avium subsp. paratuberculosis
gcgcggccaccagcgcggc

SEQ ID NO: 939928 - RNA, 17 nt, Mycobacterium avium subsp. paratuberculosis
gcgcggagcgucgcgau

SEQ ID NO: 939929 - RNA, 13 nt, Mycobacterium avium subsp. paratuberculosis
gcgcggcaccacc

SEQ ID NO: 939930 - RNA, 18 nt, Mycobacterium avium subsp. paratuberculosis
gcgcggauggguggcgau

SEQ ID NO: 939931 - RNA, 18 nt, Mycobacterium avium subsp. paratuberculosis
gcgcggauuccagcgcga

SEQ ID NO: 939932 - RNA, 17 nt, Mycobacterium avium subsp. paratuberculosis
gcgcggaucucgcgcag

SEQ ID NO: 939933 - RNA, 16 nt, Mycobacterium avium subsp. paratuberculosis
gcgcggaugcccaggc

SEQ ID NO: 939934 - RNA, 22 nt, Mycobacterium avium subsp. paratuberculosis
gcgcggaugcccaggccggcga

SEQ ID NO: 939935 - RNA, 24 nt, Mycobacterium avium subsp. paratuberculosis
gcgcggcccgcgacgucggagauc

SEQ ID NO: 939936 - RNA, 15 nt, Mycobacterium avium subsp. paratuberculosis
gcgcggcccgcggcg

SEQ ID NO: 939937 - RNA, 17 nt, Mycobacterium avium subsp. paratuberculosis
gcgcggcccgcggcguc

SEQ ID NO: 939938 - RNA, 14 nt, Mycobacterium avium subsp. paratuberculosis
gcgcggcccgccga

SEQ ID NO: 939939 - RNA, 16 nt, Mycobacterium avium subsp. paratuberculosis
gcgcggcccgccgaac

SEQ ID NO: 939940 - RNA, 14 nt, Mycobacterium avium subsp. paratuberculosis
gcgcggcccagcgu

SEQ ID NO: 939941 - RNA, 16 nt, Mycobacterium avium subsp. paratuberculosis
gcgcggcccaguucgc

SEQ ID NO: 939942 - RNA, 12 nt, Mycobacterium avium subsp. paratuberculosis
gcgcggccgcca

SEQ ID NO: 939943 - RNA, 23 nt, Mycobacterium avium subsp. paratuberculosis
gcgcggccgccaggucggggccc

SEQ ID NO: 939944 - RNA, 14 nt, Mycobacterium avium subsp. paratuberculosis
gcgcggccgcccag

SEQ ID NO: 939945 - RNA, 15 nt, Mycobacterium avium subsp. paratuberculosis
gcgcggccgcccagc

SEQ ID NO: 939946 - RNA, 22 nt, Mycobacterium avium subsp. paratuberculosis
gcgcggccgcccagucgccgcc

SEQ ID NO: 939947 - RNA, 15 nt, Mycobacterium avium subsp. paratuberculosis
gcgcggccgcccguc

SEQ ID NO: 939948 - RNA, 22 nt, Mycobacterium avium subsp. paratuberculosis
gcgcggccgcccgucggggccc

SEQ ID NO: 939949 - RNA, 23 nt, Mycobacterium avium subsp. paratuberculosis
gcgcggccgauucggcgccgcga

SEQ ID NO: 939950 - RNA, 14 nt, Mycobacterium avium subsp. paratuberculosis
gcgcggcccguuga

SEQ ID NO: 939951 - RNA, 21 nt, Mycobacterium avium subsp. paratuberculosis
gcgcggcccguugagcaccgc

SEQ ID NO: 939952 - RNA, 23 nt, Mycobacterium avium subsp. paratuberculosis
gcgcggcccguugagcaccgcga

SEQ ID NO: 939953 - RNA, 16 nt, Mycobacterium avium subsp. paratuberculosis
gcgcggccagcggcgc

SEQ ID NO: 939954 - RNA, 15 nt, Mycobacterium avium subsp. paratuberculosis
gcgcggccagcgcga

SEQ ID NO: 939955 - RNA, 12 nt, Mycobacterium avium subsp. paratuberculosis
gcgcggccagca

SEQ ID NO: 939956 - RNA, 11 nt, Mycobacterium avium subsp. paratuberculosis
gcgcggccagc

SEQ ID NO: 939957 - RNA, 18 nt, Mycobacterium avium subsp. paratuberculosis
gcgcggccaccuccagcc

SEQ ID NO: 939958 - RNA, 21 nt, Mycobacterium avium subsp. paratuberculosis
gcgcggccaccuccagcccgg

SEQ ID NO: 939959 - RNA, 22 nt, Mycobacterium avium subsp. paratuberculosis
gcgcggccaccuccagcccgga

SEQ ID NO: 939960 - RNA, 12 nt, Mycobacterium avium subsp. paratuberculosis
gcgcggccaccg

SEQ ID NO: 939961 - RNA, 15 nt, Mycobacterium avium subsp. paratuberculosis
gcgcggccaccgcgc

SEQ ID NO: 939962 - RNA, 13 nt, Mycobacterium avium subsp. paratuberculosis
gcgcgccgagcag

SEQ ID NO: 939963 - RNA, 21 nt, Mycobacterium avium subsp. paratuberculosis
gcgcgccgagguggcccgcca

SEQ ID NO: 939964 - RNA, 23 nt, Mycobacterium avium subsp. paratuberculosis
gcgcgccgagguggcccgccacg

SEQ ID NO: 939965 - RNA, 17 nt, Mycobacterium avium subsp. paratuberculosis
gcgcgccgauguggccg

SEQ ID NO: 939966 - RNA, 22 nt, Mycobacterium avium subsp. paratuberculosis
gcgcgccgauguggccggcgau

SEQ ID NO: 939967 - RNA, 14 nt, Mycobacterium avium subsp. paratuberculosis
gcgcgccgcacagc

SEQ ID NO: 939968 - RNA, 15 nt, Mycobacterium avium subsp. paratuberculosis
gcgcgccgcacagcc

SEQ ID NO: 939969 - RNA, 15 nt, Mycobacterium avium subsp. paratuberculosis
gcgcgccgaccacgg

SEQ ID NO: 939970 - RNA, 19 nt, Mycobacterium avium subsp. paratuberculosis
gcgcgccgaccacggcccc

SEQ ID NO: 939971 - RNA, 13 nt, Mycobacterium avium subsp. paratuberculosis
gcgcgccgaccgc

SEQ ID NO: 939972 - RNA, 14 nt, Mycobacterium avium subsp. paratuberculosis
gcgcgccgaccgcg

SEQ ID NO: 939973 - RNA, 16 nt, Mycobacterium avium subsp. paratuberculosis
gcgcgccgaccgcgag

SEQ ID NO: 939974 - RNA, 23 nt, Mycobacterium avium subsp. paratuberculosis
gcgcgccgagagcgcgucgacgc

SEQ ID NO: 939975 - RNA, 19 nt, Mycobacterium avium subsp. paratuberculosis
gcgcgcccugaggcccggu

SEQ ID NO: 939976 - RNA, 12 nt, Mycobacterium avium subsp. paratuberculosis
gcgcgcccugcu

SEQ ID NO: 939977 - RNA, 19 nt, Mycobacterium avium subsp. paratuberculosis
gcgcgccgaacaccugcgg

SEQ ID NO: 939978 - RNA, 18 nt, Mycobacterium avium subsp. paratuberculosis
gcgcgccgaagauggcca

SEQ ID NO: 939979 - RNA, 22 nt, Mycobacterium avium subsp. paratuberculosis
gcgcgccgaagauggccagcgc

SEQ ID NO: 939980 - RNA, 16 nt, Mycobacterium avium subsp. paratuberculosis
gcgcgcccgucgucgg

SEQ ID NO: 939981 - RNA, 15 nt, Mycobacterium avium subsp. paratuberculosis
gcgcgcccgcggcca

SEQ ID NO: 939982 - RNA, 16 nt, Mycobacterium avium subsp. paratuberculosis
gcgcgcccggcaccgc

SEQ ID NO: 939983 - RNA, 20 nt, Mycobacterium avium subsp. paratuberculosis
gcgcgcccggcaccgcggcg

SEQ ID NO: 939984 - RNA, 21 nt, Mycobacterium avium subsp. paratuberculosis
gcgcgcccggcaccgcggcgg

SEQ ID NO: 939985 - RNA, 13 nt, Mycobacterium avium subsp. paratuberculosis
gcgcgcccgcggc

SEQ ID NO: 939986 - RNA, 12 nt, Mycobacterium avium subsp. paratuberculosis
gcgcgcccgacg

SEQ ID NO: 939987 - RNA, 22 nt, Mycobacterium avium subsp. paratuberculosis
gcgcgcccgacgaugcggggcg

SEQ ID NO: 939988 - RNA, 23 nt, Mycobacterium avium subsp. paratuberculosis
gcgcgcccgacgaugcggggcgg

SEQ ID NO: 939989 - RNA, 16 nt, Mycobacterium avium subsp. paratuberculosis
gcgcgcccgacggucg

SEQ ID NO: 939990 - RNA, 23 nt, Mycobacterium avium subsp. paratuberculosis
gcgcgcccgagcauuucgcgcac

SEQ ID NO: 939991 - RNA, 18 nt, Mycobacterium avium subsp. paratuberculosis
gcgcgccccgggauccga

SEQ ID NO: 939992 - RNA, 21 nt, Mycobacterium avium subsp. paratuberculosis
gcgcgccccgggauccgaggc

SEQ ID NO: 939993 - RNA, 17 nt, Mycobacterium avium subsp. paratuberculosis
gcgcgccccggucccgc

SEQ ID NO: 939994 - RNA, 14 nt, Mycobacterium avium subsp. paratuberculosis
gcgcgccggccgga

SEQ ID NO: 939995 - RNA, 13 nt, Mycobacterium avium subsp. paratuberculosis
gcgcgccggcccg

SEQ ID NO: 939996 - RNA, 12 nt, Mycobacterium avium subsp. paratuberculosis
gcgcgccggccg

SEQ ID NO: 939997 - RNA, 12 nt, Mycobacterium avium subsp. paratuberculosis
gcgcgccggccc

SEQ ID NO: 939998 - RNA, 14 nt, Mycobacterium avium subsp. paratuberculosis
gcgcgccggagauc

SEQ ID NO: 939999 - RNA, 13 nt, Mycobacterium avium subsp. paratuberculosis
gcgcgccggccag

SEQ ID NO: 940000 - RNA, 14 nt, Mycobacterium avium subsp. paratuberculosis
gcgcgccggccagc

SEQ ID NO: 940001 - RNA, 23 nt, Mycobacterium avium subsp. paratuberculosis
gcgcgccggccagcacggcggcg

SEQ ID NO: 940002 - RNA, 20 nt, Mycobacterium avium subsp. paratuberculosis
gcgcgccgccgccgcccacg

SEQ ID NO: 940003 - RNA, 24 nt, Mycobacterium avium subsp. paratuberculosis
gcgcgccgccgccgcccacgccgc

SEQ ID NO: 940004 - RNA, 12 nt, Mycobacterium avium subsp. paratuberculosis
gcgcgccgcgau

SEQ ID NO: 940005 - RNA, 23 nt, Mycobacterium avium subsp. paratuberculosis
gcgcgccgcguucggcggcgcgc

SEQ ID NO: 940006 - RNA, 19 nt, Mycobacterium avium subsp. paratuberculosis
gcgcgccgcugacugcgau

SEQ ID NO: 940007 - RNA, 14 nt, Mycobacterium avium subsp. paratuberculosis
gcgcgccgcccagc

SEQ ID NO: 940008 - RNA, 20 nt, Mycobacterium avium subsp. paratuberculosis
gcgcgccgcccagcggcccc

SEQ ID NO: 940009 - RNA, 16 nt, Mycobacterium avium subsp. paratuberculosis
gcgcgccgcccccgcg

SEQ ID NO: 940010 - RNA, 23 nt, Mycobacterium avium subsp. paratuberculosis
gcgcgccgcccucgccgaaccgg

SEQ ID NO: 940011 - RNA, 23 nt, Mycobacterium avium subsp. paratuberculosis
gcgcgccgccgaugugaucggcg

SEQ ID NO: 940012 - RNA, 15 nt, Mycobacterium avium subsp. paratuberculosis
gcgcgccgcaccucg

SEQ ID NO: 940013 - RNA, 15 nt, Mycobacterium avium subsp. paratuberculosis
gcgcgccgcagcgcg

SEQ ID NO: 940014 - RNA, 16 nt, Mycobacterium avium subsp. paratuberculosis
gcgcgccgcagcgcgc

SEQ ID NO: 940015 - RNA, 21 nt, Mycobacterium avium subsp. paratuberculosis
gcgcgccgcaggagaucggcg

SEQ ID NO: 940016 - RNA, 18 nt, Mycobacterium avium subsp. paratuberculosis
gcgcgccgaucgcccagu

SEQ ID NO: 940017 - RNA, 19 nt, Mycobacterium avium subsp. paratuberculosis
gcgcgccgaugccgcgcug

SEQ ID NO: 940018 - RNA, 15 nt, Mycobacterium avium subsp. paratuberculosis
gcgcgccccggcccg

SEQ ID NO: 940019 - RNA, 16 nt, Mycobacterium avium subsp. paratuberculosis
gcgcgccccggcccgg

SEQ ID NO: 940020 - RNA, 18 nt, Mycobacterium avium subsp. paratuberculosis
gcgcgccccggcccggcg

SEQ ID NO: 940021 - RNA, 19 nt, Mycobacterium avium subsp. paratuberculosis
gcgcgccccggcccggcga

SEQ ID NO: 940022 - RNA, 16 nt, Mycobacterium avium subsp. paratuberculosis
gcgcgccccggcccgu

SEQ ID NO: 940023 - RNA, 17 nt, Mycobacterium avium subsp. paratuberculosis
gcgcgccccggcccguc

SEQ ID NO: 940024 - RNA, 17 nt, Mycobacterium avium subsp. paratuberculosis
gcgcgccaggucgaaga

SEQ ID NO: 940025 - RNA, 15 nt, Mycobacterium avium subsp. paratuberculosis
gcgcgcccaggcccg

SEQ ID NO: 940026 - RNA, 14 nt, Mycobacterium avium subsp. paratuberculosis
gcgcgcccaggcug

SEQ ID NO: 940027 - RNA, 15 nt, Mycobacterium avium subsp. paratuberculosis
gcgcgcccaggcuga

SEQ ID NO: 940028 - RNA, 12 nt, Mycobacterium avium subsp. paratuberculosis
gcgcgcccaggc

SEQ ID NO: 940029 - RNA, 12 nt, Mycobacterium avium subsp. paratuberculosis
gcgcgcccaccc

SEQ ID NO: 940030 - RNA, 14 nt, Mycobacterium avium subsp. paratuberculosis
gcgcgcccacccgc

SEQ ID NO: 940031 - RNA, 16 nt, Mycobacterium avium subsp. paratuberculosis
gcgcgcccacccgcgc

SEQ ID NO: 940032 - RNA, 22 nt, Mycobacterium avium subsp. paratuberculosis
gcgcgcccacccgcgccggcag

SEQ ID NO: 940033 - RNA, 20 nt, Mycobacterium avium subsp. paratuberculosis
gcgcgccagcgucugcugcg

SEQ ID NO: 940034 - RNA, 14 nt, Mycobacterium avium subsp. paratuberculosis
gcgcgccagcgcgu

SEQ ID NO: 940035 - RNA, 17 nt, Mycobacterium avium subsp. paratuberculosis
gcgcgccagcgcgugcg

SEQ ID NO: 940036 - RNA, 13 nt, Mycobacterium avium subsp. paratuberculosis
gcgcgccagcagc

SEQ ID NO: 940037 - RNA, 16 nt, Mycobacterium avium subsp. paratuberculosis
gcgcgccagcagcgcg

SEQ ID NO: 940038 - RNA, 17 nt, Mycobacterium avium subsp. paratuberculosis
gcgcgccagcagcgcgc

SEQ ID NO: 940039 - RNA, 18 nt, Mycobacterium avium subsp. paratuberculosis
gcgcgccagcagcgcgcc

SEQ ID NO: 940040 - RNA, 16 nt, Mycobacterium avium subsp. paratuberculosis
gcgcgccaccaggcgg

SEQ ID NO: 940041 - RNA, 17 nt, Mycobacterium avium subsp. paratuberculosis
gcgcgcaccacgugcgc

SEQ ID NO: 940042 - RNA, 15 nt, Mycobacterium avium subsp. paratuberculosis
gcgcgcaccgcgggc

SEQ ID NO: 940043 - RNA, 14 nt, Mycobacterium avium subsp. paratuberculosis
gcgcgacggccucg

SEQ ID NO: 940044 - RNA, 19 nt, Mycobacterium avium subsp. paratuberculosis
gcgcgacugggcgcccacc

SEQ ID NO: 940045 - RNA, 22 nt, Mycobacterium avium subsp. paratuberculosis
gcgcgacugggcgcccacccgu

SEQ ID NO: 940046 - RNA, 18 nt, Mycobacterium avium subsp. paratuberculosis
gcgcgacgucgaccgcga

SEQ ID NO: 940047 - RNA, 18 nt, Mycobacterium avium subsp. paratuberculosis
gcgcgacgugccggcgau

SEQ ID NO: 940048 - RNA, 19 nt, Mycobacterium avium subsp. paratuberculosis
gcgcgacgugccggcgaug

SEQ ID NO: 940049 - RNA, 20 nt, Mycobacterium avium subsp. paratuberculosis
gcgcgacgugccggcgaugg

SEQ ID NO: 940050 - RNA, 16 nt, Mycobacterium avium subsp. paratuberculosis
gcgcgacggcgcguga

SEQ ID NO: 940051 - RNA, 14 nt, Mycobacterium avium subsp. paratuberculosis
gcgcgacggcgcug

SEQ ID NO: 940052 - RNA, 14 nt, Mycobacterium avium subsp. paratuberculosis
gcgcgacgggcacc

SEQ ID NO: 940053 - RNA, 17 nt, Mycobacterium avium subsp. paratuberculosis
gcgcgacgggcacccgc

SEQ ID NO: 940054 - RNA, 13 nt, Mycobacterium avium subsp. paratuberculosis
gcgcgacgggcug

SEQ ID NO: 940055 - RNA, 20 nt, Mycobacterium avium subsp. paratuberculosis
gcgcgacgguguaggacgcc

SEQ ID NO: 940056 - RNA, 12 nt, Mycobacterium avium subsp. paratuberculosis
gcgcgacgcgca

SEQ ID NO: 940057 - RNA, 16 nt, Mycobacterium avium subsp. paratuberculosis
gcgcgacgcgcaugcc

SEQ ID NO: 940058 - RNA, 14 nt, Mycobacterium avium subsp. paratuberculosis
gcgcgacgccgacg

SEQ ID NO: 940059 - RNA, 21 nt, Mycobacterium avium subsp. paratuberculosis
gcgcgacgccguagaucacgc

SEQ ID NO: 940060 - RNA, 14 nt, Mycobacterium avium subsp. paratuberculosis
gcgcgacgccguca

SEQ ID NO: 940061 - RNA, 14 nt, Mycobacterium avium subsp. paratuberculosis
gcgcgacgcugaug

SEQ ID NO: 940062 - RNA, 18 nt, Mycobacterium avium subsp. paratuberculosis
gcgcgaccucgguggugc

SEQ ID NO: 940063 - RNA, 15 nt, Mycobacterium avium subsp. paratuberculosis
gcgcgaccugcuugg

SEQ ID NO: 940064 - RNA, 18 nt, Mycobacterium avium subsp. paratuberculosis
gcgcgaccugcuuggcgg

SEQ ID NO: 940065 - RNA, 21 nt, Mycobacterium avium subsp. paratuberculosis
gcgcgaccugcuuggcggccu

SEQ ID NO: 940066 - RNA, 19 nt, Mycobacterium avium subsp. paratuberculosis
gcgcgacgaacagcaccgc

SEQ ID NO: 940067 - RNA, 20 nt, Mycobacterium avium subsp. paratuberculosis
gcgcgacgaacagcaccgcc

SEQ ID NO: 940068 - RNA, 22 nt, Mycobacterium avium subsp. paratuberculosis
gcgcgacgaacagcaccgccac

SEQ ID NO: 940069 - RNA, 19 nt, Mycobacterium avium subsp. paratuberculosis
gcgcgacgaauccggugac

SEQ ID NO: 940070 - RNA, 13 nt, Mycobacterium avium subsp. paratuberculosis
gcgcgacaagcag

SEQ ID NO: 940071 - RNA, 14 nt, Mycobacterium avium subsp. paratuberculosis
gcgcgacaccgcgg

SEQ ID NO: 940072 - RNA, 18 nt, Mycobacterium avium subsp. paratuberculosis
gcgcgaauuccucagcgc

SEQ ID NO: 940073 - RNA, 14 nt, Mycobacterium avium subsp. paratuberculosis
gcgcgaaucccggc

SEQ ID NO: 940074 - RNA, 15 nt, Mycobacterium avium subsp. paratuberculosis
gcgcgaaucccggcc

SEQ ID NO: 940075 - RNA, 14 nt, Mycobacterium avium subsp. paratuberculosis
gcgcgaauccgguc

SEQ ID NO: 940076 - RNA, 14 nt, Mycobacterium avium subsp. paratuberculosis
gcgcgaagguggcg

SEQ ID NO: 940077 - RNA, 21 nt, Mycobacterium avium subsp. paratuberculosis
gcgcgaagucccacugcccgu

SEQ ID NO: 940078 - RNA, 15 nt, Mycobacterium avium subsp. paratuberculosis
gcgcgaagucgagca

SEQ ID NO: 940079 - RNA, 22 nt, Mycobacterium avium subsp. paratuberculosis
gcgccgucuccucgaccagcgc

SEQ ID NO: 940080 - RNA, 14 nt, Mycobacterium avium subsp. paratuberculosis
gcgccgugacgccg

SEQ ID NO: 940081 - RNA, 14 nt, Mycobacterium avium subsp. paratuberculosis
gcgccgucucgacc

SEQ ID NO: 940082 - RNA, 19 nt, Mycobacterium avium subsp. paratuberculosis
gcgccgucucgacccgggc

SEQ ID NO: 940083 - RNA, 16 nt, Mycobacterium avium subsp. paratuberculosis
gcgccgucuuccgggc

SEQ ID NO: 940084 - RNA, 17 nt, Mycobacterium avium subsp. paratuberculosis
gcgccgucuuccgggcc

SEQ ID NO: 940085 - RNA, 18 nt, Mycobacterium avium subsp. paratuberculosis
gcgccgucuuccgggcca

SEQ ID NO: 940086 - RNA, 20 nt, Mycobacterium avium subsp. paratuberculosis
gcgccgugaacugugcggug

SEQ ID NO: 940087 - RNA, 21 nt, Mycobacterium avium subsp. paratuberculosis
gcgccgugaacugugcggugc

SEQ ID NO: 940088 - RNA, 20 nt, Mycobacterium avium subsp. paratuberculosis
gcgccgugaagggcccgccg

SEQ ID NO: 940089 - RNA, 21 nt, Mycobacterium avium subsp. paratuberculosis
gcgccgugaagggcccgccgg

SEQ ID NO: 940090 - RNA, 22 nt, Mycobacterium avium subsp. paratuberculosis
gcgcgcaucugcucggcgucca

SEQ ID NO: 940091 - RNA, 19 nt, Mycobacterium avium subsp. paratuberculosis
gcgcgcaccaucgcgaugg

SEQ ID NO: 940092 - RNA, 14 nt, Mycobacterium avium subsp. paratuberculosis
gcgcgcaccagcuc

SEQ ID NO: 940093 - RNA, 15 nt, Mycobacterium avium subsp. paratuberculosis
gcgcgcaccagcucg

SEQ ID NO: 940094 - RNA, 16 nt, Mycobacterium avium subsp. paratuberculosis
gcgcgcaccagcucgg

SEQ ID NO: 940095 - RNA, 23 nt, Mycobacterium avium subsp. paratuberculosis
gcgcgcaccagcucggcgcuguc

SEQ ID NO: 940096 - RNA, 14 nt, Mycobacterium avium subsp. paratuberculosis
gcgcgcacagcgcc

SEQ ID NO: 940097 - RNA, 17 nt, Mycobacterium avium subsp. paratuberculosis
gcgcgcacagcgccaca

SEQ ID NO: 940098 - RNA, 18 nt, Mycobacterium avium subsp. paratuberculosis
gcgcgcaacgacgaaguc

SEQ ID NO: 940099 - RNA, 15 nt, Mycobacterium avium subsp. paratuberculosis
gcgcgcaacgaggcg

SEQ ID NO: 940100 - RNA, 19 nt, Mycobacterium avium subsp. paratuberculosis
gcgcgcaacgaggcggugg

SEQ ID NO: 940101 - RNA, 21 nt, Mycobacterium avium subsp. paratuberculosis
gcgcgcaacgaggcgguggug

SEQ ID NO: 940102 - RNA, 21 nt, Mycobacterium avium subsp. paratuberculosis
gcgcgcaacucguccaccagc

SEQ ID NO: 940103 - RNA, 13 nt, Mycobacterium avium subsp. paratuberculosis
gcgcgcaacagcg

SEQ ID NO: 940104 - RNA, 15 nt, Mycobacterium avium subsp. paratuberculosis
gcgcgaucgccggau

SEQ ID NO: 940105 - RNA, 22 nt, Mycobacterium avium subsp. paratuberculosis
gcgcgaucgccggugcggccgc

SEQ ID NO: 940106 - RNA, 13 nt, Mycobacterium avium subsp. paratuberculosis
gcgcgaucggcag

SEQ ID NO: 940107 - RNA, 20 nt, Mycobacterium avium subsp. paratuberculosis
gcgcgaucggcaggucgucg

SEQ ID NO: 940108 - RNA, 21 nt, Mycobacterium avium subsp. paratuberculosis
gcgcgaucggcaggucgucga

SEQ ID NO: 940109 - RNA, 14 nt, Mycobacterium avium subsp. paratuberculosis
gcgcgaucggcgag

SEQ ID NO: 940110 - RNA, 16 nt, Mycobacterium avium subsp. paratuberculosis
gcgcgaucggcgagcc

SEQ ID NO: 940111 - RNA, 15 nt, Mycobacterium avium subsp. paratuberculosis
gcgcgauccgcgcgu

SEQ ID NO: 940112 - RNA, 19 nt, Mycobacterium avium subsp. paratuberculosis
gcgcgauccgcgcgucggg

SEQ ID NO: 940113 - RNA, 13 nt, Mycobacterium avium subsp. paratuberculosis
gcgcgauccgggg

SEQ ID NO: 940114 - RNA, 13 nt, Mycobacterium avium subsp. paratuberculosis
gcgcgauccgcgc

SEQ ID NO: 940115 - RNA, 20 nt, Mycobacterium avium subsp. paratuberculosis
gcgcgauccacuccgagguc

SEQ ID NO: 940116 - RNA, 20 nt, Mycobacterium avium subsp. paratuberculosis
gcgcgagacaccucgucgau

SEQ ID NO: 940117 - RNA, 20 nt, Mycobacterium avium subsp. paratuberculosis
gcgcgagcagacgcaaaagc

SEQ ID NO: 940118 - RNA, 14 nt, Mycobacterium avium subsp. paratuberculosis
gcgcgaucagcgcc

SEQ ID NO: 940119 - RNA, 14 nt, Mycobacterium avium subsp. paratuberculosis
gcgcgaucaggccg

SEQ ID NO: 940120 - RNA, 16 nt, Mycobacterium avium subsp. paratuberculosis
gcgcgaucaggccggc

SEQ ID NO: 940121 - RNA, 22 nt, Mycobacterium avium subsp. paratuberculosis
gcgcgaucaggccggccaccag

SEQ ID NO: 940122 - RNA, 17 nt, Mycobacterium avium subsp. paratuberculosis
gcgcgagcgucacgcug

SEQ ID NO: 940123 - RNA, 19 nt, Mycobacterium avium subsp. paratuberculosis
gcgcgaggacgauggacga

SEQ ID NO: 940124 - RNA, 22 nt, Mycobacterium avium subsp. paratuberculosis
gcgcgaucaacgggucgagcac

SEQ ID NO: 940125 - RNA, 14 nt, Mycobacterium avium subsp. paratuberculosis
gcgcgagcgcgcug

SEQ ID NO: 940126 - RNA, 13 nt, Mycobacterium avium subsp. paratuberculosis
gcgcgagcgcagc

SEQ ID NO: 940127 - RNA, 19 nt, Mycobacterium avium subsp. paratuberculosis
gcgcgagcgcagcgccagg

SEQ ID NO: 940128 - RNA, 16 nt, Mycobacterium avium subsp. paratuberculosis
gcgcgagcaucaccgu

SEQ ID NO: 940129 - RNA, 23 nt, Mycobacterium avium subsp. paratuberculosis
gcgcgagcaucaccgucaucucg

SEQ ID NO: 940130 - RNA, 13 nt, Mycobacterium avium subsp. paratuberculosis
gcgcgagccgaaa

SEQ ID NO: 940131 - RNA, 19 nt, Mycobacterium avium subsp. paratuberculosis
gcgcgagaguaucgccacg

SEQ ID NO: 940132 - RNA, 20 nt, Mycobacterium avium subsp. paratuberculosis
gcgcggcgaucucggcggcc

SEQ ID NO: 940133 - RNA, 13 nt, Mycobacterium avium subsp. paratuberculosis
gcgcggcgaugcg

SEQ ID NO: 940134 - RNA, 13 nt, Mycobacterium avium subsp. paratuberculosis
gcgcggcgaucag

SEQ ID NO: 940135 - RNA, 21 nt, Mycobacterium avium subsp. paratuberculosis
gcgcggcgaucagcugcucgu

SEQ ID NO: 940136 - RNA, 15 nt, Mycobacterium avium subsp. paratuberculosis
gcgcggcgcagcgcg

SEQ ID NO: 940137 - RNA, 15 nt, Mycobacterium avium subsp. paratuberculosis
gcgcggcgcaccgag

SEQ ID NO: 940138 - RNA, 18 nt, Mycobacterium avium subsp. paratuberculosis
gcgcggcgcaccgcccgc

SEQ ID NO: 940139 - RNA, 11 nt, Mycobacterium avium subsp. paratuberculosis
gcgcggcgccc

SEQ ID NO: 940140 - RNA, 15 nt, Mycobacterium avium subsp. paratuberculosis
gcgcggcgccagcgg

SEQ ID NO: 940141 - RNA, 17 nt, Mycobacterium avium subsp. paratuberculosis
gcgcggcgccagcggcc

SEQ ID NO: 940142 - RNA, 14 nt, Mycobacterium avium subsp. paratuberculosis
gcgcggcgcccagg

SEQ ID NO: 940143 - RNA, 16 nt, Mycobacterium avium subsp. paratuberculosis
gcgcggcgcaguucga

SEQ ID NO: 940144 - RNA, 15 nt, Mycobacterium avium subsp. paratuberculosis
gcgcggcgcggagcc

SEQ ID NO: 940145 - RNA, 13 nt, Mycobacterium avium subsp. paratuberculosis
gcgcggcgcgcga

SEQ ID NO: 940146 - RNA, 12 nt, Mycobacterium avium subsp. paratuberculosis
gcgcggcgcgcg

SEQ ID NO: 940147 - RNA, 17 nt, Mycobacterium avium subsp. paratuberculosis
gcgcggcgcccccgcga

SEQ ID NO: 940148 - RNA, 14 nt, Mycobacterium avium subsp. paratuberculosis
gcgcggcgccggau

SEQ ID NO: 940149 - RNA, 16 nt, Mycobacterium avium subsp. paratuberculosis
gcgcggcgacgaucac

SEQ ID NO: 940150 - RNA, 15 nt, Mycobacterium avium subsp. paratuberculosis
gcgcggcgacggugg

SEQ ID NO: 940151 - RNA, 14 nt, Mycobacterium avium subsp. paratuberculosis
gcgcggcgacguga

SEQ ID NO: 940152 - RNA, 20 nt, Mycobacterium avium subsp. paratuberculosis
gcgcggcgaccaccucggcg

SEQ ID NO: 940153 - RNA, 14 nt, Mycobacterium avium subsp. paratuberculosis
gcgcggccugcagc

SEQ ID NO: 940154 - RNA, 15 nt, Mycobacterium avium subsp. paratuberculosis
gcgcggccugcagca

SEQ ID NO: 940155 - RNA, 17 nt, Mycobacterium avium subsp. paratuberculosis
gcgcggccugcagcacc

SEQ ID NO: 940156 - RNA, 15 nt, Mycobacterium avium subsp. paratuberculosis
gcgcggccuccagcc

SEQ ID NO: 940157 - RNA, 14 nt, Mycobacterium avium subsp. paratuberculosis
gcgcggccgggcgc

SEQ ID NO: 940158 - RNA, 14 nt, Mycobacterium avium subsp. paratuberculosis
gcgcggccggugcg

SEQ ID NO: 940159 - RNA, 21 nt, Mycobacterium avium subsp. paratuberculosis
gcgcggccggugcgcgucagc

SEQ ID NO: 940160 - RNA, 15 nt, Mycobacterium avium subsp. paratuberculosis
gcgcggccggccacg

SEQ ID NO: 940161 - RNA, 22 nt, Mycobacterium avium subsp. paratuberculosis
gcgcggccggccgacaccccga

SEQ ID NO: 940162 - RNA, 21 nt, Mycobacterium avium subsp. paratuberculosis
gcgcggccgcgacugcaggug

SEQ ID NO: 940163 - RNA, 12 nt, Mycobacterium avium subsp. paratuberculosis
gcgcggccgcgu

SEQ ID NO: 940164 - RNA, 16 nt, Mycobacterium avium subsp. paratuberculosis
gcgcggccgcgucggc

SEQ ID NO: 940165 - RNA, 19 nt, Mycobacterium avium subsp. paratuberculosis
gcgcggccggaucgaaucc

SEQ ID NO: 940166 - RNA, 17 nt, Mycobacterium avium subsp. paratuberculosis
gcgcggcguucuccagc

SEQ ID NO: 940167 - RNA, 22 nt, Mycobacterium avium subsp. paratuberculosis
gcgcggcuaauucagcugcgga

SEQ ID NO: 940168 - RNA, 22 nt, Mycobacterium avium subsp. paratuberculosis
gcgcggcuacagcaacauccug

SEQ ID NO: 940169 - RNA, 15 nt, Mycobacterium avium subsp. paratuberculosis
gcgcggcggcggcgc

SEQ ID NO: 940170 - RNA, 17 nt, Mycobacterium avium subsp. paratuberculosis
gcgcggcgugguagccg

SEQ ID NO: 940171 - RNA, 21 nt, Mycobacterium avium subsp. paratuberculosis
gcgcggcgugguagccgccgu

SEQ ID NO: 940172 - RNA, 13 nt, Mycobacterium avium subsp. paratuberculosis
gcgcggcgggcca

SEQ ID NO: 940173 - RNA, 14 nt, Mycobacterium avium subsp. paratuberculosis
gcgcggcgucggcc

SEQ ID NO: 940174 - RNA, 15 nt, Mycobacterium avium subsp. paratuberculosis
gcgcggcgucggccg

SEQ ID NO: 940175 - RNA, 22 nt, Mycobacterium avium subsp. paratuberculosis
gcgcggcgguccagcgagcccu

SEQ ID NO: 940176 - RNA, 18 nt, Mycobacterium avium subsp. paratuberculosis
gcgcggcggucgcgcgcc

SEQ ID NO: 940177 - RNA, 16 nt, Mycobacterium avium subsp. paratuberculosis
gcgcggcggugagccg

SEQ ID NO: 940178 - RNA, 19 nt, Mycobacterium avium subsp. paratuberculosis
gcgcggcggcguccgcggc

SEQ ID NO: 940179 - RNA, 13 nt, Mycobacterium avium subsp. paratuberculosis
gcgcggcgguggu

SEQ ID NO: 940180 - RNA, 19 nt, Mycobacterium avium subsp. paratuberculosis
gcgcggcguagccgccggu

SEQ ID NO: 940181 - RNA, 21 nt, Mycobacterium avium subsp. paratuberculosis
gcgcggcgucaggggugccag

SEQ ID NO: 940182 - RNA, 17 nt, Mycobacterium avium subsp. paratuberculosis
gcgcggcguccaccagc

SEQ ID NO: 940183 - RNA, 18 nt, Mycobacterium avium subsp. paratuberculosis
gcgcggcguccaccagca

SEQ ID NO: 940184 - RNA, 15 nt, Mycobacterium avium subsp. paratuberculosis
gcgcggcguccucga

SEQ ID NO: 940185 - RNA, 16 nt, Mycobacterium avium subsp. paratuberculosis
gcgcggcguccucgau

SEQ ID NO: 940186 - RNA, 19 nt, Mycobacterium avium subsp. paratuberculosis
gcgcggcguccucgaugac

SEQ ID NO: 940187 - RNA, 13 nt, Mycobacterium avium subsp. paratuberculosis
gcgcggcggcguc

SEQ ID NO: 940188 - RNA, 16 nt, Mycobacterium avium subsp. paratuberculosis
gcgcggcggcgccguc

SEQ ID NO: 940189 - RNA, 21 nt, Mycobacterium avium subsp. paratuberculosis
gcgcggcggcgccgucgccga

SEQ ID NO: 940190 - RNA, 12 nt, Mycobacterium avium subsp. paratuberculosis
gcgcggcggcgg

SEQ ID NO: 940191 - RNA, 14 nt, Mycobacterium avium subsp. paratuberculosis
gcgcggcggccggc

SEQ ID NO: 940192 - RNA, 20 nt, Mycobacterium avium subsp. paratuberculosis
gcgcggcggccggccagcgc

SEQ ID NO: 940193 - RNA, 17 nt, Mycobacterium avium subsp. paratuberculosis
gcgcggcggcgccgcgg

SEQ ID NO: 940194 - RNA, 18 nt, Mycobacterium avium subsp. paratuberculosis
gcgcggcggcgacgucga

SEQ ID NO: 940195 - RNA, 13 nt, Mycobacterium avium subsp. paratuberculosis
gcgcggcggcgcc

SEQ ID NO: 940196 - RNA, 12 nt, Mycobacterium avium subsp. paratuberculosis
gcgcggcggcaa

SEQ ID NO: 940197 - RNA, 12 nt, Mycobacterium avium subsp. paratuberculosis
gcgcggcggcca

SEQ ID NO: 940198 - RNA, 13 nt, Mycobacterium avium subsp. paratuberculosis
gcgcggcggccaa

SEQ ID NO: 940199 - RNA, 21 nt, Mycobacterium avium subsp. paratuberculosis
gcgcggcggccaacgcgacga

SEQ ID NO: 940200 - RNA, 13 nt, Mycobacterium avium subsp. paratuberculosis
gcgcggcggccac

SEQ ID NO: 940201 - RNA, 14 nt, Mycobacterium avium subsp. paratuberculosis
gcgcggcggccacc

SEQ ID NO: 940202 - RNA, 16 nt, Mycobacterium avium subsp. paratuberculosis
gcgcggcggccaccgc

SEQ ID NO: 940203 - RNA, 15 nt, Mycobacterium avium subsp. paratuberculosis
gcgcggcggccaccu

SEQ ID NO: 940204 - RNA, 18 nt, Mycobacterium avium subsp. paratuberculosis
gcgcgggcgccgucgggg

SEQ ID NO: 940205 - RNA, 21 nt, Mycobacterium avium subsp. paratuberculosis
gcgcgggcggcaggucggcgg

SEQ ID NO: 940206 - RNA, 16 nt, Mycobacterium avium subsp. paratuberculosis
gcgcgggcgcggccag

SEQ ID NO: 940207 - RNA, 12 nt, Mycobacterium avium subsp. paratuberculosis
gcgcgggccgca

SEQ ID NO: 940208 - RNA, 18 nt, Mycobacterium avium subsp. paratuberculosis
gcgcgggccgcagcgcgc

SEQ ID NO: 940209 - RNA, 22 nt, Mycobacterium avium subsp. paratuberculosis
gcgcgggccgccgacgucgugg

SEQ ID NO: 940210 - RNA, 13 nt, Mycobacterium avium subsp. paratuberculosis
gcgcgggccgcgu

SEQ ID NO: 940211 - RNA, 16 nt, Mycobacterium avium subsp. paratuberculosis
gcgcgggcaccgucgu

SEQ ID NO: 940212 - RNA, 23 nt, Mycobacterium avium subsp. paratuberculosis
gcgcgggccagcagcagcagguc

SEQ ID NO: 940213 - RNA, 17 nt, Mycobacterium avium subsp. paratuberculosis
gcgcgggccagcaguuc

SEQ ID NO: 940214 - RNA, 13 nt, Mycobacterium avium subsp. paratuberculosis
gcgcgggccagcg

SEQ ID NO: 940215 - RNA, 18 nt, Mycobacterium avium subsp. paratuberculosis
gcgcgggccagcgccuuc

SEQ ID NO: 940216 - RNA, 14 nt, Mycobacterium avium subsp. paratuberculosis
gcgcgggcagccca

SEQ ID NO: 940217 - RNA, 17 nt, Mycobacterium avium subsp. paratuberculosis
gcgcgggaucggugccg

SEQ ID NO: 940218 - RNA, 18 nt, Mycobacterium avium subsp. paratuberculosis
gcgcgggaucggugccga

SEQ ID NO: 940219 - RNA, 23 nt, Mycobacterium avium subsp. paratuberculosis
gcgcgggaucggugccgacggug

SEQ ID NO: 940220 - RNA, 18 nt, Mycobacterium avium subsp. paratuberculosis
gcgcgggcaaucgcugcg

SEQ ID NO: 940221 - RNA, 20 nt, Mycobacterium avium subsp. paratuberculosis
gcgcggcuggccgucgucga

SEQ ID NO: 940222 - RNA, 12 nt, Mycobacterium avium subsp. paratuberculosis
gcgcgggaacga

SEQ ID NO: 940223 - RNA, 18 nt, Mycobacterium avium subsp. paratuberculosis
gcgcgggaagccgccgcc

SEQ ID NO: 940224 - RNA, 14 nt, Mycobacterium avium subsp. paratuberculosis
gcgcggcugcucga

SEQ ID NO: 940225 - RNA, 13 nt, Mycobacterium avium subsp. paratuberculosis
gcgcggucagcgc

SEQ ID NO: 940226 - RNA, 15 nt, Mycobacterium avium subsp. paratuberculosis
gcgcggucaucguca

SEQ ID NO: 940227 - RNA, 14 nt, Mycobacterium avium subsp. paratuberculosis
gcgcggucgccacc

SEQ ID NO: 940228 - RNA, 16 nt, Mycobacterium avium subsp. paratuberculosis
gcgcgguccacggugg

SEQ ID NO: 940229 - RNA, 18 nt, Mycobacterium avium subsp. paratuberculosis
gcgcgguccacgguggcg

SEQ ID NO: 940230 - RNA, 12 nt, Mycobacterium avium subsp. paratuberculosis
gcgcggucggug

SEQ ID NO: 940231 - RNA, 20 nt, Mycobacterium avium subsp. paratuberculosis
gcgcggucgguggcggugcc

SEQ ID NO: 940232 - RNA, 23 nt, Mycobacterium avium subsp. paratuberculosis
gcgcggucgucgcccgucucggc

SEQ ID NO: 940233 - RNA, 15 nt, Mycobacterium avium subsp. paratuberculosis
gcgcggucucgaucu

SEQ ID NO: 940234 - RNA, 20 nt, Mycobacterium avium subsp. paratuberculosis
gcgcggucucgaucugcacc

SEQ ID NO: 940235 - RNA, 21 nt, Mycobacterium avium subsp. paratuberculosis
gcgcggucucgaucugcacca

SEQ ID NO: 940236 - RNA, 18 nt, Mycobacterium avium subsp. paratuberculosis
gcgcggucaacaccggga

SEQ ID NO: 940237 - RNA, 21 nt, Mycobacterium avium subsp. paratuberculosis
gcgcgguaacagagcgggauc

SEQ ID NO: 940238 - RNA, 19 nt, Mycobacterium avium subsp. paratuberculosis
gcgcggguucacccuggcg

SEQ ID NO: 940239 - RNA, 20 nt, Mycobacterium avium subsp. paratuberculosis
gcgcgggucgagcagcagcc

SEQ ID NO: 940240 - RNA, 13 nt, Mycobacterium avium subsp. paratuberculosis
gcgcgggucgccg

SEQ ID NO: 940241 - RNA, 14 nt, Mycobacterium avium subsp. paratuberculosis
gcgcgggucgccgg

SEQ ID NO: 940242 - RNA, 14 nt, Mycobacterium avium subsp. paratuberculosis
gcgcgggucgcggu

SEQ ID NO: 940243 - RNA, 19 nt, Mycobacterium avium subsp. paratuberculosis
gcgcgggucgcgguucgca

SEQ ID NO: 940244 - RNA, 17 nt, Mycobacterium avium subsp. paratuberculosis
gcgcgggucgcuggccg

SEQ ID NO: 940245 - RNA, 20 nt, Mycobacterium avium subsp. paratuberculosis
gcgcgggucgcuggccgcga

SEQ ID NO: 940246 - RNA, 14 nt, Mycobacterium avium subsp. paratuberculosis
gcgcgggucggcgc

SEQ ID NO: 940247 - RNA, 18 nt, Mycobacterium avium subsp. paratuberculosis
gcgcgggucggcgccggc

SEQ ID NO: 940248 - RNA, 15 nt, Mycobacterium avium subsp. paratuberculosis
gcgcgggucgucggc

SEQ ID NO: 940249 - RNA, 16 nt, Mycobacterium avium subsp. paratuberculosis
gcgcgggucgucggcc

SEQ ID NO: 940250 - RNA, 16 nt, Mycobacterium avium subsp. paratuberculosis
gcgcgggguggcgccg

SEQ ID NO: 940251 - RNA, 18 nt, Mycobacterium avium subsp. paratuberculosis
gcgcgggguggcgccggc

SEQ ID NO: 940252 - RNA, 19 nt, Mycobacterium avium subsp. paratuberculosis
gcgcgggguggcgccggcc

SEQ ID NO: 940253 - RNA, 22 nt, Mycobacterium avium subsp. paratuberculosis
gcgcgggguggcgccggccagc

SEQ ID NO: 940254 - RNA, 23 nt, Mycobacterium avium subsp. paratuberculosis
gcgcggggugucgcggcugcgca

SEQ ID NO: 940255 - RNA, 13 nt, Mycobacterium avium subsp. paratuberculosis
gcgcgggcggcgu

SEQ ID NO: 940256 - RNA, 13 nt, Mycobacterium avium subsp. paratuberculosis
gcgcggggccggc

SEQ ID NO: 940257 - RNA, 15 nt, Mycobacterium avium subsp. paratuberculosis
gcgcggggccggcgc

SEQ ID NO: 940258 - RNA, 19 nt, Mycobacterium avium subsp. paratuberculosis
gcgcggggccggcgcggug

SEQ ID NO: 940259 - RNA, 20 nt, Mycobacterium avium subsp. paratuberculosis
gcgcggggccggcgcggugc

SEQ ID NO: 940260 - RNA, 16 nt, Mycobacterium avium subsp. paratuberculosis
gcgcggggcggccgcc

SEQ ID NO: 940261 - RNA, 20 nt, Mycobacterium avium subsp. paratuberculosis
gcgcggggcggccgccgggc

SEQ ID NO: 940262 - RNA, 18 nt, Mycobacterium avium subsp. paratuberculosis
gcgcgggggccgccgcga

SEQ ID NO: 940263 - RNA, 14 nt, Mycobacterium avium subsp. paratuberculosis
gcgcggggccacca

SEQ ID NO: 940264 - RNA, 19 nt, Mycobacterium avium subsp. paratuberculosis
gcgcggggccaccaggcgc

SEQ ID NO: 940265 - RNA, 21 nt, Mycobacterium avium subsp. paratuberculosis
gcgcggggccaccaggcgccg

SEQ ID NO: 940266 - RNA, 13 nt, Mycobacterium avium subsp. paratuberculosis
gcgcgggcgucca

SEQ ID NO: 940267 - RNA, 22 nt, Mycobacterium avium subsp. paratuberculosis
gcgcgggcguccacgaaaccca

SEQ ID NO: 940268 - RNA, 23 nt, Mycobacterium avium subsp. paratuberculosis
gcgcgggcguccucgucggcgaa

SEQ ID NO: 940269 - RNA, 19 nt, Mycobacterium avium subsp. paratuberculosis
gcgcguauuccagcgccag

SEQ ID NO: 940270 - RNA, 20 nt, Mycobacterium avium subsp. paratuberculosis
gcgcguauuccagcgccagc

SEQ ID NO: 940271 - RNA, 19 nt, Mycobacterium avium subsp. paratuberculosis
gcgcguagucggcgucggc

SEQ ID NO: 940272 - RNA, 22 nt, Mycobacterium avium subsp. paratuberculosis
gcgcguagucggcgucggccac

SEQ ID NO: 940273 - RNA, 18 nt, Mycobacterium avium subsp. paratuberculosis
gcgcguagugcucgcgca

SEQ ID NO: 940274 - RNA, 19 nt, Mycobacterium avium subsp. paratuberculosis
gcgcgucacgcuggcguga

SEQ ID NO: 940275 - RNA, 14 nt, Mycobacterium avium subsp. paratuberculosis
gcgcgucagccguc

SEQ ID NO: 940276 - RNA, 18 nt, Mycobacterium avium subsp. paratuberculosis
gcgcguccaaccgcggac

SEQ ID NO: 940277 - RNA, 23 nt, Mycobacterium avium subsp. paratuberculosis
gcgcguaaaggaugucgccgcag

SEQ ID NO: 940278 - RNA, 15 nt, Mycobacterium avium subsp. paratuberculosis
gcgcgguuucggcgu

SEQ ID NO: 940279 - RNA, 13 nt, Mycobacterium avium subsp. paratuberculosis
gcgcguacagguc

SEQ ID NO: 940280 - RNA, 14 nt, Mycobacterium avium subsp. paratuberculosis
gcgcguacaggucg

SEQ ID NO: 940281 - RNA, 18 nt, Mycobacterium avium subsp. paratuberculosis
gcgcguacaggucgcaca

SEQ ID NO: 940282 - RNA, 20 nt, Mycobacterium avium subsp. paratuberculosis
gcgcguagagcaucaggucg

SEQ ID NO: 940283 - RNA, 16 nt, Mycobacterium avium subsp. paratuberculosis
gcgcguagcgcagcuc

SEQ ID NO: 940284 - RNA, 16 nt, Mycobacterium avium subsp. paratuberculosis
gcgcgguugucguuga

SEQ ID NO: 940285 - RNA, 22 nt, Mycobacterium avium subsp. paratuberculosis
gcgcgguggcgugcagcgcggc

SEQ ID NO: 940286 - RNA, 16 nt, Mycobacterium avium subsp. paratuberculosis
gcgcggugggcggcgg

SEQ ID NO: 940287 - RNA, 15 nt, Mycobacterium avium subsp. paratuberculosis
gcgcgguugcccgca

SEQ ID NO: 940288 - RNA, 15 nt, Mycobacterium avium subsp. paratuberculosis
gcgcggugucgacgu

SEQ ID NO: 940289 - RNA, 23 nt, Mycobacterium avium subsp. paratuberculosis
gcgcggugucgacgucgguggug

SEQ ID NO: 940290 - RNA, 15 nt, Mycobacterium avium subsp. paratuberculosis
gcgcgguggucagca

SEQ ID NO: 940291 - RNA, 18 nt, Mycobacterium avium subsp. paratuberculosis
gcgcgguggucagcaccg

SEQ ID NO: 940292 - RNA, 19 nt, Mycobacterium avium subsp. paratuberculosis
gcgcgguggucagcggcgc

SEQ ID NO: 940293 - RNA, 20 nt, Mycobacterium avium subsp. paratuberculosis
gcgcgguggucagcggcgcc

SEQ ID NO: 940294 - RNA, 22 nt, Mycobacterium avium subsp. paratuberculosis
gcgcgguggucagcggcgccac

SEQ ID NO: 940295 - RNA, 22 nt, Mycobacterium avium subsp. paratuberculosis
gcgcggugguguugcggugguc

SEQ ID NO: 940296 - RNA, 12 nt, Mycobacterium avium subsp. paratuberculosis
gcgcgguggcgc

SEQ ID NO: 940297 - RNA, 14 nt, Mycobacterium avium subsp. paratuberculosis
gcgcgguggccagc

SEQ ID NO: 940298 - RNA, 17 nt, Mycobacterium avium subsp. paratuberculosis
gcgcggugcgccagcgc

SEQ ID NO: 940299 - RNA, 15 nt, Mycobacterium avium subsp. paratuberculosis
gcgcggugcgccgac

SEQ ID NO: 940300 - RNA, 21 nt, Mycobacterium avium subsp. paratuberculosis
gcgcggugaagucggugccca

SEQ ID NO: 940301 - RNA, 15 nt, Mycobacterium avium subsp. paratuberculosis
gcgcggugagcagca

SEQ ID NO: 940302 - RNA, 17 nt, Mycobacterium avium subsp. paratuberculosis
gcgcggugagcagcaug

SEQ ID NO: 940303 - RNA, 16 nt, Mycobacterium avium subsp. paratuberculosis
gcgcggugaugaccuc

SEQ ID NO: 940304 - RNA, 21 nt, Mycobacterium avium subsp. paratuberculosis
gcgcggugauguugucgaaca

SEQ ID NO: 940305 - RNA, 19 nt, Mycobacterium avium subsp. paratuberculosis
gcgcggugcaccaggacgc

SEQ ID NO: 940306 - RNA, 12 nt, Mycobacterium avium subsp. paratuberculosis
gcgcggugccga

SEQ ID NO: 940307 - RNA, 18 nt, Mycobacterium avium subsp. paratuberculosis
gcgcggugccgaccuggg

SEQ ID NO: 940308 - RNA, 21 nt, Mycobacterium avium subsp. paratuberculosis
gcgcggugccgaccugggcgg

SEQ ID NO: 940309 - RNA, 14 nt, Mycobacterium avium subsp. paratuberculosis
gcgcgucgaucgcg

SEQ ID NO: 940310 - RNA, 18 nt, Mycobacterium avium subsp. paratuberculosis
gcgcgucgacaccccgcu

SEQ ID NO: 940311 - RNA, 20 nt, Mycobacterium avium subsp. paratuberculosis
gcgcgucgacguucgccgcc

SEQ ID NO: 940312 - RNA, 14 nt, Mycobacterium avium subsp. paratuberculosis
gcgcgucgagcagc

SEQ ID NO: 940313 - RNA, 23 nt, Mycobacterium avium subsp. paratuberculosis
gcgcgucgagcagcaccacccgc

SEQ ID NO: 940314 - RNA, 17 nt, Mycobacterium avium subsp. paratuberculosis
gcgcguccauggucgag

SEQ ID NO: 940315 - RNA, 15 nt, Mycobacterium avium subsp. paratuberculosis
gcgcguccaggugcg

SEQ ID NO: 940316 - RNA, 16 nt, Mycobacterium avium subsp. paratuberculosis
gcgcguccaggugcgc

SEQ ID NO: 940317 - RNA, 17 nt, Mycobacterium avium subsp. paratuberculosis
gcgcguccaggugcgcc

SEQ ID NO: 940318 - RNA, 18 nt, Mycobacterium avium subsp. paratuberculosis
gcgcguccaggugcgccg

SEQ ID NO: 940319 - RNA, 15 nt, Mycobacterium avium subsp. paratuberculosis
gcgcgucgcgcagcg

SEQ ID NO: 940320 - RNA, 12 nt, Mycobacterium avium subsp. paratuberculosis
gcgcgucgcgcc

SEQ ID NO: 940321 - RNA, 15 nt, Mycobacterium avium subsp. paratuberculosis
gcgcgucgcgcccgg

SEQ ID NO: 940322 - RNA, 19 nt, Mycobacterium avium subsp. paratuberculosis
gcgcgucgcgguggagcac

SEQ ID NO: 940323 - RNA, 19 nt, Mycobacterium avium subsp. paratuberculosis
gcgcgucgcugccguagcg

SEQ ID NO: 940324 - RNA, 13 nt, Mycobacterium avium subsp. paratuberculosis
gcgcgucgcuggg

SEQ ID NO: 940325 - RNA, 20 nt, Mycobacterium avium subsp. paratuberculosis
gcgcgucgcugggcagccgu

SEQ ID NO: 940326 - RNA, 14 nt, Mycobacterium avium subsp. paratuberculosis
gcgcgucggagauc

SEQ ID NO: 940327 - RNA, 19 nt, Mycobacterium avium subsp. paratuberculosis
gcgcgucggagaucaccgg

SEQ ID NO: 940328 - RNA, 14 nt, Mycobacterium avium subsp. paratuberculosis
gcgcgucgcggcgc

SEQ ID NO: 940329 - RNA, 17 nt, Mycobacterium avium subsp. paratuberculosis
gcgcgucgcggcgcgga

SEQ ID NO: 940330 - RNA, 14 nt, Mycobacterium avium subsp. paratuberculosis
gcgcgucgcgggcc

SEQ ID NO: 940331 - RNA, 15 nt, Mycobacterium avium subsp. paratuberculosis
gcgcgucucccccga

SEQ ID NO: 940332 - RNA, 18 nt, Mycobacterium avium subsp. paratuberculosis
gcgcgucguugcccugaa

SEQ ID NO: 940333 - RNA, 12 nt, Mycobacterium avium subsp. paratuberculosis
gcgcgugacccc

SEQ ID NO: 940334 - RNA, 14 nt, Mycobacterium avium subsp. paratuberculosis
gcgcgugaccccgg

SEQ ID NO: 940335 - RNA, 16 nt, Mycobacterium avium subsp. paratuberculosis
gcgcgugaccccggcg

SEQ ID NO: 940336 - RNA, 20 nt, Mycobacterium avium subsp. paratuberculosis
gcgcgugaccccggcgacca

SEQ ID NO: 940337 - RNA, 18 nt, Mycobacterium avium subsp. paratuberculosis
gcgcgugcagccgggcgg

SEQ ID NO: 940338 - RNA, 21 nt, Mycobacterium avium subsp. paratuberculosis
gcgcgugcagccgggcggcgc

SEQ ID NO: 940339 - RNA, 14 nt, Mycobacterium avium subsp. paratuberculosis
gcgcgugacgcgcg

SEQ ID NO: 940340 - RNA, 13 nt, Mycobacterium avium subsp. paratuberculosis
gcgcgugacggcg

SEQ ID NO: 940341 - RNA, 18 nt, Mycobacterium avium subsp. paratuberculosis
gcgcgugacggcggggcg

SEQ ID NO: 940342 - RNA, 20 nt, Mycobacterium avium subsp. paratuberculosis
gcgcgugacggcggggcgga

SEQ ID NO: 940343 - RNA, 14 nt, Mycobacterium avium subsp. paratuberculosis
gcgcgugaucggug

SEQ ID NO: 940344 - RNA, 16 nt, Mycobacterium avium subsp. paratuberculosis
gcgcgugaucggugcc

SEQ ID NO: 940345 - RNA, 18 nt, Mycobacterium avium subsp. paratuberculosis
gcgcgugaucggugcccg

SEQ ID NO: 940346 - RNA, 21 nt, Mycobacterium avium subsp. paratuberculosis
gcgcgugaucggugcccgcgg

SEQ ID NO: 940347 - RNA, 22 nt, Mycobacterium avium subsp. paratuberculosis
gcgcgugaugggugggcagcuc

SEQ ID NO: 940348 - RNA, 16 nt, Mycobacterium avium subsp. paratuberculosis
gcgcgugcacaccggc

SEQ ID NO: 940349 - RNA, 13 nt, Mycobacterium avium subsp. paratuberculosis
gcgcgugcacgaa

SEQ ID NO: 940350 - RNA, 20 nt, Mycobacterium avium subsp. paratuberculosis
gcgcgucguagucgcucggc

SEQ ID NO: 940351 - RNA, 22 nt, Mycobacterium avium subsp. paratuberculosis
gcgcgucguagucgcucggcgg

SEQ ID NO: 940352 - RNA, 21 nt, Mycobacterium avium subsp. paratuberculosis
gcgcgucguccgacaccaccu

SEQ ID NO: 940353 - RNA, 23 nt, Mycobacterium avium subsp. paratuberculosis
gcgcgucguccgacaccaccugc

SEQ ID NO: 940354 - RNA, 16 nt, Mycobacterium avium subsp. paratuberculosis
gcgcgucgucgauggc

SEQ ID NO: 940355 - RNA, 13 nt, Mycobacterium avium subsp. paratuberculosis
gcgcgucgucgcc

SEQ ID NO: 940356 - RNA, 16 nt, Mycobacterium avium subsp. paratuberculosis
gcgcgucgucgccgaa

SEQ ID NO: 940357 - RNA, 12 nt, Mycobacterium avium subsp. paratuberculosis
gcgcgucggcga

SEQ ID NO: 940358 - RNA, 18 nt, Mycobacterium avium subsp. paratuberculosis
gcgcgucggcgaccgcgc

SEQ ID NO: 940359 - RNA, 20 nt, Mycobacterium avium subsp. paratuberculosis
gcgcgucggcgaccgcgcgc

SEQ ID NO: 940360 - RNA, 18 nt, Mycobacterium avium subsp. paratuberculosis
gcgcgucgggcucgcggu

SEQ ID NO: 940361 - RNA, 18 nt, Mycobacterium avium subsp. paratuberculosis
gcgcgucgguaaucggcg

SEQ ID NO: 940362 - RNA, 21 nt, Mycobacterium avium subsp. paratuberculosis
gcgcgucgguaaucggcggug

SEQ ID NO: 940363 - RNA, 14 nt, Mycobacterium avium subsp. paratuberculosis
gcgcgucggcgucu

SEQ ID NO: 940364 - RNA, 12 nt, Mycobacterium avium subsp. paratuberculosis
gcgcgucgguga

SEQ ID NO: 940365 - RNA, 19 nt, Mycobacterium avium subsp. paratuberculosis
gcgcgugcuggggguggcg

SEQ ID NO: 940366 - RNA, 14 nt, Mycobacterium avium subsp. paratuberculosis
gcgcgugcgccgcg

SEQ ID NO: 940367 - RNA, 15 nt, Mycobacterium avium subsp. paratuberculosis
gcgcgugcgccgcgg

SEQ ID NO: 940368 - RNA, 16 nt, Mycobacterium avium subsp. paratuberculosis
gcgcgugcgccgcggc

SEQ ID NO: 940369 - RNA, 20 nt, Mycobacterium avium subsp. paratuberculosis
gcgcgugcgccgcggcggcu

SEQ ID NO: 940370 - RNA, 15 nt, Mycobacterium avium subsp. paratuberculosis
gcgcgugcgcgacga

SEQ ID NO: 940371 - RNA, 18 nt, Mycobacterium avium subsp. paratuberculosis
gcgcguggucccacacca

SEQ ID NO: 940372 - RNA, 19 nt, Mycobacterium avium subsp. paratuberculosis
gcgcguggggcgucgccgc

SEQ ID NO: 940373 - RNA, 21 nt, Mycobacterium avium subsp. paratuberculosis
gcgcguggggcgucgccgccc

SEQ ID NO: 940374 - RNA, 22 nt, Mycobacterium avium subsp. paratuberculosis
gcgcgugcuguugcaggugcgc

SEQ ID NO: 940375 - RNA, 20 nt, Mycobacterium avium subsp. paratuberculosis
gcgcgugcccgcggucaugc

SEQ ID NO: 940376 - RNA, 13 nt, Mycobacterium avium subsp. paratuberculosis
gcgcgugggccaa

SEQ ID NO: 940377 - RNA, 15 nt, Mycobacterium avium subsp. paratuberculosis
gcgcgugggccaacg

SEQ ID NO: 940378 - RNA, 19 nt, Mycobacterium avium subsp. paratuberculosis
gcgcgugggccaacgcgau

SEQ ID NO: 940379 - RNA, 21 nt, Mycobacterium avium subsp. paratuberculosis
gcgcguugcgcggaccggcga

SEQ ID NO: 940380 - RNA, 19 nt, Mycobacterium avium subsp. paratuberculosis
gcgcguugaugccgugcgc

SEQ ID NO: 940381 - RNA, 15 nt, Mycobacterium avium subsp. paratuberculosis
gcgcguuggucauca

SEQ ID NO: 940382 - RNA, 18 nt, Mycobacterium avium subsp. paratuberculosis
gcgcguuggucaucaccc

SEQ ID NO: 940383 - RNA, 15 nt, Mycobacterium avium subsp. paratuberculosis
gcgcguuguccagca

SEQ ID NO: 940384 - RNA, 16 nt, Mycobacterium avium subsp. paratuberculosis
gcgcguuguccagcag

SEQ ID NO: 940385 - RNA, 18 nt, Mycobacterium avium subsp. paratuberculosis
gcgcguuguccagcagcg

SEQ ID NO: 940386 - RNA, 22 nt, Mycobacterium avium subsp. paratuberculosis
gcgcguuguccagcagcgccgg

SEQ ID NO: 940387 - RNA, 23 nt, Mycobacterium avium subsp. paratuberculosis
gcgcguuguccagcagcgccggc

SEQ ID NO: 940388 - RNA, 23 nt, Mycobacterium avium subsp. paratuberculosis
gcgcguuggccagguugcgccgu

SEQ ID NO: 940389 - RNA, 16 nt, Mycobacterium avium subsp. paratuberculosis
gcgcguucuccaccgc

SEQ ID NO: 940390 - RNA, 20 nt, Mycobacterium avium subsp. paratuberculosis
gcgcguucuccaccgcgcgc

SEQ ID NO: 940391 - RNA, 13 nt, Mycobacterium avium subsp. paratuberculosis
gcgcguucggcgc

SEQ ID NO: 940392 - RNA, 14 nt, Mycobacterium avium subsp. paratuberculosis
gcgcguucggcgcc

SEQ ID NO: 940393 - RNA, 15 nt, Mycobacterium avium subsp. paratuberculosis
gcgcguucggcgcca

SEQ ID NO: 940394 - RNA, 17 nt, Mycobacterium avium subsp. paratuberculosis
gcgcguucggcgccacc

SEQ ID NO: 940395 - RNA, 21 nt, Mycobacterium avium subsp. paratuberculosis
gcgcguucgaguucgucgacc

SEQ ID NO: 940396 - RNA, 23 nt, Mycobacterium avium subsp. paratuberculosis
gcgcguucgaguucgucgaccag

SEQ ID NO: 940397 - RNA, 11 nt, Mycobacterium avium subsp. paratuberculosis
gcgcguucggg

SEQ ID NO: 940398 - RNA, 18 nt, Mycobacterium avium subsp. paratuberculosis
gcgcguuccaucagcgcc

SEQ ID NO: 940399 - RNA, 19 nt, Mycobacterium avium subsp. paratuberculosis
gcgcguuccaucagcgccc

SEQ ID NO: 940400 - RNA, 22 nt, Mycobacterium avium subsp. paratuberculosis
gcgcguuccaucagcgcccgcg

SEQ ID NO: 940401 - RNA, 23 nt, Mycobacterium avium subsp. paratuberculosis
gcgcguuccaucagcgcccgcgc

SEQ ID NO: 940402 - RNA, 19 nt, Mycobacterium avium subsp. paratuberculosis
gcgcguuccagcacgccca

SEQ ID NO: 940403 - RNA, 23 nt, Mycobacterium avium subsp. paratuberculosis
gcgcguguccagaacucggcggc

SEQ ID NO: 940404 - RNA, 22 nt, Mycobacterium avium subsp. paratuberculosis
gcgcguucagggugcaggcccg

SEQ ID NO: 940405 - RNA, 21 nt, Mycobacterium avium subsp. paratuberculosis
gcgcguucaagccgccgaucu

SEQ ID NO: 940406 - RNA, 20 nt, Mycobacterium avium subsp. paratuberculosis
gcgcuccagccacuccacca

SEQ ID NO: 940407 - RNA, 12 nt, Mycobacterium avium subsp. paratuberculosis
gcgcuccagcag

SEQ ID NO: 940408 - RNA, 13 nt, Mycobacterium avium subsp. paratuberculosis
gcgcuccagcagg

SEQ ID NO: 940409 - RNA, 14 nt, Mycobacterium avium subsp. paratuberculosis
gcgcuccagcaggc

SEQ ID NO: 940410 - RNA, 16 nt, Mycobacterium avium subsp. paratuberculosis
gcgcuccagcaggcug

SEQ ID NO: 940411 - RNA, 19 nt, Mycobacterium avium subsp. paratuberculosis
gcgcuccagcaggcuggcg

SEQ ID NO: 940412 - RNA, 17 nt, Mycobacterium avium subsp. paratuberculosis
gcgcuccagcgggcggc

SEQ ID NO: 940413 - RNA, 14 nt, Mycobacterium avium subsp. paratuberculosis
gcgcucccggcgcc

SEQ ID NO: 940414 - RNA, 15 nt, Mycobacterium avium subsp. paratuberculosis
gcgcucccggcgccg

SEQ ID NO: 940415 - RNA, 16 nt, Mycobacterium avium subsp. paratuberculosis
gcgcucccggcgccgc

SEQ ID NO: 940416 - RNA, 19 nt, Mycobacterium avium subsp. paratuberculosis
gcgcucccggcgccgccgu

SEQ ID NO: 940417 - RNA, 14 nt, Mycobacterium avium subsp. paratuberculosis
gcgcuccucgacgu

SEQ ID NO: 940418 - RNA, 13 nt, Mycobacterium avium subsp. paratuberculosis
gcgcucccgaugg

SEQ ID NO: 940419 - RNA, 18 nt, Mycobacterium avium subsp. paratuberculosis
gcgcuccugcagcgcggc

SEQ ID NO: 940420 - RNA, 19 nt, Mycobacterium avium subsp. paratuberculosis
gcgcuccugcagcgcggcg

SEQ ID NO: 940421 - RNA, 23 nt, Mycobacterium avium subsp. paratuberculosis
gcgcuccugcagcgcggcgauca

SEQ ID NO: 940422 - RNA, 18 nt, Mycobacterium avium subsp. paratuberculosis
gcgcuccuggccggacgg

SEQ ID NO: 940423 - RNA, 21 nt, Mycobacterium avium subsp. paratuberculosis
gcgcucaucaggcggccggcc

SEQ ID NO: 940424 - RNA, 23 nt, Mycobacterium avium subsp. paratuberculosis
gcgcucaucaggcggccggcccg

SEQ ID NO: 940425 - RNA, 20 nt, Mycobacterium avium subsp. paratuberculosis
gcgcucagugcacgcucggc

SEQ ID NO: 940426 - RNA, 22 nt, Mycobacterium avium subsp. paratuberculosis
gcgcucagugcacgcucggcgc

SEQ ID NO: 940427 - RNA, 17 nt, Mycobacterium avium subsp. paratuberculosis
gcgcucagcgcggccac

SEQ ID NO: 940428 - RNA, 22 nt, Mycobacterium avium subsp. paratuberculosis
gcgcucagcgcggccacaccga

SEQ ID NO: 940429 - RNA, 18 nt, Mycobacterium avium subsp. paratuberculosis
gcgcucagcgcggcgggc

SEQ ID NO: 940430 - RNA, 18 nt, Mycobacterium avium subsp. paratuberculosis
gcgcucagcggcagcguc

SEQ ID NO: 940431 - RNA, 15 nt, Mycobacterium avium subsp. paratuberculosis
gcgcucaaccgccca

SEQ ID NO: 940432 - RNA, 16 nt, Mycobacterium avium subsp. paratuberculosis
gcgcucaaccgcccag

SEQ ID NO: 940433 - RNA, 20 nt, Mycobacterium avium subsp. paratuberculosis
gcgcucaaccgcccagcggc

SEQ ID NO: 940434 - RNA, 22 nt, Mycobacterium avium subsp. paratuberculosis
gcgcucaacgugauacgccgac

SEQ ID NO: 940435 - RNA, 18 nt, Mycobacterium avium subsp. paratuberculosis
gcgcucagccccagcgga

SEQ ID NO: 940436 - RNA, 17 nt, Mycobacterium avium subsp. paratuberculosis
gcgcucaccgucgcggu

SEQ ID NO: 940437 - RNA, 13 nt, Mycobacterium avium subsp. paratuberculosis
gcgcucaccgcau

SEQ ID NO: 940438 - RNA, 15 nt, Mycobacterium avium subsp. paratuberculosis
gcgcucaccgcgaug

SEQ ID NO: 940439 - RNA, 16 nt, Mycobacterium avium subsp. paratuberculosis
gcgcucaccgcggggu

SEQ ID NO: 940440 - RNA, 23 nt, Mycobacterium avium subsp. paratuberculosis
gcgcucaccgcggggugcccggc

SEQ ID NO: 940441 - RNA, 13 nt, Mycobacterium avium subsp. paratuberculosis
gcgcucaccggcg

SEQ ID NO: 940442 - RNA, 14 nt, Mycobacterium avium subsp. paratuberculosis
gcgcucaccggcgu

SEQ ID NO: 940443 - RNA, 16 nt, Mycobacterium avium subsp. paratuberculosis
gcgcuagcugcgccgg

SEQ ID NO: 940444 - RNA, 17 nt, Mycobacterium avium subsp. paratuberculosis
gcgcuagcugcgccggc

SEQ ID NO: 940445 - RNA, 16 nt, Mycobacterium avium subsp. paratuberculosis
gcgcuaggacgcgggc

SEQ ID NO: 940446 - RNA, 16 nt, Mycobacterium avium subsp. paratuberculosis
gcgcuacgccggcucg

SEQ ID NO: 940447 - RNA, 18 nt, Mycobacterium avium subsp. paratuberculosis
gcgcuacgccggcucggu

SEQ ID NO: 940448 - RNA, 19 nt, Mycobacterium avium subsp. paratuberculosis
gcgcuacgccggcucgguc

SEQ ID NO: 940449 - RNA, 20 nt, Mycobacterium avium subsp. paratuberculosis
gcgcguuuugaaauccgggc

SEQ ID NO: 940450 - RNA, 22 nt, Mycobacterium avium subsp. paratuberculosis
gcgcguuuugaaauccgggcgc

SEQ ID NO: 940451 - RNA, 23 nt, Mycobacterium avium subsp. paratuberculosis
gcgcguuuugaaauccgggcgcg

SEQ ID NO: 940452 - RNA, 13 nt, Mycobacterium avium subsp. paratuberculosis
gcgcuaccgcgcu

SEQ ID NO: 940453 - RNA, 18 nt, Mycobacterium avium subsp. paratuberculosis
gcgcuaccgcgcucaccg

SEQ ID NO: 940454 - RNA, 19 nt, Mycobacterium avium subsp. paratuberculosis
gcgcuaccgcgcucaccgu

SEQ ID NO: 940455 - RNA, 14 nt, Mycobacterium avium subsp. paratuberculosis
gcgcuaccaggcgu

SEQ ID NO: 940456 - RNA, 21 nt, Mycobacterium avium subsp. paratuberculosis
gcgcuaaggccgcugcccggc

SEQ ID NO: 940457 - RNA, 17 nt, Mycobacterium avium subsp. paratuberculosis
guacacggcggcgaagu

SEQ ID NO: 940458 - RNA, 21 nt, Mycobacterium avium subsp. paratuberculosis
guacacguagaaggcgccguc

SEQ ID NO: 940459 - RNA, 21 nt, Mycobacterium avium subsp. paratuberculosis
guacacguagcgguccagcgu

SEQ ID NO: 940460 - RNA, 17 nt, Mycobacterium avium subsp. paratuberculosis
guacagcagccccugca

SEQ ID NO: 940461 - RNA, 18 nt, Mycobacterium avium subsp. paratuberculosis
guaacgccacggcggccg

SEQ ID NO: 940462 - RNA, 20 nt, Mycobacterium avium subsp. paratuberculosis
guaacgguaggcgcggucgg

SEQ ID NO: 940463 - RNA, 15 nt, Mycobacterium avium subsp. paratuberculosis
guaacccuccggcgc

SEQ ID NO: 940464 - RNA, 15 nt, Mycobacterium avium subsp. paratuberculosis
guaaccgcccgagca

SEQ ID NO: 940465 - RNA, 15 nt, Mycobacterium avium subsp. paratuberculosis
guaaccgccguuggc

SEQ ID NO: 940466 - RNA, 15 nt, Mycobacterium avium subsp. paratuberculosis
guaaccggcggcggu

SEQ ID NO: 940467 - RNA, 17 nt, Mycobacterium avium subsp. paratuberculosis
guaaccguacggcccga

SEQ ID NO: 940468 - RNA, 22 nt, Mycobacterium avium subsp. paratuberculosis
guaacacgaucucggucgccag

SEQ ID NO: 940469 - RNA, 15 nt, Mycobacterium avium subsp. paratuberculosis
guaacacccugcgcc

SEQ ID NO: 940470 - RNA, 21 nt, Mycobacterium avium subsp. paratuberculosis
gguuugcgccggcuccaccgc

SEQ ID NO: 940471 - RNA, 22 nt, Mycobacterium avium subsp. paratuberculosis
gguuugcgccggcuccaccgcg

SEQ ID NO: 940472 - RNA, 23 nt, Mycobacterium avium subsp. paratuberculosis
gguuugcccggcgaugucgggca

SEQ ID NO: 940473 - RNA, 20 nt, Mycobacterium avium subsp. paratuberculosis
gguuuccacgugcacggcgc

SEQ ID NO: 940474 - RNA, 22 nt, Mycobacterium avium subsp. paratuberculosis
gguuuccaggacgaugcgcgcc

SEQ ID NO: 940475 - RNA, 17 nt, Mycobacterium avium subsp. paratuberculosis
gguuucgugugcucagc

SEQ ID NO: 940476 - RNA, 18 nt, Mycobacterium avium subsp. paratuberculosis
gguuucgaccugcgggug

SEQ ID NO: 940477 - RNA, 18 nt, Mycobacterium avium subsp. paratuberculosis
gguuucggggucgccguc

SEQ ID NO: 940478 - RNA, 16 nt, Mycobacterium avium subsp. paratuberculosis
gguuucggucgcggug

SEQ ID NO: 940479 - RNA, 20 nt, Mycobacterium avium subsp. paratuberculosis
guaccagcugcccaccagca

SEQ ID NO: 940480 - RNA, 24 nt, Mycobacterium avium subsp. paratuberculosis
guaccagcgcucgacgaggcgggc

SEQ ID NO: 940481 - RNA, 18 nt, Mycobacterium avium subsp. paratuberculosis
guaccagcggccgucgcg

SEQ ID NO: 940482 - RNA, 16 nt, Mycobacterium avium subsp. paratuberculosis
guaccgcaacaccgaa

SEQ ID NO: 940483 - RNA, 17 nt, Mycobacterium avium subsp. paratuberculosis
guaccagggcagcgccu

SEQ ID NO: 940484 - RNA, 15 nt, Mycobacterium avium subsp. paratuberculosis
guaccggcgccaggc

SEQ ID NO: 940485 - RNA, 19 nt, Mycobacterium avium subsp. paratuberculosis
guaccggcgccaggccggc

SEQ ID NO: 940486 - RNA, 21 nt, Mycobacterium avium subsp. paratuberculosis
guaccggcgccaggccggcga

SEQ ID NO: 940487 - RNA, 22 nt, Mycobacterium avium subsp. paratuberculosis
guaccggcgccaggccggcgac

SEQ ID NO: 940488 - RNA, 23 nt, Mycobacterium avium subsp. paratuberculosis
guaccgcggcggcgucgaccgcc

SEQ ID NO: 940489 - RNA, 15 nt, Mycobacterium avium subsp. paratuberculosis
guaccgcuuggccca

SEQ ID NO: 940490 - RNA, 16 nt, Mycobacterium avium subsp. paratuberculosis
guacagcuaggccagc

SEQ ID NO: 940491 - RNA, 18 nt, Mycobacterium avium subsp. paratuberculosis
guacagcuaggccagcag

SEQ ID NO: 940492 - RNA, 19 nt, Mycobacterium avium subsp. paratuberculosis
guacagcuaggccagcagc

SEQ ID NO: 940493 - RNA, 20 nt, Mycobacterium avium subsp. paratuberculosis
guacagcuaggccagcagcg

SEQ ID NO: 940494 - RNA, 22 nt, Mycobacterium avium subsp. paratuberculosis
guacagcgggucguuggcggcg

SEQ ID NO: 940495 - RNA, 21 nt, Mycobacterium avium subsp. paratuberculosis
guacagcgucugcuggauggu

SEQ ID NO: 940496 - RNA, 20 nt, Mycobacterium avium subsp. paratuberculosis
guacagcugguccggccggc

SEQ ID NO: 940497 - RNA, 22 nt, Mycobacterium avium subsp. paratuberculosis
guacagcugguccggccggccg

SEQ ID NO: 940498 - RNA, 19 nt, Mycobacterium avium subsp. paratuberculosis
guacagcgacuccagcgcg

SEQ ID NO: 940499 - RNA, 20 nt, Mycobacterium avium subsp. paratuberculosis
guacagcgacuccagcgcga

SEQ ID NO: 940500 - RNA, 21 nt, Mycobacterium avium subsp. paratuberculosis
guacagcgacuccagcgcgau

SEQ ID NO: 940501 - RNA, 13 nt, Mycobacterium avium subsp. paratuberculosis
guacagccagccc

SEQ ID NO: 940502 - RNA, 14 nt, Mycobacterium avium subsp. paratuberculosis
guacagccagcccg

SEQ ID NO: 940503 - RNA, 20 nt, Mycobacterium avium subsp. paratuberculosis
guaccaccaccagucggcgc

SEQ ID NO: 940504 - RNA, 21 nt, Mycobacterium avium subsp. paratuberculosis
guaccaccaccagucggcgcg

SEQ ID NO: 940505 - RNA, 13 nt, Mycobacterium avium subsp. paratuberculosis
guaccagcgccac

SEQ ID NO: 940506 - RNA, 14 nt, Mycobacterium avium subsp. paratuberculosis
guacagcgccagcg

SEQ ID NO: 940507 - RNA, 15 nt, Mycobacterium avium subsp. paratuberculosis
guacgcgccgcgcgc

SEQ ID NO: 940508 - RNA, 14 nt, Mycobacterium avium subsp. paratuberculosis
guacgcgccggcca

SEQ ID NO: 940509 - RNA, 17 nt, Mycobacterium avium subsp. paratuberculosis
guacgcgccgucgucgu

SEQ ID NO: 940510 - RNA, 20 nt, Mycobacterium avium subsp. paratuberculosis
guacgcgccgucgucgucgc

SEQ ID NO: 940511 - RNA, 20 nt, Mycobacterium avium subsp. paratuberculosis
guacgcggcguugccgccgg

SEQ ID NO: 940512 - RNA, 15 nt, Mycobacterium avium subsp. paratuberculosis
guacgcggcuggcgg

SEQ ID NO: 940513 - RNA, 18 nt, Mycobacterium avium subsp. paratuberculosis
guacgcgagaagcgcgca

SEQ ID NO: 940514 - RNA, 17 nt, Mycobacterium avium subsp. paratuberculosis
guacgcgauggcggcgc

SEQ ID NO: 940515 - RNA, 22 nt, Mycobacterium avium subsp. paratuberculosis
guacgcgauggcggcgcgcucg

SEQ ID NO: 940516 - RNA, 14 nt, Mycobacterium avium subsp. paratuberculosis
guacgcaucggcgc

SEQ ID NO: 940517 - RNA, 20 nt, Mycobacterium avium subsp. paratuberculosis
guacgccaugaacucgucca

SEQ ID NO: 940518 - RNA, 14 nt, Mycobacterium avium subsp. paratuberculosis
guaccggguggccg

SEQ ID NO: 940519 - RNA, 20 nt, Mycobacterium avium subsp. paratuberculosis
guaccgguacagcgacucca

SEQ ID NO: 940520 - RNA, 14 nt, Mycobacterium avium subsp. paratuberculosis
guacggccgacgcc

SEQ ID NO: 940521 - RNA, 15 nt, Mycobacterium avium subsp. paratuberculosis
guacggccgacgccc

SEQ ID NO: 940522 - RNA, 18 nt, Mycobacterium avium subsp. paratuberculosis
guacggccgacgcccagc

SEQ ID NO: 940523 - RNA, 13 nt, Mycobacterium avium subsp. paratuberculosis
guacgugcgccgg

SEQ ID NO: 940524 - RNA, 16 nt, Mycobacterium avium subsp. paratuberculosis
guacgugcgccggcgg

SEQ ID NO: 940525 - RNA, 21 nt, Mycobacterium avium subsp. paratuberculosis
guacucaaaccgggccugcgc

SEQ ID NO: 940526 - RNA, 19 nt, Mycobacterium avium subsp. paratuberculosis
guacuccaccgcgccgucg

SEQ ID NO: 940527 - RNA, 20 nt, Mycobacterium avium subsp. paratuberculosis
guagacguucuccccgccgg

SEQ ID NO: 940528 - RNA, 18 nt, Mycobacterium avium subsp. paratuberculosis
guagacucagcgucgaug

SEQ ID NO: 940529 - RNA, 22 nt, Mycobacterium avium subsp. paratuberculosis
guagagcgccagggucuggccc

SEQ ID NO: 940530 - RNA, 14 nt, Mycobacterium avium subsp. paratuberculosis
guagcccagcgcgu

SEQ ID NO: 940531 - RNA, 11 nt, Mycobacterium avium subsp. paratuberculosis
guagcccagga

SEQ ID NO: 940532 - RNA, 20 nt, Mycobacterium avium subsp. paratuberculosis
guagcccaggauucccgacc

SEQ ID NO: 940533 - RNA, 23 nt, Mycobacterium avium subsp. paratuberculosis
guagcccaggauucccgaccccg

SEQ ID NO: 940534 - RNA, 16 nt, Mycobacterium avium subsp. paratuberculosis
guagccagcaccgccc

SEQ ID NO: 940535 - RNA, 12 nt, Mycobacterium avium subsp. paratuberculosis
guagaucgccag

SEQ ID NO: 940536 - RNA, 15 nt, Mycobacterium avium subsp. paratuberculosis
guagaucacgccggu

SEQ ID NO: 940537 - RNA, 14 nt, Mycobacterium avium subsp. paratuberculosis
guagaucagcgccu

SEQ ID NO: 940538 - RNA, 17 nt, Mycobacterium avium subsp. paratuberculosis
guagaucagcgccuggu

SEQ ID NO: 940539 - RNA, 17 nt, Mycobacterium avium subsp. paratuberculosis
guagaagaucagcgcca

SEQ ID NO: 940540 - RNA, 19 nt, Mycobacterium avium subsp. paratuberculosis
guagaagaucagcgccagc

SEQ ID NO: 940541 - RNA, 18 nt, Mycobacterium avium subsp. paratuberculosis
guagaaccaacgcggcgc

SEQ ID NO: 940542 - RNA, 23 nt, Mycobacterium avium subsp. paratuberculosis
guagaaccaacgcggcgccggug

SEQ ID NO: 940543 - RNA, 20 nt, Mycobacterium avium subsp. paratuberculosis
guagaaccggcccagcagcg

SEQ ID NO: 940544 - RNA, 23 nt, Mycobacterium avium subsp. paratuberculosis
guagacagcguggucgcgcagca

SEQ ID NO: 940545 - RNA, 14 nt, Mycobacterium avium subsp. paratuberculosis
guagaacucgggau

SEQ ID NO: 940546 - RNA, 13 nt, Mycobacterium avium subsp. paratuberculosis
guacucggcggcg

SEQ ID NO: 940547 - RNA, 14 nt, Mycobacterium avium subsp. paratuberculosis
guacucggcggcgg

SEQ ID NO: 940548 - RNA, 16 nt, Mycobacterium avium subsp. paratuberculosis
guacucggcggcgggc

SEQ ID NO: 940549 - RNA, 19 nt, Mycobacterium avium subsp. paratuberculosis
guacucgcacagccggcgc

SEQ ID NO: 940550 - RNA, 19 nt, Mycobacterium avium subsp. paratuberculosis
guagccgaucuccaccgag

SEQ ID NO: 940551 - RNA, 15 nt, Mycobacterium avium subsp. paratuberculosis
guagccgccgguggc

SEQ ID NO: 940552 - RNA, 19 nt, Mycobacterium avium subsp. paratuberculosis
guagccgccgguggcgucg

SEQ ID NO: 940553 - RNA, 14 nt, Mycobacterium avium subsp. paratuberculosis
guagccgcgcacca

SEQ ID NO: 940554 - RNA, 14 nt, Mycobacterium avium subsp. paratuberculosis
guagccgcggguga

SEQ ID NO: 940555 - RNA, 20 nt, Mycobacterium avium subsp. paratuberculosis
guagccgcgguucggcgucg

SEQ ID NO: 940556 - RNA, 17 nt, Mycobacterium avium subsp. paratuberculosis
guagccgaccaacgggc

SEQ ID NO: 940557 - RNA, 19 nt, Mycobacterium avium subsp. paratuberculosis
guagccgaccaacgggcgg

SEQ ID NO: 940558 - RNA, 14 nt, Mycobacterium avium subsp. paratuberculosis
guagccgaccgacc

SEQ ID NO: 940559 - RNA, 16 nt, Mycobacterium avium subsp. paratuberculosis
guagccgaccgacccg

SEQ ID NO: 940560 - RNA, 15 nt, Mycobacterium avium subsp. paratuberculosis
guagcccugcaggua

SEQ ID NO: 940561 - RNA, 13 nt, Mycobacterium avium subsp. paratuberculosis
guagccgaacgug

SEQ ID NO: 940562 - RNA, 19 nt, Mycobacterium avium subsp. paratuberculosis
guagcccaccucgagcacg

SEQ ID NO: 940563 - RNA, 22 nt, Mycobacterium avium subsp. paratuberculosis
guagcccaccucgagcacgccc

SEQ ID NO: 940564 - RNA, 19 nt, Mycobacterium avium subsp. paratuberculosis
guagcccaugucgccggug

SEQ ID NO: 940565 - RNA, 20 nt, Mycobacterium avium subsp. paratuberculosis
guagcccaugucgccggugc

SEQ ID NO: 940566 - RNA, 15 nt, Mycobacterium avium subsp. paratuberculosis
guagcgugcgcccga

SEQ ID NO: 940567 - RNA, 22 nt, Mycobacterium avium subsp. paratuberculosis
guagcggucgugcgggaugccg

SEQ ID NO: 940568 - RNA, 19 nt, Mycobacterium avium subsp. paratuberculosis
guagcggugaaacgccugc

SEQ ID NO: 940569 - RNA, 21 nt, Mycobacterium avium subsp. paratuberculosis
guagcggugaaacgccugcac

SEQ ID NO: 940570 - RNA, 13 nt, Mycobacterium avium subsp. paratuberculosis
guagcggcggaac

SEQ ID NO: 940571 - RNA, 19 nt, Mycobacterium avium subsp. paratuberculosis
guagcggauggcgacggcg

SEQ ID NO: 940572 - RNA, 21 nt, Mycobacterium avium subsp. paratuberculosis
guagcggcagauggucucgau

SEQ ID NO: 940573 - RNA, 23 nt, Mycobacterium avium subsp. paratuberculosis
guagcggcagauggucucgaucu

SEQ ID NO: 940574 - RNA, 20 nt, Mycobacterium avium subsp. paratuberculosis
guagcggcccgaaaacgccc

SEQ ID NO: 940575 - RNA, 14 nt, Mycobacterium avium subsp. paratuberculosis
guagcggcucgcca

SEQ ID NO: 940576 - RNA, 13 nt, Mycobacterium avium subsp. paratuberculosis
guagccggccagc

SEQ ID NO: 940577 - RNA, 13 nt, Mycobacterium avium subsp. paratuberculosis
guagccggcccgc

SEQ ID NO: 940578 - RNA, 21 nt, Mycobacterium avium subsp. paratuberculosis
guagccggcccgcagccagcg

SEQ ID NO: 940579 - RNA, 11 nt, Mycobacterium avium subsp. paratuberculosis
guagccgggcu

SEQ ID NO: 940580 - RNA, 17 nt, Mycobacterium avium subsp. paratuberculosis
guagccgggcucgagca

SEQ ID NO: 940581 - RNA, 17 nt, Mycobacterium avium subsp. paratuberculosis
guaggacaggucgcggu

SEQ ID NO: 940582 - RNA, 12 nt, Mycobacterium avium subsp. paratuberculosis
guaggacaccac

SEQ ID NO: 940583 - RNA, 18 nt, Mycobacterium avium subsp. paratuberculosis
guaggacaccacgguggc

SEQ ID NO: 940584 - RNA, 13 nt, Mycobacterium avium subsp. paratuberculosis
guaggacagcacc

SEQ ID NO: 940585 - RNA, 13 nt, Mycobacterium avium subsp. paratuberculosis
guaggacagcagc

SEQ ID NO: 940586 - RNA, 15 nt, Mycobacterium avium subsp. paratuberculosis
guaggacgccgugca

SEQ ID NO: 940587 - RNA, 21 nt, Mycobacterium avium subsp. paratuberculosis
guaggacgccgugcaggaggc

SEQ ID NO: 940588 - RNA, 12 nt, Mycobacterium avium subsp. paratuberculosis
aaguccgcgagg

SEQ ID NO: 940589 - RNA, 14 nt, Mycobacterium avium subsp. paratuberculosis
guaggccgcgcggu

SEQ ID NO: 940590 - RNA, 16 nt, Mycobacterium avium subsp. paratuberculosis
guaggccgcgcggugc

SEQ ID NO: 940591 - RNA, 12 nt, Mycobacterium avium subsp. paratuberculosis
aaguccggcggu

SEQ ID NO: 940592 - RNA, 22 nt, Mycobacterium avium subsp. paratuberculosis
aaguccggguccuaucaggacu

SEQ ID NO: 940593 - RNA, 20 nt, Mycobacterium avium subsp. paratuberculosis
guaggccagcaucucggcga

SEQ ID NO: 940594 - RNA, 16 nt, Mycobacterium avium subsp. paratuberculosis
guaggccagcccggcg

SEQ ID NO: 940595 - RNA, 19 nt, Mycobacterium avium subsp. paratuberculosis
guaggccagcccggcgugc

SEQ ID NO: 940596 - RNA, 16 nt, Mycobacterium avium subsp. paratuberculosis
guaggccgccgcgacc

SEQ ID NO: 940597 - RNA, 23 nt, Mycobacterium avium subsp. paratuberculosis
guaggccauccugaagaagcggc

SEQ ID NO: 940598 - RNA, 16 nt, Mycobacterium avium subsp. paratuberculosis
guaggcgcaccgccgg

SEQ ID NO: 940599 - RNA, 19 nt, Mycobacterium avium subsp. paratuberculosis
guaggcgccgaacgccgga

SEQ ID NO: 940600 - RNA, 12 nt, Mycobacterium avium subsp. paratuberculosis
guaggcgccgcu

SEQ ID NO: 940601 - RNA, 13 nt, Mycobacterium avium subsp. paratuberculosis
guaggcgccgcuc

SEQ ID NO: 940602 - RNA, 19 nt, Mycobacterium avium subsp. paratuberculosis
guaggcgaucagcgcgcac

SEQ ID NO: 940603 - RNA, 16 nt, Mycobacterium avium subsp. paratuberculosis
guaggccggccgcagc

SEQ ID NO: 940604 - RNA, 15 nt, Mycobacterium avium subsp. paratuberculosis
guaguugcggccggc

SEQ ID NO: 940605 - RNA, 17 nt, Mycobacterium avium subsp. paratuberculosis
guaguugcggccggcgg

SEQ ID NO: 940606 - RNA, 14 nt, Mycobacterium avium subsp. paratuberculosis
guaguucagcgcgc

SEQ ID NO: 940607 - RNA, 17 nt, Mycobacterium avium subsp. paratuberculosis
guauccggucagcgcca

SEQ ID NO: 940608 - RNA, 19 nt, Mycobacterium avium subsp. paratuberculosis
guauccggucagcgccagc

SEQ ID NO: 940609 - RNA, 22 nt, Mycobacterium avium subsp. paratuberculosis
guauccggucagcgccagcaug

SEQ ID NO: 940610 - RNA, 16 nt, Mycobacterium avium subsp. paratuberculosis
guaucccugccagggg

SEQ ID NO: 940611 - RNA, 17 nt, Mycobacterium avium subsp. paratuberculosis
guaggcgguggcgcaca

SEQ ID NO: 940612 - RNA, 18 nt, Mycobacterium avium subsp. paratuberculosis
guagggcagauaggcggc

SEQ ID NO: 940613 - RNA, 21 nt, Mycobacterium avium subsp. paratuberculosis
guagggcagcccgagcaacug

SEQ ID NO: 940614 - RNA, 23 nt, Mycobacterium avium subsp. paratuberculosis
guaggcgucgaacgggccgggca

SEQ ID NO: 940615 - RNA, 15 nt, Mycobacterium avium subsp. paratuberculosis
guaggcgucgcgcag

SEQ ID NO: 940616 - RNA, 15 nt, Mycobacterium avium subsp. paratuberculosis
guaggcgucggcgga

SEQ ID NO: 940617 - RNA, 19 nt, Mycobacterium avium subsp. paratuberculosis
guaggcggccagcgcccgc

SEQ ID NO: 940618 - RNA, 20 nt, Mycobacterium avium subsp. paratuberculosis
guaggcggcgugccagggca

SEQ ID NO: 940619 - RNA, 15 nt, Mycobacterium avium subsp. paratuberculosis
guaggcggcgcagcc

SEQ ID NO: 940620 - RNA, 19 nt, Mycobacterium avium subsp. paratuberculosis
guaggugaucgccucgacc

SEQ ID NO: 940621 - RNA, 18 nt, Mycobacterium avium subsp. paratuberculosis
guaggucaucagcgacgu

SEQ ID NO: 940622 - RNA, 19 nt, Mycobacterium avium subsp. paratuberculosis
guaggucaucagcgacguc

SEQ ID NO: 940623 - RNA, 22 nt, Mycobacterium avium subsp. paratuberculosis
guaggguucgccgauguccccg

SEQ ID NO: 940624 - RNA, 12 nt, Mycobacterium avium subsp. paratuberculosis
guagggccgcuu

SEQ ID NO: 940625 - RNA, 17 nt, Mycobacterium avium subsp. paratuberculosis
guagggccggucaccgg

SEQ ID NO: 940626 - RNA, 16 nt, Mycobacterium avium subsp. paratuberculosis
guagggcucggcgucg

SEQ ID NO: 940627 - RNA, 19 nt, Mycobacterium avium subsp. paratuberculosis
guagggguccuccagcggc

SEQ ID NO: 940628 - RNA, 17 nt, Mycobacterium avium subsp. paratuberculosis
ggugggcuuagcggggu

SEQ ID NO: 940629 - RNA, 15 nt, Mycobacterium avium subsp. paratuberculosis
gguggggacgacgcc

SEQ ID NO: 940630 - RNA, 20 nt, Mycobacterium avium subsp. paratuberculosis
gguggggaucacgucggcgu

SEQ ID NO: 940631 - RNA, 20 nt, Mycobacterium avium subsp. paratuberculosis
gguggggcagcaccucgcgc

SEQ ID NO: 940632 - RNA, 21 nt, Mycobacterium avium subsp. paratuberculosis
gguggggccgaugaccgcggc

SEQ ID NO: 940633 - RNA, 16 nt, Mycobacterium avium subsp. paratuberculosis
ggugggguagacggca

SEQ ID NO: 940634 - RNA, 15 nt, Mycobacterium avium subsp. paratuberculosis
gguggggugaugagg

SEQ ID NO: 940635 - RNA, 18 nt, Mycobacterium avium subsp. paratuberculosis
ggugggcgcgggccgcgu

SEQ ID NO: 940636 - RNA, 12 nt, Mycobacterium avium subsp. paratuberculosis
ggugggcggcca

SEQ ID NO: 940637 - RNA, 17 nt, Mycobacterium avium subsp. paratuberculosis
ggugggcgugcaggccg

SEQ ID NO: 940638 - RNA, 14 nt, Mycobacterium avium subsp. paratuberculosis
ggugggcucggcgc

SEQ ID NO: 940639 - RNA, 16 nt, Mycobacterium avium subsp. paratuberculosis
ggugggcucggcgccg

SEQ ID NO: 940640 - RNA, 20 nt, Mycobacterium avium subsp. paratuberculosis
ggugggcagcucgguggccg

SEQ ID NO: 940641 - RNA, 14 nt, Mycobacterium avium subsp. paratuberculosis
ggugggcgccggcg

SEQ ID NO: 940642 - RNA, 16 nt, Mycobacterium avium subsp. paratuberculosis
ggugggcgccggguca

SEQ ID NO: 940643 - RNA, 15 nt, Mycobacterium avium subsp. paratuberculosis
ggugggccagucgaa

SEQ ID NO: 940644 - RNA, 17 nt, Mycobacterium avium subsp. paratuberculosis
ggugggcccgccgucga

SEQ ID NO: 940645 - RNA, 16 nt, Mycobacterium avium subsp. paratuberculosis
ggugggccgccgcggc

SEQ ID NO: 940646 - RNA, 12 nt, Mycobacterium avium subsp. paratuberculosis
ggugggcgaaca

SEQ ID NO: 940647 - RNA, 18 nt, Mycobacterium avium subsp. paratuberculosis
ggugggcgaacagcagca

SEQ ID NO: 940648 - RNA, 18 nt, Mycobacterium avium subsp. paratuberculosis
ggugggcagaugcccgcu

SEQ ID NO: 940649 - RNA, 18 nt, Mycobacterium avium subsp. paratuberculosis
gguggcgggccgccgggu

SEQ ID NO: 940650 - RNA, 22 nt, Mycobacterium avium subsp. paratuberculosis
ggugggcaccagcagcgcgacg

SEQ ID NO: 940651 - RNA, 19 nt, Mycobacterium avium subsp. paratuberculosis
ggugggcaccagcugcgga

SEQ ID NO: 940652 - RNA, 21 nt, Mycobacterium avium subsp. paratuberculosis
ggugggcaccuggccgucggu

SEQ ID NO: 940653 - RNA, 22 nt, Mycobacterium avium subsp. paratuberculosis
gguggucgacgagcccgcgccc

SEQ ID NO: 940654 - RNA, 13 nt, Mycobacterium avium subsp. paratuberculosis
gguggucgacgcg

SEQ ID NO: 940655 - RNA, 14 nt, Mycobacterium avium subsp. paratuberculosis
gguggucggcguca

SEQ ID NO: 940656 - RNA, 23 nt, Mycobacterium avium subsp. paratuberculosis
gguggucugccagaacggcggca

SEQ ID NO: 940657 - RNA, 14 nt, Mycobacterium avium subsp. paratuberculosis
gguggugcggguga

SEQ ID NO: 940658 - RNA, 20 nt, Mycobacterium avium subsp. paratuberculosis
gguggugcucgccccgcccg

SEQ ID NO: 940659 - RNA, 16 nt, Mycobacterium avium subsp. paratuberculosis
gguggugcccccgccc

SEQ ID NO: 940660 - RNA, 14 nt, Mycobacterium avium subsp. paratuberculosis
gguggugccgccgu

SEQ ID NO: 940661 - RNA, 16 nt, Mycobacterium avium subsp. paratuberculosis
gguggugccgccgucg

SEQ ID NO: 940662 - RNA, 17 nt, Mycobacterium avium subsp. paratuberculosis
gguggugaucacccagc

SEQ ID NO: 940663 - RNA, 17 nt, Mycobacterium avium subsp. paratuberculosis
gguggguccggucagca

SEQ ID NO: 940664 - RNA, 17 nt, Mycobacterium avium subsp. paratuberculosis
ggugggugcucaccccg

SEQ ID NO: 940665 - RNA, 19 nt, Mycobacterium avium subsp. paratuberculosis
ggugggugcucaccccggc

SEQ ID NO: 940666 - RNA, 21 nt, Mycobacterium avium subsp. paratuberculosis
ggugggugcucaccccggcca

SEQ ID NO: 940667 - RNA, 23 nt, Mycobacterium avium subsp. paratuberculosis
ggugguagacagcguggucgcgc

SEQ ID NO: 940668 - RNA, 16 nt, Mycobacterium avium subsp. paratuberculosis
gguggucagcggcgcc

SEQ ID NO: 940669 - RNA, 19 nt, Mycobacterium avium subsp. paratuberculosis
ggugguccuggcgguggcc

SEQ ID NO: 940670 - RNA, 17 nt, Mycobacterium avium subsp. paratuberculosis
gguggucgaacacggcg

SEQ ID NO: 940671 - RNA, 17 nt, Mycobacterium avium subsp. paratuberculosis
gguggucgaacuggcgc

SEQ ID NO: 940672 - RNA, 14 nt, Mycobacterium avium subsp. paratuberculosis
gguggucacaccgc

SEQ ID NO: 940673 - RNA, 18 nt, Mycobacterium avium subsp. paratuberculosis
gguggucaccagcgcggu

SEQ ID NO: 940674 - RNA, 19 nt, Mycobacterium avium subsp. paratuberculosis
gguggucaccagcgcgguc

SEQ ID NO: 940675 - RNA, 14 nt, Mycobacterium avium subsp. paratuberculosis
gguggucaccggca

SEQ ID NO: 940676 - RNA, 23 nt, Mycobacterium avium subsp. paratuberculosis
ggugucugaccucgcgccgcgau

SEQ ID NO: 940677 - RNA, 20 nt, Mycobacterium avium subsp. paratuberculosis
ggugucgucgcgcacccagc

SEQ ID NO: 940678 - RNA, 23 nt, Mycobacterium avium subsp. paratuberculosis
ggugucgucgggccgcagcacgg

SEQ ID NO: 940679 - RNA, 13 nt, Mycobacterium avium subsp. paratuberculosis
ggugucgucgucg

SEQ ID NO: 940680 - RNA, 18 nt, Mycobacterium avium subsp. paratuberculosis
ggugucgugcauucaggu

SEQ ID NO: 940681 - RNA, 23 nt, Mycobacterium avium subsp. paratuberculosis
ggugucgugcauucaggucaccg

SEQ ID NO: 940682 - RNA, 22 nt, Mycobacterium avium subsp. paratuberculosis
ggugucguagacgacgucgacc

SEQ ID NO: 940683 - RNA, 12 nt, Mycobacterium avium subsp. paratuberculosis
ggugucggcggu

SEQ ID NO: 940684 - RNA, 13 nt, Mycobacterium avium subsp. paratuberculosis
ggugucggcggug

SEQ ID NO: 940685 - RNA, 14 nt, Mycobacterium avium subsp. paratuberculosis
ggugucggcgguga

SEQ ID NO: 940686 - RNA, 14 nt, Mycobacterium avium subsp. paratuberculosis
ggugucggcgacca

SEQ ID NO: 940687 - RNA, 12 nt, Mycobacterium avium subsp. paratuberculosis
ggugucggcgag

SEQ ID NO: 940688 - RNA, 18 nt, Mycobacterium avium subsp. paratuberculosis
ggugucggcgagcuuggc

SEQ ID NO: 940689 - RNA, 12 nt, Mycobacterium avium subsp. paratuberculosis
ggugucggcgau

SEQ ID NO: 940690 - RNA, 23 nt, Mycobacterium avium subsp. paratuberculosis
ggugucggacuugucgccguugu

SEQ ID NO: 940691 - RNA, 13 nt, Mycobacterium avium subsp. paratuberculosis
gguguccacccgc

SEQ ID NO: 940692 - RNA, 17 nt, Mycobacterium avium subsp. paratuberculosis
gguguccacccgcgccc

SEQ ID NO: 940693 - RNA, 18 nt, Mycobacterium avium subsp. paratuberculosis
gguguccacgaugcggug

SEQ ID NO: 940694 - RNA, 19 nt, Mycobacterium avium subsp. paratuberculosis
gguguccacgucgcccagc

SEQ ID NO: 940695 - RNA, 19 nt, Mycobacterium avium subsp. paratuberculosis
ggugucccaguucccggcg

SEQ ID NO: 940696 - RNA, 21 nt, Mycobacterium avium subsp. paratuberculosis
ggugucccaguucccggcggg

SEQ ID NO: 940697 - RNA, 22 nt, Mycobacterium avium subsp. paratuberculosis
gguguccgagcgggccguggca

SEQ ID NO: 940698 - RNA, 16 nt, Mycobacterium avium subsp. paratuberculosis
gguguccgcggcgucg

SEQ ID NO: 940699 - RNA, 14 nt, Mycobacterium avium subsp. paratuberculosis
gguguccgcgggca

SEQ ID NO: 940700 - RNA, 14 nt, Mycobacterium avium subsp. paratuberculosis
ggugucgcccucgg

SEQ ID NO: 940701 - RNA, 14 nt, Mycobacterium avium subsp. paratuberculosis
ggugucgccgagcc

SEQ ID NO: 940702 - RNA, 19 nt, Mycobacterium avium subsp. paratuberculosis
ggugucgccgagccgcacc

SEQ ID NO: 940703 - RNA, 23 nt, Mycobacterium avium subsp. paratuberculosis
ggugucgccgauuucggugucga

SEQ ID NO: 940704 - RNA, 12 nt, Mycobacterium avium subsp. paratuberculosis
ggugucgacgcu

SEQ ID NO: 940705 - RNA, 20 nt, Mycobacterium avium subsp. paratuberculosis
ggugucgagccaccacugcg

SEQ ID NO: 940706 - RNA, 23 nt, Mycobacterium avium subsp. paratuberculosis
ggugucgagccggugccgaggca

SEQ ID NO: 940707 - RNA, 14 nt, Mycobacterium avium subsp. paratuberculosis
ggugucgagggcca

SEQ ID NO: 940708 - RNA, 19 nt, Mycobacterium avium subsp. paratuberculosis
ggugucgaggucgucggcc

SEQ ID NO: 940709 - RNA, 20 nt, Mycobacterium avium subsp. paratuberculosis
gguguccuugcgcaccacgu

SEQ ID NO: 940710 - RNA, 18 nt, Mycobacterium avium subsp. paratuberculosis
ggugucgaaggccggggu

SEQ ID NO: 940711 - RNA, 13 nt, Mycobacterium avium subsp. paratuberculosis
ggugucgacgccg

SEQ ID NO: 940712 - RNA, 17 nt, Mycobacterium avium subsp. paratuberculosis
ggugucgacgccgggcu

SEQ ID NO: 940713 - RNA, 14 nt, Mycobacterium avium subsp. paratuberculosis
ggugguucgcgcga

SEQ ID NO: 940714 - RNA, 17 nt, Mycobacterium avium subsp. paratuberculosis
gguguaacgcgucgacg

SEQ ID NO: 940715 - RNA, 18 nt, Mycobacterium avium subsp. paratuberculosis
gguguaacgcgucgacgg

SEQ ID NO: 940716 - RNA, 13 nt, Mycobacterium avium subsp. paratuberculosis
gguggugggcgcg

SEQ ID NO: 940717 - RNA, 17 nt, Mycobacterium avium subsp. paratuberculosis
gguggugggcgcggugg

SEQ ID NO: 940718 - RNA, 23 nt, Mycobacterium avium subsp. paratuberculosis
ggugguggucgucgacgagcccg

SEQ ID NO: 940719 - RNA, 14 nt, Mycobacterium avium subsp. paratuberculosis
gguggugucgacgg

SEQ ID NO: 940720 - RNA, 14 nt, Mycobacterium avium subsp. paratuberculosis
ggugguggccuuga

SEQ ID NO: 940721 - RNA, 19 nt, Mycobacterium avium subsp. paratuberculosis
gguggugaucggccaggcg

SEQ ID NO: 940722 - RNA, 18 nt, Mycobacterium avium subsp. paratuberculosis
gguguacucaaaccgggc

SEQ ID NO: 940723 - RNA, 17 nt, Mycobacterium avium subsp. paratuberculosis
gguguagacgcgggccg

SEQ ID NO: 940724 - RNA, 13 nt, Mycobacterium avium subsp. paratuberculosis
ggugucagcgcga

SEQ ID NO: 940725 - RNA, 19 nt, Mycobacterium avium subsp. paratuberculosis
ggugucacgcuggcgugac

SEQ ID NO: 940726 - RNA, 17 nt, Mycobacterium avium subsp. paratuberculosis
ggugucacguccacgcc

SEQ ID NO: 940727 - RNA, 19 nt, Mycobacterium avium subsp. paratuberculosis
ggugucacguccacgccgc

SEQ ID NO: 940728 - RNA, 19 nt, Mycobacterium avium subsp. paratuberculosis
gguguauucgcccaccccg

SEQ ID NO: 940729 - RNA, 15 nt, Mycobacterium avium subsp. paratuberculosis
ggugucaccgacgcc

SEQ ID NO: 940730 - RNA, 20 nt, Mycobacterium avium subsp. paratuberculosis
ggugucaccgacgccagcgg

SEQ ID NO: 940731 - RNA, 16 nt, Mycobacterium avium subsp. paratuberculosis
gguguaguccugcuuc

SEQ ID NO: 940732 - RNA, 22 nt, Mycobacterium avium subsp. paratuberculosis
gguguaguccugcuucagcucg

SEQ ID NO: 940733 - RNA, 16 nt, Mycobacterium avium subsp. paratuberculosis
gguguagcugcggguc

SEQ ID NO: 940734 - RNA, 13 nt, Mycobacterium avium subsp. paratuberculosis
gguguaggccgcg

SEQ ID NO: 940735 - RNA, 20 nt, Mycobacterium avium subsp. paratuberculosis
gguguacagcgcgccgcgga

SEQ ID NO: 940736 - RNA, 22 nt, Mycobacterium avium subsp. paratuberculosis
gguguagcggauggcgacggcg

SEQ ID NO: 940737 - RNA, 14 nt, Mycobacterium avium subsp. paratuberculosis
gguguagcggcggc

SEQ ID NO: 940738 - RNA, 15 nt, Mycobacterium avium subsp. paratuberculosis
ggugaugacgucgcc

SEQ ID NO: 940739 - RNA, 22 nt, Mycobacterium avium subsp. paratuberculosis
ggugaugacguuggugaucgcc

SEQ ID NO: 940740 - RNA, 23 nt, Mycobacterium avium subsp. paratuberculosis
ggugaugccggcauccucggcgc

SEQ ID NO: 940741 - RNA, 15 nt, Mycobacterium avium subsp. paratuberculosis
ggugaugccggcggu

SEQ ID NO: 940742 - RNA, 19 nt, Mycobacterium avium subsp. paratuberculosis
ggugaucuuguuguuggug

SEQ ID NO: 940743 - RNA, 20 nt, Mycobacterium avium subsp. paratuberculosis
ggugaugaaaaccgggcccu

SEQ ID NO: 940744 - RNA, 19 nt, Mycobacterium avium subsp. paratuberculosis
ggugaugaacgcgccgucg

SEQ ID NO: 940745 - RNA, 23 nt, Mycobacterium avium subsp. paratuberculosis
ggugaugaacgcgccgucgucgg

SEQ ID NO: 940746 - RNA, 21 nt, Mycobacterium avium subsp. paratuberculosis
ggugaugaggucgcgaccgcc

SEQ ID NO: 940747 - RNA, 14 nt, Mycobacterium avium subsp. paratuberculosis
ggugaugcgggugu

SEQ ID NO: 940748 - RNA, 21 nt, Mycobacterium avium subsp. paratuberculosis
ggugauggccaucuggccgcg

SEQ ID NO: 940749 - RNA, 15 nt, Mycobacterium avium subsp. paratuberculosis
ggugauggccgccgc

SEQ ID NO: 940750 - RNA, 20 nt, Mycobacterium avium subsp. paratuberculosis
ggugaugcggaugcccgccg

SEQ ID NO: 940751 - RNA, 23 nt, Mycobacterium avium subsp. paratuberculosis
ggugaugcggaugcccgccggcg

SEQ ID NO: 940752 - RNA, 15 nt, Mycobacterium avium subsp. paratuberculosis
ggugaugcggcccga

SEQ ID NO: 940753 - RNA, 19 nt, Mycobacterium avium subsp. paratuberculosis
ggugaugcggcccgacccg

SEQ ID NO: 940754 - RNA, 12 nt, Mycobacterium avium subsp. paratuberculosis
ggugauggacau

SEQ ID NO: 940755 - RNA, 19 nt, Mycobacterium avium subsp. paratuberculosis
ggugauggacggggcgaug

SEQ ID NO: 940756 - RNA, 21 nt, Mycobacterium avium subsp. paratuberculosis
ggugauggacggggcgaugcc

SEQ ID NO: 940757 - RNA, 20 nt, Mycobacterium avium subsp. paratuberculosis
ggugcucuugacggccgcgg

SEQ ID NO: 940758 - RNA, 16 nt, Mycobacterium avium subsp. paratuberculosis
ggugcucuugguggug

SEQ ID NO: 940759 - RNA, 21 nt, Mycobacterium avium subsp. paratuberculosis
ggugcugaacgccugccggcg

SEQ ID NO: 940760 - RNA, 20 nt, Mycobacterium avium subsp. paratuberculosis
ggugcugaaugaacgaccug

SEQ ID NO: 940761 - RNA, 20 nt, Mycobacterium avium subsp. paratuberculosis
ggugcugacccggucgcggc

SEQ ID NO: 940762 - RNA, 21 nt, Mycobacterium avium subsp. paratuberculosis
ggugcugacccggucgcggcc

SEQ ID NO: 940763 - RNA, 19 nt, Mycobacterium avium subsp. paratuberculosis
ggugcucgacggcacccgg

SEQ ID NO: 940764 - RNA, 22 nt, Mycobacterium avium subsp. paratuberculosis
ggugcucgaucggcgcgccgaa

SEQ ID NO: 940765 - RNA, 10 nt, Mycobacterium avium subsp. paratuberculosis
ggugcucgcc

SEQ ID NO: 940766 - RNA, 18 nt, Mycobacterium avium subsp. paratuberculosis
ggugcucgccggcgcgga

SEQ ID NO: 940767 - RNA, 19 nt, Mycobacterium avium subsp. paratuberculosis
ggugcucgcgccgggcggc

SEQ ID NO: 940768 - RNA, 14 nt, Mycobacterium avium subsp. paratuberculosis
ggugcucggcgcgc

SEQ ID NO: 940769 - RNA, 22 nt, Mycobacterium avium subsp. paratuberculosis
ggugauggugaucucgccgcgg

SEQ ID NO: 940770 - RNA, 21 nt, Mycobacterium avium subsp. paratuberculosis
ggugauggucucccgggcggu

SEQ ID NO: 940771 - RNA, 20 nt, Mycobacterium avium subsp. paratuberculosis
ggugcuuaccggccggccgc

SEQ ID NO: 940772 - RNA, 23 nt, Mycobacterium avium subsp. paratuberculosis
ggugcuuggucagcgcggcccgc

SEQ ID NO: 940773 - RNA, 14 nt, Mycobacterium avium subsp. paratuberculosis
ggugcugucgucgc

SEQ ID NO: 940774 - RNA, 15 nt, Mycobacterium avium subsp. paratuberculosis
ggugcugucgucgcc

SEQ ID NO: 940775 - RNA, 23 nt, Mycobacterium avium subsp. paratuberculosis
ggugcuggcgaugugaucgcggc

SEQ ID NO: 940776 - RNA, 16 nt, Mycobacterium avium subsp. paratuberculosis
ggugcugggcacccag

SEQ ID NO: 940777 - RNA, 22 nt, Mycobacterium avium subsp. paratuberculosis
ggugcugggcggauccgcgugg

SEQ ID NO: 940778 - RNA, 19 nt, Mycobacterium avium subsp. paratuberculosis
ggugcugccguugggcacg

SEQ ID NO: 940779 - RNA, 23 nt, Mycobacterium avium subsp. paratuberculosis
ggugcugcagauccgcucgccgu

SEQ ID NO: 940780 - RNA, 20 nt, Mycobacterium avium subsp. paratuberculosis
ggugcugcccggcgcggaca

SEQ ID NO: 940781 - RNA, 23 nt, Mycobacterium avium subsp. paratuberculosis
ggugcucaucagcgacaccacgg

SEQ ID NO: 940782 - RNA, 15 nt, Mycobacterium avium subsp. paratuberculosis
gguggacgcccgcga

SEQ ID NO: 940783 - RNA, 23 nt, Mycobacterium avium subsp. paratuberculosis
gguggacgcccgcgaggugucga

SEQ ID NO: 940784 - RNA, 15 nt, Mycobacterium avium subsp. paratuberculosis
gguggacgccgcgca

SEQ ID NO: 940785 - RNA, 24 nt, Mycobacterium avium subsp. paratuberculosis
gguggacgcgaccaggcccagcgg

SEQ ID NO: 940786 - RNA, 15 nt, Mycobacterium avium subsp. paratuberculosis
gguggacgcggucgc

SEQ ID NO: 940787 - RNA, 19 nt, Mycobacterium avium subsp. paratuberculosis
gguggacgcggucgccgcc

SEQ ID NO: 940788 - RNA, 15 nt, Mycobacterium avium subsp. paratuberculosis
gguggccgacgugcc

SEQ ID NO: 940789 - RNA, 20 nt, Mycobacterium avium subsp. paratuberculosis
gguggccgacgugccggugg

SEQ ID NO: 940790 - RNA, 13 nt, Mycobacterium avium subsp. paratuberculosis
gguggccgagggu

SEQ ID NO: 940791 - RNA, 23 nt, Mycobacterium avium subsp. paratuberculosis
gguggccgaucagcggcgggccc

SEQ ID NO: 940792 - RNA, 18 nt, Mycobacterium avium subsp. paratuberculosis
gguggaauaggccgcgua

SEQ ID NO: 940793 - RNA, 22 nt, Mycobacterium avium subsp. paratuberculosis
gguggaauucuggccgaccgcc

SEQ ID NO: 940794 - RNA, 20 nt, Mycobacterium avium subsp. paratuberculosis
ggugcuuuugugucugcucg

SEQ ID NO: 940795 - RNA, 15 nt, Mycobacterium avium subsp. paratuberculosis
gguggaacuggacgc

SEQ ID NO: 940796 - RNA, 21 nt, Mycobacterium avium subsp. paratuberculosis
gguggaacuggacgccgugga

SEQ ID NO: 940797 - RNA, 15 nt, Mycobacterium avium subsp. paratuberculosis
gguggcgcccgcggu

SEQ ID NO: 940798 - RNA, 13 nt, Mycobacterium avium subsp. paratuberculosis
gguggcgcccgga

SEQ ID NO: 940799 - RNA, 14 nt, Mycobacterium avium subsp. paratuberculosis
gguggcgccggcca

SEQ ID NO: 940800 - RNA, 18 nt, Mycobacterium avium subsp. paratuberculosis
gguggcgccggccagcac

SEQ ID NO: 940801 - RNA, 14 nt, Mycobacterium avium subsp. paratuberculosis
gguggcgccgcgca

SEQ ID NO: 940802 - RNA, 13 nt, Mycobacterium avium subsp. paratuberculosis
gguggcgcgcauc

SEQ ID NO: 940803 - RNA, 13 nt, Mycobacterium avium subsp. paratuberculosis
gguggcgccggua

SEQ ID NO: 940804 - RNA, 11 nt, Mycobacterium avium subsp. paratuberculosis
gguggcggucc

SEQ ID NO: 940805 - RNA, 13 nt, Mycobacterium avium subsp. paratuberculosis
gguggcggugccg

SEQ ID NO: 940806 - RNA, 22 nt, Mycobacterium avium subsp. paratuberculosis
gguggcggugcggucgcgcagc

SEQ ID NO: 940807 - RNA, 21 nt, Mycobacterium avium subsp. paratuberculosis
gguggcgguggggccgaagcc

SEQ ID NO: 940808 - RNA, 15 nt, Mycobacterium avium subsp. paratuberculosis
gguggcgguguucga

SEQ ID NO: 940809 - RNA, 17 nt, Mycobacterium avium subsp. paratuberculosis
gguggcguccagcgggu

SEQ ID NO: 940810 - RNA, 13 nt, Mycobacterium avium subsp. paratuberculosis
gguggcgucgacg

SEQ ID NO: 940811 - RNA, 13 nt, Mycobacterium avium subsp. paratuberculosis
gguggcgucgccg

SEQ ID NO: 940812 - RNA, 23 nt, Mycobacterium avium subsp. paratuberculosis
gguggcgucgccgccggugccga

SEQ ID NO: 940813 - RNA, 17 nt, Mycobacterium avium subsp. paratuberculosis
gguggcgucggcggccu

SEQ ID NO: 940814 - RNA, 16 nt, Mycobacterium avium subsp. paratuberculosis
gguggcgucggcgucg

SEQ ID NO: 940815 - RNA, 17 nt, Mycobacterium avium subsp. paratuberculosis
gguggcgucggcgucga

SEQ ID NO: 940816 - RNA, 22 nt, Mycobacterium avium subsp. paratuberculosis
gguggcgucggugaugccggac

SEQ ID NO: 940817 - RNA, 15 nt, Mycobacterium avium subsp. paratuberculosis
gguggcgugcagcgc

SEQ ID NO: 940818 - RNA, 12 nt, Mycobacterium avium subsp. paratuberculosis
gguggcgccggc

SEQ ID NO: 940819 - RNA, 11 nt, Mycobacterium avium subsp. paratuberculosis
gguggcggcca

SEQ ID NO: 940820 - RNA, 16 nt, Mycobacterium avium subsp. paratuberculosis
gguggcggcgaugucg

SEQ ID NO: 940821 - RNA, 20 nt, Mycobacterium avium subsp. paratuberculosis
gguggcggcgaacgcgcggu

SEQ ID NO: 940822 - RNA, 23 nt, Mycobacterium avium subsp. paratuberculosis
gguggcgaugacgaauuccgcac

SEQ ID NO: 940823 - RNA, 15 nt, Mycobacterium avium subsp. paratuberculosis
gguggcgaugaucac

SEQ ID NO: 940824 - RNA, 23 nt, Mycobacterium avium subsp. paratuberculosis
gguggcgcacaacccggacagcg

SEQ ID NO: 940825 - RNA, 19 nt, Mycobacterium avium subsp. paratuberculosis
gguggccgcgucgaccagc

SEQ ID NO: 940826 - RNA, 17 nt, Mycobacterium avium subsp. paratuberculosis
gguggccuuggccacca

SEQ ID NO: 940827 - RNA, 23 nt, Mycobacterium avium subsp. paratuberculosis
gguggccuccggagugacgucgc

SEQ ID NO: 940828 - RNA, 16 nt, Mycobacterium avium subsp. paratuberculosis
gguggcgaucaccgcg

SEQ ID NO: 940829 - RNA, 14 nt, Mycobacterium avium subsp. paratuberculosis
gguggccucgucgg

SEQ ID NO: 940830 - RNA, 18 nt, Mycobacterium avium subsp. paratuberculosis
gguggccucgucggcgcc

SEQ ID NO: 940831 - RNA, 22 nt, Mycobacterium avium subsp. paratuberculosis
gguggccucgucggcgccgucg

SEQ ID NO: 940832 - RNA, 17 nt, Mycobacterium avium subsp. paratuberculosis
gguggccugcccggcgg

SEQ ID NO: 940833 - RNA, 20 nt, Mycobacterium avium subsp. paratuberculosis
gguggccugcccggcggugc

SEQ ID NO: 940834 - RNA, 23 nt, Mycobacterium avium subsp. paratuberculosis
gguggccugcccggcggugccga

SEQ ID NO: 940835 - RNA, 18 nt, Mycobacterium avium subsp. paratuberculosis
gguggccuucaucaccgc

SEQ ID NO: 940836 - RNA, 23 nt, Mycobacterium avium subsp. paratuberculosis
gguggccuucaucaccgccccga

SEQ ID NO: 940837 - RNA, 19 nt, Mycobacterium avium subsp. paratuberculosis
gguggcgaacagcggguuc

SEQ ID NO: 940838 - RNA, 17 nt, Mycobacterium avium subsp. paratuberculosis
gguggcgaacugcacca

SEQ ID NO: 940839 - RNA, 23 nt, Mycobacterium avium subsp. paratuberculosis
gguggcgaacugcaccagcacga

SEQ ID NO: 940840 - RNA, 15 nt, Mycobacterium avium subsp. paratuberculosis
gguggcgaagcacga

SEQ ID NO: 940841 - RNA, 23 nt, Mycobacterium avium subsp. paratuberculosis
gguggcgacaacaggcgaccucg

SEQ ID NO: 940842 - RNA, 17 nt, Mycobacterium avium subsp. paratuberculosis
gguggcgaccaccgacc

SEQ ID NO: 940843 - RNA, 23 nt, Mycobacterium avium subsp. paratuberculosis
gguggccgcuuuccaccccggcg

SEQ ID NO: 940844 - RNA, 13 nt, Mycobacterium avium subsp. paratuberculosis
gguggacagaugc

SEQ ID NO: 940845 - RNA, 12 nt, Mycobacterium avium subsp. paratuberculosis
gguggccgcggc

SEQ ID NO: 940846 - RNA, 14 nt, Mycobacterium avium subsp. paratuberculosis
gguggccgcggccg

SEQ ID NO: 940847 - RNA, 14 nt, Mycobacterium avium subsp. paratuberculosis
gguggccggccagc

SEQ ID NO: 940848 - RNA, 17 nt, Mycobacterium avium subsp. paratuberculosis
gguggccggccagcaca

SEQ ID NO: 940849 - RNA, 12 nt, Mycobacterium avium subsp. paratuberculosis
gguggccggggc

SEQ ID NO: 940850 - RNA, 14 nt, Mycobacterium avium subsp. paratuberculosis
gguggccggggcca

SEQ ID NO: 940851 - RNA, 20 nt, Mycobacterium avium subsp. paratuberculosis
gguggccgggucgccgucga

SEQ ID NO: 940852 - RNA, 18 nt, Mycobacterium avium subsp. paratuberculosis
gguggccggugggcggcg

SEQ ID NO: 940853 - RNA, 19 nt, Mycobacterium avium subsp. paratuberculosis
gguggccggugggcggcgc

SEQ ID NO: 940854 - RNA, 20 nt, Mycobacterium avium subsp. paratuberculosis
gguggccggugggcggcgcc

SEQ ID NO: 940855 - RNA, 16 nt, Mycobacterium avium subsp. paratuberculosis
gguggccgucgccucg

SEQ ID NO: 940856 - RNA, 23 nt, Mycobacterium avium subsp. paratuberculosis
gguggccgucucgucggccgcga

SEQ ID NO: 940857 - RNA, 18 nt, Mycobacterium avium subsp. paratuberculosis
gguggccgugaagggguc

SEQ ID NO: 940858 - RNA, 16 nt, Mycobacterium avium subsp. paratuberculosis
gguuguucagcccggu

SEQ ID NO: 940859 - RNA, 17 nt, Mycobacterium avium subsp. paratuberculosis
gguugucgucgucggcg

SEQ ID NO: 940860 - RNA, 18 nt, Mycobacterium avium subsp. paratuberculosis
gguugucgucgucggcga

SEQ ID NO: 940861 - RNA, 22 nt, Mycobacterium avium subsp. paratuberculosis
gguuguagucggcgccgacggc

SEQ ID NO: 940862 - RNA, 16 nt, Mycobacterium avium subsp. paratuberculosis
gguuguccagccggug

SEQ ID NO: 940863 - RNA, 16 nt, Mycobacterium avium subsp. paratuberculosis
gguugucgacgcugca

SEQ ID NO: 940864 - RNA, 19 nt, Mycobacterium avium subsp. paratuberculosis
gguugggcgccugcgguga

SEQ ID NO: 940865 - RNA, 14 nt, Mycobacterium avium subsp. paratuberculosis
gguugggcggggcg

SEQ ID NO: 940866 - RNA, 23 nt, Mycobacterium avium subsp. paratuberculosis
gguuggggacggcgaggaucgcg

SEQ ID NO: 940867 - RNA, 18 nt, Mycobacterium avium subsp. paratuberculosis
gguuggucaauccgggca

SEQ ID NO: 940868 - RNA, 12 nt, Mycobacterium avium subsp. paratuberculosis
gguuggcggccg

SEQ ID NO: 940869 - RNA, 15 nt, Mycobacterium avium subsp. paratuberculosis
gguuggcgaucaggg

SEQ ID NO: 940870 - RNA, 16 nt, Mycobacterium avium subsp. paratuberculosis
gguuggcgaucagggc

SEQ ID NO: 940871 - RNA, 20 nt, Mycobacterium avium subsp. paratuberculosis
gguuggcccgcaccacccag

SEQ ID NO: 940872 - RNA, 15 nt, Mycobacterium avium subsp. paratuberculosis
gguuggccgccaagu

SEQ ID NO: 940873 - RNA, 17 nt, Mycobacterium avium subsp. paratuberculosis
gguuggccggccgggcg

SEQ ID NO: 940874 - RNA, 15 nt, Mycobacterium avium subsp. paratuberculosis
gguuggccggcgggu

SEQ ID NO: 940875 - RNA, 13 nt, Mycobacterium avium subsp. paratuberculosis
gguuggccgucga

SEQ ID NO: 940876 - RNA, 23 nt, Mycobacterium avium subsp. paratuberculosis
gguuggacaguucgguggggccg

SEQ ID NO: 940877 - RNA, 20 nt, Mycobacterium avium subsp. paratuberculosis
gguugcgguguugcgcagcg

SEQ ID NO: 940878 - RNA, 17 nt, Mycobacterium avium subsp. paratuberculosis
gguugcguucgccggcg

SEQ ID NO: 940879 - RNA, 15 nt, Mycobacterium avium subsp. paratuberculosis
gguugcggcgggccg

SEQ ID NO: 940880 - RNA, 12 nt, Mycobacterium avium subsp. paratuberculosis
gguugcgggccg

SEQ ID NO: 940881 - RNA, 13 nt, Mycobacterium avium subsp. paratuberculosis
gguugcgggccga

SEQ ID NO: 940882 - RNA, 13 nt, Mycobacterium avium subsp. paratuberculosis
gguugcggcaccg

SEQ ID NO: 940883 - RNA, 16 nt, Mycobacterium avium subsp. paratuberculosis
gguugcggcaccggcg

SEQ ID NO: 940884 - RNA, 18 nt, Mycobacterium avium subsp. paratuberculosis
gguugcggccccgccagc

SEQ ID NO: 940885 - RNA, 14 nt, Mycobacterium avium subsp. paratuberculosis
gguugcggcgaacg

SEQ ID NO: 940886 - RNA, 19 nt, Mycobacterium avium subsp. paratuberculosis
gguucugggcgggcucgag

SEQ ID NO: 940887 - RNA, 15 nt, Mycobacterium avium subsp. paratuberculosis
gguucuuggcggccu

SEQ ID NO: 940888 - RNA, 17 nt, Mycobacterium avium subsp. paratuberculosis
gguucucgugauccggc

SEQ ID NO: 940889 - RNA, 15 nt, Mycobacterium avium subsp. paratuberculosis
gguucugauacacca

SEQ ID NO: 940890 - RNA, 15 nt, Mycobacterium avium subsp. paratuberculosis
gguucucgcggcggc

SEQ ID NO: 940891 - RNA, 17 nt, Mycobacterium avium subsp. paratuberculosis
gguucucgcggcggccg

SEQ ID NO: 940892 - RNA, 16 nt, Mycobacterium avium subsp. paratuberculosis
gguucggucucggcgg

SEQ ID NO: 940893 - RNA, 19 nt, Mycobacterium avium subsp. paratuberculosis
gguucuccggcccgcucgg

SEQ ID NO: 940894 - RNA, 15 nt, Mycobacterium avium subsp. paratuberculosis
gguugacgccgauga

SEQ ID NO: 940895 - RNA, 23 nt, Mycobacterium avium subsp. paratuberculosis
gguugagcaccagcccggccagc

SEQ ID NO: 940896 - RNA, 15 nt, Mycobacterium avium subsp. paratuberculosis
gguugagcaccgcga

SEQ ID NO: 940897 - RNA, 16 nt, Mycobacterium avium subsp. paratuberculosis
gguugagcaccgcgau

SEQ ID NO: 940898 - RNA, 14 nt, Mycobacterium avium subsp. paratuberculosis
gguugagcagcaga

SEQ ID NO: 940899 - RNA, 17 nt, Mycobacterium avium subsp. paratuberculosis
gguugaccccggccccg

SEQ ID NO: 940900 - RNA, 15 nt, Mycobacterium avium subsp. paratuberculosis
gguugacccggccgg

SEQ ID NO: 940901 - RNA, 22 nt, Mycobacterium avium subsp. paratuberculosis
gguugacccggccggucgccug

SEQ ID NO: 940902 - RNA, 22 nt, Mycobacterium avium subsp. paratuberculosis
gguugccccagcugucgggugg

SEQ ID NO: 940903 - RNA, 15 nt, Mycobacterium avium subsp. paratuberculosis
gguugcaggcgccca

SEQ ID NO: 940904 - RNA, 21 nt, Mycobacterium avium subsp. paratuberculosis
gguugaucacaccgucggcga

SEQ ID NO: 940905 - RNA, 16 nt, Mycobacterium avium subsp. paratuberculosis
gguugauccggauccg

SEQ ID NO: 940906 - RNA, 24 nt, Mycobacterium avium subsp. paratuberculosis
gguugauccggaucgggcggucca

SEQ ID NO: 940907 - RNA, 20 nt, Mycobacterium avium subsp. paratuberculosis
gguugcgcggaaugcucgac

SEQ ID NO: 940908 - RNA, 18 nt, Mycobacterium avium subsp. paratuberculosis
gguugcgaaagcccaggc

SEQ ID NO: 940909 - RNA, 16 nt, Mycobacterium avium subsp. paratuberculosis
gguguugccgacggcg

SEQ ID NO: 940910 - RNA, 20 nt, Mycobacterium avium subsp. paratuberculosis
gguuacguggacgcgcgcgg

SEQ ID NO: 940911 - RNA, 13 nt, Mycobacterium avium subsp. paratuberculosis
gguguuggcggcg

SEQ ID NO: 940912 - RNA, 17 nt, Mycobacterium avium subsp. paratuberculosis
gguguugcgcacccgcg

SEQ ID NO: 940913 - RNA, 20 nt, Mycobacterium avium subsp. paratuberculosis
gguguugcgcagcgucuccc

SEQ ID NO: 940914 - RNA, 20 nt, Mycobacterium avium subsp. paratuberculosis
gguguugcggcagggccacc

SEQ ID NO: 940915 - RNA, 19 nt, Mycobacterium avium subsp. paratuberculosis
gguguuggugcgggguugg

SEQ ID NO: 940916 - RNA, 20 nt, Mycobacterium avium subsp. paratuberculosis
gguguucaccgcgccgggca

SEQ ID NO: 940917 - RNA, 23 nt, Mycobacterium avium subsp. paratuberculosis
gguguucgggcaguugccggcca

SEQ ID NO: 940918 - RNA, 15 nt, Mycobacterium avium subsp. paratuberculosis
gguguucgggucggu

SEQ ID NO: 940919 - RNA, 14 nt, Mycobacterium avium subsp. paratuberculosis
gguguucgguggag

SEQ ID NO: 940920 - RNA, 17 nt, Mycobacterium avium subsp. paratuberculosis
gguguucgguggagcgc

SEQ ID NO: 940921 - RNA, 20 nt, Mycobacterium avium subsp. paratuberculosis
gguguucuugaacggcgcgu

SEQ ID NO: 940922 - RNA, 17 nt, Mycobacterium avium subsp. paratuberculosis
gguguggucaucugguu

SEQ ID NO: 940923 - RNA, 18 nt, Mycobacterium avium subsp. paratuberculosis
gguguuccccgggcgagc

SEQ ID NO: 940924 - RNA, 22 nt, Mycobacterium avium subsp. paratuberculosis
gguguuccccgggcgagcgucg

SEQ ID NO: 940925 - RNA, 22 nt, Mycobacterium avium subsp. paratuberculosis
gguguggcgucggccgggggcg

SEQ ID NO: 940926 - RNA, 22 nt, Mycobacterium avium subsp. paratuberculosis
ggugugggcgauggcggcgucg

SEQ ID NO: 940927 - RNA, 12 nt, Mycobacterium avium subsp. paratuberculosis
gguguggccgcg

SEQ ID NO: 940928 - RNA, 16 nt, Mycobacterium avium subsp. paratuberculosis
ggugugggcgccguca

SEQ ID NO: 940929 - RNA, 12 nt, Mycobacterium avium subsp. paratuberculosis
gguguggcaggu

SEQ ID NO: 940930 - RNA, 16 nt, Mycobacterium avium subsp. paratuberculosis
ggugugacauccccgg

SEQ ID NO: 940931 - RNA, 19 nt, Mycobacterium avium subsp. paratuberculosis
ggugugaucgagcaccagc

SEQ ID NO: 940932 - RNA, 15 nt, Mycobacterium avium subsp. paratuberculosis
ggugugcaaggcgau

SEQ ID NO: 940933 - RNA, 13 nt, Mycobacterium avium subsp. paratuberculosis
ggugugcaccagc

SEQ ID NO: 940934 - RNA, 15 nt, Mycobacterium avium subsp. paratuberculosis
ggugugcaccagcga

SEQ ID NO: 940935 - RNA, 13 nt, Mycobacterium avium subsp. paratuberculosis
ggugugcccgcgg

SEQ ID NO: 940936 - RNA, 17 nt, Mycobacterium avium subsp. paratuberculosis
ggugugcccggcguugg

SEQ ID NO: 940937 - RNA, 13 nt, Mycobacterium avium subsp. paratuberculosis
ggugugccgaagg

SEQ ID NO: 940938 - RNA, 14 nt, Mycobacterium avium subsp. paratuberculosis
ggugugccgaaggg

SEQ ID NO: 940939 - RNA, 23 nt, Mycobacterium avium subsp. paratuberculosis
ggugugcagccacccgucgguga

SEQ ID NO: 940940 - RNA, 20 nt, Mycobacterium avium subsp. paratuberculosis
ggugugccgcugcauccgca

SEQ ID NO: 940941 - RNA, 19 nt, Mycobacterium avium subsp. paratuberculosis
gguucgaucuccucggcgu

SEQ ID NO: 940942 - RNA, 22 nt, Mycobacterium avium subsp. paratuberculosis
gguucgaucuccucggcguaga

SEQ ID NO: 940943 - RNA, 20 nt, Mycobacterium avium subsp. paratuberculosis
gguucgauaccguccgcgcc

SEQ ID NO: 940944 - RNA, 18 nt, Mycobacterium avium subsp. paratuberculosis
gguucgacagcgaaccga

SEQ ID NO: 940945 - RNA, 23 nt, Mycobacterium avium subsp. paratuberculosis
gguucgacgucacgacggucacg

SEQ ID NO: 940946 - RNA, 21 nt, Mycobacterium avium subsp. paratuberculosis
gguucgcccuccccggccagc

SEQ ID NO: 940947 - RNA, 14 nt, Mycobacterium avium subsp. paratuberculosis
gguuccggugucga

SEQ ID NO: 940948 - RNA, 13 nt, Mycobacterium avium subsp. paratuberculosis
gguuccucggcgu

SEQ ID NO: 940949 - RNA, 23 nt, Mycobacterium avium subsp. paratuberculosis
gguuccccccauacacgggccgu

SEQ ID NO: 940950 - RNA, 19 nt, Mycobacterium avium subsp. paratuberculosis
gguuccggcgugcagcacg

SEQ ID NO: 940951 - RNA, 20 nt, Mycobacterium avium subsp. paratuberculosis
gguucggcgacgcugguggc

SEQ ID NO: 940952 - RNA, 14 nt, Mycobacterium avium subsp. paratuberculosis
gguucggcgggccu

SEQ ID NO: 940953 - RNA, 22 nt, Mycobacterium avium subsp. paratuberculosis
gguucggccgcucgggugucgc

SEQ ID NO: 940954 - RNA, 18 nt, Mycobacterium avium subsp. paratuberculosis
gguucgcuggcggccagc

SEQ ID NO: 940955 - RNA, 19 nt, Mycobacterium avium subsp. paratuberculosis
gguucgggaaccuggccgu

SEQ ID NO: 940956 - RNA, 16 nt, Mycobacterium avium subsp. paratuberculosis
gguucgucaacgcccc

SEQ ID NO: 940957 - RNA, 22 nt, Mycobacterium avium subsp. paratuberculosis
gguucaccaguuucacgucggc

SEQ ID NO: 940958 - RNA, 15 nt, Mycobacterium avium subsp. paratuberculosis
gguucacccuggcga

SEQ ID NO: 940959 - RNA, 18 nt, Mycobacterium avium subsp. paratuberculosis
gguucacccuggcgaacc

SEQ ID NO: 940960 - RNA, 22 nt, Mycobacterium avium subsp. paratuberculosis
gguucacccuggcgaaccgcgg

SEQ ID NO: 940961 - RNA, 14 nt, Mycobacterium avium subsp. paratuberculosis
gguucaccgccacc

SEQ ID NO: 940962 - RNA, 18 nt, Mycobacterium avium subsp. paratuberculosis
gguucaccgccaccagca

SEQ ID NO: 940963 - RNA, 19 nt, Mycobacterium avium subsp. paratuberculosis
gguucaccgccaccagcag

SEQ ID NO: 940964 - RNA, 13 nt, Mycobacterium avium subsp. paratuberculosis
gguuagggcguca

SEQ ID NO: 940965 - RNA, 21 nt, Mycobacterium avium subsp. paratuberculosis
gguucauguggaagccgcgau

SEQ ID NO: 940966 - RNA, 15 nt, Mycobacterium avium subsp. paratuberculosis
gguuccacaccacca

SEQ ID NO: 940967 - RNA, 11 nt, Mycobacterium avium subsp. paratuberculosis
gguuccaccgg

SEQ ID NO: 940968 - RNA, 14 nt, Mycobacterium avium subsp. paratuberculosis
gguucagcccggcg

SEQ ID NO: 940969 - RNA, 12 nt, Mycobacterium avium subsp. paratuberculosis
gguagacccggg

SEQ ID NO: 940970 - RNA, 13 nt, Mycobacterium avium subsp. paratuberculosis
gguagacgccgga

SEQ ID NO: 940971 - RNA, 16 nt, Mycobacterium avium subsp. paratuberculosis
gguagacggcaugccg

SEQ ID NO: 940972 - RNA, 18 nt, Mycobacterium avium subsp. paratuberculosis
gguagacggcaugccggg

SEQ ID NO: 940973 - RNA, 20 nt, Mycobacterium avium subsp. paratuberculosis
gguagacggcaugccgggcc

SEQ ID NO: 940974 - RNA, 21 nt, Mycobacterium avium subsp. paratuberculosis
gguagacggcaugccgggcca

SEQ ID NO: 940975 - RNA, 20 nt, Mycobacterium avium subsp. paratuberculosis
gguagacgucgggcugggcg

SEQ ID NO: 940976 - RNA, 23 nt, Mycobacterium avium subsp. paratuberculosis
gguagacguucuccccgccggag

SEQ ID NO: 940977 - RNA, 14 nt, Mycobacterium avium subsp. paratuberculosis
gguagaggccgcgg

SEQ ID NO: 940978 - RNA, 16 nt, Mycobacterium avium subsp. paratuberculosis
gguagacgaucaccgg

SEQ ID NO: 940979 - RNA, 18 nt, Mycobacterium avium subsp. paratuberculosis
gguagacgaugcccagcc

SEQ ID NO: 940980 - RNA, 19 nt, Mycobacterium avium subsp. paratuberculosis
gguagccgccguucucgcg

SEQ ID NO: 940981 - RNA, 22 nt, Mycobacterium avium subsp. paratuberculosis
gguagccgccguucucgcgcag

SEQ ID NO: 940982 - RNA, 21 nt, Mycobacterium avium subsp. paratuberculosis
gguagcggcagauggucucga

SEQ ID NO: 940983 - RNA, 15 nt, Mycobacterium avium subsp. paratuberculosis
gguagcgcaucagcu

SEQ ID NO: 940984 - RNA, 15 nt, Mycobacterium avium subsp. paratuberculosis
gguagagcggcacca

SEQ ID NO: 940985 - RNA, 22 nt, Mycobacterium avium subsp. paratuberculosis
gguagccgccguagccggcggu

SEQ ID NO: 940986 - RNA, 22 nt, Mycobacterium avium subsp. paratuberculosis
gguagccgcucgcccagcgcgg

SEQ ID NO: 940987 - RNA, 22 nt, Mycobacterium avium subsp. paratuberculosis
gguagccggcccgcagccagcg

SEQ ID NO: 940988 - RNA, 13 nt, Mycobacterium avium subsp. paratuberculosis
gguacgcgccguc

SEQ ID NO: 940989 - RNA, 23 nt, Mycobacterium avium subsp. paratuberculosis
gguacgcgcaauccugcccgguc

SEQ ID NO: 940990 - RNA, 15 nt, Mycobacterium avium subsp. paratuberculosis
gguacgcggcguugc

SEQ ID NO: 940991 - RNA, 21 nt, Mycobacterium avium subsp. paratuberculosis
gguacgcggcguugccgccgg

SEQ ID NO: 940992 - RNA, 23 nt, Mycobacterium avium subsp. paratuberculosis
gguacgcggcguugccgccggcg

SEQ ID NO: 940993 - RNA, 15 nt, Mycobacterium avium subsp. paratuberculosis
gguacggcggccgcg

SEQ ID NO: 940994 - RNA, 20 nt, Mycobacterium avium subsp. paratuberculosis
gguacggcucaacggccggc

SEQ ID NO: 940995 - RNA, 19 nt, Mycobacterium avium subsp. paratuberculosis
gguacgccgcgagagugca

SEQ ID NO: 940996 - RNA, 14 nt, Mycobacterium avium subsp. paratuberculosis
gguacgcgacgggc

SEQ ID NO: 940997 - RNA, 15 nt, Mycobacterium avium subsp. paratuberculosis
gguacgcgacgggca

SEQ ID NO: 940998 - RNA, 20 nt, Mycobacterium avium subsp. paratuberculosis
gguacgcgacgggcaugccg

SEQ ID NO: 940999 - RNA, 22 nt, Mycobacterium avium subsp. paratuberculosis
gguacgcgacgggcaugccguc

SEQ ID NO: 941000 - RNA, 19 nt, Mycobacterium avium subsp. paratuberculosis
gguacggccgacgcccagc

SEQ ID NO: 941001 - RNA, 12 nt, Mycobacterium avium subsp. paratuberculosis
gguacgugcgcc

SEQ ID NO: 941002 - RNA, 19 nt, Mycobacterium avium subsp. paratuberculosis
gguacgugcgccggcggug

SEQ ID NO: 941003 - RNA, 18 nt, Mycobacterium avium subsp. paratuberculosis
gguacucggcggcgggca

SEQ ID NO: 941004 - RNA, 19 nt, Mycobacterium avium subsp. paratuberculosis
gguacucgagcgugcccgc

SEQ ID NO: 941005 - RNA, 20 nt, Mycobacterium avium subsp. paratuberculosis
gguacucgagcgugcccgcg

SEQ ID NO: 941006 - RNA, 22 nt, Mycobacterium avium subsp. paratuberculosis
gguacucgagcgugcccgcgcc

SEQ ID NO: 941007 - RNA, 18 nt, Mycobacterium avium subsp. paratuberculosis
gguacugggcguggucgc

SEQ ID NO: 941008 - RNA, 16 nt, Mycobacterium avium subsp. paratuberculosis
gguacugaucaccgcg

SEQ ID NO: 941009 - RNA, 18 nt, Mycobacterium avium subsp. paratuberculosis
gguacugaucaccgcgcu

SEQ ID NO: 941010 - RNA, 24 nt, Mycobacterium avium subsp. paratuberculosis
gguagaaccagcccggcccgucga

SEQ ID NO: 941011 - RNA, 14 nt, Mycobacterium avium subsp. paratuberculosis
gguagaagccgcga

SEQ ID NO: 941012 - RNA, 16 nt, Mycobacterium avium subsp. paratuberculosis
gguagaagccgcgacg

SEQ ID NO: 941013 - RNA, 18 nt, Mycobacterium avium subsp. paratuberculosis
gguacaucgacgcgaccg

SEQ ID NO: 941014 - RNA, 22 nt, Mycobacterium avium subsp. paratuberculosis
gguacaucguucccugcgcggc

SEQ ID NO: 941015 - RNA, 21 nt, Mycobacterium avium subsp. paratuberculosis
gguacagggucaucgcgccgg

SEQ ID NO: 941016 - RNA, 12 nt, Mycobacterium avium subsp. paratuberculosis
gguacaccggcu

SEQ ID NO: 941017 - RNA, 15 nt, Mycobacterium avium subsp. paratuberculosis
gguacagcaccgccg

SEQ ID NO: 941018 - RNA, 18 nt, Mycobacterium avium subsp. paratuberculosis
gguacagcaccgccgcgg

SEQ ID NO: 941019 - RNA, 14 nt, Mycobacterium avium subsp. paratuberculosis
gguacagcgccagc

SEQ ID NO: 941020 - RNA, 15 nt, Mycobacterium avium subsp. paratuberculosis
gguacagcgccgcgg

SEQ ID NO: 941021 - RNA, 20 nt, Mycobacterium avium subsp. paratuberculosis
gguacagcgccgcggccagc

SEQ ID NO: 941022 - RNA, 23 nt, Mycobacterium avium subsp. paratuberculosis
ggguuuuugauugcgcggcgccg

SEQ ID NO: 941023 - RNA, 15 nt, Mycobacterium avium subsp. paratuberculosis
ggguuuucgggccgg

SEQ ID NO: 941024 - RNA, 20 nt, Mycobacterium avium subsp. paratuberculosis
ggguucaacuccucgaagag

SEQ ID NO: 941025 - RNA, 12 nt, Mycobacterium avium subsp. paratuberculosis
ggguugggcgcc

SEQ ID NO: 941026 - RNA, 13 nt, Mycobacterium avium subsp. paratuberculosis
ggguuggucggcg

SEQ ID NO: 941027 - RNA, 14 nt, Mycobacterium avium subsp. paratuberculosis
ggguguucaccgcg

SEQ ID NO: 941028 - RNA, 15 nt, Mycobacterium avium subsp. paratuberculosis
ggguguucaccgcgc

SEQ ID NO: 941029 - RNA, 14 nt, Mycobacterium avium subsp. paratuberculosis
ggguguuggacgag

SEQ ID NO: 941030 - RNA, 18 nt, Mycobacterium avium subsp. paratuberculosis
ggguguuguccgagccgc

SEQ ID NO: 941031 - RNA, 12 nt, Mycobacterium avium subsp. paratuberculosis
ggguuucgugaa

SEQ ID NO: 941032 - RNA, 22 nt, Mycobacterium avium subsp. paratuberculosis
ggguuguucuccagcggccgca

SEQ ID NO: 941033 - RNA, 19 nt, Mycobacterium avium subsp. paratuberculosis
ggguuguagaacgacgaca

SEQ ID NO: 941034 - RNA, 19 nt, Mycobacterium avium subsp. paratuberculosis
ggguuguagcaggcggugg

SEQ ID NO: 941035 - RNA, 13 nt, Mycobacterium avium subsp. paratuberculosis
ggguggacaccgc

SEQ ID NO: 941036 - RNA, 15 nt, Mycobacterium avium subsp. paratuberculosis
ggguggacaccgcga

SEQ ID NO: 941037 - RNA, 17 nt, Mycobacterium avium subsp. paratuberculosis
ggguggccagcaccagc

SEQ ID NO: 941038 - RNA, 22 nt, Mycobacterium avium subsp. paratuberculosis
ggguggccagcuucaccggucg

SEQ ID NO: 941039 - RNA, 16 nt, Mycobacterium avium subsp. paratuberculosis
ggguggccccagcccg

SEQ ID NO: 941040 - RNA, 12 nt, Mycobacterium avium subsp. paratuberculosis
ggguggcccgca

SEQ ID NO: 941041 - RNA, 13 nt, Mycobacterium avium subsp. paratuberculosis
gggugcucgaucg

SEQ ID NO: 941042 - RNA, 19 nt, Mycobacterium avium subsp. paratuberculosis
gggugcucaccccggccag

SEQ ID NO: 941043 - RNA, 18 nt, Mycobacterium avium subsp. paratuberculosis
gggugcgguugagcacca

SEQ ID NO: 941044 - RNA, 19 nt, Mycobacterium avium subsp. paratuberculosis
gggugcgguugagcaccag

SEQ ID NO: 941045 - RNA, 23 nt, Mycobacterium avium subsp. paratuberculosis
gggugcgguugagcaccagcccg

SEQ ID NO: 941046 - RNA, 21 nt, Mycobacterium avium subsp. paratuberculosis
gggugcguccagaccggccgg

SEQ ID NO: 941047 - RNA, 12 nt, Mycobacterium avium subsp. paratuberculosis
gggugcucccgc

SEQ ID NO: 941048 - RNA, 14 nt, Mycobacterium avium subsp. paratuberculosis
gggugcuggucagc

SEQ ID NO: 941049 - RNA, 20 nt, Mycobacterium avium subsp. paratuberculosis
gggugcuuuugugucugcuc

SEQ ID NO: 941050 - RNA, 19 nt, Mycobacterium avium subsp. paratuberculosis
ggguggcgccggccagcac

SEQ ID NO: 941051 - RNA, 22 nt, Mycobacterium avium subsp. paratuberculosis
ggguggcgccggccagcaccac

SEQ ID NO: 941052 - RNA, 19 nt, Mycobacterium avium subsp. paratuberculosis
ggguggccgccacguccgg

SEQ ID NO: 941053 - RNA, 14 nt, Mycobacterium avium subsp. paratuberculosis
ggguggccggccag

SEQ ID NO: 941054 - RNA, 15 nt, Mycobacterium avium subsp. paratuberculosis
ggguggccggccagc

SEQ ID NO: 941055 - RNA, 20 nt, Mycobacterium avium subsp. paratuberculosis
ggguggccucgucggcgccg

SEQ ID NO: 941056 - RNA, 14 nt, Mycobacterium avium subsp. paratuberculosis
gggugucagcgcga

SEQ ID NO: 941057 - RNA, 20 nt, Mycobacterium avium subsp. paratuberculosis
gggugucagcgcgaccucgg

SEQ ID NO: 941058 - RNA, 19 nt, Mycobacterium avium subsp. paratuberculosis
gggugucccagcgccacug

SEQ ID NO: 941059 - RNA, 12 nt, Mycobacterium avium subsp. paratuberculosis
gggugucgacgc

SEQ ID NO: 941060 - RNA, 12 nt, Mycobacterium avium subsp. paratuberculosis
gggugucgagcc

SEQ ID NO: 941061 - RNA, 23 nt, Mycobacterium avium subsp. paratuberculosis
gggugucgagccaccacugcgcc

SEQ ID NO: 941062 - RNA, 12 nt, Mycobacterium avium subsp. paratuberculosis
gggugucgauga

SEQ ID NO: 941063 - RNA, 17 nt, Mycobacterium avium subsp. paratuberculosis
gggugucgcggcugcgc

SEQ ID NO: 941064 - RNA, 17 nt, Mycobacterium avium subsp. paratuberculosis
ggguggcgaucaccgcg

SEQ ID NO: 941065 - RNA, 18 nt, Mycobacterium avium subsp. paratuberculosis
ggguggcgaucaccgcgg

SEQ ID NO: 941066 - RNA, 23 nt, Mycobacterium avium subsp. paratuberculosis
ggguguauucgcccaccccggcg

SEQ ID NO: 941067 - RNA, 13 nt, Mycobacterium avium subsp. paratuberculosis
gggugucggcggg

SEQ ID NO: 941068 - RNA, 15 nt, Mycobacterium avium subsp. paratuberculosis
gggugucgucgcgca

SEQ ID NO: 941069 - RNA, 21 nt, Mycobacterium avium subsp. paratuberculosis
gggugucgucgcgcacccagc

SEQ ID NO: 941070 - RNA, 17 nt, Mycobacterium avium subsp. paratuberculosis
gggugugcggcacggcg

SEQ ID NO: 941071 - RNA, 18 nt, Mycobacterium avium subsp. paratuberculosis
gggugugcucggcggcgc

SEQ ID NO: 941072 - RNA, 14 nt, Mycobacterium avium subsp. paratuberculosis
ggguguggcgucga

SEQ ID NO: 941073 - RNA, 18 nt, Mycobacterium avium subsp. paratuberculosis
ggguguggcgucgaugcc

SEQ ID NO: 941074 - RNA, 18 nt, Mycobacterium avium subsp. paratuberculosis
gggugcgaacagccacgg

SEQ ID NO: 941075 - RNA, 15 nt, Mycobacterium avium subsp. paratuberculosis
gggugcgcggcgccg

SEQ ID NO: 941076 - RNA, 15 nt, Mycobacterium avium subsp. paratuberculosis
gggugcgcgucgcgg

SEQ ID NO: 941077 - RNA, 16 nt, Mycobacterium avium subsp. paratuberculosis
gggugcgcucaccgca

SEQ ID NO: 941078 - RNA, 23 nt, Mycobacterium avium subsp. paratuberculosis
gggugcgcucaccgcaucgaacc

SEQ ID NO: 941079 - RNA, 15 nt, Mycobacterium avium subsp. paratuberculosis
gggugcggccagcgc

SEQ ID NO: 941080 - RNA, 13 nt, Mycobacterium avium subsp. paratuberculosis
gggugcggccggu

SEQ ID NO: 941081 - RNA, 16 nt, Mycobacterium avium subsp. paratuberculosis
gggugcgggcugcacc

SEQ ID NO: 941082 - RNA, 21 nt, Mycobacterium avium subsp. paratuberculosis
gggugccggccaccggcgcga

SEQ ID NO: 941083 - RNA, 14 nt, Mycobacterium avium subsp. paratuberculosis
gggugcccaccagc

SEQ ID NO: 941084 - RNA, 20 nt, Mycobacterium avium subsp. paratuberculosis
gggugccgcagcggcggcac

SEQ ID NO: 941085 - RNA, 22 nt, Mycobacterium avium subsp. paratuberculosis
gggugccgcagcggcggcacgg

SEQ ID NO: 941086 - RNA, 15 nt, Mycobacterium avium subsp. paratuberculosis
gggugccgcccaacg

SEQ ID NO: 941087 - RNA, 22 nt, Mycobacterium avium subsp. paratuberculosis
gggugccgcccaacgacgucgg

SEQ ID NO: 941088 - RNA, 12 nt, Mycobacterium avium subsp. paratuberculosis
gggugccgccgc

SEQ ID NO: 941089 - RNA, 12 nt, Mycobacterium avium subsp. paratuberculosis
gggugccgcggu

SEQ ID NO: 941090 - RNA, 23 nt, Mycobacterium avium subsp. paratuberculosis
gggugccgcguuccccggcgugg

SEQ ID NO: 941091 - RNA, 19 nt, Mycobacterium avium subsp. paratuberculosis
gggugccgcugcccgccgc

SEQ ID NO: 941092 - RNA, 15 nt, Mycobacterium avium subsp. paratuberculosis
gggugaucugcgccg

SEQ ID NO: 941093 - RNA, 22 nt, Mycobacterium avium subsp. paratuberculosis
gggugaugcgucccguuggcgc

SEQ ID NO: 941094 - RNA, 17 nt, Mycobacterium avium subsp. paratuberculosis
gggugauggccgccgca

SEQ ID NO: 941095 - RNA, 18 nt, Mycobacterium avium subsp. paratuberculosis
gggugaugucgccgacca

SEQ ID NO: 941096 - RNA, 16 nt, Mycobacterium avium subsp. paratuberculosis
gggugaugucgcugcc

SEQ ID NO: 941097 - RNA, 18 nt, Mycobacterium avium subsp. paratuberculosis
gggugauaccggcccagc

SEQ ID NO: 941098 - RNA, 20 nt, Mycobacterium avium subsp. paratuberculosis
gggugaucccgaugccgcgc

SEQ ID NO: 941099 - RNA, 16 nt, Mycobacterium avium subsp. paratuberculosis
gggugcagcaccacga

SEQ ID NO: 941100 - RNA, 12 nt, Mycobacterium avium subsp. paratuberculosis
gggugccagccg

SEQ ID NO: 941101 - RNA, 18 nt, Mycobacterium avium subsp. paratuberculosis
gggugccccgcaccgcca

SEQ ID NO: 941102 - RNA, 15 nt, Mycobacterium avium subsp. paratuberculosis
gggugccccgcgacc

SEQ ID NO: 941103 - RNA, 16 nt, Mycobacterium avium subsp. paratuberculosis
gggugccccgcgaccg

SEQ ID NO: 941104 - RNA, 12 nt, Mycobacterium avium subsp. paratuberculosis
gggugcccggcg

SEQ ID NO: 941105 - RNA, 20 nt, Mycobacterium avium subsp. paratuberculosis
gggugcccggcugggcgcgc

SEQ ID NO: 941106 - RNA, 14 nt, Mycobacterium avium subsp. paratuberculosis
gggugcccgggccg

SEQ ID NO: 941107 - RNA, 15 nt, Mycobacterium avium subsp. paratuberculosis
gggugcccgggccgc

SEQ ID NO: 941108 - RNA, 20 nt, Mycobacterium avium subsp. paratuberculosis
gggugcccuuuacccggacg

SEQ ID NO: 941109 - RNA, 14 nt, Mycobacterium avium subsp. paratuberculosis
gggugccgaccgcg

SEQ ID NO: 941110 - RNA, 15 nt, Mycobacterium avium subsp. paratuberculosis
gggugccgacgagcu

SEQ ID NO: 941111 - RNA, 14 nt, Mycobacterium avium subsp. paratuberculosis
gggucuucucgaag

SEQ ID NO: 941112 - RNA, 18 nt, Mycobacterium avium subsp. paratuberculosis
gggucuucagcccgcgca

SEQ ID NO: 941113 - RNA, 16 nt, Mycobacterium avium subsp. paratuberculosis
gggucuggcccggugc

SEQ ID NO: 941114 - RNA, 15 nt, Mycobacterium avium subsp. paratuberculosis
gggugaacgaggccg

SEQ ID NO: 941115 - RNA, 22 nt, Mycobacterium avium subsp. paratuberculosis
gggugaaggccuggaugccgcc

SEQ ID NO: 941116 - RNA, 15 nt, Mycobacterium avium subsp. paratuberculosis
gggugaaggcggcca

SEQ ID NO: 941117 - RNA, 17 nt, Mycobacterium avium subsp. paratuberculosis
gggugaaggcggccacc

SEQ ID NO: 941118 - RNA, 18 nt, Mycobacterium avium subsp. paratuberculosis
gggugacccggccguugg

SEQ ID NO: 941119 - RNA, 15 nt, Mycobacterium avium subsp. paratuberculosis
gggugaccgacagca

SEQ ID NO: 941120 - RNA, 22 nt, Mycobacterium avium subsp. paratuberculosis
gggugaccgagucgucgcgcac

SEQ ID NO: 941121 - RNA, 20 nt, Mycobacterium avium subsp. paratuberculosis
gggugaccgccuuggcgcgc

SEQ ID NO: 941122 - RNA, 16 nt, Mycobacterium avium subsp. paratuberculosis
gggugaccggcgccgg

SEQ ID NO: 941123 - RNA, 15 nt, Mycobacterium avium subsp. paratuberculosis
gggugaccggcgcgc

SEQ ID NO: 941124 - RNA, 18 nt, Mycobacterium avium subsp. paratuberculosis
gggugaccggcgcgcagc

SEQ ID NO: 941125 - RNA, 16 nt, Mycobacterium avium subsp. paratuberculosis
gggugaccggcggcca

SEQ ID NO: 941126 - RNA, 22 nt, Mycobacterium avium subsp. paratuberculosis
gggugaccggcggccagcgagg

SEQ ID NO: 941127 - RNA, 22 nt, Mycobacterium avium subsp. paratuberculosis
gggugaaucaccaagcgcgaca

SEQ ID NO: 941128 - RNA, 14 nt, Mycobacterium avium subsp. paratuberculosis
gggugacgaccaug

SEQ ID NO: 941129 - RNA, 19 nt, Mycobacterium avium subsp. paratuberculosis
gggugacgcccgucccgcc

SEQ ID NO: 941130 - RNA, 18 nt, Mycobacterium avium subsp. paratuberculosis
gggugacggucacgguga

SEQ ID NO: 941131 - RNA, 21 nt, Mycobacterium avium subsp. paratuberculosis
gggugacgguggcguccucga

SEQ ID NO: 941132 - RNA, 21 nt, Mycobacterium avium subsp. paratuberculosis
gggugacgucguugaccgagg

SEQ ID NO: 941133 - RNA, 23 nt, Mycobacterium avium subsp. paratuberculosis
gggugacuucgagccgggcgcgg

SEQ ID NO: 941134 - RNA, 16 nt, Mycobacterium avium subsp. paratuberculosis
gggugacuucgaugua

SEQ ID NO: 941135 - RNA, 18 nt, Mycobacterium avium subsp. paratuberculosis
gggugagacggccagcag

SEQ ID NO: 941136 - RNA, 19 nt, Mycobacterium avium subsp. paratuberculosis
gggugagacggccagcagc

SEQ ID NO: 941137 - RNA, 14 nt, Mycobacterium avium subsp. paratuberculosis
gggugagcaccgcg

SEQ ID NO: 941138 - RNA, 17 nt, Mycobacterium avium subsp. paratuberculosis
gggugagcaccgcgacc

SEQ ID NO: 941139 - RNA, 20 nt, Mycobacterium avium subsp. paratuberculosis
gggugagcaccgcgaccagc

SEQ ID NO: 941140 - RNA, 22 nt, Mycobacterium avium subsp. paratuberculosis
gggugagcagggccagcggcaa

SEQ ID NO: 941141 - RNA, 14 nt, Mycobacterium avium subsp. paratuberculosis
gggugagccggucg

SEQ ID NO: 941142 - RNA, 20 nt, Mycobacterium avium subsp. paratuberculosis
gggugagccggucgaacgcc

SEQ ID NO: 941143 - RNA, 14 nt, Mycobacterium avium subsp. paratuberculosis
gggugagcgacacc

SEQ ID NO: 941144 - RNA, 22 nt, Mycobacterium avium subsp. paratuberculosis
gggugaggcacccgcugcacca

SEQ ID NO: 941145 - RNA, 19 nt, Mycobacterium avium subsp. paratuberculosis
gggucugccacgcccaccg

SEQ ID NO: 941146 - RNA, 14 nt, Mycobacterium avium subsp. paratuberculosis
gggucucgcgccac

SEQ ID NO: 941147 - RNA, 18 nt, Mycobacterium avium subsp. paratuberculosis
gggucgugcggcggcggu

SEQ ID NO: 941148 - RNA, 18 nt, Mycobacterium avium subsp. paratuberculosis
gggucguucagcugaacg

SEQ ID NO: 941149 - RNA, 16 nt, Mycobacterium avium subsp. paratuberculosis
gggucguugcacacca

SEQ ID NO: 941150 - RNA, 17 nt, Mycobacterium avium subsp. paratuberculosis
gggucguuggcggcggu

SEQ ID NO: 941151 - RNA, 15 nt, Mycobacterium avium subsp. paratuberculosis
gggucgucgggccgg

SEQ ID NO: 941152 - RNA, 14 nt, Mycobacterium avium subsp. paratuberculosis
gggucgucgggcgg

SEQ ID NO: 941153 - RNA, 19 nt, Mycobacterium avium subsp. paratuberculosis
gggucgucgggcggcagga

SEQ ID NO: 941154 - RNA, 12 nt, Mycobacterium avium subsp. paratuberculosis
gggucgucgcgg

SEQ ID NO: 941155 - RNA, 17 nt, Mycobacterium avium subsp. paratuberculosis
gggucguaccaccacca

SEQ ID NO: 941156 - RNA, 16 nt, Mycobacterium avium subsp. paratuberculosis
gggucguagagcgcga

SEQ ID NO: 941157 - RNA, 17 nt, Mycobacterium avium subsp. paratuberculosis
gggucguagccgaagcc

SEQ ID NO: 941158 - RNA, 22 nt, Mycobacterium avium subsp. paratuberculosis
gggucguagccgaagccgccgu

SEQ ID NO: 941159 - RNA, 19 nt, Mycobacterium avium subsp. paratuberculosis
gggucguaggacaccacgg

SEQ ID NO: 941160 - RNA, 17 nt, Mycobacterium avium subsp. paratuberculosis
gggucgucgacggccgc

SEQ ID NO: 941161 - RNA, 20 nt, Mycobacterium avium subsp. paratuberculosis
gggucggcgcccucggcgau

SEQ ID NO: 941162 - RNA, 17 nt, Mycobacterium avium subsp. paratuberculosis
gggucggcgccggccag

SEQ ID NO: 941163 - RNA, 14 nt, Mycobacterium avium subsp. paratuberculosis
gggucggcgucggg

SEQ ID NO: 941164 - RNA, 22 nt, Mycobacterium avium subsp. paratuberculosis
gggucggcgucgggccgggggc

SEQ ID NO: 941165 - RNA, 22 nt, Mycobacterium avium subsp. paratuberculosis
gggucgguggcccagccggccg

SEQ ID NO: 941166 - RNA, 23 nt, Mycobacterium avium subsp. paratuberculosis
gggucggagcaaauccggcagcg

SEQ ID NO: 941167 - RNA, 19 nt, Mycobacterium avium subsp. paratuberculosis
gggucggagcgcuccacca

SEQ ID NO: 941168 - RNA, 12 nt, Mycobacterium avium subsp. paratuberculosis
gggucggccagc

SEQ ID NO: 941169 - RNA, 14 nt, Mycobacterium avium subsp. paratuberculosis
gggucggccagcga

SEQ ID NO: 941170 - RNA, 14 nt, Mycobacterium avium subsp. paratuberculosis
gggucggccagucg

SEQ ID NO: 941171 - RNA, 14 nt, Mycobacterium avium subsp. paratuberculosis
gggucggccggcgg

SEQ ID NO: 941172 - RNA, 16 nt, Mycobacterium avium subsp. paratuberculosis
gggguuucgugugcuc

SEQ ID NO: 941173 - RNA, 18 nt, Mycobacterium avium subsp. paratuberculosis
gggguuuugaucagcccg

SEQ ID NO: 941174 - RNA, 16 nt, Mycobacterium avium subsp. paratuberculosis
ggguaacccuccggcg

SEQ ID NO: 941175 - RNA, 14 nt, Mycobacterium avium subsp. paratuberculosis
gggguguucaccgc

SEQ ID NO: 941176 - RNA, 16 nt, Mycobacterium avium subsp. paratuberculosis
gggguucccggccggu

SEQ ID NO: 941177 - RNA, 14 nt, Mycobacterium avium subsp. paratuberculosis
gggguugacccggc

SEQ ID NO: 941178 - RNA, 19 nt, Mycobacterium avium subsp. paratuberculosis
gggguugacccggccgguc

SEQ ID NO: 941179 - RNA, 22 nt, Mycobacterium avium subsp. paratuberculosis
gggguuggagaagaucuucucg

SEQ ID NO: 941180 - RNA, 15 nt, Mycobacterium avium subsp. paratuberculosis
ggguacucggcggcg

SEQ ID NO: 941181 - RNA, 23 nt, Mycobacterium avium subsp. paratuberculosis
ggguagaaccagcccggcccguc

SEQ ID NO: 941182 - RNA, 22 nt, Mycobacterium avium subsp. paratuberculosis
ggguagacguucuccccgccgg

SEQ ID NO: 941183 - RNA, 15 nt, Mycobacterium avium subsp. paratuberculosis
ggguagcgccgccgg

SEQ ID NO: 941184 - RNA, 15 nt, Mycobacterium avium subsp. paratuberculosis
ggguaccucugcgcg

SEQ ID NO: 941185 - RNA, 14 nt, Mycobacterium avium subsp. paratuberculosis
ggguaccacuugaa

SEQ ID NO: 941186 - RNA, 19 nt, Mycobacterium avium subsp. paratuberculosis
ggguagggcggcgggguuc

SEQ ID NO: 941187 - RNA, 17 nt, Mycobacterium avium subsp. paratuberculosis
ggguaguucuugacgcc

SEQ ID NO: 941188 - RNA, 16 nt, Mycobacterium avium subsp. paratuberculosis
gggucagccggccugc

SEQ ID NO: 941189 - RNA, 15 nt, Mycobacterium avium subsp. paratuberculosis
gggucagcgacaacg

SEQ ID NO: 941190 - RNA, 13 nt, Mycobacterium avium subsp. paratuberculosis
gggucagcgaggc

SEQ ID NO: 941191 - RNA, 17 nt, Mycobacterium avium subsp. paratuberculosis
gggucagccacgggcgg

SEQ ID NO: 941192 - RNA, 22 nt, Mycobacterium avium subsp. paratuberculosis
gggucacucgaccuucgagccg

SEQ ID NO: 941193 - RNA, 22 nt, Mycobacterium avium subsp. paratuberculosis
gggucagcagcgucugcgccag

SEQ ID NO: 941194 - RNA, 20 nt, Mycobacterium avium subsp. paratuberculosis
gggucaagauaccggccggc

SEQ ID NO: 941195 - RNA, 15 nt, Mycobacterium avium subsp. paratuberculosis
gggucaccuuggccg

SEQ ID NO: 941196 - RNA, 20 nt, Mycobacterium avium subsp. paratuberculosis
gggucaccuuggccggaucg

SEQ ID NO: 941197 - RNA, 23 nt, Mycobacterium avium subsp. paratuberculosis
gggucacgaacuccuugacccgg

SEQ ID NO: 941198 - RNA, 18 nt, Mycobacterium avium subsp. paratuberculosis
gggucacggucaggccgg

SEQ ID NO: 941199 - RNA, 14 nt, Mycobacterium avium subsp. paratuberculosis
gggucagaccgcgg

SEQ ID NO: 941200 - RNA, 23 nt, Mycobacterium avium subsp. paratuberculosis
gggucagaccgcggcggucgcca

SEQ ID NO: 941201 - RNA, 15 nt, Mycobacterium avium subsp. paratuberculosis
gggucagcaccacca

SEQ ID NO: 941202 - RNA, 14 nt, Mycobacterium avium subsp. paratuberculosis
gggucagcagcacc

SEQ ID NO: 941203 - RNA, 15 nt, Mycobacterium avium subsp. paratuberculosis
gggucgaucucggcg

SEQ ID NO: 941204 - RNA, 17 nt, Mycobacterium avium subsp. paratuberculosis
gggucgaucucggcgca

SEQ ID NO: 941205 - RNA, 23 nt, Mycobacterium avium subsp. paratuberculosis
ggguccucgauggcggcggcugc

SEQ ID NO: 941206 - RNA, 13 nt, Mycobacterium avium subsp. paratuberculosis
gggucgacgagca

SEQ ID NO: 941207 - RNA, 17 nt, Mycobacterium avium subsp. paratuberculosis
gggucgcacgccgguag

SEQ ID NO: 941208 - RNA, 17 nt, Mycobacterium avium subsp. paratuberculosis
gggucgcagcggcacgu

SEQ ID NO: 941209 - RNA, 18 nt, Mycobacterium avium subsp. paratuberculosis
gggucgccaggccaccgc

SEQ ID NO: 941210 - RNA, 15 nt, Mycobacterium avium subsp. paratuberculosis
gggucgccgggcagg

SEQ ID NO: 941211 - RNA, 12 nt, Mycobacterium avium subsp. paratuberculosis
gggucgccgggu

SEQ ID NO: 941212 - RNA, 15 nt, Mycobacterium avium subsp. paratuberculosis
gggucgccgucgagg

SEQ ID NO: 941213 - RNA, 15 nt, Mycobacterium avium subsp. paratuberculosis
gggucgcgccgguag

SEQ ID NO: 941214 - RNA, 16 nt, Mycobacterium avium subsp. paratuberculosis
gggucgcgcgcgaaca

SEQ ID NO: 941215 - RNA, 21 nt, Mycobacterium avium subsp. paratuberculosis
gggucgccgaucucggccaac

SEQ ID NO: 941216 - RNA, 18 nt, Mycobacterium avium subsp. paratuberculosis
gggucgcguccgcgaucg

SEQ ID NO: 941217 - RNA, 16 nt, Mycobacterium avium subsp. paratuberculosis
ggguccggucagcacc

SEQ ID NO: 941218 - RNA, 19 nt, Mycobacterium avium subsp. paratuberculosis
ggguccggucagcaccgcg

SEQ ID NO: 941219 - RNA, 17 nt, Mycobacterium avium subsp. paratuberculosis
gggucgaacaucacccg

SEQ ID NO: 941220 - RNA, 22 nt, Mycobacterium avium subsp. paratuberculosis
gggucgaacaucacccggcggc

SEQ ID NO: 941221 - RNA, 23 nt, Mycobacterium avium subsp. paratuberculosis
gggucgaacaucacccggcggca

SEQ ID NO: 941222 - RNA, 23 nt, Mycobacterium avium subsp. paratuberculosis
gggucgaacggcaaccugggcgg

SEQ ID NO: 941223 - RNA, 18 nt, Mycobacterium avium subsp. paratuberculosis
gggucgaaguccugcgcc

SEQ ID NO: 941224 - RNA, 23 nt, Mycobacterium avium subsp. paratuberculosis
gggucgaaguccugcgccgcggu

SEQ ID NO: 941225 - RNA, 16 nt, Mycobacterium avium subsp. paratuberculosis
gggucgacagccugac

SEQ ID NO: 941226 - RNA, 18 nt, Mycobacterium avium subsp. paratuberculosis
gggucgaccgccgcgucg

SEQ ID NO: 941227 - RNA, 11 nt, Mycobacterium avium subsp. paratuberculosis
gggucgacgag

SEQ ID NO: 941228 - RNA, 19 nt, Mycobacterium avium subsp. paratuberculosis
gggucgagaagcccgugcg

SEQ ID NO: 941229 - RNA, 19 nt, Mycobacterium avium subsp. paratuberculosis
gggucgagacaccgucgcg

SEQ ID NO: 941230 - RNA, 21 nt, Mycobacterium avium subsp. paratuberculosis
gggucgagacaccgucgcgca

SEQ ID NO: 941231 - RNA, 17 nt, Mycobacterium avium subsp. paratuberculosis
gggucgagaucagcacc

SEQ ID NO: 941232 - RNA, 15 nt, Mycobacterium avium subsp. paratuberculosis
gggucgagcacgugg

SEQ ID NO: 941233 - RNA, 12 nt, Mycobacterium avium subsp. paratuberculosis
gggucgagcagc

SEQ ID NO: 941234 - RNA, 17 nt, Mycobacterium avium subsp. paratuberculosis
ggguccagccgccggcg

SEQ ID NO: 941235 - RNA, 13 nt, Mycobacterium avium subsp. paratuberculosis
ggguccaccggcc

SEQ ID NO: 941236 - RNA, 14 nt, Mycobacterium avium subsp. paratuberculosis
ggguccaccggccg

SEQ ID NO: 941237 - RNA, 15 nt, Mycobacterium avium subsp. paratuberculosis
ggguccaccggccga

SEQ ID NO: 941238 - RNA, 20 nt, Mycobacterium avium subsp. paratuberculosis
gggucaucagugaccgcacg

SEQ ID NO: 941239 - RNA, 22 nt, Mycobacterium avium subsp. paratuberculosis
gggucaggucgaagcccgccgu

SEQ ID NO: 941240 - RNA, 23 nt, Mycobacterium avium subsp. paratuberculosis
gggucagcuuggagccgagcacc

SEQ ID NO: 941241 - RNA, 21 nt, Mycobacterium avium subsp. paratuberculosis
gggucaggaacaccgagccgg

SEQ ID NO: 941242 - RNA, 16 nt, Mycobacterium avium subsp. paratuberculosis
ggguccaggccgcgcc

SEQ ID NO: 941243 - RNA, 18 nt, Mycobacterium avium subsp. paratuberculosis
ggguccaggccgcgccgg

SEQ ID NO: 941244 - RNA, 21 nt, Mycobacterium avium subsp. paratuberculosis
ggguccagggcgggucgucga

SEQ ID NO: 941245 - RNA, 19 nt, Mycobacterium avium subsp. paratuberculosis
gggucccaauccucgccga

SEQ ID NO: 941246 - RNA, 20 nt, Mycobacterium avium subsp. paratuberculosis
gggucccaggugggcgcgca

SEQ ID NO: 941247 - RNA, 14 nt, Mycobacterium avium subsp. paratuberculosis
gggucccccgccga

SEQ ID NO: 941248 - RNA, 16 nt, Mycobacterium avium subsp. paratuberculosis
gggucccccgccgacc

SEQ ID NO: 941249 - RNA, 13 nt, Mycobacterium avium subsp. paratuberculosis
ggguccccgccgc

SEQ ID NO: 941250 - RNA, 16 nt, Mycobacterium avium subsp. paratuberculosis
ggguccccgccgccgu

SEQ ID NO: 941251 - RNA, 20 nt, Mycobacterium avium subsp. paratuberculosis
gggucccggcaacaccggcg

SEQ ID NO: 941252 - RNA, 14 nt, Mycobacterium avium subsp. paratuberculosis
ggguccgaccagca

SEQ ID NO: 941253 - RNA, 19 nt, Mycobacterium avium subsp. paratuberculosis
ggguccgaccagcacccgg

SEQ ID NO: 941254 - RNA, 21 nt, Mycobacterium avium subsp. paratuberculosis
ggguccgaccagcacccgggc

SEQ ID NO: 941255 - RNA, 21 nt, Mycobacterium avium subsp. paratuberculosis
ggguccgcaacgccggcgugc

SEQ ID NO: 941256 - RNA, 21 nt, Mycobacterium avium subsp. paratuberculosis
ggguccgcacccgggcccggu

SEQ ID NO: 941257 - RNA, 23 nt, Mycobacterium avium subsp. paratuberculosis
ggguccgcacccgggcccggucg

SEQ ID NO: 941258 - RNA, 14 nt, Mycobacterium avium subsp. paratuberculosis
ggguccgcaggcga

SEQ ID NO: 941259 - RNA, 22 nt, Mycobacterium avium subsp. paratuberculosis
ggguccggaagcccuugcagca

SEQ ID NO: 941260 - RNA, 15 nt, Mycobacterium avium subsp. paratuberculosis
gggaacucggccagc

SEQ ID NO: 941261 - RNA, 18 nt, Mycobacterium avium subsp. paratuberculosis
gggaagagcggcgugacc

SEQ ID NO: 941262 - RNA, 22 nt, Mycobacterium avium subsp. paratuberculosis
gggaagcgaagcgggacugcag

SEQ ID NO: 941263 - RNA, 14 nt, Mycobacterium avium subsp. paratuberculosis
gggaagcccaccgc

SEQ ID NO: 941264 - RNA, 21 nt, Mycobacterium avium subsp. paratuberculosis
gggaagcccaccgcggugacc

SEQ ID NO: 941265 - RNA, 13 nt, Mycobacterium avium subsp. paratuberculosis
gggaaggcggccg

SEQ ID NO: 941266 - RNA, 14 nt, Mycobacterium avium subsp. paratuberculosis
gggacacggcggcg

SEQ ID NO: 941267 - RNA, 14 nt, Mycobacterium avium subsp. paratuberculosis
gggacagcaccacc

SEQ ID NO: 941268 - RNA, 16 nt, Mycobacterium avium subsp. paratuberculosis
gggacagcaccaccag

SEQ ID NO: 941269 - RNA, 17 nt, Mycobacterium avium subsp. paratuberculosis
gggacagccgcgccgac

SEQ ID NO: 941270 - RNA, 16 nt, Mycobacterium avium subsp. paratuberculosis
gggacagccggucgac

SEQ ID NO: 941271 - RNA, 19 nt, Mycobacterium avium subsp. paratuberculosis
gggacagccggucgacgaa

SEQ ID NO: 941272 - RNA, 13 nt, Mycobacterium avium subsp. paratuberculosis
gggacaucgucgc

SEQ ID NO: 941273 - RNA, 15 nt, Mycobacterium avium subsp. paratuberculosis
gggacaucgucgcgc

SEQ ID NO: 941274 - RNA, 21 nt, Mycobacterium avium subsp. paratuberculosis
gggacaugccgagcagcaccg

SEQ ID NO: 941275 - RNA, 16 nt, Mycobacterium avium subsp. paratuberculosis
ggggcaagcagcggca

SEQ ID NO: 941276 - RNA, 20 nt, Mycobacterium avium subsp. paratuberculosis
ggggcaagcagcggcagcca

SEQ ID NO: 941277 - RNA, 21 nt, Mycobacterium avium subsp. paratuberculosis
ggggcagcugauagcccgccg

SEQ ID NO: 941278 - RNA, 21 nt, Mycobacterium avium subsp. paratuberculosis
ggggcaggaacgccuuggugc

SEQ ID NO: 941279 - RNA, 14 nt, Mycobacterium avium subsp. paratuberculosis
gggacccgcaccgg

SEQ ID NO: 941280 - RNA, 15 nt, Mycobacterium avium subsp. paratuberculosis
ggggcagaucgucgg

SEQ ID NO: 941281 - RNA, 14 nt, Mycobacterium avium subsp. paratuberculosis
ggggcagcaccucg

SEQ ID NO: 941282 - RNA, 23 nt, Mycobacterium avium subsp. paratuberculosis
ggggccccaaccccccuuggcgg

SEQ ID NO: 941283 - RNA, 16 nt, Mycobacterium avium subsp. paratuberculosis
ggggcccggcccggcg

SEQ ID NO: 941284 - RNA, 13 nt, Mycobacterium avium subsp. paratuberculosis
ggggcgccgcggc

SEQ ID NO: 941285 - RNA, 14 nt, Mycobacterium avium subsp. paratuberculosis
ggggcaugguguca

SEQ ID NO: 941286 - RNA, 20 nt, Mycobacterium avium subsp. paratuberculosis
ggggccaacuccggcggcag

SEQ ID NO: 941287 - RNA, 13 nt, Mycobacterium avium subsp. paratuberculosis
ggggccaccaggc

SEQ ID NO: 941288 - RNA, 14 nt, Mycobacterium avium subsp. paratuberculosis
ggggccaccaggcg

SEQ ID NO: 941289 - RNA, 15 nt, Mycobacterium avium subsp. paratuberculosis
ggggccagcacccag

SEQ ID NO: 941290 - RNA, 19 nt, Mycobacterium avium subsp. paratuberculosis
ggggcaucgcagcgcgcgg

SEQ ID NO: 941291 - RNA, 23 nt, Mycobacterium avium subsp. paratuberculosis
ggggcaucgcagcgcgcggcgca

SEQ ID NO: 941292 - RNA, 13 nt, Mycobacterium avium subsp. paratuberculosis
ggggcuggccgca

SEQ ID NO: 941293 - RNA, 17 nt, Mycobacterium avium subsp. paratuberculosis
ggggcuguccucccagc

SEQ ID NO: 941294 - RNA, 15 nt, Mycobacterium avium subsp. paratuberculosis
ggggcgucggacgcc

SEQ ID NO: 941295 - RNA, 17 nt, Mycobacterium avium subsp. paratuberculosis
ggggguuucgugugcuc

SEQ ID NO: 941296 - RNA, 18 nt, Mycobacterium avium subsp. paratuberculosis
ggggguuucgugugcuca

SEQ ID NO: 941297 - RNA, 15 nt, Mycobacterium avium subsp. paratuberculosis
gggggugccgaccgc

SEQ ID NO: 941298 - RNA, 11 nt, Mycobacterium avium subsp. paratuberculosis
ggggggcacgu

SEQ ID NO: 941299 - RNA, 17 nt, Mycobacterium avium subsp. paratuberculosis
ggggguaaaccgccagc

SEQ ID NO: 941300 - RNA, 18 nt, Mycobacterium avium subsp. paratuberculosis
ggggguaaaccgccagca

SEQ ID NO: 941301 - RNA, 18 nt, Mycobacterium avium subsp. paratuberculosis
ggggguccagggugccga

SEQ ID NO: 941302 - RNA, 16 nt, Mycobacterium avium subsp. paratuberculosis
gggggucgacccgccg

SEQ ID NO: 941303 - RNA, 13 nt, Mycobacterium avium subsp. paratuberculosis
gggggucggugac

SEQ ID NO: 941304 - RNA, 13 nt, Mycobacterium avium subsp. paratuberculosis
ggggcguggcgga

SEQ ID NO: 941305 - RNA, 22 nt, Mycobacterium avium subsp. paratuberculosis
ggggcuacaaaaccaagaccgc

SEQ ID NO: 941306 - RNA, 20 nt, Mycobacterium avium subsp. paratuberculosis
ggggcggugcagccgggugc

SEQ ID NO: 941307 - RNA, 23 nt, Mycobacterium avium subsp. paratuberculosis
ggggcggccgccgggccggcggc

SEQ ID NO: 941308 - RNA, 19 nt, Mycobacterium avium subsp. paratuberculosis
ggggcggauccccgcgcug

SEQ ID NO: 941309 - RNA, 21 nt, Mycobacterium avium subsp. paratuberculosis
ggggccgaagccgacaccggg

SEQ ID NO: 941310 - RNA, 15 nt, Mycobacterium avium subsp. paratuberculosis
ggggcgccccgcugg

SEQ ID NO: 941311 - RNA, 12 nt, Mycobacterium avium subsp. paratuberculosis
ggggcgcgcgcc

SEQ ID NO: 941312 - RNA, 14 nt, Mycobacterium avium subsp. paratuberculosis
ggggcgcgcgccgg

SEQ ID NO: 941313 - RNA, 14 nt, Mycobacterium avium subsp. paratuberculosis
gggguggccggcca

SEQ ID NO: 941314 - RNA, 15 nt, Mycobacterium avium subsp. paratuberculosis
ggggugcgccaggca

SEQ ID NO: 941315 - RNA, 18 nt, Mycobacterium avium subsp. paratuberculosis
ggggucaccuuggccgga

SEQ ID NO: 941316 - RNA, 15 nt, Mycobacterium avium subsp. paratuberculosis
ggggugugcucggcg

SEQ ID NO: 941317 - RNA, 15 nt, Mycobacterium avium subsp. paratuberculosis
ggggucggcgcccuc

SEQ ID NO: 941318 - RNA, 13 nt, Mycobacterium avium subsp. paratuberculosis
ggggucggcgccg

SEQ ID NO: 941319 - RNA, 15 nt, Mycobacterium avium subsp. paratuberculosis
ggggucugcacgaug

SEQ ID NO: 941320 - RNA, 20 nt, Mycobacterium avium subsp. paratuberculosis
ggggugaaggcggccaccgc

SEQ ID NO: 941321 - RNA, 19 nt, Mycobacterium avium subsp. paratuberculosis
ggggugacgcccgucccgc

SEQ ID NO: 941322 - RNA, 17 nt, Mycobacterium avium subsp. paratuberculosis
ggggugaggcacccgcu

SEQ ID NO: 941323 - RNA, 17 nt, Mycobacterium avium subsp. paratuberculosis
ggggugcagcaccacga

SEQ ID NO: 941324 - RNA, 15 nt, Mycobacterium avium subsp. paratuberculosis
ggggugcccaccagc

SEQ ID NO: 941325 - RNA, 16 nt, Mycobacterium avium subsp. paratuberculosis
ggggugcccaccagca

SEQ ID NO: 941326 - RNA, 22 nt, Mycobacterium avium subsp. paratuberculosis
ggggugccgcccaacgacgucg

SEQ ID NO: 941327 - RNA, 21 nt, Mycobacterium avium subsp. paratuberculosis
ggggugccgccggggacccgc

SEQ ID NO: 941328 - RNA, 14 nt, Mycobacterium avium subsp. paratuberculosis
ggggugccggaggc

SEQ ID NO: 941329 - RNA, 15 nt, Mycobacterium avium subsp. paratuberculosis
ggggugccggaggcg

SEQ ID NO: 941330 - RNA, 19 nt, Mycobacterium avium subsp. paratuberculosis
ggggucgccgucgugcucg

SEQ ID NO: 941331 - RNA, 20 nt, Mycobacterium avium subsp. paratuberculosis
ggggucgccgucgugcucga

SEQ ID NO: 941332 - RNA, 13 nt, Mycobacterium avium subsp. paratuberculosis
ggggucgcgggcg

SEQ ID NO: 941333 - RNA, 15 nt, Mycobacterium avium subsp. paratuberculosis
ggggucgcgggcgcc

SEQ ID NO: 941334 - RNA, 13 nt, Mycobacterium avium subsp. paratuberculosis
ggggucggccgga

SEQ ID NO: 941335 - RNA, 23 nt, Mycobacterium avium subsp. paratuberculosis
ggggucgaacaucacccggcggc

SEQ ID NO: 941336 - RNA, 13 nt, Mycobacterium avium subsp. paratuberculosis
ggggucgacccgc

SEQ ID NO: 941337 - RNA, 16 nt, Mycobacterium avium subsp. paratuberculosis
ggggucagggcgcuca

SEQ ID NO: 941338 - RNA, 19 nt, Mycobacterium avium subsp. paratuberculosis
gggguccaccggccgaugg

SEQ ID NO: 941339 - RNA, 14 nt, Mycobacterium avium subsp. paratuberculosis
ggggguggcgucga

SEQ ID NO: 941340 - RNA, 16 nt, Mycobacterium avium subsp. paratuberculosis
gggguagccggcccgc

SEQ ID NO: 941341 - RNA, 15 nt, Mycobacterium avium subsp. paratuberculosis
gggguaguucugcuc

SEQ ID NO: 941342 - RNA, 20 nt, Mycobacterium avium subsp. paratuberculosis
ggggucccaauccucgccga

SEQ ID NO: 941343 - RNA, 19 nt, Mycobacterium avium subsp. paratuberculosis
gggguccggggcacggugg

SEQ ID NO: 941344 - RNA, 16 nt, Mycobacterium avium subsp. paratuberculosis
gggguccuccagcggc

SEQ ID NO: 941345 - RNA, 15 nt, Mycobacterium avium subsp. paratuberculosis
gggguccucucggcg

SEQ ID NO: 941346 - RNA, 16 nt, Mycobacterium avium subsp. paratuberculosis
gggguccucucggcgc

SEQ ID NO: 941347 - RNA, 17 nt, Mycobacterium avium subsp. paratuberculosis
gggguccucucggcgcc

SEQ ID NO: 941348 - RNA, 18 nt, Mycobacterium avium subsp. paratuberculosis
gggguccucucggcgccg

SEQ ID NO: 941349 - RNA, 18 nt, Mycobacterium avium subsp. paratuberculosis
ggucgaaccgcgagcgcg

SEQ ID NO: 941350 - RNA, 14 nt, Mycobacterium avium subsp. paratuberculosis
ggucgaacgcggcg

SEQ ID NO: 941351 - RNA, 22 nt, Mycobacterium avium subsp. paratuberculosis
ggucgaacagcacgccggccgg

SEQ ID NO: 941352 - RNA, 16 nt, Mycobacterium avium subsp. paratuberculosis
ggucgaacagcgcgcc

SEQ ID NO: 941353 - RNA, 22 nt, Mycobacterium avium subsp. paratuberculosis
ggucgaacagcgcgcccgacgg

SEQ ID NO: 941354 - RNA, 21 nt, Mycobacterium avium subsp. paratuberculosis
ggucgaacagcucgaccagcc

SEQ ID NO: 941355 - RNA, 17 nt, Mycobacterium avium subsp. paratuberculosis
ggucgaaccacgcggcg

SEQ ID NO: 941356 - RNA, 19 nt, Mycobacterium avium subsp. paratuberculosis
ggucgaaccacgcggcggc

SEQ ID NO: 941357 - RNA, 20 nt, Mycobacterium avium subsp. paratuberculosis
ggucgaaccacgcggcggcg

SEQ ID NO: 941358 - RNA, 20 nt, Mycobacterium avium subsp. paratuberculosis
gguccuugagguagucgcgc

SEQ ID NO: 941359 - RNA, 17 nt, Mycobacterium avium subsp. paratuberculosis
gguccuugccggcggcg

SEQ ID NO: 941360 - RNA, 19 nt, Mycobacterium avium subsp. paratuberculosis
gguccuugccggcggcggg

SEQ ID NO: 941361 - RNA, 22 nt, Mycobacterium avium subsp. paratuberculosis
gguccuucaacuugcgcgacgc

SEQ ID NO: 941362 - RNA, 13 nt, Mycobacterium avium subsp. paratuberculosis
gguccuugcgcgc

SEQ ID NO: 941363 - RNA, 19 nt, Mycobacterium avium subsp. paratuberculosis
gguccuugcggaaccgcug

SEQ ID NO: 941364 - RNA, 17 nt, Mycobacterium avium subsp. paratuberculosis
ggucgaacaacgcggug

SEQ ID NO: 941365 - RNA, 20 nt, Mycobacterium avium subsp. paratuberculosis
ggucgaacaacgcggugacc

SEQ ID NO: 941366 - RNA, 18 nt, Mycobacterium avium subsp. paratuberculosis
ggucgaacacggcgcuga

SEQ ID NO: 941367 - RNA, 18 nt, Mycobacterium avium subsp. paratuberculosis
gguccuggcgguggcccg

SEQ ID NO: 941368 - RNA, 15 nt, Mycobacterium avium subsp. paratuberculosis
gguccgcuccaccag

SEQ ID NO: 941369 - RNA, 17 nt, Mycobacterium avium subsp. paratuberculosis
gguccgcuccaccagcg

SEQ ID NO: 941370 - RNA, 16 nt, Mycobacterium avium subsp. paratuberculosis
gguccggaaccgcgcc

SEQ ID NO: 941371 - RNA, 14 nt, Mycobacterium avium subsp. paratuberculosis
gguccgcccggacc

SEQ ID NO: 941372 - RNA, 17 nt, Mycobacterium avium subsp. paratuberculosis
gguccgccgcagcggcg

SEQ ID NO: 941373 - RNA, 16 nt, Mycobacterium avium subsp. paratuberculosis
gguccgccgccggcgg

SEQ ID NO: 941374 - RNA, 16 nt, Mycobacterium avium subsp. paratuberculosis
gguccgccgucggggu

SEQ ID NO: 941375 - RNA, 15 nt, Mycobacterium avium subsp. paratuberculosis
gguccgcggugaugc

SEQ ID NO: 941376 - RNA, 14 nt, Mycobacterium avium subsp. paratuberculosis
gguccgcgguggug

SEQ ID NO: 941377 - RNA, 19 nt, Mycobacterium avium subsp. paratuberculosis
gguccgcgguuuggucagc

SEQ ID NO: 941378 - RNA, 22 nt, Mycobacterium avium subsp. paratuberculosis
gguccgcgguuuggucagcgcc

SEQ ID NO: 941379 - RNA, 15 nt, Mycobacterium avium subsp. paratuberculosis
ggucgaucaccucgu

SEQ ID NO: 941380 - RNA, 16 nt, Mycobacterium avium subsp. paratuberculosis
ggucgaucaccucguc

SEQ ID NO: 941381 - RNA, 15 nt, Mycobacterium avium subsp. paratuberculosis
ggucgauaugcugca

SEQ ID NO: 941382 - RNA, 22 nt, Mycobacterium avium subsp. paratuberculosis
ggucgauaugcugcaacggcug

SEQ ID NO: 941383 - RNA, 18 nt, Mycobacterium avium subsp. paratuberculosis
ggucgaucaacaccaacg

SEQ ID NO: 941384 - RNA, 19 nt, Mycobacterium avium subsp. paratuberculosis
ggucgagcagcagccgccg

SEQ ID NO: 941385 - RNA, 13 nt, Mycobacterium avium subsp. paratuberculosis
ggucgagaucagc

SEQ ID NO: 941386 - RNA, 14 nt, Mycobacterium avium subsp. paratuberculosis
ggucgagaucagca

SEQ ID NO: 941387 - RNA, 15 nt, Mycobacterium avium subsp. paratuberculosis
ggucgagaucagcac

SEQ ID NO: 941388 - RNA, 16 nt, Mycobacterium avium subsp. paratuberculosis
ggucgagaucagcacc

SEQ ID NO: 941389 - RNA, 17 nt, Mycobacterium avium subsp. paratuberculosis
ggucgagaucagcaccg

SEQ ID NO: 941390 - RNA, 19 nt, Mycobacterium avium subsp. paratuberculosis
ggucgagaucagcaccggg

SEQ ID NO: 941391 - RNA, 18 nt, Mycobacterium avium subsp. paratuberculosis
ggucgacuggucgucgag

SEQ ID NO: 941392 - RNA, 18 nt, Mycobacterium avium subsp. paratuberculosis
ggucgacgauggcccggg

SEQ ID NO: 941393 - RNA, 21 nt, Mycobacterium avium subsp. paratuberculosis
ggucgacgauggcccgggcca

SEQ ID NO: 941394 - RNA, 17 nt, Mycobacterium avium subsp. paratuberculosis
ggucgaagaggugcucg

SEQ ID NO: 941395 - RNA, 19 nt, Mycobacterium avium subsp. paratuberculosis
ggucgacgcgccgcacugc

SEQ ID NO: 941396 - RNA, 18 nt, Mycobacterium avium subsp. paratuberculosis
ggucgacgcggggcggcg

SEQ ID NO: 941397 - RNA, 20 nt, Mycobacterium avium subsp. paratuberculosis
ggucgacgcggggcggcggc

SEQ ID NO: 941398 - RNA, 22 nt, Mycobacterium avium subsp. paratuberculosis
ggucgacgcggggcggcggcgc

SEQ ID NO: 941399 - RNA, 21 nt, Mycobacterium avium subsp. paratuberculosis
ggucgcccccucggccggucc

SEQ ID NO: 941400 - RNA, 15 nt, Mycobacterium avium subsp. paratuberculosis
ggucgcccggcucgc

SEQ ID NO: 941401 - RNA, 21 nt, Mycobacterium avium subsp. paratuberculosis
ggucgcccggcucgccgggcu

SEQ ID NO: 941402 - RNA, 11 nt, Mycobacterium avium subsp. paratuberculosis
ggucgcccggg

SEQ ID NO: 941403 - RNA, 15 nt, Mycobacterium avium subsp. paratuberculosis
ggucgcccaccacga

SEQ ID NO: 941404 - RNA, 21 nt, Mycobacterium avium subsp. paratuberculosis
ggucgcccaccacgacgacgu

SEQ ID NO: 941405 - RNA, 14 nt, Mycobacterium avium subsp. paratuberculosis
ggucgccaccacca

SEQ ID NO: 941406 - RNA, 20 nt, Mycobacterium avium subsp. paratuberculosis
ggucgcccagauagaucgca

SEQ ID NO: 941407 - RNA, 14 nt, Mycobacterium avium subsp. paratuberculosis
ggucgccagcgcca

SEQ ID NO: 941408 - RNA, 17 nt, Mycobacterium avium subsp. paratuberculosis
ggucgccagcgccacgc

SEQ ID NO: 941409 - RNA, 16 nt, Mycobacterium avium subsp. paratuberculosis
ggucgccaggccaccg

SEQ ID NO: 941410 - RNA, 14 nt, Mycobacterium avium subsp. paratuberculosis
ggucgccacggccg

SEQ ID NO: 941411 - RNA, 20 nt, Mycobacterium avium subsp. paratuberculosis
ggucgccacggccggcagca

SEQ ID NO: 941412 - RNA, 20 nt, Mycobacterium avium subsp. paratuberculosis
ggucgccacucgggcggccg

SEQ ID NO: 941413 - RNA, 21 nt, Mycobacterium avium subsp. paratuberculosis
ggucgaugaacucgcgggcga

SEQ ID NO: 941414 - RNA, 21 nt, Mycobacterium avium subsp. paratuberculosis
ggucgaugacgccgcgccgcc

SEQ ID NO: 941415 - RNA, 16 nt, Mycobacterium avium subsp. paratuberculosis
ggucgaugagcuggug

SEQ ID NO: 941416 - RNA, 23 nt, Mycobacterium avium subsp. paratuberculosis
ggucgaugaucuggcggucccgc

SEQ ID NO: 941417 - RNA, 18 nt, Mycobacterium avium subsp. paratuberculosis
ggucgaucucggccagcg

SEQ ID NO: 941418 - RNA, 19 nt, Mycobacterium avium subsp. paratuberculosis
ggucgaucucggccagcgg

SEQ ID NO: 941419 - RNA, 16 nt, Mycobacterium avium subsp. paratuberculosis
ggucgaucucggcgca

SEQ ID NO: 941420 - RNA, 20 nt, Mycobacterium avium subsp. paratuberculosis
ggucgccugcuggacguugg

SEQ ID NO: 941421 - RNA, 19 nt, Mycobacterium avium subsp. paratuberculosis
ggucgcgaagacgcuggcc

SEQ ID NO: 941422 - RNA, 22 nt, Mycobacterium avium subsp. paratuberculosis
ggucgcgaagacgcuggccacg

SEQ ID NO: 941423 - RNA, 22 nt, Mycobacterium avium subsp. paratuberculosis
ggucgcgaagcguaugccggug

SEQ ID NO: 941424 - RNA, 17 nt, Mycobacterium avium subsp. paratuberculosis
ggucgcgcagcauggcc

SEQ ID NO: 941425 - RNA, 20 nt, Mycobacterium avium subsp. paratuberculosis
ggucgcgcagccgccgggcu

SEQ ID NO: 941426 - RNA, 16 nt, Mycobacterium avium subsp. paratuberculosis
ggucgcgcagccgggc

SEQ ID NO: 941427 - RNA, 10 nt, Mycobacterium avium subsp. paratuberculosis
ggucgccgaa

SEQ ID NO: 941428 - RNA, 12 nt, Mycobacterium avium subsp. paratuberculosis
ggucgccgaacg

SEQ ID NO: 941429 - RNA, 21 nt, Mycobacterium avium subsp. paratuberculosis
ggucgccgacagcgucgucca

SEQ ID NO: 941430 - RNA, 13 nt, Mycobacterium avium subsp. paratuberculosis
ggucgccgacgcc

SEQ ID NO: 941431 - RNA, 15 nt, Mycobacterium avium subsp. paratuberculosis
ggucgccgacgccgu

SEQ ID NO: 941432 - RNA, 14 nt, Mycobacterium avium subsp. paratuberculosis
ggucgcccucgaag

SEQ ID NO: 941433 - RNA, 20 nt, Mycobacterium avium subsp. paratuberculosis
ggucgccgacgguggcgaag

SEQ ID NO: 941434 - RNA, 20 nt, Mycobacterium avium subsp. paratuberculosis
ggucgccgacucgcaggugc

SEQ ID NO: 941435 - RNA, 10 nt, Mycobacterium avium subsp. paratuberculosis
ggucgccgau

SEQ ID NO: 941436 - RNA, 12 nt, Mycobacterium avium subsp. paratuberculosis
ggucgcggccgu

SEQ ID NO: 941437 - RNA, 19 nt, Mycobacterium avium subsp. paratuberculosis
ggucgcggccuugcgcacc

SEQ ID NO: 941438 - RNA, 17 nt, Mycobacterium avium subsp. paratuberculosis
ggucgcggaaccggccg

SEQ ID NO: 941439 - RNA, 23 nt, Mycobacterium avium subsp. paratuberculosis
ggucgcggauacgcccggccacc

SEQ ID NO: 941440 - RNA, 14 nt, Mycobacterium avium subsp. paratuberculosis
ggucgcgcugcggg

SEQ ID NO: 941441 - RNA, 20 nt, Mycobacterium avium subsp. paratuberculosis
ggucgcgcaucgccucggcg

SEQ ID NO: 941442 - RNA, 20 nt, Mycobacterium avium subsp. paratuberculosis
ggucgcgccagacguccagc

SEQ ID NO: 941443 - RNA, 15 nt, Mycobacterium avium subsp. paratuberculosis
ggucgcgcgccggcg

SEQ ID NO: 941444 - RNA, 17 nt, Mycobacterium avium subsp. paratuberculosis
ggucgcgcgccggcgca

SEQ ID NO: 941445 - RNA, 23 nt, Mycobacterium avium subsp. paratuberculosis
gguagggcgccgucggcggggga

SEQ ID NO: 941446 - RNA, 17 nt, Mycobacterium avium subsp. paratuberculosis
gguagggcuccgcgcug

SEQ ID NO: 941447 - RNA, 22 nt, Mycobacterium avium subsp. paratuberculosis
gguagcgccgccggggcgggca

SEQ ID NO: 941448 - RNA, 16 nt, Mycobacterium avium subsp. paratuberculosis
gguagcgguccucgaa

SEQ ID NO: 941449 - RNA, 19 nt, Mycobacterium avium subsp. paratuberculosis
gguagcggugcucgaugua

SEQ ID NO: 941450 - RNA, 14 nt, Mycobacterium avium subsp. paratuberculosis
gguaggcgucgcgc

SEQ ID NO: 941451 - RNA, 15 nt, Mycobacterium avium subsp. paratuberculosis
gguagguggccagcc

SEQ ID NO: 941452 - RNA, 22 nt, Mycobacterium avium subsp. paratuberculosis
gguaggugaucgccucgaccag

SEQ ID NO: 941453 - RNA, 15 nt, Mycobacterium avium subsp. paratuberculosis
gguaggugcccgggu

SEQ ID NO: 941454 - RNA, 23 nt, Mycobacterium avium subsp. paratuberculosis
gguaggugcccgggucgugcggc

SEQ ID NO: 941455 - RNA, 15 nt, Mycobacterium avium subsp. paratuberculosis
gguaggugccggccg

SEQ ID NO: 941456 - RNA, 15 nt, Mycobacterium avium subsp. paratuberculosis
gguaguccgacuucg

SEQ ID NO: 941457 - RNA, 19 nt, Mycobacterium avium subsp. paratuberculosis
gguaguccgacuucgcgug

SEQ ID NO: 941458 - RNA, 14 nt, Mycobacterium avium subsp. paratuberculosis
ggucagcggcgcca

SEQ ID NO: 941459 - RNA, 16 nt, Mycobacterium avium subsp. paratuberculosis
ggucagcggcgccacc

SEQ ID NO: 941460 - RNA, 13 nt, Mycobacterium avium subsp. paratuberculosis
ggucagcggcgug

SEQ ID NO: 941461 - RNA, 14 nt, Mycobacterium avium subsp. paratuberculosis
ggucagcggcgugc

SEQ ID NO: 941462 - RNA, 19 nt, Mycobacterium avium subsp. paratuberculosis
ggucagcggcgugcugcgc

SEQ ID NO: 941463 - RNA, 20 nt, Mycobacterium avium subsp. paratuberculosis
gguaguugcacucucgcggc

SEQ ID NO: 941464 - RNA, 23 nt, Mycobacterium avium subsp. paratuberculosis
ggucagcgcgucggcgaccgcgc

SEQ ID NO: 941465 - RNA, 18 nt, Mycobacterium avium subsp. paratuberculosis
ggucagcgcuacugccgc

SEQ ID NO: 941466 - RNA, 13 nt, Mycobacterium avium subsp. paratuberculosis
gguagucgcgcag

SEQ ID NO: 941467 - RNA, 12 nt, Mycobacterium avium subsp. paratuberculosis
gguagucgucgu

SEQ ID NO: 941468 - RNA, 17 nt, Mycobacterium avium subsp. paratuberculosis
gguagucugcacugcgg

SEQ ID NO: 941469 - RNA, 20 nt, Mycobacterium avium subsp. paratuberculosis
gguagugcauguagcggucg

SEQ ID NO: 941470 - RNA, 21 nt, Mycobacterium avium subsp. paratuberculosis
ggucaggaucgacuccgggug

SEQ ID NO: 941471 - RNA, 19 nt, Mycobacterium avium subsp. paratuberculosis
ggucaggcauuccaccgcg

SEQ ID NO: 941472 - RNA, 15 nt, Mycobacterium avium subsp. paratuberculosis
ggucaggccggcgcc

SEQ ID NO: 941473 - RNA, 19 nt, Mycobacterium avium subsp. paratuberculosis
ggucaggcgcagccagcgg

SEQ ID NO: 941474 - RNA, 21 nt, Mycobacterium avium subsp. paratuberculosis
ggucagcucccccgucgggcc

SEQ ID NO: 941475 - RNA, 13 nt, Mycobacterium avium subsp. paratuberculosis
ggucagcucccgg

SEQ ID NO: 941476 - RNA, 21 nt, Mycobacterium avium subsp. paratuberculosis
ggucagcucgaaggugcccgc

SEQ ID NO: 941477 - RNA, 23 nt, Mycobacterium avium subsp. paratuberculosis
ggucagcucgaaggugcccgcau

SEQ ID NO: 941478 - RNA, 20 nt, Mycobacterium avium subsp. paratuberculosis
ggucagcucgaucgccgcgc

SEQ ID NO: 941479 - RNA, 23 nt, Mycobacterium avium subsp. paratuberculosis
ggucagcucgaucgccgcgccca

SEQ ID NO: 941480 - RNA, 22 nt, Mycobacterium avium subsp. paratuberculosis
ggucagcucgcgcccggccagg

SEQ ID NO: 941481 - RNA, 13 nt, Mycobacterium avium subsp. paratuberculosis
ggucagcucgggg

SEQ ID NO: 941482 - RNA, 14 nt, Mycobacterium avium subsp. paratuberculosis
ggucagcgucgccg

SEQ ID NO: 941483 - RNA, 16 nt, Mycobacterium avium subsp. paratuberculosis
ggucagcgucgccgcc

SEQ ID NO: 941484 - RNA, 16 nt, Mycobacterium avium subsp. paratuberculosis
ggucagcgucucgccg

SEQ ID NO: 941485 - RNA, 20 nt, Mycobacterium avium subsp. paratuberculosis
ggucagcgucucgccgggga

SEQ ID NO: 941486 - RNA, 23 nt, Mycobacterium avium subsp. paratuberculosis
ggucagcgucucgccggggaaca

SEQ ID NO: 941487 - RNA, 22 nt, Mycobacterium avium subsp. paratuberculosis
ggucagcgucucggcgaucagc

SEQ ID NO: 941488 - RNA, 17 nt, Mycobacterium avium subsp. paratuberculosis
ggucagcgucuggcggg

SEQ ID NO: 941489 - RNA, 14 nt, Mycobacterium avium subsp. paratuberculosis
ggucagcggcaggu

SEQ ID NO: 941490 - RNA, 22 nt, Mycobacterium avium subsp. paratuberculosis
ggucagcggcccgaucaccagg

SEQ ID NO: 941491 - RNA, 22 nt, Mycobacterium avium subsp. paratuberculosis
ggucagcguggcgucggcgcgc

SEQ ID NO: 941492 - RNA, 18 nt, Mycobacterium avium subsp. paratuberculosis
gguccaaaacaucccgga

SEQ ID NO: 941493 - RNA, 17 nt, Mycobacterium avium subsp. paratuberculosis
ggucaugccgucgacga

SEQ ID NO: 941494 - RNA, 16 nt, Mycobacterium avium subsp. paratuberculosis
ggucauggcgaccgcg

SEQ ID NO: 941495 - RNA, 19 nt, Mycobacterium avium subsp. paratuberculosis
ggucauggcgaccgcgacg

SEQ ID NO: 941496 - RNA, 16 nt, Mycobacterium avium subsp. paratuberculosis
ggucaugguggcggcg

SEQ ID NO: 941497 - RNA, 18 nt, Mycobacterium avium subsp. paratuberculosis
ggucauguaccaggcgac

SEQ ID NO: 941498 - RNA, 15 nt, Mycobacterium avium subsp. paratuberculosis
ggucaucgugaucgc

SEQ ID NO: 941499 - RNA, 18 nt, Mycobacterium avium subsp. paratuberculosis
ggucauccgcuccaugaa

SEQ ID NO: 941500 - RNA, 14 nt, Mycobacterium avium subsp. paratuberculosis
ggucauccgggcca

SEQ ID NO: 941501 - RNA, 17 nt, Mycobacterium avium subsp. paratuberculosis
ggucauccgggccacca

SEQ ID NO: 941502 - RNA, 20 nt, Mycobacterium avium subsp. paratuberculosis
ggucauccgggccaccacca

SEQ ID NO: 941503 - RNA, 15 nt, Mycobacterium avium subsp. paratuberculosis
ggucauccucgccgc

SEQ ID NO: 941504 - RNA, 16 nt, Mycobacterium avium subsp. paratuberculosis
ggucauccucgccgcg

SEQ ID NO: 941505 - RNA, 17 nt, Mycobacterium avium subsp. paratuberculosis
ggucauccucgccgcgc

SEQ ID NO: 941506 - RNA, 18 nt, Mycobacterium avium subsp. paratuberculosis
ggucauccucgccgcgcc

SEQ ID NO: 941507 - RNA, 20 nt, Mycobacterium avium subsp. paratuberculosis
ggucauccucgccgcgccag

SEQ ID NO: 941508 - RNA, 20 nt, Mycobacterium avium subsp. paratuberculosis
ggucaggucgcugcgcucgc

SEQ ID NO: 941509 - RNA, 14 nt, Mycobacterium avium subsp. paratuberculosis
ggucagggccagca

SEQ ID NO: 941510 - RNA, 17 nt, Mycobacterium avium subsp. paratuberculosis
ggucagguagccgaggu

SEQ ID NO: 941511 - RNA, 16 nt, Mycobacterium avium subsp. paratuberculosis
ggucagguaggcgucg

SEQ ID NO: 941512 - RNA, 14 nt, Mycobacterium avium subsp. paratuberculosis
ggucagggcgcuca

SEQ ID NO: 941513 - RNA, 20 nt, Mycobacterium avium subsp. paratuberculosis
gguccaggcgaccggcccca

SEQ ID NO: 941514 - RNA, 18 nt, Mycobacterium avium subsp. paratuberculosis
gguccaggcgccggguug

SEQ ID NO: 941515 - RNA, 21 nt, Mycobacterium avium subsp. paratuberculosis
gguccaggaucugcagcacgc

SEQ ID NO: 941516 - RNA, 13 nt, Mycobacterium avium subsp. paratuberculosis
gguccagcccggu

SEQ ID NO: 941517 - RNA, 13 nt, Mycobacterium avium subsp. paratuberculosis
gguccagccgccg

SEQ ID NO: 941518 - RNA, 15 nt, Mycobacterium avium subsp. paratuberculosis
gguccagccgccggc

SEQ ID NO: 941519 - RNA, 16 nt, Mycobacterium avium subsp. paratuberculosis
gguccagccgccggcg

SEQ ID NO: 941520 - RNA, 12 nt, Mycobacterium avium subsp. paratuberculosis
gguccagccgcg

SEQ ID NO: 941521 - RNA, 18 nt, Mycobacterium avium subsp. paratuberculosis
gguccagccggucgcagg

SEQ ID NO: 941522 - RNA, 13 nt, Mycobacterium avium subsp. paratuberculosis
gguccauggccuu

SEQ ID NO: 941523 - RNA, 18 nt, Mycobacterium avium subsp. paratuberculosis
gguccaugugccgcaucu

SEQ ID NO: 941524 - RNA, 15 nt, Mycobacterium avium subsp. paratuberculosis
ggucccaauccucgc

SEQ ID NO: 941525 - RNA, 20 nt, Mycobacterium avium subsp. paratuberculosis
gguccaucgccucgaccagc

SEQ ID NO: 941526 - RNA, 20 nt, Mycobacterium avium subsp. paratuberculosis
gguccgaucguccggcgcca

SEQ ID NO: 941527 - RNA, 18 nt, Mycobacterium avium subsp. paratuberculosis
gguccgcaacgcggcggu

SEQ ID NO: 941528 - RNA, 15 nt, Mycobacterium avium subsp. paratuberculosis
gguccgcacccgggc

SEQ ID NO: 941529 - RNA, 18 nt, Mycobacterium avium subsp. paratuberculosis
gguccgcaugucgaagaa

SEQ ID NO: 941530 - RNA, 15 nt, Mycobacterium avium subsp. paratuberculosis
ggucggacgcgggga

SEQ ID NO: 941531 - RNA, 20 nt, Mycobacterium avium subsp. paratuberculosis
ggucggagcaaauccggcag

SEQ ID NO: 941532 - RNA, 22 nt, Mycobacterium avium subsp. paratuberculosis
ggucggagcaaauccggcagcg

SEQ ID NO: 941533 - RNA, 13 nt, Mycobacterium avium subsp. paratuberculosis
ggucgcuggccgc

SEQ ID NO: 941534 - RNA, 14 nt, Mycobacterium avium subsp. paratuberculosis
ggucgcugggcucg

SEQ ID NO: 941535 - RNA, 19 nt, Mycobacterium avium subsp. paratuberculosis
ggucggcaacccgaccucg

SEQ ID NO: 941536 - RNA, 17 nt, Mycobacterium avium subsp. paratuberculosis
ggucggcagcaccggca

SEQ ID NO: 941537 - RNA, 20 nt, Mycobacterium avium subsp. paratuberculosis
ggucggcagcaccggcagca

SEQ ID NO: 941538 - RNA, 15 nt, Mycobacterium avium subsp. paratuberculosis
ggucggcaggauccg

SEQ ID NO: 941539 - RNA, 24 nt, Mycobacterium avium subsp. paratuberculosis
ggucggcauagcgccgcucggccg

SEQ ID NO: 941540 - RNA, 15 nt, Mycobacterium avium subsp. paratuberculosis
ggucgcugaccccgc

SEQ ID NO: 941541 - RNA, 21 nt, Mycobacterium avium subsp. paratuberculosis
ggucgcugaccccgcucggcg

SEQ ID NO: 941542 - RNA, 23 nt, Mycobacterium avium subsp. paratuberculosis
ggucgcugaccccgcucggcgug

SEQ ID NO: 941543 - RNA, 22 nt, Mycobacterium avium subsp. paratuberculosis
ggucgcugcagcggcggccagu

SEQ ID NO: 941544 - RNA, 20 nt, Mycobacterium avium subsp. paratuberculosis
ggucgcggcguugcccgcug

SEQ ID NO: 941545 - RNA, 23 nt, Mycobacterium avium subsp. paratuberculosis
ggucgcggaucucgucgggccac

SEQ ID NO: 941546 - RNA, 15 nt, Mycobacterium avium subsp. paratuberculosis
ggucgcggcccaccg

SEQ ID NO: 941547 - RNA, 12 nt, Mycobacterium avium subsp. paratuberculosis
ggucgcggcccg

SEQ ID NO: 941548 - RNA, 13 nt, Mycobacterium avium subsp. paratuberculosis
ggucgcggucggc

SEQ ID NO: 941549 - RNA, 20 nt, Mycobacterium avium subsp. paratuberculosis
ggucgcggucggcgcccggc

SEQ ID NO: 941550 - RNA, 15 nt, Mycobacterium avium subsp. paratuberculosis
ggucgcggugcccag

SEQ ID NO: 941551 - RNA, 16 nt, Mycobacterium avium subsp. paratuberculosis
ggucgcggugcccagc

SEQ ID NO: 941552 - RNA, 21 nt, Mycobacterium avium subsp. paratuberculosis
ggucgcggugggcgcgggccg

SEQ ID NO: 941553 - RNA, 14 nt, Mycobacterium avium subsp. paratuberculosis
ggucgcggugucgg

SEQ ID NO: 941554 - RNA, 19 nt, Mycobacterium avium subsp. paratuberculosis
ggucgcggugucggcgucg

SEQ ID NO: 941555 - RNA, 22 nt, Mycobacterium avium subsp. paratuberculosis
ggucgcguacgggaugaucagc

SEQ ID NO: 941556 - RNA, 14 nt, Mycobacterium avium subsp. paratuberculosis
ggucgcgucgugcg

SEQ ID NO: 941557 - RNA, 16 nt, Mycobacterium avium subsp. paratuberculosis
ggucgcgucgugcggc

SEQ ID NO: 941558 - RNA, 18 nt, Mycobacterium avium subsp. paratuberculosis
ggucgcgucgugcggccg

SEQ ID NO: 941559 - RNA, 20 nt, Mycobacterium avium subsp. paratuberculosis
ggucgcgucgugcggccggc

SEQ ID NO: 941560 - RNA, 16 nt, Mycobacterium avium subsp. paratuberculosis
ggucgcgugaccggcg

SEQ ID NO: 941561 - RNA, 17 nt, Mycobacterium avium subsp. paratuberculosis
ggucgcgugaccggcgg

SEQ ID NO: 941562 - RNA, 19 nt, Mycobacterium avium subsp. paratuberculosis
ggucgcguugaaagccgcg

SEQ ID NO: 941563 - RNA, 21 nt, Mycobacterium avium subsp. paratuberculosis
ggucguagccgaagccgccgu

SEQ ID NO: 941564 - RNA, 19 nt, Mycobacterium avium subsp. paratuberculosis
ggucguaguaggugcgcga

SEQ ID NO: 941565 - RNA, 18 nt, Mycobacterium avium subsp. paratuberculosis
ggucguagucggcccgcc

SEQ ID NO: 941566 - RNA, 19 nt, Mycobacterium avium subsp. paratuberculosis
ggucguagucggcccgccg

SEQ ID NO: 941567 - RNA, 17 nt, Mycobacterium avium subsp. paratuberculosis
ggucgucgcggccaacg

SEQ ID NO: 941568 - RNA, 20 nt, Mycobacterium avium subsp. paratuberculosis
ggucgucgacgagcccgccg

SEQ ID NO: 941569 - RNA, 14 nt, Mycobacterium avium subsp. paratuberculosis
ggucgucgacgucc

SEQ ID NO: 941570 - RNA, 22 nt, Mycobacterium avium subsp. paratuberculosis
ggucgucgacguccucgaugcc

SEQ ID NO: 941571 - RNA, 19 nt, Mycobacterium avium subsp. paratuberculosis
ggucgucgagcaccggcug

SEQ ID NO: 941572 - RNA, 15 nt, Mycobacterium avium subsp. paratuberculosis
ggucgucgagggcca

SEQ ID NO: 941573 - RNA, 19 nt, Mycobacterium avium subsp. paratuberculosis
ggucgucgcccaccgacgc

SEQ ID NO: 941574 - RNA, 20 nt, Mycobacterium avium subsp. paratuberculosis
ggucgucgcccgucucggcg

SEQ ID NO: 941575 - RNA, 22 nt, Mycobacterium avium subsp. paratuberculosis
ggucguaccaccaccagucggc

SEQ ID NO: 941576 - RNA, 14 nt, Mycobacterium avium subsp. paratuberculosis
ggucgguggugauc

SEQ ID NO: 941577 - RNA, 17 nt, Mycobacterium avium subsp. paratuberculosis
ggucgguggugaucgcg

SEQ ID NO: 941578 - RNA, 17 nt, Mycobacterium avium subsp. paratuberculosis
ggucgguuugcgggcca

SEQ ID NO: 941579 - RNA, 17 nt, Mycobacterium avium subsp. paratuberculosis
ggucggugcggaugcug

SEQ ID NO: 941580 - RNA, 22 nt, Mycobacterium avium subsp. paratuberculosis
ggucgguucauccacucggcca

SEQ ID NO: 941581 - RNA, 23 nt, Mycobacterium avium subsp. paratuberculosis
ggucggugccgcggcgcaccccg

SEQ ID NO: 941582 - RNA, 12 nt, Mycobacterium avium subsp. paratuberculosis
ggucggugcgga

SEQ ID NO: 941583 - RNA, 15 nt, Mycobacterium avium subsp. paratuberculosis
ggucgguggccacca

SEQ ID NO: 941584 - RNA, 18 nt, Mycobacterium avium subsp. paratuberculosis
ggucgguggccaccaccg

SEQ ID NO: 941585 - RNA, 21 nt, Mycobacterium avium subsp. paratuberculosis
ggucgguggcccagccggccg

SEQ ID NO: 941586 - RNA, 11 nt, Mycobacterium avium subsp. paratuberculosis
ggucgguggcg

SEQ ID NO: 941587 - RNA, 21 nt, Mycobacterium avium subsp. paratuberculosis
ggucggugcccagcaccgccg

SEQ ID NO: 941588 - RNA, 20 nt, Mycobacterium avium subsp. paratuberculosis
ggucggugaagugccggcug

SEQ ID NO: 941589 - RNA, 14 nt, Mycobacterium avium subsp. paratuberculosis
ggucggugaccagc

SEQ ID NO: 941590 - RNA, 15 nt, Mycobacterium avium subsp. paratuberculosis
ggucggucggcccgc

SEQ ID NO: 941591 - RNA, 14 nt, Mycobacterium avium subsp. paratuberculosis
ggucggucggccgc

SEQ ID NO: 941592 - RNA, 15 nt, Mycobacterium avium subsp. paratuberculosis
ggucggucggccgca

SEQ ID NO: 941593 - RNA, 19 nt, Mycobacterium avium subsp. paratuberculosis
ggucggcucggcucggccg

SEQ ID NO: 941594 - RNA, 20 nt, Mycobacterium avium subsp. paratuberculosis
ggucggcguccagcgcggug

SEQ ID NO: 941595 - RNA, 20 nt, Mycobacterium avium subsp. paratuberculosis
ggucggcgucguacagcagc

SEQ ID NO: 941596 - RNA, 17 nt, Mycobacterium avium subsp. paratuberculosis
ggucggcgcccggccca

SEQ ID NO: 941597 - RNA, 18 nt, Mycobacterium avium subsp. paratuberculosis
ggucggcgggagccggcg

SEQ ID NO: 941598 - RNA, 12 nt, Mycobacterium avium subsp. paratuberculosis
ggucggcgggca

SEQ ID NO: 941599 - RNA, 15 nt, Mycobacterium avium subsp. paratuberculosis
ggucggcgcucgcgg

SEQ ID NO: 941600 - RNA, 17 nt, Mycobacterium avium subsp. paratuberculosis
ggucggcgcucgcgggu

SEQ ID NO: 941601 - RNA, 18 nt, Mycobacterium avium subsp. paratuberculosis
ggucggcggaggcgaaug

SEQ ID NO: 941602 - RNA, 19 nt, Mycobacterium avium subsp. paratuberculosis
ggucggcgcggcgacguga

SEQ ID NO: 941603 - RNA, 16 nt, Mycobacterium avium subsp. paratuberculosis
ggucggcgccggccag

SEQ ID NO: 941604 - RNA, 18 nt, Mycobacterium avium subsp. paratuberculosis
ggucggcgaugcgcacca

SEQ ID NO: 941605 - RNA, 12 nt, Mycobacterium avium subsp. paratuberculosis
ggucggcgaugc

SEQ ID NO: 941606 - RNA, 13 nt, Mycobacterium avium subsp. paratuberculosis
ggucggcgaugcg

SEQ ID NO: 941607 - RNA, 15 nt, Mycobacterium avium subsp. paratuberculosis
ggucggccacgacgc

SEQ ID NO: 941608 - RNA, 13 nt, Mycobacterium avium subsp. paratuberculosis
ggugacgcccguc

SEQ ID NO: 941609 - RNA, 15 nt, Mycobacterium avium subsp. paratuberculosis
ggugacgccgcacga

SEQ ID NO: 941610 - RNA, 22 nt, Mycobacterium avium subsp. paratuberculosis
ggugacgcgaaugucgaccacc

SEQ ID NO: 941611 - RNA, 15 nt, Mycobacterium avium subsp. paratuberculosis
ggugacgcgccggcc

SEQ ID NO: 941612 - RNA, 20 nt, Mycobacterium avium subsp. paratuberculosis
ggugacggauguggucggcc

SEQ ID NO: 941613 - RNA, 22 nt, Mycobacterium avium subsp. paratuberculosis
ggugacggauguggucggccac

SEQ ID NO: 941614 - RNA, 23 nt, Mycobacterium avium subsp. paratuberculosis
ggugacggccgugaugccgggca

SEQ ID NO: 941615 - RNA, 17 nt, Mycobacterium avium subsp. paratuberculosis
ggugacggugccgccgu

SEQ ID NO: 941616 - RNA, 21 nt, Mycobacterium avium subsp. paratuberculosis
ggugacggugccgccgugcgc

SEQ ID NO: 941617 - RNA, 16 nt, Mycobacterium avium subsp. paratuberculosis
ggugacgguggcgucc

SEQ ID NO: 941618 - RNA, 18 nt, Mycobacterium avium subsp. paratuberculosis
ggugacgggcgucggcgg

SEQ ID NO: 941619 - RNA, 14 nt, Mycobacterium avium subsp. paratuberculosis
ggugacggucaggg

SEQ ID NO: 941620 - RNA, 19 nt, Mycobacterium avium subsp. paratuberculosis
ggugacgaacccgccgcgg

SEQ ID NO: 941621 - RNA, 13 nt, Mycobacterium avium subsp. paratuberculosis
ggugacgaccggc

SEQ ID NO: 941622 - RNA, 19 nt, Mycobacterium avium subsp. paratuberculosis
ggugacgaccggcagccgc

SEQ ID NO: 941623 - RNA, 20 nt, Mycobacterium avium subsp. paratuberculosis
ggugaagcccagcgcguuga

SEQ ID NO: 941624 - RNA, 13 nt, Mycobacterium avium subsp. paratuberculosis
ggugaccucgguc

SEQ ID NO: 941625 - RNA, 19 nt, Mycobacterium avium subsp. paratuberculosis
ggugaccucgucgggcgcc

SEQ ID NO: 941626 - RNA, 14 nt, Mycobacterium avium subsp. paratuberculosis
ggugaccugcagcg

SEQ ID NO: 941627 - RNA, 23 nt, Mycobacterium avium subsp. paratuberculosis
ggugaccugcggaucgcgggcga

SEQ ID NO: 941628 - RNA, 13 nt, Mycobacterium avium subsp. paratuberculosis
ggugacgacgcuc

SEQ ID NO: 941629 - RNA, 17 nt, Mycobacterium avium subsp. paratuberculosis
ggugacgaugucgauga

SEQ ID NO: 941630 - RNA, 17 nt, Mycobacterium avium subsp. paratuberculosis
ggugacgugcaccugca

SEQ ID NO: 941631 - RNA, 17 nt, Mycobacterium avium subsp. paratuberculosis
ggugacguggcggccgu

SEQ ID NO: 941632 - RNA, 18 nt, Mycobacterium avium subsp. paratuberculosis
ggugacguuccagccgug

SEQ ID NO: 941633 - RNA, 18 nt, Mycobacterium avium subsp. paratuberculosis
ggugacuucgagccgggc

SEQ ID NO: 941634 - RNA, 22 nt, Mycobacterium avium subsp. paratuberculosis
ggugacuucgagccgggcgcgg

SEQ ID NO: 941635 - RNA, 14 nt, Mycobacterium avium subsp. paratuberculosis
ggugacuucgaugu

SEQ ID NO: 941636 - RNA, 17 nt, Mycobacterium avium subsp. paratuberculosis
ggugagcuggccgcgca

SEQ ID NO: 941637 - RNA, 17 nt, Mycobacterium avium subsp. paratuberculosis
ggugaggacgcccggcg

SEQ ID NO: 941638 - RNA, 14 nt, Mycobacterium avium subsp. paratuberculosis
ggugaggcacccgc

SEQ ID NO: 941639 - RNA, 23 nt, Mycobacterium avium subsp. paratuberculosis
ggugaggccaggcguuuggugug

SEQ ID NO: 941640 - RNA, 13 nt, Mycobacterium avium subsp. paratuberculosis
ggugaggggcgcg

SEQ ID NO: 941641 - RNA, 18 nt, Mycobacterium avium subsp. paratuberculosis
ggugaggggcgcgcgccg

SEQ ID NO: 941642 - RNA, 16 nt, Mycobacterium avium subsp. paratuberculosis
ggugaggucgcgcagg

SEQ ID NO: 941643 - RNA, 22 nt, Mycobacterium avium subsp. paratuberculosis
ggugaucaaagccgguggcagc

SEQ ID NO: 941644 - RNA, 17 nt, Mycobacterium avium subsp. paratuberculosis
ggugaucuugcccagcc

SEQ ID NO: 941645 - RNA, 22 nt, Mycobacterium avium subsp. paratuberculosis
ggugauagaucaucccggccac

SEQ ID NO: 941646 - RNA, 14 nt, Mycobacterium avium subsp. paratuberculosis
ggugaucacccagc

SEQ ID NO: 941647 - RNA, 13 nt, Mycobacterium avium subsp. paratuberculosis
ggugaucacccgc

SEQ ID NO: 941648 - RNA, 19 nt, Mycobacterium avium subsp. paratuberculosis
ggugaguucaucgacgucg

SEQ ID NO: 941649 - RNA, 18 nt, Mycobacterium avium subsp. paratuberculosis
ggugaguucgucggcgau

SEQ ID NO: 941650 - RNA, 14 nt, Mycobacterium avium subsp. paratuberculosis
ggugaguagccgau

SEQ ID NO: 941651 - RNA, 21 nt, Mycobacterium avium subsp. paratuberculosis
ggucugaaagugacggguugg

SEQ ID NO: 941652 - RNA, 21 nt, Mycobacterium avium subsp. paratuberculosis
ggucuuucaucgccccggcga

SEQ ID NO: 941653 - RNA, 15 nt, Mycobacterium avium subsp. paratuberculosis
ggucuuugccggcca

SEQ ID NO: 941654 - RNA, 14 nt, Mycobacterium avium subsp. paratuberculosis
ggugaacaccccgc

SEQ ID NO: 941655 - RNA, 19 nt, Mycobacterium avium subsp. paratuberculosis
ggugaacacgaacggcgcc

SEQ ID NO: 941656 - RNA, 21 nt, Mycobacterium avium subsp. paratuberculosis
ggugaacacgaacggcgccuu

SEQ ID NO: 941657 - RNA, 19 nt, Mycobacterium avium subsp. paratuberculosis
ggugaacagcagccacgac

SEQ ID NO: 941658 - RNA, 22 nt, Mycobacterium avium subsp. paratuberculosis
ggugaacgaggccgcgccgugc

SEQ ID NO: 941659 - RNA, 18 nt, Mycobacterium avium subsp. paratuberculosis
ggugaacgccggugaggu

SEQ ID NO: 941660 - RNA, 16 nt, Mycobacterium avium subsp. paratuberculosis
ggugaacucgccgauc

SEQ ID NO: 941661 - RNA, 21 nt, Mycobacterium avium subsp. paratuberculosis
ggugaccgucacccccggcgc

SEQ ID NO: 941662 - RNA, 16 nt, Mycobacterium avium subsp. paratuberculosis
ggugaccgucgccgac

SEQ ID NO: 941663 - RNA, 17 nt, Mycobacterium avium subsp. paratuberculosis
ggugaccgucgccgacc

SEQ ID NO: 941664 - RNA, 14 nt, Mycobacterium avium subsp. paratuberculosis
ggugaccucccgga

SEQ ID NO: 941665 - RNA, 11 nt, Mycobacterium avium subsp. paratuberculosis
ggugaccucga

SEQ ID NO: 941666 - RNA, 19 nt, Mycobacterium avium subsp. paratuberculosis
ggugaccucgagcaccggc

SEQ ID NO: 941667 - RNA, 24 nt, Mycobacterium avium subsp. paratuberculosis
ggugaccucgagcaccggcggcag

SEQ ID NO: 941668 - RNA, 22 nt, Mycobacterium avium subsp. paratuberculosis
ggugaccucgagcagcgcgcgc

SEQ ID NO: 941669 - RNA, 20 nt, Mycobacterium avium subsp. paratuberculosis
ggucuccgggcugugggcgc

SEQ ID NO: 941670 - RNA, 15 nt, Mycobacterium avium subsp. paratuberculosis
ggucuccgucggcgc

SEQ ID NO: 941671 - RNA, 19 nt, Mycobacterium avium subsp. paratuberculosis
ggucgugcagcaccgccag

SEQ ID NO: 941672 - RNA, 15 nt, Mycobacterium avium subsp. paratuberculosis
ggucuccggccccga

SEQ ID NO: 941673 - RNA, 18 nt, Mycobacterium avium subsp. paratuberculosis
ggucuccggccccgagcc

SEQ ID NO: 941674 - RNA, 22 nt, Mycobacterium avium subsp. paratuberculosis
ggucgucggguuggccagggcg

SEQ ID NO: 941675 - RNA, 20 nt, Mycobacterium avium subsp. paratuberculosis
ggucgucgucgucggugaug

SEQ ID NO: 941676 - RNA, 14 nt, Mycobacterium avium subsp. paratuberculosis
ggucgucgugguga

SEQ ID NO: 941677 - RNA, 15 nt, Mycobacterium avium subsp. paratuberculosis
ggucgucgcggucca

SEQ ID NO: 941678 - RNA, 13 nt, Mycobacterium avium subsp. paratuberculosis
ggucgucggccag

SEQ ID NO: 941679 - RNA, 16 nt, Mycobacterium avium subsp. paratuberculosis
ggucgucggcgucgga

SEQ ID NO: 941680 - RNA, 21 nt, Mycobacterium avium subsp. paratuberculosis
ggucgucuucuuggccgcggc

SEQ ID NO: 941681 - RNA, 16 nt, Mycobacterium avium subsp. paratuberculosis
ggucucguugugcacc

SEQ ID NO: 941682 - RNA, 16 nt, Mycobacterium avium subsp. paratuberculosis
ggucucgggcaccacg

SEQ ID NO: 941683 - RNA, 17 nt, Mycobacterium avium subsp. paratuberculosis
ggucucgggcaccacgc

SEQ ID NO: 941684 - RNA, 18 nt, Mycobacterium avium subsp. paratuberculosis
ggucucgggcaccacgcc

SEQ ID NO: 941685 - RNA, 20 nt, Mycobacterium avium subsp. paratuberculosis
ggucucgggcagcagcacca

SEQ ID NO: 941686 - RNA, 21 nt, Mycobacterium avium subsp. paratuberculosis
ggucucgggcagcagcaccag

SEQ ID NO: 941687 - RNA, 16 nt, Mycobacterium avium subsp. paratuberculosis
ggucuccuggccgccg

SEQ ID NO: 941688 - RNA, 17 nt, Mycobacterium avium subsp. paratuberculosis
ggucucgaacacgccgu

SEQ ID NO: 941689 - RNA, 17 nt, Mycobacterium avium subsp. paratuberculosis
ggucucgaaccgggcgg

SEQ ID NO: 941690 - RNA, 14 nt, Mycobacterium avium subsp. paratuberculosis
ggucucgacguugg

SEQ ID NO: 941691 - RNA, 16 nt, Mycobacterium avium subsp. paratuberculosis
ggucucgaucugcacc

SEQ ID NO: 941692 - RNA, 18 nt, Mycobacterium avium subsp. paratuberculosis
ggucucgaucugcaccag

SEQ ID NO: 941693 - RNA, 21 nt, Mycobacterium avium subsp. paratuberculosis
ggucucgaucugcaccagcgc

SEQ ID NO: 941694 - RNA, 22 nt, Mycobacterium avium subsp. paratuberculosis
ggucucgcgcagcacgaugauc

SEQ ID NO: 941695 - RNA, 16 nt, Mycobacterium avium subsp. paratuberculosis
ggucucggcggcgccc

SEQ ID NO: 941696 - RNA, 19 nt, Mycobacterium avium subsp. paratuberculosis
ggucucggcggcgcccagg

SEQ ID NO: 941697 - RNA, 19 nt, Mycobacterium avium subsp. paratuberculosis
guccgcaacgccggcgugc

SEQ ID NO: 941698 - RNA, 20 nt, Mycobacterium avium subsp. paratuberculosis
guccgcaacgccggcgugca

SEQ ID NO: 941699 - RNA, 16 nt, Mycobacterium avium subsp. paratuberculosis
guccgcaaccgccggc

SEQ ID NO: 941700 - RNA, 18 nt, Mycobacterium avium subsp. paratuberculosis
guccgcaaccgccggcag

SEQ ID NO: 941701 - RNA, 22 nt, Mycobacterium avium subsp. paratuberculosis
guccgcaaccgccggcagcggc

SEQ ID NO: 941702 - RNA, 17 nt, Mycobacterium avium subsp. paratuberculosis
guccgaucguccggcgc

SEQ ID NO: 941703 - RNA, 22 nt, Mycobacterium avium subsp. paratuberculosis
guccgaugacgagcagcgugcu

SEQ ID NO: 941704 - RNA, 16 nt, Mycobacterium avium subsp. paratuberculosis
guccgagcagcagccg

SEQ ID NO: 941705 - RNA, 18 nt, Mycobacterium avium subsp. paratuberculosis
guccgagcagcagccgca

SEQ ID NO: 941706 - RNA, 15 nt, Mycobacterium avium subsp. paratuberculosis
guccgaggugaucgc

SEQ ID NO: 941707 - RNA, 16 nt, Mycobacterium avium subsp. paratuberculosis
guccgaggugaucgcg

SEQ ID NO: 941708 - RNA, 17 nt, Mycobacterium avium subsp. paratuberculosis
guccgauaccagccgcg

SEQ ID NO: 941709 - RNA, 19 nt, Mycobacterium avium subsp. paratuberculosis
guccgauaccagccgcgga

SEQ ID NO: 941710 - RNA, 15 nt, Mycobacterium avium subsp. paratuberculosis
guccgagccgcccac

SEQ ID NO: 941711 - RNA, 16 nt, Mycobacterium avium subsp. paratuberculosis
guccgagccgcccacg

SEQ ID NO: 941712 - RNA, 14 nt, Mycobacterium avium subsp. paratuberculosis
guccgaggccccgc

SEQ ID NO: 941713 - RNA, 18 nt, Mycobacterium avium subsp. paratuberculosis
guccgaggccccgccaga

SEQ ID NO: 941714 - RNA, 14 nt, Mycobacterium avium subsp. paratuberculosis
guccgaggcgguuc

SEQ ID NO: 941715 - RNA, 22 nt, Mycobacterium avium subsp. paratuberculosis
guccgaggcgguuccgguggcg

SEQ ID NO: 941716 - RNA, 11 nt, Mycobacterium avium subsp. paratuberculosis
guccgacggcu

SEQ ID NO: 941717 - RNA, 16 nt, Mycobacterium avium subsp. paratuberculosis
guccgacggcuaccug

SEQ ID NO: 941718 - RNA, 22 nt, Mycobacterium avium subsp. paratuberculosis
guccgacggcugcgguuggccg

SEQ ID NO: 941719 - RNA, 17 nt, Mycobacterium avium subsp. paratuberculosis
guccgagaagggccgcc

SEQ ID NO: 941720 - RNA, 20 nt, Mycobacterium avium subsp. paratuberculosis
guccgagaagggccgccgcu

SEQ ID NO: 941721 - RNA, 14 nt, Mycobacterium avium subsp. paratuberculosis
guccgagacgucgg

SEQ ID NO: 941722 - RNA, 17 nt, Mycobacterium avium subsp. paratuberculosis
guccgagacgucggcgu

SEQ ID NO: 941723 - RNA, 12 nt, Mycobacterium avium subsp. paratuberculosis
gucccugcggcu

SEQ ID NO: 941724 - RNA, 16 nt, Mycobacterium avium subsp. paratuberculosis
gucccuggcgaugauc

SEQ ID NO: 941725 - RNA, 13 nt, Mycobacterium avium subsp. paratuberculosis
guccccggagagc

SEQ ID NO: 941726 - RNA, 12 nt, Mycobacterium avium subsp. paratuberculosis
guccccggaguc

SEQ ID NO: 941727 - RNA, 14 nt, Mycobacterium avium subsp. paratuberculosis
guccccgcggguga

SEQ ID NO: 941728 - RNA, 23 nt, Mycobacterium avium subsp. paratuberculosis
guccccgccuucgaugcccucca

SEQ ID NO: 941729 - RNA, 18 nt, Mycobacterium avium subsp. paratuberculosis
guccccgcgcccgccgcg

SEQ ID NO: 941730 - RNA, 19 nt, Mycobacterium avium subsp. paratuberculosis
guccccgcgcccgccgcgu

SEQ ID NO: 941731 - RNA, 16 nt, Mycobacterium avium subsp. paratuberculosis
guccccgcgccgggca

SEQ ID NO: 941732 - RNA, 17 nt, Mycobacterium avium subsp. paratuberculosis
guccccgcgccgggcaa

SEQ ID NO: 941733 - RNA, 18 nt, Mycobacterium avium subsp. paratuberculosis
guccccgcgccgggcaau

SEQ ID NO: 941734 - RNA, 13 nt, Mycobacterium avium subsp. paratuberculosis
guccccgcgcggc

SEQ ID NO: 941735 - RNA, 16 nt, Mycobacterium avium subsp. paratuberculosis
guccccgcgcggcucg

SEQ ID NO: 941736 - RNA, 15 nt, Mycobacterium avium subsp. paratuberculosis
guccccgccgguggc

SEQ ID NO: 941737 - RNA, 13 nt, Mycobacterium avium subsp. paratuberculosis
guccccgccgccg

SEQ ID NO: 941738 - RNA, 14 nt, Mycobacterium avium subsp. paratuberculosis
guccccgccgccgu

SEQ ID NO: 941739 - RNA, 17 nt, Mycobacterium avium subsp. paratuberculosis
guccccgccgccgugca

SEQ ID NO: 941740 - RNA, 23 nt, Mycobacterium avium subsp. paratuberculosis
guccccgaccaucauggccuccc

SEQ ID NO: 941741 - RNA, 19 nt, Mycobacterium avium subsp. paratuberculosis
guccccgauuucgcggccg

SEQ ID NO: 941742 - RNA, 18 nt, Mycobacterium avium subsp. paratuberculosis
guccccgggcaccccggu

SEQ ID NO: 941743 - RNA, 22 nt, Mycobacterium avium subsp. paratuberculosis
gucccgggcgaacgucgggucg

SEQ ID NO: 941744 - RNA, 22 nt, Mycobacterium avium subsp. paratuberculosis
gucccggggcucgacaggcagc

SEQ ID NO: 941745 - RNA, 18 nt, Mycobacterium avium subsp. paratuberculosis
gucccgguacaggucgcu

SEQ ID NO: 941746 - RNA, 16 nt, Mycobacterium avium subsp. paratuberculosis
gucccggucagcgucc

SEQ ID NO: 941747 - RNA, 22 nt, Mycobacterium avium subsp. paratuberculosis
gucccggucagguugacgccga

SEQ ID NO: 941748 - RNA, 14 nt, Mycobacterium avium subsp. paratuberculosis
gucccggucgaaca

SEQ ID NO: 941749 - RNA, 19 nt, Mycobacterium avium subsp. paratuberculosis
gucccggugucgccgucgc

SEQ ID NO: 941750 - RNA, 20 nt, Mycobacterium avium subsp. paratuberculosis
gucccggugucgccgucgcc

SEQ ID NO: 941751 - RNA, 18 nt, Mycobacterium avium subsp. paratuberculosis
gucccgguugaccccggc

SEQ ID NO: 941752 - RNA, 20 nt, Mycobacterium avium subsp. paratuberculosis
gucccgguugaccccggccc

SEQ ID NO: 941753 - RNA, 16 nt, Mycobacterium avium subsp. paratuberculosis
gucccguccaucgccg

SEQ ID NO: 941754 - RNA, 19 nt, Mycobacterium avium subsp. paratuberculosis
gucccguccaucgccgcgc

SEQ ID NO: 941755 - RNA, 20 nt, Mycobacterium avium subsp. paratuberculosis
gucccguccaucgccgcgca

SEQ ID NO: 941756 - RNA, 21 nt, Mycobacterium avium subsp. paratuberculosis
gucccguccugggccuggcgc

SEQ ID NO: 941757 - RNA, 12 nt, Mycobacterium avium subsp. paratuberculosis
gucccgucgacc

SEQ ID NO: 941758 - RNA, 12 nt, Mycobacterium avium subsp. paratuberculosis
gucccgucggcc

SEQ ID NO: 941759 - RNA, 15 nt, Mycobacterium avium subsp. paratuberculosis
gucccgugcgccgcc

SEQ ID NO: 941760 - RNA, 16 nt, Mycobacterium avium subsp. paratuberculosis
gucccgugcgccgccc

SEQ ID NO: 941761 - RNA, 17 nt, Mycobacterium avium subsp. paratuberculosis
gucccgugcgccgccca

SEQ ID NO: 941762 - RNA, 12 nt, Mycobacterium avium subsp. paratuberculosis
gucccucggcga

SEQ ID NO: 941763 - RNA, 13 nt, Mycobacterium avium subsp. paratuberculosis
guccgcaggcgaa

SEQ ID NO: 941764 - RNA, 20 nt, Mycobacterium avium subsp. paratuberculosis
guccgcaccgcgacgagauc

SEQ ID NO: 941765 - RNA, 22 nt, Mycobacterium avium subsp. paratuberculosis
guccgcagauagaucgacgcga

SEQ ID NO: 941766 - RNA, 17 nt, Mycobacterium avium subsp. paratuberculosis
guccgcgaggaaucgcg

SEQ ID NO: 941767 - RNA, 20 nt, Mycobacterium avium subsp. paratuberculosis
guccgcgaggaaucgcggca

SEQ ID NO: 941768 - RNA, 12 nt, Mycobacterium avium subsp. paratuberculosis
guccgcgaucgu

SEQ ID NO: 941769 - RNA, 13 nt, Mycobacterium avium subsp. paratuberculosis
guccgcgacgcug

SEQ ID NO: 941770 - RNA, 19 nt, Mycobacterium avium subsp. paratuberculosis
guccgcgacgcugagcgcc

SEQ ID NO: 941771 - RNA, 23 nt, Mycobacterium avium subsp. paratuberculosis
guccgcgacgcugagcgccaggc

SEQ ID NO: 941772 - RNA, 14 nt, Mycobacterium avium subsp. paratuberculosis
guccgccagggugc

SEQ ID NO: 941773 - RNA, 18 nt, Mycobacterium avium subsp. paratuberculosis
guccgccagggugccgcu

SEQ ID NO: 941774 - RNA, 24 nt, Mycobacterium avium subsp. paratuberculosis
guccgccagggugccgcugcccgc

SEQ ID NO: 941775 - RNA, 12 nt, Mycobacterium avium subsp. paratuberculosis
guccgcgcccac

SEQ ID NO: 941776 - RNA, 13 nt, Mycobacterium avium subsp. paratuberculosis
guccgcgcccacc

SEQ ID NO: 941777 - RNA, 15 nt, Mycobacterium avium subsp. paratuberculosis
guccgcgcccacccg

SEQ ID NO: 941778 - RNA, 21 nt, Mycobacterium avium subsp. paratuberculosis
guccgcgaacgggugcggcgc

SEQ ID NO: 941779 - RNA, 22 nt, Mycobacterium avium subsp. paratuberculosis
guccgcgaacgggugcggcgcu

SEQ ID NO: 941780 - RNA, 20 nt, Mycobacterium avium subsp. paratuberculosis
guccgcgaacucgucgacgc

SEQ ID NO: 941781 - RNA, 13 nt, Mycobacterium avium subsp. paratuberculosis
guccggccgugau

SEQ ID NO: 941782 - RNA, 21 nt, Mycobacterium avium subsp. paratuberculosis
guccggccgugaugcgccggc

SEQ ID NO: 941783 - RNA, 13 nt, Mycobacterium avium subsp. paratuberculosis
guccggcgacaug

SEQ ID NO: 941784 - RNA, 12 nt, Mycobacterium avium subsp. paratuberculosis
guccgcgccggu

SEQ ID NO: 941785 - RNA, 22 nt, Mycobacterium avium subsp. paratuberculosis
guccgcgccggucccgcggcgg

SEQ ID NO: 941786 - RNA, 20 nt, Mycobacterium avium subsp. paratuberculosis
guccgcgcgaccaucagccc

SEQ ID NO: 941787 - RNA, 21 nt, Mycobacterium avium subsp. paratuberculosis
guccgcgcgaccaucagcccg

SEQ ID NO: 941788 - RNA, 22 nt, Mycobacterium avium subsp. paratuberculosis
guccgcgcgaccaucagcccgg

SEQ ID NO: 941789 - RNA, 12 nt, Mycobacterium avium subsp. paratuberculosis
guccgcgccggc

SEQ ID NO: 941790 - RNA, 13 nt, Mycobacterium avium subsp. paratuberculosis
guccgcgccggcg

SEQ ID NO: 941791 - RNA, 15 nt, Mycobacterium avium subsp. paratuberculosis
guccgcgccggcgca

SEQ ID NO: 941792 - RNA, 14 nt, Mycobacterium avium subsp. paratuberculosis
guccggcucggugc

SEQ ID NO: 941793 - RNA, 15 nt, Mycobacterium avium subsp. paratuberculosis
guccggcucggugcc

SEQ ID NO: 941794 - RNA, 16 nt, Mycobacterium avium subsp. paratuberculosis
guccggcucggugccg

SEQ ID NO: 941795 - RNA, 23 nt, Mycobacterium avium subsp. paratuberculosis
guccggcucugccugcaggaugg

SEQ ID NO: 941796 - RNA, 19 nt, Mycobacterium avium subsp. paratuberculosis
guccggcugaacgccagca

SEQ ID NO: 941797 - RNA, 15 nt, Mycobacterium avium subsp. paratuberculosis
guccggcggucagca

SEQ ID NO: 941798 - RNA, 22 nt, Mycobacterium avium subsp. paratuberculosis
guccggcggucgcugcagcggc

SEQ ID NO: 941799 - RNA, 23 nt, Mycobacterium avium subsp. paratuberculosis
guccggcggucgcugcagcggcg

SEQ ID NO: 941800 - RNA, 24 nt, Mycobacterium avium subsp. paratuberculosis
guccggcggucgcugcagcggcgg

SEQ ID NO: 941801 - RNA, 20 nt, Mycobacterium avium subsp. paratuberculosis
guccggcggcaccacccgcg

SEQ ID NO: 941802 - RNA, 13 nt, Mycobacterium avium subsp. paratuberculosis
guccggcgcccgg

SEQ ID NO: 941803 - RNA, 14 nt, Mycobacterium avium subsp. paratuberculosis
guccggcgccgacc

SEQ ID NO: 941804 - RNA, 21 nt, Mycobacterium avium subsp. paratuberculosis
guccggcgccgacccccgccg

SEQ ID NO: 941805 - RNA, 15 nt, Mycobacterium avium subsp. paratuberculosis
guccggcgcgcagca

SEQ ID NO: 941806 - RNA, 16 nt, Mycobacterium avium subsp. paratuberculosis
guccggcgcgcccgga

SEQ ID NO: 941807 - RNA, 22 nt, Mycobacterium avium subsp. paratuberculosis
guccggcgaguacccgccgcac

SEQ ID NO: 941808 - RNA, 14 nt, Mycobacterium avium subsp. paratuberculosis
guccggcgccagcc

SEQ ID NO: 941809 - RNA, 17 nt, Mycobacterium avium subsp. paratuberculosis
guccggcgccagcccgg

SEQ ID NO: 941810 - RNA, 22 nt, Mycobacterium avium subsp. paratuberculosis
guccggcgccagcccggugauc

SEQ ID NO: 941811 - RNA, 14 nt, Mycobacterium avium subsp. paratuberculosis
guccagccgcacga

SEQ ID NO: 941812 - RNA, 15 nt, Mycobacterium avium subsp. paratuberculosis
guccagccgccgcgu

SEQ ID NO: 941813 - RNA, 13 nt, Mycobacterium avium subsp. paratuberculosis
guccagccgccgg

SEQ ID NO: 941814 - RNA, 14 nt, Mycobacterium avium subsp. paratuberculosis
guccagccgccggc

SEQ ID NO: 941815 - RNA, 15 nt, Mycobacterium avium subsp. paratuberculosis
guccagccgccggcg

SEQ ID NO: 941816 - RNA, 16 nt, Mycobacterium avium subsp. paratuberculosis
guccagccgccggcgg

SEQ ID NO: 941817 - RNA, 12 nt, Mycobacterium avium subsp. paratuberculosis
guccagcgccga

SEQ ID NO: 941818 - RNA, 19 nt, Mycobacterium avium subsp. paratuberculosis
guccagccggucgcaggug

SEQ ID NO: 941819 - RNA, 17 nt, Mycobacterium avium subsp. paratuberculosis
guccagccggugcacca

SEQ ID NO: 941820 - RNA, 13 nt, Mycobacterium avium subsp. paratuberculosis
guccagccgugcg

SEQ ID NO: 941821 - RNA, 15 nt, Mycobacterium avium subsp. paratuberculosis
guccagccgugcggc

SEQ ID NO: 941822 - RNA, 19 nt, Mycobacterium avium subsp. paratuberculosis
guccagcgaaucgaccggg

SEQ ID NO: 941823 - RNA, 14 nt, Mycobacterium avium subsp. paratuberculosis
guccagcgccgcca

SEQ ID NO: 941824 - RNA, 13 nt, Mycobacterium avium subsp. paratuberculosis
guccagcccgcgc

SEQ ID NO: 941825 - RNA, 17 nt, Mycobacterium avium subsp. paratuberculosis
guccagcccgcgccagc

SEQ ID NO: 941826 - RNA, 21 nt, Mycobacterium avium subsp. paratuberculosis
guccagcccgcgccagcucgg

SEQ ID NO: 941827 - RNA, 17 nt, Mycobacterium avium subsp. paratuberculosis
guccagccagccgcgcc

SEQ ID NO: 941828 - RNA, 20 nt, Mycobacterium avium subsp. paratuberculosis
guccagccagccgcgccgcg

SEQ ID NO: 941829 - RNA, 17 nt, Mycobacterium avium subsp. paratuberculosis
guccagcaugcccacgc

SEQ ID NO: 941830 - RNA, 19 nt, Mycobacterium avium subsp. paratuberculosis
guccagcagcgagaaccgg

SEQ ID NO: 941831 - RNA, 14 nt, Mycobacterium avium subsp. paratuberculosis
guccagcagcgccg

SEQ ID NO: 941832 - RNA, 15 nt, Mycobacterium avium subsp. paratuberculosis
guccagcagcgccgg

SEQ ID NO: 941833 - RNA, 17 nt, Mycobacterium avium subsp. paratuberculosis
guccagcucagcgcgca

SEQ ID NO: 941834 - RNA, 18 nt, Mycobacterium avium subsp. paratuberculosis
guccagcucagcgcgcac

SEQ ID NO: 941835 - RNA, 16 nt, Mycobacterium avium subsp. paratuberculosis
guccagcugcgcgccg

SEQ ID NO: 941836 - RNA, 18 nt, Mycobacterium avium subsp. paratuberculosis
guccagcugcgcgccggc

SEQ ID NO: 941837 - RNA, 20 nt, Mycobacterium avium subsp. paratuberculosis
guccagcugcgcgccggcgg

SEQ ID NO: 941838 - RNA, 22 nt, Mycobacterium avium subsp. paratuberculosis
guccagcugcgcgccggcggcc

SEQ ID NO: 941839 - RNA, 16 nt, Mycobacterium avium subsp. paratuberculosis
guccagcuccgccgac

SEQ ID NO: 941840 - RNA, 17 nt, Mycobacterium avium subsp. paratuberculosis
guccagcuccgccgaca

SEQ ID NO: 941841 - RNA, 19 nt, Mycobacterium avium subsp. paratuberculosis
guccagcuccgccgacacc

SEQ ID NO: 941842 - RNA, 21 nt, Mycobacterium avium subsp. paratuberculosis
guccagcucgcgaagcgcgau

SEQ ID NO: 941843 - RNA, 22 nt, Mycobacterium avium subsp. paratuberculosis
guccaggccgaggcugacgauc

SEQ ID NO: 941844 - RNA, 16 nt, Mycobacterium avium subsp. paratuberculosis
guccaggaucacgcgg

SEQ ID NO: 941845 - RNA, 20 nt, Mycobacterium avium subsp. paratuberculosis
guccaggaucacgcggcggg

SEQ ID NO: 941846 - RNA, 19 nt, Mycobacterium avium subsp. paratuberculosis
guccaggauccgcaccggg

SEQ ID NO: 941847 - RNA, 21 nt, Mycobacterium avium subsp. paratuberculosis
guccaggauccgcaccgggca

SEQ ID NO: 941848 - RNA, 19 nt, Mycobacterium avium subsp. paratuberculosis
guccaggaucugcagcacg

SEQ ID NO: 941849 - RNA, 20 nt, Mycobacterium avium subsp. paratuberculosis
guccagcuugucguagcggc

SEQ ID NO: 941850 - RNA, 22 nt, Mycobacterium avium subsp. paratuberculosis
guccagcuugucguagcggcgc

SEQ ID NO: 941851 - RNA, 18 nt, Mycobacterium avium subsp. paratuberculosis
guccagcgugugcguggu

SEQ ID NO: 941852 - RNA, 13 nt, Mycobacterium avium subsp. paratuberculosis
guccagcgucgcg

SEQ ID NO: 941853 - RNA, 16 nt, Mycobacterium avium subsp. paratuberculosis
guccagcgucgcggcc

SEQ ID NO: 941854 - RNA, 19 nt, Mycobacterium avium subsp. paratuberculosis
guccagcgucgcggccggg

SEQ ID NO: 941855 - RNA, 17 nt, Mycobacterium avium subsp. paratuberculosis
guccagcgugccgcgca

SEQ ID NO: 941856 - RNA, 20 nt, Mycobacterium avium subsp. paratuberculosis
guccagcgugccgcgcacca

SEQ ID NO: 941857 - RNA, 13 nt, Mycobacterium avium subsp. paratuberculosis
guccagcgcgucg

SEQ ID NO: 941858 - RNA, 14 nt, Mycobacterium avium subsp. paratuberculosis
guccagcgcgucgc

SEQ ID NO: 941859 - RNA, 20 nt, Mycobacterium avium subsp. paratuberculosis
guccagcggguugucgucgu

SEQ ID NO: 941860 - RNA, 22 nt, Mycobacterium avium subsp. paratuberculosis
guccagcggguugucgucgucg

SEQ ID NO: 941861 - RNA, 17 nt, Mycobacterium avium subsp. paratuberculosis
guccagcguccgggcgu

SEQ ID NO: 941862 - RNA, 21 nt, Mycobacterium avium subsp. paratuberculosis
guccagcgucgacugcaccga

SEQ ID NO: 941863 - RNA, 13 nt, Mycobacterium avium subsp. paratuberculosis
guccagcggcucg

SEQ ID NO: 941864 - RNA, 15 nt, Mycobacterium avium subsp. paratuberculosis
guccaggcgaccggc

SEQ ID NO: 941865 - RNA, 17 nt, Mycobacterium avium subsp. paratuberculosis
guccaggcgaccggccc

SEQ ID NO: 941866 - RNA, 16 nt, Mycobacterium avium subsp. paratuberculosis
guccaggcgcaccgcc

SEQ ID NO: 941867 - RNA, 17 nt, Mycobacterium avium subsp. paratuberculosis
guccaggcgcaccgcca

SEQ ID NO: 941868 - RNA, 22 nt, Mycobacterium avium subsp. paratuberculosis
guccaggcgcaccgccaccgcg

SEQ ID NO: 941869 - RNA, 14 nt, Mycobacterium avium subsp. paratuberculosis
guccaggccgucga

SEQ ID NO: 941870 - RNA, 23 nt, Mycobacterium avium subsp. paratuberculosis
guccaggccgucgaggcgcugca

SEQ ID NO: 941871 - RNA, 14 nt, Mycobacterium avium subsp. paratuberculosis
guccaggccggcgc

SEQ ID NO: 941872 - RNA, 18 nt, Mycobacterium avium subsp. paratuberculosis
guccaggccggcgccgcg

SEQ ID NO: 941873 - RNA, 17 nt, Mycobacterium avium subsp. paratuberculosis
guccaggcguucgaccc

SEQ ID NO: 941874 - RNA, 16 nt, Mycobacterium avium subsp. paratuberculosis
guccagguggccaugg

SEQ ID NO: 941875 - RNA, 21 nt, Mycobacterium avium subsp. paratuberculosis
guccaggugcacccgcggcgc

SEQ ID NO: 941876 - RNA, 22 nt, Mycobacterium avium subsp. paratuberculosis
guccaggugcacccgcggcgcg

SEQ ID NO: 941877 - RNA, 23 nt, Mycobacterium avium subsp. paratuberculosis
guccaggugcgccgccgcgucgc

SEQ ID NO: 941878 - RNA, 20 nt, Mycobacterium avium subsp. paratuberculosis
guccaggguggugguggugc

SEQ ID NO: 941879 - RNA, 23 nt, Mycobacterium avium subsp. paratuberculosis
guccaggguggugguggugccca

SEQ ID NO: 941880 - RNA, 14 nt, Mycobacterium avium subsp. paratuberculosis
guccagggugucgu

SEQ ID NO: 941881 - RNA, 17 nt, Mycobacterium avium subsp. paratuberculosis
guccagggugucgucgu

SEQ ID NO: 941882 - RNA, 15 nt, Mycobacterium avium subsp. paratuberculosis
guccaggucgcccuc

SEQ ID NO: 941883 - RNA, 14 nt, Mycobacterium avium subsp. paratuberculosis
guccaggguggcca

SEQ ID NO: 941884 - RNA, 17 nt, Mycobacterium avium subsp. paratuberculosis
guccaggguggccagca

SEQ ID NO: 941885 - RNA, 19 nt, Mycobacterium avium subsp. paratuberculosis
guccaggguggccagcacg

SEQ ID NO: 941886 - RNA, 21 nt, Mycobacterium avium subsp. paratuberculosis
guccaggguggccagcacgcu

SEQ ID NO: 941887 - RNA, 13 nt, Mycobacterium avium subsp. paratuberculosis
guccagggccacc

SEQ ID NO: 941888 - RNA, 17 nt, Mycobacterium avium subsp. paratuberculosis
guccagggccaccgcgu

SEQ ID NO: 941889 - RNA, 19 nt, Mycobacterium avium subsp. paratuberculosis
guccagggccaccgcgucg

SEQ ID NO: 941890 - RNA, 22 nt, Mycobacterium avium subsp. paratuberculosis
guccaugcucuugcgggcggca

SEQ ID NO: 941891 - RNA, 20 nt, Mycobacterium avium subsp. paratuberculosis
guccaugcuggugccgccga

SEQ ID NO: 941892 - RNA, 18 nt, Mycobacterium avium subsp. paratuberculosis
guccaucguccucgcgcc

SEQ ID NO: 941893 - RNA, 15 nt, Mycobacterium avium subsp. paratuberculosis
guccaucuccagcuc

SEQ ID NO: 941894 - RNA, 15 nt, Mycobacterium avium subsp. paratuberculosis
guccaguacaccgcg

SEQ ID NO: 941895 - RNA, 16 nt, Mycobacterium avium subsp. paratuberculosis
guccaguagccgccgg

SEQ ID NO: 941896 - RNA, 16 nt, Mycobacterium avium subsp. paratuberculosis
gucccaauccucgccg

SEQ ID NO: 941897 - RNA, 20 nt, Mycobacterium avium subsp. paratuberculosis
gucccacaccaccaccgagc

SEQ ID NO: 941898 - RNA, 17 nt, Mycobacterium avium subsp. paratuberculosis
gucccacagcggggucg

SEQ ID NO: 941899 - RNA, 17 nt, Mycobacterium avium subsp. paratuberculosis
gucccccgagcgggccu

SEQ ID NO: 941900 - RNA, 16 nt, Mycobacterium avium subsp. paratuberculosis
gucccaccggcgaugu

SEQ ID NO: 941901 - RNA, 17 nt, Mycobacterium avium subsp. paratuberculosis
gucccaccggcgaugug

SEQ ID NO: 941902 - RNA, 24 nt, Mycobacterium avium subsp. paratuberculosis
gucccacguggugaucagcauccg

SEQ ID NO: 941903 - RNA, 13 nt, Mycobacterium avium subsp. paratuberculosis
gucauugaucucc

SEQ ID NO: 941904 - RNA, 19 nt, Mycobacterium avium subsp. paratuberculosis
gucauugaucuccgcggcg

SEQ ID NO: 941905 - RNA, 18 nt, Mycobacterium avium subsp. paratuberculosis
gucauuccgccgcgcccg

SEQ ID NO: 941906 - RNA, 19 nt, Mycobacterium avium subsp. paratuberculosis
gucauuccgccgcgcccgu

SEQ ID NO: 941907 - RNA, 22 nt, Mycobacterium avium subsp. paratuberculosis
gucauucugaauucggccaccg

SEQ ID NO: 941908 - RNA, 20 nt, Mycobacterium avium subsp. paratuberculosis
guccaaagacguugaccgcg

SEQ ID NO: 941909 - RNA, 23 nt, Mycobacterium avium subsp. paratuberculosis
guccaacaggugcuuggucagcg

SEQ ID NO: 941910 - RNA, 20 nt, Mycobacterium avium subsp. paratuberculosis
guccaacgggcucagcacca

SEQ ID NO: 941911 - RNA, 18 nt, Mycobacterium avium subsp. paratuberculosis
guccaacguggguggccc

SEQ ID NO: 941912 - RNA, 18 nt, Mycobacterium avium subsp. paratuberculosis
guccaccaggugaccggc

SEQ ID NO: 941913 - RNA, 23 nt, Mycobacterium avium subsp. paratuberculosis
guccaccauggcuuccgccgaga

SEQ ID NO: 941914 - RNA, 17 nt, Mycobacterium avium subsp. paratuberculosis
guccacccccgcgguga

SEQ ID NO: 941915 - RNA, 19 nt, Mycobacterium avium subsp. paratuberculosis
guccacccccgcggugagu

SEQ ID NO: 941916 - RNA, 14 nt, Mycobacterium avium subsp. paratuberculosis
guccaccccgccaa

SEQ ID NO: 941917 - RNA, 13 nt, Mycobacterium avium subsp. paratuberculosis
guccaccgacgcc

SEQ ID NO: 941918 - RNA, 14 nt, Mycobacterium avium subsp. paratuberculosis
guccaccgacgcca

SEQ ID NO: 941919 - RNA, 13 nt, Mycobacterium avium subsp. paratuberculosis
guccacccgcgcc

SEQ ID NO: 941920 - RNA, 15 nt, Mycobacterium avium subsp. paratuberculosis
guccaccgccgcgcc

SEQ ID NO: 941921 - RNA, 18 nt, Mycobacterium avium subsp. paratuberculosis
guccaccgccgcgccgag

SEQ ID NO: 941922 - RNA, 19 nt, Mycobacterium avium subsp. paratuberculosis
guccaccagaucgccccgc

SEQ ID NO: 941923 - RNA, 14 nt, Mycobacterium avium subsp. paratuberculosis
guccaccagcacca

SEQ ID NO: 941924 - RNA, 17 nt, Mycobacterium avium subsp. paratuberculosis
guccaccagcaccaggc

SEQ ID NO: 941925 - RNA, 16 nt, Mycobacterium avium subsp. paratuberculosis
guccacagccggcggc

SEQ ID NO: 941926 - RNA, 17 nt, Mycobacterium avium subsp. paratuberculosis
guccacaccgggaaggu

SEQ ID NO: 941927 - RNA, 15 nt, Mycobacterium avium subsp. paratuberculosis
guccacacguccugg

SEQ ID NO: 941928 - RNA, 20 nt, Mycobacterium avium subsp. paratuberculosis
guccaccaccaacccggucu

SEQ ID NO: 941929 - RNA, 19 nt, Mycobacterium avium subsp. paratuberculosis
guccaccaccacacccgcg

SEQ ID NO: 941930 - RNA, 21 nt, Mycobacterium avium subsp. paratuberculosis
guccaccaccacacccgcggc

SEQ ID NO: 941931 - RNA, 22 nt, Mycobacterium avium subsp. paratuberculosis
guccaccaccacacccgcggcc

SEQ ID NO: 941932 - RNA, 23 nt, Mycobacterium avium subsp. paratuberculosis
guccaccaccacacccgcggccg

SEQ ID NO: 941933 - RNA, 13 nt, Mycobacterium avium subsp. paratuberculosis
guccagaucggcg

SEQ ID NO: 941934 - RNA, 14 nt, Mycobacterium avium subsp. paratuberculosis
guccagaucggcgc

SEQ ID NO: 941935 - RNA, 17 nt, Mycobacterium avium subsp. paratuberculosis
guccagaucggcgcgcg

SEQ ID NO: 941936 - RNA, 18 nt, Mycobacterium avium subsp. paratuberculosis
guccagaucggcgcgcgg

SEQ ID NO: 941937 - RNA, 21 nt, Mycobacterium avium subsp. paratuberculosis
guccagaacucggcggcgguu

SEQ ID NO: 941938 - RNA, 16 nt, Mycobacterium avium subsp. paratuberculosis
guccagaccggccggg

SEQ ID NO: 941939 - RNA, 20 nt, Mycobacterium avium subsp. paratuberculosis
guccagaccggccggggcgg

SEQ ID NO: 941940 - RNA, 22 nt, Mycobacterium avium subsp. paratuberculosis
guccagaccggccggggcgggc

SEQ ID NO: 941941 - RNA, 18 nt, Mycobacterium avium subsp. paratuberculosis
guccacguugaugccgcc

SEQ ID NO: 941942 - RNA, 20 nt, Mycobacterium avium subsp. paratuberculosis
guccacguugaugccgccca

SEQ ID NO: 941943 - RNA, 15 nt, Mycobacterium avium subsp. paratuberculosis
guccacucgaugucc

SEQ ID NO: 941944 - RNA, 16 nt, Mycobacterium avium subsp. paratuberculosis
guccacucgucggcgg

SEQ ID NO: 941945 - RNA, 15 nt, Mycobacterium avium subsp. paratuberculosis
guccagcagcagcgc

SEQ ID NO: 941946 - RNA, 14 nt, Mycobacterium avium subsp. paratuberculosis
guccagcacggcga

SEQ ID NO: 941947 - RNA, 22 nt, Mycobacterium avium subsp. paratuberculosis
guccagcaccugaccgucggcc

SEQ ID NO: 941948 - RNA, 16 nt, Mycobacterium avium subsp. paratuberculosis
guccagcacgcccaga

SEQ ID NO: 941949 - RNA, 15 nt, Mycobacterium avium subsp. paratuberculosis
guccagcacagcauc

SEQ ID NO: 941950 - RNA, 15 nt, Mycobacterium avium subsp. paratuberculosis
guccagcaccgccac

SEQ ID NO: 941951 - RNA, 16 nt, Mycobacterium avium subsp. paratuberculosis
guccagcaccgccacg

SEQ ID NO: 941952 - RNA, 17 nt, Mycobacterium avium subsp. paratuberculosis
guccagcaccgccacgu

SEQ ID NO: 941953 - RNA, 14 nt, Mycobacterium avium subsp. paratuberculosis
guccagcaccggcg

SEQ ID NO: 941954 - RNA, 15 nt, Mycobacterium avium subsp. paratuberculosis
guccagcaccggcgc

SEQ ID NO: 941955 - RNA, 19 nt, Mycobacterium avium subsp. paratuberculosis
guccagcaccggcgccccg

SEQ ID NO: 941956 - RNA, 16 nt, Mycobacterium avium subsp. paratuberculosis
guccagaugccguucc

SEQ ID NO: 941957 - RNA, 12 nt, Mycobacterium avium subsp. paratuberculosis
guccacgggucg

SEQ ID NO: 941958 - RNA, 17 nt, Mycobacterium avium subsp. paratuberculosis
guccacgggucgccgug

SEQ ID NO: 941959 - RNA, 20 nt, Mycobacterium avium subsp. paratuberculosis
guccacgggucgccguggcc

SEQ ID NO: 941960 - RNA, 18 nt, Mycobacterium avium subsp. paratuberculosis
guccacgguggcgccgaa

SEQ ID NO: 941961 - RNA, 13 nt, Mycobacterium avium subsp. paratuberculosis
guccacggugucg

SEQ ID NO: 941962 - RNA, 14 nt, Mycobacterium avium subsp. paratuberculosis
guccacguccugcc

SEQ ID NO: 941963 - RNA, 20 nt, Mycobacterium avium subsp. paratuberculosis
guccacguccugccaguugu

SEQ ID NO: 941964 - RNA, 14 nt, Mycobacterium avium subsp. paratuberculosis
guccacgucgccca

SEQ ID NO: 941965 - RNA, 18 nt, Mycobacterium avium subsp. paratuberculosis
guccacgucgcccagcgu

SEQ ID NO: 941966 - RNA, 19 nt, Mycobacterium avium subsp. paratuberculosis
guccacgcuggcggugucg

SEQ ID NO: 941967 - RNA, 23 nt, Mycobacterium avium subsp. paratuberculosis
guccacgcuggcggugucgaaga

SEQ ID NO: 941968 - RNA, 15 nt, Mycobacterium avium subsp. paratuberculosis
guccacgccgagggc

SEQ ID NO: 941969 - RNA, 19 nt, Mycobacterium avium subsp. paratuberculosis
guccacgccgagggcggcg

SEQ ID NO: 941970 - RNA, 14 nt, Mycobacterium avium subsp. paratuberculosis
guccacgccggcga

SEQ ID NO: 941971 - RNA, 12 nt, Mycobacterium avium subsp. paratuberculosis
guccacgccgug

SEQ ID NO: 941972 - RNA, 13 nt, Mycobacterium avium subsp. paratuberculosis
guccacgcccagc

SEQ ID NO: 941973 - RNA, 14 nt, Mycobacterium avium subsp. paratuberculosis
guccacgacguccu

SEQ ID NO: 941974 - RNA, 17 nt, Mycobacterium avium subsp. paratuberculosis
guccacgaugcggugcc

SEQ ID NO: 941975 - RNA, 22 nt, Mycobacterium avium subsp. paratuberculosis
guccacgcaguguccgaucgcc

SEQ ID NO: 941976 - RNA, 14 nt, Mycobacterium avium subsp. paratuberculosis
guccacgaccccgg

SEQ ID NO: 941977 - RNA, 18 nt, Mycobacterium avium subsp. paratuberculosis
guccacgaccccggcggc

SEQ ID NO: 941978 - RNA, 22 nt, Mycobacterium avium subsp. paratuberculosis
guccacgaccccggcggcaccg

SEQ ID NO: 941979 - RNA, 13 nt, Mycobacterium avium subsp. paratuberculosis
guccaccggcgga

SEQ ID NO: 941980 - RNA, 22 nt, Mycobacterium avium subsp. paratuberculosis
guccaccguugucucggcgccg

SEQ ID NO: 941981 - RNA, 17 nt, Mycobacterium avium subsp. paratuberculosis
guccaccggcacggcac

SEQ ID NO: 941982 - RNA, 19 nt, Mycobacterium avium subsp. paratuberculosis
guccaccggcacggcaccg

SEQ ID NO: 941983 - RNA, 12 nt, Mycobacterium avium subsp. paratuberculosis
guccaccggccg

SEQ ID NO: 941984 - RNA, 23 nt, Mycobacterium avium subsp. paratuberculosis
guccaccggccgauggcccaggc

SEQ ID NO: 941985 - RNA, 12 nt, Mycobacterium avium subsp. paratuberculosis
guccaccgccgc

SEQ ID NO: 941986 - RNA, 16 nt, Mycobacterium avium subsp. paratuberculosis
guccaccgcggcggcc

SEQ ID NO: 941987 - RNA, 19 nt, Mycobacterium avium subsp. paratuberculosis
gucaugccgcgcucgucga

SEQ ID NO: 941988 - RNA, 14 nt, Mycobacterium avium subsp. paratuberculosis
gucaugccgucgac

SEQ ID NO: 941989 - RNA, 15 nt, Mycobacterium avium subsp. paratuberculosis
gucaugccgucgacg

SEQ ID NO: 941990 - RNA, 16 nt, Mycobacterium avium subsp. paratuberculosis
gucaugccgucgacga

SEQ ID NO: 941991 - RNA, 21 nt, Mycobacterium avium subsp. paratuberculosis
gucaugccgucgacgacgguc

SEQ ID NO: 941992 - RNA, 22 nt, Mycobacterium avium subsp. paratuberculosis
gucaugccguugaugaagaccu

SEQ ID NO: 941993 - RNA, 14 nt, Mycobacterium avium subsp. paratuberculosis
gucaugaacgccgg

SEQ ID NO: 941994 - RNA, 17 nt, Mycobacterium avium subsp. paratuberculosis
gucaugacgaacaugcu

SEQ ID NO: 941995 - RNA, 17 nt, Mycobacterium avium subsp. paratuberculosis
gucauggagaucaccgc

SEQ ID NO: 941996 - RNA, 20 nt, Mycobacterium avium subsp. paratuberculosis
gucaugguggcggcgccgga

SEQ ID NO: 941997 - RNA, 23 nt, Mycobacterium avium subsp. paratuberculosis
gucauggugucccauucgugguu

SEQ ID NO: 941998 - RNA, 13 nt, Mycobacterium avium subsp. paratuberculosis
gucauggcgaccg

SEQ ID NO: 941999 - RNA, 17 nt, Mycobacterium avium subsp. paratuberculosis
gucaguuggucgauguc

SEQ ID NO: 942000 - RNA, 22 nt, Mycobacterium avium subsp. paratuberculosis
gucaguuggucgaugucggugc

SEQ ID NO: 942001 - RNA, 15 nt, Mycobacterium avium subsp. paratuberculosis
gucaguucgcggcgc

SEQ ID NO: 942002 - RNA, 20 nt, Mycobacterium avium subsp. paratuberculosis
gucaucgugugggcgcccgc

SEQ ID NO: 942003 - RNA, 14 nt, Mycobacterium avium subsp. paratuberculosis
gucaucgggcccga

SEQ ID NO: 942004 - RNA, 19 nt, Mycobacterium avium subsp. paratuberculosis
gucaguucguagaucacgg

SEQ ID NO: 942005 - RNA, 22 nt, Mycobacterium avium subsp. paratuberculosis
gucauaccagccguucucgucc

SEQ ID NO: 942006 - RNA, 20 nt, Mycobacterium avium subsp. paratuberculosis
gucagcucgaucgccgcgcc

SEQ ID NO: 942007 - RNA, 16 nt, Mycobacterium avium subsp. paratuberculosis
gucagcucgccguccg

SEQ ID NO: 942008 - RNA, 17 nt, Mycobacterium avium subsp. paratuberculosis
gucagcucgcgcccggc

SEQ ID NO: 942009 - RNA, 14 nt, Mycobacterium avium subsp. paratuberculosis
gucagcugccgcac

SEQ ID NO: 942010 - RNA, 17 nt, Mycobacterium avium subsp. paratuberculosis
gucagcugccgcaccgc

SEQ ID NO: 942011 - RNA, 16 nt, Mycobacterium avium subsp. paratuberculosis
gucagcugguagaugg

SEQ ID NO: 942012 - RNA, 22 nt, Mycobacterium avium subsp. paratuberculosis
gucagcugguagaugguggccg

SEQ ID NO: 942013 - RNA, 23 nt, Mycobacterium avium subsp. paratuberculosis
gucaggaacaccgagccggcggc

SEQ ID NO: 942014 - RNA, 14 nt, Mycobacterium avium subsp. paratuberculosis
guauccgcgcagcg

SEQ ID NO: 942015 - RNA, 14 nt, Mycobacterium avium subsp. paratuberculosis
guaucgccacgccg

SEQ ID NO: 942016 - RNA, 18 nt, Mycobacterium avium subsp. paratuberculosis
guaucgccacgccgacca

SEQ ID NO: 942017 - RNA, 16 nt, Mycobacterium avium subsp. paratuberculosis
guaucgagcaccagca

SEQ ID NO: 942018 - RNA, 22 nt, Mycobacterium avium subsp. paratuberculosis
gucagguucuucugcgcgaugu

SEQ ID NO: 942019 - RNA, 17 nt, Mycobacterium avium subsp. paratuberculosis
gucagguucgccacgau

SEQ ID NO: 942020 - RNA, 21 nt, Mycobacterium avium subsp. paratuberculosis
gucaguacagcuaggccagca

SEQ ID NO: 942021 - RNA, 13 nt, Mycobacterium avium subsp. paratuberculosis
gucaggguggccu

SEQ ID NO: 942022 - RNA, 18 nt, Mycobacterium avium subsp. paratuberculosis
gucaggguggccucgucg

SEQ ID NO: 942023 - RNA, 19 nt, Mycobacterium avium subsp. paratuberculosis
gucaggguggccucgucgg

SEQ ID NO: 942024 - RNA, 19 nt, Mycobacterium avium subsp. paratuberculosis
gucaggguguaggccgcgu

SEQ ID NO: 942025 - RNA, 20 nt, Mycobacterium avium subsp. paratuberculosis
gucagggcagcggugucacc

SEQ ID NO: 942026 - RNA, 23 nt, Mycobacterium avium subsp. paratuberculosis
gucagggcagcggugucaccgac

SEQ ID NO: 942027 - RNA, 14 nt, Mycobacterium avium subsp. paratuberculosis
gucagggccagcaa

SEQ ID NO: 942028 - RNA, 16 nt, Mycobacterium avium subsp. paratuberculosis
gucagguaggcgucga

SEQ ID NO: 942029 - RNA, 13 nt, Mycobacterium avium subsp. paratuberculosis
gucaggucaccga

SEQ ID NO: 942030 - RNA, 17 nt, Mycobacterium avium subsp. paratuberculosis
gucagguccgcgaguug

SEQ ID NO: 942031 - RNA, 16 nt, Mycobacterium avium subsp. paratuberculosis
gucaggaucgccgguc

SEQ ID NO: 942032 - RNA, 16 nt, Mycobacterium avium subsp. paratuberculosis
gucaggcacucgauca

SEQ ID NO: 942033 - RNA, 22 nt, Mycobacterium avium subsp. paratuberculosis
gucagggcgcucaucaggcggc

SEQ ID NO: 942034 - RNA, 14 nt, Mycobacterium avium subsp. paratuberculosis
guccgggucgcaca

SEQ ID NO: 942035 - RNA, 20 nt, Mycobacterium avium subsp. paratuberculosis
guccgggucgcacagccgca

SEQ ID NO: 942036 - RNA, 20 nt, Mycobacterium avium subsp. paratuberculosis
guccggggccggugcguccg

SEQ ID NO: 942037 - RNA, 17 nt, Mycobacterium avium subsp. paratuberculosis
guccggggugagcaggg

SEQ ID NO: 942038 - RNA, 19 nt, Mycobacterium avium subsp. paratuberculosis
guccggggugagcagggcc

SEQ ID NO: 942039 - RNA, 21 nt, Mycobacterium avium subsp. paratuberculosis
guccuguccggucucggucgc

SEQ ID NO: 942040 - RNA, 16 nt, Mycobacterium avium subsp. paratuberculosis
guccggcgugccaccg

SEQ ID NO: 942041 - RNA, 16 nt, Mycobacterium avium subsp. paratuberculosis
guccggcuggucggcc

SEQ ID NO: 942042 - RNA, 18 nt, Mycobacterium avium subsp. paratuberculosis
guccgggaacacguagcg

SEQ ID NO: 942043 - RNA, 18 nt, Mycobacterium avium subsp. paratuberculosis
guccgggaacagcgacuc

SEQ ID NO: 942044 - RNA, 22 nt, Mycobacterium avium subsp. paratuberculosis
guccgggauaguucgccgccgc

SEQ ID NO: 942045 - RNA, 19 nt, Mycobacterium avium subsp. paratuberculosis
guccgggaugacaccgcgg

SEQ ID NO: 942046 - RNA, 20 nt, Mycobacterium avium subsp. paratuberculosis
guccgggaugacaccgcgga

SEQ ID NO: 942047 - RNA, 22 nt, Mycobacterium avium subsp. paratuberculosis
guccgggaugacaccgcggacc

SEQ ID NO: 942048 - RNA, 23 nt, Mycobacterium avium subsp. paratuberculosis
guccgggcugcgguuccgggcgc

SEQ ID NO: 942049 - RNA, 22 nt, Mycobacterium avium subsp. paratuberculosis
guccgggcgcugcgcgguggcg

SEQ ID NO: 942050 - RNA, 23 nt, Mycobacterium avium subsp. paratuberculosis
guccgggcgcugcgcgguggcgc

SEQ ID NO: 942051 - RNA, 21 nt, Mycobacterium avium subsp. paratuberculosis
guccgggauggacgacgugcc

SEQ ID NO: 942052 - RNA, 14 nt, Mycobacterium avium subsp. paratuberculosis
guccgggcacccga

SEQ ID NO: 942053 - RNA, 13 nt, Mycobacterium avium subsp. paratuberculosis
guccgggccgccg

SEQ ID NO: 942054 - RNA, 14 nt, Mycobacterium avium subsp. paratuberculosis
guccgggccgccgg

SEQ ID NO: 942055 - RNA, 16 nt, Mycobacterium avium subsp. paratuberculosis
guccgggccgccggcc

SEQ ID NO: 942056 - RNA, 13 nt, Mycobacterium avium subsp. paratuberculosis
guccgggccggcc

SEQ ID NO: 942057 - RNA, 17 nt, Mycobacterium avium subsp. paratuberculosis
guccuugaccagcugcg

SEQ ID NO: 942058 - RNA, 17 nt, Mycobacterium avium subsp. paratuberculosis
guccuugauccgggcgc

SEQ ID NO: 942059 - RNA, 21 nt, Mycobacterium avium subsp. paratuberculosis
guccuugaucgggaacgggua

SEQ ID NO: 942060 - RNA, 17 nt, Mycobacterium avium subsp. paratuberculosis
guccuucucgaaccggg

SEQ ID NO: 942061 - RNA, 17 nt, Mycobacterium avium subsp. paratuberculosis
guccuugcccagcaguu

SEQ ID NO: 942062 - RNA, 17 nt, Mycobacterium avium subsp. paratuberculosis
guccuugcgcaccacgu

SEQ ID NO: 942063 - RNA, 14 nt, Mycobacterium avium subsp. paratuberculosis
guccuugcgccccg

SEQ ID NO: 942064 - RNA, 23 nt, Mycobacterium avium subsp. paratuberculosis
guccuugcgccccggcgggcggc

SEQ ID NO: 942065 - RNA, 18 nt, Mycobacterium avium subsp. paratuberculosis
guccuugcgcgccgcgac

SEQ ID NO: 942066 - RNA, 13 nt, Mycobacterium avium subsp. paratuberculosis
guccuuggccgcc

SEQ ID NO: 942067 - RNA, 24 nt, Mycobacterium avium subsp. paratuberculosis
guccuugggcuccucgaccacgca

SEQ ID NO: 942068 - RNA, 15 nt, Mycobacterium avium subsp. paratuberculosis
guccuugucgcgcac

SEQ ID NO: 942069 - RNA, 17 nt, Mycobacterium avium subsp. paratuberculosis
guccuuguggcccaggc

SEQ ID NO: 942070 - RNA, 14 nt, Mycobacterium avium subsp. paratuberculosis
guccuuguggucga

SEQ ID NO: 942071 - RNA, 17 nt, Mycobacterium avium subsp. paratuberculosis
guccuuguggucgaugc

SEQ ID NO: 942072 - RNA, 15 nt, Mycobacterium avium subsp. paratuberculosis
gucgaaaaacccggu

SEQ ID NO: 942073 - RNA, 19 nt, Mycobacterium avium subsp. paratuberculosis
gucgaaaaacccggugccg

SEQ ID NO: 942074 - RNA, 22 nt, Mycobacterium avium subsp. paratuberculosis
gucgaaaaacccggugccggcc

SEQ ID NO: 942075 - RNA, 16 nt, Mycobacterium avium subsp. paratuberculosis
gucgaaauagcggcgc

SEQ ID NO: 942076 - RNA, 21 nt, Mycobacterium avium subsp. paratuberculosis
gucgaaauagcggcgcaccug

SEQ ID NO: 942077 - RNA, 12 nt, Mycobacterium avium subsp. paratuberculosis
gucgaaaucgca

SEQ ID NO: 942078 - RNA, 14 nt, Mycobacterium avium subsp. paratuberculosis
gucgaaaccgccca

SEQ ID NO: 942079 - RNA, 15 nt, Mycobacterium avium subsp. paratuberculosis
gucgaacaacgcggu

SEQ ID NO: 942080 - RNA, 20 nt, Mycobacterium avium subsp. paratuberculosis
gucgaacaacgcggugaccg

SEQ ID NO: 942081 - RNA, 14 nt, Mycobacterium avium subsp. paratuberculosis
gucgaacaccgugc

SEQ ID NO: 942082 - RNA, 15 nt, Mycobacterium avium subsp. paratuberculosis
gucgaacaccgugcc

SEQ ID NO: 942083 - RNA, 22 nt, Mycobacterium avium subsp. paratuberculosis
gucgaacacggcgcugagcgac

SEQ ID NO: 942084 - RNA, 17 nt, Mycobacterium avium subsp. paratuberculosis
gucgaacagcacgccgg

SEQ ID NO: 942085 - RNA, 21 nt, Mycobacterium avium subsp. paratuberculosis
gucgaacagcacgccggccgg

SEQ ID NO: 942086 - RNA, 20 nt, Mycobacterium avium subsp. paratuberculosis
gucgaccagcgggcugucgg

SEQ ID NO: 942087 - RNA, 23 nt, Mycobacterium avium subsp. paratuberculosis
gucgaccagcgggcugucggcgc

SEQ ID NO: 942088 - RNA, 18 nt, Mycobacterium avium subsp. paratuberculosis
gucgaacugcagccggcc

SEQ ID NO: 942089 - RNA, 19 nt, Mycobacterium avium subsp. paratuberculosis
gucgaacugcagccggcca

SEQ ID NO: 942090 - RNA, 14 nt, Mycobacterium avium subsp. paratuberculosis
gucgaccagccgca

SEQ ID NO: 942091 - RNA, 16 nt, Mycobacterium avium subsp. paratuberculosis
gucgaccagccgcauc

SEQ ID NO: 942092 - RNA, 17 nt, Mycobacterium avium subsp. paratuberculosis
gucgaccagccgcauca

SEQ ID NO: 942093 - RNA, 23 nt, Mycobacterium avium subsp. paratuberculosis
gucgaaccacgcggcggcggugc

SEQ ID NO: 942094 - RNA, 22 nt, Mycobacterium avium subsp. paratuberculosis
gucgaacuccauccgccgucga

SEQ ID NO: 942095 - RNA, 18 nt, Mycobacterium avium subsp. paratuberculosis
gucgaacucgggcccgag

SEQ ID NO: 942096 - RNA, 23 nt, Mycobacterium avium subsp. paratuberculosis
gucgaacucgaugggggugccgc

SEQ ID NO: 942097 - RNA, 20 nt, Mycobacterium avium subsp. paratuberculosis
gucgaacgggccgggcaccg

SEQ ID NO: 942098 - RNA, 12 nt, Mycobacterium avium subsp. paratuberculosis
gucgaacggcaa

SEQ ID NO: 942099 - RNA, 15 nt, Mycobacterium avium subsp. paratuberculosis
gucgaacggcaaccu

SEQ ID NO: 942100 - RNA, 18 nt, Mycobacterium avium subsp. paratuberculosis
gucgaacgcggcgccgac

SEQ ID NO: 942101 - RNA, 23 nt, Mycobacterium avium subsp. paratuberculosis
gucgaacgcguacacggcccgcg

SEQ ID NO: 942102 - RNA, 17 nt, Mycobacterium avium subsp. paratuberculosis
gucgaacaucacccggc

SEQ ID NO: 942103 - RNA, 20 nt, Mycobacterium avium subsp. paratuberculosis
gucgaacaucacccggcggc

SEQ ID NO: 942104 - RNA, 21 nt, Mycobacterium avium subsp. paratuberculosis
gucgaacccgaaaagcaccag

SEQ ID NO: 942105 - RNA, 23 nt, Mycobacterium avium subsp. paratuberculosis
gucgaacccgaaaagcaccaggc

SEQ ID NO: 942106 - RNA, 14 nt, Mycobacterium avium subsp. paratuberculosis
gucgaaccgcgagc

SEQ ID NO: 942107 - RNA, 23 nt, Mycobacterium avium subsp. paratuberculosis
gucgaacgccaccuucaccgcgc

SEQ ID NO: 942108 - RNA, 20 nt, Mycobacterium avium subsp. paratuberculosis
gucgaacgccagcgccgcaa

SEQ ID NO: 942109 - RNA, 23 nt, Mycobacterium avium subsp. paratuberculosis
gucgaacaggaugcagccggcca

SEQ ID NO: 942110 - RNA, 18 nt, Mycobacterium avium subsp. paratuberculosis
gucgaacagccgggccgc

SEQ ID NO: 942111 - RNA, 14 nt, Mycobacterium avium subsp. paratuberculosis
gucgaacagcgcgc

SEQ ID NO: 942112 - RNA, 14 nt, Mycobacterium avium subsp. paratuberculosis
gucgaacagcaggc

SEQ ID NO: 942113 - RNA, 20 nt, Mycobacterium avium subsp. paratuberculosis
gucgaacagcaggcccaggc

SEQ ID NO: 942114 - RNA, 18 nt, Mycobacterium avium subsp. paratuberculosis
gucgaccaucugccggcg

SEQ ID NO: 942115 - RNA, 17 nt, Mycobacterium avium subsp. paratuberculosis
gucgaccagggcgauca

SEQ ID NO: 942116 - RNA, 15 nt, Mycobacterium avium subsp. paratuberculosis
gucgaccagguaggc

SEQ ID NO: 942117 - RNA, 17 nt, Mycobacterium avium subsp. paratuberculosis
gucgaccagguaggcgc

SEQ ID NO: 942118 - RNA, 13 nt, Mycobacterium avium subsp. paratuberculosis
gucgacccgccgc

SEQ ID NO: 942119 - RNA, 17 nt, Mycobacterium avium subsp. paratuberculosis
gucgacccgccgcagcc

SEQ ID NO: 942120 - RNA, 14 nt, Mycobacterium avium subsp. paratuberculosis
gucgaccucggcca

SEQ ID NO: 942121 - RNA, 15 nt, Mycobacterium avium subsp. paratuberculosis
gucgaccucggccac

SEQ ID NO: 942122 - RNA, 16 nt, Mycobacterium avium subsp. paratuberculosis
gucgaccucggccacc

SEQ ID NO: 942123 - RNA, 17 nt, Mycobacterium avium subsp. paratuberculosis
gucgaccucggccacca

SEQ ID NO: 942124 - RNA, 20 nt, Mycobacterium avium subsp. paratuberculosis
gucgaccucggccaccaccu

SEQ ID NO: 942125 - RNA, 17 nt, Mycobacterium avium subsp. paratuberculosis
gucgaccccgccggccc

SEQ ID NO: 942126 - RNA, 20 nt, Mycobacterium avium subsp. paratuberculosis
gucgaccugcucgucgguga

SEQ ID NO: 942127 - RNA, 20 nt, Mycobacterium avium subsp. paratuberculosis
gucgaccuugcagcccgcgu

SEQ ID NO: 942128 - RNA, 20 nt, Mycobacterium avium subsp. paratuberculosis
gucgaccuuggggucaccgu

SEQ ID NO: 942129 - RNA, 17 nt, Mycobacterium avium subsp. paratuberculosis
gucgacgaccaccacca

SEQ ID NO: 942130 - RNA, 13 nt, Mycobacterium avium subsp. paratuberculosis
gucgacgacccgu

SEQ ID NO: 942131 - RNA, 21 nt, Mycobacterium avium subsp. paratuberculosis
gucgacgacgaaucccgccuc

SEQ ID NO: 942132 - RNA, 15 nt, Mycobacterium avium subsp. paratuberculosis
gucgacgacggcgcc

SEQ ID NO: 942133 - RNA, 18 nt, Mycobacterium avium subsp. paratuberculosis
gucgacgacggcgccgcg

SEQ ID NO: 942134 - RNA, 19 nt, Mycobacterium avium subsp. paratuberculosis
gucgacgacggcgccgcgu

SEQ ID NO: 942135 - RNA, 23 nt, Mycobacterium avium subsp. paratuberculosis
gucgacgacggucuucccgccgc

SEQ ID NO: 942136 - RNA, 18 nt, Mycobacterium avium subsp. paratuberculosis
gucgagacaccgucgcgc

SEQ ID NO: 942137 - RNA, 14 nt, Mycobacterium avium subsp. paratuberculosis
gucgacgcgccgca

SEQ ID NO: 942138 - RNA, 14 nt, Mycobacterium avium subsp. paratuberculosis
gucgacgccgugcu

SEQ ID NO: 942139 - RNA, 13 nt, Mycobacterium avium subsp. paratuberculosis
gucgacgcggggc

SEQ ID NO: 942140 - RNA, 21 nt, Mycobacterium avium subsp. paratuberculosis
gucgagaagaccugguugccg

SEQ ID NO: 942141 - RNA, 15 nt, Mycobacterium avium subsp. paratuberculosis
gucgagaagcccgug

SEQ ID NO: 942142 - RNA, 17 nt, Mycobacterium avium subsp. paratuberculosis
gucgagaucagcaccgg

SEQ ID NO: 942143 - RNA, 17 nt, Mycobacterium avium subsp. paratuberculosis
gucgagaucgucgugga

SEQ ID NO: 942144 - RNA, 20 nt, Mycobacterium avium subsp. paratuberculosis
gucgagcaccaggucguugc

SEQ ID NO: 942145 - RNA, 12 nt, Mycobacterium avium subsp. paratuberculosis
gucgagcaccgc

SEQ ID NO: 942146 - RNA, 22 nt, Mycobacterium avium subsp. paratuberculosis
gucgagcaccggcuggugcagc

SEQ ID NO: 942147 - RNA, 23 nt, Mycobacterium avium subsp. paratuberculosis
gucgagcaccggcuggugcagca

SEQ ID NO: 942148 - RNA, 13 nt, Mycobacterium avium subsp. paratuberculosis
gucgagcaccgcg

SEQ ID NO: 942149 - RNA, 15 nt, Mycobacterium avium subsp. paratuberculosis
gucgagcaccgcgac

SEQ ID NO: 942150 - RNA, 16 nt, Mycobacterium avium subsp. paratuberculosis
gucgagcaccgcgacc

SEQ ID NO: 942151 - RNA, 19 nt, Mycobacterium avium subsp. paratuberculosis
gucgagcaccgcgaccacg

SEQ ID NO: 942152 - RNA, 23 nt, Mycobacterium avium subsp. paratuberculosis
gucgagcaccgcgaccacgccgc

SEQ ID NO: 942153 - RNA, 17 nt, Mycobacterium avium subsp. paratuberculosis
gucgagcaccgcgauca

SEQ ID NO: 942154 - RNA, 21 nt, Mycobacterium avium subsp. paratuberculosis
gucgagcaccgcgaucaccga

SEQ ID NO: 942155 - RNA, 15 nt, Mycobacterium avium subsp. paratuberculosis
gucgagcaccgcguc

SEQ ID NO: 942156 - RNA, 22 nt, Mycobacterium avium subsp. paratuberculosis
gucgagcaccgcguccgcgucg

SEQ ID NO: 942157 - RNA, 16 nt, Mycobacterium avium subsp. paratuberculosis
gucgagcaccggcagc

SEQ ID NO: 942158 - RNA, 17 nt, Mycobacterium avium subsp. paratuberculosis
gucgagcaccggcagcc

SEQ ID NO: 942159 - RNA, 14 nt, Mycobacterium avium subsp. paratuberculosis
gucgagcaccggcu

SEQ ID NO: 942160 - RNA, 17 nt, Mycobacterium avium subsp. paratuberculosis
gucgagcacgucgacgc

SEQ ID NO: 942161 - RNA, 19 nt, Mycobacterium avium subsp. paratuberculosis
gucgagcacgucgacgccg

SEQ ID NO: 942162 - RNA, 14 nt, Mycobacterium avium subsp. paratuberculosis
gucgagcagcacca

SEQ ID NO: 942163 - RNA, 21 nt, Mycobacterium avium subsp. paratuberculosis
gucgagcagcaccacccgcac

SEQ ID NO: 942164 - RNA, 13 nt, Mycobacterium avium subsp. paratuberculosis
gucgagcagcgcc

SEQ ID NO: 942165 - RNA, 16 nt, Mycobacterium avium subsp. paratuberculosis
gucgagagccgcaucg

SEQ ID NO: 942166 - RNA, 18 nt, Mycobacterium avium subsp. paratuberculosis
gucgagcagcgcccggcg

SEQ ID NO: 942167 - RNA, 20 nt, Mycobacterium avium subsp. paratuberculosis
gucgagcagcgcccggcgau

SEQ ID NO: 942168 - RNA, 14 nt, Mycobacterium avium subsp. paratuberculosis
gucgacgcccugcc

SEQ ID NO: 942169 - RNA, 13 nt, Mycobacterium avium subsp. paratuberculosis
gucgacgcccacc

SEQ ID NO: 942170 - RNA, 15 nt, Mycobacterium avium subsp. paratuberculosis
gucgacgccccgcgc

SEQ ID NO: 942171 - RNA, 19 nt, Mycobacterium avium subsp. paratuberculosis
gucgacgccgauggugacc

SEQ ID NO: 942172 - RNA, 15 nt, Mycobacterium avium subsp. paratuberculosis
gucgacgccgcugcc

SEQ ID NO: 942173 - RNA, 20 nt, Mycobacterium avium subsp. paratuberculosis
gucgacgcggugacaugccc

SEQ ID NO: 942174 - RNA, 22 nt, Mycobacterium avium subsp. paratuberculosis
gucgacgcguuguugcucggcg

SEQ ID NO: 942175 - RNA, 19 nt, Mycobacterium avium subsp. paratuberculosis
gucgacgcugagcacccgc

SEQ ID NO: 942176 - RNA, 20 nt, Mycobacterium avium subsp. paratuberculosis
gucgacgcugagcacccgcc

SEQ ID NO: 942177 - RNA, 22 nt, Mycobacterium avium subsp. paratuberculosis
gucgacgcugagcacccgcccg

SEQ ID NO: 942178 - RNA, 17 nt, Mycobacterium avium subsp. paratuberculosis
gucgacuuguugcguga

SEQ ID NO: 942179 - RNA, 17 nt, Mycobacterium avium subsp. paratuberculosis
gucgagaaaagcggcga

SEQ ID NO: 942180 - RNA, 16 nt, Mycobacterium avium subsp. paratuberculosis
gucgacgagcccgccg

SEQ ID NO: 942181 - RNA, 18 nt, Mycobacterium avium subsp. paratuberculosis
gucgacgagcccgccggc

SEQ ID NO: 942182 - RNA, 16 nt, Mycobacterium avium subsp. paratuberculosis
gucgacgagcccgcgc

SEQ ID NO: 942183 - RNA, 18 nt, Mycobacterium avium subsp. paratuberculosis
gucgacgaugcgcugcug

SEQ ID NO: 942184 - RNA, 21 nt, Mycobacterium avium subsp. paratuberculosis
gucgacgauggcccggaccgc

SEQ ID NO: 942185 - RNA, 19 nt, Mycobacterium avium subsp. paratuberculosis
gucgacgauggcccgggcc

SEQ ID NO: 942186 - RNA, 23 nt, Mycobacterium avium subsp. paratuberculosis
gucgacgauggcccgggccacac

SEQ ID NO: 942187 - RNA, 16 nt, Mycobacterium avium subsp. paratuberculosis
gucgacgauggcgucc

SEQ ID NO: 942188 - RNA, 15 nt, Mycobacterium avium subsp. paratuberculosis
gucgacgauggucug

SEQ ID NO: 942189 - RNA, 20 nt, Mycobacterium avium subsp. paratuberculosis
gucgacgcaccacgagcagc

SEQ ID NO: 942190 - RNA, 19 nt, Mycobacterium avium subsp. paratuberculosis
gucgaucuccucgcgcggc

SEQ ID NO: 942191 - RNA, 23 nt, Mycobacterium avium subsp. paratuberculosis
gucgaucuccucgcgcggcacca

SEQ ID NO: 942192 - RNA, 18 nt, Mycobacterium avium subsp. paratuberculosis
gucgaucucggcgcaggu

SEQ ID NO: 942193 - RNA, 16 nt, Mycobacterium avium subsp. paratuberculosis
gucgaucucggugagc

SEQ ID NO: 942194 - RNA, 18 nt, Mycobacterium avium subsp. paratuberculosis
gucgaucucggugagccg

SEQ ID NO: 942195 - RNA, 19 nt, Mycobacterium avium subsp. paratuberculosis
gucgaucucuucgccggac

SEQ ID NO: 942196 - RNA, 18 nt, Mycobacterium avium subsp. paratuberculosis
gucgaucugcggcacggu

SEQ ID NO: 942197 - RNA, 19 nt, Mycobacterium avium subsp. paratuberculosis
gucgaucugcggcacggug

SEQ ID NO: 942198 - RNA, 15 nt, Mycobacterium avium subsp. paratuberculosis
gucgaugacggcggc

SEQ ID NO: 942199 - RNA, 16 nt, Mycobacterium avium subsp. paratuberculosis
gucgaugacggcggcg

SEQ ID NO: 942200 - RNA, 13 nt, Mycobacterium avium subsp. paratuberculosis
gucgaugacgguc

SEQ ID NO: 942201 - RNA, 17 nt, Mycobacterium avium subsp. paratuberculosis
gucgaugaagucgguga

SEQ ID NO: 942202 - RNA, 14 nt, Mycobacterium avium subsp. paratuberculosis
gucgaucuggcgga

SEQ ID NO: 942203 - RNA, 12 nt, Mycobacterium avium subsp. paratuberculosis
gucgaucgccag

SEQ ID NO: 942204 - RNA, 17 nt, Mycobacterium avium subsp. paratuberculosis
gucgaucgccagcgcgc

SEQ ID NO: 942205 - RNA, 15 nt, Mycobacterium avium subsp. paratuberculosis
gucgaggucgccgac

SEQ ID NO: 942206 - RNA, 15 nt, Mycobacterium avium subsp. paratuberculosis
gucgagcaguugcgc

SEQ ID NO: 942207 - RNA, 17 nt, Mycobacterium avium subsp. paratuberculosis
gucgaucgacgccgaca

SEQ ID NO: 942208 - RNA, 14 nt, Mycobacterium avium subsp. paratuberculosis
gucgaucgccguca

SEQ ID NO: 942209 - RNA, 12 nt, Mycobacterium avium subsp. paratuberculosis
gucgaucggcuc

SEQ ID NO: 942210 - RNA, 15 nt, Mycobacterium avium subsp. paratuberculosis
gucgaucggcucggc

SEQ ID NO: 942211 - RNA, 17 nt, Mycobacterium avium subsp. paratuberculosis
gucgaucggcucggcgc

SEQ ID NO: 942212 - RNA, 19 nt, Mycobacterium avium subsp. paratuberculosis
gucgaucggcucggcgccc

SEQ ID NO: 942213 - RNA, 22 nt, Mycobacterium avium subsp. paratuberculosis
gucgaucggcucggcgccccac

SEQ ID NO: 942214 - RNA, 15 nt, Mycobacterium avium subsp. paratuberculosis
gucgagguagugcgc

SEQ ID NO: 942215 - RNA, 15 nt, Mycobacterium avium subsp. paratuberculosis
gucgauccccgcagc

SEQ ID NO: 942216 - RNA, 16 nt, Mycobacterium avium subsp. paratuberculosis
gucgauccccgcagcu

SEQ ID NO: 942217 - RNA, 19 nt, Mycobacterium avium subsp. paratuberculosis
gucgauccccgcagcuccc

SEQ ID NO: 942218 - RNA, 15 nt, Mycobacterium avium subsp. paratuberculosis
gucgaucccgccggc

SEQ ID NO: 942219 - RNA, 22 nt, Mycobacterium avium subsp. paratuberculosis
gucgaucccgccggcgaucgac

SEQ ID NO: 942220 - RNA, 22 nt, Mycobacterium avium subsp. paratuberculosis
gucgagccgcucgcgcaccggg

SEQ ID NO: 942221 - RNA, 12 nt, Mycobacterium avium subsp. paratuberculosis
gucgagccggcc

SEQ ID NO: 942222 - RNA, 21 nt, Mycobacterium avium subsp. paratuberculosis
gucgagccggccggacaccga

SEQ ID NO: 942223 - RNA, 23 nt, Mycobacterium avium subsp. paratuberculosis
gucgagccggccggacaccgaac

SEQ ID NO: 942224 - RNA, 18 nt, Mycobacterium avium subsp. paratuberculosis
gucgagcauccggcgcac

SEQ ID NO: 942225 - RNA, 18 nt, Mycobacterium avium subsp. paratuberculosis
gucgagcaugcguccggu

SEQ ID NO: 942226 - RNA, 23 nt, Mycobacterium avium subsp. paratuberculosis
gucgagcagguucuccucccagc

SEQ ID NO: 942227 - RNA, 17 nt, Mycobacterium avium subsp. paratuberculosis
gucgagccaccacugcg

SEQ ID NO: 942228 - RNA, 23 nt, Mycobacterium avium subsp. paratuberculosis
gucgagccaccacugcgccguca

SEQ ID NO: 942229 - RNA, 17 nt, Mycobacterium avium subsp. paratuberculosis
gucgaggaauccggucc

SEQ ID NO: 942230 - RNA, 20 nt, Mycobacterium avium subsp. paratuberculosis
gucgaggacugggucaccgu

SEQ ID NO: 942231 - RNA, 23 nt, Mycobacterium avium subsp. paratuberculosis
gucgaggacugggucaccgucac

SEQ ID NO: 942232 - RNA, 22 nt, Mycobacterium avium subsp. paratuberculosis
gucgaggccgaaccgcagccgg

SEQ ID NO: 942233 - RNA, 16 nt, Mycobacterium avium subsp. paratuberculosis
gucgaggcgcugcagc

SEQ ID NO: 942234 - RNA, 23 nt, Mycobacterium avium subsp. paratuberculosis
gucgaggcggaucuucucgcugc

SEQ ID NO: 942235 - RNA, 13 nt, Mycobacterium avium subsp. paratuberculosis
gucgaggccggcc

SEQ ID NO: 942236 - RNA, 14 nt, Mycobacterium avium subsp. paratuberculosis
gucgagggccaccg

SEQ ID NO: 942237 - RNA, 20 nt, Mycobacterium avium subsp. paratuberculosis
gucgagggccaccggcuccu

SEQ ID NO: 942238 - RNA, 13 nt, Mycobacterium avium subsp. paratuberculosis
gucgagggccauc

SEQ ID NO: 942239 - RNA, 16 nt, Mycobacterium avium subsp. paratuberculosis
gucgagggcgccguug

SEQ ID NO: 942240 - RNA, 19 nt, Mycobacterium avium subsp. paratuberculosis
gucgagggcguucgcggug

SEQ ID NO: 942241 - RNA, 19 nt, Mycobacterium avium subsp. paratuberculosis
gucgagggcuaaccaccgg

SEQ ID NO: 942242 - RNA, 22 nt, Mycobacterium avium subsp. paratuberculosis
gucgagggcuaaccaccgguga

SEQ ID NO: 942243 - RNA, 18 nt, Mycobacterium avium subsp. paratuberculosis
gucgaggggcuugagcgc

SEQ ID NO: 942244 - RNA, 20 nt, Mycobacterium avium subsp. paratuberculosis
gucgaggggcuugagcgcgu

SEQ ID NO: 942245 - RNA, 17 nt, Mycobacterium avium subsp. paratuberculosis
gucgagggucgccaggc

SEQ ID NO: 942246 - RNA, 18 nt, Mycobacterium avium subsp. paratuberculosis
gucgagggucgccaggcc

SEQ ID NO: 942247 - RNA, 22 nt, Mycobacterium avium subsp. paratuberculosis
gucgagggucgccaggccaccg

SEQ ID NO: 942248 - RNA, 15 nt, Mycobacterium avium subsp. paratuberculosis
gucgauugccgcggc

SEQ ID NO: 942249 - RNA, 19 nt, Mycobacterium avium subsp. paratuberculosis
gucgauugccgcggccgcg

SEQ ID NO: 942250 - RNA, 22 nt, Mycobacterium avium subsp. paratuberculosis
gucgcaaagacauucggggcca

SEQ ID NO: 942251 - RNA, 16 nt, Mycobacterium avium subsp. paratuberculosis
gucgcacaaccgggcc

SEQ ID NO: 942252 - RNA, 22 nt, Mycobacterium avium subsp. paratuberculosis
gucgcacaccagcacggcggcg

SEQ ID NO: 942253 - RNA, 23 nt, Mycobacterium avium subsp. paratuberculosis
gucgcacaccagcacggcggcgc

SEQ ID NO: 942254 - RNA, 16 nt, Mycobacterium avium subsp. paratuberculosis
gucgcacagcaugucc

SEQ ID NO: 942255 - RNA, 14 nt, Mycobacterium avium subsp. paratuberculosis
gucgcacagccgca

SEQ ID NO: 942256 - RNA, 20 nt, Mycobacterium avium subsp. paratuberculosis
gucgcacagccgcagcagcc

SEQ ID NO: 942257 - RNA, 18 nt, Mycobacterium avium subsp. paratuberculosis
gucgcacaggaugcccaa

SEQ ID NO: 942258 - RNA, 22 nt, Mycobacterium avium subsp. paratuberculosis
gucgaugugggccgcagcagcg

SEQ ID NO: 942259 - RNA, 17 nt, Mycobacterium avium subsp. paratuberculosis
gucgaugucgucgucga

SEQ ID NO: 942260 - RNA, 19 nt, Mycobacterium avium subsp. paratuberculosis
gucgaugucgucgucgacg

SEQ ID NO: 942261 - RNA, 22 nt, Mycobacterium avium subsp. paratuberculosis
gucgaugucggcgaaccagggc

SEQ ID NO: 942262 - RNA, 19 nt, Mycobacterium avium subsp. paratuberculosis
gucgaugucggcggcccgg

SEQ ID NO: 942263 - RNA, 21 nt, Mycobacterium avium subsp. paratuberculosis
gucgaugucggcggcccggua

SEQ ID NO: 942264 - RNA, 17 nt, Mycobacterium avium subsp. paratuberculosis
gucgauguaguucugca

SEQ ID NO: 942265 - RNA, 20 nt, Mycobacterium avium subsp. paratuberculosis
gucgauguaguucugcacgu

SEQ ID NO: 942266 - RNA, 20 nt, Mycobacterium avium subsp. paratuberculosis
gucgauggucgccugcugga

SEQ ID NO: 942267 - RNA, 20 nt, Mycobacterium avium subsp. paratuberculosis
gucgauggucugcccgccgc

SEQ ID NO: 942268 - RNA, 21 nt, Mycobacterium avium subsp. paratuberculosis
gucgauggucugcccgccgcc

SEQ ID NO: 942269 - RNA, 17 nt, Mycobacterium avium subsp. paratuberculosis
gucgauggccucgucgc

SEQ ID NO: 942270 - RNA, 19 nt, Mycobacterium avium subsp. paratuberculosis
gucgauggcgcggcccagu

SEQ ID NO: 942271 - RNA, 18 nt, Mycobacterium avium subsp. paratuberculosis
gucgaugccgaaccgcuc

SEQ ID NO: 942272 - RNA, 23 nt, Mycobacterium avium subsp. paratuberculosis
gucgaugccgaaccgcuccccga

SEQ ID NO: 942273 - RNA, 15 nt, Mycobacterium avium subsp. paratuberculosis
gucgaugcgcgccac

SEQ ID NO: 942274 - RNA, 16 nt, Mycobacterium avium subsp. paratuberculosis
gucgaugcgggcccgc

SEQ ID NO: 942275 - RNA, 17 nt, Mycobacterium avium subsp. paratuberculosis
gucgaugcgggcccgca

SEQ ID NO: 942276 - RNA, 14 nt, Mycobacterium avium subsp. paratuberculosis
gucgaugccgagcc

SEQ ID NO: 942277 - RNA, 17 nt, Mycobacterium avium subsp. paratuberculosis
gucgaugccgagccggc

SEQ ID NO: 942278 - RNA, 18 nt, Mycobacterium avium subsp. paratuberculosis
gucgaugccgagccggcc

SEQ ID NO: 942279 - RNA, 20 nt, Mycobacterium avium subsp. paratuberculosis
gucgaugccgagccggccga

SEQ ID NO: 942280 - RNA, 14 nt, Mycobacterium avium subsp. paratuberculosis
gucgaugcccgcgc

SEQ ID NO: 942281 - RNA, 15 nt, Mycobacterium avium subsp. paratuberculosis
gucgaugcccgcgcc

SEQ ID NO: 942282 - RNA, 19 nt, Mycobacterium avium subsp. paratuberculosis
gucgaugcccgcgccgacc

SEQ ID NO: 942283 - RNA, 20 nt, Mycobacterium avium subsp. paratuberculosis
gucgaugcccgcgccgacca

SEQ ID NO: 942284 - RNA, 22 nt, Mycobacterium avium subsp. paratuberculosis
gucgaugcccgcgccgaccagc

SEQ ID NO: 942285 - RNA, 23 nt, Mycobacterium avium subsp. paratuberculosis
gucgaugcccgcgccgaccagcg

SEQ ID NO: 942286 - RNA, 18 nt, Mycobacterium avium subsp. paratuberculosis
gucgaugaugccggcgga

SEQ ID NO: 942287 - RNA, 14 nt, Mycobacterium avium subsp. paratuberculosis
gucgaugagcuggu

SEQ ID NO: 942288 - RNA, 19 nt, Mycobacterium avium subsp. paratuberculosis
gucgaugagcuggugcagc

SEQ ID NO: 942289 - RNA, 14 nt, Mycobacterium avium subsp. paratuberculosis
gucgaugacgccgc

SEQ ID NO: 942290 - RNA, 16 nt, Mycobacterium avium subsp. paratuberculosis
gucgaugacgccgcgc

SEQ ID NO: 942291 - RNA, 19 nt, Mycobacterium avium subsp. paratuberculosis
gucgaugacgccgcgccgc

SEQ ID NO: 942292 - RNA, 16 nt, Mycobacterium avium subsp. paratuberculosis
gucgccaauccggcgg

SEQ ID NO: 942293 - RNA, 20 nt, Mycobacterium avium subsp. paratuberculosis
gucgccaccgaugcgggcca

SEQ ID NO: 942294 - RNA, 16 nt, Mycobacterium avium subsp. paratuberculosis
gucgcagcagcagccc

SEQ ID NO: 942295 - RNA, 15 nt, Mycobacterium avium subsp. paratuberculosis
gucgccaccaccacg

SEQ ID NO: 942296 - RNA, 17 nt, Mycobacterium avium subsp. paratuberculosis
gucgccaccaccagcgg

SEQ ID NO: 942297 - RNA, 14 nt, Mycobacterium avium subsp. paratuberculosis
gucgccaccaccgc

SEQ ID NO: 942298 - RNA, 18 nt, Mycobacterium avium subsp. paratuberculosis
gucgccaccaccgcgccg

SEQ ID NO: 942299 - RNA, 19 nt, Mycobacterium avium subsp. paratuberculosis
gucgccaccaccgcgccgu

SEQ ID NO: 942300 - RNA, 15 nt, Mycobacterium avium subsp. paratuberculosis
gucgccaccacggcg

SEQ ID NO: 942301 - RNA, 15 nt, Mycobacterium avium subsp. paratuberculosis
gucgccaccagaccg

SEQ ID NO: 942302 - RNA, 18 nt, Mycobacterium avium subsp. paratuberculosis
gucgccaccagaccggcg

SEQ ID NO: 942303 - RNA, 19 nt, Mycobacterium avium subsp. paratuberculosis
gucgccaccagaccggcga

SEQ ID NO: 942304 - RNA, 23 nt, Mycobacterium avium subsp. paratuberculosis
gucgccaccagaccggcgaagcu

SEQ ID NO: 942305 - RNA, 18 nt, Mycobacterium avium subsp. paratuberculosis
gucgcagaucccgccggc

SEQ ID NO: 942306 - RNA, 20 nt, Mycobacterium avium subsp. paratuberculosis
gucgcagaucccgccggcgg

SEQ ID NO: 942307 - RNA, 22 nt, Mycobacterium avium subsp. paratuberculosis
gucgcagaucccgccggcggcc

SEQ ID NO: 942308 - RNA, 23 nt, Mycobacterium avium subsp. paratuberculosis
gucgcagaucccgccggcggcca

SEQ ID NO: 942309 - RNA, 13 nt, Mycobacterium avium subsp. paratuberculosis
gucgcaccgcggc

SEQ ID NO: 942310 - RNA, 16 nt, Mycobacterium avium subsp. paratuberculosis
gucgcaccgcggcgug

SEQ ID NO: 942311 - RNA, 17 nt, Mycobacterium avium subsp. paratuberculosis
gucgcaccgcggcgugg

SEQ ID NO: 942312 - RNA, 15 nt, Mycobacterium avium subsp. paratuberculosis
gucgcaccggcagug

SEQ ID NO: 942313 - RNA, 16 nt, Mycobacterium avium subsp. paratuberculosis
gucgcaccggcaguga

SEQ ID NO: 942314 - RNA, 13 nt, Mycobacterium avium subsp. paratuberculosis
gucgcacgccggu

SEQ ID NO: 942315 - RNA, 17 nt, Mycobacterium avium subsp. paratuberculosis
gucgcacgccgguagcc

SEQ ID NO: 942316 - RNA, 18 nt, Mycobacterium avium subsp. paratuberculosis
gucgcacuagguccggcg

SEQ ID NO: 942317 - RNA, 15 nt, Mycobacterium avium subsp. paratuberculosis
gucgccacgaucacc

SEQ ID NO: 942318 - RNA, 23 nt, Mycobacterium avium subsp. paratuberculosis
gucgccacgaucaccaccaccgc

SEQ ID NO: 942319 - RNA, 15 nt, Mycobacterium avium subsp. paratuberculosis
gucgccacggccggc

SEQ ID NO: 942320 - RNA, 18 nt, Mycobacterium avium subsp. paratuberculosis
gucgccacggccggcagc

SEQ ID NO: 942321 - RNA, 15 nt, Mycobacterium avium subsp. paratuberculosis
gucgccacucgggcg

SEQ ID NO: 942322 - RNA, 20 nt, Mycobacterium avium subsp. paratuberculosis
gucgccacucgggcggccgc

SEQ ID NO: 942323 - RNA, 12 nt, Mycobacterium avium subsp. paratuberculosis
gucgcccacccg

SEQ ID NO: 942324 - RNA, 23 nt, Mycobacterium avium subsp. paratuberculosis
gucgcccacccgccagcccgcgu

SEQ ID NO: 942325 - RNA, 17 nt, Mycobacterium avium subsp. paratuberculosis
gucgcccacccggggcc

SEQ ID NO: 942326 - RNA, 18 nt, Mycobacterium avium subsp. paratuberculosis
gucgcccacccggggccg

SEQ ID NO: 942327 - RNA, 14 nt, Mycobacterium avium subsp. paratuberculosis
gucgcccaccgacg

SEQ ID NO: 942328 - RNA, 14 nt, Mycobacterium avium subsp. paratuberculosis
gucgcccaccgugu

SEQ ID NO: 942329 - RNA, 17 nt, Mycobacterium avium subsp. paratuberculosis
gucgcccaccguguuga

SEQ ID NO: 942330 - RNA, 15 nt, Mycobacterium avium subsp. paratuberculosis
gucgcccacgccggu

SEQ ID NO: 942331 - RNA, 17 nt, Mycobacterium avium subsp. paratuberculosis
gucgcccacgccggugg

SEQ ID NO: 942332 - RNA, 14 nt, Mycobacterium avium subsp. paratuberculosis
gucgcccagcagcc

SEQ ID NO: 942333 - RNA, 15 nt, Mycobacterium avium subsp. paratuberculosis
gucgcccagcagccc

SEQ ID NO: 942334 - RNA, 16 nt, Mycobacterium avium subsp. paratuberculosis
gucgcccagcagcccg

SEQ ID NO: 942335 - RNA, 13 nt, Mycobacterium avium subsp. paratuberculosis
gucgccccgcacc

SEQ ID NO: 942336 - RNA, 14 nt, Mycobacterium avium subsp. paratuberculosis
gucgccccgcaccg

SEQ ID NO: 942337 - RNA, 15 nt, Mycobacterium avium subsp. paratuberculosis
gucgccccgcaccga

SEQ ID NO: 942338 - RNA, 17 nt, Mycobacterium avium subsp. paratuberculosis
gucgccccgcaccgagc

SEQ ID NO: 942339 - RNA, 20 nt, Mycobacterium avium subsp. paratuberculosis
gucgcccuggauauccagcc

SEQ ID NO: 942340 - RNA, 18 nt, Mycobacterium avium subsp. paratuberculosis
gucgcccccucggccggu

SEQ ID NO: 942341 - RNA, 13 nt, Mycobacterium avium subsp. paratuberculosis
gucgcccaccacg

SEQ ID NO: 942342 - RNA, 20 nt, Mycobacterium avium subsp. paratuberculosis
gucgcccaccacgacgacgu

SEQ ID NO: 942343 - RNA, 23 nt, Mycobacterium avium subsp. paratuberculosis
gucgcccaccacgacgacguggu

SEQ ID NO: 942344 - RNA, 22 nt, Mycobacterium avium subsp. paratuberculosis
gucgcccagcgugucggcgauc

SEQ ID NO: 942345 - RNA, 14 nt, Mycobacterium avium subsp. paratuberculosis
gucgcccagcuggg

SEQ ID NO: 942346 - RNA, 15 nt, Mycobacterium avium subsp. paratuberculosis
gucgcccagcugggc

SEQ ID NO: 942347 - RNA, 15 nt, Mycobacterium avium subsp. paratuberculosis
gucgcccacaccgga

SEQ ID NO: 942348 - RNA, 22 nt, Mycobacterium avium subsp. paratuberculosis
gucgccgucguauucgacggcg

SEQ ID NO: 942349 - RNA, 17 nt, Mycobacterium avium subsp. paratuberculosis
gucgccguuggcgugga

SEQ ID NO: 942350 - RNA, 23 nt, Mycobacterium avium subsp. paratuberculosis
gucgccguuggcguggauggccg

SEQ ID NO: 942351 - RNA, 18 nt, Mycobacterium avium subsp. paratuberculosis
gucgccguuggucugcgc

SEQ ID NO: 942352 - RNA, 20 nt, Mycobacterium avium subsp. paratuberculosis
gucgccguuggucugcgcga

SEQ ID NO: 942353 - RNA, 22 nt, Mycobacterium avium subsp. paratuberculosis
gucgccuccgagauggacagca

SEQ ID NO: 942354 - RNA, 23 nt, Mycobacterium avium subsp. paratuberculosis
gucgccuccugcuggcgcugcca

SEQ ID NO: 942355 - RNA, 19 nt, Mycobacterium avium subsp. paratuberculosis
gucgccucgcccucggugu

SEQ ID NO: 942356 - RNA, 20 nt, Mycobacterium avium subsp. paratuberculosis
gucgccucgcccucgguguu

SEQ ID NO: 942357 - RNA, 23 nt, Mycobacterium avium subsp. paratuberculosis
gucgcgccagacguccagcgccg

SEQ ID NO: 942358 - RNA, 19 nt, Mycobacterium avium subsp. paratuberculosis
gucgcgcaucgccucggcg

SEQ ID NO: 942359 - RNA, 21 nt, Mycobacterium avium subsp. paratuberculosis
gucgcgcaucgccucggcggc

SEQ ID NO: 942360 - RNA, 17 nt, Mycobacterium avium subsp. paratuberculosis
gucgccuuccugcgcgu

SEQ ID NO: 942361 - RNA, 17 nt, Mycobacterium avium subsp. paratuberculosis
gucgccuucuggcuggg

SEQ ID NO: 942362 - RNA, 15 nt, Mycobacterium avium subsp. paratuberculosis
gucgcgcagguaggu

SEQ ID NO: 942363 - RNA, 16 nt, Mycobacterium avium subsp. paratuberculosis
gucgcgcaggucgggc

SEQ ID NO: 942364 - RNA, 21 nt, Mycobacterium avium subsp. paratuberculosis
gucgcgcaggucgggccggcc

SEQ ID NO: 942365 - RNA, 13 nt, Mycobacterium avium subsp. paratuberculosis
gucgcgcugcggg

SEQ ID NO: 942366 - RNA, 15 nt, Mycobacterium avium subsp. paratuberculosis
gucgcggaacagccg

SEQ ID NO: 942367 - RNA, 17 nt, Mycobacterium avium subsp. paratuberculosis
gucgcggaacagccggc

SEQ ID NO: 942368 - RNA, 17 nt, Mycobacterium avium subsp. paratuberculosis
gucgcggaaccggccgg

SEQ ID NO: 942369 - RNA, 18 nt, Mycobacterium avium subsp. paratuberculosis
gucgcggaaccggccggg

SEQ ID NO: 942370 - RNA, 20 nt, Mycobacterium avium subsp. paratuberculosis
gucgcggaaccggccggggc

SEQ ID NO: 942371 - RNA, 17 nt, Mycobacterium avium subsp. paratuberculosis
gucgcggaacgggucga

SEQ ID NO: 942372 - RNA, 18 nt, Mycobacterium avium subsp. paratuberculosis
gucgcggaacgggucgau

SEQ ID NO: 942373 - RNA, 21 nt, Mycobacterium avium subsp. paratuberculosis
gucgcgcgacugggcgcccac

SEQ ID NO: 942374 - RNA, 23 nt, Mycobacterium avium subsp. paratuberculosis
gucgcgcucagugcacgcucggc

SEQ ID NO: 942375 - RNA, 13 nt, Mycobacterium avium subsp. paratuberculosis
gucgcgcgggguc

SEQ ID NO: 942376 - RNA, 18 nt, Mycobacterium avium subsp. paratuberculosis
gucgcgcggggugacgcc

SEQ ID NO: 942377 - RNA, 21 nt, Mycobacterium avium subsp. paratuberculosis
gucgcgcggggugacgcccgu

SEQ ID NO: 942378 - RNA, 20 nt, Mycobacterium avium subsp. paratuberculosis
gucgcgccgaccuggucgcc

SEQ ID NO: 942379 - RNA, 22 nt, Mycobacterium avium subsp. paratuberculosis
gucgcgccgaccuggucgccga

SEQ ID NO: 942380 - RNA, 15 nt, Mycobacterium avium subsp. paratuberculosis
gucgcgccgccagca

SEQ ID NO: 942381 - RNA, 12 nt, Mycobacterium avium subsp. paratuberculosis
gucgcgcgaaca

SEQ ID NO: 942382 - RNA, 13 nt, Mycobacterium avium subsp. paratuberculosis
gucgcgcccagga

SEQ ID NO: 942383 - RNA, 19 nt, Mycobacterium avium subsp. paratuberculosis
gucgcgcccaggaacgcgc

SEQ ID NO: 942384 - RNA, 12 nt, Mycobacterium avium subsp. paratuberculosis
gucgcgccgcgu

SEQ ID NO: 942385 - RNA, 17 nt, Mycobacterium avium subsp. paratuberculosis
gucgcgccgcucggcca

SEQ ID NO: 942386 - RNA, 19 nt, Mycobacterium avium subsp. paratuberculosis
gucgcgccgcucggccagc

SEQ ID NO: 942387 - RNA, 15 nt, Mycobacterium avium subsp. paratuberculosis
gucgcgccggagccg

SEQ ID NO: 942388 - RNA, 23 nt, Mycobacterium avium subsp. paratuberculosis
gucgccggugucauaccagccgu

SEQ ID NO: 942389 - RNA, 13 nt, Mycobacterium avium subsp. paratuberculosis
gucgccggugugc

SEQ ID NO: 942390 - RNA, 21 nt, Mycobacterium avium subsp. paratuberculosis
gucgccggugugcagccaccc

SEQ ID NO: 942391 - RNA, 22 nt, Mycobacterium avium subsp. paratuberculosis
gucgccggugugcagccacccg

SEQ ID NO: 942392 - RNA, 14 nt, Mycobacterium avium subsp. paratuberculosis
gucgccguccaaca

SEQ ID NO: 942393 - RNA, 23 nt, Mycobacterium avium subsp. paratuberculosis
gucgccguccaacaggugcuugg

SEQ ID NO: 942394 - RNA, 16 nt, Mycobacterium avium subsp. paratuberculosis
gucgccguccggggcc

SEQ ID NO: 942395 - RNA, 17 nt, Mycobacterium avium subsp. paratuberculosis
gucgccguccggggccg

SEQ ID NO: 942396 - RNA, 19 nt, Mycobacterium avium subsp. paratuberculosis
gucgccguccggggccggu

SEQ ID NO: 942397 - RNA, 13 nt, Mycobacterium avium subsp. paratuberculosis
gucgccgucgagg

SEQ ID NO: 942398 - RNA, 16 nt, Mycobacterium avium subsp. paratuberculosis
gucgccgucgccgcac

SEQ ID NO: 942399 - RNA, 16 nt, Mycobacterium avium subsp. paratuberculosis
gucgccgucaccucga

SEQ ID NO: 942400 - RNA, 17 nt, Mycobacterium avium subsp. paratuberculosis
gucgccgucaccucgag

SEQ ID NO: 942401 - RNA, 19 nt, Mycobacterium avium subsp. paratuberculosis
gucgccgucggggucgcgc

SEQ ID NO: 942402 - RNA, 15 nt, Mycobacterium avium subsp. paratuberculosis
gucgccgucgugcuc

SEQ ID NO: 942403 - RNA, 18 nt, Mycobacterium avium subsp. paratuberculosis
gucgccgugaucuggugg

SEQ ID NO: 942404 - RNA, 20 nt, Mycobacterium avium subsp. paratuberculosis
gucgccgugaucuggugggc

SEQ ID NO: 942405 - RNA, 21 nt, Mycobacterium avium subsp. paratuberculosis
gucgccgugaucuggugggcg

SEQ ID NO: 942406 - RNA, 16 nt, Mycobacterium avium subsp. paratuberculosis
gucgccgugccggacc

SEQ ID NO: 942407 - RNA, 21 nt, Mycobacterium avium subsp. paratuberculosis
gucgccgugccggaccgcgcg

SEQ ID NO: 942408 - RNA, 16 nt, Mycobacterium avium subsp. paratuberculosis
gucgccguggcggccc

SEQ ID NO: 942409 - RNA, 17 nt, Mycobacterium avium subsp. paratuberculosis
gucgccguggcggcccg

SEQ ID NO: 942410 - RNA, 19 nt, Mycobacterium avium subsp. paratuberculosis
gucgccguggcggcccgac

SEQ ID NO: 942411 - RNA, 15 nt, Mycobacterium avium subsp. paratuberculosis
gucgccgggcggggu

SEQ ID NO: 942412 - RNA, 17 nt, Mycobacterium avium subsp. paratuberculosis
gucgccgggcggggugg

SEQ ID NO: 942413 - RNA, 23 nt, Mycobacterium avium subsp. paratuberculosis
gucgccgggcggggugguggacg

SEQ ID NO: 942414 - RNA, 14 nt, Mycobacterium avium subsp. paratuberculosis
gucgccgggcgggu

SEQ ID NO: 942415 - RNA, 14 nt, Mycobacterium avium subsp. paratuberculosis
gucgccgggcuggg

SEQ ID NO: 942416 - RNA, 13 nt, Mycobacterium avium subsp. paratuberculosis
gucgccggcgcgc

SEQ ID NO: 942417 - RNA, 19 nt, Mycobacterium avium subsp. paratuberculosis
gucgccggcugacugccgg

SEQ ID NO: 942418 - RNA, 23 nt, Mycobacterium avium subsp. paratuberculosis
gucgccggcugacugccggcgac

SEQ ID NO: 942419 - RNA, 22 nt, Mycobacterium avium subsp. paratuberculosis
gucgccggcuuaccgaccucga

SEQ ID NO: 942420 - RNA, 16 nt, Mycobacterium avium subsp. paratuberculosis
gucgccggcgcgcagc

SEQ ID NO: 942421 - RNA, 21 nt, Mycobacterium avium subsp. paratuberculosis
gucgccgggucuuccacgccg

SEQ ID NO: 942422 - RNA, 16 nt, Mycobacterium avium subsp. paratuberculosis
gucgccggugcugguc

SEQ ID NO: 942423 - RNA, 20 nt, Mycobacterium avium subsp. paratuberculosis
gucgccggugcuggucaugc

SEQ ID NO: 942424 - RNA, 16 nt, Mycobacterium avium subsp. paratuberculosis
gucgccgguggccgcc

SEQ ID NO: 942425 - RNA, 18 nt, Mycobacterium avium subsp. paratuberculosis
gucgccgguggccgccgg

SEQ ID NO: 942426 - RNA, 20 nt, Mycobacterium avium subsp. paratuberculosis
gucgccgguggugcaccggu

SEQ ID NO: 942427 - RNA, 16 nt, Mycobacterium avium subsp. paratuberculosis
gucgccgacgggccca

SEQ ID NO: 942428 - RNA, 23 nt, Mycobacterium avium subsp. paratuberculosis
gucgccgacgggcccagcgcgac

SEQ ID NO: 942429 - RNA, 22 nt, Mycobacterium avium subsp. paratuberculosis
gucgccgacguuguugucgaug

SEQ ID NO: 942430 - RNA, 13 nt, Mycobacterium avium subsp. paratuberculosis
gucgccgacucgc

SEQ ID NO: 942431 - RNA, 13 nt, Mycobacterium avium subsp. paratuberculosis
gucgccggcggcc

SEQ ID NO: 942432 - RNA, 15 nt, Mycobacterium avium subsp. paratuberculosis
gucgccggcggccga

SEQ ID NO: 942433 - RNA, 17 nt, Mycobacterium avium subsp. paratuberculosis
gucgccggcggccgaca

SEQ ID NO: 942434 - RNA, 22 nt, Mycobacterium avium subsp. paratuberculosis
gucgccggcggccgacagggug

SEQ ID NO: 942435 - RNA, 23 nt, Mycobacterium avium subsp. paratuberculosis
gucgccggcggcgaucgccgcga

SEQ ID NO: 942436 - RNA, 18 nt, Mycobacterium avium subsp. paratuberculosis
gucgccggcggggcgucg

SEQ ID NO: 942437 - RNA, 17 nt, Mycobacterium avium subsp. paratuberculosis
gucgccggccaggccgg

SEQ ID NO: 942438 - RNA, 12 nt, Mycobacterium avium subsp. paratuberculosis
gucgccggccgc

SEQ ID NO: 942439 - RNA, 14 nt, Mycobacterium avium subsp. paratuberculosis
gucgccggccgcca

SEQ ID NO: 942440 - RNA, 21 nt, Mycobacterium avium subsp. paratuberculosis
gucgccggccgccagcgcccg

SEQ ID NO: 942441 - RNA, 13 nt, Mycobacterium avium subsp. paratuberculosis
gucgccggccugc

SEQ ID NO: 942442 - RNA, 14 nt, Mycobacterium avium subsp. paratuberculosis
gucgccggcgaccg

SEQ ID NO: 942443 - RNA, 18 nt, Mycobacterium avium subsp. paratuberculosis
gucgccggcgaccgccac

SEQ ID NO: 942444 - RNA, 17 nt, Mycobacterium avium subsp. paratuberculosis
gucgccggcgaccgccu

SEQ ID NO: 942445 - RNA, 17 nt, Mycobacterium avium subsp. paratuberculosis
gucgccgaacgccacca

SEQ ID NO: 942446 - RNA, 20 nt, Mycobacterium avium subsp. paratuberculosis
gucgccgaaguuccagccga

SEQ ID NO: 942447 - RNA, 23 nt, Mycobacterium avium subsp. paratuberculosis
gucgccgaaguuccagccgaucg

SEQ ID NO: 942448 - RNA, 17 nt, Mycobacterium avium subsp. paratuberculosis
gucgccgaauccggcgg

SEQ ID NO: 942449 - RNA, 18 nt, Mycobacterium avium subsp. paratuberculosis
gucgccgaauccggcggg

SEQ ID NO: 942450 - RNA, 13 nt, Mycobacterium avium subsp. paratuberculosis
gucgccgaccagc

SEQ ID NO: 942451 - RNA, 16 nt, Mycobacterium avium subsp. paratuberculosis
gucgccgacgccgucg

SEQ ID NO: 942452 - RNA, 18 nt, Mycobacterium avium subsp. paratuberculosis
gucgccgacgccgucgau

SEQ ID NO: 942453 - RNA, 20 nt, Mycobacterium avium subsp. paratuberculosis
gucgccgacgccgucgauga

SEQ ID NO: 942454 - RNA, 19 nt, Mycobacterium avium subsp. paratuberculosis
gucgccgagccgcaccgcc

SEQ ID NO: 942455 - RNA, 20 nt, Mycobacterium avium subsp. paratuberculosis
gucgccgagccgcaccgccu

SEQ ID NO: 942456 - RNA, 14 nt, Mycobacterium avium subsp. paratuberculosis
gucgccgagccgcg

SEQ ID NO: 942457 - RNA, 17 nt, Mycobacterium avium subsp. paratuberculosis
gucgccgagccgcgcca

SEQ ID NO: 942458 - RNA, 17 nt, Mycobacterium avium subsp. paratuberculosis
gucguauucgacggcga

SEQ ID NO: 942459 - RNA, 14 nt, Mycobacterium avium subsp. paratuberculosis
gucguauuguccug

SEQ ID NO: 942460 - RNA, 21 nt, Mycobacterium avium subsp. paratuberculosis
gucguauuguccugucgacag

SEQ ID NO: 942461 - RNA, 12 nt, Mycobacterium avium subsp. paratuberculosis
gucgucagcacc

SEQ ID NO: 942462 - RNA, 14 nt, Mycobacterium avium subsp. paratuberculosis
gucgucagcaccgu

SEQ ID NO: 942463 - RNA, 15 nt, Mycobacterium avium subsp. paratuberculosis
gucgucagcaccgug

SEQ ID NO: 942464 - RNA, 13 nt, Mycobacterium avium subsp. paratuberculosis
gucgucaccucga

SEQ ID NO: 942465 - RNA, 16 nt, Mycobacterium avium subsp. paratuberculosis
gucguagucgcucggc

SEQ ID NO: 942466 - RNA, 18 nt, Mycobacterium avium subsp. paratuberculosis
gucguagucggcccgccg

SEQ ID NO: 942467 - RNA, 22 nt, Mycobacterium avium subsp. paratuberculosis
gucgucccaggguugccgcacg

SEQ ID NO: 942468 - RNA, 20 nt, Mycobacterium avium subsp. paratuberculosis
gucguccagcuucucggcgu

SEQ ID NO: 942469 - RNA, 16 nt, Mycobacterium avium subsp. paratuberculosis
gucguccagcgucgac

SEQ ID NO: 942470 - RNA, 16 nt, Mycobacterium avium subsp. paratuberculosis
gucguccacgcccagc

SEQ ID NO: 942471 - RNA, 23 nt, Mycobacterium avium subsp. paratuberculosis
gucguccacgcccagcgccccga

SEQ ID NO: 942472 - RNA, 16 nt, Mycobacterium avium subsp. paratuberculosis
gucgucagccgggcca

SEQ ID NO: 942473 - RNA, 15 nt, Mycobacterium avium subsp. paratuberculosis
gucgucgaugccgau

SEQ ID NO: 942474 - RNA, 20 nt, Mycobacterium avium subsp. paratuberculosis
gucgucgaugcgcagcagcg

SEQ ID NO: 942475 - RNA, 17 nt, Mycobacterium avium subsp. paratuberculosis
gucgucgauggccacca

SEQ ID NO: 942476 - RNA, 23 nt, Mycobacterium avium subsp. paratuberculosis
gucgucgaucucggugagccgcu

SEQ ID NO: 942477 - RNA, 21 nt, Mycobacterium avium subsp. paratuberculosis
gucgucgaugaagucggugag

SEQ ID NO: 942478 - RNA, 18 nt, Mycobacterium avium subsp. paratuberculosis
gucgucgagcgcucgcgg

SEQ ID NO: 942479 - RNA, 19 nt, Mycobacterium avium subsp. paratuberculosis
gucgucgagggccaccggc

SEQ ID NO: 942480 - RNA, 13 nt, Mycobacterium avium subsp. paratuberculosis
gucgucgaucagg

SEQ ID NO: 942481 - RNA, 22 nt, Mycobacterium avium subsp. paratuberculosis
gucgucgaagagcuggucgccc

SEQ ID NO: 942482 - RNA, 23 nt, Mycobacterium avium subsp. paratuberculosis
gucgucgaagagcuggucgccca

SEQ ID NO: 942483 - RNA, 21 nt, Mycobacterium avium subsp. paratuberculosis
gucgucgacgagcccgccggc

SEQ ID NO: 942484 - RNA, 15 nt, Mycobacterium avium subsp. paratuberculosis
gucgucgacggccgc

SEQ ID NO: 942485 - RNA, 14 nt, Mycobacterium avium subsp. paratuberculosis
gucgucgacgucca

SEQ ID NO: 942486 - RNA, 19 nt, Mycobacterium avium subsp. paratuberculosis
gucgucgagcaccacccgg

SEQ ID NO: 942487 - RNA, 21 nt, Mycobacterium avium subsp. paratuberculosis
gucgucgagcaccacccgggu

SEQ ID NO: 942488 - RNA, 14 nt, Mycobacterium avium subsp. paratuberculosis
gucgucgagcaccg

SEQ ID NO: 942489 - RNA, 19 nt, Mycobacterium avium subsp. paratuberculosis
gucgucgagcaccggcagc

SEQ ID NO: 942490 - RNA, 22 nt, Mycobacterium avium subsp. paratuberculosis
gucgucgagccgcucgcgcacc

SEQ ID NO: 942491 - RNA, 17 nt, Mycobacterium avium subsp. paratuberculosis
gucguccucggucaggc

SEQ ID NO: 942492 - RNA, 22 nt, Mycobacterium avium subsp. paratuberculosis
gucguccucguucuggcccgcc

SEQ ID NO: 942493 - RNA, 16 nt, Mycobacterium avium subsp. paratuberculosis
gucguccucuucgcgg

SEQ ID NO: 942494 - RNA, 15 nt, Mycobacterium avium subsp. paratuberculosis
gucguccucccggcc

SEQ ID NO: 942495 - RNA, 14 nt, Mycobacterium avium subsp. paratuberculosis
gucguccucgauca

SEQ ID NO: 942496 - RNA, 20 nt, Mycobacterium avium subsp. paratuberculosis
gucguccucgaucaccgaca

SEQ ID NO: 942497 - RNA, 20 nt, Mycobacterium avium subsp. paratuberculosis
gucguccaugcccgcccacg

SEQ ID NO: 942498 - RNA, 21 nt, Mycobacterium avium subsp. paratuberculosis
gucguccuugagcccccaccu

SEQ ID NO: 942499 - RNA, 23 nt, Mycobacterium avium subsp. paratuberculosis
gucguccgacaccaccugcacgg

SEQ ID NO: 942500 - RNA, 22 nt, Mycobacterium avium subsp. paratuberculosis
gucguccgcaaccgccggcagc

SEQ ID NO: 942501 - RNA, 15 nt, Mycobacterium avium subsp. paratuberculosis
gucguccggcgcgca

SEQ ID NO: 942502 - RNA, 16 nt, Mycobacterium avium subsp. paratuberculosis
gucgguuugcgggcca

SEQ ID NO: 942503 - RNA, 16 nt, Mycobacterium avium subsp. paratuberculosis
gucgguuucgaccugc

SEQ ID NO: 942504 - RNA, 21 nt, Mycobacterium avium subsp. paratuberculosis
gucgguucauccacucggcca

SEQ ID NO: 942505 - RNA, 17 nt, Mycobacterium avium subsp. paratuberculosis
gucguagcggcccaggu

SEQ ID NO: 942506 - RNA, 15 nt, Mycobacterium avium subsp. paratuberculosis
gucguagcggcgcca

SEQ ID NO: 942507 - RNA, 16 nt, Mycobacterium avium subsp. paratuberculosis
gucguagcggcgccac

SEQ ID NO: 942508 - RNA, 14 nt, Mycobacterium avium subsp. paratuberculosis
gucguagcggucgg

SEQ ID NO: 942509 - RNA, 17 nt, Mycobacterium avium subsp. paratuberculosis
gucguagccggcacgca

SEQ ID NO: 942510 - RNA, 13 nt, Mycobacterium avium subsp. paratuberculosis
gucguagccgucg

SEQ ID NO: 942511 - RNA, 17 nt, Mycobacterium avium subsp. paratuberculosis
gucguagaggggccgga

SEQ ID NO: 942512 - RNA, 17 nt, Mycobacterium avium subsp. paratuberculosis
gucguacgggcgcagcg

SEQ ID NO: 942513 - RNA, 19 nt, Mycobacterium avium subsp. paratuberculosis
gucguacgggcgcagcgcc

SEQ ID NO: 942514 - RNA, 20 nt, Mycobacterium avium subsp. paratuberculosis
gucguacgucuugcgcaccu

SEQ ID NO: 942515 - RNA, 20 nt, Mycobacterium avium subsp. paratuberculosis
gucguacucccaggccgcgg

SEQ ID NO: 942516 - RNA, 21 nt, Mycobacterium avium subsp. paratuberculosis
gucguacucccaggccgcggc

SEQ ID NO: 942517 - RNA, 23 nt, Mycobacterium avium subsp. paratuberculosis
gucguacucccaggccgcggcca

SEQ ID NO: 942518 - RNA, 16 nt, Mycobacterium avium subsp. paratuberculosis
gucguacucgaccgcg

SEQ ID NO: 942519 - RNA, 22 nt, Mycobacterium avium subsp. paratuberculosis
gucgguggugaucgcggcggcg

SEQ ID NO: 942520 - RNA, 16 nt, Mycobacterium avium subsp. paratuberculosis
gucggugguggggccg

SEQ ID NO: 942521 - RNA, 18 nt, Mycobacterium avium subsp. paratuberculosis
gucggugguggggccggc

SEQ ID NO: 942522 - RNA, 19 nt, Mycobacterium avium subsp. paratuberculosis
gucggugguggggccggcg

SEQ ID NO: 942523 - RNA, 21 nt, Mycobacterium avium subsp. paratuberculosis
gucggugguggggccggcgaa

SEQ ID NO: 942524 - RNA, 22 nt, Mycobacterium avium subsp. paratuberculosis
gucggugguguggcagguggcg

SEQ ID NO: 942525 - RNA, 19 nt, Mycobacterium avium subsp. paratuberculosis
gucggugggggccaggcgg

SEQ ID NO: 942526 - RNA, 16 nt, Mycobacterium avium subsp. paratuberculosis
gucgguggccaccacc

SEQ ID NO: 942527 - RNA, 17 nt, Mycobacterium avium subsp. paratuberculosis
gucgguggccaccaccg

SEQ ID NO: 942528 - RNA, 16 nt, Mycobacterium avium subsp. paratuberculosis
gucgguggcggcggcg

SEQ ID NO: 942529 - RNA, 16 nt, Mycobacterium avium subsp. paratuberculosis
gucgguggcggugccg

SEQ ID NO: 942530 - RNA, 19 nt, Mycobacterium avium subsp. paratuberculosis
gucgguggcgguggggccg

SEQ ID NO: 942531 - RNA, 23 nt, Mycobacterium avium subsp. paratuberculosis
gucgguguagcgagugccggcca

SEQ ID NO: 942532 - RNA, 15 nt, Mycobacterium avium subsp. paratuberculosis
gucggugucccgcgc

SEQ ID NO: 942533 - RNA, 18 nt, Mycobacterium avium subsp. paratuberculosis
gucggugucccgcgcccg

SEQ ID NO: 942534 - RNA, 14 nt, Mycobacterium avium subsp. paratuberculosis
gucggugucgccga

SEQ ID NO: 942535 - RNA, 17 nt, Mycobacterium avium subsp. paratuberculosis
gucgguguggaccgcgc

SEQ ID NO: 942536 - RNA, 20 nt, Mycobacterium avium subsp. paratuberculosis
gucggugugggucagcgagg

SEQ ID NO: 942537 - RNA, 21 nt, Mycobacterium avium subsp. paratuberculosis
gucggugggcagcucgucggc

SEQ ID NO: 942538 - RNA, 14 nt, Mycobacterium avium subsp. paratuberculosis
gucggugggccgca

SEQ ID NO: 942539 - RNA, 15 nt, Mycobacterium avium subsp. paratuberculosis
gucggugggccgcac

SEQ ID NO: 942540 - RNA, 15 nt, Mycobacterium avium subsp. paratuberculosis
gucggugggccgccg

SEQ ID NO: 942541 - RNA, 16 nt, Mycobacterium avium subsp. paratuberculosis
gucggugggccgccgc

SEQ ID NO: 942542 - RNA, 20 nt, Mycobacterium avium subsp. paratuberculosis
gucggugggccgccgcggcg

SEQ ID NO: 942543 - RNA, 21 nt, Mycobacterium avium subsp. paratuberculosis
gucgguggcccagccggccga

SEQ ID NO: 942544 - RNA, 23 nt, Mycobacterium avium subsp. paratuberculosis
gucgguggcccagccggccgacg

SEQ ID NO: 942545 - RNA, 24 nt, Mycobacterium avium subsp. paratuberculosis
gucgguggcccagccggccgacgc

SEQ ID NO: 942546 - RNA, 17 nt, Mycobacterium avium subsp. paratuberculosis
gucggugauggccggcu

SEQ ID NO: 942547 - RNA, 15 nt, Mycobacterium avium subsp. paratuberculosis
gucggugccgcggcg

SEQ ID NO: 942548 - RNA, 17 nt, Mycobacterium avium subsp. paratuberculosis
gucggugccgcggcgca

SEQ ID NO: 942549 - RNA, 23 nt, Mycobacterium avium subsp. paratuberculosis
gucggugccgcggcgcaccccga

SEQ ID NO: 942550 - RNA, 21 nt, Mycobacterium avium subsp. paratuberculosis
gucggugcgcgggguggcgcc

SEQ ID NO: 942551 - RNA, 14 nt, Mycobacterium avium subsp. paratuberculosis
gucggugcggcggg

SEQ ID NO: 942552 - RNA, 19 nt, Mycobacterium avium subsp. paratuberculosis
gucgguggacagcgcgacg

SEQ ID NO: 942553 - RNA, 18 nt, Mycobacterium avium subsp. paratuberculosis
gucguggggcucagccga

SEQ ID NO: 942554 - RNA, 20 nt, Mycobacterium avium subsp. paratuberculosis
gucguggguauccgccgcca

SEQ ID NO: 942555 - RNA, 21 nt, Mycobacterium avium subsp. paratuberculosis
gucguggcgugccgggcggua

SEQ ID NO: 942556 - RNA, 19 nt, Mycobacterium avium subsp. paratuberculosis
gucguggcgacaucgccgc

SEQ ID NO: 942557 - RNA, 21 nt, Mycobacterium avium subsp. paratuberculosis
gucguggcgacaucgccgcgg

SEQ ID NO: 942558 - RNA, 21 nt, Mycobacterium avium subsp. paratuberculosis
gucgugcucggcgagcaccgu

SEQ ID NO: 942559 - RNA, 22 nt, Mycobacterium avium subsp. paratuberculosis
gucgugcucgucggcgggcacc

SEQ ID NO: 942560 - RNA, 21 nt, Mycobacterium avium subsp. paratuberculosis
gucgugcggccggcgccggcg

SEQ ID NO: 942561 - RNA, 15 nt, Mycobacterium avium subsp. paratuberculosis
gucgugcaucggcgc

SEQ ID NO: 942562 - RNA, 21 nt, Mycobacterium avium subsp. paratuberculosis
gucgugcauucaggucaccgc

SEQ ID NO: 942563 - RNA, 18 nt, Mycobacterium avium subsp. paratuberculosis
gucgugcaacucccgcgc

SEQ ID NO: 942564 - RNA, 20 nt, Mycobacterium avium subsp. paratuberculosis
gucgugcacgccguggcggc

SEQ ID NO: 942565 - RNA, 14 nt, Mycobacterium avium subsp. paratuberculosis
gucgugcagcaccg

SEQ ID NO: 942566 - RNA, 17 nt, Mycobacterium avium subsp. paratuberculosis
gucgugcagcaccgcca

SEQ ID NO: 942567 - RNA, 18 nt, Mycobacterium avium subsp. paratuberculosis
gucgugcagcaccgccag

SEQ ID NO: 942568 - RNA, 18 nt, Mycobacterium avium subsp. paratuberculosis
gucguucaugaucggcag

SEQ ID NO: 942569 - RNA, 17 nt, Mycobacterium avium subsp. paratuberculosis
gucguucauucagcacc

SEQ ID NO: 942570 - RNA, 16 nt, Mycobacterium avium subsp. paratuberculosis
gucguucagcugcagc

SEQ ID NO: 942571 - RNA, 18 nt, Mycobacterium avium subsp. paratuberculosis
gucguucgauccgccggu

SEQ ID NO: 942572 - RNA, 17 nt, Mycobacterium avium subsp. paratuberculosis
gucguucggccagcacc

SEQ ID NO: 942573 - RNA, 17 nt, Mycobacterium avium subsp. paratuberculosis
gucgugguggccgcgaa

SEQ ID NO: 942574 - RNA, 14 nt, Mycobacterium avium subsp. paratuberculosis
gucguguccgggcc

SEQ ID NO: 942575 - RNA, 17 nt, Mycobacterium avium subsp. paratuberculosis
gucguguccgggcccga

SEQ ID NO: 942576 - RNA, 23 nt, Mycobacterium avium subsp. paratuberculosis
gucguguccgggcccgaacaucg

SEQ ID NO: 942577 - RNA, 14 nt, Mycobacterium avium subsp. paratuberculosis
gucguggucgacgc

SEQ ID NO: 942578 - RNA, 17 nt, Mycobacterium avium subsp. paratuberculosis
gucguggucgcugcuca

SEQ ID NO: 942579 - RNA, 14 nt, Mycobacterium avium subsp. paratuberculosis
gucguggugacggg

SEQ ID NO: 942580 - RNA, 17 nt, Mycobacterium avium subsp. paratuberculosis
gucguugcgggcggcgc

SEQ ID NO: 942581 - RNA, 20 nt, Mycobacterium avium subsp. paratuberculosis
gucguugagcaucaccauga

SEQ ID NO: 942582 - RNA, 18 nt, Mycobacterium avium subsp. paratuberculosis
gucguugaacgcgcgggu

SEQ ID NO: 942583 - RNA, 14 nt, Mycobacterium avium subsp. paratuberculosis
gucguugacgcugg

SEQ ID NO: 942584 - RNA, 13 nt, Mycobacterium avium subsp. paratuberculosis
gucguugaucagg

SEQ ID NO: 942585 - RNA, 23 nt, Mycobacterium avium subsp. paratuberculosis
gucguugaucaggugcagcgugg

SEQ ID NO: 942586 - RNA, 17 nt, Mycobacterium avium subsp. paratuberculosis
gucguugcacacccggu

SEQ ID NO: 942587 - RNA, 20 nt, Mycobacterium avium subsp. paratuberculosis
gucguugcccgccagcaugg

SEQ ID NO: 942588 - RNA, 22 nt, Mycobacterium avium subsp. paratuberculosis
gucguugcccugaacgucuugg

SEQ ID NO: 942589 - RNA, 17 nt, Mycobacterium avium subsp. paratuberculosis
gucgugaaacauggcgc

SEQ ID NO: 942590 - RNA, 23 nt, Mycobacterium avium subsp. paratuberculosis
gucgugaaacauggcgcccgcgu

SEQ ID NO: 942591 - RNA, 18 nt, Mycobacterium avium subsp. paratuberculosis
gucgucuucuuggccgcg

SEQ ID NO: 942592 - RNA, 15 nt, Mycobacterium avium subsp. paratuberculosis
gucgugacgcggcgu

SEQ ID NO: 942593 - RNA, 20 nt, Mycobacterium avium subsp. paratuberculosis
gucgucguugagcaucacca

SEQ ID NO: 942594 - RNA, 20 nt, Mycobacterium avium subsp. paratuberculosis
gucgucguuggcccgccgcg

SEQ ID NO: 942595 - RNA, 19 nt, Mycobacterium avium subsp. paratuberculosis
gucgucguugugggccagc

SEQ ID NO: 942596 - RNA, 18 nt, Mycobacterium avium subsp. paratuberculosis
gucgucggcgcgguuguc

SEQ ID NO: 942597 - RNA, 15 nt, Mycobacterium avium subsp. paratuberculosis
gucgucguggugacg

SEQ ID NO: 942598 - RNA, 23 nt, Mycobacterium avium subsp. paratuberculosis
gucgucguggugacgggcgucgg

SEQ ID NO: 942599 - RNA, 23 nt, Mycobacterium avium subsp. paratuberculosis
gucgucggggcaucgcagcgcgc

SEQ ID NO: 942600 - RNA, 17 nt, Mycobacterium avium subsp. paratuberculosis
gucgucggggcuggcgg

SEQ ID NO: 942601 - RNA, 18 nt, Mycobacterium avium subsp. paratuberculosis
gucgucggggcuggcggc

SEQ ID NO: 942602 - RNA, 16 nt, Mycobacterium avium subsp. paratuberculosis
gucgucggucagcucg

SEQ ID NO: 942603 - RNA, 17 nt, Mycobacterium avium subsp. paratuberculosis
gucgucggucagcucga

SEQ ID NO: 942604 - RNA, 14 nt, Mycobacterium avium subsp. paratuberculosis
gucgucggucaggc

SEQ ID NO: 942605 - RNA, 20 nt, Mycobacterium avium subsp. paratuberculosis
gucgucggucaggccggcgc

SEQ ID NO: 942606 - RNA, 13 nt, Mycobacterium avium subsp. paratuberculosis
gucgucgggcacc

SEQ ID NO: 942607 - RNA, 21 nt, Mycobacterium avium subsp. paratuberculosis
gucgucgggcaccacggcggc

SEQ ID NO: 942608 - RNA, 22 nt, Mycobacterium avium subsp. paratuberculosis
gucgucgggcaccacggcggca

SEQ ID NO: 942609 - RNA, 14 nt, Mycobacterium avium subsp. paratuberculosis
gucgucgggcagga

SEQ ID NO: 942610 - RNA, 16 nt, Mycobacterium avium subsp. paratuberculosis
gucgucgggcgccggu

SEQ ID NO: 942611 - RNA, 15 nt, Mycobacterium avium subsp. paratuberculosis
gucgucgggcgcggu

SEQ ID NO: 942612 - RNA, 22 nt, Mycobacterium avium subsp. paratuberculosis
gucgucggucucuucgacccgg

SEQ ID NO: 942613 - RNA, 15 nt, Mycobacterium avium subsp. paratuberculosis
gucgucggugauggu

SEQ ID NO: 942614 - RNA, 18 nt, Mycobacterium avium subsp. paratuberculosis
gucgucggugccgaagcg

SEQ ID NO: 942615 - RNA, 20 nt, Mycobacterium avium subsp. paratuberculosis
gucgucggugccgaagcgcc

SEQ ID NO: 942616 - RNA, 22 nt, Mycobacterium avium subsp. paratuberculosis
gucgucggugggccgccgcggc

SEQ ID NO: 942617 - RNA, 22 nt, Mycobacterium avium subsp. paratuberculosis
gucgucguccgcaaccgccggc

SEQ ID NO: 942618 - RNA, 16 nt, Mycobacterium avium subsp. paratuberculosis
gucgucgucgaaggcc

SEQ ID NO: 942619 - RNA, 15 nt, Mycobacterium avium subsp. paratuberculosis
gucgucgucgacgcu

SEQ ID NO: 942620 - RNA, 16 nt, Mycobacterium avium subsp. paratuberculosis
gucgucgucgagccgc

SEQ ID NO: 942621 - RNA, 14 nt, Mycobacterium avium subsp. paratuberculosis
gucgucgucgccgc

SEQ ID NO: 942622 - RNA, 17 nt, Mycobacterium avium subsp. paratuberculosis
gucgucgucgccgccgg

SEQ ID NO: 942623 - RNA, 15 nt, Mycobacterium avium subsp. paratuberculosis
gucgucgucgccgcg

SEQ ID NO: 942624 - RNA, 22 nt, Mycobacterium avium subsp. paratuberculosis
gucgucgugcaccacgacgucg

SEQ ID NO: 942625 - RNA, 15 nt, Mycobacterium avium subsp. paratuberculosis
gucgucggcggacug

SEQ ID NO: 942626 - RNA, 13 nt, Mycobacterium avium subsp. paratuberculosis
gucgucggcggcg

SEQ ID NO: 942627 - RNA, 13 nt, Mycobacterium avium subsp. paratuberculosis
gucgucggccggg

SEQ ID NO: 942628 - RNA, 14 nt, Mycobacterium avium subsp. paratuberculosis
gucgucggccugca

SEQ ID NO: 942629 - RNA, 23 nt, Mycobacterium avium subsp. paratuberculosis
gucgucggccugcacgucggcgc

SEQ ID NO: 942630 - RNA, 14 nt, Mycobacterium avium subsp. paratuberculosis
gucgucggcgacga

SEQ ID NO: 942631 - RNA, 16 nt, Mycobacterium avium subsp. paratuberculosis
gucgucggcgacgacc

SEQ ID NO: 942632 - RNA, 17 nt, Mycobacterium avium subsp. paratuberculosis
gucgucggcgccgcgcc

SEQ ID NO: 942633 - RNA, 21 nt, Mycobacterium avium subsp. paratuberculosis
gucgucggccaguucaccgcg

SEQ ID NO: 942634 - RNA, 22 nt, Mycobacterium avium subsp. paratuberculosis
gucgucggccaguucaccgcgc

SEQ ID NO: 942635 - RNA, 23 nt, Mycobacterium avium subsp. paratuberculosis
gucgucggcccaguccagucgcg

SEQ ID NO: 942636 - RNA, 16 nt, Mycobacterium avium subsp. paratuberculosis
gucgucgcguccagca

SEQ ID NO: 942637 - RNA, 14 nt, Mycobacterium avium subsp. paratuberculosis
gucgucgcugacgc

SEQ ID NO: 942638 - RNA, 17 nt, Mycobacterium avium subsp. paratuberculosis
gucgucggacaccagca

SEQ ID NO: 942639 - RNA, 19 nt, Mycobacterium avium subsp. paratuberculosis
gucgucggacagcagcacc

SEQ ID NO: 942640 - RNA, 22 nt, Mycobacterium avium subsp. paratuberculosis
gucgucggagacguugccgcac

SEQ ID NO: 942641 - RNA, 15 nt, Mycobacterium avium subsp. paratuberculosis
gucgucgcgguccac

SEQ ID NO: 942642 - RNA, 13 nt, Mycobacterium avium subsp. paratuberculosis
gucgucgcgcacc

SEQ ID NO: 942643 - RNA, 20 nt, Mycobacterium avium subsp. paratuberculosis
gucgucgcgcaccagcucga

SEQ ID NO: 942644 - RNA, 15 nt, Mycobacterium avium subsp. paratuberculosis
gucgucgccggccgc

SEQ ID NO: 942645 - RNA, 18 nt, Mycobacterium avium subsp. paratuberculosis
gucgucgccggccgcggu

SEQ ID NO: 942646 - RNA, 14 nt, Mycobacterium avium subsp. paratuberculosis
gucgucgccggggu

SEQ ID NO: 942647 - RNA, 14 nt, Mycobacterium avium subsp. paratuberculosis
gucgucgccggugg

SEQ ID NO: 942648 - RNA, 19 nt, Mycobacterium avium subsp. paratuberculosis
gucgucgccgguggccgcc

SEQ ID NO: 942649 - RNA, 20 nt, Mycobacterium avium subsp. paratuberculosis
gucgucgccgguggccgccg

SEQ ID NO: 942650 - RNA, 22 nt, Mycobacterium avium subsp. paratuberculosis
gucgucgccgguggccgccgga

SEQ ID NO: 942651 - RNA, 13 nt, Mycobacterium avium subsp. paratuberculosis
gucgucgcccacc

SEQ ID NO: 942652 - RNA, 22 nt, Mycobacterium avium subsp. paratuberculosis
gucgucgcccacccgccagccc

SEQ ID NO: 942653 - RNA, 13 nt, Mycobacterium avium subsp. paratuberculosis
gucgucgcaccgg

SEQ ID NO: 942654 - RNA, 14 nt, Mycobacterium avium subsp. paratuberculosis
gucgucgcagugcc

SEQ ID NO: 942655 - RNA, 18 nt, Mycobacterium avium subsp. paratuberculosis
gucgucgcagugcccgcc

SEQ ID NO: 942656 - RNA, 20 nt, Mycobacterium avium subsp. paratuberculosis
gucgucgcccugacacagca

SEQ ID NO: 942657 - RNA, 21 nt, Mycobacterium avium subsp. paratuberculosis
gucgucgcccugacacagcac

SEQ ID NO: 942658 - RNA, 22 nt, Mycobacterium avium subsp. paratuberculosis
gucgucgcccugacacagcacc

SEQ ID NO: 942659 - RNA, 19 nt, Mycobacterium avium subsp. paratuberculosis
gucgucgccgaugcgccgc

SEQ ID NO: 942660 - RNA, 21 nt, Mycobacterium avium subsp. paratuberculosis
gucgucgccgaugcgccgcac

SEQ ID NO: 942661 - RNA, 22 nt, Mycobacterium avium subsp. paratuberculosis
gucgucgccgaugcgccgcacc

SEQ ID NO: 942662 - RNA, 13 nt, Mycobacterium avium subsp. paratuberculosis
gucgcggcgucgc

SEQ ID NO: 942663 - RNA, 17 nt, Mycobacterium avium subsp. paratuberculosis
gucgcggcgucgcggua

SEQ ID NO: 942664 - RNA, 16 nt, Mycobacterium avium subsp. paratuberculosis
gucgcggcugccggug

SEQ ID NO: 942665 - RNA, 16 nt, Mycobacterium avium subsp. paratuberculosis
gucgcggcugcgcacg

SEQ ID NO: 942666 - RNA, 21 nt, Mycobacterium avium subsp. paratuberculosis
gucgcggcuggugccgccggc

SEQ ID NO: 942667 - RNA, 23 nt, Mycobacterium avium subsp. paratuberculosis
gucgcggcuggugccgccggcga

SEQ ID NO: 942668 - RNA, 20 nt, Mycobacterium avium subsp. paratuberculosis
gucgcgggaaucccacccgc

SEQ ID NO: 942669 - RNA, 15 nt, Mycobacterium avium subsp. paratuberculosis
gucgcgggacaacac

SEQ ID NO: 942670 - RNA, 17 nt, Mycobacterium avium subsp. paratuberculosis
gucgcgggacaacacca

SEQ ID NO: 942671 - RNA, 19 nt, Mycobacterium avium subsp. paratuberculosis
gucgcgggacaacaccacc

SEQ ID NO: 942672 - RNA, 21 nt, Mycobacterium avium subsp. paratuberculosis
gucgcgcugccggcccgauag

SEQ ID NO: 942673 - RNA, 17 nt, Mycobacterium avium subsp. paratuberculosis
gucgcggacccuggcca

SEQ ID NO: 942674 - RNA, 19 nt, Mycobacterium avium subsp. paratuberculosis
gucgcggacccuggccagc

SEQ ID NO: 942675 - RNA, 18 nt, Mycobacterium avium subsp. paratuberculosis
gucgcggcggcccgucgc

SEQ ID NO: 942676 - RNA, 17 nt, Mycobacterium avium subsp. paratuberculosis
gucgcggcggccggcgc

SEQ ID NO: 942677 - RNA, 21 nt, Mycobacterium avium subsp. paratuberculosis
gucgcggcggccggcgccgac

SEQ ID NO: 942678 - RNA, 13 nt, Mycobacterium avium subsp. paratuberculosis
gucgcggcggcgc

SEQ ID NO: 942679 - RNA, 14 nt, Mycobacterium avium subsp. paratuberculosis
gucgcggcggcgcu

SEQ ID NO: 942680 - RNA, 15 nt, Mycobacterium avium subsp. paratuberculosis
gucgcggcggcgcug

SEQ ID NO: 942681 - RNA, 11 nt, Mycobacterium avium subsp. paratuberculosis
gucgcggcggg

SEQ ID NO: 942682 - RNA, 20 nt, Mycobacterium avium subsp. paratuberculosis
gucgcggcggugcgcagccg

SEQ ID NO: 942683 - RNA, 22 nt, Mycobacterium avium subsp. paratuberculosis
gucgcggcggugcgcagccgcu

SEQ ID NO: 942684 - RNA, 15 nt, Mycobacterium avium subsp. paratuberculosis
gucgcgggcccgggc

SEQ ID NO: 942685 - RNA, 18 nt, Mycobacterium avium subsp. paratuberculosis
gucgcgggcagccggcgc

SEQ ID NO: 942686 - RNA, 21 nt, Mycobacterium avium subsp. paratuberculosis
gucgcgggcagccggcgcccg

SEQ ID NO: 942687 - RNA, 22 nt, Mycobacterium avium subsp. paratuberculosis
gucgcgggcagccggcgcccgc

SEQ ID NO: 942688 - RNA, 23 nt, Mycobacterium avium subsp. paratuberculosis
gucgcgggcagccggcgcccgca

SEQ ID NO: 942689 - RNA, 18 nt, Mycobacterium avium subsp. paratuberculosis
gucgcgggagagcgcggg

SEQ ID NO: 942690 - RNA, 20 nt, Mycobacterium avium subsp. paratuberculosis
gucgcgggagagcgcgggca

SEQ ID NO: 942691 - RNA, 22 nt, Mycobacterium avium subsp. paratuberculosis
gucgcgggagagcgcgggcacc

SEQ ID NO: 942692 - RNA, 23 nt, Mycobacterium avium subsp. paratuberculosis
gucgcgggagagcgcgggcaccg

SEQ ID NO: 942693 - RNA, 21 nt, Mycobacterium avium subsp. paratuberculosis
gucggcgaacaccugcuuguu

SEQ ID NO: 942694 - RNA, 17 nt, Mycobacterium avium subsp. paratuberculosis
gucggcgaacagugcac

SEQ ID NO: 942695 - RNA, 17 nt, Mycobacterium avium subsp. paratuberculosis
gucggcgaacgcccggu

SEQ ID NO: 942696 - RNA, 12 nt, Mycobacterium avium subsp. paratuberculosis
gucggcgccgcc

SEQ ID NO: 942697 - RNA, 14 nt, Mycobacterium avium subsp. paratuberculosis
gucggcgccgccga

SEQ ID NO: 942698 - RNA, 19 nt, Mycobacterium avium subsp. paratuberculosis
gucggcgccgccgagccgc

SEQ ID NO: 942699 - RNA, 21 nt, Mycobacterium avium subsp. paratuberculosis
gucggcgccgccgagccgcgg

SEQ ID NO: 942700 - RNA, 13 nt, Mycobacterium avium subsp. paratuberculosis
gucggcgccgcgc

SEQ ID NO: 942701 - RNA, 13 nt, Mycobacterium avium subsp. paratuberculosis
gucggcgccggcg

SEQ ID NO: 942702 - RNA, 14 nt, Mycobacterium avium subsp. paratuberculosis
gucggcgccggcgc

SEQ ID NO: 942703 - RNA, 17 nt, Mycobacterium avium subsp. paratuberculosis
gucggcgccggcgcgca

SEQ ID NO: 942704 - RNA, 16 nt, Mycobacterium avium subsp. paratuberculosis
gucggcgcgcaggcug

SEQ ID NO: 942705 - RNA, 15 nt, Mycobacterium avium subsp. paratuberculosis
gucggcgcgccaccc

SEQ ID NO: 942706 - RNA, 14 nt, Mycobacterium avium subsp. paratuberculosis
gucggcggccgcga

SEQ ID NO: 942707 - RNA, 16 nt, Mycobacterium avium subsp. paratuberculosis
gucggcggccgcgaag

SEQ ID NO: 942708 - RNA, 21 nt, Mycobacterium avium subsp. paratuberculosis
gucggcggccgcgaaggcggc

SEQ ID NO: 942709 - RNA, 12 nt, Mycobacterium avium subsp. paratuberculosis
gucggcggccgg

SEQ ID NO: 942710 - RNA, 17 nt, Mycobacterium avium subsp. paratuberculosis
gucggcgccgcgccggc

SEQ ID NO: 942711 - RNA, 14 nt, Mycobacterium avium subsp. paratuberculosis
gucggcgccgcgcg

SEQ ID NO: 942712 - RNA, 21 nt, Mycobacterium avium subsp. paratuberculosis
gucggcgccggaucggccccc

SEQ ID NO: 942713 - RNA, 14 nt, Mycobacterium avium subsp. paratuberculosis
gucggcgcccagga

SEQ ID NO: 942714 - RNA, 15 nt, Mycobacterium avium subsp. paratuberculosis
gucggcgccccgccc

SEQ ID NO: 942715 - RNA, 17 nt, Mycobacterium avium subsp. paratuberculosis
gucggcgccccgcccgc

SEQ ID NO: 942716 - RNA, 14 nt, Mycobacterium avium subsp. paratuberculosis
gucggcgccccggc

SEQ ID NO: 942717 - RNA, 16 nt, Mycobacterium avium subsp. paratuberculosis
gucggcgccccggcgc

SEQ ID NO: 942718 - RNA, 19 nt, Mycobacterium avium subsp. paratuberculosis
gucggcgccgacggccagc

SEQ ID NO: 942719 - RNA, 13 nt, Mycobacterium avium subsp. paratuberculosis
gucggcgcccggc

SEQ ID NO: 942720 - RNA, 14 nt, Mycobacterium avium subsp. paratuberculosis
gucggcgcccggca

SEQ ID NO: 942721 - RNA, 20 nt, Mycobacterium avium subsp. paratuberculosis
gucggcgcccggcaccggga

SEQ ID NO: 942722 - RNA, 15 nt, Mycobacterium avium subsp. paratuberculosis
gucggcgcccggccc

SEQ ID NO: 942723 - RNA, 21 nt, Mycobacterium avium subsp. paratuberculosis
gucggcgcccggcccagccgc

SEQ ID NO: 942724 - RNA, 23 nt, Mycobacterium avium subsp. paratuberculosis
gucggcgcccuugagcucggccu

SEQ ID NO: 942725 - RNA, 15 nt, Mycobacterium avium subsp. paratuberculosis
gucggcgaccgcgcg

SEQ ID NO: 942726 - RNA, 13 nt, Mycobacterium avium subsp. paratuberculosis
gucggcgcccaga

SEQ ID NO: 942727 - RNA, 19 nt, Mycobacterium avium subsp. paratuberculosis
gucggcgcccagaucggcc

SEQ ID NO: 942728 - RNA, 22 nt, Mycobacterium avium subsp. paratuberculosis
gucggcgcccagaucggccagc

SEQ ID NO: 942729 - RNA, 14 nt, Mycobacterium avium subsp. paratuberculosis
gucggcgacccgca

SEQ ID NO: 942730 - RNA, 17 nt, Mycobacterium avium subsp. paratuberculosis
gucggcgacccgcacga

SEQ ID NO: 942731 - RNA, 17 nt, Mycobacterium avium subsp. paratuberculosis
gucggcgacccgcuugg

SEQ ID NO: 942732 - RNA, 19 nt, Mycobacterium avium subsp. paratuberculosis
gucggcgacccgcuuggug

SEQ ID NO: 942733 - RNA, 20 nt, Mycobacterium avium subsp. paratuberculosis
gucggcgacccgcuugguga

SEQ ID NO: 942734 - RNA, 20 nt, Mycobacterium avium subsp. paratuberculosis
gucggcgaacggccagucca

SEQ ID NO: 942735 - RNA, 19 nt, Mycobacterium avium subsp. paratuberculosis
gucggcgaaggcgcgcagg

SEQ ID NO: 942736 - RNA, 23 nt, Mycobacterium avium subsp. paratuberculosis
gucggcgaaggcgcgcagggcga

SEQ ID NO: 942737 - RNA, 20 nt, Mycobacterium avium subsp. paratuberculosis
gucggcgaaggugccccgcu

SEQ ID NO: 942738 - RNA, 21 nt, Mycobacterium avium subsp. paratuberculosis
gucggcgaaggugccccgcug

SEQ ID NO: 942739 - RNA, 22 nt, Mycobacterium avium subsp. paratuberculosis
gucggcgaaggugccccgcugg

SEQ ID NO: 942740 - RNA, 17 nt, Mycobacterium avium subsp. paratuberculosis
gucgggaaugucggcgu

SEQ ID NO: 942741 - RNA, 19 nt, Mycobacterium avium subsp. paratuberculosis
gucggcuuccuccucggcg

SEQ ID NO: 942742 - RNA, 16 nt, Mycobacterium avium subsp. paratuberculosis
gucgggaaaucggacc

SEQ ID NO: 942743 - RNA, 17 nt, Mycobacterium avium subsp. paratuberculosis
gucgggaaaucggaccc

SEQ ID NO: 942744 - RNA, 18 nt, Mycobacterium avium subsp. paratuberculosis
gucgggaaaucggaccca

SEQ ID NO: 942745 - RNA, 23 nt, Mycobacterium avium subsp. paratuberculosis
gucgggaaaucggacccagcccg

SEQ ID NO: 942746 - RNA, 14 nt, Mycobacterium avium subsp. paratuberculosis
gucgggaacgccga

SEQ ID NO: 942747 - RNA, 17 nt, Mycobacterium avium subsp. paratuberculosis
gucgggaacgccgauca

SEQ ID NO: 942748 - RNA, 17 nt, Mycobacterium avium subsp. paratuberculosis
gucggcuggcgugcggc

SEQ ID NO: 942749 - RNA, 24 nt, Mycobacterium avium subsp. paratuberculosis
gucggcucggcucggccggccggc

SEQ ID NO: 942750 - RNA, 19 nt, Mycobacterium avium subsp. paratuberculosis
gucgggauggucgauccac

SEQ ID NO: 942751 - RNA, 17 nt, Mycobacterium avium subsp. paratuberculosis
gucgggcaaucggaccc

SEQ ID NO: 942752 - RNA, 21 nt, Mycobacterium avium subsp. paratuberculosis
gucgggcaaucggacccagcc

SEQ ID NO: 942753 - RNA, 23 nt, Mycobacterium avium subsp. paratuberculosis
gucgggcaaucggacccagcccg

SEQ ID NO: 942754 - RNA, 15 nt, Mycobacterium avium subsp. paratuberculosis
gucgggaucaacacg

SEQ ID NO: 942755 - RNA, 14 nt, Mycobacterium avium subsp. paratuberculosis
gucgggaucgaucc

SEQ ID NO: 942756 - RNA, 21 nt, Mycobacterium avium subsp. paratuberculosis
gucgggaucgaucccgucggc

SEQ ID NO: 942757 - RNA, 22 nt, Mycobacterium avium subsp. paratuberculosis
gucgggaucgaucccgucggcc

SEQ ID NO: 942758 - RNA, 23 nt, Mycobacterium avium subsp. paratuberculosis
gucgggaucgaucccgucggcca

SEQ ID NO: 942759 - RNA, 21 nt, Mycobacterium avium subsp. paratuberculosis
gucgggaccgaugccgcugau

SEQ ID NO: 942760 - RNA, 17 nt, Mycobacterium avium subsp. paratuberculosis
gucgggaccgucgcgca

SEQ ID NO: 942761 - RNA, 20 nt, Mycobacterium avium subsp. paratuberculosis
gucgggaccgucgcgcagcc

SEQ ID NO: 942762 - RNA, 23 nt, Mycobacterium avium subsp. paratuberculosis
gucgggaccgucgcgcagcccga

SEQ ID NO: 942763 - RNA, 18 nt, Mycobacterium avium subsp. paratuberculosis
gucgggaggcagcgcgga

SEQ ID NO: 942764 - RNA, 16 nt, Mycobacterium avium subsp. paratuberculosis
gucgggauacucgucc

SEQ ID NO: 942765 - RNA, 20 nt, Mycobacterium avium subsp. paratuberculosis
gucggcguugguccacacgu

SEQ ID NO: 942766 - RNA, 16 nt, Mycobacterium avium subsp. paratuberculosis
gucggcucgcccgcga

SEQ ID NO: 942767 - RNA, 14 nt, Mycobacterium avium subsp. paratuberculosis
gucggcucgccgau

SEQ ID NO: 942768 - RNA, 20 nt, Mycobacterium avium subsp. paratuberculosis
gucggcggucuuggcggcca

SEQ ID NO: 942769 - RNA, 23 nt, Mycobacterium avium subsp. paratuberculosis
gucggcggucuuggcggccagcg

SEQ ID NO: 942770 - RNA, 15 nt, Mycobacterium avium subsp. paratuberculosis
gucggcggucgccag

SEQ ID NO: 942771 - RNA, 16 nt, Mycobacterium avium subsp. paratuberculosis
gucggcggucgccagc

SEQ ID NO: 942772 - RNA, 15 nt, Mycobacterium avium subsp. paratuberculosis
gucggcggucgcggu

SEQ ID NO: 942773 - RNA, 16 nt, Mycobacterium avium subsp. paratuberculosis
gucggcggucgcggug

SEQ ID NO: 942774 - RNA, 14 nt, Mycobacterium avium subsp. paratuberculosis
gucggcggugaugg

SEQ ID NO: 942775 - RNA, 14 nt, Mycobacterium avium subsp. paratuberculosis
gucggcggugucga

SEQ ID NO: 942776 - RNA, 22 nt, Mycobacterium avium subsp. paratuberculosis
gucggcgguuucggugccggcc

SEQ ID NO: 942777 - RNA, 23 nt, Mycobacterium avium subsp. paratuberculosis
gucggcgguuucggugccggccc

SEQ ID NO: 942778 - RNA, 20 nt, Mycobacterium avium subsp. paratuberculosis
gucggcggggaaggugcggg

SEQ ID NO: 942779 - RNA, 16 nt, Mycobacterium avium subsp. paratuberculosis
gucggcggggccggug

SEQ ID NO: 942780 - RNA, 20 nt, Mycobacterium avium subsp. paratuberculosis
gucggcgggggauccgccug

SEQ ID NO: 942781 - RNA, 22 nt, Mycobacterium avium subsp. paratuberculosis
gucggcggcgacggcgaccaca

SEQ ID NO: 942782 - RNA, 23 nt, Mycobacterium avium subsp. paratuberculosis
gucggcgggcagcgagucgaagg

SEQ ID NO: 942783 - RNA, 15 nt, Mycobacterium avium subsp. paratuberculosis
gucggcgggccgguc

SEQ ID NO: 942784 - RNA, 12 nt, Mycobacterium avium subsp. paratuberculosis
gucggcgccgau

SEQ ID NO: 942785 - RNA, 14 nt, Mycobacterium avium subsp. paratuberculosis
gucggcgccgauca

SEQ ID NO: 942786 - RNA, 21 nt, Mycobacterium avium subsp. paratuberculosis
gucggcgccgaucacgccggu

SEQ ID NO: 942787 - RNA, 16 nt, Mycobacterium avium subsp. paratuberculosis
gucggcgccgucgcgg

SEQ ID NO: 942788 - RNA, 17 nt, Mycobacterium avium subsp. paratuberculosis
gucggcggccugcucgc

SEQ ID NO: 942789 - RNA, 20 nt, Mycobacterium avium subsp. paratuberculosis
gucggcggcgacgugccggc

SEQ ID NO: 942790 - RNA, 12 nt, Mycobacterium avium subsp. paratuberculosis
gucggcggcggc

SEQ ID NO: 942791 - RNA, 14 nt, Mycobacterium avium subsp. paratuberculosis
gucggcggcggccu

SEQ ID NO: 942792 - RNA, 16 nt, Mycobacterium avium subsp. paratuberculosis
gucggcggcggccugc

SEQ ID NO: 942793 - RNA, 13 nt, Mycobacterium avium subsp. paratuberculosis
gucggcggcggcg

SEQ ID NO: 942794 - RNA, 15 nt, Mycobacterium avium subsp. paratuberculosis
gucggcggcggcggc

SEQ ID NO: 942795 - RNA, 20 nt, Mycobacterium avium subsp. paratuberculosis
gucgggcagugcacgacgac

SEQ ID NO: 942796 - RNA, 17 nt, Mycobacterium avium subsp. paratuberculosis
gucgggcaugccggccg

SEQ ID NO: 942797 - RNA, 20 nt, Mycobacterium avium subsp. paratuberculosis
gucgggcaugccggccggca

SEQ ID NO: 942798 - RNA, 13 nt, Mycobacterium avium subsp. paratuberculosis
gucgggcccgccc

SEQ ID NO: 942799 - RNA, 15 nt, Mycobacterium avium subsp. paratuberculosis
gucgggccgcagcac

SEQ ID NO: 942800 - RNA, 16 nt, Mycobacterium avium subsp. paratuberculosis
gucgggccgcagcacg

SEQ ID NO: 942801 - RNA, 16 nt, Mycobacterium avium subsp. paratuberculosis
gucgggcaggccggug

SEQ ID NO: 942802 - RNA, 14 nt, Mycobacterium avium subsp. paratuberculosis
gucgggcaccugcu

SEQ ID NO: 942803 - RNA, 14 nt, Mycobacterium avium subsp. paratuberculosis
gucgggcaccagca

SEQ ID NO: 942804 - RNA, 15 nt, Mycobacterium avium subsp. paratuberculosis
gucgggcacagccag

SEQ ID NO: 942805 - RNA, 23 nt, Mycobacterium avium subsp. paratuberculosis
gucgggcacagccagcgcccggc

SEQ ID NO: 942806 - RNA, 18 nt, Mycobacterium avium subsp. paratuberculosis
gucgggcguugcgcucug

SEQ ID NO: 942807 - RNA, 15 nt, Mycobacterium avium subsp. paratuberculosis
gucgggcgcggcggc

SEQ ID NO: 942808 - RNA, 18 nt, Mycobacterium avium subsp. paratuberculosis
gucgggcgcggcggcaac

SEQ ID NO: 942809 - RNA, 13 nt, Mycobacterium avium subsp. paratuberculosis
gucgggcgcggug

SEQ ID NO: 942810 - RNA, 22 nt, Mycobacterium avium subsp. paratuberculosis
gucgggcggcaggaaccggguc

SEQ ID NO: 942811 - RNA, 13 nt, Mycobacterium avium subsp. paratuberculosis
gucgggccggaca

SEQ ID NO: 942812 - RNA, 17 nt, Mycobacterium avium subsp. paratuberculosis
gucgggccggacagcgg

SEQ ID NO: 942813 - RNA, 18 nt, Mycobacterium avium subsp. paratuberculosis
gucgggccggacagcggc

SEQ ID NO: 942814 - RNA, 14 nt, Mycobacterium avium subsp. paratuberculosis
gucgggccggauca

SEQ ID NO: 942815 - RNA, 17 nt, Mycobacterium avium subsp. paratuberculosis
gucgggccggccgauga

SEQ ID NO: 942816 - RNA, 20 nt, Mycobacterium avium subsp. paratuberculosis
gucgggccggccgaugaccu

SEQ ID NO: 942817 - RNA, 20 nt, Mycobacterium avium subsp. paratuberculosis
gucgggccgggggcggcggc

SEQ ID NO: 942818 - RNA, 18 nt, Mycobacterium avium subsp. paratuberculosis
gucgggcgagguguagau

SEQ ID NO: 942819 - RNA, 15 nt, Mycobacterium avium subsp. paratuberculosis
gucgggcgcaccacg

SEQ ID NO: 942820 - RNA, 22 nt, Mycobacterium avium subsp. paratuberculosis
gucgggcgccagcccgcccagc

SEQ ID NO: 942821 - RNA, 13 nt, Mycobacterium avium subsp. paratuberculosis
gucgggcgccggc

SEQ ID NO: 942822 - RNA, 14 nt, Mycobacterium avium subsp. paratuberculosis
gucgggcgccggcg

SEQ ID NO: 942823 - RNA, 15 nt, Mycobacterium avium subsp. paratuberculosis
gucgggcgccggcgc

SEQ ID NO: 942824 - RNA, 21 nt, Mycobacterium avium subsp. paratuberculosis
gucgggcgccggcgcguccgg

SEQ ID NO: 942825 - RNA, 20 nt, Mycobacterium avium subsp. paratuberculosis
gucggggcaucgcagcgcgc

SEQ ID NO: 942826 - RNA, 23 nt, Mycobacterium avium subsp. paratuberculosis
gucggggcaucgcagcgcgcggc

SEQ ID NO: 942827 - RNA, 19 nt, Mycobacterium avium subsp. paratuberculosis
gucggggaauuccggcgcg

SEQ ID NO: 942828 - RNA, 20 nt, Mycobacterium avium subsp. paratuberculosis
gucggggaauuccggcgcga

SEQ ID NO: 942829 - RNA, 17 nt, Mycobacterium avium subsp. paratuberculosis
gucggggaccguccccg

SEQ ID NO: 942830 - RNA, 21 nt, Mycobacterium avium subsp. paratuberculosis
gucggggacgaagaccggguc

SEQ ID NO: 942831 - RNA, 14 nt, Mycobacterium avium subsp. paratuberculosis
gucggggaucagcg

SEQ ID NO: 942832 - RNA, 15 nt, Mycobacterium avium subsp. paratuberculosis
gucggggaucagcgu

SEQ ID NO: 942833 - RNA, 21 nt, Mycobacterium avium subsp. paratuberculosis
gucggggaucagcgucgcgau

SEQ ID NO: 942834 - RNA, 19 nt, Mycobacterium avium subsp. paratuberculosis
gucggggaugucgucgggc

SEQ ID NO: 942835 - RNA, 21 nt, Mycobacterium avium subsp. paratuberculosis
gucggggaugucgucgggcgc

SEQ ID NO: 942836 - RNA, 16 nt, Mycobacterium avium subsp. paratuberculosis
gucgggcucgccucgg

SEQ ID NO: 942837 - RNA, 13 nt, Mycobacterium avium subsp. paratuberculosis
gucgggcucgcgc

SEQ ID NO: 942838 - RNA, 15 nt, Mycobacterium avium subsp. paratuberculosis
gucgggcucgcgcac

SEQ ID NO: 942839 - RNA, 15 nt, Mycobacterium avium subsp. paratuberculosis
gucgggcucggccgc

SEQ ID NO: 942840 - RNA, 16 nt, Mycobacterium avium subsp. paratuberculosis
gucgggcucggccgcc

SEQ ID NO: 942841 - RNA, 20 nt, Mycobacterium avium subsp. paratuberculosis
gucgggcucggccgccgaca

SEQ ID NO: 942842 - RNA, 14 nt, Mycobacterium avium subsp. paratuberculosis
gucgggcugggcgg

SEQ ID NO: 942843 - RNA, 16 nt, Mycobacterium avium subsp. paratuberculosis
gucgggguggugggcg

SEQ ID NO: 942844 - RNA, 17 nt, Mycobacterium avium subsp. paratuberculosis
gucgggguggugggcgc

SEQ ID NO: 942845 - RNA, 15 nt, Mycobacterium avium subsp. paratuberculosis
gucggggugcgccag

SEQ ID NO: 942846 - RNA, 17 nt, Mycobacterium avium subsp. paratuberculosis
gucggggugcgccaggc

SEQ ID NO: 942847 - RNA, 19 nt, Mycobacterium avium subsp. paratuberculosis
gucggggugcggucggcga

SEQ ID NO: 942848 - RNA, 14 nt, Mycobacterium avium subsp. paratuberculosis
gucggggucggcgc

SEQ ID NO: 942849 - RNA, 16 nt, Mycobacterium avium subsp. paratuberculosis
gucggggucggcgccg

SEQ ID NO: 942850 - RNA, 19 nt, Mycobacterium avium subsp. paratuberculosis
gucggggucggcgccgcgc

SEQ ID NO: 942851 - RNA, 17 nt, Mycobacterium avium subsp. paratuberculosis
gucggggucgucgacgg

SEQ ID NO: 942852 - RNA, 14 nt, Mycobacterium avium subsp. paratuberculosis
gucggggucgucgc

SEQ ID NO: 942853 - RNA, 14 nt, Mycobacterium avium subsp. paratuberculosis
gucggggccgcacu

SEQ ID NO: 942854 - RNA, 17 nt, Mycobacterium avium subsp. paratuberculosis
gucggggcuggcggcga

SEQ ID NO: 942855 - RNA, 16 nt, Mycobacterium avium subsp. paratuberculosis
gucggugcccagcgcg

SEQ ID NO: 942856 - RNA, 19 nt, Mycobacterium avium subsp. paratuberculosis
gucggugcccagcgcgagg

SEQ ID NO: 942857 - RNA, 22 nt, Mycobacterium avium subsp. paratuberculosis
gucggugcccagcgcgaggucg

SEQ ID NO: 942858 - RNA, 15 nt, Mycobacterium avium subsp. paratuberculosis
gucggugcccagguc

SEQ ID NO: 942859 - RNA, 17 nt, Mycobacterium avium subsp. paratuberculosis
gucggugcccaggucgc

SEQ ID NO: 942860 - RNA, 17 nt, Mycobacterium avium subsp. paratuberculosis
gucggugcccugugagg

SEQ ID NO: 942861 - RNA, 18 nt, Mycobacterium avium subsp. paratuberculosis
gucggugagcgccacccc

SEQ ID NO: 942862 - RNA, 20 nt, Mycobacterium avium subsp. paratuberculosis
gucggugagcgccaccccga

SEQ ID NO: 942863 - RNA, 19 nt, Mycobacterium avium subsp. paratuberculosis
gucggugagcuggccgcgc

SEQ ID NO: 942864 - RNA, 23 nt, Mycobacterium avium subsp. paratuberculosis
gucggugagcuggccgcgcagcg

SEQ ID NO: 942865 - RNA, 21 nt, Mycobacterium avium subsp. paratuberculosis
gucggucgagccuggcgcgca

SEQ ID NO: 942866 - RNA, 15 nt, Mycobacterium avium subsp. paratuberculosis
gucggugaaguccga

SEQ ID NO: 942867 - RNA, 19 nt, Mycobacterium avium subsp. paratuberculosis
gucggugaaguccgagacg

SEQ ID NO: 942868 - RNA, 15 nt, Mycobacterium avium subsp. paratuberculosis
gucggugaccacggu

SEQ ID NO: 942869 - RNA, 23 nt, Mycobacterium avium subsp. paratuberculosis
gucggugaccacggucggcgggu

SEQ ID NO: 942870 - RNA, 18 nt, Mycobacterium avium subsp. paratuberculosis
gucggugaacgccgguga

SEQ ID NO: 942871 - RNA, 14 nt, Mycobacterium avium subsp. paratuberculosis
gucggucucgacgu

SEQ ID NO: 942872 - RNA, 21 nt, Mycobacterium avium subsp. paratuberculosis
gucggucgcgccgaccugguc

SEQ ID NO: 942873 - RNA, 14 nt, Mycobacterium avium subsp. paratuberculosis
gucggucggcccgc

SEQ ID NO: 942874 - RNA, 15 nt, Mycobacterium avium subsp. paratuberculosis
gucggucggcccgcu

SEQ ID NO: 942875 - RNA, 17 nt, Mycobacterium avium subsp. paratuberculosis
gucggucggcccgcugc

SEQ ID NO: 942876 - RNA, 14 nt, Mycobacterium avium subsp. paratuberculosis
gucggucggccgca

SEQ ID NO: 942877 - RNA, 20 nt, Mycobacterium avium subsp. paratuberculosis
gucggucaacgugucgagca

SEQ ID NO: 942878 - RNA, 20 nt, Mycobacterium avium subsp. paratuberculosis
gucggucagucgcgccgcca

SEQ ID NO: 942879 - RNA, 13 nt, Mycobacterium avium subsp. paratuberculosis
gucggucccgacg

SEQ ID NO: 942880 - RNA, 16 nt, Mycobacterium avium subsp. paratuberculosis
gucggucccgacgcgg

SEQ ID NO: 942881 - RNA, 13 nt, Mycobacterium avium subsp. paratuberculosis
gucgggucggcga

SEQ ID NO: 942882 - RNA, 21 nt, Mycobacterium avium subsp. paratuberculosis
gucgggguggggacgacgccg

SEQ ID NO: 942883 - RNA, 13 nt, Mycobacterium avium subsp. paratuberculosis
gucgggucccggc

SEQ ID NO: 942884 - RNA, 16 nt, Mycobacterium avium subsp. paratuberculosis
gucgggucccggcaac

SEQ ID NO: 942885 - RNA, 19 nt, Mycobacterium avium subsp. paratuberculosis
gucggguccgaccagcacc

SEQ ID NO: 942886 - RNA, 23 nt, Mycobacterium avium subsp. paratuberculosis
gucggggucgcgccgguagagcg

SEQ ID NO: 942887 - RNA, 15 nt, Mycobacterium avium subsp. paratuberculosis
gucggguugcgcgga

SEQ ID NO: 942888 - RNA, 19 nt, Mycobacterium avium subsp. paratuberculosis
gucggguuggccagggcgg

SEQ ID NO: 942889 - RNA, 19 nt, Mycobacterium avium subsp. paratuberculosis
gucgggucggcgagcagcc

SEQ ID NO: 942890 - RNA, 20 nt, Mycobacterium avium subsp. paratuberculosis
gucgggucggcgagcagccg

SEQ ID NO: 942891 - RNA, 18 nt, Mycobacterium avium subsp. paratuberculosis
gucgggugcggcgguguu

SEQ ID NO: 942892 - RNA, 16 nt, Mycobacterium avium subsp. paratuberculosis
gucggguguggcgccg

SEQ ID NO: 942893 - RNA, 17 nt, Mycobacterium avium subsp. paratuberculosis
gucggguucgccgguga

SEQ ID NO: 942894 - RNA, 13 nt, Mycobacterium avium subsp. paratuberculosis
gucggucagcgcc

SEQ ID NO: 942895 - RNA, 15 nt, Mycobacterium avium subsp. paratuberculosis
gucggucagcgccac

SEQ ID NO: 942896 - RNA, 18 nt, Mycobacterium avium subsp. paratuberculosis
gucggucagcgucgccgc

SEQ ID NO: 942897 - RNA, 19 nt, Mycobacterium avium subsp. paratuberculosis
gucggucagcgucgccgcc

SEQ ID NO: 942898 - RNA, 20 nt, Mycobacterium avium subsp. paratuberculosis
gucggucagcgucgccgccc

SEQ ID NO: 942899 - RNA, 14 nt, Mycobacterium avium subsp. paratuberculosis
gucggucagcucga

SEQ ID NO: 942900 - RNA, 15 nt, Mycobacterium avium subsp. paratuberculosis
gucggucagcucgaa

SEQ ID NO: 942901 - RNA, 17 nt, Mycobacterium avium subsp. paratuberculosis
gucggucaggaacgcgg

SEQ ID NO: 942902 - RNA, 14 nt, Mycobacterium avium subsp. paratuberculosis
gucggucaggccgg

SEQ ID NO: 942903 - RNA, 15 nt, Mycobacterium avium subsp. paratuberculosis
gucggucaggccggc

SEQ ID NO: 942904 - RNA, 16 nt, Mycobacterium avium subsp. paratuberculosis
gucggucaggccggcg

SEQ ID NO: 942905 - RNA, 18 nt, Mycobacterium avium subsp. paratuberculosis
gucggucaggccggcgcc

SEQ ID NO: 942906 - RNA, 17 nt, Mycobacterium avium subsp. paratuberculosis
gugaacaccccgcggga

SEQ ID NO: 942907 - RNA, 21 nt, Mycobacterium avium subsp. paratuberculosis
gugaaacuaacuucacgcucg

SEQ ID NO: 942908 - RNA, 21 nt, Mycobacterium avium subsp. paratuberculosis
gugaaacuagcuucacgcucg

SEQ ID NO: 942909 - RNA, 21 nt, Mycobacterium avium subsp. paratuberculosis
gugaacagguaggcggcgccg

SEQ ID NO: 942910 - RNA, 13 nt, Mycobacterium avium subsp. paratuberculosis
gugaacgcgucgg

SEQ ID NO: 942911 - RNA, 14 nt, Mycobacterium avium subsp. paratuberculosis
gugaacgcgucggu

SEQ ID NO: 942912 - RNA, 20 nt, Mycobacterium avium subsp. paratuberculosis
gugaacgcgucggucagcgg

SEQ ID NO: 942913 - RNA, 19 nt, Mycobacterium avium subsp. paratuberculosis
gugaacgccucgggccggc

SEQ ID NO: 942914 - RNA, 13 nt, Mycobacterium avium subsp. paratuberculosis
gugaacgccggug

SEQ ID NO: 942915 - RNA, 16 nt, Mycobacterium avium subsp. paratuberculosis
gugaacgccggugagg

SEQ ID NO: 942916 - RNA, 13 nt, Mycobacterium avium subsp. paratuberculosis
gugaacgaggccg

SEQ ID NO: 942917 - RNA, 18 nt, Mycobacterium avium subsp. paratuberculosis
gugaacgaggccgcgccg

SEQ ID NO: 942918 - RNA, 21 nt, Mycobacterium avium subsp. paratuberculosis
gugaacuuaacuucacgcucg

SEQ ID NO: 942919 - RNA, 23 nt, Mycobacterium avium subsp. paratuberculosis
gugaacuuaacuucacgcucggc

SEQ ID NO: 942920 - RNA, 14 nt, Mycobacterium avium subsp. paratuberculosis
gugaacucgccgau

SEQ ID NO: 942921 - RNA, 13 nt, Mycobacterium avium subsp. paratuberculosis
gugaagaucagcg

SEQ ID NO: 942922 - RNA, 15 nt, Mycobacterium avium subsp. paratuberculosis
gugaagaucagcgcg

SEQ ID NO: 942923 - RNA, 18 nt, Mycobacterium avium subsp. paratuberculosis
gugaagaucagcgcgucg

SEQ ID NO: 942924 - RNA, 20 nt, Mycobacterium avium subsp. paratuberculosis
gugaagaucagcgcgucggu

SEQ ID NO: 942925 - RNA, 14 nt, Mycobacterium avium subsp. paratuberculosis
gugaagcagaacgc

SEQ ID NO: 942926 - RNA, 15 nt, Mycobacterium avium subsp. paratuberculosis
gugaagcccagcgcg

SEQ ID NO: 942927 - RNA, 19 nt, Mycobacterium avium subsp. paratuberculosis
gugaagcccagcgcguuga

SEQ ID NO: 942928 - RNA, 19 nt, Mycobacterium avium subsp. paratuberculosis
gugaagucggugcccagcg

SEQ ID NO: 942929 - RNA, 19 nt, Mycobacterium avium subsp. paratuberculosis
gugaagucguccagcgucg

SEQ ID NO: 942930 - RNA, 20 nt, Mycobacterium avium subsp. paratuberculosis
gugaaguccgagacgucggc

SEQ ID NO: 942931 - RNA, 22 nt, Mycobacterium avium subsp. paratuberculosis
gugaagggcccgccgguggccg

SEQ ID NO: 942932 - RNA, 23 nt, Mycobacterium avium subsp. paratuberculosis
gugaagggguccggaagcccuug

SEQ ID NO: 942933 - RNA, 16 nt, Mycobacterium avium subsp. paratuberculosis
gugaaggugcccuccu

SEQ ID NO: 942934 - RNA, 22 nt, Mycobacterium avium subsp. paratuberculosis
gugaaggugcccuccucgccgg

SEQ ID NO: 942935 - RNA, 14 nt, Mycobacterium avium subsp. paratuberculosis
gugaaggcggccac

SEQ ID NO: 942936 - RNA, 16 nt, Mycobacterium avium subsp. paratuberculosis
gugaaggcggccaccg

SEQ ID NO: 942937 - RNA, 19 nt, Mycobacterium avium subsp. paratuberculosis
gugaaggcggccaccgcgg

SEQ ID NO: 942938 - RNA, 16 nt, Mycobacterium avium subsp. paratuberculosis
gugaagaucgacgcca

SEQ ID NO: 942939 - RNA, 18 nt, Mycobacterium avium subsp. paratuberculosis
gugaagaucgcccgccgc

SEQ ID NO: 942940 - RNA, 23 nt, Mycobacterium avium subsp. paratuberculosis
gugaagcuagcuucacgcucggc

SEQ ID NO: 942941 - RNA, 14 nt, Mycobacterium avium subsp. paratuberculosis
gugaagcugccgac

SEQ ID NO: 942942 - RNA, 16 nt, Mycobacterium avium subsp. paratuberculosis
gugaaugcccagcggg

SEQ ID NO: 942943 - RNA, 14 nt, Mycobacterium avium subsp. paratuberculosis
gugaaugggcugcg

SEQ ID NO: 942944 - RNA, 21 nt, Mycobacterium avium subsp. paratuberculosis
gugaauggguguaacgcgucg

SEQ ID NO: 942945 - RNA, 22 nt, Mycobacterium avium subsp. paratuberculosis
gugaauggguguaacgcgucga

SEQ ID NO: 942946 - RNA, 17 nt, Mycobacterium avium subsp. paratuberculosis
gugaauccucagcacgg

SEQ ID NO: 942947 - RNA, 14 nt, Mycobacterium avium subsp. paratuberculosis
gugaaucgacaccg

SEQ ID NO: 942948 - RNA, 19 nt, Mycobacterium avium subsp. paratuberculosis
gugaaucgacaccgcacgg

SEQ ID NO: 942949 - RNA, 16 nt, Mycobacterium avium subsp. paratuberculosis
gugaaucuuggccagc

SEQ ID NO: 942950 - RNA, 19 nt, Mycobacterium avium subsp. paratuberculosis
gugaaucuuggccagcagc

SEQ ID NO: 942951 - RNA, 21 nt, Mycobacterium avium subsp. paratuberculosis
gugaauaccacugcgcgcccg

SEQ ID NO: 942952 - RNA, 14 nt, Mycobacterium avium subsp. paratuberculosis
gugaauccagccgu

SEQ ID NO: 942953 - RNA, 18 nt, Mycobacterium avium subsp. paratuberculosis
gugaaguuggcggcggug

SEQ ID NO: 942954 - RNA, 15 nt, Mycobacterium avium subsp. paratuberculosis
gugaagugccggucc

SEQ ID NO: 942955 - RNA, 21 nt, Mycobacterium avium subsp. paratuberculosis
gugaagugccgguccagccgc

SEQ ID NO: 942956 - RNA, 13 nt, Mycobacterium avium subsp. paratuberculosis
gugacacagccaa

SEQ ID NO: 942957 - RNA, 21 nt, Mycobacterium avium subsp. paratuberculosis
gugacaaagaucacagcgccc

SEQ ID NO: 942958 - RNA, 18 nt, Mycobacterium avium subsp. paratuberculosis
gugacaagccggcgucga

SEQ ID NO: 942959 - RNA, 19 nt, Mycobacterium avium subsp. paratuberculosis
gugaccaccugcaccugcg

SEQ ID NO: 942960 - RNA, 14 nt, Mycobacterium avium subsp. paratuberculosis
gugaccacgccgug

SEQ ID NO: 942961 - RNA, 16 nt, Mycobacterium avium subsp. paratuberculosis
gugaccacgccgugcc

SEQ ID NO: 942962 - RNA, 22 nt, Mycobacterium avium subsp. paratuberculosis
gugaccacgccgugcccggcgc

SEQ ID NO: 942963 - RNA, 15 nt, Mycobacterium avium subsp. paratuberculosis
gugacaugcccgggc

SEQ ID NO: 942964 - RNA, 16 nt, Mycobacterium avium subsp. paratuberculosis
gugacaugcccgggcu

SEQ ID NO: 942965 - RNA, 23 nt, Mycobacterium avium subsp. paratuberculosis
gugacaugcccgggcucgcacuc

SEQ ID NO: 942966 - RNA, 20 nt, Mycobacterium avium subsp. paratuberculosis
gugaccgccgccauccgcgc

SEQ ID NO: 942967 - RNA, 14 nt, Mycobacterium avium subsp. paratuberculosis
gugaccgcgacgcu

SEQ ID NO: 942968 - RNA, 15 nt, Mycobacterium avium subsp. paratuberculosis
gugaccgcgacgcug

SEQ ID NO: 942969 - RNA, 20 nt, Mycobacterium avium subsp. paratuberculosis
gugaccgcgacgcugccggu

SEQ ID NO: 942970 - RNA, 16 nt, Mycobacterium avium subsp. paratuberculosis
gugaccgcgccgcggg

SEQ ID NO: 942971 - RNA, 14 nt, Mycobacterium avium subsp. paratuberculosis
gugaccgcgccggu

SEQ ID NO: 942972 - RNA, 12 nt, Mycobacterium avium subsp. paratuberculosis
gugaccgcggcc

SEQ ID NO: 942973 - RNA, 19 nt, Mycobacterium avium subsp. paratuberculosis
gugaccgcggccucgucga

SEQ ID NO: 942974 - RNA, 21 nt, Mycobacterium avium subsp. paratuberculosis
gugaccgcccgcucgacggcc

SEQ ID NO: 942975 - RNA, 19 nt, Mycobacterium avium subsp. paratuberculosis
gugaccgaggccgcccgcu

SEQ ID NO: 942976 - RNA, 22 nt, Mycobacterium avium subsp. paratuberculosis
gugaccgagucgucgcgcacca

SEQ ID NO: 942977 - RNA, 18 nt, Mycobacterium avium subsp. paratuberculosis
gugaccgccagcaccgcg

SEQ ID NO: 942978 - RNA, 19 nt, Mycobacterium avium subsp. paratuberculosis
gugaccgccagcaccgcgg

SEQ ID NO: 942979 - RNA, 20 nt, Mycobacterium avium subsp. paratuberculosis
gugaccgccagcaccgcggg

SEQ ID NO: 942980 - RNA, 18 nt, Mycobacterium avium subsp. paratuberculosis
gugacccugccgucaccg

SEQ ID NO: 942981 - RNA, 21 nt, Mycobacterium avium subsp. paratuberculosis
gugacccugccgucaccggcc

SEQ ID NO: 942982 - RNA, 12 nt, Mycobacterium avium subsp. paratuberculosis
gugaccacgcug

SEQ ID NO: 942983 - RNA, 20 nt, Mycobacterium avium subsp. paratuberculosis
gugaccagaaucuucgccuc

SEQ ID NO: 942984 - RNA, 13 nt, Mycobacterium avium subsp. paratuberculosis
gugaccagcguga

SEQ ID NO: 942985 - RNA, 22 nt, Mycobacterium avium subsp. paratuberculosis
gugaccagugcagagcgauggg

SEQ ID NO: 942986 - RNA, 21 nt, Mycobacterium avium subsp. paratuberculosis
gugaccaucgggucgucggcg

SEQ ID NO: 942987 - RNA, 14 nt, Mycobacterium avium subsp. paratuberculosis
gugaccccggcgac

SEQ ID NO: 942988 - RNA, 22 nt, Mycobacterium avium subsp. paratuberculosis
gugacccgauccagggcccgcu

SEQ ID NO: 942989 - RNA, 17 nt, Mycobacterium avium subsp. paratuberculosis
gugacccgccgugaccg

SEQ ID NO: 942990 - RNA, 19 nt, Mycobacterium avium subsp. paratuberculosis
gugacccgccgugaccggc

SEQ ID NO: 942991 - RNA, 13 nt, Mycobacterium avium subsp. paratuberculosis
gugacccgcucgg

SEQ ID NO: 942992 - RNA, 18 nt, Mycobacterium avium subsp. paratuberculosis
gugacccgcucgggcgcc

SEQ ID NO: 942993 - RNA, 21 nt, Mycobacterium avium subsp. paratuberculosis
gugacccgcucgggcgccucg

SEQ ID NO: 942994 - RNA, 13 nt, Mycobacterium avium subsp. paratuberculosis
gugacccggccgu

SEQ ID NO: 942995 - RNA, 20 nt, Mycobacterium avium subsp. paratuberculosis
gugacuccuccucggccagc

SEQ ID NO: 942996 - RNA, 20 nt, Mycobacterium avium subsp. paratuberculosis
gugacguuguaggagaacgu

SEQ ID NO: 942997 - RNA, 14 nt, Mycobacterium avium subsp. paratuberculosis
gugacguucggcca

SEQ ID NO: 942998 - RNA, 20 nt, Mycobacterium avium subsp. paratuberculosis
gugagaaaagcgaccagcgc

SEQ ID NO: 942999 - RNA, 19 nt, Mycobacterium avium subsp. paratuberculosis
gugagcaacaccggcacga

SEQ ID NO: 943000 - RNA, 14 nt, Mycobacterium avium subsp. paratuberculosis
gugacggucgaccu

SEQ ID NO: 943001 - RNA, 20 nt, Mycobacterium avium subsp. paratuberculosis
gugacggguuggucggcgcg

SEQ ID NO: 943002 - RNA, 22 nt, Mycobacterium avium subsp. paratuberculosis
gugacgguggcguccucgacgg

SEQ ID NO: 943003 - RNA, 23 nt, Mycobacterium avium subsp. paratuberculosis
gugacggugugcgggucgguggu

SEQ ID NO: 943004 - RNA, 15 nt, Mycobacterium avium subsp. paratuberculosis
gugacggccgugaug

SEQ ID NO: 943005 - RNA, 13 nt, Mycobacterium avium subsp. paratuberculosis
gugacggccuccc

SEQ ID NO: 943006 - RNA, 22 nt, Mycobacterium avium subsp. paratuberculosis
gugacggccucccacucgucga

SEQ ID NO: 943007 - RNA, 12 nt, Mycobacterium avium subsp. paratuberculosis
gugacggcgucg

SEQ ID NO: 943008 - RNA, 16 nt, Mycobacterium avium subsp. paratuberculosis
gugacggcgucggcga

SEQ ID NO: 943009 - RNA, 13 nt, Mycobacterium avium subsp. paratuberculosis
gugacgucgccga

SEQ ID NO: 943010 - RNA, 18 nt, Mycobacterium avium subsp. paratuberculosis
gugacgucgccgauggcg

SEQ ID NO: 943011 - RNA, 15 nt, Mycobacterium avium subsp. paratuberculosis
gugacgucgcgccgc

SEQ ID NO: 943012 - RNA, 17 nt, Mycobacterium avium subsp. paratuberculosis
gugacgucgcgccgcuc

SEQ ID NO: 943013 - RNA, 13 nt, Mycobacterium avium subsp. paratuberculosis
gugacgucgcgcg

SEQ ID NO: 943014 - RNA, 15 nt, Mycobacterium avium subsp. paratuberculosis
gugacgucgcgcggg

SEQ ID NO: 943015 - RNA, 23 nt, Mycobacterium avium subsp. paratuberculosis
gugacguggcggccgucgcgcac

SEQ ID NO: 943016 - RNA, 17 nt, Mycobacterium avium subsp. paratuberculosis
gugacguaagugucgug

SEQ ID NO: 943017 - RNA, 16 nt, Mycobacterium avium subsp. paratuberculosis
gugacggucaugccga

SEQ ID NO: 943018 - RNA, 17 nt, Mycobacterium avium subsp. paratuberculosis
gugagcuaucagcucgc

SEQ ID NO: 943019 - RNA, 12 nt, Mycobacterium avium subsp. paratuberculosis
gugagcgcgucg

SEQ ID NO: 943020 - RNA, 15 nt, Mycobacterium avium subsp. paratuberculosis
gugagcggccgcagc

SEQ ID NO: 943021 - RNA, 23 nt, Mycobacterium avium subsp. paratuberculosis
gugagcggccgcagcgcaucgcc

SEQ ID NO: 943022 - RNA, 13 nt, Mycobacterium avium subsp. paratuberculosis
gugagcgccaccc

SEQ ID NO: 943023 - RNA, 15 nt, Mycobacterium avium subsp. paratuberculosis
gugagcgccaccccg

SEQ ID NO: 943024 - RNA, 14 nt, Mycobacterium avium subsp. paratuberculosis
gugagcgcgccggc

SEQ ID NO: 943025 - RNA, 18 nt, Mycobacterium avium subsp. paratuberculosis
gugagcgcgccggcccga

SEQ ID NO: 943026 - RNA, 16 nt, Mycobacterium avium subsp. paratuberculosis
gugagcuuccugccaa

SEQ ID NO: 943027 - RNA, 18 nt, Mycobacterium avium subsp. paratuberculosis
gugaggacgaggcgagua

SEQ ID NO: 943028 - RNA, 14 nt, Mycobacterium avium subsp. paratuberculosis
gugaggcacccgcu

SEQ ID NO: 943029 - RNA, 20 nt, Mycobacterium avium subsp. paratuberculosis
gugaggcaccgaacgccagc

SEQ ID NO: 943030 - RNA, 15 nt, Mycobacterium avium subsp. paratuberculosis
gugaggccagcaccc

SEQ ID NO: 943031 - RNA, 13 nt, Mycobacterium avium subsp. paratuberculosis
gugaggcccggcg

SEQ ID NO: 943032 - RNA, 13 nt, Mycobacterium avium subsp. paratuberculosis
gugaggcgcgccg

SEQ ID NO: 943033 - RNA, 15 nt, Mycobacterium avium subsp. paratuberculosis
gugaggcgcgccggu

SEQ ID NO: 943034 - RNA, 15 nt, Mycobacterium avium subsp. paratuberculosis
gugagcaccgccguc

SEQ ID NO: 943035 - RNA, 16 nt, Mycobacterium avium subsp. paratuberculosis
gugagcaccgccgucc

SEQ ID NO: 943036 - RNA, 14 nt, Mycobacterium avium subsp. paratuberculosis
gugagcaccgggaa

SEQ ID NO: 943037 - RNA, 12 nt, Mycobacterium avium subsp. paratuberculosis
gugagcaccguu

SEQ ID NO: 943038 - RNA, 13 nt, Mycobacterium avium subsp. paratuberculosis
gugagcagcucgg

SEQ ID NO: 943039 - RNA, 19 nt, Mycobacterium avium subsp. paratuberculosis
gugagcagggccagcggca

SEQ ID NO: 943040 - RNA, 16 nt, Mycobacterium avium subsp. paratuberculosis
gugagcaucgggcgca

SEQ ID NO: 943041 - RNA, 12 nt, Mycobacterium avium subsp. paratuberculosis
gugagccggucg

SEQ ID NO: 943042 - RNA, 13 nt, Mycobacterium avium subsp. paratuberculosis
gugacgccgggcc

SEQ ID NO: 943043 - RNA, 23 nt, Mycobacterium avium subsp. paratuberculosis
gugacgccgggccgccgcggcca

SEQ ID NO: 943044 - RNA, 15 nt, Mycobacterium avium subsp. paratuberculosis
gugacgccugcggcc

SEQ ID NO: 943045 - RNA, 17 nt, Mycobacterium avium subsp. paratuberculosis
gugacgccugcggccca

SEQ ID NO: 943046 - RNA, 19 nt, Mycobacterium avium subsp. paratuberculosis
gugacgccugcggcccagc

SEQ ID NO: 943047 - RNA, 22 nt, Mycobacterium avium subsp. paratuberculosis
gugacgccugcggcccagcgua

SEQ ID NO: 943048 - RNA, 13 nt, Mycobacterium avium subsp. paratuberculosis
gugacgcgccggc

SEQ ID NO: 943049 - RNA, 14 nt, Mycobacterium avium subsp. paratuberculosis
gugacgcgccggcc

SEQ ID NO: 943050 - RNA, 16 nt, Mycobacterium avium subsp. paratuberculosis
gugacgcgcgugacgg

SEQ ID NO: 943051 - RNA, 11 nt, Mycobacterium avium subsp. paratuberculosis
gugacgcggcg

SEQ ID NO: 943052 - RNA, 18 nt, Mycobacterium avium subsp. paratuberculosis
gugacgcgggaccgggcc

SEQ ID NO: 943053 - RNA, 17 nt, Mycobacterium avium subsp. paratuberculosis
gugacgcucgacggccg

SEQ ID NO: 943054 - RNA, 22 nt, Mycobacterium avium subsp. paratuberculosis
gugacgcucgacggccggcguc

SEQ ID NO: 943055 - RNA, 21 nt, Mycobacterium avium subsp. paratuberculosis
gugacgcucgccggcggccgc

SEQ ID NO: 943056 - RNA, 14 nt, Mycobacterium avium subsp. paratuberculosis
gugacgcucgcgug

SEQ ID NO: 943057 - RNA, 14 nt, Mycobacterium avium subsp. paratuberculosis
gugacgcucggccu

SEQ ID NO: 943058 - RNA, 16 nt, Mycobacterium avium subsp. paratuberculosis
gugacgcucggccuca

SEQ ID NO: 943059 - RNA, 23 nt, Mycobacterium avium subsp. paratuberculosis
gugacgcucggccucaggcgucg

SEQ ID NO: 943060 - RNA, 14 nt, Mycobacterium avium subsp. paratuberculosis
gugacgcucggcgc

SEQ ID NO: 943061 - RNA, 16 nt, Mycobacterium avium subsp. paratuberculosis
gugacgcucggcgccg

SEQ ID NO: 943062 - RNA, 19 nt, Mycobacterium avium subsp. paratuberculosis
gugacgcucggcgccggcc

SEQ ID NO: 943063 - RNA, 23 nt, Mycobacterium avium subsp. paratuberculosis
gugacgcucggcgcgucguccga

SEQ ID NO: 943064 - RNA, 16 nt, Mycobacterium avium subsp. paratuberculosis
gugacgcucggcggcc

SEQ ID NO: 943065 - RNA, 21 nt, Mycobacterium avium subsp. paratuberculosis
gugacggaguuggaucgccgc

SEQ ID NO: 943066 - RNA, 16 nt, Mycobacterium avium subsp. paratuberculosis
gugacggccgcggcgc

SEQ ID NO: 943067 - RNA, 16 nt, Mycobacterium avium subsp. paratuberculosis
gugacggauccgggcg

SEQ ID NO: 943068 - RNA, 19 nt, Mycobacterium avium subsp. paratuberculosis
gugacggauguggucggcc

SEQ ID NO: 943069 - RNA, 22 nt, Mycobacterium avium subsp. paratuberculosis
gugacggauguggucggccacg

SEQ ID NO: 943070 - RNA, 23 nt, Mycobacterium avium subsp. paratuberculosis
gugacggauguggucggccacga

SEQ ID NO: 943071 - RNA, 17 nt, Mycobacterium avium subsp. paratuberculosis
gugacgaugacgauggu

SEQ ID NO: 943072 - RNA, 18 nt, Mycobacterium avium subsp. paratuberculosis
gugacgaugaugucggcc

SEQ ID NO: 943073 - RNA, 21 nt, Mycobacterium avium subsp. paratuberculosis
gugacgaugaugucggccggc

SEQ ID NO: 943074 - RNA, 19 nt, Mycobacterium avium subsp. paratuberculosis
gugacgaccuggucgccgc

SEQ ID NO: 943075 - RNA, 22 nt, Mycobacterium avium subsp. paratuberculosis
gugacgaccuggucgccgccgu

SEQ ID NO: 943076 - RNA, 13 nt, Mycobacterium avium subsp. paratuberculosis
gugacgauccaca

SEQ ID NO: 943077 - RNA, 20 nt, Mycobacterium avium subsp. paratuberculosis
gugacgauccggucgaugaa

SEQ ID NO: 943078 - RNA, 12 nt, Mycobacterium avium subsp. paratuberculosis
gugacgcccggc

SEQ ID NO: 943079 - RNA, 16 nt, Mycobacterium avium subsp. paratuberculosis
gugacgcccggcgccg

SEQ ID NO: 943080 - RNA, 13 nt, Mycobacterium avium subsp. paratuberculosis
gugacgcccgucc

SEQ ID NO: 943081 - RNA, 20 nt, Mycobacterium avium subsp. paratuberculosis
gugacgcccgucccgccgac

SEQ ID NO: 943082 - RNA, 21 nt, Mycobacterium avium subsp. paratuberculosis
gugacgcccuuguccucgagc

SEQ ID NO: 943083 - RNA, 21 nt, Mycobacterium avium subsp. paratuberculosis
gugacgccgauccgcugcgga

SEQ ID NO: 943084 - RNA, 13 nt, Mycobacterium avium subsp. paratuberculosis
gugacgccgcacg

SEQ ID NO: 943085 - RNA, 19 nt, Mycobacterium avium subsp. paratuberculosis
gugacgccgcucggccagc

SEQ ID NO: 943086 - RNA, 18 nt, Mycobacterium avium subsp. paratuberculosis
gugaccgccuuggcgcgc

SEQ ID NO: 943087 - RNA, 17 nt, Mycobacterium avium subsp. paratuberculosis
gugaccggaucggccag

SEQ ID NO: 943088 - RNA, 18 nt, Mycobacterium avium subsp. paratuberculosis
gugaccggaucggccagc

SEQ ID NO: 943089 - RNA, 23 nt, Mycobacterium avium subsp. paratuberculosis
gugaccggccugagacgacgcca

SEQ ID NO: 943090 - RNA, 12 nt, Mycobacterium avium subsp. paratuberculosis
gugaccggcgag

SEQ ID NO: 943091 - RNA, 14 nt, Mycobacterium avium subsp. paratuberculosis
gugaccggcgaggu

SEQ ID NO: 943092 - RNA, 15 nt, Mycobacterium avium subsp. paratuberculosis
gugaccggcgccggg

SEQ ID NO: 943093 - RNA, 18 nt, Mycobacterium avium subsp. paratuberculosis
gugaccggcgccgggucg

SEQ ID NO: 943094 - RNA, 12 nt, Mycobacterium avium subsp. paratuberculosis
gugaccggcgcg

SEQ ID NO: 943095 - RNA, 19 nt, Mycobacterium avium subsp. paratuberculosis
gugaccggcgcgcccgagu

SEQ ID NO: 943096 - RNA, 16 nt, Mycobacterium avium subsp. paratuberculosis
gugaccggcggugucg

SEQ ID NO: 943097 - RNA, 21 nt, Mycobacterium avium subsp. paratuberculosis
gugaccggcggugucggugcc

SEQ ID NO: 943098 - RNA, 17 nt, Mycobacterium avium subsp. paratuberculosis
gugaccggcucgagcag

SEQ ID NO: 943099 - RNA, 17 nt, Mycobacterium avium subsp. paratuberculosis
gugaccggggucggcgc

SEQ ID NO: 943100 - RNA, 20 nt, Mycobacterium avium subsp. paratuberculosis
gugaccggggucggcgcccu

SEQ ID NO: 943101 - RNA, 23 nt, Mycobacterium avium subsp. paratuberculosis
gugaccggggucggcgcccucgg

SEQ ID NO: 943102 - RNA, 17 nt, Mycobacterium avium subsp. paratuberculosis
gugaccguacucguggg

SEQ ID NO: 943103 - RNA, 14 nt, Mycobacterium avium subsp. paratuberculosis
gugaccgucgccga

SEQ ID NO: 943104 - RNA, 16 nt, Mycobacterium avium subsp. paratuberculosis
gugaccgucgccgacc

SEQ ID NO: 943105 - RNA, 20 nt, Mycobacterium avium subsp. paratuberculosis
gugaccgucacccccggcgc

SEQ ID NO: 943106 - RNA, 13 nt, Mycobacterium avium subsp. paratuberculosis
gugacgaccggca

SEQ ID NO: 943107 - RNA, 15 nt, Mycobacterium avium subsp. paratuberculosis
gugacgaccggcagc

SEQ ID NO: 943108 - RNA, 18 nt, Mycobacterium avium subsp. paratuberculosis
gugacgaacaucgacgac

SEQ ID NO: 943109 - RNA, 19 nt, Mycobacterium avium subsp. paratuberculosis
gugacgaacccgccgcggc

SEQ ID NO: 943110 - RNA, 18 nt, Mycobacterium avium subsp. paratuberculosis
gugacgaacucaagggcg

SEQ ID NO: 943111 - RNA, 22 nt, Mycobacterium avium subsp. paratuberculosis
gugaccucgucgggcgccagcc

SEQ ID NO: 943112 - RNA, 16 nt, Mycobacterium avium subsp. paratuberculosis
gugaccugcagcgccu

SEQ ID NO: 943113 - RNA, 19 nt, Mycobacterium avium subsp. paratuberculosis
gugaccucgaagauggucg

SEQ ID NO: 943114 - RNA, 15 nt, Mycobacterium avium subsp. paratuberculosis
gugaccucgacggug

SEQ ID NO: 943115 - RNA, 16 nt, Mycobacterium avium subsp. paratuberculosis
gugaccucgagcaccg

SEQ ID NO: 943116 - RNA, 19 nt, Mycobacterium avium subsp. paratuberculosis
gugaccucgagcaccggcg

SEQ ID NO: 943117 - RNA, 18 nt, Mycobacterium avium subsp. paratuberculosis
gugaccucgagcagcgcg

SEQ ID NO: 943118 - RNA, 23 nt, Mycobacterium avium subsp. paratuberculosis
gugaccucgagcagcgcgcgcuu

SEQ ID NO: 943119 - RNA, 19 nt, Mycobacterium avium subsp. paratuberculosis
gucuuugccaucccggugg

SEQ ID NO: 943120 - RNA, 12 nt, Mycobacterium avium subsp. paratuberculosis
gucuugcggccg

SEQ ID NO: 943121 - RNA, 22 nt, Mycobacterium avium subsp. paratuberculosis
gucuugucggggaagggcgcgu

SEQ ID NO: 943122 - RNA, 12 nt, Mycobacterium avium subsp. paratuberculosis
gugaaaccggcg

SEQ ID NO: 943123 - RNA, 22 nt, Mycobacterium avium subsp. paratuberculosis
gugaaacacaaacucgcccaau

SEQ ID NO: 943124 - RNA, 16 nt, Mycobacterium avium subsp. paratuberculosis
gucuugaccgcccggg

SEQ ID NO: 943125 - RNA, 19 nt, Mycobacterium avium subsp. paratuberculosis
gucuucuuggcgggcgacu

SEQ ID NO: 943126 - RNA, 20 nt, Mycobacterium avium subsp. paratuberculosis
gucuugccggcuuccucgcg

SEQ ID NO: 943127 - RNA, 16 nt, Mycobacterium avium subsp. paratuberculosis
gucuugaucucggcgg

SEQ ID NO: 943128 - RNA, 15 nt, Mycobacterium avium subsp. paratuberculosis
gucuuggacgcccgc

SEQ ID NO: 943129 - RNA, 13 nt, Mycobacterium avium subsp. paratuberculosis
gucuugggcgcga

SEQ ID NO: 943130 - RNA, 14 nt, Mycobacterium avium subsp. paratuberculosis
gucuugggcucggc

SEQ ID NO: 943131 - RNA, 19 nt, Mycobacterium avium subsp. paratuberculosis
gucuucggugucgcacagc

SEQ ID NO: 943132 - RNA, 14 nt, Mycobacterium avium subsp. paratuberculosis
gucuucggccaucg

SEQ ID NO: 943133 - RNA, 15 nt, Mycobacterium avium subsp. paratuberculosis
gucuucggggccgcc

SEQ ID NO: 943134 - RNA, 16 nt, Mycobacterium avium subsp. paratuberculosis
gucuucggggccgccg

SEQ ID NO: 943135 - RNA, 20 nt, Mycobacterium avium subsp. paratuberculosis
gucuucggggccgccgucgg

SEQ ID NO: 943136 - RNA, 22 nt, Mycobacterium avium subsp. paratuberculosis
gucuucggugaagucaacgcac

SEQ ID NO: 943137 - RNA, 21 nt, Mycobacterium avium subsp. paratuberculosis
gucuuaucuaucuucggcggg

SEQ ID NO: 943138 - RNA, 19 nt, Mycobacterium avium subsp. paratuberculosis
gucuuacggauaucccgcg

SEQ ID NO: 943139 - RNA, 15 nt, Mycobacterium avium subsp. paratuberculosis
gucuucccgccgccg

SEQ ID NO: 943140 - RNA, 16 nt, Mycobacterium avium subsp. paratuberculosis
gucugcgccucgauca

SEQ ID NO: 943141 - RNA, 14 nt, Mycobacterium avium subsp. paratuberculosis
gucugcgccggcgg

SEQ ID NO: 943142 - RNA, 21 nt, Mycobacterium avium subsp. paratuberculosis
gucugcgccggcggugucgag

SEQ ID NO: 943143 - RNA, 13 nt, Mycobacterium avium subsp. paratuberculosis
gucugcggccggg

SEQ ID NO: 943144 - RNA, 16 nt, Mycobacterium avium subsp. paratuberculosis
gucugcggcucggcgc

SEQ ID NO: 943145 - RNA, 22 nt, Mycobacterium avium subsp. paratuberculosis
gucugcgggaagcccaccgcgg

SEQ ID NO: 943146 - RNA, 13 nt, Mycobacterium avium subsp. paratuberculosis
gucugccuggcga

SEQ ID NO: 943147 - RNA, 23 nt, Mycobacterium avium subsp. paratuberculosis
gucugccuugcugacgccgcggu

SEQ ID NO: 943148 - RNA, 22 nt, Mycobacterium avium subsp. paratuberculosis
gucugcgccagcugggugguca

SEQ ID NO: 943149 - RNA, 15 nt, Mycobacterium avium subsp. paratuberculosis
gucugcgccccggcg

SEQ ID NO: 943150 - RNA, 17 nt, Mycobacterium avium subsp. paratuberculosis
gucugcgccccggcguc

SEQ ID NO: 943151 - RNA, 12 nt, Mycobacterium avium subsp. paratuberculosis
gucugcgcccga

SEQ ID NO: 943152 - RNA, 14 nt, Mycobacterium avium subsp. paratuberculosis
gucugcggugcgcc

SEQ ID NO: 943153 - RNA, 16 nt, Mycobacterium avium subsp. paratuberculosis
gucugcggugcgccca

SEQ ID NO: 943154 - RNA, 19 nt, Mycobacterium avium subsp. paratuberculosis
gucugcucccaggacggcg

SEQ ID NO: 943155 - RNA, 13 nt, Mycobacterium avium subsp. paratuberculosis
gucugcucgccgg

SEQ ID NO: 943156 - RNA, 16 nt, Mycobacterium avium subsp. paratuberculosis
gucugcucgccgucac

SEQ ID NO: 943157 - RNA, 12 nt, Mycobacterium avium subsp. paratuberculosis
gucugcucgcgc

SEQ ID NO: 943158 - RNA, 14 nt, Mycobacterium avium subsp. paratuberculosis
gucugcucggcggg

SEQ ID NO: 943159 - RNA, 15 nt, Mycobacterium avium subsp. paratuberculosis
gucugcuggcccggu

SEQ ID NO: 943160 - RNA, 21 nt, Mycobacterium avium subsp. paratuberculosis
gucugcugggcguugccgguc

SEQ ID NO: 943161 - RNA, 15 nt, Mycobacterium avium subsp. paratuberculosis
gucuggccaccgaag

SEQ ID NO: 943162 - RNA, 19 nt, Mycobacterium avium subsp. paratuberculosis
gucuggccaccgaagccga

SEQ ID NO: 943163 - RNA, 13 nt, Mycobacterium avium subsp. paratuberculosis
gucuggccccguc

SEQ ID NO: 943164 - RNA, 13 nt, Mycobacterium avium subsp. paratuberculosis
gucuggcagccgg

SEQ ID NO: 943165 - RNA, 16 nt, Mycobacterium avium subsp. paratuberculosis
gucuggcagccggccg

SEQ ID NO: 943166 - RNA, 18 nt, Mycobacterium avium subsp. paratuberculosis
gucuggcagccggccggc

SEQ ID NO: 943167 - RNA, 22 nt, Mycobacterium avium subsp. paratuberculosis
gucuggcagccggccggcaggu

SEQ ID NO: 943168 - RNA, 18 nt, Mycobacterium avium subsp. paratuberculosis
gucuggaugaucgucucg

SEQ ID NO: 943169 - RNA, 16 nt, Mycobacterium avium subsp. paratuberculosis
gucugguccaccgggc

SEQ ID NO: 943170 - RNA, 15 nt, Mycobacterium avium subsp. paratuberculosis
gucugugaccacggu

SEQ ID NO: 943171 - RNA, 22 nt, Mycobacterium avium subsp. paratuberculosis
gucguuuuccagccggcgcacc

SEQ ID NO: 943172 - RNA, 23 nt, Mycobacterium avium subsp. paratuberculosis
gucguuuuccagccggcgcacca

SEQ ID NO: 943173 - RNA, 20 nt, Mycobacterium avium subsp. paratuberculosis
gucguuggcgccguccgcgg

SEQ ID NO: 943174 - RNA, 17 nt, Mycobacterium avium subsp. paratuberculosis
gucguuggcggcggugg

SEQ ID NO: 943175 - RNA, 18 nt, Mycobacterium avium subsp. paratuberculosis
gucguuggcggcgguggg

SEQ ID NO: 943176 - RNA, 12 nt, Mycobacterium avium subsp. paratuberculosis
gucguuggugaa

SEQ ID NO: 943177 - RNA, 19 nt, Mycobacterium avium subsp. paratuberculosis
gucguuggugcgcaccagc

SEQ ID NO: 943178 - RNA, 20 nt, Mycobacterium avium subsp. paratuberculosis
gucguuggugcgcaccagca

SEQ ID NO: 943179 - RNA, 18 nt, Mycobacterium avium subsp. paratuberculosis
gucguugugggccagcgc

SEQ ID NO: 943180 - RNA, 17 nt, Mycobacterium avium subsp. paratuberculosis
gucucagucggccaccg

SEQ ID NO: 943181 - RNA, 21 nt, Mycobacterium avium subsp. paratuberculosis
gucucagucggccaccgcgau

SEQ ID NO: 943182 - RNA, 15 nt, Mycobacterium avium subsp. paratuberculosis
gucucaucccgccga

SEQ ID NO: 943183 - RNA, 22 nt, Mycobacterium avium subsp. paratuberculosis
gucuagaucuccaggcucgaca

SEQ ID NO: 943184 - RNA, 22 nt, Mycobacterium avium subsp. paratuberculosis
gucguucucgggggcgggcacc

SEQ ID NO: 943185 - RNA, 13 nt, Mycobacterium avium subsp. paratuberculosis
gucuagcggcgug

SEQ ID NO: 943186 - RNA, 19 nt, Mycobacterium avium subsp. paratuberculosis
gucuccaugucgucggcgg

SEQ ID NO: 943187 - RNA, 20 nt, Mycobacterium avium subsp. paratuberculosis
gucucccacgaacggguccu

SEQ ID NO: 943188 - RNA, 18 nt, Mycobacterium avium subsp. paratuberculosis
gucucccagacgucgacc

SEQ ID NO: 943189 - RNA, 14 nt, Mycobacterium avium subsp. paratuberculosis
gucucccccgauca

SEQ ID NO: 943190 - RNA, 18 nt, Mycobacterium avium subsp. paratuberculosis
gucucccccgaucagcgu

SEQ ID NO: 943191 - RNA, 19 nt, Mycobacterium avium subsp. paratuberculosis
gucuccucgaccagcgcgc

SEQ ID NO: 943192 - RNA, 23 nt, Mycobacterium avium subsp. paratuberculosis
gucuccucgaccagcgcgccgcc

SEQ ID NO: 943193 - RNA, 14 nt, Mycobacterium avium subsp. paratuberculosis
gucuccucgaccgc

SEQ ID NO: 943194 - RNA, 15 nt, Mycobacterium avium subsp. paratuberculosis
gucuccgcgcagcca

SEQ ID NO: 943195 - RNA, 11 nt, Mycobacterium avium subsp. paratuberculosis
gucuccggccc

SEQ ID NO: 943196 - RNA, 15 nt, Mycobacterium avium subsp. paratuberculosis
gucucgacaccggcg

SEQ ID NO: 943197 - RNA, 17 nt, Mycobacterium avium subsp. paratuberculosis
gucucgacaccggcggu

SEQ ID NO: 943198 - RNA, 19 nt, Mycobacterium avium subsp. paratuberculosis
gucucgaccacccggcggg

SEQ ID NO: 943199 - RNA, 23 nt, Mycobacterium avium subsp. paratuberculosis
gucucgaccacccggcgggccag

SEQ ID NO: 943200 - RNA, 16 nt, Mycobacterium avium subsp. paratuberculosis
gucucgaccgcggcgc

SEQ ID NO: 943201 - RNA, 17 nt, Mycobacterium avium subsp. paratuberculosis
gucucgaccgcggcgcc

SEQ ID NO: 943202 - RNA, 19 nt, Mycobacterium avium subsp. paratuberculosis
gucucgaccgcggcgccga

SEQ ID NO: 943203 - RNA, 14 nt, Mycobacterium avium subsp. paratuberculosis
gucucgaccgcggu

SEQ ID NO: 943204 - RNA, 13 nt, Mycobacterium avium subsp. paratuberculosis
gucuccuggccgc

SEQ ID NO: 943205 - RNA, 17 nt, Mycobacterium avium subsp. paratuberculosis
gucuccuggccgccgug

SEQ ID NO: 943206 - RNA, 18 nt, Mycobacterium avium subsp. paratuberculosis
gucucgaacacgccgucg

SEQ ID NO: 943207 - RNA, 16 nt, Mycobacterium avium subsp. paratuberculosis
gucucgaaccgggcgg

SEQ ID NO: 943208 - RNA, 19 nt, Mycobacterium avium subsp. paratuberculosis
gucucgaaccgggcgguga

SEQ ID NO: 943209 - RNA, 17 nt, Mycobacterium avium subsp. paratuberculosis
gucucgacggcgccgac

SEQ ID NO: 943210 - RNA, 15 nt, Mycobacterium avium subsp. paratuberculosis
gucucgagccggcgc

SEQ ID NO: 943211 - RNA, 17 nt, Mycobacterium avium subsp. paratuberculosis
gucucgagccggcgcac

SEQ ID NO: 943212 - RNA, 19 nt, Mycobacterium avium subsp. paratuberculosis
gucucgagccggcgcacuc

SEQ ID NO: 943213 - RNA, 15 nt, Mycobacterium avium subsp. paratuberculosis
gucucgaucgacgac

SEQ ID NO: 943214 - RNA, 16 nt, Mycobacterium avium subsp. paratuberculosis
gucugccagaacggcg

SEQ ID NO: 943215 - RNA, 18 nt, Mycobacterium avium subsp. paratuberculosis
gucugccagaacggcggc

SEQ ID NO: 943216 - RNA, 22 nt, Mycobacterium avium subsp. paratuberculosis
gucugccagaacggcggcagcg

SEQ ID NO: 943217 - RNA, 16 nt, Mycobacterium avium subsp. paratuberculosis
gucugcaggucguagu

SEQ ID NO: 943218 - RNA, 21 nt, Mycobacterium avium subsp. paratuberculosis
gucugcauccggaaccgggca

SEQ ID NO: 943219 - RNA, 17 nt, Mycobacterium avium subsp. paratuberculosis
gucugcacgaugccgac

SEQ ID NO: 943220 - RNA, 17 nt, Mycobacterium avium subsp. paratuberculosis
gucugccacgcccaccg

SEQ ID NO: 943221 - RNA, 22 nt, Mycobacterium avium subsp. paratuberculosis
gucugccacgcccaccgguggc

SEQ ID NO: 943222 - RNA, 13 nt, Mycobacterium avium subsp. paratuberculosis
gucugaccccccg

SEQ ID NO: 943223 - RNA, 17 nt, Mycobacterium avium subsp. paratuberculosis
gucugaccucgcgccgc

SEQ ID NO: 943224 - RNA, 18 nt, Mycobacterium avium subsp. paratuberculosis
gucugaccccccgacgcc

SEQ ID NO: 943225 - RNA, 21 nt, Mycobacterium avium subsp. paratuberculosis
gucugaccccccgacgccgac

SEQ ID NO: 943226 - RNA, 15 nt, Mycobacterium avium subsp. paratuberculosis
gucugaucgcccagc

SEQ ID NO: 943227 - RNA, 16 nt, Mycobacterium avium subsp. paratuberculosis
gucugaucgcccagca

SEQ ID NO: 943228 - RNA, 18 nt, Mycobacterium avium subsp. paratuberculosis
gucugaucgcccagcacc

SEQ ID NO: 943229 - RNA, 15 nt, Mycobacterium avium subsp. paratuberculosis
gucucguugugcacc

SEQ ID NO: 943230 - RNA, 20 nt, Mycobacterium avium subsp. paratuberculosis
gucucguugugcaccggcac

SEQ ID NO: 943231 - RNA, 18 nt, Mycobacterium avium subsp. paratuberculosis
gucucuucgacccgguag

SEQ ID NO: 943232 - RNA, 16 nt, Mycobacterium avium subsp. paratuberculosis
gucucgucggccgcga

SEQ ID NO: 943233 - RNA, 17 nt, Mycobacterium avium subsp. paratuberculosis
gucucgucggccgcgac

SEQ ID NO: 943234 - RNA, 20 nt, Mycobacterium avium subsp. paratuberculosis
gucucggugucggacuuguc

SEQ ID NO: 943235 - RNA, 15 nt, Mycobacterium avium subsp. paratuberculosis
gucucggccagccgg

SEQ ID NO: 943236 - RNA, 17 nt, Mycobacterium avium subsp. paratuberculosis
gucucgguggagaacca

SEQ ID NO: 943237 - RNA, 15 nt, Mycobacterium avium subsp. paratuberculosis
gucucgggaucgccg

SEQ ID NO: 943238 - RNA, 20 nt, Mycobacterium avium subsp. paratuberculosis
gucucgggcaccacgccgac

SEQ ID NO: 943239 - RNA, 16 nt, Mycobacterium avium subsp. paratuberculosis
gucucgggcagcagca

SEQ ID NO: 943240 - RNA, 12 nt, Mycobacterium avium subsp. paratuberculosis
gucucgcgcagc

SEQ ID NO: 943241 - RNA, 14 nt, Mycobacterium avium subsp. paratuberculosis
gucucgcgcagcac

SEQ ID NO: 943242 - RNA, 16 nt, Mycobacterium avium subsp. paratuberculosis
gucucgccccggccgu

SEQ ID NO: 943243 - RNA, 15 nt, Mycobacterium avium subsp. paratuberculosis
gucucgcaccugccg

SEQ ID NO: 943244 - RNA, 16 nt, Mycobacterium avium subsp. paratuberculosis
gucucgcaccugccgu

SEQ ID NO: 943245 - RNA, 19 nt, Mycobacterium avium subsp. paratuberculosis
gucucgcaccugccgucga

SEQ ID NO: 943246 - RNA, 20 nt, Mycobacterium avium subsp. paratuberculosis
gucucgaugcacggucggcc

SEQ ID NO: 943247 - RNA, 23 nt, Mycobacterium avium subsp. paratuberculosis
gucucgaugcacggucggccccg

SEQ ID NO: 943248 - RNA, 18 nt, Mycobacterium avium subsp. paratuberculosis
gucucgcgggaguggccg

SEQ ID NO: 943249 - RNA, 13 nt, Mycobacterium avium subsp. paratuberculosis
gucucgccgaucu

SEQ ID NO: 943250 - RNA, 14 nt, Mycobacterium avium subsp. paratuberculosis
gucucggcggccga

SEQ ID NO: 943251 - RNA, 21 nt, Mycobacterium avium subsp. paratuberculosis
gucucggcggccgagcgcacc

SEQ ID NO: 943252 - RNA, 23 nt, Mycobacterium avium subsp. paratuberculosis
gucucggcggccgagcgcaccgc

SEQ ID NO: 943253 - RNA, 14 nt, Mycobacterium avium subsp. paratuberculosis
gucucggcggcgcc

SEQ ID NO: 943254 - RNA, 12 nt, Mycobacterium avium subsp. paratuberculosis
gucucggcgucu

SEQ ID NO: 943255 - RNA, 20 nt, Mycobacterium avium subsp. paratuberculosis
gucucggcgucucggcccga

SEQ ID NO: 943256 - RNA, 18 nt, Mycobacterium avium subsp. paratuberculosis
gucucggcgucucggcgu

SEQ ID NO: 943257 - RNA, 22 nt, Mycobacterium avium subsp. paratuberculosis
gucucggcgugcucggccacga

SEQ ID NO: 943258 - RNA, 20 nt, Mycobacterium avium subsp. paratuberculosis
ggcuuaccgaccucgaggcc

SEQ ID NO: 943259 - RNA, 21 nt, Mycobacterium avium subsp. paratuberculosis
ggcuuaccggcgggcggcggc

SEQ ID NO: 943260 - RNA, 12 nt, Mycobacterium avium subsp. paratuberculosis
ggcugucggcgc

SEQ ID NO: 943261 - RNA, 14 nt, Mycobacterium avium subsp. paratuberculosis
ggcugugccggcgg

SEQ ID NO: 943262 - RNA, 18 nt, Mycobacterium avium subsp. paratuberculosis
ggcugucguagcggccca

SEQ ID NO: 943263 - RNA, 19 nt, Mycobacterium avium subsp. paratuberculosis
ggcugugaucgcugacgcc

SEQ ID NO: 943264 - RNA, 12 nt, Mycobacterium avium subsp. paratuberculosis
ggcugucgcgcu

SEQ ID NO: 943265 - RNA, 17 nt, Mycobacterium avium subsp. paratuberculosis
ggcugucccggccgcga

SEQ ID NO: 943266 - RNA, 15 nt, Mycobacterium avium subsp. paratuberculosis
ggcuguccucccagc

SEQ ID NO: 943267 - RNA, 18 nt, Mycobacterium avium subsp. paratuberculosis
ggcuguccucccagcgcc

SEQ ID NO: 943268 - RNA, 22 nt, Mycobacterium avium subsp. paratuberculosis
ggcugucgacaggaucgacaac

SEQ ID NO: 943269 - RNA, 16 nt, Mycobacterium avium subsp. paratuberculosis
ggcuguagcacccggc

SEQ ID NO: 943270 - RNA, 13 nt, Mycobacterium avium subsp. paratuberculosis
ggcuggucggcgg

SEQ ID NO: 943271 - RNA, 15 nt, Mycobacterium avium subsp. paratuberculosis
ggcuggugcagcagc

SEQ ID NO: 943272 - RNA, 22 nt, Mycobacterium avium subsp. paratuberculosis
ggcuggguccgauuucccgacu

SEQ ID NO: 943273 - RNA, 14 nt, Mycobacterium avium subsp. paratuberculosis
ggcuggucacccac

SEQ ID NO: 943274 - RNA, 17 nt, Mycobacterium avium subsp. paratuberculosis
ggcuggcaggucgcgcc

SEQ ID NO: 943275 - RNA, 14 nt, Mycobacterium avium subsp. paratuberculosis
ggcuggaaguucgc

SEQ ID NO: 943276 - RNA, 13 nt, Mycobacterium avium subsp. paratuberculosis
ggcuggaaucccg

SEQ ID NO: 943277 - RNA, 16 nt, Mycobacterium avium subsp. paratuberculosis
ggcuggaaucccgccu

SEQ ID NO: 943278 - RNA, 19 nt, Mycobacterium avium subsp. paratuberculosis
ggcuggaaucccgccucgg

SEQ ID NO: 943279 - RNA, 23 nt, Mycobacterium avium subsp. paratuberculosis
ggcuggaaucccgccucggcgga

SEQ ID NO: 943280 - RNA, 15 nt, Mycobacterium avium subsp. paratuberculosis
ggcuggacaccacgu

SEQ ID NO: 943281 - RNA, 16 nt, Mycobacterium avium subsp. paratuberculosis
ggcuggacacccccga

SEQ ID NO: 943282 - RNA, 19 nt, Mycobacterium avium subsp. paratuberculosis
ggcugggucggucccgaca

SEQ ID NO: 943283 - RNA, 14 nt, Mycobacterium avium subsp. paratuberculosis
ggcuggguggacac

SEQ ID NO: 943284 - RNA, 15 nt, Mycobacterium avium subsp. paratuberculosis
ggcuggguggcgaaa

SEQ ID NO: 943285 - RNA, 17 nt, Mycobacterium avium subsp. paratuberculosis
ggcuggguugcucgccg

SEQ ID NO: 943286 - RNA, 13 nt, Mycobacterium avium subsp. paratuberculosis
ggcuggcgggugg

SEQ ID NO: 943287 - RNA, 16 nt, Mycobacterium avium subsp. paratuberculosis
ggcuggcgugcggcgc

SEQ ID NO: 943288 - RNA, 18 nt, Mycobacterium avium subsp. paratuberculosis
ggcuggcguaggacagca

SEQ ID NO: 943289 - RNA, 22 nt, Mycobacterium avium subsp. paratuberculosis
ggcuggcguaggacagcagccg

SEQ ID NO: 943290 - RNA, 18 nt, Mycobacterium avium subsp. paratuberculosis
ggcuggcgggcgaucgcc

SEQ ID NO: 943291 - RNA, 21 nt, Mycobacterium avium subsp. paratuberculosis
ggcuggcgcaggugugcggca

SEQ ID NO: 943292 - RNA, 14 nt, Mycobacterium avium subsp. paratuberculosis
ggcuggcggcaacg

SEQ ID NO: 943293 - RNA, 18 nt, Mycobacterium avium subsp. paratuberculosis
ggcuggcggcaacggcca

SEQ ID NO: 943294 - RNA, 13 nt, Mycobacterium avium subsp. paratuberculosis
ggcuggcccggcg

SEQ ID NO: 943295 - RNA, 20 nt, Mycobacterium avium subsp. paratuberculosis
ggcuuuugcgucugcucgcg

SEQ ID NO: 943296 - RNA, 13 nt, Mycobacterium avium subsp. paratuberculosis
gggaacgcggcga

SEQ ID NO: 943297 - RNA, 13 nt, Mycobacterium avium subsp. paratuberculosis
gggaacggucagc

SEQ ID NO: 943298 - RNA, 20 nt, Mycobacterium avium subsp. paratuberculosis
gggaacgccgaucaccggca

SEQ ID NO: 943299 - RNA, 22 nt, Mycobacterium avium subsp. paratuberculosis
gggaacagcgggaacaccacgu

SEQ ID NO: 943300 - RNA, 16 nt, Mycobacterium avium subsp. paratuberculosis
gggaaaggcagcagcc

SEQ ID NO: 943301 - RNA, 18 nt, Mycobacterium avium subsp. paratuberculosis
gggaaaugcgucgccagu

SEQ ID NO: 943302 - RNA, 13 nt, Mycobacterium avium subsp. paratuberculosis
gggaacaacgcgc

SEQ ID NO: 943303 - RNA, 14 nt, Mycobacterium avium subsp. paratuberculosis
gggaacaccacguc

SEQ ID NO: 943304 - RNA, 13 nt, Mycobacterium avium subsp. paratuberculosis
gggaacaccggcg

SEQ ID NO: 943305 - RNA, 18 nt, Mycobacterium avium subsp. paratuberculosis
ggcuuuagaaggccgccu

SEQ ID NO: 943306 - RNA, 16 nt, Mycobacterium avium subsp. paratuberculosis
ggcuuggguguggcgu

SEQ ID NO: 943307 - RNA, 14 nt, Mycobacterium avium subsp. paratuberculosis
ggcuuucggcgcca

SEQ ID NO: 943308 - RNA, 13 nt, Mycobacterium avium subsp. paratuberculosis
ggcuuuggucgcc

SEQ ID NO: 943309 - RNA, 19 nt, Mycobacterium avium subsp. paratuberculosis
ggcuuuggugacgccgacg

SEQ ID NO: 943310 - RNA, 16 nt, Mycobacterium avium subsp. paratuberculosis
ggcuugcugcgguagg

SEQ ID NO: 943311 - RNA, 14 nt, Mycobacterium avium subsp. paratuberculosis
ggcuugcgcaacag

SEQ ID NO: 943312 - RNA, 22 nt, Mycobacterium avium subsp. paratuberculosis
ggcuugcgcagguugucggcca

SEQ ID NO: 943313 - RNA, 15 nt, Mycobacterium avium subsp. paratuberculosis
ggcuugccgaucgcc

SEQ ID NO: 943314 - RNA, 19 nt, Mycobacterium avium subsp. paratuberculosis
ggcuugaugaacgcguuga

SEQ ID NO: 943315 - RNA, 16 nt, Mycobacterium avium subsp. paratuberculosis
ggcuugagcgccagcg

SEQ ID NO: 943316 - RNA, 22 nt, Mycobacterium avium subsp. paratuberculosis
ggcuugagcgccagcgcggugc

SEQ ID NO: 943317 - RNA, 22 nt, Mycobacterium avium subsp. paratuberculosis
ggcuucccacgccuugcgguug

SEQ ID NO: 943318 - RNA, 21 nt, Mycobacterium avium subsp. paratuberculosis
ggcuuccccaaccuggacggu

SEQ ID NO: 943319 - RNA, 23 nt, Mycobacterium avium subsp. paratuberculosis
ggcuuccgccgagacggcguggc

SEQ ID NO: 943320 - RNA, 19 nt, Mycobacterium avium subsp. paratuberculosis
ggcuucgaacgcccgcacc

SEQ ID NO: 943321 - RNA, 23 nt, Mycobacterium avium subsp. paratuberculosis
ggcuucgaacgcccgcaccacga

SEQ ID NO: 943322 - RNA, 23 nt, Mycobacterium avium subsp. paratuberculosis
ggcuucguaacacccucggucgg

SEQ ID NO: 943323 - RNA, 20 nt, Mycobacterium avium subsp. paratuberculosis
ggcuucgggaucagcgggac

SEQ ID NO: 943324 - RNA, 22 nt, Mycobacterium avium subsp. paratuberculosis
ggcugcccugggaggaagugca

SEQ ID NO: 943325 - RNA, 14 nt, Mycobacterium avium subsp. paratuberculosis
ggcugccgaccucg

SEQ ID NO: 943326 - RNA, 18 nt, Mycobacterium avium subsp. paratuberculosis
ggcugccgaccucgaugg

SEQ ID NO: 943327 - RNA, 20 nt, Mycobacterium avium subsp. paratuberculosis
ggcugccgaccucgauggcg

SEQ ID NO: 943328 - RNA, 22 nt, Mycobacterium avium subsp. paratuberculosis
ggcugcccucuuccucgcuguc

SEQ ID NO: 943329 - RNA, 18 nt, Mycobacterium avium subsp. paratuberculosis
ggcugcgcacguagccca

SEQ ID NO: 943330 - RNA, 19 nt, Mycobacterium avium subsp. paratuberculosis
ggcugccgcugcgccggcg

SEQ ID NO: 943331 - RNA, 13 nt, Mycobacterium avium subsp. paratuberculosis
ggcugcggccccg

SEQ ID NO: 943332 - RNA, 15 nt, Mycobacterium avium subsp. paratuberculosis
ggcugcgggugggga

SEQ ID NO: 943333 - RNA, 19 nt, Mycobacterium avium subsp. paratuberculosis
ggcugcgguuggccggccg

SEQ ID NO: 943334 - RNA, 23 nt, Mycobacterium avium subsp. paratuberculosis
ggcugcgguuggccggccgggcg

SEQ ID NO: 943335 - RNA, 21 nt, Mycobacterium avium subsp. paratuberculosis
ggcugcugcacgucgccggcg

SEQ ID NO: 943336 - RNA, 22 nt, Mycobacterium avium subsp. paratuberculosis
ggcugcugcagcgcccgggcca

SEQ ID NO: 943337 - RNA, 22 nt, Mycobacterium avium subsp. paratuberculosis
ggcugcugcacgacgaccgcga

SEQ ID NO: 943338 - RNA, 23 nt, Mycobacterium avium subsp. paratuberculosis
ggcugcugcacgacgaccgcgac

SEQ ID NO: 943339 - RNA, 11 nt, Mycobacterium avium subsp. paratuberculosis
ggcugcucgaa

SEQ ID NO: 943340 - RNA, 19 nt, Mycobacterium avium subsp. paratuberculosis
ggcugcgcgucgagcagca

SEQ ID NO: 943341 - RNA, 18 nt, Mycobacterium avium subsp. paratuberculosis
ggcugcgcuugcggcgca

SEQ ID NO: 943342 - RNA, 17 nt, Mycobacterium avium subsp. paratuberculosis
ggcugcgcguucggcgc

SEQ ID NO: 943343 - RNA, 18 nt, Mycobacterium avium subsp. paratuberculosis
ggcugcgcguucggcgcc

SEQ ID NO: 943344 - RNA, 19 nt, Mycobacterium avium subsp. paratuberculosis
ggcugcgcguucggcgcca

SEQ ID NO: 943345 - RNA, 17 nt, Mycobacterium avium subsp. paratuberculosis
ggcugagcagcucgcgg

SEQ ID NO: 943346 - RNA, 14 nt, Mycobacterium avium subsp. paratuberculosis
ggcugagcgucggu

SEQ ID NO: 943347 - RNA, 17 nt, Mycobacterium avium subsp. paratuberculosis
ggcugagcugugccgcg

SEQ ID NO: 943348 - RNA, 13 nt, Mycobacterium avium subsp. paratuberculosis
ggcugacugccgg

SEQ ID NO: 943349 - RNA, 21 nt, Mycobacterium avium subsp. paratuberculosis
ggcugagcaccggggucugca

SEQ ID NO: 943350 - RNA, 17 nt, Mycobacterium avium subsp. paratuberculosis
ggcugauccgcgacgcc

SEQ ID NO: 943351 - RNA, 18 nt, Mycobacterium avium subsp. paratuberculosis
ggcugauccgcgacgcca

SEQ ID NO: 943352 - RNA, 16 nt, Mycobacterium avium subsp. paratuberculosis
ggcugaucucggcggu

SEQ ID NO: 943353 - RNA, 17 nt, Mycobacterium avium subsp. paratuberculosis
ggcugaucucggcgguc

SEQ ID NO: 943354 - RNA, 15 nt, Mycobacterium avium subsp. paratuberculosis
ggcugaucagccggc

SEQ ID NO: 943355 - RNA, 16 nt, Mycobacterium avium subsp. paratuberculosis
ggcugaucagccggcg

SEQ ID NO: 943356 - RNA, 20 nt, Mycobacterium avium subsp. paratuberculosis
ggcugaucagccggcgagcg

SEQ ID NO: 943357 - RNA, 17 nt, Mycobacterium avium subsp. paratuberculosis
ggcugauguucaguucg

SEQ ID NO: 943358 - RNA, 22 nt, Mycobacterium avium subsp. paratuberculosis
ggcugauguucaguucguccag

SEQ ID NO: 943359 - RNA, 16 nt, Mycobacterium avium subsp. paratuberculosis
ggcugcccggcaaccg

SEQ ID NO: 943360 - RNA, 17 nt, Mycobacterium avium subsp. paratuberculosis
ggcugcccggcccgccg

SEQ ID NO: 943361 - RNA, 20 nt, Mycobacterium avium subsp. paratuberculosis
ggcugcccggcccgccgcug

SEQ ID NO: 943362 - RNA, 22 nt, Mycobacterium avium subsp. paratuberculosis
ggcugcccaggaucaccgggac

SEQ ID NO: 943363 - RNA, 19 nt, Mycobacterium avium subsp. paratuberculosis
ggcugcccgacccgcacca

SEQ ID NO: 943364 - RNA, 23 nt, Mycobacterium avium subsp. paratuberculosis
ggcugcccgacccgcaccaccgc

SEQ ID NO: 943365 - RNA, 13 nt, Mycobacterium avium subsp. paratuberculosis
ggcugcagccggg

SEQ ID NO: 943366 - RNA, 18 nt, Mycobacterium avium subsp. paratuberculosis
ggcugcaucuccagccgc

SEQ ID NO: 943367 - RNA, 21 nt, Mycobacterium avium subsp. paratuberculosis
ggcugcaucuccagccgcggc

SEQ ID NO: 943368 - RNA, 16 nt, Mycobacterium avium subsp. paratuberculosis
ggcugcacgcugcgca

SEQ ID NO: 943369 - RNA, 19 nt, Mycobacterium avium subsp. paratuberculosis
ggcugcaccagggcgucga

SEQ ID NO: 943370 - RNA, 22 nt, Mycobacterium avium subsp. paratuberculosis
ggcugcacccucugccacggcg

SEQ ID NO: 943371 - RNA, 23 nt, Mycobacterium avium subsp. paratuberculosis
ggcugcacccucugccacggcgg

SEQ ID NO: 943372 - RNA, 17 nt, Mycobacterium avium subsp. paratuberculosis
ggcucgaucgcggucac

SEQ ID NO: 943373 - RNA, 22 nt, Mycobacterium avium subsp. paratuberculosis
ggcucgaguuuggccagcucgg

SEQ ID NO: 943374 - RNA, 17 nt, Mycobacterium avium subsp. paratuberculosis
ggcucgagggcggcgac

SEQ ID NO: 943375 - RNA, 18 nt, Mycobacterium avium subsp. paratuberculosis
ggcucgagggcggcgacc

SEQ ID NO: 943376 - RNA, 20 nt, Mycobacterium avium subsp. paratuberculosis
ggcucgagggcggcgaccug

SEQ ID NO: 943377 - RNA, 19 nt, Mycobacterium avium subsp. paratuberculosis
ggcucgaccacgccguaca

SEQ ID NO: 943378 - RNA, 18 nt, Mycobacterium avium subsp. paratuberculosis
ggcucgccguugcggguc

SEQ ID NO: 943379 - RNA, 23 nt, Mycobacterium avium subsp. paratuberculosis
ggcucgcgacgcggcucgcgcgg

SEQ ID NO: 943380 - RNA, 19 nt, Mycobacterium avium subsp. paratuberculosis
ggcucgcgagggcgggcca

SEQ ID NO: 943381 - RNA, 19 nt, Mycobacterium avium subsp. paratuberculosis
ggcucgauggacgccagca

SEQ ID NO: 943382 - RNA, 23 nt, Mycobacterium avium subsp. paratuberculosis
ggcucgcagaugauuucgaagcu

SEQ ID NO: 943383 - RNA, 22 nt, Mycobacterium avium subsp. paratuberculosis
ggcucgcccgcgacugucggcu

SEQ ID NO: 943384 - RNA, 23 nt, Mycobacterium avium subsp. paratuberculosis
ggcucgcccgggcuaucgcccgg

SEQ ID NO: 943385 - RNA, 14 nt, Mycobacterium avium subsp. paratuberculosis
ggcucggugccgcg

SEQ ID NO: 943386 - RNA, 17 nt, Mycobacterium avium subsp. paratuberculosis
ggcucggucaagccggc

SEQ ID NO: 943387 - RNA, 17 nt, Mycobacterium avium subsp. paratuberculosis
ggcucggucaccccgga

SEQ ID NO: 943388 - RNA, 13 nt, Mycobacterium avium subsp. paratuberculosis
ggcucggucgcga

SEQ ID NO: 943389 - RNA, 19 nt, Mycobacterium avium subsp. paratuberculosis
ggcucgggaacggucagcc

SEQ ID NO: 943390 - RNA, 14 nt, Mycobacterium avium subsp. paratuberculosis
ggcucgggcggugg

SEQ ID NO: 943391 - RNA, 18 nt, Mycobacterium avium subsp. paratuberculosis
ggcucgggcgguggcgcc

SEQ ID NO: 943392 - RNA, 17 nt, Mycobacterium avium subsp. paratuberculosis
ggcucggcagccggcug

SEQ ID NO: 943393 - RNA, 12 nt, Mycobacterium avium subsp. paratuberculosis
ggcucggcgccg

SEQ ID NO: 943394 - RNA, 17 nt, Mycobacterium avium subsp. paratuberculosis
ggcucggccaucccggu

SEQ ID NO: 943395 - RNA, 14 nt, Mycobacterium avium subsp. paratuberculosis
ggcucggcccgccg

SEQ ID NO: 943396 - RNA, 20 nt, Mycobacterium avium subsp. paratuberculosis
ggcucggcccgccgggcgcc

SEQ ID NO: 943397 - RNA, 13 nt, Mycobacterium avium subsp. paratuberculosis
ggcucggccgccg

SEQ ID NO: 943398 - RNA, 19 nt, Mycobacterium avium subsp. paratuberculosis
ggcucggccuucggggugg

SEQ ID NO: 943399 - RNA, 21 nt, Mycobacterium avium subsp. paratuberculosis
ggcucggcgacaacagcgccg

SEQ ID NO: 943400 - RNA, 22 nt, Mycobacterium avium subsp. paratuberculosis
ggcucgcugaucugcggcacca

SEQ ID NO: 943401 - RNA, 15 nt, Mycobacterium avium subsp. paratuberculosis
ggcucgcucccgcgc

SEQ ID NO: 943402 - RNA, 16 nt, Mycobacterium avium subsp. paratuberculosis
ggcucgcucccgcgcg

SEQ ID NO: 943403 - RNA, 21 nt, Mycobacterium avium subsp. paratuberculosis
ggcucgcgcacccguaacacg

SEQ ID NO: 943404 - RNA, 13 nt, Mycobacterium avium subsp. paratuberculosis
ggcucgcgcuggc

SEQ ID NO: 943405 - RNA, 21 nt, Mycobacterium avium subsp. paratuberculosis
ggcucgcgcuggcggccaucg

SEQ ID NO: 943406 - RNA, 19 nt, Mycobacterium avium subsp. paratuberculosis
ggcucgcggccugcgggcg

SEQ ID NO: 943407 - RNA, 21 nt, Mycobacterium avium subsp. paratuberculosis
ggcucgcggccugcgggcgcc

SEQ ID NO: 943408 - RNA, 22 nt, Mycobacterium avium subsp. paratuberculosis
ggcucgcgggcgaugcggcccg

SEQ ID NO: 943409 - RNA, 12 nt, Mycobacterium avium subsp. paratuberculosis
ggcucgcggggu

SEQ ID NO: 943410 - RNA, 22 nt, Mycobacterium avium subsp. paratuberculosis
ggcucgcguucgcuuucgcguu

SEQ ID NO: 943411 - RNA, 20 nt, Mycobacterium avium subsp. paratuberculosis
ggcugacgaucgucgacguc

SEQ ID NO: 943412 - RNA, 13 nt, Mycobacterium avium subsp. paratuberculosis
ggcugaccucgcc

SEQ ID NO: 943413 - RNA, 21 nt, Mycobacterium avium subsp. paratuberculosis
ggcugaccucgccgcccucgc

SEQ ID NO: 943414 - RNA, 17 nt, Mycobacterium avium subsp. paratuberculosis
ggcugaccucgcgcacc

SEQ ID NO: 943415 - RNA, 16 nt, Mycobacterium avium subsp. paratuberculosis
ggcugacgcgaccgcg

SEQ ID NO: 943416 - RNA, 17 nt, Mycobacterium avium subsp. paratuberculosis
ggcugacgcgaccgcgc

SEQ ID NO: 943417 - RNA, 20 nt, Mycobacterium avium subsp. paratuberculosis
ggcugacgcgaccgcgcggc

SEQ ID NO: 943418 - RNA, 16 nt, Mycobacterium avium subsp. paratuberculosis
ggcugacggcgucguu

SEQ ID NO: 943419 - RNA, 15 nt, Mycobacterium avium subsp. paratuberculosis
ggcugaccgacggcg

SEQ ID NO: 943420 - RNA, 16 nt, Mycobacterium avium subsp. paratuberculosis
ggcugaccgacggcga

SEQ ID NO: 943421 - RNA, 17 nt, Mycobacterium avium subsp. paratuberculosis
ggcugaccgagcggcgc

SEQ ID NO: 943422 - RNA, 14 nt, Mycobacterium avium subsp. paratuberculosis
ggcugaccgccagg

SEQ ID NO: 943423 - RNA, 14 nt, Mycobacterium avium subsp. paratuberculosis
ggcugaccggcggu

SEQ ID NO: 943424 - RNA, 19 nt, Mycobacterium avium subsp. paratuberculosis
ggcugaccggcggugccgg

SEQ ID NO: 943425 - RNA, 21 nt, Mycobacterium avium subsp. paratuberculosis
ggcugaacaccaccaggccgu

SEQ ID NO: 943426 - RNA, 23 nt, Mycobacterium avium subsp. paratuberculosis
ggcugaaccugcugggcggcacc

SEQ ID NO: 943427 - RNA, 15 nt, Mycobacterium avium subsp. paratuberculosis
ggcugaacgccagca

SEQ ID NO: 943428 - RNA, 18 nt, Mycobacterium avium subsp. paratuberculosis
ggcugaacgucgucagca

SEQ ID NO: 943429 - RNA, 21 nt, Mycobacterium avium subsp. paratuberculosis
ggcugaacucgacgucgacgu

SEQ ID NO: 943430 - RNA, 22 nt, Mycobacterium avium subsp. paratuberculosis
ggcucuucgcggcggggcaugg

SEQ ID NO: 943431 - RNA, 14 nt, Mycobacterium avium subsp. paratuberculosis
ggcucuucggcgcc

SEQ ID NO: 943432 - RNA, 21 nt, Mycobacterium avium subsp. paratuberculosis
ggcucuucggcgccgagcguc

SEQ ID NO: 943433 - RNA, 15 nt, Mycobacterium avium subsp. paratuberculosis
ggcugacccgcccgg

SEQ ID NO: 943434 - RNA, 13 nt, Mycobacterium avium subsp. paratuberculosis
ggcugaagcgcug

SEQ ID NO: 943435 - RNA, 21 nt, Mycobacterium avium subsp. paratuberculosis
ggcugaacagcgcgccgaaca

SEQ ID NO: 943436 - RNA, 19 nt, Mycobacterium avium subsp. paratuberculosis
ggcucugaugguguacacg

SEQ ID NO: 943437 - RNA, 19 nt, Mycobacterium avium subsp. paratuberculosis
ggcucugcagagcggugac

SEQ ID NO: 943438 - RNA, 16 nt, Mycobacterium avium subsp. paratuberculosis
ggcucguugagcacac

SEQ ID NO: 943439 - RNA, 19 nt, Mycobacterium avium subsp. paratuberculosis
ggcucguagcuggugcgca

SEQ ID NO: 943440 - RNA, 21 nt, Mycobacterium avium subsp. paratuberculosis
ggcucgugggaaugcggcugg

SEQ ID NO: 943441 - RNA, 15 nt, Mycobacterium avium subsp. paratuberculosis
ggcucgugcagccgg

SEQ ID NO: 943442 - RNA, 19 nt, Mycobacterium avium subsp. paratuberculosis
ggcucgugcagccggcggc

SEQ ID NO: 943443 - RNA, 21 nt, Mycobacterium avium subsp. paratuberculosis
ggcucgugcagccggcggcgc

SEQ ID NO: 943444 - RNA, 23 nt, Mycobacterium avium subsp. paratuberculosis
ggcucgugcagccggcggcgccu

SEQ ID NO: 943445 - RNA, 22 nt, Mycobacterium avium subsp. paratuberculosis
ggcucgucgaacucguggaugu

SEQ ID NO: 943446 - RNA, 14 nt, Mycobacterium avium subsp. paratuberculosis
ggcucgucguugcg

SEQ ID NO: 943447 - RNA, 22 nt, Mycobacterium avium subsp. paratuberculosis
ggcuaaacaauggccccggcgu

SEQ ID NO: 943448 - RNA, 14 nt, Mycobacterium avium subsp. paratuberculosis
ggcguuugguguga

SEQ ID NO: 943449 - RNA, 13 nt, Mycobacterium avium subsp. paratuberculosis
ggcguuggucacc

SEQ ID NO: 943450 - RNA, 15 nt, Mycobacterium avium subsp. paratuberculosis
ggcguugcggaucga

SEQ ID NO: 943451 - RNA, 18 nt, Mycobacterium avium subsp. paratuberculosis
ggcguugcauuucggcgu

SEQ ID NO: 943452 - RNA, 20 nt, Mycobacterium avium subsp. paratuberculosis
ggcguugaugcgggcgugcg

SEQ ID NO: 943453 - RNA, 19 nt, Mycobacterium avium subsp. paratuberculosis
ggcguugaugucggccagg

SEQ ID NO: 943454 - RNA, 17 nt, Mycobacterium avium subsp. paratuberculosis
ggcguugagccggcgca

SEQ ID NO: 943455 - RNA, 22 nt, Mycobacterium avium subsp. paratuberculosis
ggcguucgcugcccaacgucga

SEQ ID NO: 943456 - RNA, 13 nt, Mycobacterium avium subsp. paratuberculosis
ggcguugaccggg

SEQ ID NO: 943457 - RNA, 17 nt, Mycobacterium avium subsp. paratuberculosis
ggcguugaccgggccgc

SEQ ID NO: 943458 - RNA, 16 nt, Mycobacterium avium subsp. paratuberculosis
ggcguugcccgccgcg

SEQ ID NO: 943459 - RNA, 18 nt, Mycobacterium avium subsp. paratuberculosis
ggcguugcccgccgcggc

SEQ ID NO: 943460 - RNA, 16 nt, Mycobacterium avium subsp. paratuberculosis
ggcguugcccgucgcc

SEQ ID NO: 943461 - RNA, 13 nt, Mycobacterium avium subsp. paratuberculosis
ggcguugccgguc

SEQ ID NO: 943462 - RNA, 14 nt, Mycobacterium avium subsp. paratuberculosis
ggcguugcgccgcg

SEQ ID NO: 943463 - RNA, 15 nt, Mycobacterium avium subsp. paratuberculosis
ggcguugcgccgcga

SEQ ID NO: 943464 - RNA, 20 nt, Mycobacterium avium subsp. paratuberculosis
ggcguuggcuuccucgcuga

SEQ ID NO: 943465 - RNA, 12 nt, Mycobacterium avium subsp. paratuberculosis
ggcguuggcccg

SEQ ID NO: 943466 - RNA, 13 nt, Mycobacterium avium subsp. paratuberculosis
ggcguuggcccgc

SEQ ID NO: 943467 - RNA, 15 nt, Mycobacterium avium subsp. paratuberculosis
ggcguuggcccgcac

SEQ ID NO: 943468 - RNA, 13 nt, Mycobacterium avium subsp. paratuberculosis
ggcguuggccgcc

SEQ ID NO: 943469 - RNA, 14 nt, Mycobacterium avium subsp. paratuberculosis
ggcguuggccgccg

SEQ ID NO: 943470 - RNA, 15 nt, Mycobacterium avium subsp. paratuberculosis
ggcguuggccgccgc

SEQ ID NO: 943471 - RNA, 14 nt, Mycobacterium avium subsp. paratuberculosis
ggcguugcgggugg

SEQ ID NO: 943472 - RNA, 15 nt, Mycobacterium avium subsp. paratuberculosis
ggcguugcgucccgc

SEQ ID NO: 943473 - RNA, 15 nt, Mycobacterium avium subsp. paratuberculosis
ggcguugcuggcgcg

SEQ ID NO: 943474 - RNA, 15 nt, Mycobacterium avium subsp. paratuberculosis
ggcguuggacagcuc

SEQ ID NO: 943475 - RNA, 18 nt, Mycobacterium avium subsp. paratuberculosis
ggcguuggacuccaccgc

SEQ ID NO: 943476 - RNA, 20 nt, Mycobacterium avium subsp. paratuberculosis
ggcguuggacuccaccgcca

SEQ ID NO: 943477 - RNA, 22 nt, Mycobacterium avium subsp. paratuberculosis
ggcguuggacuccaccgccacc

SEQ ID NO: 943478 - RNA, 13 nt, Mycobacterium avium subsp. paratuberculosis
ggcguuggagccg

SEQ ID NO: 943479 - RNA, 23 nt, Mycobacterium avium subsp. paratuberculosis
ggcguuggagccgaccagcgcga

SEQ ID NO: 943480 - RNA, 13 nt, Mycobacterium avium subsp. paratuberculosis
ggcguucaucacc

SEQ ID NO: 943481 - RNA, 21 nt, Mycobacterium avium subsp. paratuberculosis
ggcguucaucguccacaccgg

SEQ ID NO: 943482 - RNA, 18 nt, Mycobacterium avium subsp. paratuberculosis
ggcguucugcaccgacug

SEQ ID NO: 943483 - RNA, 19 nt, Mycobacterium avium subsp. paratuberculosis
ggcguucuccagcacccgc

SEQ ID NO: 943484 - RNA, 12 nt, Mycobacterium avium subsp. paratuberculosis
ggcguucgaccc

SEQ ID NO: 943485 - RNA, 21 nt, Mycobacterium avium subsp. paratuberculosis
ggcguucgaccccaacccgaa

SEQ ID NO: 943486 - RNA, 17 nt, Mycobacterium avium subsp. paratuberculosis
ggcguuacacccgcgga

SEQ ID NO: 943487 - RNA, 19 nt, Mycobacterium avium subsp. paratuberculosis
ggcguuacccgaacccagc

SEQ ID NO: 943488 - RNA, 17 nt, Mycobacterium avium subsp. paratuberculosis
ggcguguugcaggcgga

SEQ ID NO: 943489 - RNA, 21 nt, Mycobacterium avium subsp. paratuberculosis
ggcguggugcggugcaccgcg

SEQ ID NO: 943490 - RNA, 18 nt, Mycobacterium avium subsp. paratuberculosis
ggcguucagcagcgcggu

SEQ ID NO: 943491 - RNA, 16 nt, Mycobacterium avium subsp. paratuberculosis
ggcguggggacccccu

SEQ ID NO: 943492 - RNA, 23 nt, Mycobacterium avium subsp. paratuberculosis
ggcguggcuugaucgcacccauc

SEQ ID NO: 943493 - RNA, 13 nt, Mycobacterium avium subsp. paratuberculosis
ggcguggcggugg

SEQ ID NO: 943494 - RNA, 22 nt, Mycobacterium avium subsp. paratuberculosis
ggcgugcugcgcagcagcgcca

SEQ ID NO: 943495 - RNA, 15 nt, Mycobacterium avium subsp. paratuberculosis
ggcguggcgccggcg

SEQ ID NO: 943496 - RNA, 19 nt, Mycobacterium avium subsp. paratuberculosis
ggcguggcucggcccgccg

SEQ ID NO: 943497 - RNA, 23 nt, Mycobacterium avium subsp. paratuberculosis
ggcguggcugaggccgccccggc

SEQ ID NO: 943498 - RNA, 20 nt, Mycobacterium avium subsp. paratuberculosis
ggcguguuccuugcggccgc

SEQ ID NO: 943499 - RNA, 22 nt, Mycobacterium avium subsp. paratuberculosis
ggcguguuccuugcggccgccg

SEQ ID NO: 943500 - RNA, 13 nt, Mycobacterium avium subsp. paratuberculosis
ggcgugucgguga

SEQ ID NO: 943501 - RNA, 18 nt, Mycobacterium avium subsp. paratuberculosis
ggcgugucggugauggcc

SEQ ID NO: 943502 - RNA, 23 nt, Mycobacterium avium subsp. paratuberculosis
ggcguguagccguaacgaugccg

SEQ ID NO: 943503 - RNA, 16 nt, Mycobacterium avium subsp. paratuberculosis
ggcuagacgcgcacca

SEQ ID NO: 943504 - RNA, 20 nt, Mycobacterium avium subsp. paratuberculosis
ggcuagacgcgcaccagggc

SEQ ID NO: 943505 - RNA, 19 nt, Mycobacterium avium subsp. paratuberculosis
ggcuagcgggcgcgcagcc

SEQ ID NO: 943506 - RNA, 13 nt, Mycobacterium avium subsp. paratuberculosis
ggcuaggcucggc

SEQ ID NO: 943507 - RNA, 17 nt, Mycobacterium avium subsp. paratuberculosis
ggcuaggcucggcagcc

SEQ ID NO: 943508 - RNA, 18 nt, Mycobacterium avium subsp. paratuberculosis
ggcuaggcucggcagccg

SEQ ID NO: 943509 - RNA, 20 nt, Mycobacterium avium subsp. paratuberculosis
ggcuaauucgggccgccgcg

SEQ ID NO: 943510 - RNA, 21 nt, Mycobacterium avium subsp. paratuberculosis
ggcuaauucgggccgccgcgc

SEQ ID NO: 943511 - RNA, 21 nt, Mycobacterium avium subsp. paratuberculosis
ggcuaccuaggcgucgucggc

SEQ ID NO: 943512 - RNA, 18 nt, Mycobacterium avium subsp. paratuberculosis
ggcuaucgcccggcgccc

SEQ ID NO: 943513 - RNA, 15 nt, Mycobacterium avium subsp. paratuberculosis
ggcucaacggccggc

SEQ ID NO: 943514 - RNA, 16 nt, Mycobacterium avium subsp. paratuberculosis
ggcucaacggccggcg

SEQ ID NO: 943515 - RNA, 19 nt, Mycobacterium avium subsp. paratuberculosis
ggcucaacggccggcgccg

SEQ ID NO: 943516 - RNA, 17 nt, Mycobacterium avium subsp. paratuberculosis
ggcucaacacguccugg

SEQ ID NO: 943517 - RNA, 22 nt, Mycobacterium avium subsp. paratuberculosis
ggcucaacacguccuggcgcca

SEQ ID NO: 943518 - RNA, 16 nt, Mycobacterium avium subsp. paratuberculosis
ggcucacagcgcggcg

SEQ ID NO: 943519 - RNA, 13 nt, Mycobacterium avium subsp. paratuberculosis
ggcucagcccggc

SEQ ID NO: 943520 - RNA, 14 nt, Mycobacterium avium subsp. paratuberculosis
ggcucagcccggcg

SEQ ID NO: 943521 - RNA, 16 nt, Mycobacterium avium subsp. paratuberculosis
ggcucagcccggcgcu

SEQ ID NO: 943522 - RNA, 18 nt, Mycobacterium avium subsp. paratuberculosis
ggcucagcccggcgcuca

SEQ ID NO: 943523 - RNA, 20 nt, Mycobacterium avium subsp. paratuberculosis
ggcucagccgaagccggcgc

SEQ ID NO: 943524 - RNA, 17 nt, Mycobacterium avium subsp. paratuberculosis
ggcucacaugggcgcgu

SEQ ID NO: 943525 - RNA, 19 nt, Mycobacterium avium subsp. paratuberculosis
ggcucacgacuccuggccg

SEQ ID NO: 943526 - RNA, 14 nt, Mycobacterium avium subsp. paratuberculosis
ggcucagcagcacc

SEQ ID NO: 943527 - RNA, 14 nt, Mycobacterium avium subsp. paratuberculosis
ggcucagcgcaccg

SEQ ID NO: 943528 - RNA, 17 nt, Mycobacterium avium subsp. paratuberculosis
ggcucagcgcaccgccg

SEQ ID NO: 943529 - RNA, 18 nt, Mycobacterium avium subsp. paratuberculosis
ggcucagcgcaccgccgu

SEQ ID NO: 943530 - RNA, 20 nt, Mycobacterium avium subsp. paratuberculosis
ggcucagcgcaccgccgucg

SEQ ID NO: 943531 - RNA, 23 nt, Mycobacterium avium subsp. paratuberculosis
ggcucagcgcaccgccgucgggg

SEQ ID NO: 943532 - RNA, 18 nt, Mycobacterium avium subsp. paratuberculosis
ggcuccacgaugcccguc

SEQ ID NO: 943533 - RNA, 13 nt, Mycobacterium avium subsp. paratuberculosis
ggcuccaccgcgc

SEQ ID NO: 943534 - RNA, 14 nt, Mycobacterium avium subsp. paratuberculosis
ggcuccaccgcgcc

SEQ ID NO: 943535 - RNA, 18 nt, Mycobacterium avium subsp. paratuberculosis
ggcuccaccgcgccggcg

SEQ ID NO: 943536 - RNA, 21 nt, Mycobacterium avium subsp. paratuberculosis
ggcuccaccgcgccggcggcg

SEQ ID NO: 943537 - RNA, 23 nt, Mycobacterium avium subsp. paratuberculosis
ggcuccaccgcgccggcggcggc

SEQ ID NO: 943538 - RNA, 12 nt, Mycobacterium avium subsp. paratuberculosis
ggcucccaccgu

SEQ ID NO: 943539 - RNA, 21 nt, Mycobacterium avium subsp. paratuberculosis
ggcucccagucccagcacagc

SEQ ID NO: 943540 - RNA, 19 nt, Mycobacterium avium subsp. paratuberculosis
ggcuccccggacagccacu

SEQ ID NO: 943541 - RNA, 17 nt, Mycobacterium avium subsp. paratuberculosis
ggcuccagcgcccgccg

SEQ ID NO: 943542 - RNA, 23 nt, Mycobacterium avium subsp. paratuberculosis
ggcucauacggcggcucgggggu

SEQ ID NO: 943543 - RNA, 17 nt, Mycobacterium avium subsp. paratuberculosis
ggcucagcggcaggugc

SEQ ID NO: 943544 - RNA, 17 nt, Mycobacterium avium subsp. paratuberculosis
ggcucaggaucagcagc

SEQ ID NO: 943545 - RNA, 19 nt, Mycobacterium avium subsp. paratuberculosis
ggcucaggaucagcagccg

SEQ ID NO: 943546 - RNA, 17 nt, Mycobacterium avium subsp. paratuberculosis
ggcuccugccguucggc

SEQ ID NO: 943547 - RNA, 20 nt, Mycobacterium avium subsp. paratuberculosis
ggcucgaaaugccuuggcgg

SEQ ID NO: 943548 - RNA, 22 nt, Mycobacterium avium subsp. paratuberculosis
ggcucgaaaugccuuggcggcg

SEQ ID NO: 943549 - RNA, 17 nt, Mycobacterium avium subsp. paratuberculosis
ggcucgaacaacccggc

SEQ ID NO: 943550 - RNA, 20 nt, Mycobacterium avium subsp. paratuberculosis
ggcucgaacaacccggccgc

SEQ ID NO: 943551 - RNA, 17 nt, Mycobacterium avium subsp. paratuberculosis
ggcucgaaguggcagcg

SEQ ID NO: 943552 - RNA, 15 nt, Mycobacterium avium subsp. paratuberculosis
ggcucgacaggcagc

SEQ ID NO: 943553 - RNA, 19 nt, Mycobacterium avium subsp. paratuberculosis
ggcucgacaggcagcccgg

SEQ ID NO: 943554 - RNA, 15 nt, Mycobacterium avium subsp. paratuberculosis
ggcuccggccgcgcc

SEQ ID NO: 943555 - RNA, 21 nt, Mycobacterium avium subsp. paratuberculosis
ggcuccgccgauguacuccug

SEQ ID NO: 943556 - RNA, 12 nt, Mycobacterium avium subsp. paratuberculosis
ggcuccgcacga

SEQ ID NO: 943557 - RNA, 19 nt, Mycobacterium avium subsp. paratuberculosis
ggcuccgcaugcccgggcg

SEQ ID NO: 943558 - RNA, 22 nt, Mycobacterium avium subsp. paratuberculosis
ggcuccgcaugcccgggcgacu

SEQ ID NO: 943559 - RNA, 16 nt, Mycobacterium avium subsp. paratuberculosis
ggcuccagcgggucca

SEQ ID NO: 943560 - RNA, 23 nt, Mycobacterium avium subsp. paratuberculosis
ggcuccgcgcugaccagcgugac

SEQ ID NO: 943561 - RNA, 20 nt, Mycobacterium avium subsp. paratuberculosis
ggcuccgcguucgaccucca

SEQ ID NO: 943562 - RNA, 21 nt, Mycobacterium avium subsp. paratuberculosis
ggcucccgcuccauggcggcg

SEQ ID NO: 943563 - RNA, 23 nt, Mycobacterium avium subsp. paratuberculosis
ggcucccgcuccauggcggcgac

SEQ ID NO: 943564 - RNA, 13 nt, Mycobacterium avium subsp. paratuberculosis
ggcucccgcucgc

SEQ ID NO: 943565 - RNA, 17 nt, Mycobacterium avium subsp. paratuberculosis
ggcucccucgucgcuac

SEQ ID NO: 943566 - RNA, 17 nt, Mycobacterium avium subsp. paratuberculosis
ggcgucucagucggcca

SEQ ID NO: 943567 - RNA, 20 nt, Mycobacterium avium subsp. paratuberculosis
ggcgucucagucggccaccg

SEQ ID NO: 943568 - RNA, 22 nt, Mycobacterium avium subsp. paratuberculosis
ggcgucguugaacgcgcgggug

SEQ ID NO: 943569 - RNA, 22 nt, Mycobacterium avium subsp. paratuberculosis
ggcgucgucgucgagccgcucg

SEQ ID NO: 943570 - RNA, 14 nt, Mycobacterium avium subsp. paratuberculosis
ggcgucgucgccgu

SEQ ID NO: 943571 - RNA, 11 nt, Mycobacterium avium subsp. paratuberculosis
ggcgucgucgg

SEQ ID NO: 943572 - RNA, 15 nt, Mycobacterium avium subsp. paratuberculosis
ggcgucgucggccca

SEQ ID NO: 943573 - RNA, 14 nt, Mycobacterium avium subsp. paratuberculosis
ggcgucgucggccg

SEQ ID NO: 943574 - RNA, 19 nt, Mycobacterium avium subsp. paratuberculosis
ggcgucgucggccggcucg

SEQ ID NO: 943575 - RNA, 16 nt, Mycobacterium avium subsp. paratuberculosis
ggcgucgucgagcacc

SEQ ID NO: 943576 - RNA, 20 nt, Mycobacterium avium subsp. paratuberculosis
ggcgucgucgagcaccggca

SEQ ID NO: 943577 - RNA, 21 nt, Mycobacterium avium subsp. paratuberculosis
ggcgucgucgagcaccggcag

SEQ ID NO: 943578 - RNA, 17 nt, Mycobacterium avium subsp. paratuberculosis
ggcgucguaguugcggc

SEQ ID NO: 943579 - RNA, 21 nt, Mycobacterium avium subsp. paratuberculosis
ggcgucguaguugcggccggc

SEQ ID NO: 943580 - RNA, 16 nt, Mycobacterium avium subsp. paratuberculosis
ggcgucgguggcggcg

SEQ ID NO: 943581 - RNA, 20 nt, Mycobacterium avium subsp. paratuberculosis
ggcgucgguggcggcggcga

SEQ ID NO: 943582 - RNA, 23 nt, Mycobacterium avium subsp. paratuberculosis
ggcgucgguggcggcggcgacga

SEQ ID NO: 943583 - RNA, 22 nt, Mycobacterium avium subsp. paratuberculosis
ggcgucggugucccgcgcccgc

SEQ ID NO: 943584 - RNA, 22 nt, Mycobacterium avium subsp. paratuberculosis
ggcgucguaaugcgucaugccg

SEQ ID NO: 943585 - RNA, 23 nt, Mycobacterium avium subsp. paratuberculosis
ggcgucggcgccccccugcucgc

SEQ ID NO: 943586 - RNA, 20 nt, Mycobacterium avium subsp. paratuberculosis
ggcgucggguagggcgccgu

SEQ ID NO: 943587 - RNA, 22 nt, Mycobacterium avium subsp. paratuberculosis
ggcgucggguagggcgccgucg

SEQ ID NO: 943588 - RNA, 23 nt, Mycobacterium avium subsp. paratuberculosis
ggcgucggucagcaggcgccgca

SEQ ID NO: 943589 - RNA, 13 nt, Mycobacterium avium subsp. paratuberculosis
ggcgucggggggu

SEQ ID NO: 943590 - RNA, 16 nt, Mycobacterium avium subsp. paratuberculosis
ggcgucgggcagcagc

SEQ ID NO: 943591 - RNA, 15 nt, Mycobacterium avium subsp. paratuberculosis
ggcgucgggcgggug

SEQ ID NO: 943592 - RNA, 16 nt, Mycobacterium avium subsp. paratuberculosis
ggcgucgggcgggugg

SEQ ID NO: 943593 - RNA, 17 nt, Mycobacterium avium subsp. paratuberculosis
ggcgucgggcuugcgca

SEQ ID NO: 943594 - RNA, 21 nt, Mycobacterium avium subsp. paratuberculosis
ggcgucggggcccuccgcggc

SEQ ID NO: 943595 - RNA, 24 nt, Mycobacterium avium subsp. paratuberculosis
ggcgugacggaugugacgcgggac

SEQ ID NO: 943596 - RNA, 16 nt, Mycobacterium avium subsp. paratuberculosis
ggcgugacgccgcugc

SEQ ID NO: 943597 - RNA, 23 nt, Mycobacterium avium subsp. paratuberculosis
ggcgugacgcucgaggccccgcg

SEQ ID NO: 943598 - RNA, 15 nt, Mycobacterium avium subsp. paratuberculosis
ggcgugacgcucgcc

SEQ ID NO: 943599 - RNA, 17 nt, Mycobacterium avium subsp. paratuberculosis
ggcgugacgcucgccgg

SEQ ID NO: 943600 - RNA, 18 nt, Mycobacterium avium subsp. paratuberculosis
ggcgugacgcucggccgu

SEQ ID NO: 943601 - RNA, 16 nt, Mycobacterium avium subsp. paratuberculosis
ggcgugacgcucggcg

SEQ ID NO: 943602 - RNA, 17 nt, Mycobacterium avium subsp. paratuberculosis
ggcgugacgcucggcgc

SEQ ID NO: 943603 - RNA, 18 nt, Mycobacterium avium subsp. paratuberculosis
ggcgugacgcucggcgcc

SEQ ID NO: 943604 - RNA, 19 nt, Mycobacterium avium subsp. paratuberculosis
ggcgugacgcucggcgccg

SEQ ID NO: 943605 - RNA, 21 nt, Mycobacterium avium subsp. paratuberculosis
ggcgugacgcucggcgccgcg

SEQ ID NO: 943606 - RNA, 16 nt, Mycobacterium avium subsp. paratuberculosis
ggcgugacgcucgggg

SEQ ID NO: 943607 - RNA, 20 nt, Mycobacterium avium subsp. paratuberculosis
ggcgugaaucuuggccagca

SEQ ID NO: 943608 - RNA, 21 nt, Mycobacterium avium subsp. paratuberculosis
ggcgugaaucuuggccagcag

SEQ ID NO: 943609 - RNA, 22 nt, Mycobacterium avium subsp. paratuberculosis
ggcgugaaucuuggccagcagc

SEQ ID NO: 943610 - RNA, 22 nt, Mycobacterium avium subsp. paratuberculosis
ggcgugacaggguaacccggga

SEQ ID NO: 943611 - RNA, 12 nt, Mycobacterium avium subsp. paratuberculosis
ggcgugaccggc

SEQ ID NO: 943612 - RNA, 19 nt, Mycobacterium avium subsp. paratuberculosis
ggcgugaccggcugcucgc

SEQ ID NO: 943613 - RNA, 20 nt, Mycobacterium avium subsp. paratuberculosis
ggcgugaccggcugcucgcg

SEQ ID NO: 943614 - RNA, 18 nt, Mycobacterium avium subsp. paratuberculosis
ggcgucuugaucucggcg

SEQ ID NO: 943615 - RNA, 16 nt, Mycobacterium avium subsp. paratuberculosis
ggcgucuugcugcgga

SEQ ID NO: 943616 - RNA, 13 nt, Mycobacterium avium subsp. paratuberculosis
ggcgucuggccgg

SEQ ID NO: 943617 - RNA, 21 nt, Mycobacterium avium subsp. paratuberculosis
ggcgucugccuugcugacgcc

SEQ ID NO: 943618 - RNA, 13 nt, Mycobacterium avium subsp. paratuberculosis
ggcgucucggcgu

SEQ ID NO: 943619 - RNA, 14 nt, Mycobacterium avium subsp. paratuberculosis
ggcgucucggcguc

SEQ ID NO: 943620 - RNA, 20 nt, Mycobacterium avium subsp. paratuberculosis
ggcgugaugacggcggcggu

SEQ ID NO: 943621 - RNA, 22 nt, Mycobacterium avium subsp. paratuberculosis
ggcgugaugacggcggcggugc

SEQ ID NO: 943622 - RNA, 19 nt, Mycobacterium avium subsp. paratuberculosis
ggcgugcaacugcguggcc

SEQ ID NO: 943623 - RNA, 18 nt, Mycobacterium avium subsp. paratuberculosis
ggcgugcacaggccgccg

SEQ ID NO: 943624 - RNA, 20 nt, Mycobacterium avium subsp. paratuberculosis
ggcgugcacaggccgccgca

SEQ ID NO: 943625 - RNA, 19 nt, Mycobacterium avium subsp. paratuberculosis
ggcgugcagcacggggacg

SEQ ID NO: 943626 - RNA, 17 nt, Mycobacterium avium subsp. paratuberculosis
ggcgugacggucgaccu

SEQ ID NO: 943627 - RNA, 23 nt, Mycobacterium avium subsp. paratuberculosis
ggcgugcacccgguucugggcgg

SEQ ID NO: 943628 - RNA, 17 nt, Mycobacterium avium subsp. paratuberculosis
ggcgugcaccgcccgcg

SEQ ID NO: 943629 - RNA, 23 nt, Mycobacterium avium subsp. paratuberculosis
ggcgugcaccgcccgcgcgaugc

SEQ ID NO: 943630 - RNA, 14 nt, Mycobacterium avium subsp. paratuberculosis
ggcgugcagcccgc

SEQ ID NO: 943631 - RNA, 15 nt, Mycobacterium avium subsp. paratuberculosis
ggcgugcagcgcggc

SEQ ID NO: 943632 - RNA, 16 nt, Mycobacterium avium subsp. paratuberculosis
ggcgugcagcgcggcg

SEQ ID NO: 943633 - RNA, 18 nt, Mycobacterium avium subsp. paratuberculosis
ggcgugcagcgcggcgau

SEQ ID NO: 943634 - RNA, 13 nt, Mycobacterium avium subsp. paratuberculosis
ggcgugcccggcg

SEQ ID NO: 943635 - RNA, 16 nt, Mycobacterium avium subsp. paratuberculosis
ggcgugcccggcgccg

SEQ ID NO: 943636 - RNA, 14 nt, Mycobacterium avium subsp. paratuberculosis
ggcgugccgcccgg

SEQ ID NO: 943637 - RNA, 23 nt, Mycobacterium avium subsp. paratuberculosis
ggcgugccgcccggaccgcgguc

SEQ ID NO: 943638 - RNA, 16 nt, Mycobacterium avium subsp. paratuberculosis
ggcgugccggacaccg

SEQ ID NO: 943639 - RNA, 18 nt, Mycobacterium avium subsp. paratuberculosis
ggcgugccggacaccggc

SEQ ID NO: 943640 - RNA, 18 nt, Mycobacterium avium subsp. paratuberculosis
ggcgugccggaugcgguc

SEQ ID NO: 943641 - RNA, 15 nt, Mycobacterium avium subsp. paratuberculosis
ggcgugccggcggcg

SEQ ID NO: 943642 - RNA, 13 nt, Mycobacterium avium subsp. paratuberculosis
ggcgugccacagc

SEQ ID NO: 943643 - RNA, 17 nt, Mycobacterium avium subsp. paratuberculosis
ggcgugccacagcauga

SEQ ID NO: 943644 - RNA, 14 nt, Mycobacterium avium subsp. paratuberculosis
ggcgugcccgccga

SEQ ID NO: 943645 - RNA, 16 nt, Mycobacterium avium subsp. paratuberculosis
ggcgugcccgccgacc

SEQ ID NO: 943646 - RNA, 15 nt, Mycobacterium avium subsp. paratuberculosis
ggcgugcaggccgcg

SEQ ID NO: 943647 - RNA, 20 nt, Mycobacterium avium subsp. paratuberculosis
ggcgugcaggccgcgggugg

SEQ ID NO: 943648 - RNA, 17 nt, Mycobacterium avium subsp. paratuberculosis
ggcguggcgcucagcgg

SEQ ID NO: 943649 - RNA, 23 nt, Mycobacterium avium subsp. paratuberculosis
ggcguggcgcucagcggcagcgu

SEQ ID NO: 943650 - RNA, 16 nt, Mycobacterium avium subsp. paratuberculosis
ggcgugcucggccacg

SEQ ID NO: 943651 - RNA, 19 nt, Mycobacterium avium subsp. paratuberculosis
ggcguggaacacgcccagc

SEQ ID NO: 943652 - RNA, 22 nt, Mycobacterium avium subsp. paratuberculosis
ggcguggaacgcgucgcgccag

SEQ ID NO: 943653 - RNA, 19 nt, Mycobacterium avium subsp. paratuberculosis
ggcguggauggccggccgg

SEQ ID NO: 943654 - RNA, 22 nt, Mycobacterium avium subsp. paratuberculosis
ggcguggauggccggccggguc

SEQ ID NO: 943655 - RNA, 16 nt, Mycobacterium avium subsp. paratuberculosis
ggcguggcacccgggc

SEQ ID NO: 943656 - RNA, 20 nt, Mycobacterium avium subsp. paratuberculosis
ggcguggcacccgggcgcga

SEQ ID NO: 943657 - RNA, 23 nt, Mycobacterium avium subsp. paratuberculosis
ggcguggcacccgggcgcgacgg

SEQ ID NO: 943658 - RNA, 17 nt, Mycobacterium avium subsp. paratuberculosis
ggcguggcaggcgaugg

SEQ ID NO: 943659 - RNA, 13 nt, Mycobacterium avium subsp. paratuberculosis
ggcgugcgcgugg

SEQ ID NO: 943660 - RNA, 22 nt, Mycobacterium avium subsp. paratuberculosis
ggcgugcgcguggggcgucgcc

SEQ ID NO: 943661 - RNA, 11 nt, Mycobacterium avium subsp. paratuberculosis
ggcgugcucgg

SEQ ID NO: 943662 - RNA, 15 nt, Mycobacterium avium subsp. paratuberculosis
ggcgugcggccgcag

SEQ ID NO: 943663 - RNA, 15 nt, Mycobacterium avium subsp. paratuberculosis
ggcgugcuccagcag

SEQ ID NO: 943664 - RNA, 22 nt, Mycobacterium avium subsp. paratuberculosis
ggcgugcuccagcaggcgcgcc

SEQ ID NO: 943665 - RNA, 14 nt, Mycobacterium avium subsp. paratuberculosis
ggcgugcucgaucg

SEQ ID NO: 943666 - RNA, 16 nt, Mycobacterium avium subsp. paratuberculosis
ggcgugcucgaucgcg

SEQ ID NO: 943667 - RNA, 16 nt, Mycobacterium avium subsp. paratuberculosis
ggcgugcgcggccgcc

SEQ ID NO: 943668 - RNA, 17 nt, Mycobacterium avium subsp. paratuberculosis
ggcgugcgcggccgccc

SEQ ID NO: 943669 - RNA, 15 nt, Mycobacterium avium subsp. paratuberculosis
ggcgugccagggcag

SEQ ID NO: 943670 - RNA, 22 nt, Mycobacterium avium subsp. paratuberculosis
ggcgggcgaaguagccggcgau

SEQ ID NO: 943671 - RNA, 15 nt, Mycobacterium avium subsp. paratuberculosis
ggcguccagugcaug

SEQ ID NO: 943672 - RNA, 22 nt, Mycobacterium avium subsp. paratuberculosis
ggcguccagugcaugccggccu

SEQ ID NO: 943673 - RNA, 13 nt, Mycobacterium avium subsp. paratuberculosis
ggcguccaguucg

SEQ ID NO: 943674 - RNA, 19 nt, Mycobacterium avium subsp. paratuberculosis
ggcguccaguucggccagc

SEQ ID NO: 943675 - RNA, 22 nt, Mycobacterium avium subsp. paratuberculosis
ggcguccaguucggccagcgcg

SEQ ID NO: 943676 - RNA, 21 nt, Mycobacterium avium subsp. paratuberculosis
ggcguccgagaagggccgccg

SEQ ID NO: 943677 - RNA, 18 nt, Mycobacterium avium subsp. paratuberculosis
ggcguccgcaagcaccuc

SEQ ID NO: 943678 - RNA, 14 nt, Mycobacterium avium subsp. paratuberculosis
ggcguccgcggccg

SEQ ID NO: 943679 - RNA, 16 nt, Mycobacterium avium subsp. paratuberculosis
ggcguccgcggccgcg

SEQ ID NO: 943680 - RNA, 18 nt, Mycobacterium avium subsp. paratuberculosis
ggcguccgcggccgcggc

SEQ ID NO: 943681 - RNA, 23 nt, Mycobacterium avium subsp. paratuberculosis
ggcguccgcggccgcggcgcgca

SEQ ID NO: 943682 - RNA, 18 nt, Mycobacterium avium subsp. paratuberculosis
ggcguccagggccaccgc

SEQ ID NO: 943683 - RNA, 19 nt, Mycobacterium avium subsp. paratuberculosis
ggcguccagggccaccgcg

SEQ ID NO: 943684 - RNA, 20 nt, Mycobacterium avium subsp. paratuberculosis
ggcguccagggccaccgcgu

SEQ ID NO: 943685 - RNA, 17 nt, Mycobacterium avium subsp. paratuberculosis
ggcguccaggucgcccu

SEQ ID NO: 943686 - RNA, 18 nt, Mycobacterium avium subsp. paratuberculosis
ggcguccaggucgcccuc

SEQ ID NO: 943687 - RNA, 18 nt, Mycobacterium avium subsp. paratuberculosis
ggcguccaguagccgccg

SEQ ID NO: 943688 - RNA, 14 nt, Mycobacterium avium subsp. paratuberculosis
ggcguccagccagc

SEQ ID NO: 943689 - RNA, 16 nt, Mycobacterium avium subsp. paratuberculosis
ggcguccagccagcgu

SEQ ID NO: 943690 - RNA, 22 nt, Mycobacterium avium subsp. paratuberculosis
ggcguccagcgccgccacggcc

SEQ ID NO: 943691 - RNA, 18 nt, Mycobacterium avium subsp. paratuberculosis
ggcguccagcugcgcgcc

SEQ ID NO: 943692 - RNA, 17 nt, Mycobacterium avium subsp. paratuberculosis
ggcguccaggcgcaccg

SEQ ID NO: 943693 - RNA, 20 nt, Mycobacterium avium subsp. paratuberculosis
ggcguccaggcgcaccgcca

SEQ ID NO: 943694 - RNA, 14 nt, Mycobacterium avium subsp. paratuberculosis
ggcgggcgaucgcc

SEQ ID NO: 943695 - RNA, 14 nt, Mycobacterium avium subsp. paratuberculosis
ggcgggccgguccc

SEQ ID NO: 943696 - RNA, 23 nt, Mycobacterium avium subsp. paratuberculosis
ggcgggccgguccccggcgacca

SEQ ID NO: 943697 - RNA, 21 nt, Mycobacterium avium subsp. paratuberculosis
ggcgggccuugagcaccgcgu

SEQ ID NO: 943698 - RNA, 14 nt, Mycobacterium avium subsp. paratuberculosis
ggcgggccggcgcc

SEQ ID NO: 943699 - RNA, 15 nt, Mycobacterium avium subsp. paratuberculosis
ggcgggccggcgccg

SEQ ID NO: 943700 - RNA, 14 nt, Mycobacterium avium subsp. paratuberculosis
ggcguccuugccga

SEQ ID NO: 943701 - RNA, 20 nt, Mycobacterium avium subsp. paratuberculosis
ggcgucgaaauagcggcgca

SEQ ID NO: 943702 - RNA, 19 nt, Mycobacterium avium subsp. paratuberculosis
ggcgucgaacggcgucugg

SEQ ID NO: 943703 - RNA, 23 nt, Mycobacterium avium subsp. paratuberculosis
ggcgucgaacggcgucuggccgg

SEQ ID NO: 943704 - RNA, 23 nt, Mycobacterium avium subsp. paratuberculosis
ggcgucgaacgggccgggcaccg

SEQ ID NO: 943705 - RNA, 17 nt, Mycobacterium avium subsp. paratuberculosis
ggcguccucgucggcga

SEQ ID NO: 943706 - RNA, 16 nt, Mycobacterium avium subsp. paratuberculosis
ggcguccuugaccagc

SEQ ID NO: 943707 - RNA, 19 nt, Mycobacterium avium subsp. paratuberculosis
ggcguccuugaccagcugc

SEQ ID NO: 943708 - RNA, 21 nt, Mycobacterium avium subsp. paratuberculosis
ggcguccuugauccgggcgcc

SEQ ID NO: 943709 - RNA, 23 nt, Mycobacterium avium subsp. paratuberculosis
ggcguccuugauccgggcgccau

SEQ ID NO: 943710 - RNA, 20 nt, Mycobacterium avium subsp. paratuberculosis
ggcgucccggguaccucugc

SEQ ID NO: 943711 - RNA, 15 nt, Mycobacterium avium subsp. paratuberculosis
ggcguccgcggcgga

SEQ ID NO: 943712 - RNA, 16 nt, Mycobacterium avium subsp. paratuberculosis
ggcguccgcggcggag

SEQ ID NO: 943713 - RNA, 21 nt, Mycobacterium avium subsp. paratuberculosis
ggcguccgggcgcugcgcggu

SEQ ID NO: 943714 - RNA, 16 nt, Mycobacterium avium subsp. paratuberculosis
ggcguccgugccgucc

SEQ ID NO: 943715 - RNA, 17 nt, Mycobacterium avium subsp. paratuberculosis
ggcguccgugccguccg

SEQ ID NO: 943716 - RNA, 19 nt, Mycobacterium avium subsp. paratuberculosis
ggcguccuccucguccgcg

SEQ ID NO: 943717 - RNA, 22 nt, Mycobacterium avium subsp. paratuberculosis
ggcguccuccucguccgcggcg

SEQ ID NO: 943718 - RNA, 19 nt, Mycobacterium avium subsp. paratuberculosis
ggcguccucgaccacccgc

SEQ ID NO: 943719 - RNA, 24 nt, Mycobacterium avium subsp. paratuberculosis
ggcguccucgaccacccgcugguc

SEQ ID NO: 943720 - RNA, 14 nt, Mycobacterium avium subsp. paratuberculosis
ggcguccucgacgc

SEQ ID NO: 943721 - RNA, 15 nt, Mycobacterium avium subsp. paratuberculosis
ggcguccucgacgcc

SEQ ID NO: 943722 - RNA, 18 nt, Mycobacterium avium subsp. paratuberculosis
ggcguccucgacgccgcg

SEQ ID NO: 943723 - RNA, 22 nt, Mycobacterium avium subsp. paratuberculosis
ggcguccucgacgccgcgcacc

SEQ ID NO: 943724 - RNA, 19 nt, Mycobacterium avium subsp. paratuberculosis
ggcguccucgacgguggag

SEQ ID NO: 943725 - RNA, 17 nt, Mycobacterium avium subsp. paratuberculosis
ggcgucggcggccuuga

SEQ ID NO: 943726 - RNA, 14 nt, Mycobacterium avium subsp. paratuberculosis
ggcgucggcgucga

SEQ ID NO: 943727 - RNA, 16 nt, Mycobacterium avium subsp. paratuberculosis
ggcgucggcgcgcacc

SEQ ID NO: 943728 - RNA, 19 nt, Mycobacterium avium subsp. paratuberculosis
ggcgucggcgcgcaccgcg

SEQ ID NO: 943729 - RNA, 20 nt, Mycobacterium avium subsp. paratuberculosis
ggcgucggcgacggcgucca

SEQ ID NO: 943730 - RNA, 19 nt, Mycobacterium avium subsp. paratuberculosis
ggcgucggcgagcgguucg

SEQ ID NO: 943731 - RNA, 13 nt, Mycobacterium avium subsp. paratuberculosis
ggcgucggcgccc

SEQ ID NO: 943732 - RNA, 15 nt, Mycobacterium avium subsp. paratuberculosis
ggcgucggccgggcu

SEQ ID NO: 943733 - RNA, 16 nt, Mycobacterium avium subsp. paratuberculosis
ggcgucggccgggcug

SEQ ID NO: 943734 - RNA, 23 nt, Mycobacterium avium subsp. paratuberculosis
ggcgucggccgggggcgcgggcg

SEQ ID NO: 943735 - RNA, 13 nt, Mycobacterium avium subsp. paratuberculosis
ggcgucggccugc

SEQ ID NO: 943736 - RNA, 15 nt, Mycobacterium avium subsp. paratuberculosis
ggcgucggccagcgg

SEQ ID NO: 943737 - RNA, 18 nt, Mycobacterium avium subsp. paratuberculosis
ggcgucggccaccgcgcc

SEQ ID NO: 943738 - RNA, 13 nt, Mycobacterium avium subsp. paratuberculosis
ggcgucggccagc

SEQ ID NO: 943739 - RNA, 14 nt, Mycobacterium avium subsp. paratuberculosis
ggcgucggccagcg

SEQ ID NO: 943740 - RNA, 15 nt, Mycobacterium avium subsp. paratuberculosis
ggcgucggagaugcg

SEQ ID NO: 943741 - RNA, 20 nt, Mycobacterium avium subsp. paratuberculosis
ggcgucggagaugcgggcca

SEQ ID NO: 943742 - RNA, 23 nt, Mycobacterium avium subsp. paratuberculosis
ggcgucggagaugcgggccaccg

SEQ ID NO: 943743 - RNA, 19 nt, Mycobacterium avium subsp. paratuberculosis
ggcgucggacaugccggcg

SEQ ID NO: 943744 - RNA, 14 nt, Mycobacterium avium subsp. paratuberculosis
ggcgucggacgcca

SEQ ID NO: 943745 - RNA, 22 nt, Mycobacterium avium subsp. paratuberculosis
ggcgucgccgcucuucgacgac

SEQ ID NO: 943746 - RNA, 15 nt, Mycobacterium avium subsp. paratuberculosis
ggcgucgccgcuggu

SEQ ID NO: 943747 - RNA, 19 nt, Mycobacterium avium subsp. paratuberculosis
ggcgucgccuuccugcgcg

SEQ ID NO: 943748 - RNA, 12 nt, Mycobacterium avium subsp. paratuberculosis
ggcgucgcgcuc

SEQ ID NO: 943749 - RNA, 21 nt, Mycobacterium avium subsp. paratuberculosis
ggcgucgcggcgcacccgggc

SEQ ID NO: 943750 - RNA, 17 nt, Mycobacterium avium subsp. paratuberculosis
ggcgucgaugcgugaca

SEQ ID NO: 943751 - RNA, 20 nt, Mycobacterium avium subsp. paratuberculosis
ggcgucgcacgugguguuga

SEQ ID NO: 943752 - RNA, 22 nt, Mycobacterium avium subsp. paratuberculosis
ggcgucgaugaccucgcgcagc

SEQ ID NO: 943753 - RNA, 19 nt, Mycobacterium avium subsp. paratuberculosis
ggcgucgaugaugccggcg

SEQ ID NO: 943754 - RNA, 22 nt, Mycobacterium avium subsp. paratuberculosis
ggcgucgaugaugccggcggac

SEQ ID NO: 943755 - RNA, 13 nt, Mycobacterium avium subsp. paratuberculosis
ggcgucgaucagc

SEQ ID NO: 943756 - RNA, 16 nt, Mycobacterium avium subsp. paratuberculosis
ggcgucgaucgccguc

SEQ ID NO: 943757 - RNA, 14 nt, Mycobacterium avium subsp. paratuberculosis
ggcgucgcccgccg

SEQ ID NO: 943758 - RNA, 19 nt, Mycobacterium avium subsp. paratuberculosis
ggcgucgcccgccgacggc

SEQ ID NO: 943759 - RNA, 24 nt, Mycobacterium avium subsp. paratuberculosis
ggcgucgcccgccgacggcugccc

SEQ ID NO: 943760 - RNA, 13 nt, Mycobacterium avium subsp. paratuberculosis
ggcgucgccgagc

SEQ ID NO: 943761 - RNA, 14 nt, Mycobacterium avium subsp. paratuberculosis
ggcgucgccgagcc

SEQ ID NO: 943762 - RNA, 15 nt, Mycobacterium avium subsp. paratuberculosis
ggcgucgccgagccg

SEQ ID NO: 943763 - RNA, 17 nt, Mycobacterium avium subsp. paratuberculosis
ggcgucgccgagccgcg

SEQ ID NO: 943764 - RNA, 11 nt, Mycobacterium avium subsp. paratuberculosis
ggcgucgccga

SEQ ID NO: 943765 - RNA, 13 nt, Mycobacterium avium subsp. paratuberculosis
ggcgucgccgccc

SEQ ID NO: 943766 - RNA, 15 nt, Mycobacterium avium subsp. paratuberculosis
ggcgucgccgccggu

SEQ ID NO: 943767 - RNA, 20 nt, Mycobacterium avium subsp. paratuberculosis
ggcgucgccgccggugccga

SEQ ID NO: 943768 - RNA, 18 nt, Mycobacterium avium subsp. paratuberculosis
ggcgucgaguucgccguc

SEQ ID NO: 943769 - RNA, 13 nt, Mycobacterium avium subsp. paratuberculosis
ggcgucgagcgcg

SEQ ID NO: 943770 - RNA, 13 nt, Mycobacterium avium subsp. paratuberculosis
ggcgucgacgucg

SEQ ID NO: 943771 - RNA, 17 nt, Mycobacterium avium subsp. paratuberculosis
ggcgucgaccgccccgc

SEQ ID NO: 943772 - RNA, 18 nt, Mycobacterium avium subsp. paratuberculosis
ggcgucgacagccggucg

SEQ ID NO: 943773 - RNA, 22 nt, Mycobacterium avium subsp. paratuberculosis
ggcgucgacagccggucgcgca

SEQ ID NO: 943774 - RNA, 16 nt, Mycobacterium avium subsp. paratuberculosis
ggcgucgacgacggcg

SEQ ID NO: 943775 - RNA, 18 nt, Mycobacterium avium subsp. paratuberculosis
ggcgucgacgacggcgcc

SEQ ID NO: 943776 - RNA, 22 nt, Mycobacterium avium subsp. paratuberculosis
ggcgucgacgacggcgccgcgu

SEQ ID NO: 943777 - RNA, 13 nt, Mycobacterium avium subsp. paratuberculosis
ggcgucgacgaug

SEQ ID NO: 943778 - RNA, 19 nt, Mycobacterium avium subsp. paratuberculosis
ggcgucgaagcgcaugccg

SEQ ID NO: 943779 - RNA, 16 nt, Mycobacterium avium subsp. paratuberculosis
ggcgucgacgaugguc

SEQ ID NO: 943780 - RNA, 17 nt, Mycobacterium avium subsp. paratuberculosis
ggcgaugaccagcgcga

SEQ ID NO: 943781 - RNA, 18 nt, Mycobacterium avium subsp. paratuberculosis
ggcgaugaccagcgcgaa

SEQ ID NO: 943782 - RNA, 15 nt, Mycobacterium avium subsp. paratuberculosis
ggcgaugaagccccg

SEQ ID NO: 943783 - RNA, 17 nt, Mycobacterium avium subsp. paratuberculosis
ggcgaugaagccggcga

SEQ ID NO: 943784 - RNA, 21 nt, Mycobacterium avium subsp. paratuberculosis
ggcgaugacgucgucgcggcg

SEQ ID NO: 943785 - RNA, 23 nt, Mycobacterium avium subsp. paratuberculosis
ggcgaugacgucgucgcggcgcu

SEQ ID NO: 943786 - RNA, 17 nt, Mycobacterium avium subsp. paratuberculosis
ggcgaugauccgcggcg

SEQ ID NO: 943787 - RNA, 20 nt, Mycobacterium avium subsp. paratuberculosis
ggcgaugauccgcggcgccg

SEQ ID NO: 943788 - RNA, 20 nt, Mycobacterium avium subsp. paratuberculosis
ggcgaugaccgccugcggca

SEQ ID NO: 943789 - RNA, 18 nt, Mycobacterium avium subsp. paratuberculosis
ggcgaugcagaucaccac

SEQ ID NO: 943790 - RNA, 20 nt, Mycobacterium avium subsp. paratuberculosis
ggcgaugcagaucaccacgg

SEQ ID NO: 943791 - RNA, 14 nt, Mycobacterium avium subsp. paratuberculosis
ggcgaugcccguga

SEQ ID NO: 943792 - RNA, 13 nt, Mycobacterium avium subsp. paratuberculosis
ggcgaugccgaca

SEQ ID NO: 943793 - RNA, 14 nt, Mycobacterium avium subsp. paratuberculosis
ggcgaugccgagcc

SEQ ID NO: 943794 - RNA, 12 nt, Mycobacterium avium subsp. paratuberculosis
ggcgaugcccag

SEQ ID NO: 943795 - RNA, 17 nt, Mycobacterium avium subsp. paratuberculosis
ggcgaugccagcgcacc

SEQ ID NO: 943796 - RNA, 17 nt, Mycobacterium avium subsp. paratuberculosis
ggcgaugccgccgacga

SEQ ID NO: 943797 - RNA, 14 nt, Mycobacterium avium subsp. paratuberculosis
ggcgaugccgugcu

SEQ ID NO: 943798 - RNA, 19 nt, Mycobacterium avium subsp. paratuberculosis
ggcgaugccgugcugggcg

SEQ ID NO: 943799 - RNA, 20 nt, Mycobacterium avium subsp. paratuberculosis
ggcgaugccgugcugggcgg

SEQ ID NO: 943800 - RNA, 23 nt, Mycobacterium avium subsp. paratuberculosis
ggcgaugccgugcugggcggacg

SEQ ID NO: 943801 - RNA, 16 nt, Mycobacterium avium subsp. paratuberculosis
ggcgaucggccgcugc

SEQ ID NO: 943802 - RNA, 14 nt, Mycobacterium avium subsp. paratuberculosis
ggcgaucggcgguc

SEQ ID NO: 943803 - RNA, 17 nt, Mycobacterium avium subsp. paratuberculosis
ggcgaucggcgguccgc

SEQ ID NO: 943804 - RNA, 14 nt, Mycobacterium avium subsp. paratuberculosis
ggcgaucggcgugc

SEQ ID NO: 943805 - RNA, 16 nt, Mycobacterium avium subsp. paratuberculosis
ggcgaucggcgugccg

SEQ ID NO: 943806 - RNA, 13 nt, Mycobacterium avium subsp. paratuberculosis
ggcgaucgcgcgc

SEQ ID NO: 943807 - RNA, 17 nt, Mycobacterium avium subsp. paratuberculosis
ggcgaucgcggccacca

SEQ ID NO: 943808 - RNA, 22 nt, Mycobacterium avium subsp. paratuberculosis
ggcgaucgcggccaccacgacg

SEQ ID NO: 943809 - RNA, 14 nt, Mycobacterium avium subsp. paratuberculosis
ggcgaucgccgcga

SEQ ID NO: 943810 - RNA, 17 nt, Mycobacterium avium subsp. paratuberculosis
ggcgaucgacaccagcg

SEQ ID NO: 943811 - RNA, 20 nt, Mycobacterium avium subsp. paratuberculosis
ggcgaucgacaccagcgugu

SEQ ID NO: 943812 - RNA, 18 nt, Mycobacterium avium subsp. paratuberculosis
ggcgaucucuucgaugcc

SEQ ID NO: 943813 - RNA, 18 nt, Mycobacterium avium subsp. paratuberculosis
ggcgaucgggucaccggc

SEQ ID NO: 943814 - RNA, 19 nt, Mycobacterium avium subsp. paratuberculosis
ggcgaucgggucaccggcc

SEQ ID NO: 943815 - RNA, 22 nt, Mycobacterium avium subsp. paratuberculosis
ggcgaucuccagcggccgggcg

SEQ ID NO: 943816 - RNA, 14 nt, Mycobacterium avium subsp. paratuberculosis
ggcgaucucgccga

SEQ ID NO: 943817 - RNA, 18 nt, Mycobacterium avium subsp. paratuberculosis
ggcgaucucggcggccgc

SEQ ID NO: 943818 - RNA, 16 nt, Mycobacterium avium subsp. paratuberculosis
ggcgaucucggucacc

SEQ ID NO: 943819 - RNA, 20 nt, Mycobacterium avium subsp. paratuberculosis
ggcgaucucggucaccgagc

SEQ ID NO: 943820 - RNA, 21 nt, Mycobacterium avium subsp. paratuberculosis
ggcgaucucggucaccgagcg

SEQ ID NO: 943821 - RNA, 14 nt, Mycobacterium avium subsp. paratuberculosis
ggcgaucucgucgc

SEQ ID NO: 943822 - RNA, 20 nt, Mycobacterium avium subsp. paratuberculosis
ggcgaucucgucgcgcagcu

SEQ ID NO: 943823 - RNA, 17 nt, Mycobacterium avium subsp. paratuberculosis
ggcgaucucgucgcggu

SEQ ID NO: 943824 - RNA, 22 nt, Mycobacterium avium subsp. paratuberculosis
ggcgauucccggaugcugcggg

SEQ ID NO: 943825 - RNA, 20 nt, Mycobacterium avium subsp. paratuberculosis
ggcgauucgucgucguuggc

SEQ ID NO: 943826 - RNA, 20 nt, Mycobacterium avium subsp. paratuberculosis
ggcgauguggguggucagcg

SEQ ID NO: 943827 - RNA, 21 nt, Mycobacterium avium subsp. paratuberculosis
ggcgaugggcaauaccggcag

SEQ ID NO: 943828 - RNA, 21 nt, Mycobacterium avium subsp. paratuberculosis
ggcgaugugaucgcggcccac

SEQ ID NO: 943829 - RNA, 23 nt, Mycobacterium avium subsp. paratuberculosis
ggcgauguugaccacccgcagcg

SEQ ID NO: 943830 - RNA, 19 nt, Mycobacterium avium subsp. paratuberculosis
ggcgauuaggucgguggcc

SEQ ID NO: 943831 - RNA, 20 nt, Mycobacterium avium subsp. paratuberculosis
ggcgauggugcugcccggcg

SEQ ID NO: 943832 - RNA, 18 nt, Mycobacterium avium subsp. paratuberculosis
ggcgaugguggcgcugcc

SEQ ID NO: 943833 - RNA, 17 nt, Mycobacterium avium subsp. paratuberculosis
ggcgauggugggcagcc

SEQ ID NO: 943834 - RNA, 20 nt, Mycobacterium avium subsp. paratuberculosis
ggcgauggugggcagccggc

SEQ ID NO: 943835 - RNA, 19 nt, Mycobacterium avium subsp. paratuberculosis
ggcgauguaggacgccgca

SEQ ID NO: 943836 - RNA, 12 nt, Mycobacterium avium subsp. paratuberculosis
ggcgauggugcc

SEQ ID NO: 943837 - RNA, 14 nt, Mycobacterium avium subsp. paratuberculosis
ggcgauggugccga

SEQ ID NO: 943838 - RNA, 22 nt, Mycobacterium avium subsp. paratuberculosis
ggcgauggugccgaagcgccgc

SEQ ID NO: 943839 - RNA, 17 nt, Mycobacterium avium subsp. paratuberculosis
ggcgauggugccggcca

SEQ ID NO: 943840 - RNA, 18 nt, Mycobacterium avium subsp. paratuberculosis
ggcgauggcgcggccggc

SEQ ID NO: 943841 - RNA, 13 nt, Mycobacterium avium subsp. paratuberculosis
ggcgauggcggcg

SEQ ID NO: 943842 - RNA, 15 nt, Mycobacterium avium subsp. paratuberculosis
ggcgauggcggcguc

SEQ ID NO: 943843 - RNA, 16 nt, Mycobacterium avium subsp. paratuberculosis
ggcgauggcggcgucg

SEQ ID NO: 943844 - RNA, 17 nt, Mycobacterium avium subsp. paratuberculosis
ggcgauggcggcgucga

SEQ ID NO: 943845 - RNA, 14 nt, Mycobacterium avium subsp. paratuberculosis
ggcgauggccgaca

SEQ ID NO: 943846 - RNA, 24 nt, Mycobacterium avium subsp. paratuberculosis
ggcgauggccgacaacauccgcga

SEQ ID NO: 943847 - RNA, 18 nt, Mycobacterium avium subsp. paratuberculosis
ggcgauggccauggccag

SEQ ID NO: 943848 - RNA, 13 nt, Mycobacterium avium subsp. paratuberculosis
ggcgauggcccgc

SEQ ID NO: 943849 - RNA, 20 nt, Mycobacterium avium subsp. paratuberculosis
ggcgauggcccgcugcgccg

SEQ ID NO: 943850 - RNA, 21 nt, Mycobacterium avium subsp. paratuberculosis
ggcgauggcccgcugcgccga

SEQ ID NO: 943851 - RNA, 24 nt, Mycobacterium avium subsp. paratuberculosis
ggcgauggaguagcugaccgaucg

SEQ ID NO: 943852 - RNA, 14 nt, Mycobacterium avium subsp. paratuberculosis
ggcgaugcgccguc

SEQ ID NO: 943853 - RNA, 15 nt, Mycobacterium avium subsp. paratuberculosis
ggcgaugcggcccgg

SEQ ID NO: 943854 - RNA, 16 nt, Mycobacterium avium subsp. paratuberculosis
ggcgaugcguugcgcc

SEQ ID NO: 943855 - RNA, 17 nt, Mycobacterium avium subsp. paratuberculosis
ggcgaugcgguggucga

SEQ ID NO: 943856 - RNA, 13 nt, Mycobacterium avium subsp. paratuberculosis
ggcgaugcgcgcc

SEQ ID NO: 943857 - RNA, 14 nt, Mycobacterium avium subsp. paratuberculosis
ggcgaugcgcgccu

SEQ ID NO: 943858 - RNA, 17 nt, Mycobacterium avium subsp. paratuberculosis
ggcgaugcgcggcccgu

SEQ ID NO: 943859 - RNA, 20 nt, Mycobacterium avium subsp. paratuberculosis
ggcgaugcgcggcccguuga

SEQ ID NO: 943860 - RNA, 15 nt, Mycobacterium avium subsp. paratuberculosis
ggcgaugcgcacguc

SEQ ID NO: 943861 - RNA, 22 nt, Mycobacterium avium subsp. paratuberculosis
ggcgaugccuuccucggcgcuc

SEQ ID NO: 943862 - RNA, 19 nt, Mycobacterium avium subsp. paratuberculosis
ggcgauaaccucggcggcg

SEQ ID NO: 943863 - RNA, 14 nt, Mycobacterium avium subsp. paratuberculosis
ggcgaguccgcgga

SEQ ID NO: 943864 - RNA, 21 nt, Mycobacterium avium subsp. paratuberculosis
ggcgaguccggccaggucgcc

SEQ ID NO: 943865 - RNA, 21 nt, Mycobacterium avium subsp. paratuberculosis
ggcgagucgcggaucaugauc

SEQ ID NO: 943866 - RNA, 21 nt, Mycobacterium avium subsp. paratuberculosis
ggcgagugcgaaacucaccgc

SEQ ID NO: 943867 - RNA, 22 nt, Mycobacterium avium subsp. paratuberculosis
ggcgagugcgaaacucaccgcg

SEQ ID NO: 943868 - RNA, 17 nt, Mycobacterium avium subsp. paratuberculosis
ggcgaguuaugccguca

SEQ ID NO: 943869 - RNA, 21 nt, Mycobacterium avium subsp. paratuberculosis
ggcgaguucagaagucgcccg

SEQ ID NO: 943870 - RNA, 15 nt, Mycobacterium avium subsp. paratuberculosis
ggcgaucaccccggc

SEQ ID NO: 943871 - RNA, 20 nt, Mycobacterium avium subsp. paratuberculosis
ggcgaucaccccggcgacgg

SEQ ID NO: 943872 - RNA, 18 nt, Mycobacterium avium subsp. paratuberculosis
ggcgaucaccgccgcggc

SEQ ID NO: 943873 - RNA, 23 nt, Mycobacterium avium subsp. paratuberculosis
ggcgaucaccgccgcggcgacca

SEQ ID NO: 943874 - RNA, 14 nt, Mycobacterium avium subsp. paratuberculosis
ggcgaucaccgcgg

SEQ ID NO: 943875 - RNA, 16 nt, Mycobacterium avium subsp. paratuberculosis
ggcgaucaccgcggcg

SEQ ID NO: 943876 - RNA, 20 nt, Mycobacterium avium subsp. paratuberculosis
ggcgaucaccuugcggccgg

SEQ ID NO: 943877 - RNA, 21 nt, Mycobacterium avium subsp. paratuberculosis
ggcgaucaccuugcggccggc

SEQ ID NO: 943878 - RNA, 13 nt, Mycobacterium avium subsp. paratuberculosis
ggcgaucauccag

SEQ ID NO: 943879 - RNA, 16 nt, Mycobacterium avium subsp. paratuberculosis
ggcgaucauccaggug

SEQ ID NO: 943880 - RNA, 21 nt, Mycobacterium avium subsp. paratuberculosis
ggcgauccacgccuccggcag

SEQ ID NO: 943881 - RNA, 17 nt, Mycobacterium avium subsp. paratuberculosis
ggcgaucagggcggcgc

SEQ ID NO: 943882 - RNA, 17 nt, Mycobacterium avium subsp. paratuberculosis
ggcgaucagcugcucgu

SEQ ID NO: 943883 - RNA, 13 nt, Mycobacterium avium subsp. paratuberculosis
ggcgaucagcccg

SEQ ID NO: 943884 - RNA, 14 nt, Mycobacterium avium subsp. paratuberculosis
ggcgaucagcccgc

SEQ ID NO: 943885 - RNA, 23 nt, Mycobacterium avium subsp. paratuberculosis
ggcgaucagcccgcccaccacga

SEQ ID NO: 943886 - RNA, 15 nt, Mycobacterium avium subsp. paratuberculosis
ggcgaucagcccggc

SEQ ID NO: 943887 - RNA, 16 nt, Mycobacterium avium subsp. paratuberculosis
ggcgaucagcccggcc

SEQ ID NO: 943888 - RNA, 12 nt, Mycobacterium avium subsp. paratuberculosis
ggcgaucagcgc

SEQ ID NO: 943889 - RNA, 18 nt, Mycobacterium avium subsp. paratuberculosis
ggcgauccggccggcggc

SEQ ID NO: 943890 - RNA, 21 nt, Mycobacterium avium subsp. paratuberculosis
ggcgauccggccggcggcggu

SEQ ID NO: 943891 - RNA, 12 nt, Mycobacterium avium subsp. paratuberculosis
ggcgaucgacgu

SEQ ID NO: 943892 - RNA, 20 nt, Mycobacterium avium subsp. paratuberculosis
ggcgaucgaucccuuggcgg

SEQ ID NO: 943893 - RNA, 13 nt, Mycobacterium avium subsp. paratuberculosis
ggcgaucgaugcc

SEQ ID NO: 943894 - RNA, 18 nt, Mycobacterium avium subsp. paratuberculosis
ggcgaucgaugcccagcg

SEQ ID NO: 943895 - RNA, 24 nt, Mycobacterium avium subsp. paratuberculosis
ggcgaucgaugcccagcgcgcggu

SEQ ID NO: 943896 - RNA, 17 nt, Mycobacterium avium subsp. paratuberculosis
ggcgauccgcaggccgu

SEQ ID NO: 943897 - RNA, 23 nt, Mycobacterium avium subsp. paratuberculosis
ggcgauccgcaggccgucgccgg

SEQ ID NO: 943898 - RNA, 16 nt, Mycobacterium avium subsp. paratuberculosis
ggcgauccgcgcggcg

SEQ ID NO: 943899 - RNA, 20 nt, Mycobacterium avium subsp. paratuberculosis
ggcgauccgcgcggcgacga

SEQ ID NO: 943900 - RNA, 16 nt, Mycobacterium avium subsp. paratuberculosis
ggccugcuucucgccg

SEQ ID NO: 943901 - RNA, 17 nt, Mycobacterium avium subsp. paratuberculosis
ggccugcuucucgccgu

SEQ ID NO: 943902 - RNA, 15 nt, Mycobacterium avium subsp. paratuberculosis
ggccugcuugaccgc

SEQ ID NO: 943903 - RNA, 17 nt, Mycobacterium avium subsp. paratuberculosis
ggccugcuugaccgcca

SEQ ID NO: 943904 - RNA, 18 nt, Mycobacterium avium subsp. paratuberculosis
ggccugcuugaccgccag

SEQ ID NO: 943905 - RNA, 23 nt, Mycobacterium avium subsp. paratuberculosis
ggccuggacuugcgucgcgaugc

SEQ ID NO: 943906 - RNA, 22 nt, Mycobacterium avium subsp. paratuberculosis
ggccuggaaccgggucucgcgc

SEQ ID NO: 943907 - RNA, 15 nt, Mycobacterium avium subsp. paratuberculosis
ggccuggaugccgcc

SEQ ID NO: 943908 - RNA, 16 nt, Mycobacterium avium subsp. paratuberculosis
ggccuggccgucgcgg

SEQ ID NO: 943909 - RNA, 20 nt, Mycobacterium avium subsp. paratuberculosis
ggcgaggaacucagcgccca

SEQ ID NO: 943910 - RNA, 21 nt, Mycobacterium avium subsp. paratuberculosis
ggcgaggaaguccggcgcgcc

SEQ ID NO: 943911 - RNA, 22 nt, Mycobacterium avium subsp. paratuberculosis
ggcgaggaaguccggcgcgccc

SEQ ID NO: 943912 - RNA, 16 nt, Mycobacterium avium subsp. paratuberculosis
ggcgaggaauugcgcu

SEQ ID NO: 943913 - RNA, 17 nt, Mycobacterium avium subsp. paratuberculosis
ggccuggcgcuccagcc

SEQ ID NO: 943914 - RNA, 23 nt, Mycobacterium avium subsp. paratuberculosis
ggcgagggcaacgucuggccacc

SEQ ID NO: 943915 - RNA, 12 nt, Mycobacterium avium subsp. paratuberculosis
ggcgaggcgguc

SEQ ID NO: 943916 - RNA, 14 nt, Mycobacterium avium subsp. paratuberculosis
ggcgaggcggucgg

SEQ ID NO: 943917 - RNA, 18 nt, Mycobacterium avium subsp. paratuberculosis
ggcgaggcggucggcgga

SEQ ID NO: 943918 - RNA, 17 nt, Mycobacterium avium subsp. paratuberculosis
ggcgaggaucgcgaugu

SEQ ID NO: 943919 - RNA, 14 nt, Mycobacterium avium subsp. paratuberculosis
ggcgaggucgggau

SEQ ID NO: 943920 - RNA, 16 nt, Mycobacterium avium subsp. paratuberculosis
ggcgaggucgucgagg

SEQ ID NO: 943921 - RNA, 20 nt, Mycobacterium avium subsp. paratuberculosis
ggcgaguaaggccgaggcga

SEQ ID NO: 943922 - RNA, 15 nt, Mycobacterium avium subsp. paratuberculosis
ggcgaguacccgccg

SEQ ID NO: 943923 - RNA, 17 nt, Mycobacterium avium subsp. paratuberculosis
ggcgaguacccgccgca

SEQ ID NO: 943924 - RNA, 16 nt, Mycobacterium avium subsp. paratuberculosis
ggcgagucccggcgca

SEQ ID NO: 943925 - RNA, 19 nt, Mycobacterium avium subsp. paratuberculosis
ggcgagucccggcgcacca

SEQ ID NO: 943926 - RNA, 18 nt, Mycobacterium avium subsp. paratuberculosis
ggcgagguaauggugggc

SEQ ID NO: 943927 - RNA, 18 nt, Mycobacterium avium subsp. paratuberculosis
ggcgagguagaccgccga

SEQ ID NO: 943928 - RNA, 20 nt, Mycobacterium avium subsp. paratuberculosis
ggcgagguagaccgccgagu

SEQ ID NO: 943929 - RNA, 13 nt, Mycobacterium avium subsp. paratuberculosis
ggcgcaccgccac

SEQ ID NO: 943930 - RNA, 13 nt, Mycobacterium avium subsp. paratuberculosis
ggcgcaccgccgg

SEQ ID NO: 943931 - RNA, 15 nt, Mycobacterium avium subsp. paratuberculosis
ggcgcaccgccgggc

SEQ ID NO: 943932 - RNA, 13 nt, Mycobacterium avium subsp. paratuberculosis
ggcgcaccgcgcg

SEQ ID NO: 943933 - RNA, 15 nt, Mycobacterium avium subsp. paratuberculosis
ggcgcaccgcgcgcc

SEQ ID NO: 943934 - RNA, 16 nt, Mycobacterium avium subsp. paratuberculosis
ggcgcaccgcgcgcca

SEQ ID NO: 943935 - RNA, 11 nt, Mycobacterium avium subsp. paratuberculosis
ggcgcaacacc

SEQ ID NO: 943936 - RNA, 23 nt, Mycobacterium avium subsp. paratuberculosis
ggcgcaccaaccggccccgagcg

SEQ ID NO: 943937 - RNA, 17 nt, Mycobacterium avium subsp. paratuberculosis
ggcgcaccaccagcucg

SEQ ID NO: 943938 - RNA, 18 nt, Mycobacterium avium subsp. paratuberculosis
ggcgcaccaccagcucgu

SEQ ID NO: 943939 - RNA, 22 nt, Mycobacterium avium subsp. paratuberculosis
ggcgcaccuggcgcagcaccga

SEQ ID NO: 943940 - RNA, 19 nt, Mycobacterium avium subsp. paratuberculosis
ggcgcaccgugucgucgcu

SEQ ID NO: 943941 - RNA, 20 nt, Mycobacterium avium subsp. paratuberculosis
ggcgcaccgugucgucgcug

SEQ ID NO: 943942 - RNA, 12 nt, Mycobacterium avium subsp. paratuberculosis
ggcgcaccgcgg

SEQ ID NO: 943943 - RNA, 15 nt, Mycobacterium avium subsp. paratuberculosis
ggcgcaccgcggccu

SEQ ID NO: 943944 - RNA, 20 nt, Mycobacterium avium subsp. paratuberculosis
ggcgcaccgcggccucggcg

SEQ ID NO: 943945 - RNA, 12 nt, Mycobacterium avium subsp. paratuberculosis
ggcgcaccgcgu

SEQ ID NO: 943946 - RNA, 18 nt, Mycobacterium avium subsp. paratuberculosis
ggcgcaccgcgucgacca

SEQ ID NO: 943947 - RNA, 17 nt, Mycobacterium avium subsp. paratuberculosis
ggcgcaccgcgucgaug

SEQ ID NO: 943948 - RNA, 19 nt, Mycobacterium avium subsp. paratuberculosis
ggcgcaccgcgucgaugcg

SEQ ID NO: 943949 - RNA, 16 nt, Mycobacterium avium subsp. paratuberculosis
ggcgcagccagcucgg

SEQ ID NO: 943950 - RNA, 21 nt, Mycobacterium avium subsp. paratuberculosis
ggcgcagcccgagcggcauca

SEQ ID NO: 943951 - RNA, 14 nt, Mycobacterium avium subsp. paratuberculosis
ggcgcagcccggcg

SEQ ID NO: 943952 - RNA, 19 nt, Mycobacterium avium subsp. paratuberculosis
ggcgcagcccggcgguuga

SEQ ID NO: 943953 - RNA, 19 nt, Mycobacterium avium subsp. paratuberculosis
ggcgcagccgaucgacgaa

SEQ ID NO: 943954 - RNA, 15 nt, Mycobacterium avium subsp. paratuberculosis
ggcgcagcacggcca

SEQ ID NO: 943955 - RNA, 18 nt, Mycobacterium avium subsp. paratuberculosis
ggcgcagcacggccacug

SEQ ID NO: 943956 - RNA, 15 nt, Mycobacterium avium subsp. paratuberculosis
ggcgcagcaccgacu

SEQ ID NO: 943957 - RNA, 21 nt, Mycobacterium avium subsp. paratuberculosis
ggcgcagaagcuaacgccagc

SEQ ID NO: 943958 - RNA, 23 nt, Mycobacterium avium subsp. paratuberculosis
ggcgcagaagcuaacgccagcug

SEQ ID NO: 943959 - RNA, 14 nt, Mycobacterium avium subsp. paratuberculosis
ggcgcaccgagucg

SEQ ID NO: 943960 - RNA, 22 nt, Mycobacterium avium subsp. paratuberculosis
ggcgcacgcccaugaucacacc

SEQ ID NO: 943961 - RNA, 14 nt, Mycobacterium avium subsp. paratuberculosis
ggcgcacggcgccc

SEQ ID NO: 943962 - RNA, 17 nt, Mycobacterium avium subsp. paratuberculosis
ggcgcacggcgcccagg

SEQ ID NO: 943963 - RNA, 18 nt, Mycobacterium avium subsp. paratuberculosis
ggcgcacggugcccgucg

SEQ ID NO: 943964 - RNA, 20 nt, Mycobacterium avium subsp. paratuberculosis
ggcgcacguggcugaccgac

SEQ ID NO: 943965 - RNA, 19 nt, Mycobacterium avium subsp. paratuberculosis
ggcgcacuccaucacgacc

SEQ ID NO: 943966 - RNA, 18 nt, Mycobacterium avium subsp. paratuberculosis
ggcgcaucaucucggcga

SEQ ID NO: 943967 - RNA, 21 nt, Mycobacterium avium subsp. paratuberculosis
ggcgcaucaucucggcgaagu

SEQ ID NO: 943968 - RNA, 15 nt, Mycobacterium avium subsp. paratuberculosis
ggcgcaugccagacc

SEQ ID NO: 943969 - RNA, 17 nt, Mycobacterium avium subsp. paratuberculosis
ggcgcaugccagaccac

SEQ ID NO: 943970 - RNA, 16 nt, Mycobacterium avium subsp. paratuberculosis
ggcgcagaugaccggc

SEQ ID NO: 943971 - RNA, 17 nt, Mycobacterium avium subsp. paratuberculosis
ggcgcagcgcgaugucc

SEQ ID NO: 943972 - RNA, 16 nt, Mycobacterium avium subsp. paratuberculosis
ggcgcagcgccgcgcc

SEQ ID NO: 943973 - RNA, 18 nt, Mycobacterium avium subsp. paratuberculosis
ggcgcagcgccgcgccga

SEQ ID NO: 943974 - RNA, 20 nt, Mycobacterium avium subsp. paratuberculosis
ggcgcagcgccgcgccgacc

SEQ ID NO: 943975 - RNA, 18 nt, Mycobacterium avium subsp. paratuberculosis
ggcgcagcgccgucucga

SEQ ID NO: 943976 - RNA, 15 nt, Mycobacterium avium subsp. paratuberculosis
ggcgcagccggccac

SEQ ID NO: 943977 - RNA, 18 nt, Mycobacterium avium subsp. paratuberculosis
ggcgcagcgcacgucgcc

SEQ ID NO: 943978 - RNA, 21 nt, Mycobacterium avium subsp. paratuberculosis
ggcgcagcgcacgucgccgcc

SEQ ID NO: 943979 - RNA, 18 nt, Mycobacterium avium subsp. paratuberculosis
ggcgccaguaguggauca

SEQ ID NO: 943980 - RNA, 21 nt, Mycobacterium avium subsp. paratuberculosis
ggcgccaguaguggaucagcc

SEQ ID NO: 943981 - RNA, 18 nt, Mycobacterium avium subsp. paratuberculosis
ggcgccaggccggcgacg

SEQ ID NO: 943982 - RNA, 16 nt, Mycobacterium avium subsp. paratuberculosis
ggcgccaacaacucga

SEQ ID NO: 943983 - RNA, 21 nt, Mycobacterium avium subsp. paratuberculosis
ggcgccaacaacucgacgcuc

SEQ ID NO: 943984 - RNA, 21 nt, Mycobacterium avium subsp. paratuberculosis
ggcgccauccgcagcccgucg

SEQ ID NO: 943985 - RNA, 18 nt, Mycobacterium avium subsp. paratuberculosis
ggcgccauccgccacccg

SEQ ID NO: 943986 - RNA, 16 nt, Mycobacterium avium subsp. paratuberculosis
ggcgcccacccguugg

SEQ ID NO: 943987 - RNA, 13 nt, Mycobacterium avium subsp. paratuberculosis
ggcgcccaccgcg

SEQ ID NO: 943988 - RNA, 14 nt, Mycobacterium avium subsp. paratuberculosis
ggcgcccaccgcgg

SEQ ID NO: 943989 - RNA, 13 nt, Mycobacterium avium subsp. paratuberculosis
ggcgcccacggcc

SEQ ID NO: 943990 - RNA, 19 nt, Mycobacterium avium subsp. paratuberculosis
ggcgcccacggccaccacg

SEQ ID NO: 943991 - RNA, 18 nt, Mycobacterium avium subsp. paratuberculosis
ggcgcccagaugccgccg

SEQ ID NO: 943992 - RNA, 21 nt, Mycobacterium avium subsp. paratuberculosis
ggcgcccagaugccgccgcca

SEQ ID NO: 943993 - RNA, 20 nt, Mycobacterium avium subsp. paratuberculosis
ggcgcccagcaaacccagca

SEQ ID NO: 943994 - RNA, 22 nt, Mycobacterium avium subsp. paratuberculosis
ggcgcccagcaaacccagcacc

SEQ ID NO: 943995 - RNA, 13 nt, Mycobacterium avium subsp. paratuberculosis
ggcgcccacagca

SEQ ID NO: 943996 - RNA, 17 nt, Mycobacterium avium subsp. paratuberculosis
ggcgcccacagcaggua

SEQ ID NO: 943997 - RNA, 12 nt, Mycobacterium avium subsp. paratuberculosis
ggcgcccagccc

SEQ ID NO: 943998 - RNA, 15 nt, Mycobacterium avium subsp. paratuberculosis
ggcgcccagcccgag

SEQ ID NO: 943999 - RNA, 22 nt, Mycobacterium avium subsp. paratuberculosis
ggcgcccagcccgagcaccagc

SEQ ID NO: 944000 - RNA, 23 nt, Mycobacterium avium subsp. paratuberculosis
ggcgcccagcccgagcaccagcg

SEQ ID NO: 944001 - RNA, 13 nt, Mycobacterium avium subsp. paratuberculosis
ggcgccuggucaa

SEQ ID NO: 944002 - RNA, 12 nt, Mycobacterium avium subsp. paratuberculosis
ggcgccucggcg

SEQ ID NO: 944003 - RNA, 14 nt, Mycobacterium avium subsp. paratuberculosis
ggcgccucggcgcc

SEQ ID NO: 944004 - RNA, 14 nt, Mycobacterium avium subsp. paratuberculosis
ggcgccucggcguc

SEQ ID NO: 944005 - RNA, 16 nt, Mycobacterium avium subsp. paratuberculosis
ggcgccgucgauggcg

SEQ ID NO: 944006 - RNA, 21 nt, Mycobacterium avium subsp. paratuberculosis
ggcgccgucgauggcgcggcc

SEQ ID NO: 944007 - RNA, 19 nt, Mycobacterium avium subsp. paratuberculosis
ggcgccgucgccgacguug

SEQ ID NO: 944008 - RNA, 15 nt, Mycobacterium avium subsp. paratuberculosis
ggcgccgucgccgcc

SEQ ID NO: 944009 - RNA, 14 nt, Mycobacterium avium subsp. paratuberculosis
ggcgccgucgccgg

SEQ ID NO: 944010 - RNA, 14 nt, Mycobacterium avium subsp. paratuberculosis
ggcgccgucgacca

SEQ ID NO: 944011 - RNA, 13 nt, Mycobacterium avium subsp. paratuberculosis
ggcgccgucgagg

SEQ ID NO: 944012 - RNA, 13 nt, Mycobacterium avium subsp. paratuberculosis
ggcgccgucgaug

SEQ ID NO: 944013 - RNA, 16 nt, Mycobacterium avium subsp. paratuberculosis
ggcgccguccagcucg

SEQ ID NO: 944014 - RNA, 20 nt, Mycobacterium avium subsp. paratuberculosis
ggcgccguccgcggcggcca

SEQ ID NO: 944015 - RNA, 20 nt, Mycobacterium avium subsp. paratuberculosis
ggcgccgguuuucggcgugu

SEQ ID NO: 944016 - RNA, 16 nt, Mycobacterium avium subsp. paratuberculosis
ggcgccguaggccgcg

SEQ ID NO: 944017 - RNA, 20 nt, Mycobacterium avium subsp. paratuberculosis
ggcgccguaggccgcgcuga

SEQ ID NO: 944018 - RNA, 14 nt, Mycobacterium avium subsp. paratuberculosis
ggcgccggugccca

SEQ ID NO: 944019 - RNA, 14 nt, Mycobacterium avium subsp. paratuberculosis
ggcgccggugccgc

SEQ ID NO: 944020 - RNA, 22 nt, Mycobacterium avium subsp. paratuberculosis
ggcgccggugaagaucgcccgc

SEQ ID NO: 944021 - RNA, 21 nt, Mycobacterium avium subsp. paratuberculosis
ggcgccgguaggcgcggguga

SEQ ID NO: 944022 - RNA, 22 nt, Mycobacterium avium subsp. paratuberculosis
ggcgccgguauauucgcgaugg

SEQ ID NO: 944023 - RNA, 13 nt, Mycobacterium avium subsp. paratuberculosis
ggcgccggucagc

SEQ ID NO: 944024 - RNA, 17 nt, Mycobacterium avium subsp. paratuberculosis
ggcgccggucgacgcgg

SEQ ID NO: 944025 - RNA, 20 nt, Mycobacterium avium subsp. paratuberculosis
ggcgccggucgacgcggggc

SEQ ID NO: 944026 - RNA, 14 nt, Mycobacterium avium subsp. paratuberculosis
ggcgccggcccgcg

SEQ ID NO: 944027 - RNA, 15 nt, Mycobacterium avium subsp. paratuberculosis
ggcgccggcccgcgg

SEQ ID NO: 944028 - RNA, 17 nt, Mycobacterium avium subsp. paratuberculosis
ggcgccggcccgcggcg

SEQ ID NO: 944029 - RNA, 18 nt, Mycobacterium avium subsp. paratuberculosis
ggcgccggcccgcggcgg

SEQ ID NO: 944030 - RNA, 20 nt, Mycobacterium avium subsp. paratuberculosis
ggcgccggcccgcggcggau

SEQ ID NO: 944031 - RNA, 22 nt, Mycobacterium avium subsp. paratuberculosis
ggcgccggccgacauggacgcg

SEQ ID NO: 944032 - RNA, 17 nt, Mycobacterium avium subsp. paratuberculosis
ggcgccggaucggcccc

SEQ ID NO: 944033 - RNA, 20 nt, Mycobacterium avium subsp. paratuberculosis
ggcgccggaucggcccccgg

SEQ ID NO: 944034 - RNA, 15 nt, Mycobacterium avium subsp. paratuberculosis
ggcgccggccagcac

SEQ ID NO: 944035 - RNA, 16 nt, Mycobacterium avium subsp. paratuberculosis
ggcgccggccagcacc

SEQ ID NO: 944036 - RNA, 19 nt, Mycobacterium avium subsp. paratuberculosis
ggcgccggccagcaccacg

SEQ ID NO: 944037 - RNA, 23 nt, Mycobacterium avium subsp. paratuberculosis
ggcgccggcacugcugcccgcga

SEQ ID NO: 944038 - RNA, 17 nt, Mycobacterium avium subsp. paratuberculosis
ggcgccggcauccagca

SEQ ID NO: 944039 - RNA, 19 nt, Mycobacterium avium subsp. paratuberculosis
ggcgccggcauccagcacg

SEQ ID NO: 944040 - RNA, 14 nt, Mycobacterium avium subsp. paratuberculosis
ggcgccggcaucga

SEQ ID NO: 944041 - RNA, 17 nt, Mycobacterium avium subsp. paratuberculosis
ggcgccggacggcccgc

SEQ ID NO: 944042 - RNA, 14 nt, Mycobacterium avium subsp. paratuberculosis
ggcgccggaucaug

SEQ ID NO: 944043 - RNA, 17 nt, Mycobacterium avium subsp. paratuberculosis
ggcgccggaucaugucg

SEQ ID NO: 944044 - RNA, 23 nt, Mycobacterium avium subsp. paratuberculosis
ggcgccgcucgaccccucggcau

SEQ ID NO: 944045 - RNA, 17 nt, Mycobacterium avium subsp. paratuberculosis
ggcgccgcugcgggcca

SEQ ID NO: 944046 - RNA, 21 nt, Mycobacterium avium subsp. paratuberculosis
ggcgccgcugcgggccaucga

SEQ ID NO: 944047 - RNA, 23 nt, Mycobacterium avium subsp. paratuberculosis
ggcgccgcugcgggccaucgacu

SEQ ID NO: 944048 - RNA, 17 nt, Mycobacterium avium subsp. paratuberculosis
ggcgccgcgggugcggc

SEQ ID NO: 944049 - RNA, 14 nt, Mycobacterium avium subsp. paratuberculosis
ggcgccgcgggcgc

SEQ ID NO: 944050 - RNA, 19 nt, Mycobacterium avium subsp. paratuberculosis
ggcgccgcgggcggucgcg

SEQ ID NO: 944051 - RNA, 22 nt, Mycobacterium avium subsp. paratuberculosis
ggcgccgacgaucccggcgagc

SEQ ID NO: 944052 - RNA, 12 nt, Mycobacterium avium subsp. paratuberculosis
ggcgccgcgggc

SEQ ID NO: 944053 - RNA, 13 nt, Mycobacterium avium subsp. paratuberculosis
ggcgccgcggccc

SEQ ID NO: 944054 - RNA, 14 nt, Mycobacterium avium subsp. paratuberculosis
ggcgccgcggcccu

SEQ ID NO: 944055 - RNA, 14 nt, Mycobacterium avium subsp. paratuberculosis
ggcgccgcggcgcc

SEQ ID NO: 944056 - RNA, 15 nt, Mycobacterium avium subsp. paratuberculosis
ggcgccgcggcggca

SEQ ID NO: 944057 - RNA, 19 nt, Mycobacterium avium subsp. paratuberculosis
ggcgccgcggcggcaccca

SEQ ID NO: 944058 - RNA, 16 nt, Mycobacterium avium subsp. paratuberculosis
ggcgccgcgcgccagc

SEQ ID NO: 944059 - RNA, 15 nt, Mycobacterium avium subsp. paratuberculosis
ggcgccgcgccggca

SEQ ID NO: 944060 - RNA, 13 nt, Mycobacterium avium subsp. paratuberculosis
ggcgccgcgcagc

SEQ ID NO: 944061 - RNA, 17 nt, Mycobacterium avium subsp. paratuberculosis
ggcgccgcgaccccgga

SEQ ID NO: 944062 - RNA, 16 nt, Mycobacterium avium subsp. paratuberculosis
ggcgccgccguucgcc

SEQ ID NO: 944063 - RNA, 21 nt, Mycobacterium avium subsp. paratuberculosis
ggcgccgccguucgccggcga

SEQ ID NO: 944064 - RNA, 17 nt, Mycobacterium avium subsp. paratuberculosis
ggcgccgccggcgucga

SEQ ID NO: 944065 - RNA, 14 nt, Mycobacterium avium subsp. paratuberculosis
ggcgccgaucacgc

SEQ ID NO: 944066 - RNA, 22 nt, Mycobacterium avium subsp. paratuberculosis
ggcgccgauuccgucgguggcg

SEQ ID NO: 944067 - RNA, 13 nt, Mycobacterium avium subsp. paratuberculosis
ggcgccgaucgcg

SEQ ID NO: 944068 - RNA, 16 nt, Mycobacterium avium subsp. paratuberculosis
ggcgccgaucgcgcgc

SEQ ID NO: 944069 - RNA, 17 nt, Mycobacterium avium subsp. paratuberculosis
ggcgccgaucgcgcgca

SEQ ID NO: 944070 - RNA, 21 nt, Mycobacterium avium subsp. paratuberculosis
ggcgccgaguccgggccgccg

SEQ ID NO: 944071 - RNA, 15 nt, Mycobacterium avium subsp. paratuberculosis
ggcgccgaugcagca

SEQ ID NO: 944072 - RNA, 20 nt, Mycobacterium avium subsp. paratuberculosis
ggcgccgaugcccgccccgg

SEQ ID NO: 944073 - RNA, 22 nt, Mycobacterium avium subsp. paratuberculosis
ggcgccgaugcccgccccggac

SEQ ID NO: 944074 - RNA, 18 nt, Mycobacterium avium subsp. paratuberculosis
ggcgccgagcgucacgcu

SEQ ID NO: 944075 - RNA, 19 nt, Mycobacterium avium subsp. paratuberculosis
ggcgccgagcgucacgcug

SEQ ID NO: 944076 - RNA, 15 nt, Mycobacterium avium subsp. paratuberculosis
ggcgccgagcgugaa

SEQ ID NO: 944077 - RNA, 17 nt, Mycobacterium avium subsp. paratuberculosis
ggcgccgacgggcccgc

SEQ ID NO: 944078 - RNA, 13 nt, Mycobacterium avium subsp. paratuberculosis
ggcgccgacgucc

SEQ ID NO: 944079 - RNA, 19 nt, Mycobacterium avium subsp. paratuberculosis
ggcgccgagaacaggccga

SEQ ID NO: 944080 - RNA, 19 nt, Mycobacterium avium subsp. paratuberculosis
ggcgccgaccucggccagc

SEQ ID NO: 944081 - RNA, 16 nt, Mycobacterium avium subsp. paratuberculosis
ggcgccgacgacgucg

SEQ ID NO: 944082 - RNA, 24 nt, Mycobacterium avium subsp. paratuberculosis
ggcgccgacgacgucgcgcaggua

SEQ ID NO: 944083 - RNA, 12 nt, Mycobacterium avium subsp. paratuberculosis
ggcgcccgaucg

SEQ ID NO: 944084 - RNA, 18 nt, Mycobacterium avium subsp. paratuberculosis
ggcgcccccgcgacgucc

SEQ ID NO: 944085 - RNA, 14 nt, Mycobacterium avium subsp. paratuberculosis
ggcgcccgacaucc

SEQ ID NO: 944086 - RNA, 17 nt, Mycobacterium avium subsp. paratuberculosis
ggcgccgacccccgccg

SEQ ID NO: 944087 - RNA, 13 nt, Mycobacterium avium subsp. paratuberculosis
ggcgccccgcccg

SEQ ID NO: 944088 - RNA, 14 nt, Mycobacterium avium subsp. paratuberculosis
ggcgccccgcccgc

SEQ ID NO: 944089 - RNA, 15 nt, Mycobacterium avium subsp. paratuberculosis
ggcgccccgcccgcg

SEQ ID NO: 944090 - RNA, 21 nt, Mycobacterium avium subsp. paratuberculosis
ggcgccaugaacuccgacucc

SEQ ID NO: 944091 - RNA, 21 nt, Mycobacterium avium subsp. paratuberculosis
ggcgcccagcgagcugccggc

SEQ ID NO: 944092 - RNA, 22 nt, Mycobacterium avium subsp. paratuberculosis
ggcgcccagcgagcugccggcg

SEQ ID NO: 944093 - RNA, 19 nt, Mycobacterium avium subsp. paratuberculosis
ggcgcccagcgucucggcg

SEQ ID NO: 944094 - RNA, 20 nt, Mycobacterium avium subsp. paratuberculosis
ggcgcccagcgucucggcgg

SEQ ID NO: 944095 - RNA, 14 nt, Mycobacterium avium subsp. paratuberculosis
ggcgcccagcgugg

SEQ ID NO: 944096 - RNA, 15 nt, Mycobacterium avium subsp. paratuberculosis
ggcgcccagcguggu

SEQ ID NO: 944097 - RNA, 17 nt, Mycobacterium avium subsp. paratuberculosis
ggcggcaaaacgcuggg

SEQ ID NO: 944098 - RNA, 18 nt, Mycobacterium avium subsp. paratuberculosis
ggcggcacgguuggccgg

SEQ ID NO: 944099 - RNA, 16 nt, Mycobacterium avium subsp. paratuberculosis
ggcggcaggucggcgg

SEQ ID NO: 944100 - RNA, 18 nt, Mycobacterium avium subsp. paratuberculosis
ggcggcaggugaaggugc

SEQ ID NO: 944101 - RNA, 14 nt, Mycobacterium avium subsp. paratuberculosis
ggcggcagcagcug

SEQ ID NO: 944102 - RNA, 14 nt, Mycobacterium avium subsp. paratuberculosis
ggcggcagccaggu

SEQ ID NO: 944103 - RNA, 18 nt, Mycobacterium avium subsp. paratuberculosis
ggcggccaucgccgcggu

SEQ ID NO: 944104 - RNA, 14 nt, Mycobacterium avium subsp. paratuberculosis
ggcggccaucgccg

SEQ ID NO: 944105 - RNA, 15 nt, Mycobacterium avium subsp. paratuberculosis
ggcggccaucgccgc

SEQ ID NO: 944106 - RNA, 19 nt, Mycobacterium avium subsp. paratuberculosis
ggcggccagggcggcgccg

SEQ ID NO: 944107 - RNA, 23 nt, Mycobacterium avium subsp. paratuberculosis
ggcggccaguucgagcgccgcgg

SEQ ID NO: 944108 - RNA, 21 nt, Mycobacterium avium subsp. paratuberculosis
ggcggccaguugacguugauc

SEQ ID NO: 944109 - RNA, 21 nt, Mycobacterium avium subsp. paratuberculosis
ggcggcagguggggcagcacc

SEQ ID NO: 944110 - RNA, 15 nt, Mycobacterium avium subsp. paratuberculosis
ggcggcaguccggcg

SEQ ID NO: 944111 - RNA, 22 nt, Mycobacterium avium subsp. paratuberculosis
ggcggcagugcgccgucccgga

SEQ ID NO: 944112 - RNA, 22 nt, Mycobacterium avium subsp. paratuberculosis
ggcggcauccccagcugggccg

SEQ ID NO: 944113 - RNA, 14 nt, Mycobacterium avium subsp. paratuberculosis
ggcggcaucgcgcc

SEQ ID NO: 944114 - RNA, 16 nt, Mycobacterium avium subsp. paratuberculosis
ggcggcaucgcgcgcg

SEQ ID NO: 944115 - RNA, 20 nt, Mycobacterium avium subsp. paratuberculosis
ggcggcaucgcgcgcggcgg

SEQ ID NO: 944116 - RNA, 23 nt, Mycobacterium avium subsp. paratuberculosis
ggcggcaucgcgcgcggcggcca

SEQ ID NO: 944117 - RNA, 14 nt, Mycobacterium avium subsp. paratuberculosis
ggcggccgccauca

SEQ ID NO: 944118 - RNA, 16 nt, Mycobacterium avium subsp. paratuberculosis
ggcggccgccgcccgc

SEQ ID NO: 944119 - RNA, 19 nt, Mycobacterium avium subsp. paratuberculosis
ggcggccgccgcccgcgcg

SEQ ID NO: 944120 - RNA, 14 nt, Mycobacterium avium subsp. paratuberculosis
ggcggccgccgcga

SEQ ID NO: 944121 - RNA, 12 nt, Mycobacterium avium subsp. paratuberculosis
ggcggccgccgg

SEQ ID NO: 944122 - RNA, 18 nt, Mycobacterium avium subsp. paratuberculosis
ggcggccgaauccggccg

SEQ ID NO: 944123 - RNA, 20 nt, Mycobacterium avium subsp. paratuberculosis
ggcggccgagcgcaccgcgg

SEQ ID NO: 944124 - RNA, 14 nt, Mycobacterium avium subsp. paratuberculosis
ggcggccgcagcgu

SEQ ID NO: 944125 - RNA, 17 nt, Mycobacterium avium subsp. paratuberculosis
ggcggccgccacgcugg

SEQ ID NO: 944126 - RNA, 23 nt, Mycobacterium avium subsp. paratuberculosis
ggcggccgccacgcuggugugac

SEQ ID NO: 944127 - RNA, 20 nt, Mycobacterium avium subsp. paratuberculosis
ggcggcccuucucggacgcc

SEQ ID NO: 944128 - RNA, 21 nt, Mycobacterium avium subsp. paratuberculosis
ggcggcccgaccagcgggccg

SEQ ID NO: 944129 - RNA, 23 nt, Mycobacterium avium subsp. paratuberculosis
ggcggcccguccgccccgcugcc

SEQ ID NO: 944130 - RNA, 14 nt, Mycobacterium avium subsp. paratuberculosis
ggcggcccgucgcc

SEQ ID NO: 944131 - RNA, 15 nt, Mycobacterium avium subsp. paratuberculosis
ggcggcccgucgcca

SEQ ID NO: 944132 - RNA, 23 nt, Mycobacterium avium subsp. paratuberculosis
ggcggcccgucgccaccacggcg

SEQ ID NO: 944133 - RNA, 22 nt, Mycobacterium avium subsp. paratuberculosis
ggcggcccggguggacgcccgc

SEQ ID NO: 944134 - RNA, 14 nt, Mycobacterium avium subsp. paratuberculosis
ggcggcccgcacgg

SEQ ID NO: 944135 - RNA, 17 nt, Mycobacterium avium subsp. paratuberculosis
ggcggcccgcacggccg

SEQ ID NO: 944136 - RNA, 20 nt, Mycobacterium avium subsp. paratuberculosis
ggcggcccgcacggccgcca

SEQ ID NO: 944137 - RNA, 21 nt, Mycobacterium avium subsp. paratuberculosis
ggcggcccgcaggaucgagcc

SEQ ID NO: 944138 - RNA, 19 nt, Mycobacterium avium subsp. paratuberculosis
ggcggcccgccgcgcccgg

SEQ ID NO: 944139 - RNA, 20 nt, Mycobacterium avium subsp. paratuberculosis
ggcggcccgccgcgcccggc

SEQ ID NO: 944140 - RNA, 17 nt, Mycobacterium avium subsp. paratuberculosis
ggcggcccgccucggcg

SEQ ID NO: 944141 - RNA, 23 nt, Mycobacterium avium subsp. paratuberculosis
ggcggcccgccucggcggccgcc

SEQ ID NO: 944142 - RNA, 15 nt, Mycobacterium avium subsp. paratuberculosis
ggcggcccgcgccgg

SEQ ID NO: 944143 - RNA, 17 nt, Mycobacterium avium subsp. paratuberculosis
ggcggcccgcgccggcg

SEQ ID NO: 944144 - RNA, 22 nt, Mycobacterium avium subsp. paratuberculosis
ggcggccccgggcgcuggcgau

SEQ ID NO: 944145 - RNA, 16 nt, Mycobacterium avium subsp. paratuberculosis
ggcggccccgguagcc

SEQ ID NO: 944146 - RNA, 20 nt, Mycobacterium avium subsp. paratuberculosis
ggcgcugguaguggcgugcg

SEQ ID NO: 944147 - RNA, 16 nt, Mycobacterium avium subsp. paratuberculosis
ggcgcugggugcgggc

SEQ ID NO: 944148 - RNA, 22 nt, Mycobacterium avium subsp. paratuberculosis
ggcgcuggguguuccccgggcg

SEQ ID NO: 944149 - RNA, 16 nt, Mycobacterium avium subsp. paratuberculosis
ggcgcuggucggcggg

SEQ ID NO: 944150 - RNA, 23 nt, Mycobacterium avium subsp. paratuberculosis
ggcgcuguaccgcgagaucagcg

SEQ ID NO: 944151 - RNA, 17 nt, Mycobacterium avium subsp. paratuberculosis
ggcgcuguccuggucgc

SEQ ID NO: 944152 - RNA, 18 nt, Mycobacterium avium subsp. paratuberculosis
ggcgcuugaccucgccga

SEQ ID NO: 944153 - RNA, 19 nt, Mycobacterium avium subsp. paratuberculosis
ggcgcuugcguucccagcc

SEQ ID NO: 944154 - RNA, 20 nt, Mycobacterium avium subsp. paratuberculosis
ggcgcuugcguucccagccc

SEQ ID NO: 944155 - RNA, 21 nt, Mycobacterium avium subsp. paratuberculosis
ggcgcuugcguucccagcccg

SEQ ID NO: 944156 - RNA, 22 nt, Mycobacterium avium subsp. paratuberculosis
ggcggaucgcgugcgucacgcu

SEQ ID NO: 944157 - RNA, 13 nt, Mycobacterium avium subsp. paratuberculosis
ggcggauuggugc

SEQ ID NO: 944158 - RNA, 14 nt, Mycobacterium avium subsp. paratuberculosis
ggcggauuggugcc

SEQ ID NO: 944159 - RNA, 20 nt, Mycobacterium avium subsp. paratuberculosis
ggcggaugugccuggcccag

SEQ ID NO: 944160 - RNA, 16 nt, Mycobacterium avium subsp. paratuberculosis
ggcggaugcgcuggug

SEQ ID NO: 944161 - RNA, 18 nt, Mycobacterium avium subsp. paratuberculosis
ggcggaugggugcgguug

SEQ ID NO: 944162 - RNA, 19 nt, Mycobacterium avium subsp. paratuberculosis
ggcggaucaguaccggcga

SEQ ID NO: 944163 - RNA, 19 nt, Mycobacterium avium subsp. paratuberculosis
ggcggauccagcaccgcca

SEQ ID NO: 944164 - RNA, 19 nt, Mycobacterium avium subsp. paratuberculosis
ggcggauccccgcgcuggg

SEQ ID NO: 944165 - RNA, 17 nt, Mycobacterium avium subsp. paratuberculosis
ggcggcgcagucggccg

SEQ ID NO: 944166 - RNA, 12 nt, Mycobacterium avium subsp. paratuberculosis
ggcggcgcagcc

SEQ ID NO: 944167 - RNA, 14 nt, Mycobacterium avium subsp. paratuberculosis
ggcggcgcccgaca

SEQ ID NO: 944168 - RNA, 14 nt, Mycobacterium avium subsp. paratuberculosis
ggcggcgcccgcgg

SEQ ID NO: 944169 - RNA, 20 nt, Mycobacterium avium subsp. paratuberculosis
ggcggcgcccgcggccucca

SEQ ID NO: 944170 - RNA, 14 nt, Mycobacterium avium subsp. paratuberculosis
ggcggcgcccugcg

SEQ ID NO: 944171 - RNA, 23 nt, Mycobacterium avium subsp. paratuberculosis
ggcggcgccgaaccgggugacga

SEQ ID NO: 944172 - RNA, 21 nt, Mycobacterium avium subsp. paratuberculosis
ggcggcgccgaacucggcgcc

SEQ ID NO: 944173 - RNA, 22 nt, Mycobacterium avium subsp. paratuberculosis
ggcggcgccgaacucggcgccg

SEQ ID NO: 944174 - RNA, 18 nt, Mycobacterium avium subsp. paratuberculosis
ggcggcgccgacgggccc

SEQ ID NO: 944175 - RNA, 15 nt, Mycobacterium avium subsp. paratuberculosis
ggcggcggggugacg

SEQ ID NO: 944176 - RNA, 20 nt, Mycobacterium avium subsp. paratuberculosis
ggcggcggggugacggucac

SEQ ID NO: 944177 - RNA, 23 nt, Mycobacterium avium subsp. paratuberculosis
ggcggcgggggcgagaccgucgg

SEQ ID NO: 944178 - RNA, 20 nt, Mycobacterium avium subsp. paratuberculosis
ggcggcgggggcgggcccca

SEQ ID NO: 944179 - RNA, 19 nt, Mycobacterium avium subsp. paratuberculosis
ggcggcggcugggccgcgg

SEQ ID NO: 944180 - RNA, 19 nt, Mycobacterium avium subsp. paratuberculosis
ggcggcgggagcuaggcgg

SEQ ID NO: 944181 - RNA, 22 nt, Mycobacterium avium subsp. paratuberculosis
ggcggcgggagcuaggcggccg

SEQ ID NO: 944182 - RNA, 12 nt, Mycobacterium avium subsp. paratuberculosis
ggcggcgggcca

SEQ ID NO: 944183 - RNA, 16 nt, Mycobacterium avium subsp. paratuberculosis
ggcggcgggcccggcg

SEQ ID NO: 944184 - RNA, 17 nt, Mycobacterium avium subsp. paratuberculosis
ggcggcgggcccggcga

SEQ ID NO: 944185 - RNA, 14 nt, Mycobacterium avium subsp. paratuberculosis
ggcggcggcguugg

SEQ ID NO: 944186 - RNA, 14 nt, Mycobacterium avium subsp. paratuberculosis
ggcggcggcggcag

SEQ ID NO: 944187 - RNA, 14 nt, Mycobacterium avium subsp. paratuberculosis
ggcggcggcggccg

SEQ ID NO: 944188 - RNA, 15 nt, Mycobacterium avium subsp. paratuberculosis
ggcggcggcgggcca

SEQ ID NO: 944189 - RNA, 16 nt, Mycobacterium avium subsp. paratuberculosis
ggcggcggcggucggc

SEQ ID NO: 944190 - RNA, 21 nt, Mycobacterium avium subsp. paratuberculosis
ggcggcgagcugaucggcguu

SEQ ID NO: 944191 - RNA, 20 nt, Mycobacterium avium subsp. paratuberculosis
ggcggcgaguccggccaggu

SEQ ID NO: 944192 - RNA, 17 nt, Mycobacterium avium subsp. paratuberculosis
ggcggcgaguucggcgg

SEQ ID NO: 944193 - RNA, 12 nt, Mycobacterium avium subsp. paratuberculosis
ggcggcgaucac

SEQ ID NO: 944194 - RNA, 13 nt, Mycobacterium avium subsp. paratuberculosis
ggcggcgaucgcc

SEQ ID NO: 944195 - RNA, 20 nt, Mycobacterium avium subsp. paratuberculosis
ggcggcgaucggcgcggcga

SEQ ID NO: 944196 - RNA, 17 nt, Mycobacterium avium subsp. paratuberculosis
ggcggccuucuuggccg

SEQ ID NO: 944197 - RNA, 18 nt, Mycobacterium avium subsp. paratuberculosis
ggcggccugcacccaggu

SEQ ID NO: 944198 - RNA, 20 nt, Mycobacterium avium subsp. paratuberculosis
ggcggccuggccgucgcggc

SEQ ID NO: 944199 - RNA, 21 nt, Mycobacterium avium subsp. paratuberculosis
ggcggccuggccgucgcggcg

SEQ ID NO: 944200 - RNA, 16 nt, Mycobacterium avium subsp. paratuberculosis
ggcggccugccggccg

SEQ ID NO: 944201 - RNA, 23 nt, Mycobacterium avium subsp. paratuberculosis
ggcggccugccggccgccgcgca

SEQ ID NO: 944202 - RNA, 12 nt, Mycobacterium avium subsp. paratuberculosis
ggcggccugcgc

SEQ ID NO: 944203 - RNA, 14 nt, Mycobacterium avium subsp. paratuberculosis
ggcggccugcggcg

SEQ ID NO: 944204 - RNA, 17 nt, Mycobacterium avium subsp. paratuberculosis
ggcggccugcggcggca

SEQ ID NO: 944205 - RNA, 15 nt, Mycobacterium avium subsp. paratuberculosis
ggcggccugcucgaa

SEQ ID NO: 944206 - RNA, 21 nt, Mycobacterium avium subsp. paratuberculosis
ggcggccugcuucucgccguc

SEQ ID NO: 944207 - RNA, 18 nt, Mycobacterium avium subsp. paratuberculosis
ggcggccugcuugaccgc

SEQ ID NO: 944208 - RNA, 20 nt, Mycobacterium avium subsp. paratuberculosis
ggcggccugcuugaccgcca

SEQ ID NO: 944209 - RNA, 22 nt, Mycobacterium avium subsp. paratuberculosis
ggcggccugcuugaccgccaga

SEQ ID NO: 944210 - RNA, 19 nt, Mycobacterium avium subsp. paratuberculosis
ggcggccgcgucgccgauc

SEQ ID NO: 944211 - RNA, 22 nt, Mycobacterium avium subsp. paratuberculosis
ggcggccgcgucggcggucgcc

SEQ ID NO: 944212 - RNA, 15 nt, Mycobacterium avium subsp. paratuberculosis
ggcggccucggcguc

SEQ ID NO: 944213 - RNA, 20 nt, Mycobacterium avium subsp. paratuberculosis
ggcggccucggcguccgcgg

SEQ ID NO: 944214 - RNA, 15 nt, Mycobacterium avium subsp. paratuberculosis
ggcggccgcgacgga

SEQ ID NO: 944215 - RNA, 14 nt, Mycobacterium avium subsp. paratuberculosis
ggcggccgcgagcc

SEQ ID NO: 944216 - RNA, 18 nt, Mycobacterium avium subsp. paratuberculosis
ggcggccgcggacccgac

SEQ ID NO: 944217 - RNA, 13 nt, Mycobacterium avium subsp. paratuberculosis
ggcggccgcggau

SEQ ID NO: 944218 - RNA, 22 nt, Mycobacterium avium subsp. paratuberculosis
ggcggccucggugcucaucagc

SEQ ID NO: 944219 - RNA, 16 nt, Mycobacterium avium subsp. paratuberculosis
ggcggccucggugguc

SEQ ID NO: 944220 - RNA, 23 nt, Mycobacterium avium subsp. paratuberculosis
ggcggcguagucgccgguguaga

SEQ ID NO: 944221 - RNA, 18 nt, Mycobacterium avium subsp. paratuberculosis
ggcggcguagucggcgca

SEQ ID NO: 944222 - RNA, 20 nt, Mycobacterium avium subsp. paratuberculosis
ggcggcguagucggcgcagc

SEQ ID NO: 944223 - RNA, 13 nt, Mycobacterium avium subsp. paratuberculosis
ggcggcgguggcc

SEQ ID NO: 944224 - RNA, 18 nt, Mycobacterium avium subsp. paratuberculosis
ggcggcgguggcgaugac

SEQ ID NO: 944225 - RNA, 12 nt, Mycobacterium avium subsp. paratuberculosis
ggcggcgguuuc

SEQ ID NO: 944226 - RNA, 20 nt, Mycobacterium avium subsp. paratuberculosis
ggcggcggucuucuuggcgg

SEQ ID NO: 944227 - RNA, 13 nt, Mycobacterium avium subsp. paratuberculosis
ggcggcggugagc

SEQ ID NO: 944228 - RNA, 15 nt, Mycobacterium avium subsp. paratuberculosis
ggcggcggugagcgc

SEQ ID NO: 944229 - RNA, 13 nt, Mycobacterium avium subsp. paratuberculosis
ggcggcggugauc

SEQ ID NO: 944230 - RNA, 16 nt, Mycobacterium avium subsp. paratuberculosis
ggcggcggugaucgcc

SEQ ID NO: 944231 - RNA, 24 nt, Mycobacterium avium subsp. paratuberculosis
ggcggcggugaucgccggaucgcc

SEQ ID NO: 944232 - RNA, 15 nt, Mycobacterium avium subsp. paratuberculosis
ggcggcggucggcau

SEQ ID NO: 944233 - RNA, 12 nt, Mycobacterium avium subsp. paratuberculosis
ggcggcggugcc

SEQ ID NO: 944234 - RNA, 14 nt, Mycobacterium avium subsp. paratuberculosis
ggcggcggugccgc

SEQ ID NO: 944235 - RNA, 18 nt, Mycobacterium avium subsp. paratuberculosis
ggcggcggugccgcaggc

SEQ ID NO: 944236 - RNA, 23 nt, Mycobacterium avium subsp. paratuberculosis
ggcggcgucccagugcucgacca

SEQ ID NO: 944237 - RNA, 15 nt, Mycobacterium avium subsp. paratuberculosis
ggcggcgucgagcac

SEQ ID NO: 944238 - RNA, 22 nt, Mycobacterium avium subsp. paratuberculosis
ggcggcgucgaugucgcccggc

SEQ ID NO: 944239 - RNA, 14 nt, Mycobacterium avium subsp. paratuberculosis
ggcggcguccgcgg

SEQ ID NO: 944240 - RNA, 19 nt, Mycobacterium avium subsp. paratuberculosis
ggcggcguccgcggccgcg

SEQ ID NO: 944241 - RNA, 20 nt, Mycobacterium avium subsp. paratuberculosis
ggcggcguccgcggccgcgg

SEQ ID NO: 944242 - RNA, 16 nt, Mycobacterium avium subsp. paratuberculosis
ggcggcgucgaccgcc

SEQ ID NO: 944243 - RNA, 22 nt, Mycobacterium avium subsp. paratuberculosis
ggcggcgucgaccgccccgccg

SEQ ID NO: 944244 - RNA, 15 nt, Mycobacterium avium subsp. paratuberculosis
ggcggcgucggcgac

SEQ ID NO: 944245 - RNA, 23 nt, Mycobacterium avium subsp. paratuberculosis
ggcggcgucggcgacggcgucca

SEQ ID NO: 944246 - RNA, 14 nt, Mycobacterium avium subsp. paratuberculosis
ggcggcgucggcgu

SEQ ID NO: 944247 - RNA, 13 nt, Mycobacterium avium subsp. paratuberculosis
ggcggcgucgucg

SEQ ID NO: 944248 - RNA, 15 nt, Mycobacterium avium subsp. paratuberculosis
ggcggcgucgucgcc

SEQ ID NO: 944249 - RNA, 15 nt, Mycobacterium avium subsp. paratuberculosis
ggcggcgucgugacc

SEQ ID NO: 944250 - RNA, 22 nt, Mycobacterium avium subsp. paratuberculosis
ggcggcugaaccaccgcgccca

SEQ ID NO: 944251 - RNA, 15 nt, Mycobacterium avium subsp. paratuberculosis
ggcgggccgcccggc

SEQ ID NO: 944252 - RNA, 16 nt, Mycobacterium avium subsp. paratuberculosis
ggcgggccgcccggcg

SEQ ID NO: 944253 - RNA, 13 nt, Mycobacterium avium subsp. paratuberculosis
ggcgggccgccgg

SEQ ID NO: 944254 - RNA, 15 nt, Mycobacterium avium subsp. paratuberculosis
ggcgggccgccgggu

SEQ ID NO: 944255 - RNA, 19 nt, Mycobacterium avium subsp. paratuberculosis
ggcgggccagcucgaaccu

SEQ ID NO: 944256 - RNA, 15 nt, Mycobacterium avium subsp. paratuberculosis
ggcgggccagucgcc

SEQ ID NO: 944257 - RNA, 15 nt, Mycobacterium avium subsp. paratuberculosis
ggcgggcccagcaga

SEQ ID NO: 944258 - RNA, 15 nt, Mycobacterium avium subsp. paratuberculosis
ggcgggcccggcgau

SEQ ID NO: 944259 - RNA, 12 nt, Mycobacterium avium subsp. paratuberculosis
ggcgggcccggg

SEQ ID NO: 944260 - RNA, 14 nt, Mycobacterium avium subsp. paratuberculosis
ggcgggcccgggcg

SEQ ID NO: 944261 - RNA, 21 nt, Mycobacterium avium subsp. paratuberculosis
ggcgggcccgucgccggcgcg

SEQ ID NO: 944262 - RNA, 19 nt, Mycobacterium avium subsp. paratuberculosis
ggcgggaaaccaccugccg

SEQ ID NO: 944263 - RNA, 14 nt, Mycobacterium avium subsp. paratuberculosis
ggcgggcaggccga

SEQ ID NO: 944264 - RNA, 17 nt, Mycobacterium avium subsp. paratuberculosis
ggcgggcagguucauca

SEQ ID NO: 944265 - RNA, 23 nt, Mycobacterium avium subsp. paratuberculosis
ggcgggcagguucaucaccacga

SEQ ID NO: 944266 - RNA, 13 nt, Mycobacterium avium subsp. paratuberculosis
ggcgggcauacug

SEQ ID NO: 944267 - RNA, 22 nt, Mycobacterium avium subsp. paratuberculosis
ggcgggcauacugcuugccguc

SEQ ID NO: 944268 - RNA, 15 nt, Mycobacterium avium subsp. paratuberculosis
ggcggcugggcagcc

SEQ ID NO: 944269 - RNA, 20 nt, Mycobacterium avium subsp. paratuberculosis
ggcggcugggcagccgcgcg

SEQ ID NO: 944270 - RNA, 21 nt, Mycobacterium avium subsp. paratuberculosis
ggcggcugggccgcggcgccg

SEQ ID NO: 944271 - RNA, 13 nt, Mycobacterium avium subsp. paratuberculosis
ggcgcuacgcgcc

SEQ ID NO: 944272 - RNA, 15 nt, Mycobacterium avium subsp. paratuberculosis
ggcgcuacgcgccua

SEQ ID NO: 944273 - RNA, 13 nt, Mycobacterium avium subsp. paratuberculosis
ggcgcucccgaug

SEQ ID NO: 944274 - RNA, 20 nt, Mycobacterium avium subsp. paratuberculosis
ggcgcucccgauggcucgcg

SEQ ID NO: 944275 - RNA, 18 nt, Mycobacterium avium subsp. paratuberculosis
ggcgcuaaagccaccagc

SEQ ID NO: 944276 - RNA, 17 nt, Mycobacterium avium subsp. paratuberculosis
ggcgcuaaagccgaccg

SEQ ID NO: 944277 - RNA, 23 nt, Mycobacterium avium subsp. paratuberculosis
ggcgcuaaagccgaccgccccgc

SEQ ID NO: 944278 - RNA, 14 nt, Mycobacterium avium subsp. paratuberculosis
ggcgcguuggcccg

SEQ ID NO: 944279 - RNA, 19 nt, Mycobacterium avium subsp. paratuberculosis
ggcgcguuggccggcugga

SEQ ID NO: 944280 - RNA, 17 nt, Mycobacterium avium subsp. paratuberculosis
ggcgcguuccaucagcg

SEQ ID NO: 944281 - RNA, 22 nt, Mycobacterium avium subsp. paratuberculosis
ggcgcguuccaucagcgcccgc

SEQ ID NO: 944282 - RNA, 23 nt, Mycobacterium avium subsp. paratuberculosis
ggcgcguuccaucagcgcccgcg

SEQ ID NO: 944283 - RNA, 19 nt, Mycobacterium avium subsp. paratuberculosis
ggcgcguugaugccgugcg

SEQ ID NO: 944284 - RNA, 21 nt, Mycobacterium avium subsp. paratuberculosis
ggcgcugaacugcucgaccag

SEQ ID NO: 944285 - RNA, 14 nt, Mycobacterium avium subsp. paratuberculosis
ggcgcucgucgaug

SEQ ID NO: 944286 - RNA, 14 nt, Mycobacterium avium subsp. paratuberculosis
ggcgcucggcccgc

SEQ ID NO: 944287 - RNA, 21 nt, Mycobacterium avium subsp. paratuberculosis
ggcgcucgcacaacccgcccg

SEQ ID NO: 944288 - RNA, 12 nt, Mycobacterium avium subsp. paratuberculosis
ggcgcucgccgc

SEQ ID NO: 944289 - RNA, 13 nt, Mycobacterium avium subsp. paratuberculosis
ggcgcucgccgcg

SEQ ID NO: 944290 - RNA, 20 nt, Mycobacterium avium subsp. paratuberculosis
ggcgcuccagccacuccacc

SEQ ID NO: 944291 - RNA, 22 nt, Mycobacterium avium subsp. paratuberculosis
ggcgcuccagccacuccaccac

SEQ ID NO: 944292 - RNA, 18 nt, Mycobacterium avium subsp. paratuberculosis
ggcgcuccagcgggcggc

SEQ ID NO: 944293 - RNA, 17 nt, Mycobacterium avium subsp. paratuberculosis
ggcgcugagcggguaac

SEQ ID NO: 944294 - RNA, 16 nt, Mycobacterium avium subsp. paratuberculosis
ggcgcugcccgccgcg

SEQ ID NO: 944295 - RNA, 19 nt, Mycobacterium avium subsp. paratuberculosis
ggcgcugcccgcgaucgcc

SEQ ID NO: 944296 - RNA, 16 nt, Mycobacterium avium subsp. paratuberculosis
ggcgcugcagcagccc

SEQ ID NO: 944297 - RNA, 17 nt, Mycobacterium avium subsp. paratuberculosis
ggcgcugcagcagcccg

SEQ ID NO: 944298 - RNA, 22 nt, Mycobacterium avium subsp. paratuberculosis
ggcgcugaucgaguccucgcgg

SEQ ID NO: 944299 - RNA, 14 nt, Mycobacterium avium subsp. paratuberculosis
ggcgcugcgcggug

SEQ ID NO: 944300 - RNA, 15 nt, Mycobacterium avium subsp. paratuberculosis
ggcgcugcgcggugg

SEQ ID NO: 944301 - RNA, 18 nt, Mycobacterium avium subsp. paratuberculosis
ggcgcugcgcgguggcgc

SEQ ID NO: 944302 - RNA, 12 nt, Mycobacterium avium subsp. paratuberculosis
ggcgcugccguc

SEQ ID NO: 944303 - RNA, 14 nt, Mycobacterium avium subsp. paratuberculosis
ggcgcugccguccu

SEQ ID NO: 944304 - RNA, 16 nt, Mycobacterium avium subsp. paratuberculosis
ggcgcugccgagcacc

SEQ ID NO: 944305 - RNA, 14 nt, Mycobacterium avium subsp. paratuberculosis
ggcgcugcccgucg

SEQ ID NO: 944306 - RNA, 13 nt, Mycobacterium avium subsp. paratuberculosis
ggcgcugccgccg

SEQ ID NO: 944307 - RNA, 17 nt, Mycobacterium avium subsp. paratuberculosis
ggcgcugccgccggccu

SEQ ID NO: 944308 - RNA, 15 nt, Mycobacterium avium subsp. paratuberculosis
ggcgcugccggcgca

SEQ ID NO: 944309 - RNA, 20 nt, Mycobacterium avium subsp. paratuberculosis
ggcgcugccggcgcacccgc

SEQ ID NO: 944310 - RNA, 22 nt, Mycobacterium avium subsp. paratuberculosis
ggcgcugccggugcugcucgag

SEQ ID NO: 944311 - RNA, 12 nt, Mycobacterium avium subsp. paratuberculosis
ggcgcugcucgg

SEQ ID NO: 944312 - RNA, 20 nt, Mycobacterium avium subsp. paratuberculosis
ggcgcugcgcuucgagcaga

SEQ ID NO: 944313 - RNA, 14 nt, Mycobacterium avium subsp. paratuberculosis
ggcgcugcgcgaca

SEQ ID NO: 944314 - RNA, 12 nt, Mycobacterium avium subsp. paratuberculosis
ggcgcugaugcc

SEQ ID NO: 944315 - RNA, 13 nt, Mycobacterium avium subsp. paratuberculosis
ggcgcugcgcccg

SEQ ID NO: 944316 - RNA, 14 nt, Mycobacterium avium subsp. paratuberculosis
ggcgcuggcgugcu

SEQ ID NO: 944317 - RNA, 16 nt, Mycobacterium avium subsp. paratuberculosis
ggcgcugggagcgggc

SEQ ID NO: 944318 - RNA, 17 nt, Mycobacterium avium subsp. paratuberculosis
ggcgcugggagcgggcc

SEQ ID NO: 944319 - RNA, 18 nt, Mycobacterium avium subsp. paratuberculosis
ggcgcugggagcgggcca

SEQ ID NO: 944320 - RNA, 13 nt, Mycobacterium avium subsp. paratuberculosis
ggcgcuggcgcgc

SEQ ID NO: 944321 - RNA, 21 nt, Mycobacterium avium subsp. paratuberculosis
ggcgcuggccgcggccagcug

SEQ ID NO: 944322 - RNA, 15 nt, Mycobacterium avium subsp. paratuberculosis
ggcgcuggccagcgc

SEQ ID NO: 944323 - RNA, 19 nt, Mycobacterium avium subsp. paratuberculosis
ggcgcuggccagcgcgacg

SEQ ID NO: 944324 - RNA, 14 nt, Mycobacterium avium subsp. paratuberculosis
ggcgcuggccagcg

SEQ ID NO: 944325 - RNA, 21 nt, Mycobacterium avium subsp. paratuberculosis
ggcgcggauggguggcgauca

SEQ ID NO: 944326 - RNA, 14 nt, Mycobacterium avium subsp. paratuberculosis
ggcgcgggccagca

SEQ ID NO: 944327 - RNA, 15 nt, Mycobacterium avium subsp. paratuberculosis
ggcgcggggccacca

SEQ ID NO: 944328 - RNA, 19 nt, Mycobacterium avium subsp. paratuberculosis
ggcgcgggcggcgcgguug

SEQ ID NO: 944329 - RNA, 13 nt, Mycobacterium avium subsp. paratuberculosis
ggcgcgggcggca

SEQ ID NO: 944330 - RNA, 23 nt, Mycobacterium avium subsp. paratuberculosis
ggcgcggcuuuuggcgucguuga

SEQ ID NO: 944331 - RNA, 15 nt, Mycobacterium avium subsp. paratuberculosis
ggcgcgggaucggug

SEQ ID NO: 944332 - RNA, 19 nt, Mycobacterium avium subsp. paratuberculosis
ggcgcgggaucggugccga

SEQ ID NO: 944333 - RNA, 20 nt, Mycobacterium avium subsp. paratuberculosis
ggcgcggaucucgcgcaggu

SEQ ID NO: 944334 - RNA, 17 nt, Mycobacterium avium subsp. paratuberculosis
ggcgcggaugacgugca

SEQ ID NO: 944335 - RNA, 18 nt, Mycobacterium avium subsp. paratuberculosis
ggcgcggaucgucaccga

SEQ ID NO: 944336 - RNA, 20 nt, Mycobacterium avium subsp. paratuberculosis
ggcgcggaucgucaccgacc

SEQ ID NO: 944337 - RNA, 19 nt, Mycobacterium avium subsp. paratuberculosis
ggcgcggagccggccgccg

SEQ ID NO: 944338 - RNA, 21 nt, Mycobacterium avium subsp. paratuberculosis
ggcgcggagccggccgccgaa

SEQ ID NO: 944339 - RNA, 23 nt, Mycobacterium avium subsp. paratuberculosis
ggcgcggagccggccgccgaagc

SEQ ID NO: 944340 - RNA, 16 nt, Mycobacterium avium subsp. paratuberculosis
ggcgcggacagcgcgg

SEQ ID NO: 944341 - RNA, 21 nt, Mycobacterium avium subsp. paratuberculosis
ggcgcggacagcgcggugaug

SEQ ID NO: 944342 - RNA, 15 nt, Mycobacterium avium subsp. paratuberculosis
ggcgcggaccgcacc

SEQ ID NO: 944343 - RNA, 16 nt, Mycobacterium avium subsp. paratuberculosis
ggcgcggaccgcaccc

SEQ ID NO: 944344 - RNA, 13 nt, Mycobacterium avium subsp. paratuberculosis
ggcgcggacguga

SEQ ID NO: 944345 - RNA, 17 nt, Mycobacterium avium subsp. paratuberculosis
ggcgcgguugucguuga

SEQ ID NO: 944346 - RNA, 20 nt, Mycobacterium avium subsp. paratuberculosis
ggcgcggugcucggcgcgcg

SEQ ID NO: 944347 - RNA, 16 nt, Mycobacterium avium subsp. paratuberculosis
ggcgcgguggcgugca

SEQ ID NO: 944348 - RNA, 15 nt, Mycobacterium avium subsp. paratuberculosis
ggcgcgguugaccgc

SEQ ID NO: 944349 - RNA, 20 nt, Mycobacterium avium subsp. paratuberculosis
ggcgcgguugaccgccgaca

SEQ ID NO: 944350 - RNA, 17 nt, Mycobacterium avium subsp. paratuberculosis
ggcgcggugcgccgaca

SEQ ID NO: 944351 - RNA, 21 nt, Mycobacterium avium subsp. paratuberculosis
ggcgcggugcgccgacagcug

SEQ ID NO: 944352 - RNA, 16 nt, Mycobacterium avium subsp. paratuberculosis
ggcgcggucgguggcg

SEQ ID NO: 944353 - RNA, 22 nt, Mycobacterium avium subsp. paratuberculosis
ggcgcggucgaaaaaugcggaa

SEQ ID NO: 944354 - RNA, 18 nt, Mycobacterium avium subsp. paratuberculosis
ggcgcgguccacggucag

SEQ ID NO: 944355 - RNA, 19 nt, Mycobacterium avium subsp. paratuberculosis
ggcgcgguccacggucagc

SEQ ID NO: 944356 - RNA, 20 nt, Mycobacterium avium subsp. paratuberculosis
ggcgcgguccacggucagcg

SEQ ID NO: 944357 - RNA, 18 nt, Mycobacterium avium subsp. paratuberculosis
ggcgcgggucgcgguucg

SEQ ID NO: 944358 - RNA, 17 nt, Mycobacterium avium subsp. paratuberculosis
ggcgcgggucgcuggcc

SEQ ID NO: 944359 - RNA, 18 nt, Mycobacterium avium subsp. paratuberculosis
ggcgcgggucgcuggccg

SEQ ID NO: 944360 - RNA, 21 nt, Mycobacterium avium subsp. paratuberculosis
ggcgcgggucgcuggccgcga

SEQ ID NO: 944361 - RNA, 16 nt, Mycobacterium avium subsp. paratuberculosis
ggcgcgcguagcgcag

SEQ ID NO: 944362 - RNA, 14 nt, Mycobacterium avium subsp. paratuberculosis
ggcgcgcggccagc

SEQ ID NO: 944363 - RNA, 21 nt, Mycobacterium avium subsp. paratuberculosis
ggcgcgcgcuggugcgggcca

SEQ ID NO: 944364 - RNA, 21 nt, Mycobacterium avium subsp. paratuberculosis
ggcgcgcggagaucaccccug

SEQ ID NO: 944365 - RNA, 13 nt, Mycobacterium avium subsp. paratuberculosis
ggcgcgcgcgcca

SEQ ID NO: 944366 - RNA, 16 nt, Mycobacterium avium subsp. paratuberculosis
ggcgcgcucggugcug

SEQ ID NO: 944367 - RNA, 14 nt, Mycobacterium avium subsp. paratuberculosis
ggcgcgcucggugg

SEQ ID NO: 944368 - RNA, 17 nt, Mycobacterium avium subsp. paratuberculosis
ggcgcgcucgguggaca

SEQ ID NO: 944369 - RNA, 14 nt, Mycobacterium avium subsp. paratuberculosis
ggcgcgcucgucgu

SEQ ID NO: 944370 - RNA, 18 nt, Mycobacterium avium subsp. paratuberculosis
ggcgcgcucuaacuccgc

SEQ ID NO: 944371 - RNA, 19 nt, Mycobacterium avium subsp. paratuberculosis
ggcgcgcugaagcgcgacc

SEQ ID NO: 944372 - RNA, 22 nt, Mycobacterium avium subsp. paratuberculosis
ggcgcgcuuggucuuucgcgcu

SEQ ID NO: 944373 - RNA, 14 nt, Mycobacterium avium subsp. paratuberculosis
ggcgcgaaccgggc

SEQ ID NO: 944374 - RNA, 16 nt, Mycobacterium avium subsp. paratuberculosis
ggcgcgaaccgggcca

SEQ ID NO: 944375 - RNA, 14 nt, Mycobacterium avium subsp. paratuberculosis
ggcgcgaacgcagu

SEQ ID NO: 944376 - RNA, 16 nt, Mycobacterium avium subsp. paratuberculosis
ggcgcgaacagcgccg

SEQ ID NO: 944377 - RNA, 19 nt, Mycobacterium avium subsp. paratuberculosis
ggcgcgaacagcgccgacu

SEQ ID NO: 944378 - RNA, 20 nt, Mycobacterium avium subsp. paratuberculosis
ggcgccuugaaccggcugga

SEQ ID NO: 944379 - RNA, 23 nt, Mycobacterium avium subsp. paratuberculosis
ggcgccuugaaccggcuggacac

SEQ ID NO: 944380 - RNA, 16 nt, Mycobacterium avium subsp. paratuberculosis
ggcgcgaagguggcgc

SEQ ID NO: 944381 - RNA, 21 nt, Mycobacterium avium subsp. paratuberculosis
ggcgcgaccacauaccgggac

SEQ ID NO: 944382 - RNA, 14 nt, Mycobacterium avium subsp. paratuberculosis
ggcgcgacaccgcg

SEQ ID NO: 944383 - RNA, 16 nt, Mycobacterium avium subsp. paratuberculosis
ggcgcgaccagcggca

SEQ ID NO: 944384 - RNA, 17 nt, Mycobacterium avium subsp. paratuberculosis
ggcgcgaccagcggcag

SEQ ID NO: 944385 - RNA, 22 nt, Mycobacterium avium subsp. paratuberculosis
ggcgcgaccagcggcagcagca

SEQ ID NO: 944386 - RNA, 22 nt, Mycobacterium avium subsp. paratuberculosis
ggcgcgaccagguucucggugg

SEQ ID NO: 944387 - RNA, 17 nt, Mycobacterium avium subsp. paratuberculosis
ggaugaagugacuggcg

SEQ ID NO: 944388 - RNA, 16 nt, Mycobacterium avium subsp. paratuberculosis
ggaugaccaagccccg

SEQ ID NO: 944389 - RNA, 16 nt, Mycobacterium avium subsp. paratuberculosis
ggaugaccaggucgcc

SEQ ID NO: 944390 - RNA, 22 nt, Mycobacterium avium subsp. paratuberculosis
ggaugaccgcccaggacccgua

SEQ ID NO: 944391 - RNA, 17 nt, Mycobacterium avium subsp. paratuberculosis
ggaugaccgcgucggcg

SEQ ID NO: 944392 - RNA, 18 nt, Mycobacterium avium subsp. paratuberculosis
ggaugaccgcgucggcgc

SEQ ID NO: 944393 - RNA, 19 nt, Mycobacterium avium subsp. paratuberculosis
ggaugaccgcgucggcgcc

SEQ ID NO: 944394 - RNA, 24 nt, Mycobacterium avium subsp. paratuberculosis
ggaucuugguguccagcggcucgg

SEQ ID NO: 944395 - RNA, 18 nt, Mycobacterium avium subsp. paratuberculosis
ggaucuugucggcggccu

SEQ ID NO: 944396 - RNA, 23 nt, Mycobacterium avium subsp. paratuberculosis
ggaucuugaucgcgaagaccagc

SEQ ID NO: 944397 - RNA, 23 nt, Mycobacterium avium subsp. paratuberculosis
ggaucuugccgucggccgccgac

SEQ ID NO: 944398 - RNA, 18 nt, Mycobacterium avium subsp. paratuberculosis
ggaugacgugcaccaccg

SEQ ID NO: 944399 - RNA, 17 nt, Mycobacterium avium subsp. paratuberculosis
ggaugacgacggucacc

SEQ ID NO: 944400 - RNA, 18 nt, Mycobacterium avium subsp. paratuberculosis
ggaugacgcagccgaugu

SEQ ID NO: 944401 - RNA, 18 nt, Mycobacterium avium subsp. paratuberculosis
ggaugaugccggcggugu

SEQ ID NO: 944402 - RNA, 20 nt, Mycobacterium avium subsp. paratuberculosis
ggaugauguucuccggcccg

SEQ ID NO: 944403 - RNA, 21 nt, Mycobacterium avium subsp. paratuberculosis
ggaugauguucuccggcccgg

SEQ ID NO: 944404 - RNA, 22 nt, Mycobacterium avium subsp. paratuberculosis
ggaugauguucuccggcccggc

SEQ ID NO: 944405 - RNA, 15 nt, Mycobacterium avium subsp. paratuberculosis
ggaucucgcgggccc

SEQ ID NO: 944406 - RNA, 14 nt, Mycobacterium avium subsp. paratuberculosis
ggaucuggccggug

SEQ ID NO: 944407 - RNA, 13 nt, Mycobacterium avium subsp. paratuberculosis
ggaucuggugcgc

SEQ ID NO: 944408 - RNA, 19 nt, Mycobacterium avium subsp. paratuberculosis
ggaucugcacgucggcggc

SEQ ID NO: 944409 - RNA, 14 nt, Mycobacterium avium subsp. paratuberculosis
ggaucugcgccgcc

SEQ ID NO: 944410 - RNA, 13 nt, Mycobacterium avium subsp. paratuberculosis
ggaucgucaccga

SEQ ID NO: 944411 - RNA, 16 nt, Mycobacterium avium subsp. paratuberculosis
ggaucguguggccgcc

SEQ ID NO: 944412 - RNA, 14 nt, Mycobacterium avium subsp. paratuberculosis
ggaucuccggccgg

SEQ ID NO: 944413 - RNA, 16 nt, Mycobacterium avium subsp. paratuberculosis
ggaucuccggccggug

SEQ ID NO: 944414 - RNA, 15 nt, Mycobacterium avium subsp. paratuberculosis
ggaucggggugccgc

SEQ ID NO: 944415 - RNA, 18 nt, Mycobacterium avium subsp. paratuberculosis
ggaucggggugccgccgg

SEQ ID NO: 944416 - RNA, 23 nt, Mycobacterium avium subsp. paratuberculosis
ggaucggcuagcagcuccggucg

SEQ ID NO: 944417 - RNA, 15 nt, Mycobacterium avium subsp. paratuberculosis
ggaucgggcguggcg

SEQ ID NO: 944418 - RNA, 16 nt, Mycobacterium avium subsp. paratuberculosis
ggaucggccgcgucgg

SEQ ID NO: 944419 - RNA, 20 nt, Mycobacterium avium subsp. paratuberculosis
ggaucgcgggcgacccgcug

SEQ ID NO: 944420 - RNA, 12 nt, Mycobacterium avium subsp. paratuberculosis
ggaucgcggcgg

SEQ ID NO: 944421 - RNA, 12 nt, Mycobacterium avium subsp. paratuberculosis
ggaucgcgcagc

SEQ ID NO: 944422 - RNA, 16 nt, Mycobacterium avium subsp. paratuberculosis
ggaucgcgcagccgcg

SEQ ID NO: 944423 - RNA, 20 nt, Mycobacterium avium subsp. paratuberculosis
ggaucgcgcagccgcggugg

SEQ ID NO: 944424 - RNA, 15 nt, Mycobacterium avium subsp. paratuberculosis
ggaucgcgcagguga

SEQ ID NO: 944425 - RNA, 18 nt, Mycobacterium avium subsp. paratuberculosis
ggaucggcgggacccgcg

SEQ ID NO: 944426 - RNA, 19 nt, Mycobacterium avium subsp. paratuberculosis
ggaucggcgggcgccgaau

SEQ ID NO: 944427 - RNA, 17 nt, Mycobacterium avium subsp. paratuberculosis
ggaucggcugcgggcca

SEQ ID NO: 944428 - RNA, 18 nt, Mycobacterium avium subsp. paratuberculosis
ggaucggcugcgggccag

SEQ ID NO: 944429 - RNA, 22 nt, Mycobacterium avium subsp. paratuberculosis
ggaucggcuuggugggcgccgg

SEQ ID NO: 944430 - RNA, 19 nt, Mycobacterium avium subsp. paratuberculosis
ggaucggcgcgucggcguc

SEQ ID NO: 944431 - RNA, 22 nt, Mycobacterium avium subsp. paratuberculosis
ggaucgcuugaccagcaacacc

SEQ ID NO: 944432 - RNA, 18 nt, Mycobacterium avium subsp. paratuberculosis
ggaucggccagcaggucg

SEQ ID NO: 944433 - RNA, 15 nt, Mycobacterium avium subsp. paratuberculosis
ggaucgagcgcaccg

SEQ ID NO: 944434 - RNA, 16 nt, Mycobacterium avium subsp. paratuberculosis
ggaucgagcgcaccgc

SEQ ID NO: 944435 - RNA, 20 nt, Mycobacterium avium subsp. paratuberculosis
ggaucgcccauuugccggug

SEQ ID NO: 944436 - RNA, 14 nt, Mycobacterium avium subsp. paratuberculosis
ggaucgccggacag

SEQ ID NO: 944437 - RNA, 12 nt, Mycobacterium avium subsp. paratuberculosis
ggaaaugcgucg

SEQ ID NO: 944438 - RNA, 15 nt, Mycobacterium avium subsp. paratuberculosis
ggaugcguucggcca

SEQ ID NO: 944439 - RNA, 16 nt, Mycobacterium avium subsp. paratuberculosis
ggaugcguucggccag

SEQ ID NO: 944440 - RNA, 15 nt, Mycobacterium avium subsp. paratuberculosis
ggaugcggccgaagu

SEQ ID NO: 944441 - RNA, 23 nt, Mycobacterium avium subsp. paratuberculosis
ggaugcgggccacacacugcugc

SEQ ID NO: 944442 - RNA, 23 nt, Mycobacterium avium subsp. paratuberculosis
ggaugcggucgaugagcuggugc

SEQ ID NO: 944443 - RNA, 18 nt, Mycobacterium avium subsp. paratuberculosis
ggaugcggucgucgccca

SEQ ID NO: 944444 - RNA, 15 nt, Mycobacterium avium subsp. paratuberculosis
ggaugcggcgcccac

SEQ ID NO: 944445 - RNA, 14 nt, Mycobacterium avium subsp. paratuberculosis
ggaugcgcuggugc

SEQ ID NO: 944446 - RNA, 17 nt, Mycobacterium avium subsp. paratuberculosis
ggaugcgccgugcccaa

SEQ ID NO: 944447 - RNA, 14 nt, Mycobacterium avium subsp. paratuberculosis
ggauggcgcccagc

SEQ ID NO: 944448 - RNA, 16 nt, Mycobacterium avium subsp. paratuberculosis
ggauggcgcccggcag

SEQ ID NO: 944449 - RNA, 12 nt, Mycobacterium avium subsp. paratuberculosis
ggauggcgccca

SEQ ID NO: 944450 - RNA, 13 nt, Mycobacterium avium subsp. paratuberculosis
ggauggcccgcca

SEQ ID NO: 944451 - RNA, 14 nt, Mycobacterium avium subsp. paratuberculosis
ggauggcccgccag

SEQ ID NO: 944452 - RNA, 13 nt, Mycobacterium avium subsp. paratuberculosis
ggauggccggccg

SEQ ID NO: 944453 - RNA, 14 nt, Mycobacterium avium subsp. paratuberculosis
ggauggccgggcag

SEQ ID NO: 944454 - RNA, 15 nt, Mycobacterium avium subsp. paratuberculosis
ggauggacgcccaga

SEQ ID NO: 944455 - RNA, 16 nt, Mycobacterium avium subsp. paratuberculosis
ggaugcuggggucggc

SEQ ID NO: 944456 - RNA, 19 nt, Mycobacterium avium subsp. paratuberculosis
ggaugcuggggucggccag

SEQ ID NO: 944457 - RNA, 20 nt, Mycobacterium avium subsp. paratuberculosis
ggaugcuggggucggccagc

SEQ ID NO: 944458 - RNA, 17 nt, Mycobacterium avium subsp. paratuberculosis
ggaugcuuggucgcggc

SEQ ID NO: 944459 - RNA, 18 nt, Mycobacterium avium subsp. paratuberculosis
ggaugcuuggucgcggcg

SEQ ID NO: 944460 - RNA, 21 nt, Mycobacterium avium subsp. paratuberculosis
ggaugcccaacagcucgcggg

SEQ ID NO: 944461 - RNA, 16 nt, Mycobacterium avium subsp. paratuberculosis
ggaugccaguccuggg

SEQ ID NO: 944462 - RNA, 20 nt, Mycobacterium avium subsp. paratuberculosis
ggaugccaguccugggccgg

SEQ ID NO: 944463 - RNA, 15 nt, Mycobacterium avium subsp. paratuberculosis
ggaugcccagcacca

SEQ ID NO: 944464 - RNA, 17 nt, Mycobacterium avium subsp. paratuberculosis
ggaugcccagcaccacu

SEQ ID NO: 944465 - RNA, 16 nt, Mycobacterium avium subsp. paratuberculosis
ggaugcccaggccggc

SEQ ID NO: 944466 - RNA, 16 nt, Mycobacterium avium subsp. paratuberculosis
ggaugccgaaccgcug

SEQ ID NO: 944467 - RNA, 21 nt, Mycobacterium avium subsp. paratuberculosis
ggaugccccguauugccgucg

SEQ ID NO: 944468 - RNA, 15 nt, Mycobacterium avium subsp. paratuberculosis
ggaugcccgccggcg

SEQ ID NO: 944469 - RNA, 14 nt, Mycobacterium avium subsp. paratuberculosis
ggaugcccgggccg

SEQ ID NO: 944470 - RNA, 17 nt, Mycobacterium avium subsp. paratuberculosis
ggaugcaccggcagcca

SEQ ID NO: 944471 - RNA, 22 nt, Mycobacterium avium subsp. paratuberculosis
ggaugcacgugcaccgcggcca

SEQ ID NO: 944472 - RNA, 13 nt, Mycobacterium avium subsp. paratuberculosis
ggaugcagccggc

SEQ ID NO: 944473 - RNA, 15 nt, Mycobacterium avium subsp. paratuberculosis
ggaugcagccggcca

SEQ ID NO: 944474 - RNA, 16 nt, Mycobacterium avium subsp. paratuberculosis
ggaugcgagccagcug

SEQ ID NO: 944475 - RNA, 16 nt, Mycobacterium avium subsp. paratuberculosis
ggaugccgaugucgga

SEQ ID NO: 944476 - RNA, 13 nt, Mycobacterium avium subsp. paratuberculosis
ggaugccgcccac

SEQ ID NO: 944477 - RNA, 18 nt, Mycobacterium avium subsp. paratuberculosis
ggaugccgcccaccaccg

SEQ ID NO: 944478 - RNA, 21 nt, Mycobacterium avium subsp. paratuberculosis
ggaugccgcccaccaccggcu

SEQ ID NO: 944479 - RNA, 22 nt, Mycobacterium avium subsp. paratuberculosis
ggaugccgcccuugcucgcggc

SEQ ID NO: 944480 - RNA, 23 nt, Mycobacterium avium subsp. paratuberculosis
ggaugccgcccuugcucgcggcg

SEQ ID NO: 944481 - RNA, 14 nt, Mycobacterium avium subsp. paratuberculosis
ggaugccgccgguc

SEQ ID NO: 944482 - RNA, 19 nt, Mycobacterium avium subsp. paratuberculosis
ggaugccgccggucacggc

SEQ ID NO: 944483 - RNA, 20 nt, Mycobacterium avium subsp. paratuberculosis
ggaugccgcgcggcgccagc

SEQ ID NO: 944484 - RNA, 14 nt, Mycobacterium avium subsp. paratuberculosis
ggaugccggcgccc

SEQ ID NO: 944485 - RNA, 12 nt, Mycobacterium avium subsp. paratuberculosis
ggauggcgaugg

SEQ ID NO: 944486 - RNA, 20 nt, Mycobacterium avium subsp. paratuberculosis
ggauggguggcgaucaccgc

SEQ ID NO: 944487 - RNA, 12 nt, Mycobacterium avium subsp. paratuberculosis
ggauggcggucg

SEQ ID NO: 944488 - RNA, 18 nt, Mycobacterium avium subsp. paratuberculosis
ggaugguccgcaugucga

SEQ ID NO: 944489 - RNA, 14 nt, Mycobacterium avium subsp. paratuberculosis
ggauguagccgccg

SEQ ID NO: 944490 - RNA, 23 nt, Mycobacterium avium subsp. paratuberculosis
ggauggugcgccgggucgcggug

SEQ ID NO: 944491 - RNA, 19 nt, Mycobacterium avium subsp. paratuberculosis
ggauguggaggcgagcaac

SEQ ID NO: 944492 - RNA, 12 nt, Mycobacterium avium subsp. paratuberculosis
ggaugucgucgg

SEQ ID NO: 944493 - RNA, 18 nt, Mycobacterium avium subsp. paratuberculosis
ggaugucgugcggucgca

SEQ ID NO: 944494 - RNA, 14 nt, Mycobacterium avium subsp. paratuberculosis
ggaugucgggcgag

SEQ ID NO: 944495 - RNA, 20 nt, Mycobacterium avium subsp. paratuberculosis
ggaugucguaggcgcggucg

SEQ ID NO: 944496 - RNA, 21 nt, Mycobacterium avium subsp. paratuberculosis
ggaugugacgcgggaccgggc

SEQ ID NO: 944497 - RNA, 15 nt, Mycobacterium avium subsp. paratuberculosis
ggauguccuacggcg

SEQ ID NO: 944498 - RNA, 20 nt, Mycobacterium avium subsp. paratuberculosis
ggauguccuacggcgggugc

SEQ ID NO: 944499 - RNA, 19 nt, Mycobacterium avium subsp. paratuberculosis
ggaugggcgcacgaucggg

SEQ ID NO: 944500 - RNA, 19 nt, Mycobacterium avium subsp. paratuberculosis
ggaugucgacgaugcgcug

SEQ ID NO: 944501 - RNA, 14 nt, Mycobacterium avium subsp. paratuberculosis
ggauuacucgccgg

SEQ ID NO: 944502 - RNA, 16 nt, Mycobacterium avium subsp. paratuberculosis
ggauuacucgccggcg

SEQ ID NO: 944503 - RNA, 17 nt, Mycobacterium avium subsp. paratuberculosis
ggauguucaccccggcg

SEQ ID NO: 944504 - RNA, 18 nt, Mycobacterium avium subsp. paratuberculosis
ggauguucaccccggcgc

SEQ ID NO: 944505 - RNA, 22 nt, Mycobacterium avium subsp. paratuberculosis
ggauucccgaacagggcgacgg

SEQ ID NO: 944506 - RNA, 18 nt, Mycobacterium avium subsp. paratuberculosis
ggauuccgucggcggccg

SEQ ID NO: 944507 - RNA, 18 nt, Mycobacterium avium subsp. paratuberculosis
ggauucggccaugccgcg

SEQ ID NO: 944508 - RNA, 14 nt, Mycobacterium avium subsp. paratuberculosis
ggauuggcggccaa

SEQ ID NO: 944509 - RNA, 21 nt, Mycobacterium avium subsp. paratuberculosis
ggauuggcgucgguggcggcg

SEQ ID NO: 944510 - RNA, 15 nt, Mycobacterium avium subsp. paratuberculosis
ggauucucagcagcg

SEQ ID NO: 944511 - RNA, 14 nt, Mycobacterium avium subsp. paratuberculosis
ggauucucgcucug

SEQ ID NO: 944512 - RNA, 16 nt, Mycobacterium avium subsp. paratuberculosis
ggcaaagaucggugcc

SEQ ID NO: 944513 - RNA, 16 nt, Mycobacterium avium subsp. paratuberculosis
ggcaaccagcuccggc

SEQ ID NO: 944514 - RNA, 23 nt, Mycobacterium avium subsp. paratuberculosis
ggcaacccgaccucgucgacggc

SEQ ID NO: 944515 - RNA, 16 nt, Mycobacterium avium subsp. paratuberculosis
ggcaacccgaucgccg

SEQ ID NO: 944516 - RNA, 13 nt, Mycobacterium avium subsp. paratuberculosis
ggcaaccugggcg

SEQ ID NO: 944517 - RNA, 18 nt, Mycobacterium avium subsp. paratuberculosis
ggcaaccugggcggcggc

SEQ ID NO: 944518 - RNA, 23 nt, Mycobacterium avium subsp. paratuberculosis
ggcaacgaggccagggcccgcag

SEQ ID NO: 944519 - RNA, 21 nt, Mycobacterium avium subsp. paratuberculosis
ggcaacgccagccagaacacg

SEQ ID NO: 944520 - RNA, 22 nt, Mycobacterium avium subsp. paratuberculosis
ggcaacgccagccagaacacgc

SEQ ID NO: 944521 - RNA, 12 nt, Mycobacterium avium subsp. paratuberculosis
ggcaaccgcagc

SEQ ID NO: 944522 - RNA, 12 nt, Mycobacterium avium subsp. paratuberculosis
ggcaaccgcugc

SEQ ID NO: 944523 - RNA, 22 nt, Mycobacterium avium subsp. paratuberculosis
ggcacagcagggcaccgacggc

SEQ ID NO: 944524 - RNA, 15 nt, Mycobacterium avium subsp. paratuberculosis
ggcacagccagcgcc

SEQ ID NO: 944525 - RNA, 16 nt, Mycobacterium avium subsp. paratuberculosis
ggcacagccagcgccc

SEQ ID NO: 944526 - RNA, 21 nt, Mycobacterium avium subsp. paratuberculosis
ggcacagcgaaagcgcuuggc

SEQ ID NO: 944527 - RNA, 19 nt, Mycobacterium avium subsp. paratuberculosis
ggcaaugaccggcaccagc

SEQ ID NO: 944528 - RNA, 14 nt, Mycobacterium avium subsp. paratuberculosis
ggcaauggccgcga

SEQ ID NO: 944529 - RNA, 17 nt, Mycobacterium avium subsp. paratuberculosis
ggcaaugguugcggcgg

SEQ ID NO: 944530 - RNA, 16 nt, Mycobacterium avium subsp. paratuberculosis
ggcaaucgcugcgccc

SEQ ID NO: 944531 - RNA, 23 nt, Mycobacterium avium subsp. paratuberculosis
ggcaaucgcugcgcccgccgcca

SEQ ID NO: 944532 - RNA, 19 nt, Mycobacterium avium subsp. paratuberculosis
ggcaagcaguaugcccgcc

SEQ ID NO: 944533 - RNA, 22 nt, Mycobacterium avium subsp. paratuberculosis
ggcaagcagcggcagccacggc

SEQ ID NO: 944534 - RNA, 16 nt, Mycobacterium avium subsp. paratuberculosis
ggcaacugggcggccu

SEQ ID NO: 944535 - RNA, 20 nt, Mycobacterium avium subsp. paratuberculosis
ggcaacugggcggccugcac

SEQ ID NO: 944536 - RNA, 21 nt, Mycobacterium avium subsp. paratuberculosis
ggcacuaccgccucgccagcc

SEQ ID NO: 944537 - RNA, 19 nt, Mycobacterium avium subsp. paratuberculosis
ggcacguugacguagacga

SEQ ID NO: 944538 - RNA, 14 nt, Mycobacterium avium subsp. paratuberculosis
ggcacgcugcgcca

SEQ ID NO: 944539 - RNA, 16 nt, Mycobacterium avium subsp. paratuberculosis
ggcacgcugcgccagc

SEQ ID NO: 944540 - RNA, 17 nt, Mycobacterium avium subsp. paratuberculosis
ggcacgcugcgccagcc

SEQ ID NO: 944541 - RNA, 18 nt, Mycobacterium avium subsp. paratuberculosis
ggcacgcugcgccagccg

SEQ ID NO: 944542 - RNA, 13 nt, Mycobacterium avium subsp. paratuberculosis
ggcacucgucgug

SEQ ID NO: 944543 - RNA, 23 nt, Mycobacterium avium subsp. paratuberculosis
ggcacucgucguggcggugcucu

SEQ ID NO: 944544 - RNA, 14 nt, Mycobacterium avium subsp. paratuberculosis
ggcacucgcccagg

SEQ ID NO: 944545 - RNA, 22 nt, Mycobacterium avium subsp. paratuberculosis
ggcacucgcccagggcgugcgc

SEQ ID NO: 944546 - RNA, 22 nt, Mycobacterium avium subsp. paratuberculosis
ggcacugcccgcaucgcacaga

SEQ ID NO: 944547 - RNA, 14 nt, Mycobacterium avium subsp. paratuberculosis
ggcacuggcgcugc

SEQ ID NO: 944548 - RNA, 15 nt, Mycobacterium avium subsp. paratuberculosis
ggcacgacgccgccg

SEQ ID NO: 944549 - RNA, 18 nt, Mycobacterium avium subsp. paratuberculosis
ggcacgacgccgccgagg

SEQ ID NO: 944550 - RNA, 19 nt, Mycobacterium avium subsp. paratuberculosis
ggcaccuuggugagcaccg

SEQ ID NO: 944551 - RNA, 16 nt, Mycobacterium avium subsp. paratuberculosis
ggcacgaacgcgacga

SEQ ID NO: 944552 - RNA, 22 nt, Mycobacterium avium subsp. paratuberculosis
ggcaccugauaggggucggcga

SEQ ID NO: 944553 - RNA, 13 nt, Mycobacterium avium subsp. paratuberculosis
ggcaccucggcgu

SEQ ID NO: 944554 - RNA, 17 nt, Mycobacterium avium subsp. paratuberculosis
ggcaccucggcgucggc

SEQ ID NO: 944555 - RNA, 19 nt, Mycobacterium avium subsp. paratuberculosis
ggcaccucggcgucggcgc

SEQ ID NO: 944556 - RNA, 19 nt, Mycobacterium avium subsp. paratuberculosis
ggcaccuccugcacccguc

SEQ ID NO: 944557 - RNA, 22 nt, Mycobacterium avium subsp. paratuberculosis
ggcaccucgaagggcgccagcc

SEQ ID NO: 944558 - RNA, 14 nt, Mycobacterium avium subsp. paratuberculosis
ggcaccucggccag

SEQ ID NO: 944559 - RNA, 15 nt, Mycobacterium avium subsp. paratuberculosis
ggcaccuggccgucg

SEQ ID NO: 944560 - RNA, 16 nt, Mycobacterium avium subsp. paratuberculosis
ggcacgcgcgcccggc

SEQ ID NO: 944561 - RNA, 23 nt, Mycobacterium avium subsp. paratuberculosis
ggcacgcgcgcccggcaccgcgg

SEQ ID NO: 944562 - RNA, 21 nt, Mycobacterium avium subsp. paratuberculosis
ggcacgcgagacgagccgccg

SEQ ID NO: 944563 - RNA, 19 nt, Mycobacterium avium subsp. paratuberculosis
ggcaccuccagcccggcga

SEQ ID NO: 944564 - RNA, 13 nt, Mycobacterium avium subsp. paratuberculosis
ggcaccgugccgc

SEQ ID NO: 944565 - RNA, 18 nt, Mycobacterium avium subsp. paratuberculosis
ggcaccgugccgcgcggc

SEQ ID NO: 944566 - RNA, 20 nt, Mycobacterium avium subsp. paratuberculosis
ggcaccgugccgcgcggcgg

SEQ ID NO: 944567 - RNA, 20 nt, Mycobacterium avium subsp. paratuberculosis
ggcaccgcccccgcggcggc

SEQ ID NO: 944568 - RNA, 22 nt, Mycobacterium avium subsp. paratuberculosis
ggcaccgcccccgcggcggcca

SEQ ID NO: 944569 - RNA, 23 nt, Mycobacterium avium subsp. paratuberculosis
ggcaccgcccggguugucgacgu

SEQ ID NO: 944570 - RNA, 13 nt, Mycobacterium avium subsp. paratuberculosis
ggcaccgccagcc

SEQ ID NO: 944571 - RNA, 14 nt, Mycobacterium avium subsp. paratuberculosis
ggcaccgcggcggu

SEQ ID NO: 944572 - RNA, 18 nt, Mycobacterium avium subsp. paratuberculosis
ggcaccgcggcggugucg

SEQ ID NO: 944573 - RNA, 21 nt, Mycobacterium avium subsp. paratuberculosis
ggcaccgcggcggugucggcg

SEQ ID NO: 944574 - RNA, 16 nt, Mycobacterium avium subsp. paratuberculosis
ggcaccgcggcucggu

SEQ ID NO: 944575 - RNA, 13 nt, Mycobacterium avium subsp. paratuberculosis
ggcaccgcggucu

SEQ ID NO: 944576 - RNA, 21 nt, Mycobacterium avium subsp. paratuberculosis
ggcaccgcggucugcgccagc

SEQ ID NO: 944577 - RNA, 17 nt, Mycobacterium avium subsp. paratuberculosis
ggcaccgauaguagcca

SEQ ID NO: 944578 - RNA, 13 nt, Mycobacterium avium subsp. paratuberculosis
ggcacccgccagc

SEQ ID NO: 944579 - RNA, 20 nt, Mycobacterium avium subsp. paratuberculosis
ggcaccgaucggcacgucga

SEQ ID NO: 944580 - RNA, 22 nt, Mycobacterium avium subsp. paratuberculosis
ggcaccgaucggcacgucgagc

SEQ ID NO: 944581 - RNA, 16 nt, Mycobacterium avium subsp. paratuberculosis
ggcaccgccgcgcggc

SEQ ID NO: 944582 - RNA, 18 nt, Mycobacterium avium subsp. paratuberculosis
ggcaccgccgcgcggccg

SEQ ID NO: 944583 - RNA, 14 nt, Mycobacterium avium subsp. paratuberculosis
ggcaccgccgcggu

SEQ ID NO: 944584 - RNA, 16 nt, Mycobacterium avium subsp. paratuberculosis
ggcaccgccgcggugg

SEQ ID NO: 944585 - RNA, 19 nt, Mycobacterium avium subsp. paratuberculosis
ggcacccccgggguggugu

SEQ ID NO: 944586 - RNA, 17 nt, Mycobacterium avium subsp. paratuberculosis
ggcaccccgcgccgggc

SEQ ID NO: 944587 - RNA, 13 nt, Mycobacterium avium subsp. paratuberculosis
ggcaccccgcggu

SEQ ID NO: 944588 - RNA, 17 nt, Mycobacterium avium subsp. paratuberculosis
ggcacccaggucaccga

SEQ ID NO: 944589 - RNA, 21 nt, Mycobacterium avium subsp. paratuberculosis
ggcaccagucgcgcagcguca

SEQ ID NO: 944590 - RNA, 16 nt, Mycobacterium avium subsp. paratuberculosis
ggcacccgcaacacca

SEQ ID NO: 944591 - RNA, 22 nt, Mycobacterium avium subsp. paratuberculosis
ggcacccgcaacaccacgucgg

SEQ ID NO: 944592 - RNA, 19 nt, Mycobacterium avium subsp. paratuberculosis
ggcaccccugccgccaccg

SEQ ID NO: 944593 - RNA, 22 nt, Mycobacterium avium subsp. paratuberculosis
ggcaccccugccgccaccgcga

SEQ ID NO: 944594 - RNA, 17 nt, Mycobacterium avium subsp. paratuberculosis
ggcacccgaccgacgcc

SEQ ID NO: 944595 - RNA, 18 nt, Mycobacterium avium subsp. paratuberculosis
ggcacccgaccgacgccc

SEQ ID NO: 944596 - RNA, 17 nt, Mycobacterium avium subsp. paratuberculosis
ggcaccaccacccccga

SEQ ID NO: 944597 - RNA, 14 nt, Mycobacterium avium subsp. paratuberculosis
ggcaccaccaccga

SEQ ID NO: 944598 - RNA, 16 nt, Mycobacterium avium subsp. paratuberculosis
ggcaccaccaccgaca

SEQ ID NO: 944599 - RNA, 17 nt, Mycobacterium avium subsp. paratuberculosis
ggcaccaccaccgacac

SEQ ID NO: 944600 - RNA, 15 nt, Mycobacterium avium subsp. paratuberculosis
ggcauucguguggcg

SEQ ID NO: 944601 - RNA, 16 nt, Mycobacterium avium subsp. paratuberculosis
ggcauucguguggcgc

SEQ ID NO: 944602 - RNA, 19 nt, Mycobacterium avium subsp. paratuberculosis
ggcauucguguggcgcacg

SEQ ID NO: 944603 - RNA, 19 nt, Mycobacterium avium subsp. paratuberculosis
ggccaaaaagugccggacc

SEQ ID NO: 944604 - RNA, 14 nt, Mycobacterium avium subsp. paratuberculosis
ggcauuggcagcuc

SEQ ID NO: 944605 - RNA, 23 nt, Mycobacterium avium subsp. paratuberculosis
ggccaaaucgcuugcgccgcagc

SEQ ID NO: 944606 - RNA, 15 nt, Mycobacterium avium subsp. paratuberculosis
ggcauuccaccgcgc

SEQ ID NO: 944607 - RNA, 18 nt, Mycobacterium avium subsp. paratuberculosis
ggcauuccaccgcgcggc

SEQ ID NO: 944608 - RNA, 22 nt, Mycobacterium avium subsp. paratuberculosis
ggcauuccaccgcgcggcgcag

SEQ ID NO: 944609 - RNA, 20 nt, Mycobacterium avium subsp. paratuberculosis
ggcauggugucaggaucgcc

SEQ ID NO: 944610 - RNA, 15 nt, Mycobacterium avium subsp. paratuberculosis
ggcauggucaccgga

SEQ ID NO: 944611 - RNA, 24 nt, Mycobacterium avium subsp. paratuberculosis
ggcauggcgaacacgucggccagc

SEQ ID NO: 944612 - RNA, 15 nt, Mycobacterium avium subsp. paratuberculosis
ggcagguuguugacg

SEQ ID NO: 944613 - RNA, 12 nt, Mycobacterium avium subsp. paratuberculosis
ggcaggugagcc

SEQ ID NO: 944614 - RNA, 13 nt, Mycobacterium avium subsp. paratuberculosis
ggcaggugagccg

SEQ ID NO: 944615 - RNA, 20 nt, Mycobacterium avium subsp. paratuberculosis
ggcagguuggggacggcgag

SEQ ID NO: 944616 - RNA, 21 nt, Mycobacterium avium subsp. paratuberculosis
ggcagguuggggacggcgagg

SEQ ID NO: 944617 - RNA, 16 nt, Mycobacterium avium subsp. paratuberculosis
ggcagguugucgcuga

SEQ ID NO: 944618 - RNA, 21 nt, Mycobacterium avium subsp. paratuberculosis
ggcagguggauugucggccgc

SEQ ID NO: 944619 - RNA, 23 nt, Mycobacterium avium subsp. paratuberculosis
ggcagguggauugucggccgccc

SEQ ID NO: 944620 - RNA, 13 nt, Mycobacterium avium subsp. paratuberculosis
ggcagguggcgua

SEQ ID NO: 944621 - RNA, 20 nt, Mycobacterium avium subsp. paratuberculosis
ggcagguggcguagucggug

SEQ ID NO: 944622 - RNA, 16 nt, Mycobacterium avium subsp. paratuberculosis
ggcagguggggcagca

SEQ ID NO: 944623 - RNA, 17 nt, Mycobacterium avium subsp. paratuberculosis
ggcagguggucggcgaa

SEQ ID NO: 944624 - RNA, 16 nt, Mycobacterium avium subsp. paratuberculosis
ggcagguggucgguga

SEQ ID NO: 944625 - RNA, 22 nt, Mycobacterium avium subsp. paratuberculosis
ggcaguugccggccaucugcug

SEQ ID NO: 944626 - RNA, 15 nt, Mycobacterium avium subsp. paratuberculosis
ggcaguagcgcaccg

SEQ ID NO: 944627 - RNA, 16 nt, Mycobacterium avium subsp. paratuberculosis
ggcaguagcgcaccgg

SEQ ID NO: 944628 - RNA, 18 nt, Mycobacterium avium subsp. paratuberculosis
ggcaguagugguccaccg

SEQ ID NO: 944629 - RNA, 21 nt, Mycobacterium avium subsp. paratuberculosis
ggcaguuccuugcgcagcacc

SEQ ID NO: 944630 - RNA, 22 nt, Mycobacterium avium subsp. paratuberculosis
ggcaguuccuugcgcagcaccu

SEQ ID NO: 944631 - RNA, 15 nt, Mycobacterium avium subsp. paratuberculosis
ggcaguucgaugccg

SEQ ID NO: 944632 - RNA, 15 nt, Mycobacterium avium subsp. paratuberculosis
ggcaugaccggccag

SEQ ID NO: 944633 - RNA, 22 nt, Mycobacterium avium subsp. paratuberculosis
ggcaugaaccaggccgcgcugg

SEQ ID NO: 944634 - RNA, 13 nt, Mycobacterium avium subsp. paratuberculosis
ggcaucgucggcg

SEQ ID NO: 944635 - RNA, 15 nt, Mycobacterium avium subsp. paratuberculosis
ggcaucgucggcgcc

SEQ ID NO: 944636 - RNA, 16 nt, Mycobacterium avium subsp. paratuberculosis
ggcaucgucggcgccg

SEQ ID NO: 944637 - RNA, 15 nt, Mycobacterium avium subsp. paratuberculosis
ggcaucucccgcgcg

SEQ ID NO: 944638 - RNA, 23 nt, Mycobacterium avium subsp. paratuberculosis
ggcauagagcuggugggccaucg

SEQ ID NO: 944639 - RNA, 13 nt, Mycobacterium avium subsp. paratuberculosis
ggcaucgguggca

SEQ ID NO: 944640 - RNA, 18 nt, Mycobacterium avium subsp. paratuberculosis
ggcaucgguggcaccccg

SEQ ID NO: 944641 - RNA, 19 nt, Mycobacterium avium subsp. paratuberculosis
ggcaucgguggcaccccgc

SEQ ID NO: 944642 - RNA, 22 nt, Mycobacterium avium subsp. paratuberculosis
ggcauacugcuugccgucgacg

SEQ ID NO: 944643 - RNA, 19 nt, Mycobacterium avium subsp. paratuberculosis
ggcagcugauagcccgccg

SEQ ID NO: 944644 - RNA, 20 nt, Mycobacterium avium subsp. paratuberculosis
ggcagcugauagcccgccgc

SEQ ID NO: 944645 - RNA, 15 nt, Mycobacterium avium subsp. paratuberculosis
ggcagcugcccgucg

SEQ ID NO: 944646 - RNA, 23 nt, Mycobacterium avium subsp. paratuberculosis
ggcaggaaccgggucagcaccac

SEQ ID NO: 944647 - RNA, 14 nt, Mycobacterium avium subsp. paratuberculosis
ggcaggcacgagcg

SEQ ID NO: 944648 - RNA, 16 nt, Mycobacterium avium subsp. paratuberculosis
ggcaggcacugauccc

SEQ ID NO: 944649 - RNA, 17 nt, Mycobacterium avium subsp. paratuberculosis
ggcaggauccggucgau

SEQ ID NO: 944650 - RNA, 20 nt, Mycobacterium avium subsp. paratuberculosis
ggcaggauccggucgaucac

SEQ ID NO: 944651 - RNA, 13 nt, Mycobacterium avium subsp. paratuberculosis
ggcaggaugccgc

SEQ ID NO: 944652 - RNA, 15 nt, Mycobacterium avium subsp. paratuberculosis
ggcaggauggucagc

SEQ ID NO: 944653 - RNA, 18 nt, Mycobacterium avium subsp. paratuberculosis
ggcaggucgucgacgucg

SEQ ID NO: 944654 - RNA, 15 nt, Mycobacterium avium subsp. paratuberculosis
ggcaggucgucgucg

SEQ ID NO: 944655 - RNA, 19 nt, Mycobacterium avium subsp. paratuberculosis
ggcaggucgucgucgccgc

SEQ ID NO: 944656 - RNA, 13 nt, Mycobacterium avium subsp. paratuberculosis
ggcaggucggcgg

SEQ ID NO: 944657 - RNA, 16 nt, Mycobacterium avium subsp. paratuberculosis
ggcaggucggccagcg

SEQ ID NO: 944658 - RNA, 14 nt, Mycobacterium avium subsp. paratuberculosis
ggcaggcggccagg

SEQ ID NO: 944659 - RNA, 22 nt, Mycobacterium avium subsp. paratuberculosis
ggcaggcggcccgcucgauguc

SEQ ID NO: 944660 - RNA, 16 nt, Mycobacterium avium subsp. paratuberculosis
ggcaggcgauggcguc

SEQ ID NO: 944661 - RNA, 21 nt, Mycobacterium avium subsp. paratuberculosis
ggcaggcgauggcgucggcca

SEQ ID NO: 944662 - RNA, 21 nt, Mycobacterium avium subsp. paratuberculosis
ggcaggcgauggugccggcca

SEQ ID NO: 944663 - RNA, 12 nt, Mycobacterium avium subsp. paratuberculosis
ggcaggcgaugu

SEQ ID NO: 944664 - RNA, 13 nt, Mycobacterium avium subsp. paratuberculosis
ggcaggcgaugug

SEQ ID NO: 944665 - RNA, 18 nt, Mycobacterium avium subsp. paratuberculosis
ggcaggcgaugugggugg

SEQ ID NO: 944666 - RNA, 14 nt, Mycobacterium avium subsp. paratuberculosis
ggcaggccggcagc

SEQ ID NO: 944667 - RNA, 15 nt, Mycobacterium avium subsp. paratuberculosis
ggcaggccggcagcc

SEQ ID NO: 944668 - RNA, 18 nt, Mycobacterium avium subsp. paratuberculosis
ggcaggccaucagcccgg

SEQ ID NO: 944669 - RNA, 18 nt, Mycobacterium avium subsp. paratuberculosis
ggcaggcccgagcccgac

SEQ ID NO: 944670 - RNA, 20 nt, Mycobacterium avium subsp. paratuberculosis
ggcaggccgaagaacucagc

SEQ ID NO: 944671 - RNA, 15 nt, Mycobacterium avium subsp. paratuberculosis
ggcagauggucgccg

SEQ ID NO: 944672 - RNA, 16 nt, Mycobacterium avium subsp. paratuberculosis
ggcagauggucgccga

SEQ ID NO: 944673 - RNA, 18 nt, Mycobacterium avium subsp. paratuberculosis
ggcagauggucgccgacg

SEQ ID NO: 944674 - RNA, 15 nt, Mycobacterium avium subsp. paratuberculosis
ggcagauggucucga

SEQ ID NO: 944675 - RNA, 15 nt, Mycobacterium avium subsp. paratuberculosis
ggcagaucgcggccc

SEQ ID NO: 944676 - RNA, 17 nt, Mycobacterium avium subsp. paratuberculosis
ggcagaucgcggcccgc

SEQ ID NO: 944677 - RNA, 14 nt, Mycobacterium avium subsp. paratuberculosis
ggcagcaaccgcga

SEQ ID NO: 944678 - RNA, 23 nt, Mycobacterium avium subsp. paratuberculosis
ggcagcgcgcccugaggcccggu

SEQ ID NO: 944679 - RNA, 22 nt, Mycobacterium avium subsp. paratuberculosis
ggcagcgcgauccgcgcgucgg

SEQ ID NO: 944680 - RNA, 18 nt, Mycobacterium avium subsp. paratuberculosis
ggcagcucgguggccggu

SEQ ID NO: 944681 - RNA, 13 nt, Mycobacterium avium subsp. paratuberculosis
ggcagcucggcgg

SEQ ID NO: 944682 - RNA, 18 nt, Mycobacterium avium subsp. paratuberculosis
ggcagcucggcggcccgc

SEQ ID NO: 944683 - RNA, 14 nt, Mycobacterium avium subsp. paratuberculosis
ggcagcucggcggg

SEQ ID NO: 944684 - RNA, 15 nt, Mycobacterium avium subsp. paratuberculosis
ggcagcucggcgggc

SEQ ID NO: 944685 - RNA, 13 nt, Mycobacterium avium subsp. paratuberculosis
ggcagcucgucga

SEQ ID NO: 944686 - RNA, 14 nt, Mycobacterium avium subsp. paratuberculosis
ggcagcucgucgac

SEQ ID NO: 944687 - RNA, 16 nt, Mycobacterium avium subsp. paratuberculosis
ggcagcucgucgacgu

SEQ ID NO: 944688 - RNA, 13 nt, Mycobacterium avium subsp. paratuberculosis
ggcagcucgucgg

SEQ ID NO: 944689 - RNA, 15 nt, Mycobacterium avium subsp. paratuberculosis
ggcagcucgucggcg

SEQ ID NO: 944690 - RNA, 18 nt, Mycobacterium avium subsp. paratuberculosis
ggcagcucgucggcgcgc

SEQ ID NO: 944691 - RNA, 20 nt, Mycobacterium avium subsp. paratuberculosis
ggcagcucgucggcgcgcca

SEQ ID NO: 944692 - RNA, 21 nt, Mycobacterium avium subsp. paratuberculosis
ggcagcucgucggcgcgccac

SEQ ID NO: 944693 - RNA, 19 nt, Mycobacterium avium subsp. paratuberculosis
ggcagcggccccacguuga

SEQ ID NO: 944694 - RNA, 13 nt, Mycobacterium avium subsp. paratuberculosis
ggcagcgcguuga

SEQ ID NO: 944695 - RNA, 17 nt, Mycobacterium avium subsp. paratuberculosis
ggcagcgcuaaccgcgg

SEQ ID NO: 944696 - RNA, 22 nt, Mycobacterium avium subsp. paratuberculosis
ggcagcgcuccugcagcgcggc

SEQ ID NO: 944697 - RNA, 16 nt, Mycobacterium avium subsp. paratuberculosis
ggcagcgcucgucguc

SEQ ID NO: 944698 - RNA, 22 nt, Mycobacterium avium subsp. paratuberculosis
ggcagcggacccggucggccgc

SEQ ID NO: 944699 - RNA, 13 nt, Mycobacterium avium subsp. paratuberculosis
ggcagcgcggcca

SEQ ID NO: 944700 - RNA, 15 nt, Mycobacterium avium subsp. paratuberculosis
ggccagcguggcgcg

SEQ ID NO: 944701 - RNA, 23 nt, Mycobacterium avium subsp. paratuberculosis
ggccagcguggcgcgccccggcc

SEQ ID NO: 944702 - RNA, 18 nt, Mycobacterium avium subsp. paratuberculosis
ggccagcgucgcgccgcc

SEQ ID NO: 944703 - RNA, 17 nt, Mycobacterium avium subsp. paratuberculosis
ggccagcgucagggcga

SEQ ID NO: 944704 - RNA, 22 nt, Mycobacterium avium subsp. paratuberculosis
ggccagcgucuccggcgggcug

SEQ ID NO: 944705 - RNA, 23 nt, Mycobacterium avium subsp. paratuberculosis
ggccagcgucuccggcgggcugg

SEQ ID NO: 944706 - RNA, 19 nt, Mycobacterium avium subsp. paratuberculosis
ggccagcgugaacaccgcg

SEQ ID NO: 944707 - RNA, 20 nt, Mycobacterium avium subsp. paratuberculosis
ggccagcgugaacaccgcgu

SEQ ID NO: 944708 - RNA, 13 nt, Mycobacterium avium subsp. paratuberculosis
ggccagcgguugc

SEQ ID NO: 944709 - RNA, 20 nt, Mycobacterium avium subsp. paratuberculosis
ggccagcgguugcacggucu

SEQ ID NO: 944710 - RNA, 18 nt, Mycobacterium avium subsp. paratuberculosis
ggccagcgggugauggcc

SEQ ID NO: 944711 - RNA, 22 nt, Mycobacterium avium subsp. paratuberculosis
ggccagcgggugauggccgccg

SEQ ID NO: 944712 - RNA, 13 nt, Mycobacterium avium subsp. paratuberculosis
ggccagcgggucg

SEQ ID NO: 944713 - RNA, 13 nt, Mycobacterium avium subsp. paratuberculosis
ggccagcgcggcc

SEQ ID NO: 944714 - RNA, 16 nt, Mycobacterium avium subsp. paratuberculosis
ggccagcuccgccacc

SEQ ID NO: 944715 - RNA, 22 nt, Mycobacterium avium subsp. paratuberculosis
ggccagcucccgggcggcgccg

SEQ ID NO: 944716 - RNA, 23 nt, Mycobacterium avium subsp. paratuberculosis
ggccagcucccgggcggcgccga

SEQ ID NO: 944717 - RNA, 19 nt, Mycobacterium avium subsp. paratuberculosis
ggccagcguuuccagcgcc

SEQ ID NO: 944718 - RNA, 21 nt, Mycobacterium avium subsp. paratuberculosis
ggccagcguuuccagcgccgg

SEQ ID NO: 944719 - RNA, 23 nt, Mycobacterium avium subsp. paratuberculosis
ggccagcguuuccagcgccggca

SEQ ID NO: 944720 - RNA, 16 nt, Mycobacterium avium subsp. paratuberculosis
ggccagcuccgggucg

SEQ ID NO: 944721 - RNA, 17 nt, Mycobacterium avium subsp. paratuberculosis
ggccagcuccgggucga

SEQ ID NO: 944722 - RNA, 21 nt, Mycobacterium avium subsp. paratuberculosis
ggccagcuccgggucgaccgc

SEQ ID NO: 944723 - RNA, 23 nt, Mycobacterium avium subsp. paratuberculosis
ggccagcuccgggucgaccgccu

SEQ ID NO: 944724 - RNA, 19 nt, Mycobacterium avium subsp. paratuberculosis
ggccagcgcgcgggcgcgc

SEQ ID NO: 944725 - RNA, 20 nt, Mycobacterium avium subsp. paratuberculosis
ggccagcgcgcgggcgcgcg

SEQ ID NO: 944726 - RNA, 23 nt, Mycobacterium avium subsp. paratuberculosis
ggccagcgcgcgggcgcgcgccg

SEQ ID NO: 944727 - RNA, 14 nt, Mycobacterium avium subsp. paratuberculosis
ggccagcgcgcggc

SEQ ID NO: 944728 - RNA, 20 nt, Mycobacterium avium subsp. paratuberculosis
ggccagcgcgcggcccagcg

SEQ ID NO: 944729 - RNA, 21 nt, Mycobacterium avium subsp. paratuberculosis
ggccagcgcgccgccgaugug

SEQ ID NO: 944730 - RNA, 15 nt, Mycobacterium avium subsp. paratuberculosis
ggccagcgcgccgca

SEQ ID NO: 944731 - RNA, 24 nt, Mycobacterium avium subsp. paratuberculosis
ggccagcgcgccgcacagccggcg

SEQ ID NO: 944732 - RNA, 14 nt, Mycobacterium avium subsp. paratuberculosis
ggccagcgcgacgg

SEQ ID NO: 944733 - RNA, 16 nt, Mycobacterium avium subsp. paratuberculosis
ggccagcgcgaucgcc

SEQ ID NO: 944734 - RNA, 13 nt, Mycobacterium avium subsp. paratuberculosis
ggccagcgcgacg

SEQ ID NO: 944735 - RNA, 19 nt, Mycobacterium avium subsp. paratuberculosis
ggccagcgcgaaagcagca

SEQ ID NO: 944736 - RNA, 16 nt, Mycobacterium avium subsp. paratuberculosis
ggccagcgccuucggc

SEQ ID NO: 944737 - RNA, 20 nt, Mycobacterium avium subsp. paratuberculosis
ggccagcgccuucggcgcca

SEQ ID NO: 944738 - RNA, 23 nt, Mycobacterium avium subsp. paratuberculosis
ggccagcgccuucggcgccagcc

SEQ ID NO: 944739 - RNA, 21 nt, Mycobacterium avium subsp. paratuberculosis
ggccagcgccgucaucaccgc

SEQ ID NO: 944740 - RNA, 21 nt, Mycobacterium avium subsp. paratuberculosis
ggccagccggcucuuggcgac

SEQ ID NO: 944741 - RNA, 18 nt, Mycobacterium avium subsp. paratuberculosis
ggccagcgccgcgcgcgc

SEQ ID NO: 944742 - RNA, 14 nt, Mycobacterium avium subsp. paratuberculosis
ggccagcgccgcgc

SEQ ID NO: 944743 - RNA, 13 nt, Mycobacterium avium subsp. paratuberculosis
ggccagcgccgcg

SEQ ID NO: 944744 - RNA, 18 nt, Mycobacterium avium subsp. paratuberculosis
ggccagccgcucccggcg

SEQ ID NO: 944745 - RNA, 20 nt, Mycobacterium avium subsp. paratuberculosis
ggccagccgcucccggcgca

SEQ ID NO: 944746 - RNA, 18 nt, Mycobacterium avium subsp. paratuberculosis
ggccagcgccgccagccg

SEQ ID NO: 944747 - RNA, 15 nt, Mycobacterium avium subsp. paratuberculosis
ggccagccggccgcu

SEQ ID NO: 944748 - RNA, 15 nt, Mycobacterium avium subsp. paratuberculosis
ggccagccgcgcgac

SEQ ID NO: 944749 - RNA, 18 nt, Mycobacterium avium subsp. paratuberculosis
ggccagccgcgcgacgcc

SEQ ID NO: 944750 - RNA, 19 nt, Mycobacterium avium subsp. paratuberculosis
ggccagccgcgcgacgccg

SEQ ID NO: 944751 - RNA, 15 nt, Mycobacterium avium subsp. paratuberculosis
ggccagccgcgcggc

SEQ ID NO: 944752 - RNA, 17 nt, Mycobacterium avium subsp. paratuberculosis
ggccagccgcgcggcgu

SEQ ID NO: 944753 - RNA, 18 nt, Mycobacterium avium subsp. paratuberculosis
ggccagccgcgcggcguc

SEQ ID NO: 944754 - RNA, 19 nt, Mycobacterium avium subsp. paratuberculosis
ggccagccgcgcggcgucg

SEQ ID NO: 944755 - RNA, 22 nt, Mycobacterium avium subsp. paratuberculosis
ggccagauagaugagccgcagc

SEQ ID NO: 944756 - RNA, 17 nt, Mycobacterium avium subsp. paratuberculosis
ggccagauacuccucgg

SEQ ID NO: 944757 - RNA, 23 nt, Mycobacterium avium subsp. paratuberculosis
ggccagaucgacccccaccgcga

SEQ ID NO: 944758 - RNA, 14 nt, Mycobacterium avium subsp. paratuberculosis
ggccagaucgacgc

SEQ ID NO: 944759 - RNA, 15 nt, Mycobacterium avium subsp. paratuberculosis
ggccagaucgacgcc

SEQ ID NO: 944760 - RNA, 18 nt, Mycobacterium avium subsp. paratuberculosis
ggccagaucgacgccgcg

SEQ ID NO: 944761 - RNA, 15 nt, Mycobacterium avium subsp. paratuberculosis
ggccagaucggccag

SEQ ID NO: 944762 - RNA, 16 nt, Mycobacterium avium subsp. paratuberculosis
ggccagaucggccagg

SEQ ID NO: 944763 - RNA, 22 nt, Mycobacterium avium subsp. paratuberculosis
ggccagaugcccgccccgcccg

SEQ ID NO: 944764 - RNA, 20 nt, Mycobacterium avium subsp. paratuberculosis
ggccagacugcgcaccgcca

SEQ ID NO: 944765 - RNA, 21 nt, Mycobacterium avium subsp. paratuberculosis
ggccagacugcgcaccgccag

SEQ ID NO: 944766 - RNA, 23 nt, Mycobacterium avium subsp. paratuberculosis
ggccagacugcgcaccgccagca

SEQ ID NO: 944767 - RNA, 14 nt, Mycobacterium avium subsp. paratuberculosis
ggccagcagcgcgg

SEQ ID NO: 944768 - RNA, 18 nt, Mycobacterium avium subsp. paratuberculosis
ggccagcagcgcggcgau

SEQ ID NO: 944769 - RNA, 22 nt, Mycobacterium avium subsp. paratuberculosis
ggccagcagcgcggcgaucucg

SEQ ID NO: 944770 - RNA, 17 nt, Mycobacterium avium subsp. paratuberculosis
ggccagcaacaccagcu

SEQ ID NO: 944771 - RNA, 18 nt, Mycobacterium avium subsp. paratuberculosis
ggccagcaacaccagcug

SEQ ID NO: 944772 - RNA, 18 nt, Mycobacterium avium subsp. paratuberculosis
ggccagcaacagcagcgg

SEQ ID NO: 944773 - RNA, 22 nt, Mycobacterium avium subsp. paratuberculosis
ggccagcagcgcgucgcgggcc

SEQ ID NO: 944774 - RNA, 20 nt, Mycobacterium avium subsp. paratuberculosis
ggccagccgaugcgcccgcg

SEQ ID NO: 944775 - RNA, 17 nt, Mycobacterium avium subsp. paratuberculosis
ggccagcccggcgugca

SEQ ID NO: 944776 - RNA, 24 nt, Mycobacterium avium subsp. paratuberculosis
ggccagccccgggaaccagcccag

SEQ ID NO: 944777 - RNA, 17 nt, Mycobacterium avium subsp. paratuberculosis
ggccagcccaucccgau

SEQ ID NO: 944778 - RNA, 15 nt, Mycobacterium avium subsp. paratuberculosis
ggccagccccaccac

SEQ ID NO: 944779 - RNA, 21 nt, Mycobacterium avium subsp. paratuberculosis
ggccagccccaccaccgccac

SEQ ID NO: 944780 - RNA, 22 nt, Mycobacterium avium subsp. paratuberculosis
ggccagccccaccaccgccacc

SEQ ID NO: 944781 - RNA, 15 nt, Mycobacterium avium subsp. paratuberculosis
ggccagcagggcgcc

SEQ ID NO: 944782 - RNA, 18 nt, Mycobacterium avium subsp. paratuberculosis
ggccagcagggcgccgac

SEQ ID NO: 944783 - RNA, 19 nt, Mycobacterium avium subsp. paratuberculosis
ggccagcagggcgccgacg

SEQ ID NO: 944784 - RNA, 19 nt, Mycobacterium avium subsp. paratuberculosis
ggccagcagcuugacgucg

SEQ ID NO: 944785 - RNA, 15 nt, Mycobacterium avium subsp. paratuberculosis
ggccagcagcguggg

SEQ ID NO: 944786 - RNA, 13 nt, Mycobacterium avium subsp. paratuberculosis
ggccacgccgacu

SEQ ID NO: 944787 - RNA, 23 nt, Mycobacterium avium subsp. paratuberculosis
ggccacgccgacuagcgcggcgg

SEQ ID NO: 944788 - RNA, 16 nt, Mycobacterium avium subsp. paratuberculosis
ggccaccuugucggcg

SEQ ID NO: 944789 - RNA, 18 nt, Mycobacterium avium subsp. paratuberculosis
ggccaccuugucggcgcc

SEQ ID NO: 944790 - RNA, 19 nt, Mycobacterium avium subsp. paratuberculosis
ggccaccuugcgcgggucg

SEQ ID NO: 944791 - RNA, 23 nt, Mycobacterium avium subsp. paratuberculosis
ggccaccuugcgcgggucgccgg

SEQ ID NO: 944792 - RNA, 18 nt, Mycobacterium avium subsp. paratuberculosis
ggccacgcuagcgugacg

SEQ ID NO: 944793 - RNA, 20 nt, Mycobacterium avium subsp. paratuberculosis
ggccacgcuagcgugacgcu

SEQ ID NO: 944794 - RNA, 13 nt, Mycobacterium avium subsp. paratuberculosis
ggccacggggucg

SEQ ID NO: 944795 - RNA, 13 nt, Mycobacterium avium subsp. paratuberculosis
ggccacggcguug

SEQ ID NO: 944796 - RNA, 14 nt, Mycobacterium avium subsp. paratuberculosis
ggccacggcguuga

SEQ ID NO: 944797 - RNA, 21 nt, Mycobacterium avium subsp. paratuberculosis
ggccacggcguugaccaacgc

SEQ ID NO: 944798 - RNA, 23 nt, Mycobacterium avium subsp. paratuberculosis
ggccacggcguugaccaacgccg

SEQ ID NO: 944799 - RNA, 19 nt, Mycobacterium avium subsp. paratuberculosis
ggccacgcucucgccgguc

SEQ ID NO: 944800 - RNA, 12 nt, Mycobacterium avium subsp. paratuberculosis
ggccacgcucgc

SEQ ID NO: 944801 - RNA, 17 nt, Mycobacterium avium subsp. paratuberculosis
ggccacgcucgccagac

SEQ ID NO: 944802 - RNA, 19 nt, Mycobacterium avium subsp. paratuberculosis
ggccacgcucgccagaccg

SEQ ID NO: 944803 - RNA, 16 nt, Mycobacterium avium subsp. paratuberculosis
ggccacgcucggcggc

SEQ ID NO: 944804 - RNA, 17 nt, Mycobacterium avium subsp. paratuberculosis
ggccacgcucggcggcg

SEQ ID NO: 944805 - RNA, 23 nt, Mycobacterium avium subsp. paratuberculosis
ggccacgcucgggccggcgccga

SEQ ID NO: 944806 - RNA, 14 nt, Mycobacterium avium subsp. paratuberculosis
ggccaccucguccc

SEQ ID NO: 944807 - RNA, 19 nt, Mycobacterium avium subsp. paratuberculosis
ggccaccucgucccagcgc

SEQ ID NO: 944808 - RNA, 16 nt, Mycobacterium avium subsp. paratuberculosis
ggccaccucgucggcg

SEQ ID NO: 944809 - RNA, 18 nt, Mycobacterium avium subsp. paratuberculosis
ggccaccucgucggcggu

SEQ ID NO: 944810 - RNA, 17 nt, Mycobacterium avium subsp. paratuberculosis
ggccaccgucuucgggg

SEQ ID NO: 944811 - RNA, 23 nt, Mycobacterium avium subsp. paratuberculosis
ggccaccgucuucggggccgccg

SEQ ID NO: 944812 - RNA, 14 nt, Mycobacterium avium subsp. paratuberculosis
ggccaccucgccgc

SEQ ID NO: 944813 - RNA, 12 nt, Mycobacterium avium subsp. paratuberculosis
ggccaccucggc

SEQ ID NO: 944814 - RNA, 13 nt, Mycobacterium avium subsp. paratuberculosis
ggccaccucggcg

SEQ ID NO: 944815 - RNA, 14 nt, Mycobacterium avium subsp. paratuberculosis
ggccaccucggcgg

SEQ ID NO: 944816 - RNA, 18 nt, Mycobacterium avium subsp. paratuberculosis
ggccaccucggcggcacc

SEQ ID NO: 944817 - RNA, 19 nt, Mycobacterium avium subsp. paratuberculosis
ggccaccucggcggcaccg

SEQ ID NO: 944818 - RNA, 20 nt, Mycobacterium avium subsp. paratuberculosis
ggccaccgucagcgucagca

SEQ ID NO: 944819 - RNA, 20 nt, Mycobacterium avium subsp. paratuberculosis
ggccaccgucaggguggugc

SEQ ID NO: 944820 - RNA, 16 nt, Mycobacterium avium subsp. paratuberculosis
ggccaccgucccggug

SEQ ID NO: 944821 - RNA, 19 nt, Mycobacterium avium subsp. paratuberculosis
ggccaccgucccggugucg

SEQ ID NO: 944822 - RNA, 19 nt, Mycobacterium avium subsp. paratuberculosis
ggccaccggcgcgacggcg

SEQ ID NO: 944823 - RNA, 11 nt, Mycobacterium avium subsp. paratuberculosis
ggccaccgggg

SEQ ID NO: 944824 - RNA, 16 nt, Mycobacterium avium subsp. paratuberculosis
ggccaccgggucgcca

SEQ ID NO: 944825 - RNA, 21 nt, Mycobacterium avium subsp. paratuberculosis
ggccaccgggucguccgcgac

SEQ ID NO: 944826 - RNA, 15 nt, Mycobacterium avium subsp. paratuberculosis
ggccacccgggcgcc

SEQ ID NO: 944827 - RNA, 14 nt, Mycobacterium avium subsp. paratuberculosis
ggccacccgcgauc

SEQ ID NO: 944828 - RNA, 15 nt, Mycobacterium avium subsp. paratuberculosis
ggccacccucgccgc

SEQ ID NO: 944829 - RNA, 16 nt, Mycobacterium avium subsp. paratuberculosis
ggccacccucgccgcc

SEQ ID NO: 944830 - RNA, 17 nt, Mycobacterium avium subsp. paratuberculosis
ggccacccucgccgccg

SEQ ID NO: 944831 - RNA, 21 nt, Mycobacterium avium subsp. paratuberculosis
ggccacccucgccgccgccga

SEQ ID NO: 944832 - RNA, 15 nt, Mycobacterium avium subsp. paratuberculosis
ggccaccgaagccga

SEQ ID NO: 944833 - RNA, 15 nt, Mycobacterium avium subsp. paratuberculosis
ggccacagcggcgac

SEQ ID NO: 944834 - RNA, 20 nt, Mycobacterium avium subsp. paratuberculosis
ggccaccagggacaugccga

SEQ ID NO: 944835 - RNA, 20 nt, Mycobacterium avium subsp. paratuberculosis
ggccacacuggcgugacgcu

SEQ ID NO: 944836 - RNA, 21 nt, Mycobacterium avium subsp. paratuberculosis
ggccaccaucaggccggccug

SEQ ID NO: 944837 - RNA, 24 nt, Mycobacterium avium subsp. paratuberculosis
ggccaccaucaggccggccugcca

SEQ ID NO: 944838 - RNA, 21 nt, Mycobacterium avium subsp. paratuberculosis
ggccaccaucuccgcggcgcg

SEQ ID NO: 944839 - RNA, 15 nt, Mycobacterium avium subsp. paratuberculosis
ggccaccaugccggc

SEQ ID NO: 944840 - RNA, 19 nt, Mycobacterium avium subsp. paratuberculosis
ggccaccaugccggcgucc

SEQ ID NO: 944841 - RNA, 17 nt, Mycobacterium avium subsp. paratuberculosis
ggccaccaugucggcgu

SEQ ID NO: 944842 - RNA, 21 nt, Mycobacterium avium subsp. paratuberculosis
ggccaccaugucggcgucgcc

SEQ ID NO: 944843 - RNA, 22 nt, Mycobacterium avium subsp. paratuberculosis
ggccaccccgcagaacaccagc

SEQ ID NO: 944844 - RNA, 23 nt, Mycobacterium avium subsp. paratuberculosis
ggccaccccgcagaacaccagcg

SEQ ID NO: 944845 - RNA, 14 nt, Mycobacterium avium subsp. paratuberculosis
ggccaccccgguga

SEQ ID NO: 944846 - RNA, 22 nt, Mycobacterium avium subsp. paratuberculosis
ggccacaacgucucugucgucg

SEQ ID NO: 944847 - RNA, 15 nt, Mycobacterium avium subsp. paratuberculosis
ggccacacccgucga

SEQ ID NO: 944848 - RNA, 17 nt, Mycobacterium avium subsp. paratuberculosis
ggccacacccgucgacu

SEQ ID NO: 944849 - RNA, 21 nt, Mycobacterium avium subsp. paratuberculosis
ggccacacccgucgacucggc

SEQ ID NO: 944850 - RNA, 22 nt, Mycobacterium avium subsp. paratuberculosis
ggccacacccgucgacucggcg

SEQ ID NO: 944851 - RNA, 16 nt, Mycobacterium avium subsp. paratuberculosis
ggccacaccgaucagc

SEQ ID NO: 944852 - RNA, 22 nt, Mycobacterium avium subsp. paratuberculosis
ggccaaguagacucagcgucga

SEQ ID NO: 944853 - RNA, 19 nt, Mycobacterium avium subsp. paratuberculosis
ggccaacgccucgucgacc

SEQ ID NO: 944854 - RNA, 22 nt, Mycobacterium avium subsp. paratuberculosis
ggccaacgccucgucgaccgcg

SEQ ID NO: 944855 - RNA, 21 nt, Mycobacterium avium subsp. paratuberculosis
ggccaacgcgauucucgcugc

SEQ ID NO: 944856 - RNA, 22 nt, Mycobacterium avium subsp. paratuberculosis
ggccaacgcguucuccucgaac

SEQ ID NO: 944857 - RNA, 15 nt, Mycobacterium avium subsp. paratuberculosis
ggccaacgagcgcgc

SEQ ID NO: 944858 - RNA, 18 nt, Mycobacterium avium subsp. paratuberculosis
ggccaacgagcgcgccga

SEQ ID NO: 944859 - RNA, 20 nt, Mycobacterium avium subsp. paratuberculosis
ggccaacgagcgcgccgagg

SEQ ID NO: 944860 - RNA, 18 nt, Mycobacterium avium subsp. paratuberculosis
ggccaacagugcgcaggc

SEQ ID NO: 944861 - RNA, 23 nt, Mycobacterium avium subsp. paratuberculosis
ggccaacagugcgcaggcggcgc

SEQ ID NO: 944862 - RNA, 17 nt, Mycobacterium avium subsp. paratuberculosis
ggccaacccgggcgcca

SEQ ID NO: 944863 - RNA, 20 nt, Mycobacterium avium subsp. paratuberculosis
ggccaacccgggcgccaucc

SEQ ID NO: 944864 - RNA, 15 nt, Mycobacterium avium subsp. paratuberculosis
ggccaaccgcccggc

SEQ ID NO: 944865 - RNA, 16 nt, Mycobacterium avium subsp. paratuberculosis
ggccaaccgcccggcg

SEQ ID NO: 944866 - RNA, 22 nt, Mycobacterium avium subsp. paratuberculosis
ggccaaccgcccggcgccgauc

SEQ ID NO: 944867 - RNA, 14 nt, Mycobacterium avium subsp. paratuberculosis
ggccaaggccagca

SEQ ID NO: 944868 - RNA, 23 nt, Mycobacterium avium subsp. paratuberculosis
ggccaacgguucggccgcucggg

SEQ ID NO: 944869 - RNA, 16 nt, Mycobacterium avium subsp. paratuberculosis
ggccaacucgaccugc

SEQ ID NO: 944870 - RNA, 21 nt, Mycobacterium avium subsp. paratuberculosis
ggccaacucgaccugcccggg

SEQ ID NO: 944871 - RNA, 20 nt, Mycobacterium avium subsp. paratuberculosis
ggccaacuccggcggcagcc

SEQ ID NO: 944872 - RNA, 17 nt, Mycobacterium avium subsp. paratuberculosis
ggcccgcgcaucccguc

SEQ ID NO: 944873 - RNA, 21 nt, Mycobacterium avium subsp. paratuberculosis
ggcccgcggcacgcugcgcca

SEQ ID NO: 944874 - RNA, 14 nt, Mycobacterium avium subsp. paratuberculosis
ggcccgcggcaucg

SEQ ID NO: 944875 - RNA, 21 nt, Mycobacterium avium subsp. paratuberculosis
ggcccgcgccgcgucgucguc

SEQ ID NO: 944876 - RNA, 23 nt, Mycobacterium avium subsp. paratuberculosis
ggcccgcgccgcgucgucgucga

SEQ ID NO: 944877 - RNA, 16 nt, Mycobacterium avium subsp. paratuberculosis
ggcccgcgccggcgug

SEQ ID NO: 944878 - RNA, 23 nt, Mycobacterium avium subsp. paratuberculosis
ggcccgcgccggcgugucggcgc

SEQ ID NO: 944879 - RNA, 14 nt, Mycobacterium avium subsp. paratuberculosis
ggcccgcgcggccg

SEQ ID NO: 944880 - RNA, 19 nt, Mycobacterium avium subsp. paratuberculosis
ggcccgcgcggccgccagg

SEQ ID NO: 944881 - RNA, 19 nt, Mycobacterium avium subsp. paratuberculosis
ggcccgcgcggcggugucg

SEQ ID NO: 944882 - RNA, 23 nt, Mycobacterium avium subsp. paratuberculosis
ggcccgcgcggcggugucggugc

SEQ ID NO: 944883 - RNA, 18 nt, Mycobacterium avium subsp. paratuberculosis
ggcccgcgccccggcggc

SEQ ID NO: 944884 - RNA, 21 nt, Mycobacterium avium subsp. paratuberculosis
ggcccgcgccccggcggccac

SEQ ID NO: 944885 - RNA, 16 nt, Mycobacterium avium subsp. paratuberculosis
ggcccgcgcccgcucg

SEQ ID NO: 944886 - RNA, 16 nt, Mycobacterium avium subsp. paratuberculosis
ggcccgccucggcggc

SEQ ID NO: 944887 - RNA, 15 nt, Mycobacterium avium subsp. paratuberculosis
ggcccgccgucgacc

SEQ ID NO: 944888 - RNA, 19 nt, Mycobacterium avium subsp. paratuberculosis
ggcccgccgucgaccacga

SEQ ID NO: 944889 - RNA, 14 nt, Mycobacterium avium subsp. paratuberculosis
ggcccgcccggcgg

SEQ ID NO: 944890 - RNA, 16 nt, Mycobacterium avium subsp. paratuberculosis
ggcccgcccggcggcg

SEQ ID NO: 944891 - RNA, 17 nt, Mycobacterium avium subsp. paratuberculosis
ggcccgcccggcggcgc

SEQ ID NO: 944892 - RNA, 18 nt, Mycobacterium avium subsp. paratuberculosis
ggcccgcccggcggcgcu

SEQ ID NO: 944893 - RNA, 14 nt, Mycobacterium avium subsp. paratuberculosis
ggcccgccgaacgc

SEQ ID NO: 944894 - RNA, 15 nt, Mycobacterium avium subsp. paratuberculosis
ggcccgccgaacgcc

SEQ ID NO: 944895 - RNA, 18 nt, Mycobacterium avium subsp. paratuberculosis
ggcccgccgaacgccucc

SEQ ID NO: 944896 - RNA, 22 nt, Mycobacterium avium subsp. paratuberculosis
ggcccgccgccggcgcuggcgc

SEQ ID NO: 944897 - RNA, 16 nt, Mycobacterium avium subsp. paratuberculosis
ggcccgccgccggcgg

SEQ ID NO: 944898 - RNA, 17 nt, Mycobacterium avium subsp. paratuberculosis
ggcccgccgccggcggc

SEQ ID NO: 944899 - RNA, 18 nt, Mycobacterium avium subsp. paratuberculosis
ggcccgccgccggcggcg

SEQ ID NO: 944900 - RNA, 15 nt, Mycobacterium avium subsp. paratuberculosis
ggcccgccgguggcc

SEQ ID NO: 944901 - RNA, 20 nt, Mycobacterium avium subsp. paratuberculosis
ggcccgccgguggccgcgcu

SEQ ID NO: 944902 - RNA, 22 nt, Mycobacterium avium subsp. paratuberculosis
ggcccgccgguggccgcgcugg

SEQ ID NO: 944903 - RNA, 19 nt, Mycobacterium avium subsp. paratuberculosis
ggcccgccguagcgccggc

SEQ ID NO: 944904 - RNA, 24 nt, Mycobacterium avium subsp. paratuberculosis
ggcccgccgcggcuccagcagcgg

SEQ ID NO: 944905 - RNA, 15 nt, Mycobacterium avium subsp. paratuberculosis
ggcccgccgcucacc

SEQ ID NO: 944906 - RNA, 19 nt, Mycobacterium avium subsp. paratuberculosis
ggcccgccgcucaccgccg

SEQ ID NO: 944907 - RNA, 23 nt, Mycobacterium avium subsp. paratuberculosis
ggcccgccgcucaccgccgagcc

SEQ ID NO: 944908 - RNA, 13 nt, Mycobacterium avium subsp. paratuberculosis
ggcccgccgcugc

SEQ ID NO: 944909 - RNA, 18 nt, Mycobacterium avium subsp. paratuberculosis
ggcccgccgcugcagcug

SEQ ID NO: 944910 - RNA, 17 nt, Mycobacterium avium subsp. paratuberculosis
ggcccgccggagccgau

SEQ ID NO: 944911 - RNA, 19 nt, Mycobacterium avium subsp. paratuberculosis
ggcccgccggagccgaucg

SEQ ID NO: 944912 - RNA, 21 nt, Mycobacterium avium subsp. paratuberculosis
ggcccgccggagccgaucgcc

SEQ ID NO: 944913 - RNA, 15 nt, Mycobacterium avium subsp. paratuberculosis
ggcccgccgggccgg

SEQ ID NO: 944914 - RNA, 19 nt, Mycobacterium avium subsp. paratuberculosis
ggcccgccgggccggaucg

SEQ ID NO: 944915 - RNA, 22 nt, Mycobacterium avium subsp. paratuberculosis
ggcccgccgggccggaucgcgc

SEQ ID NO: 944916 - RNA, 16 nt, Mycobacterium avium subsp. paratuberculosis
ggcccgccgggcgcca

SEQ ID NO: 944917 - RNA, 19 nt, Mycobacterium avium subsp. paratuberculosis
ggcccgccgggcgccacgc

SEQ ID NO: 944918 - RNA, 19 nt, Mycobacterium avium subsp. paratuberculosis
ggcccgccgggcgucgcgc

SEQ ID NO: 944919 - RNA, 20 nt, Mycobacterium avium subsp. paratuberculosis
ggcccgccgggcgucgcgcu

SEQ ID NO: 944920 - RNA, 21 nt, Mycobacterium avium subsp. paratuberculosis
ggcccgccgggcgucgcgcuc

SEQ ID NO: 944921 - RNA, 17 nt, Mycobacterium avium subsp. paratuberculosis
ggcccggacggagccgu

SEQ ID NO: 944922 - RNA, 14 nt, Mycobacterium avium subsp. paratuberculosis
ggcccggacggcca

SEQ ID NO: 944923 - RNA, 14 nt, Mycobacterium avium subsp. paratuberculosis
ggcccggaccgccg

SEQ ID NO: 944924 - RNA, 13 nt, Mycobacterium avium subsp. paratuberculosis
ggcccgcucgaug

SEQ ID NO: 944925 - RNA, 22 nt, Mycobacterium avium subsp. paratuberculosis
ggcccggcaccggugcggcggu

SEQ ID NO: 944926 - RNA, 14 nt, Mycobacterium avium subsp. paratuberculosis
ggcccggcagccgg

SEQ ID NO: 944927 - RNA, 16 nt, Mycobacterium avium subsp. paratuberculosis
ggcccggccaccaggg

SEQ ID NO: 944928 - RNA, 15 nt, Mycobacterium avium subsp. paratuberculosis
ggcccgcucgggcca

SEQ ID NO: 944929 - RNA, 18 nt, Mycobacterium avium subsp. paratuberculosis
ggcccgcugcagcgccga

SEQ ID NO: 944930 - RNA, 17 nt, Mycobacterium avium subsp. paratuberculosis
ggcccgcugcgcggccg

SEQ ID NO: 944931 - RNA, 14 nt, Mycobacterium avium subsp. paratuberculosis
ggcccgcuggccgc

SEQ ID NO: 944932 - RNA, 16 nt, Mycobacterium avium subsp. paratuberculosis
ggcccgcuucaggcag

SEQ ID NO: 944933 - RNA, 16 nt, Mycobacterium avium subsp. paratuberculosis
ggcccggaacgcgucg

SEQ ID NO: 944934 - RNA, 20 nt, Mycobacterium avium subsp. paratuberculosis
ggcccggaacgcgucgccca

SEQ ID NO: 944935 - RNA, 23 nt, Mycobacterium avium subsp. paratuberculosis
ggcccggaacgcgucgcccacgc

SEQ ID NO: 944936 - RNA, 18 nt, Mycobacterium avium subsp. paratuberculosis
ggcccgcucaccugcggc

SEQ ID NO: 944937 - RNA, 19 nt, Mycobacterium avium subsp. paratuberculosis
ggcccgcucaccugcggcc

SEQ ID NO: 944938 - RNA, 24 nt, Mycobacterium avium subsp. paratuberculosis
ggcccgcguaaccggcggcgguga

SEQ ID NO: 944939 - RNA, 17 nt, Mycobacterium avium subsp. paratuberculosis
ggcccgcggggcguacg

SEQ ID NO: 944940 - RNA, 20 nt, Mycobacterium avium subsp. paratuberculosis
ggcccgcggggcguacgcgc

SEQ ID NO: 944941 - RNA, 23 nt, Mycobacterium avium subsp. paratuberculosis
ggcccgcgggaucagcguguugg

SEQ ID NO: 944942 - RNA, 14 nt, Mycobacterium avium subsp. paratuberculosis
ggcccgcggcguca

SEQ ID NO: 944943 - RNA, 13 nt, Mycobacterium avium subsp. paratuberculosis
ggcccgcggcgcc

SEQ ID NO: 944944 - RNA, 15 nt, Mycobacterium avium subsp. paratuberculosis
ggcccgguuccagcg

SEQ ID NO: 944945 - RNA, 17 nt, Mycobacterium avium subsp. paratuberculosis
ggcccgguuccagcggc

SEQ ID NO: 944946 - RNA, 17 nt, Mycobacterium avium subsp. paratuberculosis
ggcccggugcgacgccg

SEQ ID NO: 944947 - RNA, 20 nt, Mycobacterium avium subsp. paratuberculosis
ggcccggugcgacgccgcgc

SEQ ID NO: 944948 - RNA, 23 nt, Mycobacterium avium subsp. paratuberculosis
ggcccggugcgacgccgcgcagc

SEQ ID NO: 944949 - RNA, 16 nt, Mycobacterium avium subsp. paratuberculosis
ggcccguagcucgcgc

SEQ ID NO: 944950 - RNA, 21 nt, Mycobacterium avium subsp. paratuberculosis
ggcccguagcucgcgccgacc

SEQ ID NO: 944951 - RNA, 14 nt, Mycobacterium avium subsp. paratuberculosis
ggcccguccccacc

SEQ ID NO: 944952 - RNA, 18 nt, Mycobacterium avium subsp. paratuberculosis
ggcccguccccaccaccg

SEQ ID NO: 944953 - RNA, 22 nt, Mycobacterium avium subsp. paratuberculosis
ggcccguccgcgaaucgauaac

SEQ ID NO: 944954 - RNA, 15 nt, Mycobacterium avium subsp. paratuberculosis
ggcccgucgccgauc

SEQ ID NO: 944955 - RNA, 16 nt, Mycobacterium avium subsp. paratuberculosis
ggcccgucgccgauca

SEQ ID NO: 944956 - RNA, 19 nt, Mycobacterium avium subsp. paratuberculosis
ggcccgucgccgaucagca

SEQ ID NO: 944957 - RNA, 14 nt, Mycobacterium avium subsp. paratuberculosis
ggcccgucgccggc

SEQ ID NO: 944958 - RNA, 17 nt, Mycobacterium avium subsp. paratuberculosis
ggcccgucgccggcgcg

SEQ ID NO: 944959 - RNA, 16 nt, Mycobacterium avium subsp. paratuberculosis
ggcccguugagcaccg

SEQ ID NO: 944960 - RNA, 13 nt, Mycobacterium avium subsp. paratuberculosis
ggcccggugagcc

SEQ ID NO: 944961 - RNA, 16 nt, Mycobacterium avium subsp. paratuberculosis
ggcccuauggcaucgc

SEQ ID NO: 944962 - RNA, 18 nt, Mycobacterium avium subsp. paratuberculosis
ggcccuauggcaucgcca

SEQ ID NO: 944963 - RNA, 19 nt, Mycobacterium avium subsp. paratuberculosis
ggcccuauggcaucgccaa

SEQ ID NO: 944964 - RNA, 15 nt, Mycobacterium avium subsp. paratuberculosis
ggcccucaucgucga

SEQ ID NO: 944965 - RNA, 17 nt, Mycobacterium avium subsp. paratuberculosis
ggcccucaucgucgacc

SEQ ID NO: 944966 - RNA, 20 nt, Mycobacterium avium subsp. paratuberculosis
ggcccucaucgucgacccgg

SEQ ID NO: 944967 - RNA, 21 nt, Mycobacterium avium subsp. paratuberculosis
ggcccucaucgucgacccggc

SEQ ID NO: 944968 - RNA, 18 nt, Mycobacterium avium subsp. paratuberculosis
ggcccuccacggugcgca

SEQ ID NO: 944969 - RNA, 13 nt, Mycobacterium avium subsp. paratuberculosis
ggcccgugucgcg

SEQ ID NO: 944970 - RNA, 14 nt, Mycobacterium avium subsp. paratuberculosis
ggcccgugcgggug

SEQ ID NO: 944971 - RNA, 12 nt, Mycobacterium avium subsp. paratuberculosis
ggcccgucggcg

SEQ ID NO: 944972 - RNA, 15 nt, Mycobacterium avium subsp. paratuberculosis
ggcccggucgacuug

SEQ ID NO: 944973 - RNA, 16 nt, Mycobacterium avium subsp. paratuberculosis
ggcccggucgucgagc

SEQ ID NO: 944974 - RNA, 22 nt, Mycobacterium avium subsp. paratuberculosis
ggcccggucgucgagcaccggc

SEQ ID NO: 944975 - RNA, 17 nt, Mycobacterium avium subsp. paratuberculosis
ggcccggucgucgccgg

SEQ ID NO: 944976 - RNA, 12 nt, Mycobacterium avium subsp. paratuberculosis
ggcccggguggc

SEQ ID NO: 944977 - RNA, 17 nt, Mycobacterium avium subsp. paratuberculosis
ggcccgguacagcgccg

SEQ ID NO: 944978 - RNA, 18 nt, Mycobacterium avium subsp. paratuberculosis
ggcccgguacagcgccgc

SEQ ID NO: 944979 - RNA, 20 nt, Mycobacterium avium subsp. paratuberculosis
ggcccgguacagcgccgcgg

SEQ ID NO: 944980 - RNA, 23 nt, Mycobacterium avium subsp. paratuberculosis
ggcccgguacagcgccgcggcca

SEQ ID NO: 944981 - RNA, 15 nt, Mycobacterium avium subsp. paratuberculosis
ggcccgguacaucga

SEQ ID NO: 944982 - RNA, 19 nt, Mycobacterium avium subsp. paratuberculosis
ggcccgguacaucgacgcg

SEQ ID NO: 944983 - RNA, 16 nt, Mycobacterium avium subsp. paratuberculosis
ggcccgggcgcugagc

SEQ ID NO: 944984 - RNA, 13 nt, Mycobacterium avium subsp. paratuberculosis
ggcccgggcggcg

SEQ ID NO: 944985 - RNA, 13 nt, Mycobacterium avium subsp. paratuberculosis
ggcccgggcgucc

SEQ ID NO: 944986 - RNA, 17 nt, Mycobacterium avium subsp. paratuberculosis
ggcccgggcugcccggg

SEQ ID NO: 944987 - RNA, 21 nt, Mycobacterium avium subsp. paratuberculosis
ggcccggggugugcccgaacg

SEQ ID NO: 944988 - RNA, 19 nt, Mycobacterium avium subsp. paratuberculosis
ggcccgggcgauucgucgu

SEQ ID NO: 944989 - RNA, 20 nt, Mycobacterium avium subsp. paratuberculosis
ggcccgggcgauucgucguc

SEQ ID NO: 944990 - RNA, 21 nt, Mycobacterium avium subsp. paratuberculosis
ggcccgggccacccgcgaucg

SEQ ID NO: 944991 - RNA, 19 nt, Mycobacterium avium subsp. paratuberculosis
ggcccggcucggaaccguu

SEQ ID NO: 944992 - RNA, 14 nt, Mycobacterium avium subsp. paratuberculosis
ggcccggcggguca

SEQ ID NO: 944993 - RNA, 13 nt, Mycobacterium avium subsp. paratuberculosis
ggcccggcgggca

SEQ ID NO: 944994 - RNA, 17 nt, Mycobacterium avium subsp. paratuberculosis
ggcccggcgcggcggcg

SEQ ID NO: 944995 - RNA, 18 nt, Mycobacterium avium subsp. paratuberculosis
ggcccggcgcggcggcgc

SEQ ID NO: 944996 - RNA, 23 nt, Mycobacterium avium subsp. paratuberculosis
ggcccggcgcggcggcgccgcgg

SEQ ID NO: 944997 - RNA, 13 nt, Mycobacterium avium subsp. paratuberculosis
ggcccggccggcg

SEQ ID NO: 944998 - RNA, 14 nt, Mycobacterium avium subsp. paratuberculosis
ggcccggccggcgc

SEQ ID NO: 944999 - RNA, 15 nt, Mycobacterium avium subsp. paratuberculosis
ggcccggccggcgcg

SEQ ID NO: 945000 - RNA, 18 nt, Mycobacterium avium subsp. paratuberculosis
ggcccggcgaugccgagc

SEQ ID NO: 945001 - RNA, 15 nt, Mycobacterium avium subsp. paratuberculosis
ggcccggcgcggccg

SEQ ID NO: 945002 - RNA, 19 nt, Mycobacterium avium subsp. paratuberculosis
ggcccggcgcggccggugc

SEQ ID NO: 945003 - RNA, 15 nt, Mycobacterium avium subsp. paratuberculosis
ggcccggcgcggcgg

SEQ ID NO: 945004 - RNA, 13 nt, Mycobacterium avium subsp. paratuberculosis
ggcccggcccgcu

SEQ ID NO: 945005 - RNA, 16 nt, Mycobacterium avium subsp. paratuberculosis
ggcccggcccggcgau

SEQ ID NO: 945006 - RNA, 18 nt, Mycobacterium avium subsp. paratuberculosis
ggcccggcccggcgaugc

SEQ ID NO: 945007 - RNA, 11 nt, Mycobacterium avium subsp. paratuberculosis
ggcccgccaga

SEQ ID NO: 945008 - RNA, 14 nt, Mycobacterium avium subsp. paratuberculosis
ggcccgccagaucg

SEQ ID NO: 945009 - RNA, 12 nt, Mycobacterium avium subsp. paratuberculosis
ggcccgcccagc

SEQ ID NO: 945010 - RNA, 18 nt, Mycobacterium avium subsp. paratuberculosis
ggcccgccaucgcccggu

SEQ ID NO: 945011 - RNA, 22 nt, Mycobacterium avium subsp. paratuberculosis
ggcccgccccugagggugucgg

SEQ ID NO: 945012 - RNA, 14 nt, Mycobacterium avium subsp. paratuberculosis
ggcccgcccgcagc

SEQ ID NO: 945013 - RNA, 20 nt, Mycobacterium avium subsp. paratuberculosis
ggcccgcccgcagcggcggu

SEQ ID NO: 945014 - RNA, 23 nt, Mycobacterium avium subsp. paratuberculosis
ggcccgcccgcagcggcgguugc

SEQ ID NO: 945015 - RNA, 13 nt, Mycobacterium avium subsp. paratuberculosis
ggcccgcaugcac

SEQ ID NO: 945016 - RNA, 18 nt, Mycobacterium avium subsp. paratuberculosis
ggcccgcacggccgccag

SEQ ID NO: 945017 - RNA, 22 nt, Mycobacterium avium subsp. paratuberculosis
ggcccgcacguagacggugucg

SEQ ID NO: 945018 - RNA, 16 nt, Mycobacterium avium subsp. paratuberculosis
ggcccgcaggaucgag

SEQ ID NO: 945019 - RNA, 23 nt, Mycobacterium avium subsp. paratuberculosis
ggcccgcaggaucgagccggccg

SEQ ID NO: 945020 - RNA, 15 nt, Mycobacterium avium subsp. paratuberculosis
ggcccgaugcggacc

SEQ ID NO: 945021 - RNA, 15 nt, Mycobacterium avium subsp. paratuberculosis
ggcccgauggcggcc

SEQ ID NO: 945022 - RNA, 11 nt, Mycobacterium avium subsp. paratuberculosis
ggcccgcacca

SEQ ID NO: 945023 - RNA, 17 nt, Mycobacterium avium subsp. paratuberculosis
ggcccgcaccacccagc

SEQ ID NO: 945024 - RNA, 12 nt, Mycobacterium avium subsp. paratuberculosis
ggcccgcacccg

SEQ ID NO: 945025 - RNA, 15 nt, Mycobacterium avium subsp. paratuberculosis
ggcccgcacccgccg

SEQ ID NO: 945026 - RNA, 20 nt, Mycobacterium avium subsp. paratuberculosis
ggcccgcaccgauggguugg

SEQ ID NO: 945027 - RNA, 17 nt, Mycobacterium avium subsp. paratuberculosis
ggcccgaucucgcgcgg

SEQ ID NO: 945028 - RNA, 21 nt, Mycobacterium avium subsp. paratuberculosis
ggcccgaucucgcgcgggucg

SEQ ID NO: 945029 - RNA, 13 nt, Mycobacterium avium subsp. paratuberculosis
ggcccgaucaccg

SEQ ID NO: 945030 - RNA, 16 nt, Mycobacterium avium subsp. paratuberculosis
ggcccgaucagggucc

SEQ ID NO: 945031 - RNA, 15 nt, Mycobacterium avium subsp. paratuberculosis
ggcccgaucgcggcg

SEQ ID NO: 945032 - RNA, 18 nt, Mycobacterium avium subsp. paratuberculosis
ggcccgaucgcggcgagc

SEQ ID NO: 945033 - RNA, 14 nt, Mycobacterium avium subsp. paratuberculosis
ggcccgaucgcguc

SEQ ID NO: 945034 - RNA, 22 nt, Mycobacterium avium subsp. paratuberculosis
ggcccgagguccucgcgcaacu

SEQ ID NO: 945035 - RNA, 14 nt, Mycobacterium avium subsp. paratuberculosis
ggcccgacggguuc

SEQ ID NO: 945036 - RNA, 22 nt, Mycobacterium avium subsp. paratuberculosis
ggcccgacggguucgcgcagcc

SEQ ID NO: 945037 - RNA, 21 nt, Mycobacterium avium subsp. paratuberculosis
ggcccgagugugcauccuggg

SEQ ID NO: 945038 - RNA, 12 nt, Mycobacterium avium subsp. paratuberculosis
ggcccgaccagc

SEQ ID NO: 945039 - RNA, 15 nt, Mycobacterium avium subsp. paratuberculosis
ggcccgaccagcggg

SEQ ID NO: 945040 - RNA, 21 nt, Mycobacterium avium subsp. paratuberculosis
ggcccgaccagcgggccgaca

SEQ ID NO: 945041 - RNA, 19 nt, Mycobacterium avium subsp. paratuberculosis
ggcccccugaucggccgca

SEQ ID NO: 945042 - RNA, 21 nt, Mycobacterium avium subsp. paratuberculosis
ggccccgcgcaucggucagca

SEQ ID NO: 945043 - RNA, 12 nt, Mycobacterium avium subsp. paratuberculosis
ggcccgacgacg

SEQ ID NO: 945044 - RNA, 13 nt, Mycobacterium avium subsp. paratuberculosis
ggcccgacgacgc

SEQ ID NO: 945045 - RNA, 15 nt, Mycobacterium avium subsp. paratuberculosis
ggcccgagcaccacc

SEQ ID NO: 945046 - RNA, 13 nt, Mycobacterium avium subsp. paratuberculosis
ggcccgagcccga

SEQ ID NO: 945047 - RNA, 15 nt, Mycobacterium avium subsp. paratuberculosis
ggcccgagcccgacg

SEQ ID NO: 945048 - RNA, 19 nt, Mycobacterium avium subsp. paratuberculosis
ggcccgagcccgacggcag

SEQ ID NO: 945049 - RNA, 20 nt, Mycobacterium avium subsp. paratuberculosis
ggcccgagcccgacggcagc

SEQ ID NO: 945050 - RNA, 13 nt, Mycobacterium avium subsp. paratuberculosis
ggccccgccagau

SEQ ID NO: 945051 - RNA, 15 nt, Mycobacterium avium subsp. paratuberculosis
ggccccgcccggcgc

SEQ ID NO: 945052 - RNA, 18 nt, Mycobacterium avium subsp. paratuberculosis
ggccccgcccggcgcgca

SEQ ID NO: 945053 - RNA, 19 nt, Mycobacterium avium subsp. paratuberculosis
ggccccgcccggggcggcg

SEQ ID NO: 945054 - RNA, 18 nt, Mycobacterium avium subsp. paratuberculosis
ggccccccgcacaccggc

SEQ ID NO: 945055 - RNA, 23 nt, Mycobacterium avium subsp. paratuberculosis
ggccccagaaccgcucggcggcg

SEQ ID NO: 945056 - RNA, 18 nt, Mycobacterium avium subsp. paratuberculosis
ggcccccgccccagcccg

SEQ ID NO: 945057 - RNA, 16 nt, Mycobacterium avium subsp. paratuberculosis
ggcccccgccucgccg

SEQ ID NO: 945058 - RNA, 20 nt, Mycobacterium avium subsp. paratuberculosis
ggcccccggcucgaucgcgg

SEQ ID NO: 945059 - RNA, 13 nt, Mycobacterium avium subsp. paratuberculosis
ggccaggccggcc

SEQ ID NO: 945060 - RNA, 16 nt, Mycobacterium avium subsp. paratuberculosis
ggccaggcccugccag

SEQ ID NO: 945061 - RNA, 17 nt, Mycobacterium avium subsp. paratuberculosis
ggccaggcccugccagc

SEQ ID NO: 945062 - RNA, 18 nt, Mycobacterium avium subsp. paratuberculosis
ggccaggcccugccagcg

SEQ ID NO: 945063 - RNA, 14 nt, Mycobacterium avium subsp. paratuberculosis
ggccaggccggcga

SEQ ID NO: 945064 - RNA, 16 nt, Mycobacterium avium subsp. paratuberculosis
ggccaggccggcgacg

SEQ ID NO: 945065 - RNA, 17 nt, Mycobacterium avium subsp. paratuberculosis
ggccaggccggcgacga

SEQ ID NO: 945066 - RNA, 14 nt, Mycobacterium avium subsp. paratuberculosis
ggccaggcccagcc

SEQ ID NO: 945067 - RNA, 22 nt, Mycobacterium avium subsp. paratuberculosis
ggccaggauguucaccccggcg

SEQ ID NO: 945068 - RNA, 19 nt, Mycobacterium avium subsp. paratuberculosis
ggccaggaucucgcgggcc

SEQ ID NO: 945069 - RNA, 16 nt, Mycobacterium avium subsp. paratuberculosis
ggccaggaucucgucg

SEQ ID NO: 945070 - RNA, 16 nt, Mycobacterium avium subsp. paratuberculosis
ggccaggaugaccgcc

SEQ ID NO: 945071 - RNA, 22 nt, Mycobacterium avium subsp. paratuberculosis
ggccaggaugaccgcccaggac

SEQ ID NO: 945072 - RNA, 17 nt, Mycobacterium avium subsp. paratuberculosis
ggccaggaucgcguuga

SEQ ID NO: 945073 - RNA, 22 nt, Mycobacterium avium subsp. paratuberculosis
ggccaggaagaacuccgcgaug

SEQ ID NO: 945074 - RNA, 19 nt, Mycobacterium avium subsp. paratuberculosis
ggccaggaagccggcgacg

SEQ ID NO: 945075 - RNA, 12 nt, Mycobacterium avium subsp. paratuberculosis
ggccccagccac

SEQ ID NO: 945076 - RNA, 14 nt, Mycobacterium avium subsp. paratuberculosis
ggccccagccgccg

SEQ ID NO: 945077 - RNA, 24 nt, Mycobacterium avium subsp. paratuberculosis
ggccccacgcgcucagcgcggcca

SEQ ID NO: 945078 - RNA, 21 nt, Mycobacterium avium subsp. paratuberculosis
ggccccacguugaucaugucg

SEQ ID NO: 945079 - RNA, 16 nt, Mycobacterium avium subsp. paratuberculosis
ggccccaccgccgcug

SEQ ID NO: 945080 - RNA, 20 nt, Mycobacterium avium subsp. paratuberculosis
ggcccaugaguugggucaca

SEQ ID NO: 945081 - RNA, 13 nt, Mycobacterium avium subsp. paratuberculosis
ggccaggcgggcc

SEQ ID NO: 945082 - RNA, 14 nt, Mycobacterium avium subsp. paratuberculosis
ggccaggcguuugg

SEQ ID NO: 945083 - RNA, 16 nt, Mycobacterium avium subsp. paratuberculosis
ggccaggcguuuggug

SEQ ID NO: 945084 - RNA, 14 nt, Mycobacterium avium subsp. paratuberculosis
ggccaggcgcgcgc

SEQ ID NO: 945085 - RNA, 17 nt, Mycobacterium avium subsp. paratuberculosis
ggccaggcgcgcgcugg

SEQ ID NO: 945086 - RNA, 15 nt, Mycobacterium avium subsp. paratuberculosis
ggccaggcgcccagc

SEQ ID NO: 945087 - RNA, 17 nt, Mycobacterium avium subsp. paratuberculosis
ggccaggcgcccagcac

SEQ ID NO: 945088 - RNA, 15 nt, Mycobacterium avium subsp. paratuberculosis
ggcccuucgaccucg

SEQ ID NO: 945089 - RNA, 16 nt, Mycobacterium avium subsp. paratuberculosis
ggcccuguucgccguc

SEQ ID NO: 945090 - RNA, 17 nt, Mycobacterium avium subsp. paratuberculosis
ggcccuggucggccagg

SEQ ID NO: 945091 - RNA, 20 nt, Mycobacterium avium subsp. paratuberculosis
ggcccugguugagcaccgcg

SEQ ID NO: 945092 - RNA, 22 nt, Mycobacterium avium subsp. paratuberculosis
ggcccugguugagcaccgcgau

SEQ ID NO: 945093 - RNA, 15 nt, Mycobacterium avium subsp. paratuberculosis
ggcccuggcagguga

SEQ ID NO: 945094 - RNA, 16 nt, Mycobacterium avium subsp. paratuberculosis
ggcccuucucggacgc

SEQ ID NO: 945095 - RNA, 16 nt, Mycobacterium avium subsp. paratuberculosis
ggccgaaacgcccggc

SEQ ID NO: 945096 - RNA, 17 nt, Mycobacterium avium subsp. paratuberculosis
ggccgaaacgcccggcu

SEQ ID NO: 945097 - RNA, 12 nt, Mycobacterium avium subsp. paratuberculosis
ggccgaaccgga

SEQ ID NO: 945098 - RNA, 17 nt, Mycobacterium avium subsp. paratuberculosis
ggccgaaccgcagccgg

SEQ ID NO: 945099 - RNA, 16 nt, Mycobacterium avium subsp. paratuberculosis
ggccgaacagcagcga

SEQ ID NO: 945100 - RNA, 19 nt, Mycobacterium avium subsp. paratuberculosis
ggccgaaaaaccugcggug

SEQ ID NO: 945101 - RNA, 14 nt, Mycobacterium avium subsp. paratuberculosis
ggccgaaaaacggc

SEQ ID NO: 945102 - RNA, 17 nt, Mycobacterium avium subsp. paratuberculosis
ggccgaaaucaacgcgc

SEQ ID NO: 945103 - RNA, 15 nt, Mycobacterium avium subsp. paratuberculosis
ggccgaacacggccg

SEQ ID NO: 945104 - RNA, 17 nt, Mycobacterium avium subsp. paratuberculosis
ggcccugcgcggccugc

SEQ ID NO: 945105 - RNA, 18 nt, Mycobacterium avium subsp. paratuberculosis
ggcccugcgcggccugca

SEQ ID NO: 945106 - RNA, 12 nt, Mycobacterium avium subsp. paratuberculosis
ggcccugcggcc

SEQ ID NO: 945107 - RNA, 13 nt, Mycobacterium avium subsp. paratuberculosis
ggcccugcggcca

SEQ ID NO: 945108 - RNA, 22 nt, Mycobacterium avium subsp. paratuberculosis
ggcccugcggccagugccgggc

SEQ ID NO: 945109 - RNA, 12 nt, Mycobacterium avium subsp. paratuberculosis
ggcccugcucgu

SEQ ID NO: 945110 - RNA, 18 nt, Mycobacterium avium subsp. paratuberculosis
ggcccugcucgucguuga

SEQ ID NO: 945111 - RNA, 17 nt, Mycobacterium avium subsp. paratuberculosis
ggcccugcucuucgcgc

SEQ ID NO: 945112 - RNA, 22 nt, Mycobacterium avium subsp. paratuberculosis
ggcccugcucuucgcgcgcggc

SEQ ID NO: 945113 - RNA, 15 nt, Mycobacterium avium subsp. paratuberculosis
ggcccucgccgcggu

SEQ ID NO: 945114 - RNA, 17 nt, Mycobacterium avium subsp. paratuberculosis
ggcccucgccgcgguca

SEQ ID NO: 945115 - RNA, 15 nt, Mycobacterium avium subsp. paratuberculosis
ggcccugccagcgcc

SEQ ID NO: 945116 - RNA, 16 nt, Mycobacterium avium subsp. paratuberculosis
ggcccugccagcgccc

SEQ ID NO: 945117 - RNA, 12 nt, Mycobacterium avium subsp. paratuberculosis
ggcccucguccg

SEQ ID NO: 945118 - RNA, 21 nt, Mycobacterium avium subsp. paratuberculosis
ggcccucguccgacagcgccu

SEQ ID NO: 945119 - RNA, 22 nt, Mycobacterium avium subsp. paratuberculosis
ggcccucguccgacagcgccug

SEQ ID NO: 945120 - RNA, 17 nt, Mycobacterium avium subsp. paratuberculosis
ggcccucgucggcgagc

SEQ ID NO: 945121 - RNA, 23 nt, Mycobacterium avium subsp. paratuberculosis
ggcccucggaggugccgcgcggc

SEQ ID NO: 945122 - RNA, 12 nt, Mycobacterium avium subsp. paratuberculosis
ggcccucgacgu

SEQ ID NO: 945123 - RNA, 14 nt, Mycobacterium avium subsp. paratuberculosis
ggcccuccugggug

SEQ ID NO: 945124 - RNA, 15 nt, Mycobacterium avium subsp. paratuberculosis
ggcccuccuggguga

SEQ ID NO: 945125 - RNA, 17 nt, Mycobacterium avium subsp. paratuberculosis
ggcccucccccgagucg

SEQ ID NO: 945126 - RNA, 19 nt, Mycobacterium avium subsp. paratuberculosis
ggccgacaacauccgcgac

SEQ ID NO: 945127 - RNA, 20 nt, Mycobacterium avium subsp. paratuberculosis
ggccgacaacauccgcgacg

SEQ ID NO: 945128 - RNA, 16 nt, Mycobacterium avium subsp. paratuberculosis
ggccgacaccccgaug

SEQ ID NO: 945129 - RNA, 17 nt, Mycobacterium avium subsp. paratuberculosis
ggccgacaacgacagca

SEQ ID NO: 945130 - RNA, 14 nt, Mycobacterium avium subsp. paratuberculosis
ggccgaacgggucg

SEQ ID NO: 945131 - RNA, 18 nt, Mycobacterium avium subsp. paratuberculosis
ggccgaacgggucggcga

SEQ ID NO: 945132 - RNA, 14 nt, Mycobacterium avium subsp. paratuberculosis
ggccgaaggcggcg

SEQ ID NO: 945133 - RNA, 16 nt, Mycobacterium avium subsp. paratuberculosis
ggccgaaggcggcgcc

SEQ ID NO: 945134 - RNA, 17 nt, Mycobacterium avium subsp. paratuberculosis
ggccgaaggcggcgccg

SEQ ID NO: 945135 - RNA, 20 nt, Mycobacterium avium subsp. paratuberculosis
ggccgaaggcggcgccggcc

SEQ ID NO: 945136 - RNA, 18 nt, Mycobacterium avium subsp. paratuberculosis
ggccgaaggugggguuga

SEQ ID NO: 945137 - RNA, 19 nt, Mycobacterium avium subsp. paratuberculosis
ggccgaaguccaagucgag

SEQ ID NO: 945138 - RNA, 19 nt, Mycobacterium avium subsp. paratuberculosis
ggccgaacgggucggcgac

SEQ ID NO: 945139 - RNA, 21 nt, Mycobacterium avium subsp. paratuberculosis
ggccgaacugcaucaugucca

SEQ ID NO: 945140 - RNA, 15 nt, Mycobacterium avium subsp. paratuberculosis
ggccgaauccggccg

SEQ ID NO: 945141 - RNA, 20 nt, Mycobacterium avium subsp. paratuberculosis
ggccgaagaacucagccgaa

SEQ ID NO: 945142 - RNA, 14 nt, Mycobacterium avium subsp. paratuberculosis
ggccgaagaccggg

SEQ ID NO: 945143 - RNA, 18 nt, Mycobacterium avium subsp. paratuberculosis
ggccgaagaccgggccga

SEQ ID NO: 945144 - RNA, 15 nt, Mycobacterium avium subsp. paratuberculosis
ggccgaagacgauga

SEQ ID NO: 945145 - RNA, 16 nt, Mycobacterium avium subsp. paratuberculosis
ggccgaacgauggugu

SEQ ID NO: 945146 - RNA, 20 nt, Mycobacterium avium subsp. paratuberculosis
ggccgaacgggucggcgacc

SEQ ID NO: 945147 - RNA, 21 nt, Mycobacterium avium subsp. paratuberculosis
ggccgaccggucucgaccgcg

SEQ ID NO: 945148 - RNA, 14 nt, Mycobacterium avium subsp. paratuberculosis
ggccgaccgucagc

SEQ ID NO: 945149 - RNA, 21 nt, Mycobacterium avium subsp. paratuberculosis
ggccgaccgucagccaaaccg

SEQ ID NO: 945150 - RNA, 14 nt, Mycobacterium avium subsp. paratuberculosis
ggccgaccccgaug

SEQ ID NO: 945151 - RNA, 13 nt, Mycobacterium avium subsp. paratuberculosis
ggccgaccggccg

SEQ ID NO: 945152 - RNA, 14 nt, Mycobacterium avium subsp. paratuberculosis
ggccgaccggccgg

SEQ ID NO: 945153 - RNA, 22 nt, Mycobacterium avium subsp. paratuberculosis
ggccgacccugcguccggcccg

SEQ ID NO: 945154 - RNA, 15 nt, Mycobacterium avium subsp. paratuberculosis
ggccgaccgacaguu

SEQ ID NO: 945155 - RNA, 24 nt, Mycobacterium avium subsp. paratuberculosis
ggccgaccgacaguucggcgcgca

SEQ ID NO: 945156 - RNA, 15 nt, Mycobacterium avium subsp. paratuberculosis
ggccgaccgccgcca

SEQ ID NO: 945157 - RNA, 14 nt, Mycobacterium avium subsp. paratuberculosis
ggccgaccuggcgg

SEQ ID NO: 945158 - RNA, 14 nt, Mycobacterium avium subsp. paratuberculosis
ggccgacgcccagc

SEQ ID NO: 945159 - RNA, 15 nt, Mycobacterium avium subsp. paratuberculosis
ggccgacccggccga

SEQ ID NO: 945160 - RNA, 23 nt, Mycobacterium avium subsp. paratuberculosis
ggccgacagguagcaggcgcgca

SEQ ID NO: 945161 - RNA, 14 nt, Mycobacterium avium subsp. paratuberculosis
ggccgacaucgucg

SEQ ID NO: 945162 - RNA, 18 nt, Mycobacterium avium subsp. paratuberculosis
ggccgacaucgucggcuc

SEQ ID NO: 945163 - RNA, 20 nt, Mycobacterium avium subsp. paratuberculosis
ggccgacauggacgcggccu

SEQ ID NO: 945164 - RNA, 22 nt, Mycobacterium avium subsp. paratuberculosis
ggccgacacguaggccgccugc

SEQ ID NO: 945165 - RNA, 16 nt, Mycobacterium avium subsp. paratuberculosis
ggccgacagcgcgucg

SEQ ID NO: 945166 - RNA, 19 nt, Mycobacterium avium subsp. paratuberculosis
ggccgacagcgcgucggcg

SEQ ID NO: 945167 - RNA, 21 nt, Mycobacterium avium subsp. paratuberculosis
ggccgacagcgcgucggcgau

SEQ ID NO: 945168 - RNA, 16 nt, Mycobacterium avium subsp. paratuberculosis
ggccgagcgcagcggg

SEQ ID NO: 945169 - RNA, 13 nt, Mycobacterium avium subsp. paratuberculosis
ggccgagcgcagc

SEQ ID NO: 945170 - RNA, 18 nt, Mycobacterium avium subsp. paratuberculosis
ggccgagcgcgccgagca

SEQ ID NO: 945171 - RNA, 19 nt, Mycobacterium avium subsp. paratuberculosis
ggccgagcgcgccgagcag

SEQ ID NO: 945172 - RNA, 22 nt, Mycobacterium avium subsp. paratuberculosis
ggccgagcgcgccgagcagcug

SEQ ID NO: 945173 - RNA, 17 nt, Mycobacterium avium subsp. paratuberculosis
ggccgagcgcgccgccg

SEQ ID NO: 945174 - RNA, 20 nt, Mycobacterium avium subsp. paratuberculosis
ggccgagccgagccgacccg

SEQ ID NO: 945175 - RNA, 20 nt, Mycobacterium avium subsp. paratuberculosis
ggccgagccgaugcccagca

SEQ ID NO: 945176 - RNA, 13 nt, Mycobacterium avium subsp. paratuberculosis
ggccgagccggcg

SEQ ID NO: 945177 - RNA, 22 nt, Mycobacterium avium subsp. paratuberculosis
ggccgagccggcguacccgccc

SEQ ID NO: 945178 - RNA, 13 nt, Mycobacterium avium subsp. paratuberculosis
ggccgagccgggc

SEQ ID NO: 945179 - RNA, 21 nt, Mycobacterium avium subsp. paratuberculosis
ggccgagccgggcggccagcg

SEQ ID NO: 945180 - RNA, 17 nt, Mycobacterium avium subsp. paratuberculosis
ggccgagcgcaccgcgg

SEQ ID NO: 945181 - RNA, 19 nt, Mycobacterium avium subsp. paratuberculosis
ggccgagcgcaccgcggag

SEQ ID NO: 945182 - RNA, 15 nt, Mycobacterium avium subsp. paratuberculosis
ggccgaggcugucgg

SEQ ID NO: 945183 - RNA, 14 nt, Mycobacterium avium subsp. paratuberculosis
ggccgaggccucca

SEQ ID NO: 945184 - RNA, 13 nt, Mycobacterium avium subsp. paratuberculosis
ggccgagcgcgcc

SEQ ID NO: 945185 - RNA, 18 nt, Mycobacterium avium subsp. paratuberculosis
ggccgagcguucggcgcg

SEQ ID NO: 945186 - RNA, 19 nt, Mycobacterium avium subsp. paratuberculosis
ggccgagcguucggcgcgg

SEQ ID NO: 945187 - RNA, 23 nt, Mycobacterium avium subsp. paratuberculosis
ggccgacgugcuuggccagcucg

SEQ ID NO: 945188 - RNA, 20 nt, Mycobacterium avium subsp. paratuberculosis
ggccgacuuggucagcccgc

SEQ ID NO: 945189 - RNA, 21 nt, Mycobacterium avium subsp. paratuberculosis
ggccgacuuggucagcccgcg

SEQ ID NO: 945190 - RNA, 13 nt, Mycobacterium avium subsp. paratuberculosis
ggccgagcagccg

SEQ ID NO: 945191 - RNA, 14 nt, Mycobacterium avium subsp. paratuberculosis
ggccgagagccggu

SEQ ID NO: 945192 - RNA, 16 nt, Mycobacterium avium subsp. paratuberculosis
ggccgacgcuggccga

SEQ ID NO: 945193 - RNA, 14 nt, Mycobacterium avium subsp. paratuberculosis
ggccgacgcggccu

SEQ ID NO: 945194 - RNA, 16 nt, Mycobacterium avium subsp. paratuberculosis
ggccgacgccggccac

SEQ ID NO: 945195 - RNA, 18 nt, Mycobacterium avium subsp. paratuberculosis
ggccgacgccggccacca

SEQ ID NO: 945196 - RNA, 21 nt, Mycobacterium avium subsp. paratuberculosis
ggccgacgccggccaccaaca

SEQ ID NO: 945197 - RNA, 20 nt, Mycobacterium avium subsp. paratuberculosis
ggccgaugagccucagcgcg

SEQ ID NO: 945198 - RNA, 16 nt, Mycobacterium avium subsp. paratuberculosis
ggccgaugaugaugcc

SEQ ID NO: 945199 - RNA, 18 nt, Mycobacterium avium subsp. paratuberculosis
ggccgaugaugaugccgc

SEQ ID NO: 945200 - RNA, 21 nt, Mycobacterium avium subsp. paratuberculosis
ggccgaugaugaugccgccca

SEQ ID NO: 945201 - RNA, 17 nt, Mycobacterium avium subsp. paratuberculosis
ggccgaucccggccacg

SEQ ID NO: 945202 - RNA, 14 nt, Mycobacterium avium subsp. paratuberculosis
ggccgaugaccgcg

SEQ ID NO: 945203 - RNA, 15 nt, Mycobacterium avium subsp. paratuberculosis
ggccgaugaccgcgg

SEQ ID NO: 945204 - RNA, 17 nt, Mycobacterium avium subsp. paratuberculosis
ggccgaugaccgcggcg

SEQ ID NO: 945205 - RNA, 18 nt, Mycobacterium avium subsp. paratuberculosis
ggccgaugaccgcggcgg

SEQ ID NO: 945206 - RNA, 15 nt, Mycobacterium avium subsp. paratuberculosis
ggccgauucggcgcc

SEQ ID NO: 945207 - RNA, 18 nt, Mycobacterium avium subsp. paratuberculosis
ggccgauucggcgccgcg

SEQ ID NO: 945208 - RNA, 21 nt, Mycobacterium avium subsp. paratuberculosis
ggccgauucggcgccgcgacc

SEQ ID NO: 945209 - RNA, 18 nt, Mycobacterium avium subsp. paratuberculosis
ggccgauguucaccccga

SEQ ID NO: 945210 - RNA, 21 nt, Mycobacterium avium subsp. paratuberculosis
ggccgauguucaccccgauca

SEQ ID NO: 945211 - RNA, 16 nt, Mycobacterium avium subsp. paratuberculosis
ggccgaucagcggcgg

SEQ ID NO: 945212 - RNA, 17 nt, Mycobacterium avium subsp. paratuberculosis
ggccgaucagcggcggg

SEQ ID NO: 945213 - RNA, 18 nt, Mycobacterium avium subsp. paratuberculosis
ggccgaucagcggcgggc

SEQ ID NO: 945214 - RNA, 21 nt, Mycobacterium avium subsp. paratuberculosis
ggccgaucagcugcucggcca

SEQ ID NO: 945215 - RNA, 16 nt, Mycobacterium avium subsp. paratuberculosis
ggccgaucagugccgc

SEQ ID NO: 945216 - RNA, 17 nt, Mycobacterium avium subsp. paratuberculosis
ggccgaucagugccgcg

SEQ ID NO: 945217 - RNA, 20 nt, Mycobacterium avium subsp. paratuberculosis
ggccgaucagguaguacagg

SEQ ID NO: 945218 - RNA, 19 nt, Mycobacterium avium subsp. paratuberculosis
ggccgaucauggucggcga

SEQ ID NO: 945219 - RNA, 14 nt, Mycobacterium avium subsp. paratuberculosis
ggccgaucacgcgg

SEQ ID NO: 945220 - RNA, 19 nt, Mycobacterium avium subsp. paratuberculosis
ggccgagucgacgugcucg

SEQ ID NO: 945221 - RNA, 19 nt, Mycobacterium avium subsp. paratuberculosis
ggccgaguauccgcgcagc

SEQ ID NO: 945222 - RNA, 15 nt, Mycobacterium avium subsp. paratuberculosis
ggccgagcgcgcugg

SEQ ID NO: 945223 - RNA, 21 nt, Mycobacterium avium subsp. paratuberculosis
ggccgaggcugacgaucgucg

SEQ ID NO: 945224 - RNA, 23 nt, Mycobacterium avium subsp. paratuberculosis
ggccgaggcugacgaucgucgac

SEQ ID NO: 945225 - RNA, 22 nt, Mycobacterium avium subsp. paratuberculosis
ggccgagggcuucccacgccuu

SEQ ID NO: 945226 - RNA, 18 nt, Mycobacterium avium subsp. paratuberculosis
ggccguugggccagcggc

SEQ ID NO: 945227 - RNA, 16 nt, Mycobacterium avium subsp. paratuberculosis
ggccuccagccagcgc

SEQ ID NO: 945228 - RNA, 20 nt, Mycobacterium avium subsp. paratuberculosis
ggccuccagccgcgcggccg

SEQ ID NO: 945229 - RNA, 23 nt, Mycobacterium avium subsp. paratuberculosis
ggccuccaccaccaugucguuga

SEQ ID NO: 945230 - RNA, 16 nt, Mycobacterium avium subsp. paratuberculosis
ggccuccaccagcggc

SEQ ID NO: 945231 - RNA, 20 nt, Mycobacterium avium subsp. paratuberculosis
ggccuccgcgcgcggcccgu

SEQ ID NO: 945232 - RNA, 19 nt, Mycobacterium avium subsp. paratuberculosis
ggccucccgguagaucgcc

SEQ ID NO: 945233 - RNA, 22 nt, Mycobacterium avium subsp. paratuberculosis
ggccucccgguagaucgccgga

SEQ ID NO: 945234 - RNA, 13 nt, Mycobacterium avium subsp. paratuberculosis
ggccuccgacccg

SEQ ID NO: 945235 - RNA, 17 nt, Mycobacterium avium subsp. paratuberculosis
ggccuccgagcggcgca

SEQ ID NO: 945236 - RNA, 15 nt, Mycobacterium avium subsp. paratuberculosis
ggccuccgccaccuc

SEQ ID NO: 945237 - RNA, 23 nt, Mycobacterium avium subsp. paratuberculosis
ggccuccccauccgcggccaccg

SEQ ID NO: 945238 - RNA, 12 nt, Mycobacterium avium subsp. paratuberculosis
ggccuccaccgg

SEQ ID NO: 945239 - RNA, 13 nt, Mycobacterium avium subsp. paratuberculosis
ggccuccaccggc

SEQ ID NO: 945240 - RNA, 16 nt, Mycobacterium avium subsp. paratuberculosis
ggccugagacgacgcc

SEQ ID NO: 945241 - RNA, 18 nt, Mycobacterium avium subsp. paratuberculosis
ggccugagacgacgccac

SEQ ID NO: 945242 - RNA, 14 nt, Mycobacterium avium subsp. paratuberculosis
ggccuccggcggca

SEQ ID NO: 945243 - RNA, 13 nt, Mycobacterium avium subsp. paratuberculosis
ggccuccgugcug

SEQ ID NO: 945244 - RNA, 17 nt, Mycobacterium avium subsp. paratuberculosis
ggccuccgugcuggccg

SEQ ID NO: 945245 - RNA, 16 nt, Mycobacterium avium subsp. paratuberculosis
ggccuccggagugacg

SEQ ID NO: 945246 - RNA, 22 nt, Mycobacterium avium subsp. paratuberculosis
ggccuccggagugacgucgcgc

SEQ ID NO: 945247 - RNA, 17 nt, Mycobacterium avium subsp. paratuberculosis
ggccuccuccucgcugc

SEQ ID NO: 945248 - RNA, 15 nt, Mycobacterium avium subsp. paratuberculosis
ggccugcacccaggu

SEQ ID NO: 945249 - RNA, 13 nt, Mycobacterium avium subsp. paratuberculosis
ggccugcaccucg

SEQ ID NO: 945250 - RNA, 22 nt, Mycobacterium avium subsp. paratuberculosis
ggccugcacgaagucgaccgcg

SEQ ID NO: 945251 - RNA, 14 nt, Mycobacterium avium subsp. paratuberculosis
ggccugcaccacca

SEQ ID NO: 945252 - RNA, 21 nt, Mycobacterium avium subsp. paratuberculosis
ggccugcaccaccacacccag

SEQ ID NO: 945253 - RNA, 22 nt, Mycobacterium avium subsp. paratuberculosis
ggccugcucgucggggcagccg

SEQ ID NO: 945254 - RNA, 20 nt, Mycobacterium avium subsp. paratuberculosis
ggccugcucgcuugccagcc

SEQ ID NO: 945255 - RNA, 23 nt, Mycobacterium avium subsp. paratuberculosis
ggccugcucgcuugccagccggg

SEQ ID NO: 945256 - RNA, 19 nt, Mycobacterium avium subsp. paratuberculosis
ggccugcgggcgccggcug

SEQ ID NO: 945257 - RNA, 20 nt, Mycobacterium avium subsp. paratuberculosis
ggccugcgggcgccggcugc

SEQ ID NO: 945258 - RNA, 13 nt, Mycobacterium avium subsp. paratuberculosis
ggccugcggcgcg

SEQ ID NO: 945259 - RNA, 17 nt, Mycobacterium avium subsp. paratuberculosis
ggccugcggcggcaacg

SEQ ID NO: 945260 - RNA, 15 nt, Mycobacterium avium subsp. paratuberculosis
ggccugcggcggccg

SEQ ID NO: 945261 - RNA, 18 nt, Mycobacterium avium subsp. paratuberculosis
ggccugcggcggccgcag

SEQ ID NO: 945262 - RNA, 20 nt, Mycobacterium avium subsp. paratuberculosis
ggccugcggcaacagcacca

SEQ ID NO: 945263 - RNA, 18 nt, Mycobacterium avium subsp. paratuberculosis
ggccugcgcgccgaugug

SEQ ID NO: 945264 - RNA, 19 nt, Mycobacterium avium subsp. paratuberculosis
ggccugcgcggccgcgucg

SEQ ID NO: 945265 - RNA, 13 nt, Mycobacterium avium subsp. paratuberculosis
ggccugcgcgucg

SEQ ID NO: 945266 - RNA, 18 nt, Mycobacterium avium subsp. paratuberculosis
ggccugcgcgucgucgcc

SEQ ID NO: 945267 - RNA, 14 nt, Mycobacterium avium subsp. paratuberculosis
ggccugcgcgccga

SEQ ID NO: 945268 - RNA, 23 nt, Mycobacterium avium subsp. paratuberculosis
ggccugcgccaggauccgcccgc

SEQ ID NO: 945269 - RNA, 21 nt, Mycobacterium avium subsp. paratuberculosis
ggccugcgacuucuacggcgg

SEQ ID NO: 945270 - RNA, 14 nt, Mycobacterium avium subsp. paratuberculosis
ggccugcccggcgg

SEQ ID NO: 945271 - RNA, 15 nt, Mycobacterium avium subsp. paratuberculosis
ggccugcccggcggu

SEQ ID NO: 945272 - RNA, 20 nt, Mycobacterium avium subsp. paratuberculosis
ggccugcccggcggugccga

SEQ ID NO: 945273 - RNA, 19 nt, Mycobacterium avium subsp. paratuberculosis
ggccugccggaugccgcgc

SEQ ID NO: 945274 - RNA, 22 nt, Mycobacterium avium subsp. paratuberculosis
ggccugccggaugccgcgcggc

SEQ ID NO: 945275 - RNA, 14 nt, Mycobacterium avium subsp. paratuberculosis
ggccugcccgccgc

SEQ ID NO: 945276 - RNA, 20 nt, Mycobacterium avium subsp. paratuberculosis
ggccugcccgccgcggccgc

SEQ ID NO: 945277 - RNA, 20 nt, Mycobacterium avium subsp. paratuberculosis
ggccugcagcucggugcgca

SEQ ID NO: 945278 - RNA, 22 nt, Mycobacterium avium subsp. paratuberculosis
ggccugcagcucggugcgcacc

SEQ ID NO: 945279 - RNA, 22 nt, Mycobacterium avium subsp. paratuberculosis
ggccugcacggugcgccggcag

SEQ ID NO: 945280 - RNA, 16 nt, Mycobacterium avium subsp. paratuberculosis
ggccugcacgucggcg

SEQ ID NO: 945281 - RNA, 14 nt, Mycobacterium avium subsp. paratuberculosis
ggccugcagaaugc

SEQ ID NO: 945282 - RNA, 21 nt, Mycobacterium avium subsp. paratuberculosis
ggccugcagcaacucgcgcuc

SEQ ID NO: 945283 - RNA, 15 nt, Mycobacterium avium subsp. paratuberculosis
ggccugcagcaccag

SEQ ID NO: 945284 - RNA, 16 nt, Mycobacterium avium subsp. paratuberculosis
ggccugcagcaccgaa

SEQ ID NO: 945285 - RNA, 15 nt, Mycobacterium avium subsp. paratuberculosis
ggccguucgccggcc

SEQ ID NO: 945286 - RNA, 16 nt, Mycobacterium avium subsp. paratuberculosis
ggccguucgccggcca

SEQ ID NO: 945287 - RNA, 18 nt, Mycobacterium avium subsp. paratuberculosis
ggccguucgccggccagc

SEQ ID NO: 945288 - RNA, 19 nt, Mycobacterium avium subsp. paratuberculosis
ggccguucgccggccagca

SEQ ID NO: 945289 - RNA, 15 nt, Mycobacterium avium subsp. paratuberculosis
ggccguggucggcga

SEQ ID NO: 945290 - RNA, 20 nt, Mycobacterium avium subsp. paratuberculosis
ggccgugugcgcaucggcga

SEQ ID NO: 945291 - RNA, 15 nt, Mycobacterium avium subsp. paratuberculosis
ggccguucagcgggc

SEQ ID NO: 945292 - RNA, 20 nt, Mycobacterium avium subsp. paratuberculosis
ggccguucagcgggcgguug

SEQ ID NO: 945293 - RNA, 23 nt, Mycobacterium avium subsp. paratuberculosis
ggccguucagguaaucgaugacg

SEQ ID NO: 945294 - RNA, 15 nt, Mycobacterium avium subsp. paratuberculosis
ggccguucaggucga

SEQ ID NO: 945295 - RNA, 23 nt, Mycobacterium avium subsp. paratuberculosis
ggccguucaggucgaucagcggu

SEQ ID NO: 945296 - RNA, 17 nt, Mycobacterium avium subsp. paratuberculosis
ggccguucuugcgggug

SEQ ID NO: 945297 - RNA, 24 nt, Mycobacterium avium subsp. paratuberculosis
ggccguucuugcgggugauccagc

SEQ ID NO: 945298 - RNA, 19 nt, Mycobacterium avium subsp. paratuberculosis
ggccguugaucgagcaccg

SEQ ID NO: 945299 - RNA, 15 nt, Mycobacterium avium subsp. paratuberculosis
ggccguugccggucc

SEQ ID NO: 945300 - RNA, 23 nt, Mycobacterium avium subsp. paratuberculosis
ggccguugccggucccguugauc

SEQ ID NO: 945301 - RNA, 19 nt, Mycobacterium avium subsp. paratuberculosis
ggccguugcgggugucgcc

SEQ ID NO: 945302 - RNA, 21 nt, Mycobacterium avium subsp. paratuberculosis
ggccguugcgggugucgccgg

SEQ ID NO: 945303 - RNA, 22 nt, Mycobacterium avium subsp. paratuberculosis
ggccguugcgggugucgccggu

SEQ ID NO: 945304 - RNA, 14 nt, Mycobacterium avium subsp. paratuberculosis
ggccguggccguga

SEQ ID NO: 945305 - RNA, 12 nt, Mycobacterium avium subsp. paratuberculosis
ggccgugcgcgu

SEQ ID NO: 945306 - RNA, 14 nt, Mycobacterium avium subsp. paratuberculosis
ggccgugccggcuc

SEQ ID NO: 945307 - RNA, 15 nt, Mycobacterium avium subsp. paratuberculosis
ggccgugccggcucg

SEQ ID NO: 945308 - RNA, 12 nt, Mycobacterium avium subsp. paratuberculosis
ggccgugccgcc

SEQ ID NO: 945309 - RNA, 22 nt, Mycobacterium avium subsp. paratuberculosis
ggccgugcagggggcgcagccg

SEQ ID NO: 945310 - RNA, 12 nt, Mycobacterium avium subsp. paratuberculosis
ggccgucgucgu

SEQ ID NO: 945311 - RNA, 15 nt, Mycobacterium avium subsp. paratuberculosis
ggccgucgucgugca

SEQ ID NO: 945312 - RNA, 23 nt, Mycobacterium avium subsp. paratuberculosis
ggccgucgucgugcaccacgacg

SEQ ID NO: 945313 - RNA, 15 nt, Mycobacterium avium subsp. paratuberculosis
ggccgucggcgccgc

SEQ ID NO: 945314 - RNA, 18 nt, Mycobacterium avium subsp. paratuberculosis
ggccgucggcgccgccga

SEQ ID NO: 945315 - RNA, 21 nt, Mycobacterium avium subsp. paratuberculosis
ggccgucggcgcggccggauc

SEQ ID NO: 945316 - RNA, 12 nt, Mycobacterium avium subsp. paratuberculosis
ggccgucggcga

SEQ ID NO: 945317 - RNA, 13 nt, Mycobacterium avium subsp. paratuberculosis
ggccgucggcgau

SEQ ID NO: 945318 - RNA, 15 nt, Mycobacterium avium subsp. paratuberculosis
ggccgucggcgaugg

SEQ ID NO: 945319 - RNA, 21 nt, Mycobacterium avium subsp. paratuberculosis
ggccgucggggaugccgaacc

SEQ ID NO: 945320 - RNA, 13 nt, Mycobacterium avium subsp. paratuberculosis
ggccgucgggucg

SEQ ID NO: 945321 - RNA, 17 nt, Mycobacterium avium subsp. paratuberculosis
ggccgucgggucggcga

SEQ ID NO: 945322 - RNA, 18 nt, Mycobacterium avium subsp. paratuberculosis
ggccgucgggucggcgag

SEQ ID NO: 945323 - RNA, 19 nt, Mycobacterium avium subsp. paratuberculosis
ggccgucgggucggcgagc

SEQ ID NO: 945324 - RNA, 20 nt, Mycobacterium avium subsp. paratuberculosis
ggccgucgggucggcgagca

SEQ ID NO: 945325 - RNA, 14 nt, Mycobacterium avium subsp. paratuberculosis
ggccgucggccugc

SEQ ID NO: 945326 - RNA, 18 nt, Mycobacterium avium subsp. paratuberculosis
ggccgucggccugcgcug

SEQ ID NO: 945327 - RNA, 18 nt, Mycobacterium avium subsp. paratuberculosis
ggccgucgcgcaccaccu

SEQ ID NO: 945328 - RNA, 16 nt, Mycobacterium avium subsp. paratuberculosis
ggccgucgcgcagccu

SEQ ID NO: 945329 - RNA, 22 nt, Mycobacterium avium subsp. paratuberculosis
ggccgucgcggcgaucgcgagc

SEQ ID NO: 945330 - RNA, 13 nt, Mycobacterium avium subsp. paratuberculosis
ggccgucgccggu

SEQ ID NO: 945331 - RNA, 14 nt, Mycobacterium avium subsp. paratuberculosis
ggccgucgccgguc

SEQ ID NO: 945332 - RNA, 18 nt, Mycobacterium avium subsp. paratuberculosis
ggccgucgaggcgcugca

SEQ ID NO: 945333 - RNA, 12 nt, Mycobacterium avium subsp. paratuberculosis
ggccgucgcccg

SEQ ID NO: 945334 - RNA, 13 nt, Mycobacterium avium subsp. paratuberculosis
ggccgucgccgaa

SEQ ID NO: 945335 - RNA, 20 nt, Mycobacterium avium subsp. paratuberculosis
ggccgucgaacugcagccgg

SEQ ID NO: 945336 - RNA, 13 nt, Mycobacterium avium subsp. paratuberculosis
ggccguccgccgg

SEQ ID NO: 945337 - RNA, 14 nt, Mycobacterium avium subsp. paratuberculosis
ggccguccgccggc

SEQ ID NO: 945338 - RNA, 15 nt, Mycobacterium avium subsp. paratuberculosis
ggccguccgccggcu

SEQ ID NO: 945339 - RNA, 16 nt, Mycobacterium avium subsp. paratuberculosis
ggccguccgccggcug

SEQ ID NO: 945340 - RNA, 20 nt, Mycobacterium avium subsp. paratuberculosis
ggccguccggauagccgucg

SEQ ID NO: 945341 - RNA, 23 nt, Mycobacterium avium subsp. paratuberculosis
ggccguccggauagccgucggcg

SEQ ID NO: 945342 - RNA, 14 nt, Mycobacterium avium subsp. paratuberculosis
ggccguccacggcg

SEQ ID NO: 945343 - RNA, 18 nt, Mycobacterium avium subsp. paratuberculosis
ggccguccacggcggugg

SEQ ID NO: 945344 - RNA, 13 nt, Mycobacterium avium subsp. paratuberculosis
ggccguccagcag

SEQ ID NO: 945345 - RNA, 15 nt, Mycobacterium avium subsp. paratuberculosis
ggccguccagcagca

SEQ ID NO: 945346 - RNA, 16 nt, Mycobacterium avium subsp. paratuberculosis
ggccguccaggcgcca

SEQ ID NO: 945347 - RNA, 17 nt, Mycobacterium avium subsp. paratuberculosis
ggccguagccggaccgc

SEQ ID NO: 945348 - RNA, 22 nt, Mycobacterium avium subsp. paratuberculosis
ggccguccaccaccaacccggu

SEQ ID NO: 945349 - RNA, 18 nt, Mycobacterium avium subsp. paratuberculosis
ggccguccaccagaucgc

SEQ ID NO: 945350 - RNA, 19 nt, Mycobacterium avium subsp. paratuberculosis
ggccguccaccagaucgcc

SEQ ID NO: 945351 - RNA, 16 nt, Mycobacterium avium subsp. paratuberculosis
ggccguagagcacgaa

SEQ ID NO: 945352 - RNA, 22 nt, Mycobacterium avium subsp. paratuberculosis
ggccgguggaaugcaucgcgau

SEQ ID NO: 945353 - RNA, 14 nt, Mycobacterium avium subsp. paratuberculosis
ggccguaaccgccg

SEQ ID NO: 945354 - RNA, 14 nt, Mycobacterium avium subsp. paratuberculosis
ggccguaccggcgu

SEQ ID NO: 945355 - RNA, 17 nt, Mycobacterium avium subsp. paratuberculosis
ggccguaccggcguacg

SEQ ID NO: 945356 - RNA, 21 nt, Mycobacterium avium subsp. paratuberculosis
ggccgguuggcggccgggucg

SEQ ID NO: 945357 - RNA, 16 nt, Mycobacterium avium subsp. paratuberculosis
ggccgguuggugcgcc

SEQ ID NO: 945358 - RNA, 20 nt, Mycobacterium avium subsp. paratuberculosis
ggccgguuggugcgccguca

SEQ ID NO: 945359 - RNA, 17 nt, Mycobacterium avium subsp. paratuberculosis
ggccgguuguugcgguc

SEQ ID NO: 945360 - RNA, 16 nt, Mycobacterium avium subsp. paratuberculosis
ggccggugggcggcgc

SEQ ID NO: 945361 - RNA, 14 nt, Mycobacterium avium subsp. paratuberculosis
ggccggguuggcau

SEQ ID NO: 945362 - RNA, 18 nt, Mycobacterium avium subsp. paratuberculosis
ggccggguuguccuggcc

SEQ ID NO: 945363 - RNA, 12 nt, Mycobacterium avium subsp. paratuberculosis
ggccgguggccg

SEQ ID NO: 945364 - RNA, 16 nt, Mycobacterium avium subsp. paratuberculosis
ggccgguggcgacaac

SEQ ID NO: 945365 - RNA, 20 nt, Mycobacterium avium subsp. paratuberculosis
ggccggugcguccgccggcg

SEQ ID NO: 945366 - RNA, 22 nt, Mycobacterium avium subsp. paratuberculosis
ggccggugcguccgccggcggu

SEQ ID NO: 945367 - RNA, 19 nt, Mycobacterium avium subsp. paratuberculosis
ggccggugcgugaugacca

SEQ ID NO: 945368 - RNA, 23 nt, Mycobacterium avium subsp. paratuberculosis
ggccggugcgugaugaccagggc

SEQ ID NO: 945369 - RNA, 14 nt, Mycobacterium avium subsp. paratuberculosis
ggccggguguagcu

SEQ ID NO: 945370 - RNA, 14 nt, Mycobacterium avium subsp. paratuberculosis
ggccggguuccggu

SEQ ID NO: 945371 - RNA, 13 nt, Mycobacterium avium subsp. paratuberculosis
ggccgggucggga

SEQ ID NO: 945372 - RNA, 16 nt, Mycobacterium avium subsp. paratuberculosis
ggccgggucgaccgcg

SEQ ID NO: 945373 - RNA, 17 nt, Mycobacterium avium subsp. paratuberculosis
ggccgggucgcaggcag

SEQ ID NO: 945374 - RNA, 22 nt, Mycobacterium avium subsp. paratuberculosis
ggccgggucgcaggcagcagca

SEQ ID NO: 945375 - RNA, 15 nt, Mycobacterium avium subsp. paratuberculosis
ggccgggucgagcgc

SEQ ID NO: 945376 - RNA, 16 nt, Mycobacterium avium subsp. paratuberculosis
ggccgggucgagcgcg

SEQ ID NO: 945377 - RNA, 17 nt, Mycobacterium avium subsp. paratuberculosis
ggccggggcggcgguac

SEQ ID NO: 945378 - RNA, 21 nt, Mycobacterium avium subsp. paratuberculosis
ggccggggcgggcacgucgcg

SEQ ID NO: 945379 - RNA, 18 nt, Mycobacterium avium subsp. paratuberculosis
ggccgggggcggcggcgc

SEQ ID NO: 945380 - RNA, 18 nt, Mycobacterium avium subsp. paratuberculosis
ggccggggggaggucgcg

SEQ ID NO: 945381 - RNA, 22 nt, Mycobacterium avium subsp. paratuberculosis
ggccgggucacgugcacccacg

SEQ ID NO: 945382 - RNA, 17 nt, Mycobacterium avium subsp. paratuberculosis
ggccggguccacgccga

SEQ ID NO: 945383 - RNA, 18 nt, Mycobacterium avium subsp. paratuberculosis
ggccggguccacgccgag

SEQ ID NO: 945384 - RNA, 19 nt, Mycobacterium avium subsp. paratuberculosis
ggccggggcuucgaacgcc

SEQ ID NO: 945385 - RNA, 23 nt, Mycobacterium avium subsp. paratuberculosis
ggccggggcuucgaacgcccgca

SEQ ID NO: 945386 - RNA, 14 nt, Mycobacterium avium subsp. paratuberculosis
ggccggcgauggcg

SEQ ID NO: 945387 - RNA, 20 nt, Mycobacterium avium subsp. paratuberculosis
ggccggcgauggcgcggccg

SEQ ID NO: 945388 - RNA, 14 nt, Mycobacterium avium subsp. paratuberculosis
ggccggggcgccac

SEQ ID NO: 945389 - RNA, 13 nt, Mycobacterium avium subsp. paratuberculosis
ggccggcgcagcc

SEQ ID NO: 945390 - RNA, 18 nt, Mycobacterium avium subsp. paratuberculosis
ggccggcgcagccggcca

SEQ ID NO: 945391 - RNA, 21 nt, Mycobacterium avium subsp. paratuberculosis
ggccggcgcagccggccaccg

SEQ ID NO: 945392 - RNA, 20 nt, Mycobacterium avium subsp. paratuberculosis
ggccggcgaggugggcacca

SEQ ID NO: 945393 - RNA, 14 nt, Mycobacterium avium subsp. paratuberculosis
ggccggcgaugccc

SEQ ID NO: 945394 - RNA, 15 nt, Mycobacterium avium subsp. paratuberculosis
ggccgcuucccaccc

SEQ ID NO: 945395 - RNA, 16 nt, Mycobacterium avium subsp. paratuberculosis
ggccgcuucccacccg

SEQ ID NO: 945396 - RNA, 19 nt, Mycobacterium avium subsp. paratuberculosis
ggccgcuucccacccgguc

SEQ ID NO: 945397 - RNA, 12 nt, Mycobacterium avium subsp. paratuberculosis
ggccgcggcucg

SEQ ID NO: 945398 - RNA, 16 nt, Mycobacterium avium subsp. paratuberculosis
ggccgcggcucgcgac

SEQ ID NO: 945399 - RNA, 18 nt, Mycobacterium avium subsp. paratuberculosis
ggccgcugguggugauca

SEQ ID NO: 945400 - RNA, 21 nt, Mycobacterium avium subsp. paratuberculosis
ggccgcugguggugaucaccc

SEQ ID NO: 945401 - RNA, 18 nt, Mycobacterium avium subsp. paratuberculosis
ggccgcuuguucgggccc

SEQ ID NO: 945402 - RNA, 21 nt, Mycobacterium avium subsp. paratuberculosis
ggccgcuuguucgggcccaca

SEQ ID NO: 945403 - RNA, 20 nt, Mycobacterium avium subsp. paratuberculosis
ggccgcuuuccaccccggcg

SEQ ID NO: 945404 - RNA, 21 nt, Mycobacterium avium subsp. paratuberculosis
ggccgcuuuccaccccggcgg

SEQ ID NO: 945405 - RNA, 22 nt, Mycobacterium avium subsp. paratuberculosis
ggccgcuuuccaccccggcggu

SEQ ID NO: 945406 - RNA, 14 nt, Mycobacterium avium subsp. paratuberculosis
ggccgcuucggggu

SEQ ID NO: 945407 - RNA, 16 nt, Mycobacterium avium subsp. paratuberculosis
ggccgcggcgcggccc

SEQ ID NO: 945408 - RNA, 19 nt, Mycobacterium avium subsp. paratuberculosis
ggccgcggcgggcgcgucg

SEQ ID NO: 945409 - RNA, 23 nt, Mycobacterium avium subsp. paratuberculosis
ggccgcggcgggcgcgucgaggu

SEQ ID NO: 945410 - RNA, 15 nt, Mycobacterium avium subsp. paratuberculosis
ggccgcggcggugcc

SEQ ID NO: 945411 - RNA, 13 nt, Mycobacterium avium subsp. paratuberculosis
ggccgcggcgucg

SEQ ID NO: 945412 - RNA, 12 nt, Mycobacterium avium subsp. paratuberculosis
ggccgcggcgug

SEQ ID NO: 945413 - RNA, 14 nt, Mycobacterium avium subsp. paratuberculosis
ggccgcggcgugca

SEQ ID NO: 945414 - RNA, 12 nt, Mycobacterium avium subsp. paratuberculosis
ggccgcggcgcc

SEQ ID NO: 945415 - RNA, 19 nt, Mycobacterium avium subsp. paratuberculosis
ggccgcggccuugcgagcc

SEQ ID NO: 945416 - RNA, 12 nt, Mycobacterium avium subsp. paratuberculosis
ggccgcggccgc

SEQ ID NO: 945417 - RNA, 15 nt, Mycobacterium avium subsp. paratuberculosis
ggccgcggccgccgc

SEQ ID NO: 945418 - RNA, 19 nt, Mycobacterium avium subsp. paratuberculosis
ggccgcggccgccgcgacg

SEQ ID NO: 945419 - RNA, 14 nt, Mycobacterium avium subsp. paratuberculosis
ggccgcggccggca

SEQ ID NO: 945420 - RNA, 21 nt, Mycobacterium avium subsp. paratuberculosis
ggccgcggccggcacuaccgc

SEQ ID NO: 945421 - RNA, 15 nt, Mycobacterium avium subsp. paratuberculosis
ggccgcggccggcgg

SEQ ID NO: 945422 - RNA, 17 nt, Mycobacterium avium subsp. paratuberculosis
ggccgcggccggcggca

SEQ ID NO: 945423 - RNA, 12 nt, Mycobacterium avium subsp. paratuberculosis
ggccgcggccuu

SEQ ID NO: 945424 - RNA, 21 nt, Mycobacterium avium subsp. paratuberculosis
ggccgcgcuguccacguccug

SEQ ID NO: 945425 - RNA, 17 nt, Mycobacterium avium subsp. paratuberculosis
ggccggagccgaccucg

SEQ ID NO: 945426 - RNA, 20 nt, Mycobacterium avium subsp. paratuberculosis
ggccggagccgaccucggcg

SEQ ID NO: 945427 - RNA, 12 nt, Mycobacterium avium subsp. paratuberculosis
ggccggagccuu

SEQ ID NO: 945428 - RNA, 20 nt, Mycobacterium avium subsp. paratuberculosis
ggccggagccuucuucgccg

SEQ ID NO: 945429 - RNA, 21 nt, Mycobacterium avium subsp. paratuberculosis
ggccggagccuucuugaccgc

SEQ ID NO: 945430 - RNA, 22 nt, Mycobacterium avium subsp. paratuberculosis
ggccggagccuuggucgcggcc

SEQ ID NO: 945431 - RNA, 21 nt, Mycobacterium avium subsp. paratuberculosis
ggccggagcggauggcgccgu

SEQ ID NO: 945432 - RNA, 23 nt, Mycobacterium avium subsp. paratuberculosis
ggccggagcggauggcgccgucg

SEQ ID NO: 945433 - RNA, 20 nt, Mycobacterium avium subsp. paratuberculosis
ggccggagcggugcggcucg

SEQ ID NO: 945434 - RNA, 15 nt, Mycobacterium avium subsp. paratuberculosis
ggccggaggugcggg

SEQ ID NO: 945435 - RNA, 17 nt, Mycobacterium avium subsp. paratuberculosis
ggccggaggugcggguc

SEQ ID NO: 945436 - RNA, 21 nt, Mycobacterium avium subsp. paratuberculosis
ggccggaggugcgggucucga

SEQ ID NO: 945437 - RNA, 14 nt, Mycobacterium avium subsp. paratuberculosis
ggccggacgggucg

SEQ ID NO: 945438 - RNA, 21 nt, Mycobacterium avium subsp. paratuberculosis
ggccggacgggucgaccgccg

SEQ ID NO: 945439 - RNA, 15 nt, Mycobacterium avium subsp. paratuberculosis
ggccggacaggucga

SEQ ID NO: 945440 - RNA, 22 nt, Mycobacterium avium subsp. paratuberculosis
ggccggaccacccagguggaug

SEQ ID NO: 945441 - RNA, 21 nt, Mycobacterium avium subsp. paratuberculosis
ggccggaagaccguugacgac

SEQ ID NO: 945442 - RNA, 22 nt, Mycobacterium avium subsp. paratuberculosis
ggccggaucccgguacggcuca

SEQ ID NO: 945443 - RNA, 16 nt, Mycobacterium avium subsp. paratuberculosis
ggccggauggccagca

SEQ ID NO: 945444 - RNA, 17 nt, Mycobacterium avium subsp. paratuberculosis
ggccggauggccagcag

SEQ ID NO: 945445 - RNA, 16 nt, Mycobacterium avium subsp. paratuberculosis
ggccggcaacgacccg

SEQ ID NO: 945446 - RNA, 21 nt, Mycobacterium avium subsp. paratuberculosis
ggccggcaacgacccgucggg

SEQ ID NO: 945447 - RNA, 15 nt, Mycobacterium avium subsp. paratuberculosis
ggccggcacuaccgc

SEQ ID NO: 945448 - RNA, 17 nt, Mycobacterium avium subsp. paratuberculosis
ggccggcacuaccgccu

SEQ ID NO: 945449 - RNA, 11 nt, Mycobacterium avium subsp. paratuberculosis
ggccggcacuc

SEQ ID NO: 945450 - RNA, 15 nt, Mycobacterium avium subsp. paratuberculosis
ggccggcacccgggc

SEQ ID NO: 945451 - RNA, 20 nt, Mycobacterium avium subsp. paratuberculosis
ggccggcacccgggccuuga

SEQ ID NO: 945452 - RNA, 14 nt, Mycobacterium avium subsp. paratuberculosis
ggccggccuggugc

SEQ ID NO: 945453 - RNA, 18 nt, Mycobacterium avium subsp. paratuberculosis
ggccggccuugcucgccg

SEQ ID NO: 945454 - RNA, 21 nt, Mycobacterium avium subsp. paratuberculosis
ggccggcgaaacacagcagca

SEQ ID NO: 945455 - RNA, 15 nt, Mycobacterium avium subsp. paratuberculosis
ggccggccgcuaccc

SEQ ID NO: 945456 - RNA, 16 nt, Mycobacterium avium subsp. paratuberculosis
ggccggccugccaccg

SEQ ID NO: 945457 - RNA, 13 nt, Mycobacterium avium subsp. paratuberculosis
ggccggccugccg

SEQ ID NO: 945458 - RNA, 15 nt, Mycobacterium avium subsp. paratuberculosis
ggccggccucgaugu

SEQ ID NO: 945459 - RNA, 16 nt, Mycobacterium avium subsp. paratuberculosis
ggccggccucgauguc

SEQ ID NO: 945460 - RNA, 20 nt, Mycobacterium avium subsp. paratuberculosis
ggccggcgaaggacagccgg

SEQ ID NO: 945461 - RNA, 23 nt, Mycobacterium avium subsp. paratuberculosis
ggccggcgaaggacagccggacg

SEQ ID NO: 945462 - RNA, 20 nt, Mycobacterium avium subsp. paratuberculosis
ggccggcgacgccgcgcugg

SEQ ID NO: 945463 - RNA, 14 nt, Mycobacterium avium subsp. paratuberculosis
ggccggccggccga

SEQ ID NO: 945464 - RNA, 22 nt, Mycobacterium avium subsp. paratuberculosis
ggccggcgagcucgcggccgua

SEQ ID NO: 945465 - RNA, 14 nt, Mycobacterium avium subsp. paratuberculosis
ggccggcaggccgc

SEQ ID NO: 945466 - RNA, 20 nt, Mycobacterium avium subsp. paratuberculosis
ggccggcaggccgcccgacc

SEQ ID NO: 945467 - RNA, 14 nt, Mycobacterium avium subsp. paratuberculosis
ggccggccgcgcgc

SEQ ID NO: 945468 - RNA, 14 nt, Mycobacterium avium subsp. paratuberculosis
ggccggcaggucga

SEQ ID NO: 945469 - RNA, 19 nt, Mycobacterium avium subsp. paratuberculosis
ggccggcaguuccucgccg

SEQ ID NO: 945470 - RNA, 16 nt, Mycobacterium avium subsp. paratuberculosis
ggccggcaguugcggc

SEQ ID NO: 945471 - RNA, 18 nt, Mycobacterium avium subsp. paratuberculosis
ggccggcaguugcggccg

SEQ ID NO: 945472 - RNA, 16 nt, Mycobacterium avium subsp. paratuberculosis
ggccggcagcaucggg

SEQ ID NO: 945473 - RNA, 18 nt, Mycobacterium avium subsp. paratuberculosis
ggccggcagcaucgggac

SEQ ID NO: 945474 - RNA, 12 nt, Mycobacterium avium subsp. paratuberculosis
ggccggcagccg

SEQ ID NO: 945475 - RNA, 13 nt, Mycobacterium avium subsp. paratuberculosis
ggccggcagccgg

SEQ ID NO: 945476 - RNA, 15 nt, Mycobacterium avium subsp. paratuberculosis
ggccggcagccggcc

SEQ ID NO: 945477 - RNA, 19 nt, Mycobacterium avium subsp. paratuberculosis
ggccggcagccggccaccu

SEQ ID NO: 945478 - RNA, 13 nt, Mycobacterium avium subsp. paratuberculosis
ggccgcggcccgg

SEQ ID NO: 945479 - RNA, 17 nt, Mycobacterium avium subsp. paratuberculosis
ggccgcggcccggccac

SEQ ID NO: 945480 - RNA, 19 nt, Mycobacterium avium subsp. paratuberculosis
ggccgcggcccggccacca

SEQ ID NO: 945481 - RNA, 21 nt, Mycobacterium avium subsp. paratuberculosis
ggccgcggaguaggcgccgcc

SEQ ID NO: 945482 - RNA, 15 nt, Mycobacterium avium subsp. paratuberculosis
ggccgcggaugacca

SEQ ID NO: 945483 - RNA, 19 nt, Mycobacterium avium subsp. paratuberculosis
ggccgcggauggugacggc

SEQ ID NO: 945484 - RNA, 20 nt, Mycobacterium avium subsp. paratuberculosis
ggccgcggauuccggcaucg

SEQ ID NO: 945485 - RNA, 21 nt, Mycobacterium avium subsp. paratuberculosis
ggccgcgccggaugguccgca

SEQ ID NO: 945486 - RNA, 14 nt, Mycobacterium avium subsp. paratuberculosis
ggccgcgccggccu

SEQ ID NO: 945487 - RNA, 20 nt, Mycobacterium avium subsp. paratuberculosis
ggccgcgccguagcggccca

SEQ ID NO: 945488 - RNA, 20 nt, Mycobacterium avium subsp. paratuberculosis
ggccgcgccgugcgccagcg

SEQ ID NO: 945489 - RNA, 14 nt, Mycobacterium avium subsp. paratuberculosis
ggccgcgccguuga

SEQ ID NO: 945490 - RNA, 13 nt, Mycobacterium avium subsp. paratuberculosis
ggccgcgccgggc

SEQ ID NO: 945491 - RNA, 15 nt, Mycobacterium avium subsp. paratuberculosis
ggccgcgccgggcga

SEQ ID NO: 945492 - RNA, 20 nt, Mycobacterium avium subsp. paratuberculosis
ggccgcgccgaacaccacgc

SEQ ID NO: 945493 - RNA, 14 nt, Mycobacterium avium subsp. paratuberculosis
ggccgcgccgauca

SEQ ID NO: 945494 - RNA, 12 nt, Mycobacterium avium subsp. paratuberculosis
ggccgcgccgcc

SEQ ID NO: 945495 - RNA, 16 nt, Mycobacterium avium subsp. paratuberculosis
ggccgcgagcacgacg

SEQ ID NO: 945496 - RNA, 14 nt, Mycobacterium avium subsp. paratuberculosis
ggccgcgccgccga

SEQ ID NO: 945497 - RNA, 19 nt, Mycobacterium avium subsp. paratuberculosis
ggccgcgccgccgaccacg

SEQ ID NO: 945498 - RNA, 22 nt, Mycobacterium avium subsp. paratuberculosis
ggccgcgcccaucgcggccgcc

SEQ ID NO: 945499 - RNA, 15 nt, Mycobacterium avium subsp. paratuberculosis
ggccgcgacugcacc

SEQ ID NO: 945500 - RNA, 19 nt, Mycobacterium avium subsp. paratuberculosis
ggccgccuucuccgggucg

SEQ ID NO: 945501 - RNA, 13 nt, Mycobacterium avium subsp. paratuberculosis
ggccgcgacgccg

SEQ ID NO: 945502 - RNA, 22 nt, Mycobacterium avium subsp. paratuberculosis
ggccgcgacgccgccgccgagc

SEQ ID NO: 945503 - RNA, 12 nt, Mycobacterium avium subsp. paratuberculosis
ggccgcgacgcg

SEQ ID NO: 945504 - RNA, 15 nt, Mycobacterium avium subsp. paratuberculosis
ggccgcgacgcgcgg

SEQ ID NO: 945505 - RNA, 17 nt, Mycobacterium avium subsp. paratuberculosis
ggccgccuucacgaccg

SEQ ID NO: 945506 - RNA, 20 nt, Mycobacterium avium subsp. paratuberculosis
ggccgccuucacgaccggca

SEQ ID NO: 945507 - RNA, 22 nt, Mycobacterium avium subsp. paratuberculosis
ggccgccuucacgaccggcagc

SEQ ID NO: 945508 - RNA, 18 nt, Mycobacterium avium subsp. paratuberculosis
ggccgccuugggccgguc

SEQ ID NO: 945509 - RNA, 19 nt, Mycobacterium avium subsp. paratuberculosis
ggccgccuugggccggucg

SEQ ID NO: 945510 - RNA, 21 nt, Mycobacterium avium subsp. paratuberculosis
ggccgcgaaaauaccgccggc

SEQ ID NO: 945511 - RNA, 19 nt, Mycobacterium avium subsp. paratuberculosis
ggccgcgaacggcccgccg

SEQ ID NO: 945512 - RNA, 21 nt, Mycobacterium avium subsp. paratuberculosis
ggccgcgaacgggugaccggc

SEQ ID NO: 945513 - RNA, 22 nt, Mycobacterium avium subsp. paratuberculosis
ggccgcgaacgggugaccggcg

SEQ ID NO: 945514 - RNA, 23 nt, Mycobacterium avium subsp. paratuberculosis
ggccgcgaacgggugaccggcgg

SEQ ID NO: 945515 - RNA, 20 nt, Mycobacterium avium subsp. paratuberculosis
ggccgcgaagaugucgccgu

SEQ ID NO: 945516 - RNA, 21 nt, Mycobacterium avium subsp. paratuberculosis
ggccgcgaagaugucgccgua

SEQ ID NO: 945517 - RNA, 19 nt, Mycobacterium avium subsp. paratuberculosis
ggccgcgaaggcggcgucg

SEQ ID NO: 945518 - RNA, 20 nt, Mycobacterium avium subsp. paratuberculosis
ggccgcgaaggcggcgucga

SEQ ID NO: 945519 - RNA, 23 nt, Mycobacterium avium subsp. paratuberculosis
ggccgcgaaggcggcgucgaugu

SEQ ID NO: 945520 - RNA, 22 nt, Mycobacterium avium subsp. paratuberculosis
ggccgccuggacgacgucgaug

SEQ ID NO: 945521 - RNA, 13 nt, Mycobacterium avium subsp. paratuberculosis
ggccgccugcggg

SEQ ID NO: 945522 - RNA, 14 nt, Mycobacterium avium subsp. paratuberculosis
ggccgccugcgggu

SEQ ID NO: 945523 - RNA, 23 nt, Mycobacterium avium subsp. paratuberculosis
ggccgccugcggguucuggccgu

SEQ ID NO: 945524 - RNA, 15 nt, Mycobacterium avium subsp. paratuberculosis
ggccgccucgucgag

SEQ ID NO: 945525 - RNA, 14 nt, Mycobacterium avium subsp. paratuberculosis
ggccgccgucggua

SEQ ID NO: 945526 - RNA, 15 nt, Mycobacterium avium subsp. paratuberculosis
ggccgccgucgguau

SEQ ID NO: 945527 - RNA, 13 nt, Mycobacterium avium subsp. paratuberculosis
ggccgccucccgc

SEQ ID NO: 945528 - RNA, 20 nt, Mycobacterium avium subsp. paratuberculosis
ggccgccucccgcagcgcca

SEQ ID NO: 945529 - RNA, 21 nt, Mycobacterium avium subsp. paratuberculosis
ggccgccucccgcagcgccag

SEQ ID NO: 945530 - RNA, 22 nt, Mycobacterium avium subsp. paratuberculosis
ggccgccucccgcagcgccagc

SEQ ID NO: 945531 - RNA, 24 nt, Mycobacterium avium subsp. paratuberculosis
ggccgccuccgguuugcgccggcu

SEQ ID NO: 945532 - RNA, 16 nt, Mycobacterium avium subsp. paratuberculosis
ggccgccucgaagucg

SEQ ID NO: 945533 - RNA, 20 nt, Mycobacterium avium subsp. paratuberculosis
ggccgccucgaagucgccgg

SEQ ID NO: 945534 - RNA, 21 nt, Mycobacterium avium subsp. paratuberculosis
ggccgccucgaagucgccggc

SEQ ID NO: 945535 - RNA, 23 nt, Mycobacterium avium subsp. paratuberculosis
ggccgccucgaagucgccggccu

SEQ ID NO: 945536 - RNA, 19 nt, Mycobacterium avium subsp. paratuberculosis
ggccgccgugcugacguga

SEQ ID NO: 945537 - RNA, 15 nt, Mycobacterium avium subsp. paratuberculosis
ggccgccguggccca

SEQ ID NO: 945538 - RNA, 19 nt, Mycobacterium avium subsp. paratuberculosis
ggccgccguaucccugcca

SEQ ID NO: 945539 - RNA, 20 nt, Mycobacterium avium subsp. paratuberculosis
ggccgccguaucccugccag

SEQ ID NO: 945540 - RNA, 16 nt, Mycobacterium avium subsp. paratuberculosis
ggccgccggggcccca

SEQ ID NO: 945541 - RNA, 14 nt, Mycobacterium avium subsp. paratuberculosis
ggccgccgggccgc

SEQ ID NO: 945542 - RNA, 16 nt, Mycobacterium avium subsp. paratuberculosis
ggccgccgggccgccg

SEQ ID NO: 945543 - RNA, 17 nt, Mycobacterium avium subsp. paratuberculosis
ggccgccgggccgccga

SEQ ID NO: 945544 - RNA, 17 nt, Mycobacterium avium subsp. paratuberculosis
ggccgccgggacgggca

SEQ ID NO: 945545 - RNA, 15 nt, Mycobacterium avium subsp. paratuberculosis
ggccgccgccugagc

SEQ ID NO: 945546 - RNA, 21 nt, Mycobacterium avium subsp. paratuberculosis
ggccgccgccugagcccgccu

SEQ ID NO: 945547 - RNA, 12 nt, Mycobacterium avium subsp. paratuberculosis
ggccgccgcgac

SEQ ID NO: 945548 - RNA, 13 nt, Mycobacterium avium subsp. paratuberculosis
ggccgccgcgacc

SEQ ID NO: 945549 - RNA, 16 nt, Mycobacterium avium subsp. paratuberculosis
ggccgccgcgaccguc

SEQ ID NO: 945550 - RNA, 13 nt, Mycobacterium avium subsp. paratuberculosis
ggccgccgcgaua

SEQ ID NO: 945551 - RNA, 14 nt, Mycobacterium avium subsp. paratuberculosis
ggccgccgcgauca

SEQ ID NO: 945552 - RNA, 23 nt, Mycobacterium avium subsp. paratuberculosis
ggccgccgcauuccucggccagc

SEQ ID NO: 945553 - RNA, 19 nt, Mycobacterium avium subsp. paratuberculosis
ggccgccgccaccgucgcc

SEQ ID NO: 945554 - RNA, 14 nt, Mycobacterium avium subsp. paratuberculosis
ggccgccgcccgcg

SEQ ID NO: 945555 - RNA, 15 nt, Mycobacterium avium subsp. paratuberculosis
ggccgccgcccgcgc

SEQ ID NO: 945556 - RNA, 19 nt, Mycobacterium avium subsp. paratuberculosis
ggccgccgcccgcgcggcg

SEQ ID NO: 945557 - RNA, 23 nt, Mycobacterium avium subsp. paratuberculosis
ggccgccgcccgcgcggcggcca

SEQ ID NO: 945558 - RNA, 18 nt, Mycobacterium avium subsp. paratuberculosis
ggccgccgcauaccgccc

SEQ ID NO: 945559 - RNA, 15 nt, Mycobacterium avium subsp. paratuberculosis
ggccgccgccgcggc

SEQ ID NO: 945560 - RNA, 15 nt, Mycobacterium avium subsp. paratuberculosis
ggccgcaggcggcca

SEQ ID NO: 945561 - RNA, 19 nt, Mycobacterium avium subsp. paratuberculosis
ggccgcaggcggccagcac

SEQ ID NO: 945562 - RNA, 19 nt, Mycobacterium avium subsp. paratuberculosis
ggccgcaggguggccagca

SEQ ID NO: 945563 - RNA, 20 nt, Mycobacterium avium subsp. paratuberculosis
ggccgccgaggacacguugg

SEQ ID NO: 945564 - RNA, 19 nt, Mycobacterium avium subsp. paratuberculosis
ggccgccgaggcgaugccg

SEQ ID NO: 945565 - RNA, 14 nt, Mycobacterium avium subsp. paratuberculosis
ggccgccgaucaac

SEQ ID NO: 945566 - RNA, 21 nt, Mycobacterium avium subsp. paratuberculosis
ggccgccgaugcgcccgcugc

SEQ ID NO: 945567 - RNA, 19 nt, Mycobacterium avium subsp. paratuberculosis
ggccgcagcgugggcaccg

SEQ ID NO: 945568 - RNA, 22 nt, Mycobacterium avium subsp. paratuberculosis
ggccgcagcgugggcaccggca

SEQ ID NO: 945569 - RNA, 15 nt, Mycobacterium avium subsp. paratuberculosis
ggccgcagcucgccc

SEQ ID NO: 945570 - RNA, 18 nt, Mycobacterium avium subsp. paratuberculosis
ggccgcagcucgcccagc

SEQ ID NO: 945571 - RNA, 18 nt, Mycobacterium avium subsp. paratuberculosis
ggccgcacuccgucgcga

SEQ ID NO: 945572 - RNA, 12 nt, Mycobacterium avium subsp. paratuberculosis
ggccgcagcggg

SEQ ID NO: 945573 - RNA, 13 nt, Mycobacterium avium subsp. paratuberculosis
ggccgcagcggca

SEQ ID NO: 945574 - RNA, 21 nt, Mycobacterium avium subsp. paratuberculosis
ggccgcagcgcaucgccggcg

SEQ ID NO: 945575 - RNA, 13 nt, Mycobacterium avium subsp. paratuberculosis
ggccgcagcgccc

SEQ ID NO: 945576 - RNA, 20 nt, Mycobacterium avium subsp. paratuberculosis
ggccgcagcgcccggcagcg

SEQ ID NO: 945577 - RNA, 12 nt, Mycobacterium avium subsp. paratuberculosis
ggccgcagcgcg

SEQ ID NO: 945578 - RNA, 13 nt, Mycobacterium avium subsp. paratuberculosis
ggccgcagcgcgg

SEQ ID NO: 945579 - RNA, 18 nt, Mycobacterium avium subsp. paratuberculosis
ggccgcagcgcggcgaca

SEQ ID NO: 945580 - RNA, 16 nt, Mycobacterium avium subsp. paratuberculosis
ggccgcagccgcgcgg

SEQ ID NO: 945581 - RNA, 18 nt, Mycobacterium avium subsp. paratuberculosis
ggccgcagccgcgcggcc

SEQ ID NO: 945582 - RNA, 19 nt, Mycobacterium avium subsp. paratuberculosis
ggccgcagccgcgcggccg

SEQ ID NO: 945583 - RNA, 13 nt, Mycobacterium avium subsp. paratuberculosis
ggccgcagcacca

SEQ ID NO: 945584 - RNA, 14 nt, Mycobacterium avium subsp. paratuberculosis
ggccgcagcagcga

SEQ ID NO: 945585 - RNA, 21 nt, Mycobacterium avium subsp. paratuberculosis
ggccgcacgucccgcccggcg

SEQ ID NO: 945586 - RNA, 14 nt, Mycobacterium avium subsp. paratuberculosis
ggccgcaccuggca

SEQ ID NO: 945587 - RNA, 16 nt, Mycobacterium avium subsp. paratuberculosis
ggccgcaacggcgguc

SEQ ID NO: 945588 - RNA, 17 nt, Mycobacterium avium subsp. paratuberculosis
ggccgcaacggcggucg

SEQ ID NO: 945589 - RNA, 22 nt, Mycobacterium avium subsp. paratuberculosis
ggccgcaacggcggucgugcgg

SEQ ID NO: 945590 - RNA, 16 nt, Mycobacterium avium subsp. paratuberculosis
ggccgcaagcgaagcc

SEQ ID NO: 945591 - RNA, 20 nt, Mycobacterium avium subsp. paratuberculosis
ggccgcaauacggugcccgc

SEQ ID NO: 945592 - RNA, 23 nt, Mycobacterium avium subsp. paratuberculosis
ggccgcaauacggugcccgccgc

SEQ ID NO: 945593 - RNA, 16 nt, Mycobacterium avium subsp. paratuberculosis
ggccgcaaucggcgcc

SEQ ID NO: 945594 - RNA, 15 nt, Mycobacterium avium subsp. paratuberculosis
ggccgcacaccacca

SEQ ID NO: 945595 - RNA, 22 nt, Mycobacterium avium subsp. paratuberculosis
ggccgcacaccugcaucacgau

SEQ ID NO: 945596 - RNA, 12 nt, Mycobacterium avium subsp. paratuberculosis
ggccgcacccca

SEQ ID NO: 945597 - RNA, 23 nt, Mycobacterium avium subsp. paratuberculosis
ggccgcaccccacccgcgcgaca

SEQ ID NO: 945598 - RNA, 23 nt, Mycobacterium avium subsp. paratuberculosis
ggccgcacccccuccacacggca

SEQ ID NO: 945599 - RNA, 19 nt, Mycobacterium avium subsp. paratuberculosis
aacagugcacugccgaccc

SEQ ID NO: 945600 - RNA, 14 nt, Mycobacterium avium subsp. paratuberculosis
cggcagcagggugc

SEQ ID NO: 945601 - RNA, 18 nt, Mycobacterium avium subsp. paratuberculosis
cggcagcagggugccgcc

SEQ ID NO: 945602 - RNA, 19 nt, Mycobacterium avium subsp. paratuberculosis
cggcagcagggugccgccg

SEQ ID NO: 945603 - RNA, 20 nt, Mycobacterium avium subsp. paratuberculosis
cggcagcaucgggacgccug

SEQ ID NO: 945604 - RNA, 21 nt, Mycobacterium avium subsp. paratuberculosis
cggcagcaucgggacgccugc

SEQ ID NO: 945605 - RNA, 23 nt, Mycobacterium avium subsp. paratuberculosis
cggcagcaucgggacgccugccg

SEQ ID NO: 945606 - RNA, 19 nt, Mycobacterium avium subsp. paratuberculosis
cggcagauugguucggccg

SEQ ID NO: 945607 - RNA, 14 nt, Mycobacterium avium subsp. paratuberculosis
cggcagcaaccgcg

SEQ ID NO: 945608 - RNA, 16 nt, Mycobacterium avium subsp. paratuberculosis
cggcagcaaccgcgaa

SEQ ID NO: 945609 - RNA, 16 nt, Mycobacterium avium subsp. paratuberculosis
cggcagcaaccggcgg

SEQ ID NO: 945610 - RNA, 18 nt, Mycobacterium avium subsp. paratuberculosis
cggcagcaaccggcggcu

SEQ ID NO: 945611 - RNA, 14 nt, Mycobacterium avium subsp. paratuberculosis
cggcagcaccgccg

SEQ ID NO: 945612 - RNA, 16 nt, Mycobacterium avium subsp. paratuberculosis
cggcagcaccgccgac

SEQ ID NO: 945613 - RNA, 20 nt, Mycobacterium avium subsp. paratuberculosis
cggcagcaccgccgacaucg

SEQ ID NO: 945614 - RNA, 17 nt, Mycobacterium avium subsp. paratuberculosis
cggcagcaccgccgagc

SEQ ID NO: 945615 - RNA, 13 nt, Mycobacterium avium subsp. paratuberculosis
cggcagcaccggc

SEQ ID NO: 945616 - RNA, 16 nt, Mycobacterium avium subsp. paratuberculosis
cggcagcaccggccgg

SEQ ID NO: 945617 - RNA, 17 nt, Mycobacterium avium subsp. paratuberculosis
cggcagcaccggccgga

SEQ ID NO: 945618 - RNA, 22 nt, Mycobacterium avium subsp. paratuberculosis
cggcagcacaccuuccaccacc

SEQ ID NO: 945619 - RNA, 23 nt, Mycobacterium avium subsp. paratuberculosis
cggcagcacaccuuccaccaccg

SEQ ID NO: 945620 - RNA, 19 nt, Mycobacterium avium subsp. paratuberculosis
cggcagcaccucgcgcagc

SEQ ID NO: 945621 - RNA, 20 nt, Mycobacterium avium subsp. paratuberculosis
cggcagcaccucgcgcagca

SEQ ID NO: 945622 - RNA, 22 nt, Mycobacterium avium subsp. paratuberculosis
cggcagcaccucgcgcagcacc

SEQ ID NO: 945623 - RNA, 23 nt, Mycobacterium avium subsp. paratuberculosis
cggcagcaccucgcgcagcaccg

SEQ ID NO: 945624 - RNA, 19 nt, Mycobacterium avium subsp. paratuberculosis
cggcagcagcugcgucggc

SEQ ID NO: 945625 - RNA, 20 nt, Mycobacterium avium subsp. paratuberculosis
cggcagcagcugcgucggca

SEQ ID NO: 945626 - RNA, 14 nt, Mycobacterium avium subsp. paratuberculosis
cggcagcagcgcgu

SEQ ID NO: 945627 - RNA, 17 nt, Mycobacterium avium subsp. paratuberculosis
cggcagcagcgcgucgu

SEQ ID NO: 945628 - RNA, 14 nt, Mycobacterium avium subsp. paratuberculosis
cggcagcagcgagu

SEQ ID NO: 945629 - RNA, 17 nt, Mycobacterium avium subsp. paratuberculosis
cggcagcagcgagucga

SEQ ID NO: 945630 - RNA, 22 nt, Mycobacterium avium subsp. paratuberculosis
cggcagcagcgagucgaagccg

SEQ ID NO: 945631 - RNA, 21 nt, Mycobacterium avium subsp. paratuberculosis
cggcagcacguccccgggcac

SEQ ID NO: 945632 - RNA, 21 nt, Mycobacterium avium subsp. paratuberculosis
cggcagcacgucguaggccau

SEQ ID NO: 945633 - RNA, 17 nt, Mycobacterium avium subsp. paratuberculosis
cggcacucgucguggcg

SEQ ID NO: 945634 - RNA, 18 nt, Mycobacterium avium subsp. paratuberculosis
cggcacucgucguggcgg

SEQ ID NO: 945635 - RNA, 21 nt, Mycobacterium avium subsp. paratuberculosis
cggcacucgucguggcggugc

SEQ ID NO: 945636 - RNA, 16 nt, Mycobacterium avium subsp. paratuberculosis
cggcacugaaggcgcg

SEQ ID NO: 945637 - RNA, 17 nt, Mycobacterium avium subsp. paratuberculosis
cggcacugaaggcgcgg

SEQ ID NO: 945638 - RNA, 22 nt, Mycobacterium avium subsp. paratuberculosis
cggcacguugacguagacgacg

SEQ ID NO: 945639 - RNA, 14 nt, Mycobacterium avium subsp. paratuberculosis
cggcacguugccca

SEQ ID NO: 945640 - RNA, 23 nt, Mycobacterium avium subsp. paratuberculosis
cggcacguugcccaggaaguagc

SEQ ID NO: 945641 - RNA, 14 nt, Mycobacterium avium subsp. paratuberculosis
cggcacuaccgccu

SEQ ID NO: 945642 - RNA, 15 nt, Mycobacterium avium subsp. paratuberculosis
cggcacuaccgccuc

SEQ ID NO: 945643 - RNA, 17 nt, Mycobacterium avium subsp. paratuberculosis
cggcacugcccgcaucg

SEQ ID NO: 945644 - RNA, 22 nt, Mycobacterium avium subsp. paratuberculosis
cggcacuucgaucaucuccacc

SEQ ID NO: 945645 - RNA, 22 nt, Mycobacterium avium subsp. paratuberculosis
cggcacugcugcccgcgacggc

SEQ ID NO: 945646 - RNA, 18 nt, Mycobacterium avium subsp. paratuberculosis
cggcagauagaucagcag

SEQ ID NO: 945647 - RNA, 19 nt, Mycobacterium avium subsp. paratuberculosis
cggcagauagaucagcagg

SEQ ID NO: 945648 - RNA, 15 nt, Mycobacterium avium subsp. paratuberculosis
cggcagaucgcggcc

SEQ ID NO: 945649 - RNA, 16 nt, Mycobacterium avium subsp. paratuberculosis
cggcagaucgcggccc

SEQ ID NO: 945650 - RNA, 20 nt, Mycobacterium avium subsp. paratuberculosis
cggcagaucgcggcccgccg

SEQ ID NO: 945651 - RNA, 19 nt, Mycobacterium avium subsp. paratuberculosis
cggcagaccggugagcacc

SEQ ID NO: 945652 - RNA, 16 nt, Mycobacterium avium subsp. paratuberculosis
cggcagaccgguggcg

SEQ ID NO: 945653 - RNA, 14 nt, Mycobacterium avium subsp. paratuberculosis
cggcagaccguccg

SEQ ID NO: 945654 - RNA, 14 nt, Mycobacterium avium subsp. paratuberculosis
cggcagaacgacgc

SEQ ID NO: 945655 - RNA, 16 nt, Mycobacterium avium subsp. paratuberculosis
cggcagaacgacgcca

SEQ ID NO: 945656 - RNA, 13 nt, Mycobacterium avium subsp. paratuberculosis
cggcagacccagc

SEQ ID NO: 945657 - RNA, 14 nt, Mycobacterium avium subsp. paratuberculosis
cggcagacccagca

SEQ ID NO: 945658 - RNA, 17 nt, Mycobacterium avium subsp. paratuberculosis
cggcagacccagcagcg

SEQ ID NO: 945659 - RNA, 20 nt, Mycobacterium avium subsp. paratuberculosis
cggcagacccagcagcggcc

SEQ ID NO: 945660 - RNA, 21 nt, Mycobacterium avium subsp. paratuberculosis
cggcagacccagcagcggccg

SEQ ID NO: 945661 - RNA, 22 nt, Mycobacterium avium subsp. paratuberculosis
cggcagacccagcagcggccgg

SEQ ID NO: 945662 - RNA, 23 nt, Mycobacterium avium subsp. paratuberculosis
cggcagacccagcagcggccggc

SEQ ID NO: 945663 - RNA, 13 nt, Mycobacterium avium subsp. paratuberculosis
cggcacgucgccg

SEQ ID NO: 945664 - RNA, 15 nt, Mycobacterium avium subsp. paratuberculosis
cggcacgucggccac

SEQ ID NO: 945665 - RNA, 18 nt, Mycobacterium avium subsp. paratuberculosis
cggcacgucggccacgcc

SEQ ID NO: 945666 - RNA, 16 nt, Mycobacterium avium subsp. paratuberculosis
cggcacgucgagcagu

SEQ ID NO: 945667 - RNA, 12 nt, Mycobacterium avium subsp. paratuberculosis
cggcacgucgcc

SEQ ID NO: 945668 - RNA, 14 nt, Mycobacterium avium subsp. paratuberculosis
cggcacgugcgggu

SEQ ID NO: 945669 - RNA, 22 nt, Mycobacterium avium subsp. paratuberculosis
cggcacgugcggguuggcgccg

SEQ ID NO: 945670 - RNA, 19 nt, Mycobacterium avium subsp. paratuberculosis
cggcacguguccgacgccg

SEQ ID NO: 945671 - RNA, 13 nt, Mycobacterium avium subsp. paratuberculosis
cggcacgguuggc

SEQ ID NO: 945672 - RNA, 15 nt, Mycobacterium avium subsp. paratuberculosis
cggcacgguuggccg

SEQ ID NO: 945673 - RNA, 20 nt, Mycobacterium avium subsp. paratuberculosis
cggcacgguuggccggcccg

SEQ ID NO: 945674 - RNA, 23 nt, Mycobacterium avium subsp. paratuberculosis
cggcacgguuggccggcccgccc

SEQ ID NO: 945675 - RNA, 20 nt, Mycobacterium avium subsp. paratuberculosis
cggcacggugcacacgccga

SEQ ID NO: 945676 - RNA, 15 nt, Mycobacterium avium subsp. paratuberculosis
cggcacggugcgggu

SEQ ID NO: 945677 - RNA, 16 nt, Mycobacterium avium subsp. paratuberculosis
cggcacggugcgggug

SEQ ID NO: 945678 - RNA, 20 nt, Mycobacterium avium subsp. paratuberculosis
cggcacggugcgggugccga

SEQ ID NO: 945679 - RNA, 13 nt, Mycobacterium avium subsp. paratuberculosis
cggcacgcgcgcc

SEQ ID NO: 945680 - RNA, 22 nt, Mycobacterium avium subsp. paratuberculosis
cggcacggcuaccuaggcgucg

SEQ ID NO: 945681 - RNA, 14 nt, Mycobacterium avium subsp. paratuberculosis
cggcacgggcaccg

SEQ ID NO: 945682 - RNA, 20 nt, Mycobacterium avium subsp. paratuberculosis
cggcacgggcaccgacgagg

SEQ ID NO: 945683 - RNA, 16 nt, Mycobacterium avium subsp. paratuberculosis
cggcacggccggccgg

SEQ ID NO: 945684 - RNA, 13 nt, Mycobacterium avium subsp. paratuberculosis
cggcacggcgagg

SEQ ID NO: 945685 - RNA, 19 nt, Mycobacterium avium subsp. paratuberculosis
cggcacggcgaggucggga

SEQ ID NO: 945686 - RNA, 20 nt, Mycobacterium avium subsp. paratuberculosis
cggcacggcgaggucgggau

SEQ ID NO: 945687 - RNA, 14 nt, Mycobacterium avium subsp. paratuberculosis
cggcacgcugcgcc

SEQ ID NO: 945688 - RNA, 22 nt, Mycobacterium avium subsp. paratuberculosis
cggcacgcugcgccagccgucg

SEQ ID NO: 945689 - RNA, 14 nt, Mycobacterium avium subsp. paratuberculosis
cggcacggcaccgc

SEQ ID NO: 945690 - RNA, 15 nt, Mycobacterium avium subsp. paratuberculosis
cggcacggcaccgcg

SEQ ID NO: 945691 - RNA, 20 nt, Mycobacterium avium subsp. paratuberculosis
cggcacggcaccgcgagcac

SEQ ID NO: 945692 - RNA, 13 nt, Mycobacterium avium subsp. paratuberculosis
cggcacggcaugg

SEQ ID NO: 945693 - RNA, 14 nt, Mycobacterium avium subsp. paratuberculosis
cggcacgcgucacc

SEQ ID NO: 945694 - RNA, 18 nt, Mycobacterium avium subsp. paratuberculosis
cggcacgcgucaccggaa

SEQ ID NO: 945695 - RNA, 18 nt, Mycobacterium avium subsp. paratuberculosis
cggcacgccgcucgucgg

SEQ ID NO: 945696 - RNA, 20 nt, Mycobacterium avium subsp. paratuberculosis
cggcacgccgcucgucgggc

SEQ ID NO: 945697 - RNA, 18 nt, Mycobacterium avium subsp. paratuberculosis
cggcacgcccguucgagc

SEQ ID NO: 945698 - RNA, 21 nt, Mycobacterium avium subsp. paratuberculosis
cggcacgcccguucgagcgcc

SEQ ID NO: 945699 - RNA, 11 nt, Mycobacterium avium subsp. paratuberculosis
cggcacgccga

SEQ ID NO: 945700 - RNA, 16 nt, Mycobacterium avium subsp. paratuberculosis
aacagguaggcggcgc

SEQ ID NO: 945701 - RNA, 18 nt, Mycobacterium avium subsp. paratuberculosis
cggcacgaucgucgccgc

SEQ ID NO: 945702 - RNA, 19 nt, Mycobacterium avium subsp. paratuberculosis
cggcacgaucgucgccgcc

SEQ ID NO: 945703 - RNA, 14 nt, Mycobacterium avium subsp. paratuberculosis
cggcacgaucucga

SEQ ID NO: 945704 - RNA, 22 nt, Mycobacterium avium subsp. paratuberculosis
cggcacgaucucgaccaggccg

SEQ ID NO: 945705 - RNA, 20 nt, Mycobacterium avium subsp. paratuberculosis
cggcacgauggcgcggcgca

SEQ ID NO: 945706 - RNA, 21 nt, Mycobacterium avium subsp. paratuberculosis
cggcacgauggcgcggcgcac

SEQ ID NO: 945707 - RNA, 16 nt, Mycobacterium avium subsp. paratuberculosis
aacagggcgacggcgg

SEQ ID NO: 945708 - RNA, 20 nt, Mycobacterium avium subsp. paratuberculosis
cggacaccggcacgucggcc

SEQ ID NO: 945709 - RNA, 16 nt, Mycobacterium avium subsp. paratuberculosis
cggacacgaacgacgc

SEQ ID NO: 945710 - RNA, 19 nt, Mycobacterium avium subsp. paratuberculosis
cggacacgaacgacgcggc

SEQ ID NO: 945711 - RNA, 17 nt, Mycobacterium avium subsp. paratuberculosis
cggacaccaccgcggug

SEQ ID NO: 945712 - RNA, 21 nt, Mycobacterium avium subsp. paratuberculosis
cggacaccaccgcggugggcc

SEQ ID NO: 945713 - RNA, 13 nt, Mycobacterium avium subsp. paratuberculosis
cggacaccagcau

SEQ ID NO: 945714 - RNA, 13 nt, Mycobacterium avium subsp. paratuberculosis
cggacaccagguu

SEQ ID NO: 945715 - RNA, 21 nt, Mycobacterium avium subsp. paratuberculosis
cggacaccagguuggucucga

SEQ ID NO: 945716 - RNA, 17 nt, Mycobacterium avium subsp. paratuberculosis
cggacaccagucgcaca

SEQ ID NO: 945717 - RNA, 15 nt, Mycobacterium avium subsp. paratuberculosis
cggacaccccggcca

SEQ ID NO: 945718 - RNA, 14 nt, Mycobacterium avium subsp. paratuberculosis
cggacacccgcgcg

SEQ ID NO: 945719 - RNA, 20 nt, Mycobacterium avium subsp. paratuberculosis
cggacacccgcgcggugccc

SEQ ID NO: 945720 - RNA, 23 nt, Mycobacterium avium subsp. paratuberculosis
cggacaccgaaccgccccgcgcg

SEQ ID NO: 945721 - RNA, 14 nt, Mycobacterium avium subsp. paratuberculosis
cggacagcacguug

SEQ ID NO: 945722 - RNA, 20 nt, Mycobacterium avium subsp. paratuberculosis
cggacagcagcaccggcacc

SEQ ID NO: 945723 - RNA, 21 nt, Mycobacterium avium subsp. paratuberculosis
cggacagcagcaccggcaccg

SEQ ID NO: 945724 - RNA, 13 nt, Mycobacterium avium subsp. paratuberculosis
cggacagagucga

SEQ ID NO: 945725 - RNA, 17 nt, Mycobacterium avium subsp. paratuberculosis
cggacacggccgggauu

SEQ ID NO: 945726 - RNA, 13 nt, Mycobacterium avium subsp. paratuberculosis
cggacacggcgcc

SEQ ID NO: 945727 - RNA, 16 nt, Mycobacterium avium subsp. paratuberculosis
cggacacggcgccgug

SEQ ID NO: 945728 - RNA, 17 nt, Mycobacterium avium subsp. paratuberculosis
cggacacggcgccgugc

SEQ ID NO: 945729 - RNA, 18 nt, Mycobacterium avium subsp. paratuberculosis
cggacacggcgccgugcg

SEQ ID NO: 945730 - RNA, 13 nt, Mycobacterium avium subsp. paratuberculosis
cggacagcgcgac

SEQ ID NO: 945731 - RNA, 17 nt, Mycobacterium avium subsp. paratuberculosis
cggacagcggccccccg

SEQ ID NO: 945732 - RNA, 15 nt, Mycobacterium avium subsp. paratuberculosis
cggacagcgggccga

SEQ ID NO: 945733 - RNA, 16 nt, Mycobacterium avium subsp. paratuberculosis
cggacagcgggccgac

SEQ ID NO: 945734 - RNA, 16 nt, Mycobacterium avium subsp. paratuberculosis
cggacagcucaccggg

SEQ ID NO: 945735 - RNA, 15 nt, Mycobacterium avium subsp. paratuberculosis
cggacagcucgccgg

SEQ ID NO: 945736 - RNA, 16 nt, Mycobacterium avium subsp. paratuberculosis
cggacagcucgccggc

SEQ ID NO: 945737 - RNA, 20 nt, Mycobacterium avium subsp. paratuberculosis
cggacagcucgccggccgcg

SEQ ID NO: 945738 - RNA, 21 nt, Mycobacterium avium subsp. paratuberculosis
cggacagcucgccggccgcgg

SEQ ID NO: 945739 - RNA, 15 nt, Mycobacterium avium subsp. paratuberculosis
cggcaccccgcgguc

SEQ ID NO: 945740 - RNA, 16 nt, Mycobacterium avium subsp. paratuberculosis
cggcaccccgcggucg

SEQ ID NO: 945741 - RNA, 22 nt, Mycobacterium avium subsp. paratuberculosis
cggcaccccgcggucggcggcg

SEQ ID NO: 945742 - RNA, 17 nt, Mycobacterium avium subsp. paratuberculosis
cggacagcuggcggucg

SEQ ID NO: 945743 - RNA, 17 nt, Mycobacterium avium subsp. paratuberculosis
cggcacccgccagcccg

SEQ ID NO: 945744 - RNA, 13 nt, Mycobacterium avium subsp. paratuberculosis
aacaggcccagca

SEQ ID NO: 945745 - RNA, 13 nt, Mycobacterium avium subsp. paratuberculosis
cggcacgaacgcg

SEQ ID NO: 945746 - RNA, 22 nt, Mycobacterium avium subsp. paratuberculosis
cggcaccuuggugagcaccgcg

SEQ ID NO: 945747 - RNA, 20 nt, Mycobacterium avium subsp. paratuberculosis
cggcaccuucaccgaccagc

SEQ ID NO: 945748 - RNA, 13 nt, Mycobacterium avium subsp. paratuberculosis
cggcaccgccagc

SEQ ID NO: 945749 - RNA, 20 nt, Mycobacterium avium subsp. paratuberculosis
cggcaccgacagggccagcg

SEQ ID NO: 945750 - RNA, 21 nt, Mycobacterium avium subsp. paratuberculosis
cggcaccgaucggcacgucga

SEQ ID NO: 945751 - RNA, 15 nt, Mycobacterium avium subsp. paratuberculosis
cggcaccgccaucgg

SEQ ID NO: 945752 - RNA, 19 nt, Mycobacterium avium subsp. paratuberculosis
cggcaccgcccccgcggcg

SEQ ID NO: 945753 - RNA, 22 nt, Mycobacterium avium subsp. paratuberculosis
cggcaccucgaucaccgggcgg

SEQ ID NO: 945754 - RNA, 17 nt, Mycobacterium avium subsp. paratuberculosis
cggcacccgguccggcc

SEQ ID NO: 945755 - RNA, 12 nt, Mycobacterium avium subsp. paratuberculosis
cggcaugccgcc

SEQ ID NO: 945756 - RNA, 14 nt, Mycobacterium avium subsp. paratuberculosis
cggcaugccgggcc

SEQ ID NO: 945757 - RNA, 16 nt, Mycobacterium avium subsp. paratuberculosis
cggcaugccgggccag

SEQ ID NO: 945758 - RNA, 20 nt, Mycobacterium avium subsp. paratuberculosis
cggcaugccgggccagccgg

SEQ ID NO: 945759 - RNA, 13 nt, Mycobacterium avium subsp. paratuberculosis
cggcaugcccccg

SEQ ID NO: 945760 - RNA, 14 nt, Mycobacterium avium subsp. paratuberculosis
cggccaacaacgcc

SEQ ID NO: 945761 - RNA, 17 nt, Mycobacterium avium subsp. paratuberculosis
cggccaacagcagcgcc

SEQ ID NO: 945762 - RNA, 20 nt, Mycobacterium avium subsp. paratuberculosis
cggccaacagcagcgccgcg

SEQ ID NO: 945763 - RNA, 19 nt, Mycobacterium avium subsp. paratuberculosis
cggccaaggcaagucgucg

SEQ ID NO: 945764 - RNA, 16 nt, Mycobacterium avium subsp. paratuberculosis
cggccaccaccgcauc

SEQ ID NO: 945765 - RNA, 16 nt, Mycobacterium avium subsp. paratuberculosis
cggccaccaccgccac

SEQ ID NO: 945766 - RNA, 21 nt, Mycobacterium avium subsp. paratuberculosis
cggccaccaccgccacggcgg

SEQ ID NO: 945767 - RNA, 15 nt, Mycobacterium avium subsp. paratuberculosis
cggccaaucccacca

SEQ ID NO: 945768 - RNA, 19 nt, Mycobacterium avium subsp. paratuberculosis
cggccaaucccaccaugag

SEQ ID NO: 945769 - RNA, 17 nt, Mycobacterium avium subsp. paratuberculosis
cggccaacgggaagagc

SEQ ID NO: 945770 - RNA, 22 nt, Mycobacterium avium subsp. paratuberculosis
cggccaacgggaagagcggcgu

SEQ ID NO: 945771 - RNA, 17 nt, Mycobacterium avium subsp. paratuberculosis
cggccaacugcaucgcc

SEQ ID NO: 945772 - RNA, 20 nt, Mycobacterium avium subsp. paratuberculosis
cggccaacgccucgucgacc

SEQ ID NO: 945773 - RNA, 21 nt, Mycobacterium avium subsp. paratuberculosis
cggccaacgccucgucgaccg

SEQ ID NO: 945774 - RNA, 13 nt, Mycobacterium avium subsp. paratuberculosis
cggccaacgcgac

SEQ ID NO: 945775 - RNA, 14 nt, Mycobacterium avium subsp. paratuberculosis
cggccaacgcgacg

SEQ ID NO: 945776 - RNA, 23 nt, Mycobacterium avium subsp. paratuberculosis
cggccaacgcgacgaagccggug

SEQ ID NO: 945777 - RNA, 20 nt, Mycobacterium avium subsp. paratuberculosis
cggccaacggauagcguccg

SEQ ID NO: 945778 - RNA, 19 nt, Mycobacterium avium subsp. paratuberculosis
cggccaaccgcccggcgcc

SEQ ID NO: 945779 - RNA, 15 nt, Mycobacterium avium subsp. paratuberculosis
cggccaaccgggcag

SEQ ID NO: 945780 - RNA, 17 nt, Mycobacterium avium subsp. paratuberculosis
cggccaacccgggcgcc

SEQ ID NO: 945781 - RNA, 12 nt, Mycobacterium avium subsp. paratuberculosis
cggcaucgcgcg

SEQ ID NO: 945782 - RNA, 15 nt, Mycobacterium avium subsp. paratuberculosis
cggcaucgcgcgcgg

SEQ ID NO: 945783 - RNA, 16 nt, Mycobacterium avium subsp. paratuberculosis
cggcaucgcgcgcggc

SEQ ID NO: 945784 - RNA, 17 nt, Mycobacterium avium subsp. paratuberculosis
cggcaucgcgcgcggcg

SEQ ID NO: 945785 - RNA, 18 nt, Mycobacterium avium subsp. paratuberculosis
cggcaucgcgcgcggcga

SEQ ID NO: 945786 - RNA, 20 nt, Mycobacterium avium subsp. paratuberculosis
cggcaucgcgcgcggcggcc

SEQ ID NO: 945787 - RNA, 14 nt, Mycobacterium avium subsp. paratuberculosis
cggcaucggcucgu

SEQ ID NO: 945788 - RNA, 21 nt, Mycobacterium avium subsp. paratuberculosis
cggcaucgguggcaccccgcg

SEQ ID NO: 945789 - RNA, 23 nt, Mycobacterium avium subsp. paratuberculosis
cggcaucgguggcaccccgcgcc

SEQ ID NO: 945790 - RNA, 13 nt, Mycobacterium avium subsp. paratuberculosis
cggcaucggcgac

SEQ ID NO: 945791 - RNA, 15 nt, Mycobacterium avium subsp. paratuberculosis
cggcaucggcgacgg

SEQ ID NO: 945792 - RNA, 17 nt, Mycobacterium avium subsp. paratuberculosis
cggcaucggcgacggcg

SEQ ID NO: 945793 - RNA, 13 nt, Mycobacterium avium subsp. paratuberculosis
cggcaugaccggc

SEQ ID NO: 945794 - RNA, 14 nt, Mycobacterium avium subsp. paratuberculosis
cggcaugaccggcc

SEQ ID NO: 945795 - RNA, 15 nt, Mycobacterium avium subsp. paratuberculosis
cggcaugaccggcca

SEQ ID NO: 945796 - RNA, 16 nt, Mycobacterium avium subsp. paratuberculosis
cggcaugaccggccag

SEQ ID NO: 945797 - RNA, 17 nt, Mycobacterium avium subsp. paratuberculosis
cggcaugaccggccagc

SEQ ID NO: 945798 - RNA, 19 nt, Mycobacterium avium subsp. paratuberculosis
cggcaugaccggccagcau

SEQ ID NO: 945799 - RNA, 15 nt, Mycobacterium avium subsp. paratuberculosis
cggcaugacgcccag

SEQ ID NO: 945800 - RNA, 14 nt, Mycobacterium avium subsp. paratuberculosis
cggcaucucggccg

SEQ ID NO: 945801 - RNA, 15 nt, Mycobacterium avium subsp. paratuberculosis
cggcauagagcuggu

SEQ ID NO: 945802 - RNA, 19 nt, Mycobacterium avium subsp. paratuberculosis
cggcauagagcuggugggc

SEQ ID NO: 945803 - RNA, 20 nt, Mycobacterium avium subsp. paratuberculosis
cggcauagauaccggccagc

SEQ ID NO: 945804 - RNA, 23 nt, Mycobacterium avium subsp. paratuberculosis
cggcauagauaccggccagcacg

SEQ ID NO: 945805 - RNA, 16 nt, Mycobacterium avium subsp. paratuberculosis
cggcagucgcagcagc

SEQ ID NO: 945806 - RNA, 23 nt, Mycobacterium avium subsp. paratuberculosis
cggcagucgcagcagcagcccga

SEQ ID NO: 945807 - RNA, 20 nt, Mycobacterium avium subsp. paratuberculosis
cggcagugagggaacgccga

SEQ ID NO: 945808 - RNA, 21 nt, Mycobacterium avium subsp. paratuberculosis
cggcagugugauucgggucag

SEQ ID NO: 945809 - RNA, 22 nt, Mycobacterium avium subsp. paratuberculosis
cggcaguaucuuguucgccgac

SEQ ID NO: 945810 - RNA, 23 nt, Mycobacterium avium subsp. paratuberculosis
cggcaguaucuuguucgccgaca

SEQ ID NO: 945811 - RNA, 19 nt, Mycobacterium avium subsp. paratuberculosis
cggcaguccgccggagacc

SEQ ID NO: 945812 - RNA, 15 nt, Mycobacterium avium subsp. paratuberculosis
cggcaguccgcgccg

SEQ ID NO: 945813 - RNA, 16 nt, Mycobacterium avium subsp. paratuberculosis
cggcaguccgcgccgg

SEQ ID NO: 945814 - RNA, 17 nt, Mycobacterium avium subsp. paratuberculosis
cggcaguccgcgccggu

SEQ ID NO: 945815 - RNA, 21 nt, Mycobacterium avium subsp. paratuberculosis
cggcaguccggacacggccag

SEQ ID NO: 945816 - RNA, 22 nt, Mycobacterium avium subsp. paratuberculosis
cggcaguccggacacggccagc

SEQ ID NO: 945817 - RNA, 13 nt, Mycobacterium avium subsp. paratuberculosis
cggcagcggggcg

SEQ ID NO: 945818 - RNA, 23 nt, Mycobacterium avium subsp. paratuberculosis
cggcagcggggcgaacccggcgc

SEQ ID NO: 945819 - RNA, 14 nt, Mycobacterium avium subsp. paratuberculosis
cggcagcggcugcu

SEQ ID NO: 945820 - RNA, 22 nt, Mycobacterium avium subsp. paratuberculosis
cggcagcggcugcugcagcgcc

SEQ ID NO: 945821 - RNA, 15 nt, Mycobacterium avium subsp. paratuberculosis
cggcagcggcgucgu

SEQ ID NO: 945822 - RNA, 17 nt, Mycobacterium avium subsp. paratuberculosis
cggcagcggcgucgucg

SEQ ID NO: 945823 - RNA, 13 nt, Mycobacterium avium subsp. paratuberculosis
cggcagcgcggcg

SEQ ID NO: 945824 - RNA, 15 nt, Mycobacterium avium subsp. paratuberculosis
cggcagcgcggcguu

SEQ ID NO: 945825 - RNA, 24 nt, Mycobacterium avium subsp. paratuberculosis
cggcagcggcaccaacccgaucgg

SEQ ID NO: 945826 - RNA, 18 nt, Mycobacterium avium subsp. paratuberculosis
cggcagcgucgccagccg

SEQ ID NO: 945827 - RNA, 14 nt, Mycobacterium avium subsp. paratuberculosis
cggcagcgucgggc

SEQ ID NO: 945828 - RNA, 23 nt, Mycobacterium avium subsp. paratuberculosis
cggcagcgucuuggacgcccggu

SEQ ID NO: 945829 - RNA, 16 nt, Mycobacterium avium subsp. paratuberculosis
cggcagcggugccgcc

SEQ ID NO: 945830 - RNA, 18 nt, Mycobacterium avium subsp. paratuberculosis
cggcagcggugccgcccg

SEQ ID NO: 945831 - RNA, 19 nt, Mycobacterium avium subsp. paratuberculosis
cggcagcggugccgcccgg

SEQ ID NO: 945832 - RNA, 16 nt, Mycobacterium avium subsp. paratuberculosis
cggcaggcgacccgca

SEQ ID NO: 945833 - RNA, 16 nt, Mycobacterium avium subsp. paratuberculosis
cggcaggcgccccagc

SEQ ID NO: 945834 - RNA, 13 nt, Mycobacterium avium subsp. paratuberculosis
cggcaggcggccc

SEQ ID NO: 945835 - RNA, 18 nt, Mycobacterium avium subsp. paratuberculosis
cggcaggcggcccgcucg

SEQ ID NO: 945836 - RNA, 16 nt, Mycobacterium avium subsp. paratuberculosis
cggcaggcucagcagc

SEQ ID NO: 945837 - RNA, 17 nt, Mycobacterium avium subsp. paratuberculosis
cggcaggcucagcagca

SEQ ID NO: 945838 - RNA, 20 nt, Mycobacterium avium subsp. paratuberculosis
cggcaggcucagcagcaccg

SEQ ID NO: 945839 - RNA, 21 nt, Mycobacterium avium subsp. paratuberculosis
cggcaggcucagcagcaccgc

SEQ ID NO: 945840 - RNA, 20 nt, Mycobacterium avium subsp. paratuberculosis
cggcagguggggcagcaccu

SEQ ID NO: 945841 - RNA, 19 nt, Mycobacterium avium subsp. paratuberculosis
cggcagguuggggacggcg

SEQ ID NO: 945842 - RNA, 22 nt, Mycobacterium avium subsp. paratuberculosis
cggcagguuguugacgacguug

SEQ ID NO: 945843 - RNA, 16 nt, Mycobacterium avium subsp. paratuberculosis
cggcaguacgcgccgg

SEQ ID NO: 945844 - RNA, 21 nt, Mycobacterium avium subsp. paratuberculosis
cggcaguagcgcaccggucag

SEQ ID NO: 945845 - RNA, 22 nt, Mycobacterium avium subsp. paratuberculosis
cggcagguggauugucggccgc

SEQ ID NO: 945846 - RNA, 24 nt, Mycobacterium avium subsp. paratuberculosis
cggcagguggauugucggccgccc

SEQ ID NO: 945847 - RNA, 13 nt, Mycobacterium avium subsp. paratuberculosis
cggcagggccacc

SEQ ID NO: 945848 - RNA, 18 nt, Mycobacterium avium subsp. paratuberculosis
cggcagggccaccgucag

SEQ ID NO: 945849 - RNA, 14 nt, Mycobacterium avium subsp. paratuberculosis
cggcagggccagca

SEQ ID NO: 945850 - RNA, 15 nt, Mycobacterium avium subsp. paratuberculosis
cggcagggccagcac

SEQ ID NO: 945851 - RNA, 16 nt, Mycobacterium avium subsp. paratuberculosis
cggcagggccagcacc

SEQ ID NO: 945852 - RNA, 17 nt, Mycobacterium avium subsp. paratuberculosis
cggcagggccagcacca

SEQ ID NO: 945853 - RNA, 17 nt, Mycobacterium avium subsp. paratuberculosis
cggcagcgaaaccuccg

SEQ ID NO: 945854 - RNA, 19 nt, Mycobacterium avium subsp. paratuberculosis
cggcagcgaacugccggca

SEQ ID NO: 945855 - RNA, 14 nt, Mycobacterium avium subsp. paratuberculosis
cggcagcgacagcg

SEQ ID NO: 945856 - RNA, 19 nt, Mycobacterium avium subsp. paratuberculosis
cggcagcgacagcgcgucg

SEQ ID NO: 945857 - RNA, 20 nt, Mycobacterium avium subsp. paratuberculosis
cggcagcgacagcgcgucgg

SEQ ID NO: 945858 - RNA, 15 nt, Mycobacterium avium subsp. paratuberculosis
cggcagcgacgcggu

SEQ ID NO: 945859 - RNA, 17 nt, Mycobacterium avium subsp. paratuberculosis
cggcagcgacgcgguga

SEQ ID NO: 945860 - RNA, 14 nt, Mycobacterium avium subsp. paratuberculosis
cggcagcgaguagc

SEQ ID NO: 945861 - RNA, 13 nt, Mycobacterium avium subsp. paratuberculosis
cggcagcgaggcg

SEQ ID NO: 945862 - RNA, 14 nt, Mycobacterium avium subsp. paratuberculosis
cggcagcgaggcgc

SEQ ID NO: 945863 - RNA, 13 nt, Mycobacterium avium subsp. paratuberculosis
cggcagcgcgccc

SEQ ID NO: 945864 - RNA, 15 nt, Mycobacterium avium subsp. paratuberculosis
cggcagcgcgcccag

SEQ ID NO: 945865 - RNA, 16 nt, Mycobacterium avium subsp. paratuberculosis
cggcagcgcucgucgu

SEQ ID NO: 945866 - RNA, 19 nt, Mycobacterium avium subsp. paratuberculosis
cggcagcgcucgucgucgg

SEQ ID NO: 945867 - RNA, 22 nt, Mycobacterium avium subsp. paratuberculosis
cggcagcgccucccggaccacc

SEQ ID NO: 945868 - RNA, 23 nt, Mycobacterium avium subsp. paratuberculosis
cggcagcgccucccggaccacca

SEQ ID NO: 945869 - RNA, 15 nt, Mycobacterium avium subsp. paratuberculosis
cggcagcgcgauccg

SEQ ID NO: 945870 - RNA, 15 nt, Mycobacterium avium subsp. paratuberculosis
cggcagcgccaccag

SEQ ID NO: 945871 - RNA, 16 nt, Mycobacterium avium subsp. paratuberculosis
cggcagcgccaccagc

SEQ ID NO: 945872 - RNA, 13 nt, Mycobacterium avium subsp. paratuberculosis
cggcagcgccagc

SEQ ID NO: 945873 - RNA, 17 nt, Mycobacterium avium subsp. paratuberculosis
cggcagcgccagcggga

SEQ ID NO: 945874 - RNA, 14 nt, Mycobacterium avium subsp. paratuberculosis
cggcagccccgucg

SEQ ID NO: 945875 - RNA, 21 nt, Mycobacterium avium subsp. paratuberculosis
cggcagccccgucggucccga

SEQ ID NO: 945876 - RNA, 16 nt, Mycobacterium avium subsp. paratuberculosis
aacaucacccggcggc

SEQ ID NO: 945877 - RNA, 22 nt, Mycobacterium avium subsp. paratuberculosis
aacaucacccggcggcaccgcg

SEQ ID NO: 945878 - RNA, 13 nt, Mycobacterium avium subsp. paratuberculosis
cggcagcccgacg

SEQ ID NO: 945879 - RNA, 16 nt, Mycobacterium avium subsp. paratuberculosis
cggcagcccgacgucc

SEQ ID NO: 945880 - RNA, 13 nt, Mycobacterium avium subsp. paratuberculosis
cggcagcccggag

SEQ ID NO: 945881 - RNA, 15 nt, Mycobacterium avium subsp. paratuberculosis
cggcagccggcgcgg

SEQ ID NO: 945882 - RNA, 14 nt, Mycobacterium avium subsp. paratuberculosis
cggcagccgggcga

SEQ ID NO: 945883 - RNA, 21 nt, Mycobacterium avium subsp. paratuberculosis
cggcagccggggugcccgggc

SEQ ID NO: 945884 - RNA, 22 nt, Mycobacterium avium subsp. paratuberculosis
cggcagccggggugcccgggcc

SEQ ID NO: 945885 - RNA, 13 nt, Mycobacterium avium subsp. paratuberculosis
cggcagccggcca

SEQ ID NO: 945886 - RNA, 17 nt, Mycobacterium avium subsp. paratuberculosis
cggcagccggccaccuc

SEQ ID NO: 945887 - RNA, 15 nt, Mycobacterium avium subsp. paratuberculosis
cggcagccgcuccgg

SEQ ID NO: 945888 - RNA, 19 nt, Mycobacterium avium subsp. paratuberculosis
cggcagccgcuccggcccg

SEQ ID NO: 945889 - RNA, 20 nt, Mycobacterium avium subsp. paratuberculosis
cggcagccgcuccggcccga

SEQ ID NO: 945890 - RNA, 14 nt, Mycobacterium avium subsp. paratuberculosis
cggcagccgcgccc

SEQ ID NO: 945891 - RNA, 17 nt, Mycobacterium avium subsp. paratuberculosis
cggcagccgcgcccacc

SEQ ID NO: 945892 - RNA, 18 nt, Mycobacterium avium subsp. paratuberculosis
cggcagccgcgcccaccc

SEQ ID NO: 945893 - RNA, 21 nt, Mycobacterium avium subsp. paratuberculosis
cggcagccgcgcccacccgcg

SEQ ID NO: 945894 - RNA, 15 nt, Mycobacterium avium subsp. paratuberculosis
aacaucuccagcgcg

SEQ ID NO: 945895 - RNA, 16 nt, Mycobacterium avium subsp. paratuberculosis
aacaucgccucggccg

SEQ ID NO: 945896 - RNA, 20 nt, Mycobacterium avium subsp. paratuberculosis
cggccaggucgccgcgcagc

SEQ ID NO: 945897 - RNA, 23 nt, Mycobacterium avium subsp. paratuberculosis
cggccaggucgccgcgcagcacc

SEQ ID NO: 945898 - RNA, 18 nt, Mycobacterium avium subsp. paratuberculosis
aacaucgagcccaccgcg

SEQ ID NO: 945899 - RNA, 19 nt, Mycobacterium avium subsp. paratuberculosis
aacaucgagcccaccgcgc

SEQ ID NO: 945900 - RNA, 22 nt, Mycobacterium avium subsp. paratuberculosis
aacauccugguccggcgcccga

SEQ ID NO: 945901 - RNA, 22 nt, Mycobacterium avium subsp. paratuberculosis
cggccaggcacagcagggcacc

SEQ ID NO: 945902 - RNA, 23 nt, Mycobacterium avium subsp. paratuberculosis
cggccaggcacagcagggcaccg

SEQ ID NO: 945903 - RNA, 22 nt, Mycobacterium avium subsp. paratuberculosis
aacaucuugaucugggugccgc

SEQ ID NO: 945904 - RNA, 17 nt, Mycobacterium avium subsp. paratuberculosis
cggccauccgggcggca

SEQ ID NO: 945905 - RNA, 19 nt, Mycobacterium avium subsp. paratuberculosis
cggccauccgggcggcauc

SEQ ID NO: 945906 - RNA, 20 nt, Mycobacterium avium subsp. paratuberculosis
cggccauccgggcggcaucg

SEQ ID NO: 945907 - RNA, 23 nt, Mycobacterium avium subsp. paratuberculosis
cggccaucaugcccaccaucccg

SEQ ID NO: 945908 - RNA, 21 nt, Mycobacterium avium subsp. paratuberculosis
cggccaucagcaccgaaucgc

SEQ ID NO: 945909 - RNA, 17 nt, Mycobacterium avium subsp. paratuberculosis
cggccaucagccgccgu

SEQ ID NO: 945910 - RNA, 20 nt, Mycobacterium avium subsp. paratuberculosis
cggccaucagccgccgucgc

SEQ ID NO: 945911 - RNA, 21 nt, Mycobacterium avium subsp. paratuberculosis
cggccaucagccgccgucgcg

SEQ ID NO: 945912 - RNA, 17 nt, Mycobacterium avium subsp. paratuberculosis
cggccaguccaggccgc

SEQ ID NO: 945913 - RNA, 16 nt, Mycobacterium avium subsp. paratuberculosis
cggccaguccgcguga

SEQ ID NO: 945914 - RNA, 15 nt, Mycobacterium avium subsp. paratuberculosis
cggccaguccggcag

SEQ ID NO: 945915 - RNA, 19 nt, Mycobacterium avium subsp. paratuberculosis
cggccaguccggcagcagc

SEQ ID NO: 945916 - RNA, 20 nt, Mycobacterium avium subsp. paratuberculosis
cggccaguccggcagcagcg

SEQ ID NO: 945917 - RNA, 22 nt, Mycobacterium avium subsp. paratuberculosis
cggccaguccggcagcagcgag

SEQ ID NO: 945918 - RNA, 23 nt, Mycobacterium avium subsp. paratuberculosis
cggccagucguacucccaggccg

SEQ ID NO: 945919 - RNA, 18 nt, Mycobacterium avium subsp. paratuberculosis
cggccagugccgggccag

SEQ ID NO: 945920 - RNA, 15 nt, Mycobacterium avium subsp. paratuberculosis
cggccagguuccacc

SEQ ID NO: 945921 - RNA, 18 nt, Mycobacterium avium subsp. paratuberculosis
cggccagguuccaccggg

SEQ ID NO: 945922 - RNA, 19 nt, Mycobacterium avium subsp. paratuberculosis
cggccagguuccaccgggc

SEQ ID NO: 945923 - RNA, 22 nt, Mycobacterium avium subsp. paratuberculosis
cggccagguuccaccgggcguc

SEQ ID NO: 945924 - RNA, 15 nt, Mycobacterium avium subsp. paratuberculosis
cggccagguugacca

SEQ ID NO: 945925 - RNA, 18 nt, Mycobacterium avium subsp. paratuberculosis
cggccagguugaccacca

SEQ ID NO: 945926 - RNA, 20 nt, Mycobacterium avium subsp. paratuberculosis
cggccagguugaccaccagc

SEQ ID NO: 945927 - RNA, 21 nt, Mycobacterium avium subsp. paratuberculosis
cggccagguugaccaccagcg

SEQ ID NO: 945928 - RNA, 19 nt, Mycobacterium avium subsp. paratuberculosis
cggccagguugucgucggg

SEQ ID NO: 945929 - RNA, 21 nt, Mycobacterium avium subsp. paratuberculosis
cggccauggucgcggccgugu

SEQ ID NO: 945930 - RNA, 14 nt, Mycobacterium avium subsp. paratuberculosis
cggccaucgccgcc

SEQ ID NO: 945931 - RNA, 20 nt, Mycobacterium avium subsp. paratuberculosis
cggccauggugccgccguug

SEQ ID NO: 945932 - RNA, 16 nt, Mycobacterium avium subsp. paratuberculosis
cggccauguccccgcc

SEQ ID NO: 945933 - RNA, 18 nt, Mycobacterium avium subsp. paratuberculosis
cggccauguccccgccgg

SEQ ID NO: 945934 - RNA, 15 nt, Mycobacterium avium subsp. paratuberculosis
cggccaucgccgcca

SEQ ID NO: 945935 - RNA, 20 nt, Mycobacterium avium subsp. paratuberculosis
cggccaucgccgccaucgcc

SEQ ID NO: 945936 - RNA, 15 nt, Mycobacterium avium subsp. paratuberculosis
cggccaucgccgcgg

SEQ ID NO: 945937 - RNA, 16 nt, Mycobacterium avium subsp. paratuberculosis
cggccaucgccugagc

SEQ ID NO: 945938 - RNA, 22 nt, Mycobacterium avium subsp. paratuberculosis
cggccauucaucgcgcaccagg

SEQ ID NO: 945939 - RNA, 18 nt, Mycobacterium avium subsp. paratuberculosis
cggcccagccggcggugc

SEQ ID NO: 945940 - RNA, 18 nt, Mycobacterium avium subsp. paratuberculosis
cggcccaacacgcccugc

SEQ ID NO: 945941 - RNA, 21 nt, Mycobacterium avium subsp. paratuberculosis
cggcccaacacgcccugcagg

SEQ ID NO: 945942 - RNA, 22 nt, Mycobacterium avium subsp. paratuberculosis
cggcccaacacgcccugcaggu

SEQ ID NO: 945943 - RNA, 18 nt, Mycobacterium avium subsp. paratuberculosis
cggcccaagacccgcguc

SEQ ID NO: 945944 - RNA, 19 nt, Mycobacterium avium subsp. paratuberculosis
cggccccccgggcaccagc

SEQ ID NO: 945945 - RNA, 20 nt, Mycobacterium avium subsp. paratuberculosis
cggccccccgggcaccagcg

SEQ ID NO: 945946 - RNA, 22 nt, Mycobacterium avium subsp. paratuberculosis
cggccccccgggcaccagcgcg

SEQ ID NO: 945947 - RNA, 16 nt, Mycobacterium avium subsp. paratuberculosis
cggcccaucaccagcg

SEQ ID NO: 945948 - RNA, 18 nt, Mycobacterium avium subsp. paratuberculosis
cggcccaucaccagcggc

SEQ ID NO: 945949 - RNA, 19 nt, Mycobacterium avium subsp. paratuberculosis
cggcccaucaccagcggcu

SEQ ID NO: 945950 - RNA, 20 nt, Mycobacterium avium subsp. paratuberculosis
cggcccaucaccagcggcug

SEQ ID NO: 945951 - RNA, 21 nt, Mycobacterium avium subsp. paratuberculosis
cggcccaucaccagcggcugc

SEQ ID NO: 945952 - RNA, 15 nt, Mycobacterium avium subsp. paratuberculosis
cggcccaucaccgga

SEQ ID NO: 945953 - RNA, 20 nt, Mycobacterium avium subsp. paratuberculosis
cggcccaucaccggaccggc

SEQ ID NO: 945954 - RNA, 22 nt, Mycobacterium avium subsp. paratuberculosis
cggcccaucaccggaccggcca

SEQ ID NO: 945955 - RNA, 15 nt, Mycobacterium avium subsp. paratuberculosis
cggcccaucacgucg

SEQ ID NO: 945956 - RNA, 18 nt, Mycobacterium avium subsp. paratuberculosis
cggcccccacgcagcggu

SEQ ID NO: 945957 - RNA, 16 nt, Mycobacterium avium subsp. paratuberculosis
cggccccgccagcaga

SEQ ID NO: 945958 - RNA, 13 nt, Mycobacterium avium subsp. paratuberculosis
cggccccgccagc

SEQ ID NO: 945959 - RNA, 17 nt, Mycobacterium avium subsp. paratuberculosis
cggccccgagccgacga

SEQ ID NO: 945960 - RNA, 19 nt, Mycobacterium avium subsp. paratuberculosis
cggcccccgggcccgaagc

SEQ ID NO: 945961 - RNA, 16 nt, Mycobacterium avium subsp. paratuberculosis
cggcccaguccagucg

SEQ ID NO: 945962 - RNA, 20 nt, Mycobacterium avium subsp. paratuberculosis
cggcccaguccagucgcgcc

SEQ ID NO: 945963 - RNA, 22 nt, Mycobacterium avium subsp. paratuberculosis
cggcccaguccagucgcgccga

SEQ ID NO: 945964 - RNA, 23 nt, Mycobacterium avium subsp. paratuberculosis
cggcccagcuccacgcguagccg

SEQ ID NO: 945965 - RNA, 16 nt, Mycobacterium avium subsp. paratuberculosis
cggcccaguucgcacc

SEQ ID NO: 945966 - RNA, 22 nt, Mycobacterium avium subsp. paratuberculosis
cggcccagguucuccggcccgc

SEQ ID NO: 945967 - RNA, 20 nt, Mycobacterium avium subsp. paratuberculosis
cggcccagguauucguugcc

SEQ ID NO: 945968 - RNA, 24 nt, Mycobacterium avium subsp. paratuberculosis
cggcccagguauucguugcccugc

SEQ ID NO: 945969 - RNA, 21 nt, Mycobacterium avium subsp. paratuberculosis
cggcccaggcaguagccgauc

SEQ ID NO: 945970 - RNA, 12 nt, Mycobacterium avium subsp. paratuberculosis
cggcccagcguc

SEQ ID NO: 945971 - RNA, 22 nt, Mycobacterium avium subsp. paratuberculosis
cggcccagcgucaacucgucgg

SEQ ID NO: 945972 - RNA, 13 nt, Mycobacterium avium subsp. paratuberculosis
cggcccagcgcgg

SEQ ID NO: 945973 - RNA, 17 nt, Mycobacterium avium subsp. paratuberculosis
cggccagcgcagcgacc

SEQ ID NO: 945974 - RNA, 22 nt, Mycobacterium avium subsp. paratuberculosis
cggccagcgcagguacgcggcg

SEQ ID NO: 945975 - RNA, 23 nt, Mycobacterium avium subsp. paratuberculosis
cggccagcgcagguacgcggcgu

SEQ ID NO: 945976 - RNA, 14 nt, Mycobacterium avium subsp. paratuberculosis
cggccagcgaggug

SEQ ID NO: 945977 - RNA, 21 nt, Mycobacterium avium subsp. paratuberculosis
cggccagcgaguccagccagc

SEQ ID NO: 945978 - RNA, 23 nt, Mycobacterium avium subsp. paratuberculosis
cggccagcgaguccagccagccg

SEQ ID NO: 945979 - RNA, 17 nt, Mycobacterium avium subsp. paratuberculosis
cggccagcgagucgaug

SEQ ID NO: 945980 - RNA, 11 nt, Mycobacterium avium subsp. paratuberculosis
cggccagcgca

SEQ ID NO: 945981 - RNA, 16 nt, Mycobacterium avium subsp. paratuberculosis
cggccagcgaggaccc

SEQ ID NO: 945982 - RNA, 18 nt, Mycobacterium avium subsp. paratuberculosis
cggccagcgccccgccgg

SEQ ID NO: 945983 - RNA, 15 nt, Mycobacterium avium subsp. paratuberculosis
cggccagcgcccgcg

SEQ ID NO: 945984 - RNA, 16 nt, Mycobacterium avium subsp. paratuberculosis
cggccagcgcccgcgc

SEQ ID NO: 945985 - RNA, 23 nt, Mycobacterium avium subsp. paratuberculosis
cggccagcgcccgcgcgaucggc

SEQ ID NO: 945986 - RNA, 17 nt, Mycobacterium avium subsp. paratuberculosis
cggccagcgcccgcggg

SEQ ID NO: 945987 - RNA, 18 nt, Mycobacterium avium subsp. paratuberculosis
cggccagcgcccgcgggu

SEQ ID NO: 945988 - RNA, 19 nt, Mycobacterium avium subsp. paratuberculosis
cggccagcgcccgcgggug

SEQ ID NO: 945989 - RNA, 14 nt, Mycobacterium avium subsp. paratuberculosis
cggccagcgccgcc

SEQ ID NO: 945990 - RNA, 17 nt, Mycobacterium avium subsp. paratuberculosis
cggccagcgccgcccgg

SEQ ID NO: 945991 - RNA, 19 nt, Mycobacterium avium subsp. paratuberculosis
cggccagcgccgcccgggc

SEQ ID NO: 945992 - RNA, 14 nt, Mycobacterium avium subsp. paratuberculosis
cggccagccgggcg

SEQ ID NO: 945993 - RNA, 15 nt, Mycobacterium avium subsp. paratuberculosis
cggccagccgggcgg

SEQ ID NO: 945994 - RNA, 17 nt, Mycobacterium avium subsp. paratuberculosis
cggccagccgggcggcc

SEQ ID NO: 945995 - RNA, 23 nt, Mycobacterium avium subsp. paratuberculosis
cggccagccgggcggccagggug

SEQ ID NO: 945996 - RNA, 16 nt, Mycobacterium avium subsp. paratuberculosis
cggccagccgggguag

SEQ ID NO: 945997 - RNA, 18 nt, Mycobacterium avium subsp. paratuberculosis
cggccagccggucgucgg

SEQ ID NO: 945998 - RNA, 13 nt, Mycobacterium avium subsp. paratuberculosis
cggccagccggcu

SEQ ID NO: 945999 - RNA, 14 nt, Mycobacterium avium subsp. paratuberculosis
cggccagcacgccg

SEQ ID NO: 946000 - RNA, 14 nt, Mycobacterium avium subsp. paratuberculosis
cggccagccggccg

SEQ ID NO: 946001 - RNA, 17 nt, Mycobacterium avium subsp. paratuberculosis
cggccagcacgccgucc

SEQ ID NO: 946002 - RNA, 17 nt, Mycobacterium avium subsp. paratuberculosis
cggccagcacggccagc

SEQ ID NO: 946003 - RNA, 20 nt, Mycobacterium avium subsp. paratuberculosis
cggccagcacggccagccag

SEQ ID NO: 946004 - RNA, 23 nt, Mycobacterium avium subsp. paratuberculosis
cggccagcacggccagccagccg

SEQ ID NO: 946005 - RNA, 15 nt, Mycobacterium avium subsp. paratuberculosis
cggccagcacggcgg

SEQ ID NO: 946006 - RNA, 17 nt, Mycobacterium avium subsp. paratuberculosis
cggccagcacggcggcg

SEQ ID NO: 946007 - RNA, 19 nt, Mycobacterium avium subsp. paratuberculosis
cggccagcacggcggcgug

SEQ ID NO: 946008 - RNA, 20 nt, Mycobacterium avium subsp. paratuberculosis
cggccagcacggcggcgugc

SEQ ID NO: 946009 - RNA, 13 nt, Mycobacterium avium subsp. paratuberculosis
cggccagcacgaa

SEQ ID NO: 946010 - RNA, 17 nt, Mycobacterium avium subsp. paratuberculosis
cggccagcacgaacacc

SEQ ID NO: 946011 - RNA, 15 nt, Mycobacterium avium subsp. paratuberculosis
cggccagcaccgcca

SEQ ID NO: 946012 - RNA, 20 nt, Mycobacterium avium subsp. paratuberculosis
cggccagcaccgccagcgcc

SEQ ID NO: 946013 - RNA, 22 nt, Mycobacterium avium subsp. paratuberculosis
cggccagcaccgccagcgccgg

SEQ ID NO: 946014 - RNA, 14 nt, Mycobacterium avium subsp. paratuberculosis
cggccagcacccgc

SEQ ID NO: 946015 - RNA, 17 nt, Mycobacterium avium subsp. paratuberculosis
cggccagcacccgcuga

SEQ ID NO: 946016 - RNA, 22 nt, Mycobacterium avium subsp. paratuberculosis
cggccagcacacccucgacccg

SEQ ID NO: 946017 - RNA, 12 nt, Mycobacterium avium subsp. paratuberculosis
cggccagcacca

SEQ ID NO: 946018 - RNA, 13 nt, Mycobacterium avium subsp. paratuberculosis
cggccagcaccac

SEQ ID NO: 946019 - RNA, 14 nt, Mycobacterium avium subsp. paratuberculosis
cggccagcaccacc

SEQ ID NO: 946020 - RNA, 21 nt, Mycobacterium avium subsp. paratuberculosis
cggccagcaccacggugaucu

SEQ ID NO: 946021 - RNA, 15 nt, Mycobacterium avium subsp. paratuberculosis
cggccagcaccagca

SEQ ID NO: 946022 - RNA, 17 nt, Mycobacterium avium subsp. paratuberculosis
cggccagcaccagcagc

SEQ ID NO: 946023 - RNA, 18 nt, Mycobacterium avium subsp. paratuberculosis
cggccagcaccagcagcc

SEQ ID NO: 946024 - RNA, 19 nt, Mycobacterium avium subsp. paratuberculosis
cggccagcaccagcagccg

SEQ ID NO: 946025 - RNA, 21 nt, Mycobacterium avium subsp. paratuberculosis
cggccagcaccagcagccggu

SEQ ID NO: 946026 - RNA, 16 nt, Mycobacterium avium subsp. paratuberculosis
cggccagcaccaggaa

SEQ ID NO: 946027 - RNA, 19 nt, Mycobacterium avium subsp. paratuberculosis
cggccagcaccaggaaggc

SEQ ID NO: 946028 - RNA, 14 nt, Mycobacterium avium subsp. paratuberculosis
cggccaccagcggc

SEQ ID NO: 946029 - RNA, 15 nt, Mycobacterium avium subsp. paratuberculosis
cggccaccagcggcc

SEQ ID NO: 946030 - RNA, 16 nt, Mycobacterium avium subsp. paratuberculosis
cggccaccagcggccg

SEQ ID NO: 946031 - RNA, 22 nt, Mycobacterium avium subsp. paratuberculosis
cggccaccagcggccggaacag

SEQ ID NO: 946032 - RNA, 16 nt, Mycobacterium avium subsp. paratuberculosis
cggccagaucgacgcc

SEQ ID NO: 946033 - RNA, 18 nt, Mycobacterium avium subsp. paratuberculosis
cggccagaucgacgccgc

SEQ ID NO: 946034 - RNA, 22 nt, Mycobacterium avium subsp. paratuberculosis
cggccagaucgacgccgcggug

SEQ ID NO: 946035 - RNA, 23 nt, Mycobacterium avium subsp. paratuberculosis
cggccagaucgacgccgcggugg

SEQ ID NO: 946036 - RNA, 16 nt, Mycobacterium avium subsp. paratuberculosis
cggccagaucggccag

SEQ ID NO: 946037 - RNA, 12 nt, Mycobacterium avium subsp. paratuberculosis
cggccaccagcg

SEQ ID NO: 946038 - RNA, 13 nt, Mycobacterium avium subsp. paratuberculosis
cggccaccagcgc

SEQ ID NO: 946039 - RNA, 14 nt, Mycobacterium avium subsp. paratuberculosis
cggccaccagcgcc

SEQ ID NO: 946040 - RNA, 21 nt, Mycobacterium avium subsp. paratuberculosis
cggccaccagcgcccgcccgg

SEQ ID NO: 946041 - RNA, 16 nt, Mycobacterium avium subsp. paratuberculosis
cggccaccagcgcggc

SEQ ID NO: 946042 - RNA, 18 nt, Mycobacterium avium subsp. paratuberculosis
cggccaccagcgcggcca

SEQ ID NO: 946043 - RNA, 13 nt, Mycobacterium avium subsp. paratuberculosis
cggccaccagccg

SEQ ID NO: 946044 - RNA, 16 nt, Mycobacterium avium subsp. paratuberculosis
cggccaccagccggcc

SEQ ID NO: 946045 - RNA, 18 nt, Mycobacterium avium subsp. paratuberculosis
cggccaccagccggccgg

SEQ ID NO: 946046 - RNA, 19 nt, Mycobacterium avium subsp. paratuberculosis
cggccaccagccggccggc

SEQ ID NO: 946047 - RNA, 12 nt, Mycobacterium avium subsp. paratuberculosis
cggccaccaccu

SEQ ID NO: 946048 - RNA, 16 nt, Mycobacterium avium subsp. paratuberculosis
cggccaccaccucgcg

SEQ ID NO: 946049 - RNA, 13 nt, Mycobacterium avium subsp. paratuberculosis
cggccaccacgac

SEQ ID NO: 946050 - RNA, 18 nt, Mycobacterium avium subsp. paratuberculosis
cggccaccacgacgccgg

SEQ ID NO: 946051 - RNA, 16 nt, Mycobacterium avium subsp. paratuberculosis
cggccaccacgacggg

SEQ ID NO: 946052 - RNA, 18 nt, Mycobacterium avium subsp. paratuberculosis
cggccaccacggcaccgc

SEQ ID NO: 946053 - RNA, 19 nt, Mycobacterium avium subsp. paratuberculosis
cggccaccacggcaccgcc

SEQ ID NO: 946054 - RNA, 22 nt, Mycobacterium avium subsp. paratuberculosis
cggccaccacggcaccgccgcg

SEQ ID NO: 946055 - RNA, 12 nt, Mycobacterium avium subsp. paratuberculosis
cggccaccacgu

SEQ ID NO: 946056 - RNA, 12 nt, Mycobacterium avium subsp. paratuberculosis
cggccaccacuu

SEQ ID NO: 946057 - RNA, 19 nt, Mycobacterium avium subsp. paratuberculosis
cggccaccagaugccgggc

SEQ ID NO: 946058 - RNA, 21 nt, Mycobacterium avium subsp. paratuberculosis
cggccaccagaugccgggcuc

SEQ ID NO: 946059 - RNA, 16 nt, Mycobacterium avium subsp. paratuberculosis
cggccaccagcagcga

SEQ ID NO: 946060 - RNA, 18 nt, Mycobacterium avium subsp. paratuberculosis
cggccaccagcagcgaga

SEQ ID NO: 946061 - RNA, 21 nt, Mycobacterium avium subsp. paratuberculosis
cggccaccagcagcgagaccg

SEQ ID NO: 946062 - RNA, 23 nt, Mycobacterium avium subsp. paratuberculosis
cggccaccagcagcgagaccggc

SEQ ID NO: 946063 - RNA, 19 nt, Mycobacterium avium subsp. paratuberculosis
cggccaggaucucgcgggc

SEQ ID NO: 946064 - RNA, 20 nt, Mycobacterium avium subsp. paratuberculosis
cggccaggaucuugucggcg

SEQ ID NO: 946065 - RNA, 23 nt, Mycobacterium avium subsp. paratuberculosis
cggccaggaucuugucggcggcc

SEQ ID NO: 946066 - RNA, 18 nt, Mycobacterium avium subsp. paratuberculosis
cggccagcuuuccggccg

SEQ ID NO: 946067 - RNA, 19 nt, Mycobacterium avium subsp. paratuberculosis
cggccagcuuuccggccgc

SEQ ID NO: 946068 - RNA, 17 nt, Mycobacterium avium subsp. paratuberculosis
cggccaggaaccaccgg

SEQ ID NO: 946069 - RNA, 13 nt, Mycobacterium avium subsp. paratuberculosis
cggccaggaagcc

SEQ ID NO: 946070 - RNA, 18 nt, Mycobacterium avium subsp. paratuberculosis
cggccaggaagccggcga

SEQ ID NO: 946071 - RNA, 24 nt, Mycobacterium avium subsp. paratuberculosis
cggccaggaagccggcgacgaccg

SEQ ID NO: 946072 - RNA, 16 nt, Mycobacterium avium subsp. paratuberculosis
cggccagcucggucgc

SEQ ID NO: 946073 - RNA, 21 nt, Mycobacterium avium subsp. paratuberculosis
cggccagcucggucgcggucg

SEQ ID NO: 946074 - RNA, 19 nt, Mycobacterium avium subsp. paratuberculosis
cggccagcugauagccgcc

SEQ ID NO: 946075 - RNA, 15 nt, Mycobacterium avium subsp. paratuberculosis
cggccagcugcgggu

SEQ ID NO: 946076 - RNA, 15 nt, Mycobacterium avium subsp. paratuberculosis
cggccagcugcccgc

SEQ ID NO: 946077 - RNA, 18 nt, Mycobacterium avium subsp. paratuberculosis
cggccagcugcccgccga

SEQ ID NO: 946078 - RNA, 21 nt, Mycobacterium avium subsp. paratuberculosis
cggccagcugcccgccgacgc

SEQ ID NO: 946079 - RNA, 22 nt, Mycobacterium avium subsp. paratuberculosis
cggccagcugcccgccgacgcc

SEQ ID NO: 946080 - RNA, 18 nt, Mycobacterium avium subsp. paratuberculosis
cggccagcugcgacagca

SEQ ID NO: 946081 - RNA, 21 nt, Mycobacterium avium subsp. paratuberculosis
cggccagcuccgggucgaccg

SEQ ID NO: 946082 - RNA, 22 nt, Mycobacterium avium subsp. paratuberculosis
cggccagcuccgggucgaccgc

SEQ ID NO: 946083 - RNA, 23 nt, Mycobacterium avium subsp. paratuberculosis
cggccagcuccgggucgaccgcc

SEQ ID NO: 946084 - RNA, 18 nt, Mycobacterium avium subsp. paratuberculosis
cggccagcucgagcauca

SEQ ID NO: 946085 - RNA, 20 nt, Mycobacterium avium subsp. paratuberculosis
cggccagcucgagcaucacg

SEQ ID NO: 946086 - RNA, 15 nt, Mycobacterium avium subsp. paratuberculosis
cggccagcucgccgc

SEQ ID NO: 946087 - RNA, 16 nt, Mycobacterium avium subsp. paratuberculosis
cggccagcucgccgcc

SEQ ID NO: 946088 - RNA, 16 nt, Mycobacterium avium subsp. paratuberculosis
cggccagcucggcccg

SEQ ID NO: 946089 - RNA, 19 nt, Mycobacterium avium subsp. paratuberculosis
cggccagcucggcccgcug

SEQ ID NO: 946090 - RNA, 22 nt, Mycobacterium avium subsp. paratuberculosis
cggccagcguggcgcgccccgg

SEQ ID NO: 946091 - RNA, 16 nt, Mycobacterium avium subsp. paratuberculosis
cggccagcgucgcgcc

SEQ ID NO: 946092 - RNA, 18 nt, Mycobacterium avium subsp. paratuberculosis
cggccagcgucuccggcg

SEQ ID NO: 946093 - RNA, 21 nt, Mycobacterium avium subsp. paratuberculosis
cggccagcgucuccggcgggc

SEQ ID NO: 946094 - RNA, 12 nt, Mycobacterium avium subsp. paratuberculosis
cggccagcguga

SEQ ID NO: 946095 - RNA, 20 nt, Mycobacterium avium subsp. paratuberculosis
cggccagcgugaacaccgcg

SEQ ID NO: 946096 - RNA, 23 nt, Mycobacterium avium subsp. paratuberculosis
cggccagcgugaacaccgcguug

SEQ ID NO: 946097 - RNA, 17 nt, Mycobacterium avium subsp. paratuberculosis
cggccagcucaccggcc

SEQ ID NO: 946098 - RNA, 23 nt, Mycobacterium avium subsp. paratuberculosis
cggccagcucaccggccagggcc

SEQ ID NO: 946099 - RNA, 14 nt, Mycobacterium avium subsp. paratuberculosis
cggccagcucccgg

SEQ ID NO: 946100 - RNA, 16 nt, Mycobacterium avium subsp. paratuberculosis
cggccagcucccgggc

SEQ ID NO: 946101 - RNA, 18 nt, Mycobacterium avium subsp. paratuberculosis
cggccagcucccgggcgg

SEQ ID NO: 946102 - RNA, 19 nt, Mycobacterium avium subsp. paratuberculosis
cggccagcucccgggcggc

SEQ ID NO: 946103 - RNA, 23 nt, Mycobacterium avium subsp. paratuberculosis
cggccagcucccgggcggcgccg

SEQ ID NO: 946104 - RNA, 17 nt, Mycobacterium avium subsp. paratuberculosis
cggccagcuccgccacc

SEQ ID NO: 946105 - RNA, 14 nt, Mycobacterium avium subsp. paratuberculosis
cggccagcgcggcg

SEQ ID NO: 946106 - RNA, 17 nt, Mycobacterium avium subsp. paratuberculosis
cggccagcgcggcggcc

SEQ ID NO: 946107 - RNA, 15 nt, Mycobacterium avium subsp. paratuberculosis
cggccagcgcggccg

SEQ ID NO: 946108 - RNA, 19 nt, Mycobacterium avium subsp. paratuberculosis
cggccagcgcgcgggcguc

SEQ ID NO: 946109 - RNA, 14 nt, Mycobacterium avium subsp. paratuberculosis
cggccagcgcgcgg

SEQ ID NO: 946110 - RNA, 16 nt, Mycobacterium avium subsp. paratuberculosis
cggccagcgcgcgcag

SEQ ID NO: 946111 - RNA, 17 nt, Mycobacterium avium subsp. paratuberculosis
cggccagcgcgccgccg

SEQ ID NO: 946112 - RNA, 13 nt, Mycobacterium avium subsp. paratuberculosis
cggccagcgccgc

SEQ ID NO: 946113 - RNA, 16 nt, Mycobacterium avium subsp. paratuberculosis
cggccagcgcgccgca

SEQ ID NO: 946114 - RNA, 17 nt, Mycobacterium avium subsp. paratuberculosis
cggccagcgcgccgcac

SEQ ID NO: 946115 - RNA, 16 nt, Mycobacterium avium subsp. paratuberculosis
cggccagcgcgccgcc

SEQ ID NO: 946116 - RNA, 12 nt, Mycobacterium avium subsp. paratuberculosis
cggccagcgcgc

SEQ ID NO: 946117 - RNA, 12 nt, Mycobacterium avium subsp. paratuberculosis
cggccagcgcga

SEQ ID NO: 946118 - RNA, 13 nt, Mycobacterium avium subsp. paratuberculosis
cggccagcgcgaa

SEQ ID NO: 946119 - RNA, 15 nt, Mycobacterium avium subsp. paratuberculosis
cggccagcgccgcgc

SEQ ID NO: 946120 - RNA, 16 nt, Mycobacterium avium subsp. paratuberculosis
cggccagcgccgcgcg

SEQ ID NO: 946121 - RNA, 18 nt, Mycobacterium avium subsp. paratuberculosis
cggccagcgccgcgcgcg

SEQ ID NO: 946122 - RNA, 21 nt, Mycobacterium avium subsp. paratuberculosis
cggccagcgccgcgcgcgcgg

SEQ ID NO: 946123 - RNA, 13 nt, Mycobacterium avium subsp. paratuberculosis
cggccagcgccgu

SEQ ID NO: 946124 - RNA, 14 nt, Mycobacterium avium subsp. paratuberculosis
cggccagcgccguc

SEQ ID NO: 946125 - RNA, 15 nt, Mycobacterium avium subsp. paratuberculosis
cggccagcgccguca

SEQ ID NO: 946126 - RNA, 17 nt, Mycobacterium avium subsp. paratuberculosis
cggccagcgccgucauc

SEQ ID NO: 946127 - RNA, 17 nt, Mycobacterium avium subsp. paratuberculosis
cggccgcugcgcccagc

SEQ ID NO: 946128 - RNA, 20 nt, Mycobacterium avium subsp. paratuberculosis
cggccgcugcgcccagcgcg

SEQ ID NO: 946129 - RNA, 16 nt, Mycobacterium avium subsp. paratuberculosis
cggccgcucagcgggc

SEQ ID NO: 946130 - RNA, 22 nt, Mycobacterium avium subsp. paratuberculosis
cggccgcucagcgggcggccag

SEQ ID NO: 946131 - RNA, 23 nt, Mycobacterium avium subsp. paratuberculosis
cggccgcucagcgggcggccagc

SEQ ID NO: 946132 - RNA, 20 nt, Mycobacterium avium subsp. paratuberculosis
cggccgcucgggugucgccg

SEQ ID NO: 946133 - RNA, 23 nt, Mycobacterium avium subsp. paratuberculosis
cggccgcucgggugucgccgagc

SEQ ID NO: 946134 - RNA, 18 nt, Mycobacterium avium subsp. paratuberculosis
cggccgcguugucgacca

SEQ ID NO: 946135 - RNA, 19 nt, Mycobacterium avium subsp. paratuberculosis
cggccgcguugucgaccac

SEQ ID NO: 946136 - RNA, 22 nt, Mycobacterium avium subsp. paratuberculosis
cggccgcguugucgaccaccag

SEQ ID NO: 946137 - RNA, 17 nt, Mycobacterium avium subsp. paratuberculosis
cggccgcuacccggcga

SEQ ID NO: 946138 - RNA, 13 nt, Mycobacterium avium subsp. paratuberculosis
cggccgcggccgg

SEQ ID NO: 946139 - RNA, 14 nt, Mycobacterium avium subsp. paratuberculosis
cggccgcgucggcg

SEQ ID NO: 946140 - RNA, 19 nt, Mycobacterium avium subsp. paratuberculosis
cggccgcgucggcggcggc

SEQ ID NO: 946141 - RNA, 19 nt, Mycobacterium avium subsp. paratuberculosis
cggccgcgucggcggucgc

SEQ ID NO: 946142 - RNA, 13 nt, Mycobacterium avium subsp. paratuberculosis
cggccgcgucggg

SEQ ID NO: 946143 - RNA, 15 nt, Mycobacterium avium subsp. paratuberculosis
cggccgcgucgggca

SEQ ID NO: 946144 - RNA, 16 nt, Mycobacterium avium subsp. paratuberculosis
cggccgcgugcaccug

SEQ ID NO: 946145 - RNA, 16 nt, Mycobacterium avium subsp. paratuberculosis
cggccgcggccggcgg

SEQ ID NO: 946146 - RNA, 17 nt, Mycobacterium avium subsp. paratuberculosis
cggccgcggccggcggc

SEQ ID NO: 946147 - RNA, 18 nt, Mycobacterium avium subsp. paratuberculosis
cggccgcgucgccgacca

SEQ ID NO: 946148 - RNA, 20 nt, Mycobacterium avium subsp. paratuberculosis
cggccgcgucgccgaccagc

SEQ ID NO: 946149 - RNA, 22 nt, Mycobacterium avium subsp. paratuberculosis
cggccgcgucgccgaccagcag

SEQ ID NO: 946150 - RNA, 23 nt, Mycobacterium avium subsp. paratuberculosis
cggccgcgucgccgaccagcagg

SEQ ID NO: 946151 - RNA, 17 nt, Mycobacterium avium subsp. paratuberculosis
cggccgcgucgccgauc

SEQ ID NO: 946152 - RNA, 18 nt, Mycobacterium avium subsp. paratuberculosis
cggccgcgucgccgaucg

SEQ ID NO: 946153 - RNA, 12 nt, Mycobacterium avium subsp. paratuberculosis
cggccgcggaug

SEQ ID NO: 946154 - RNA, 22 nt, Mycobacterium avium subsp. paratuberculosis
cggccgcggauggugacggccg

SEQ ID NO: 946155 - RNA, 20 nt, Mycobacterium avium subsp. paratuberculosis
cggccgcggauuccggcauc

SEQ ID NO: 946156 - RNA, 22 nt, Mycobacterium avium subsp. paratuberculosis
cggccgcggauuccggcaucgg

SEQ ID NO: 946157 - RNA, 13 nt, Mycobacterium avium subsp. paratuberculosis
cggccgcggccag

SEQ ID NO: 946158 - RNA, 14 nt, Mycobacterium avium subsp. paratuberculosis
cggccgcggccagc

SEQ ID NO: 946159 - RNA, 15 nt, Mycobacterium avium subsp. paratuberculosis
cggccgcggccagcg

SEQ ID NO: 946160 - RNA, 19 nt, Mycobacterium avium subsp. paratuberculosis
cggccgcggccagcgaggu

SEQ ID NO: 946161 - RNA, 15 nt, Mycobacterium avium subsp. paratuberculosis
cggccgcggcccggc

SEQ ID NO: 946162 - RNA, 19 nt, Mycobacterium avium subsp. paratuberculosis
cggccgcggcccggccacc

SEQ ID NO: 946163 - RNA, 18 nt, Mycobacterium avium subsp. paratuberculosis
cggccgcggacccgacgg

SEQ ID NO: 946164 - RNA, 19 nt, Mycobacterium avium subsp. paratuberculosis
cggccgcgcgugcccgcgg

SEQ ID NO: 946165 - RNA, 22 nt, Mycobacterium avium subsp. paratuberculosis
cggccgcgcgugcccgcgguca

SEQ ID NO: 946166 - RNA, 15 nt, Mycobacterium avium subsp. paratuberculosis
cggccgcgcgcggcg

SEQ ID NO: 946167 - RNA, 16 nt, Mycobacterium avium subsp. paratuberculosis
cggccgcgcgcggcgc

SEQ ID NO: 946168 - RNA, 16 nt, Mycobacterium avium subsp. paratuberculosis
cggccgcgccggccgg

SEQ ID NO: 946169 - RNA, 20 nt, Mycobacterium avium subsp. paratuberculosis
cggccgcgccggccggacag

SEQ ID NO: 946170 - RNA, 17 nt, Mycobacterium avium subsp. paratuberculosis
cggccgcgccgaacacc

SEQ ID NO: 946171 - RNA, 13 nt, Mycobacterium avium subsp. paratuberculosis
cggccgcgccggc

SEQ ID NO: 946172 - RNA, 14 nt, Mycobacterium avium subsp. paratuberculosis
cggccgcgccggcc

SEQ ID NO: 946173 - RNA, 22 nt, Mycobacterium avium subsp. paratuberculosis
cggccgcgccguugaccgcggc

SEQ ID NO: 946174 - RNA, 13 nt, Mycobacterium avium subsp. paratuberculosis
cggccgcgcgccc

SEQ ID NO: 946175 - RNA, 14 nt, Mycobacterium avium subsp. paratuberculosis
cggccgcgcgcccg

SEQ ID NO: 946176 - RNA, 17 nt, Mycobacterium avium subsp. paratuberculosis
cggccgcgcgcccgucg

SEQ ID NO: 946177 - RNA, 20 nt, Mycobacterium avium subsp. paratuberculosis
cggccgcgcgcccgucgucg

SEQ ID NO: 946178 - RNA, 21 nt, Mycobacterium avium subsp. paratuberculosis
cggccgcgcgcccgucgucgg

SEQ ID NO: 946179 - RNA, 12 nt, Mycobacterium avium subsp. paratuberculosis
cggccgcgccca

SEQ ID NO: 946180 - RNA, 21 nt, Mycobacterium avium subsp. paratuberculosis
cggccgcgcccaucgcggccg

SEQ ID NO: 946181 - RNA, 22 nt, Mycobacterium avium subsp. paratuberculosis
cggccgcgcagaucgccagcac

SEQ ID NO: 946182 - RNA, 18 nt, Mycobacterium avium subsp. paratuberculosis
cggccgcgaugucggugg

SEQ ID NO: 946183 - RNA, 14 nt, Mycobacterium avium subsp. paratuberculosis
cggccgcgcaccgc

SEQ ID NO: 946184 - RNA, 20 nt, Mycobacterium avium subsp. paratuberculosis
cggccgcgaucgccaacgcg

SEQ ID NO: 946185 - RNA, 15 nt, Mycobacterium avium subsp. paratuberculosis
cggccgcgacgaccg

SEQ ID NO: 946186 - RNA, 16 nt, Mycobacterium avium subsp. paratuberculosis
cggccgcgacgaccgc

SEQ ID NO: 946187 - RNA, 18 nt, Mycobacterium avium subsp. paratuberculosis
cggccgcgacgaccgccu

SEQ ID NO: 946188 - RNA, 20 nt, Mycobacterium avium subsp. paratuberculosis
cggccgcgacgaccgccugc

SEQ ID NO: 946189 - RNA, 13 nt, Mycobacterium avium subsp. paratuberculosis
cggccgcgacgcg

SEQ ID NO: 946190 - RNA, 14 nt, Mycobacterium avium subsp. paratuberculosis
cggccgcgacgcgc

SEQ ID NO: 946191 - RNA, 16 nt, Mycobacterium avium subsp. paratuberculosis
cggccgcgacgcgcgg

SEQ ID NO: 946192 - RNA, 19 nt, Mycobacterium avium subsp. paratuberculosis
cggccgcgacgcgcggucg

SEQ ID NO: 946193 - RNA, 19 nt, Mycobacterium avium subsp. paratuberculosis
cggccgcgacugcacccga

SEQ ID NO: 946194 - RNA, 21 nt, Mycobacterium avium subsp. paratuberculosis
cggccgcgacugcaggugacg

SEQ ID NO: 946195 - RNA, 15 nt, Mycobacterium avium subsp. paratuberculosis
cggccgcgagcccgg

SEQ ID NO: 946196 - RNA, 20 nt, Mycobacterium avium subsp. paratuberculosis
cggccgcgagcccggcgacg

SEQ ID NO: 946197 - RNA, 17 nt, Mycobacterium avium subsp. paratuberculosis
cggccgcgaaggcggcg

SEQ ID NO: 946198 - RNA, 21 nt, Mycobacterium avium subsp. paratuberculosis
cggccgcgaaggcggcgucga

SEQ ID NO: 946199 - RNA, 21 nt, Mycobacterium avium subsp. paratuberculosis
cggccgcgaauucggcgauga

SEQ ID NO: 946200 - RNA, 16 nt, Mycobacterium avium subsp. paratuberculosis
cggccgcgacagccgg

SEQ ID NO: 946201 - RNA, 14 nt, Mycobacterium avium subsp. paratuberculosis
cggccgcccagucg

SEQ ID NO: 946202 - RNA, 20 nt, Mycobacterium avium subsp. paratuberculosis
cggccgcccagucgccgccg

SEQ ID NO: 946203 - RNA, 16 nt, Mycobacterium avium subsp. paratuberculosis
cggccgcccgcaccag

SEQ ID NO: 946204 - RNA, 17 nt, Mycobacterium avium subsp. paratuberculosis
cggccgcccgcaccagc

SEQ ID NO: 946205 - RNA, 22 nt, Mycobacterium avium subsp. paratuberculosis
cggccgccuucacgaccggcag

SEQ ID NO: 946206 - RNA, 16 nt, Mycobacterium avium subsp. paratuberculosis
cggccgccaucgaucg

SEQ ID NO: 946207 - RNA, 17 nt, Mycobacterium avium subsp. paratuberculosis
cggccgccaucgaucgg

SEQ ID NO: 946208 - RNA, 14 nt, Mycobacterium avium subsp. paratuberculosis
cggccgcccagccc

SEQ ID NO: 946209 - RNA, 15 nt, Mycobacterium avium subsp. paratuberculosis
cggccgcccagcccg

SEQ ID NO: 946210 - RNA, 18 nt, Mycobacterium avium subsp. paratuberculosis
cggccgcccagcccgcgc

SEQ ID NO: 946211 - RNA, 23 nt, Mycobacterium avium subsp. paratuberculosis
cggccgcccagcccgcgccgagc

SEQ ID NO: 946212 - RNA, 20 nt, Mycobacterium avium subsp. paratuberculosis
cggccgccaggucggggccc

SEQ ID NO: 946213 - RNA, 14 nt, Mycobacterium avium subsp. paratuberculosis
cggccgccagcgcc

SEQ ID NO: 946214 - RNA, 16 nt, Mycobacterium avium subsp. paratuberculosis
cggccgccagcgcccg

SEQ ID NO: 946215 - RNA, 14 nt, Mycobacterium avium subsp. paratuberculosis
cggccgccagcguc

SEQ ID NO: 946216 - RNA, 17 nt, Mycobacterium avium subsp. paratuberculosis
cggccgccagcgcaccg

SEQ ID NO: 946217 - RNA, 19 nt, Mycobacterium avium subsp. paratuberculosis
cggccgccagcgcaccgag

SEQ ID NO: 946218 - RNA, 14 nt, Mycobacterium avium subsp. paratuberculosis
cggccgccagcagc

SEQ ID NO: 946219 - RNA, 17 nt, Mycobacterium avium subsp. paratuberculosis
cggccgaagaccgccga

SEQ ID NO: 946220 - RNA, 14 nt, Mycobacterium avium subsp. paratuberculosis
cggccgccagcagu

SEQ ID NO: 946221 - RNA, 15 nt, Mycobacterium avium subsp. paratuberculosis
cggccgcacgcgaac

SEQ ID NO: 946222 - RNA, 14 nt, Mycobacterium avium subsp. paratuberculosis
cggccgccaccgcc

SEQ ID NO: 946223 - RNA, 20 nt, Mycobacterium avium subsp. paratuberculosis
cggccgccaccgccaucucg

SEQ ID NO: 946224 - RNA, 14 nt, Mycobacterium avium subsp. paratuberculosis
cggccgccacgcug

SEQ ID NO: 946225 - RNA, 15 nt, Mycobacterium avium subsp. paratuberculosis
cggccgccacgcugg

SEQ ID NO: 946226 - RNA, 13 nt, Mycobacterium avium subsp. paratuberculosis
cggccgccagcag

SEQ ID NO: 946227 - RNA, 13 nt, Mycobacterium avium subsp. paratuberculosis
cggccgcacccca

SEQ ID NO: 946228 - RNA, 15 nt, Mycobacterium avium subsp. paratuberculosis
cggccgcaaucggcg

SEQ ID NO: 946229 - RNA, 17 nt, Mycobacterium avium subsp. paratuberculosis
cggccgcaaucggcgcc

SEQ ID NO: 946230 - RNA, 19 nt, Mycobacterium avium subsp. paratuberculosis
cggccgcaaucggcgccgg

SEQ ID NO: 946231 - RNA, 22 nt, Mycobacterium avium subsp. paratuberculosis
cggccgcaaucggcgccggcuc

SEQ ID NO: 946232 - RNA, 14 nt, Mycobacterium avium subsp. paratuberculosis
cggccgcacaccac

SEQ ID NO: 946233 - RNA, 15 nt, Mycobacterium avium subsp. paratuberculosis
cggccgcacaccacc

SEQ ID NO: 946234 - RNA, 16 nt, Mycobacterium avium subsp. paratuberculosis
cggccgauggugugga

SEQ ID NO: 946235 - RNA, 19 nt, Mycobacterium avium subsp. paratuberculosis
cggccgaugguguggaucg

SEQ ID NO: 946236 - RNA, 16 nt, Mycobacterium avium subsp. paratuberculosis
cggccgauucggcgcc

SEQ ID NO: 946237 - RNA, 17 nt, Mycobacterium avium subsp. paratuberculosis
cggccgauucggcgccg

SEQ ID NO: 946238 - RNA, 19 nt, Mycobacterium avium subsp. paratuberculosis
cggccgauucggcgccgcg

SEQ ID NO: 946239 - RNA, 15 nt, Mycobacterium avium subsp. paratuberculosis
cggccgcaacggcgg

SEQ ID NO: 946240 - RNA, 16 nt, Mycobacterium avium subsp. paratuberculosis
cggccgcaacggcggu

SEQ ID NO: 946241 - RNA, 16 nt, Mycobacterium avium subsp. paratuberculosis
cggccgcaagcgaagc

SEQ ID NO: 946242 - RNA, 18 nt, Mycobacterium avium subsp. paratuberculosis
cggccgcaagcgaagccg

SEQ ID NO: 946243 - RNA, 19 nt, Mycobacterium avium subsp. paratuberculosis
cggccgcaagcgaagccgu

SEQ ID NO: 946244 - RNA, 22 nt, Mycobacterium avium subsp. paratuberculosis
cggccgcaagcgaagccgugac

SEQ ID NO: 946245 - RNA, 23 nt, Mycobacterium avium subsp. paratuberculosis
cggccgcaagcgaagccgugacc

SEQ ID NO: 946246 - RNA, 21 nt, Mycobacterium avium subsp. paratuberculosis
cggccgaugaccucgcacagc

SEQ ID NO: 946247 - RNA, 22 nt, Mycobacterium avium subsp. paratuberculosis
cggccgaugagccucagcgcgc

SEQ ID NO: 946248 - RNA, 15 nt, Mycobacterium avium subsp. paratuberculosis
cggccgauggcccag

SEQ ID NO: 946249 - RNA, 13 nt, Mycobacterium avium subsp. paratuberculosis
cggccgauggugu

SEQ ID NO: 946250 - RNA, 23 nt, Mycobacterium avium subsp. paratuberculosis
cggccgaagcguuccgccguccu

SEQ ID NO: 946251 - RNA, 16 nt, Mycobacterium avium subsp. paratuberculosis
cggccgaauccggccg

SEQ ID NO: 946252 - RNA, 17 nt, Mycobacterium avium subsp. paratuberculosis
cggccgaauccggccgg

SEQ ID NO: 946253 - RNA, 22 nt, Mycobacterium avium subsp. paratuberculosis
cggccgaauccggccggagacc

SEQ ID NO: 946254 - RNA, 23 nt, Mycobacterium avium subsp. paratuberculosis
cggccgaauccggccggagaccg

SEQ ID NO: 946255 - RNA, 17 nt, Mycobacterium avium subsp. paratuberculosis
cggccgacaacgacagc

SEQ ID NO: 946256 - RNA, 20 nt, Mycobacterium avium subsp. paratuberculosis
cggccgacaacgacagcacc

SEQ ID NO: 946257 - RNA, 14 nt, Mycobacterium avium subsp. paratuberculosis
cggccgacaccccg

SEQ ID NO: 946258 - RNA, 17 nt, Mycobacterium avium subsp. paratuberculosis
cggccgaaacgcccggc

SEQ ID NO: 946259 - RNA, 19 nt, Mycobacterium avium subsp. paratuberculosis
cggccgaaacgcccggcuc

SEQ ID NO: 946260 - RNA, 21 nt, Mycobacterium avium subsp. paratuberculosis
cggccgaaaucaacgcgccga

SEQ ID NO: 946261 - RNA, 16 nt, Mycobacterium avium subsp. paratuberculosis
cggccgaacacggccg

SEQ ID NO: 946262 - RNA, 17 nt, Mycobacterium avium subsp. paratuberculosis
cggccgaacacggccgc

SEQ ID NO: 946263 - RNA, 22 nt, Mycobacterium avium subsp. paratuberculosis
cggccgaacacggccgccucca

SEQ ID NO: 946264 - RNA, 14 nt, Mycobacterium avium subsp. paratuberculosis
cggccgaacucucc

SEQ ID NO: 946265 - RNA, 18 nt, Mycobacterium avium subsp. paratuberculosis
cggcccguugagcaccgc

SEQ ID NO: 946266 - RNA, 19 nt, Mycobacterium avium subsp. paratuberculosis
cggcccguugagcaccgcg

SEQ ID NO: 946267 - RNA, 17 nt, Mycobacterium avium subsp. paratuberculosis
cggcccggacggagccg

SEQ ID NO: 946268 - RNA, 16 nt, Mycobacterium avium subsp. paratuberculosis
cggcccgguacaucga

SEQ ID NO: 946269 - RNA, 19 nt, Mycobacterium avium subsp. paratuberculosis
cggcccggguggacgcccg

SEQ ID NO: 946270 - RNA, 16 nt, Mycobacterium avium subsp. paratuberculosis
cggcccggucgacuug

SEQ ID NO: 946271 - RNA, 12 nt, Mycobacterium avium subsp. paratuberculosis
cggcccgucgag

SEQ ID NO: 946272 - RNA, 14 nt, Mycobacterium avium subsp. paratuberculosis
cggcccgucgagcg

SEQ ID NO: 946273 - RNA, 16 nt, Mycobacterium avium subsp. paratuberculosis
cggcccgucgagcggc

SEQ ID NO: 946274 - RNA, 17 nt, Mycobacterium avium subsp. paratuberculosis
cggcccgucgagcggcu

SEQ ID NO: 946275 - RNA, 18 nt, Mycobacterium avium subsp. paratuberculosis
cggcccgucgagcggcuu

SEQ ID NO: 946276 - RNA, 16 nt, Mycobacterium avium subsp. paratuberculosis
cggcccgucgccacca

SEQ ID NO: 946277 - RNA, 21 nt, Mycobacterium avium subsp. paratuberculosis
cggcccgucgccaccacggcg

SEQ ID NO: 946278 - RNA, 16 nt, Mycobacterium avium subsp. paratuberculosis
cggcccgucgccgauc

SEQ ID NO: 946279 - RNA, 16 nt, Mycobacterium avium subsp. paratuberculosis
cggcccgucgccgugc

SEQ ID NO: 946280 - RNA, 14 nt, Mycobacterium avium subsp. paratuberculosis
cggcccgcucggcg

SEQ ID NO: 946281 - RNA, 15 nt, Mycobacterium avium subsp. paratuberculosis
cggcccgcucggcgg

SEQ ID NO: 946282 - RNA, 16 nt, Mycobacterium avium subsp. paratuberculosis
cggcccgcucgggcca

SEQ ID NO: 946283 - RNA, 23 nt, Mycobacterium avium subsp. paratuberculosis
cggcccgcugugguccucgucac

SEQ ID NO: 946284 - RNA, 21 nt, Mycobacterium avium subsp. paratuberculosis
cggcccgcuucaggcagcgca

SEQ ID NO: 946285 - RNA, 19 nt, Mycobacterium avium subsp. paratuberculosis
cggcccgcuugccgacgug

SEQ ID NO: 946286 - RNA, 20 nt, Mycobacterium avium subsp. paratuberculosis
cggcccgcuugccgacguga

SEQ ID NO: 946287 - RNA, 21 nt, Mycobacterium avium subsp. paratuberculosis
cggcccgcuugccgacgugau

SEQ ID NO: 946288 - RNA, 21 nt, Mycobacterium avium subsp. paratuberculosis
cggcccggaacgcgucgccca

SEQ ID NO: 946289 - RNA, 23 nt, Mycobacterium avium subsp. paratuberculosis
cggcccggaacgcgucgcccacg

SEQ ID NO: 946290 - RNA, 15 nt, Mycobacterium avium subsp. paratuberculosis
cggcccgcugcgcgg

SEQ ID NO: 946291 - RNA, 19 nt, Mycobacterium avium subsp. paratuberculosis
cggcccgcugcgcggccga

SEQ ID NO: 946292 - RNA, 16 nt, Mycobacterium avium subsp. paratuberculosis
cggcccgcugcggcug

SEQ ID NO: 946293 - RNA, 13 nt, Mycobacterium avium subsp. paratuberculosis
cggcccgcuggcc

SEQ ID NO: 946294 - RNA, 17 nt, Mycobacterium avium subsp. paratuberculosis
cggcccgcuggccgccg

SEQ ID NO: 946295 - RNA, 12 nt, Mycobacterium avium subsp. paratuberculosis
cggcccgcugug

SEQ ID NO: 946296 - RNA, 12 nt, Mycobacterium avium subsp. paratuberculosis
cggcccgcgggg

SEQ ID NO: 946297 - RNA, 12 nt, Mycobacterium avium subsp. paratuberculosis
cggcccgcggca

SEQ ID NO: 946298 - RNA, 22 nt, Mycobacterium avium subsp. paratuberculosis
cggcccgcggcacgcugcgcca

SEQ ID NO: 946299 - RNA, 14 nt, Mycobacterium avium subsp. paratuberculosis
cggcccgcggcauc

SEQ ID NO: 946300 - RNA, 13 nt, Mycobacterium avium subsp. paratuberculosis
cggcccgcgccgg

SEQ ID NO: 946301 - RNA, 15 nt, Mycobacterium avium subsp. paratuberculosis
cggcccgcgccggcg

SEQ ID NO: 946302 - RNA, 16 nt, Mycobacterium avium subsp. paratuberculosis
cggcccgcgccggcgu

SEQ ID NO: 946303 - RNA, 14 nt, Mycobacterium avium subsp. paratuberculosis
cggcccgcgcgggg

SEQ ID NO: 946304 - RNA, 17 nt, Mycobacterium avium subsp. paratuberculosis
cggcccgccucggcggc

SEQ ID NO: 946305 - RNA, 17 nt, Mycobacterium avium subsp. paratuberculosis
cggcccgcgccccggcg

SEQ ID NO: 946306 - RNA, 21 nt, Mycobacterium avium subsp. paratuberculosis
cggcccgcgccccggcggcca

SEQ ID NO: 946307 - RNA, 15 nt, Mycobacterium avium subsp. paratuberculosis
cggcccgccucggcg

SEQ ID NO: 946308 - RNA, 16 nt, Mycobacterium avium subsp. paratuberculosis
cggcccgccgaacgcc

SEQ ID NO: 946309 - RNA, 18 nt, Mycobacterium avium subsp. paratuberculosis
cggcccgccucggcggcc

SEQ ID NO: 946310 - RNA, 22 nt, Mycobacterium avium subsp. paratuberculosis
cggcccgccucggcggccgccu

SEQ ID NO: 946311 - RNA, 12 nt, Mycobacterium avium subsp. paratuberculosis
cggcccgcgacg

SEQ ID NO: 946312 - RNA, 15 nt, Mycobacterium avium subsp. paratuberculosis
cggcccgcgacgucg

SEQ ID NO: 946313 - RNA, 18 nt, Mycobacterium avium subsp. paratuberculosis
cggcccgcgacgucggag

SEQ ID NO: 946314 - RNA, 15 nt, Mycobacterium avium subsp. paratuberculosis
cggcccgccgccggc

SEQ ID NO: 946315 - RNA, 16 nt, Mycobacterium avium subsp. paratuberculosis
cggcccgccgccggcg

SEQ ID NO: 946316 - RNA, 12 nt, Mycobacterium avium subsp. paratuberculosis
cggcccgccgcg

SEQ ID NO: 946317 - RNA, 18 nt, Mycobacterium avium subsp. paratuberculosis
cggcccgccgcgcccggc

SEQ ID NO: 946318 - RNA, 13 nt, Mycobacterium avium subsp. paratuberculosis
cggcccgccgcuc

SEQ ID NO: 946319 - RNA, 17 nt, Mycobacterium avium subsp. paratuberculosis
cggcccgccgcugcagc

SEQ ID NO: 946320 - RNA, 22 nt, Mycobacterium avium subsp. paratuberculosis
cggcccgccggaacucggccgg

SEQ ID NO: 946321 - RNA, 14 nt, Mycobacterium avium subsp. paratuberculosis
cggcccgccggagc

SEQ ID NO: 946322 - RNA, 16 nt, Mycobacterium avium subsp. paratuberculosis
cggcccgccggagccg

SEQ ID NO: 946323 - RNA, 17 nt, Mycobacterium avium subsp. paratuberculosis
cggcccgccggagccga

SEQ ID NO: 946324 - RNA, 19 nt, Mycobacterium avium subsp. paratuberculosis
cggcccgccggagccgauc

SEQ ID NO: 946325 - RNA, 13 nt, Mycobacterium avium subsp. paratuberculosis
cggcccgccgggc

SEQ ID NO: 946326 - RNA, 16 nt, Mycobacterium avium subsp. paratuberculosis
cggcccgccgggccgg

SEQ ID NO: 946327 - RNA, 14 nt, Mycobacterium avium subsp. paratuberculosis
cggcccgccgggcg

SEQ ID NO: 946328 - RNA, 19 nt, Mycobacterium avium subsp. paratuberculosis
cggcccgccgggcgucgcg

SEQ ID NO: 946329 - RNA, 13 nt, Mycobacterium avium subsp. paratuberculosis
cggcccgcccggc

SEQ ID NO: 946330 - RNA, 14 nt, Mycobacterium avium subsp. paratuberculosis
cggcccgcccggcg

SEQ ID NO: 946331 - RNA, 15 nt, Mycobacterium avium subsp. paratuberculosis
cggcccgcccggcgg

SEQ ID NO: 946332 - RNA, 17 nt, Mycobacterium avium subsp. paratuberculosis
cggcccgcccggcggcg

SEQ ID NO: 946333 - RNA, 20 nt, Mycobacterium avium subsp. paratuberculosis
cggcccgcccggcggcgcug

SEQ ID NO: 946334 - RNA, 14 nt, Mycobacterium avium subsp. paratuberculosis
cggcccgccacccg

SEQ ID NO: 946335 - RNA, 21 nt, Mycobacterium avium subsp. paratuberculosis
cggcccgcaggaucgagccgg

SEQ ID NO: 946336 - RNA, 17 nt, Mycobacterium avium subsp. paratuberculosis
cggcccgcaugcaccgg

SEQ ID NO: 946337 - RNA, 17 nt, Mycobacterium avium subsp. paratuberculosis
cggcccgcacggccgcc

SEQ ID NO: 946338 - RNA, 20 nt, Mycobacterium avium subsp. paratuberculosis
cggcccgcacggccgccagg

SEQ ID NO: 946339 - RNA, 18 nt, Mycobacterium avium subsp. paratuberculosis
cggcccgcagccagcgca

SEQ ID NO: 946340 - RNA, 12 nt, Mycobacterium avium subsp. paratuberculosis
cggcccgcagcg

SEQ ID NO: 946341 - RNA, 14 nt, Mycobacterium avium subsp. paratuberculosis
cggcccgcagcgcc

SEQ ID NO: 946342 - RNA, 17 nt, Mycobacterium avium subsp. paratuberculosis
cggcccgcagcgccucg

SEQ ID NO: 946343 - RNA, 19 nt, Mycobacterium avium subsp. paratuberculosis
cggcccgcagcgccucggc

SEQ ID NO: 946344 - RNA, 15 nt, Mycobacterium avium subsp. paratuberculosis
cggcccgcaucgacg

SEQ ID NO: 946345 - RNA, 14 nt, Mycobacterium avium subsp. paratuberculosis
cggcccgcaucgcg

SEQ ID NO: 946346 - RNA, 17 nt, Mycobacterium avium subsp. paratuberculosis
cggcccgcaucgcggcg

SEQ ID NO: 946347 - RNA, 15 nt, Mycobacterium avium subsp. paratuberculosis
cggcccgagcaccac

SEQ ID NO: 946348 - RNA, 16 nt, Mycobacterium avium subsp. paratuberculosis
cggcccgagcaccacc

SEQ ID NO: 946349 - RNA, 18 nt, Mycobacterium avium subsp. paratuberculosis
cggcccgagcaccaccag

SEQ ID NO: 946350 - RNA, 18 nt, Mycobacterium avium subsp. paratuberculosis
cggcccgagcccugcgcc

SEQ ID NO: 946351 - RNA, 17 nt, Mycobacterium avium subsp. paratuberculosis
cggcccgacggguucgc

SEQ ID NO: 946352 - RNA, 22 nt, Mycobacterium avium subsp. paratuberculosis
cggcccgauaggccgacuggug

SEQ ID NO: 946353 - RNA, 12 nt, Mycobacterium avium subsp. paratuberculosis
cggcccgaucac

SEQ ID NO: 946354 - RNA, 14 nt, Mycobacterium avium subsp. paratuberculosis
cggcccgaucacca

SEQ ID NO: 946355 - RNA, 17 nt, Mycobacterium avium subsp. paratuberculosis
cggcccgaucaccaggc

SEQ ID NO: 946356 - RNA, 16 nt, Mycobacterium avium subsp. paratuberculosis
cggcccgaucgcggcg

SEQ ID NO: 946357 - RNA, 19 nt, Mycobacterium avium subsp. paratuberculosis
cggcccgaucgcggcgagc

SEQ ID NO: 946358 - RNA, 19 nt, Mycobacterium avium subsp. paratuberculosis
cggcccgaucgcgucgacg

SEQ ID NO: 946359 - RNA, 16 nt, Mycobacterium avium subsp. paratuberculosis
cggcccgaugcggacc

SEQ ID NO: 946360 - RNA, 15 nt, Mycobacterium avium subsp. paratuberculosis
cggcccgaucaccgc

SEQ ID NO: 946361 - RNA, 15 nt, Mycobacterium avium subsp. paratuberculosis
cggcccgcacggccg

SEQ ID NO: 946362 - RNA, 23 nt, Mycobacterium avium subsp. paratuberculosis
cggccccugcggggugucgaccc

SEQ ID NO: 946363 - RNA, 15 nt, Mycobacterium avium subsp. paratuberculosis
cggccccgggggacc

SEQ ID NO: 946364 - RNA, 20 nt, Mycobacterium avium subsp. paratuberculosis
cggccccgggggaccagcgc

SEQ ID NO: 946365 - RNA, 21 nt, Mycobacterium avium subsp. paratuberculosis
cggccccgguagccagcaccg

SEQ ID NO: 946366 - RNA, 19 nt, Mycobacterium avium subsp. paratuberculosis
cggccccgggcgcuggcga

SEQ ID NO: 946367 - RNA, 20 nt, Mycobacterium avium subsp. paratuberculosis
cggccccgggcgcuggcgau

SEQ ID NO: 946368 - RNA, 14 nt, Mycobacterium avium subsp. paratuberculosis
cggccccggccggc

SEQ ID NO: 946369 - RNA, 15 nt, Mycobacterium avium subsp. paratuberculosis
cggccccggccggcg

SEQ ID NO: 946370 - RNA, 17 nt, Mycobacterium avium subsp. paratuberculosis
cggccccggccggcggg

SEQ ID NO: 946371 - RNA, 14 nt, Mycobacterium avium subsp. paratuberculosis
cggccccggcgacg

SEQ ID NO: 946372 - RNA, 23 nt, Mycobacterium avium subsp. paratuberculosis
cggccccuucgaugucgccggcg

SEQ ID NO: 946373 - RNA, 14 nt, Mycobacterium avium subsp. paratuberculosis
cggccccuuggcgu

SEQ ID NO: 946374 - RNA, 19 nt, Mycobacterium avium subsp. paratuberculosis
cggcccgaaaacgcccggg

SEQ ID NO: 946375 - RNA, 22 nt, Mycobacterium avium subsp. paratuberculosis
cggcccgaaaacgcccggguga

SEQ ID NO: 946376 - RNA, 15 nt, Mycobacterium avium subsp. paratuberculosis
cggcccgaacaccca

SEQ ID NO: 946377 - RNA, 13 nt, Mycobacterium avium subsp. paratuberculosis
cggcccgaccagc

SEQ ID NO: 946378 - RNA, 15 nt, Mycobacterium avium subsp. paratuberculosis
cggcccgaccagcgg

SEQ ID NO: 946379 - RNA, 16 nt, Mycobacterium avium subsp. paratuberculosis
cggcccgaccagcggg

SEQ ID NO: 946380 - RNA, 20 nt, Mycobacterium avium subsp. paratuberculosis
cggcccgaccagcgggccga

SEQ ID NO: 946381 - RNA, 17 nt, Mycobacterium avium subsp. paratuberculosis
cggcccgacccggucag

SEQ ID NO: 946382 - RNA, 21 nt, Mycobacterium avium subsp. paratuberculosis
cggcccgacccggucagcucg

SEQ ID NO: 946383 - RNA, 12 nt, Mycobacterium avium subsp. paratuberculosis
cggcccgacgac

SEQ ID NO: 946384 - RNA, 13 nt, Mycobacterium avium subsp. paratuberculosis
cggcccgacgacg

SEQ ID NO: 946385 - RNA, 14 nt, Mycobacterium avium subsp. paratuberculosis
cggcccgacgacgc

SEQ ID NO: 946386 - RNA, 16 nt, Mycobacterium avium subsp. paratuberculosis
cggcccgacgacgccg

SEQ ID NO: 946387 - RNA, 13 nt, Mycobacterium avium subsp. paratuberculosis
cggccccggccga

SEQ ID NO: 946388 - RNA, 17 nt, Mycobacterium avium subsp. paratuberculosis
cggccccggccgagccg

SEQ ID NO: 946389 - RNA, 18 nt, Mycobacterium avium subsp. paratuberculosis
cggccccggccgagccgg

SEQ ID NO: 946390 - RNA, 21 nt, Mycobacterium avium subsp. paratuberculosis
cggccccgcugccguccggcg

SEQ ID NO: 946391 - RNA, 22 nt, Mycobacterium avium subsp. paratuberculosis
cggccccgcugccguccggcgg

SEQ ID NO: 946392 - RNA, 14 nt, Mycobacterium avium subsp. paratuberculosis
cggccccgcccggc

SEQ ID NO: 946393 - RNA, 17 nt, Mycobacterium avium subsp. paratuberculosis
cggccccgcccggcgcg

SEQ ID NO: 946394 - RNA, 16 nt, Mycobacterium avium subsp. paratuberculosis
cggccccgcccggggc

SEQ ID NO: 946395 - RNA, 17 nt, Mycobacterium avium subsp. paratuberculosis
cggccccgcccggggcg

SEQ ID NO: 946396 - RNA, 18 nt, Mycobacterium avium subsp. paratuberculosis
cggccccgcccggggcgg

SEQ ID NO: 946397 - RNA, 20 nt, Mycobacterium avium subsp. paratuberculosis
cggccccgcccggggcggcg

SEQ ID NO: 946398 - RNA, 19 nt, Mycobacterium avium subsp. paratuberculosis
cggcgcugaagugcagcgc

SEQ ID NO: 946399 - RNA, 21 nt, Mycobacterium avium subsp. paratuberculosis
cggcgcggcucacgacuccug

SEQ ID NO: 946400 - RNA, 20 nt, Mycobacterium avium subsp. paratuberculosis
cggcgcugaacugcucgacc

SEQ ID NO: 946401 - RNA, 21 nt, Mycobacterium avium subsp. paratuberculosis
cggcgcugaacugcucgacca

SEQ ID NO: 946402 - RNA, 17 nt, Mycobacterium avium subsp. paratuberculosis
cggcgcucgccgcgcgg

SEQ ID NO: 946403 - RNA, 21 nt, Mycobacterium avium subsp. paratuberculosis
cggcgcucgccgcgcggcccg

SEQ ID NO: 946404 - RNA, 14 nt, Mycobacterium avium subsp. paratuberculosis
cggcgcucgcgggu

SEQ ID NO: 946405 - RNA, 14 nt, Mycobacterium avium subsp. paratuberculosis
cggcgcucggugug

SEQ ID NO: 946406 - RNA, 18 nt, Mycobacterium avium subsp. paratuberculosis
cggcgcucggugugcggu

SEQ ID NO: 946407 - RNA, 12 nt, Mycobacterium avium subsp. paratuberculosis
cggcgcucgucg

SEQ ID NO: 946408 - RNA, 18 nt, Mycobacterium avium subsp. paratuberculosis
cggcgcucgucgucgccg

SEQ ID NO: 946409 - RNA, 21 nt, Mycobacterium avium subsp. paratuberculosis
cggcgcucgucgucgccgaug

SEQ ID NO: 946410 - RNA, 22 nt, Mycobacterium avium subsp. paratuberculosis
cggcgcucgucgucgccgaugc

SEQ ID NO: 946411 - RNA, 16 nt, Mycobacterium avium subsp. paratuberculosis
cggcgcuccagcgggc

SEQ ID NO: 946412 - RNA, 18 nt, Mycobacterium avium subsp. paratuberculosis
cggcgcuccagcgggcgg

SEQ ID NO: 946413 - RNA, 22 nt, Mycobacterium avium subsp. paratuberculosis
cggcgcuccagcgggcggcggu

SEQ ID NO: 946414 - RNA, 19 nt, Mycobacterium avium subsp. paratuberculosis
cggcgcucccgauggcucg

SEQ ID NO: 946415 - RNA, 20 nt, Mycobacterium avium subsp. paratuberculosis
cggcggacuggcugagcagc

SEQ ID NO: 946416 - RNA, 14 nt, Mycobacterium avium subsp. paratuberculosis
cggcgcuggcgugc

SEQ ID NO: 946417 - RNA, 16 nt, Mycobacterium avium subsp. paratuberculosis
cggcggacgauguccg

SEQ ID NO: 946418 - RNA, 20 nt, Mycobacterium avium subsp. paratuberculosis
cggcggacgauguccgccgg

SEQ ID NO: 946419 - RNA, 23 nt, Mycobacterium avium subsp. paratuberculosis
cggcggacgauguccgccggccg

SEQ ID NO: 946420 - RNA, 15 nt, Mycobacterium avium subsp. paratuberculosis
cggcggacgcggcca

SEQ ID NO: 946421 - RNA, 17 nt, Mycobacterium avium subsp. paratuberculosis
cggcggacgcggccagc

SEQ ID NO: 946422 - RNA, 19 nt, Mycobacterium avium subsp. paratuberculosis
cggcggacgcggccagcgc

SEQ ID NO: 946423 - RNA, 19 nt, Mycobacterium avium subsp. paratuberculosis
cggcggacucggcgaaguc

SEQ ID NO: 946424 - RNA, 16 nt, Mycobacterium avium subsp. paratuberculosis
cggcgcuggcgcgccg

SEQ ID NO: 946425 - RNA, 16 nt, Mycobacterium avium subsp. paratuberculosis
cggcgcuggccagcgc

SEQ ID NO: 946426 - RNA, 19 nt, Mycobacterium avium subsp. paratuberculosis
cggcgcuggccagcgcgac

SEQ ID NO: 946427 - RNA, 20 nt, Mycobacterium avium subsp. paratuberculosis
cggcgcuggccagcgcgacg

SEQ ID NO: 946428 - RNA, 14 nt, Mycobacterium avium subsp. paratuberculosis
cggcgcuggccgcg

SEQ ID NO: 946429 - RNA, 18 nt, Mycobacterium avium subsp. paratuberculosis
cggcgcuggccgcggcca

SEQ ID NO: 946430 - RNA, 21 nt, Mycobacterium avium subsp. paratuberculosis
cggcgcuggccgcggccagcu

SEQ ID NO: 946431 - RNA, 23 nt, Mycobacterium avium subsp. paratuberculosis
cggcggcaaaacgcugggcgccg

SEQ ID NO: 946432 - RNA, 16 nt, Mycobacterium avium subsp. paratuberculosis
cggcggcagugcgccg

SEQ ID NO: 946433 - RNA, 19 nt, Mycobacterium avium subsp. paratuberculosis
cggcggcaaagcguugccg

SEQ ID NO: 946434 - RNA, 13 nt, Mycobacterium avium subsp. paratuberculosis
cggcggcagucgc

SEQ ID NO: 946435 - RNA, 16 nt, Mycobacterium avium subsp. paratuberculosis
cggcggcagucgcagc

SEQ ID NO: 946436 - RNA, 21 nt, Mycobacterium avium subsp. paratuberculosis
cggcggcauaguccagcucgc

SEQ ID NO: 946437 - RNA, 23 nt, Mycobacterium avium subsp. paratuberculosis
cggcggcauaguccagcucgcga

SEQ ID NO: 946438 - RNA, 15 nt, Mycobacterium avium subsp. paratuberculosis
cggcggccaacgcga

SEQ ID NO: 946439 - RNA, 23 nt, Mycobacterium avium subsp. paratuberculosis
cggcggccaacgcgacgaagccg

SEQ ID NO: 946440 - RNA, 16 nt, Mycobacterium avium subsp. paratuberculosis
cggcggccaaucccac

SEQ ID NO: 946441 - RNA, 18 nt, Mycobacterium avium subsp. paratuberculosis
cggcggccaaucccacca

SEQ ID NO: 946442 - RNA, 19 nt, Mycobacterium avium subsp. paratuberculosis
cggcggccaaucccaccau

SEQ ID NO: 946443 - RNA, 13 nt, Mycobacterium avium subsp. paratuberculosis
cggcggccaccag

SEQ ID NO: 946444 - RNA, 20 nt, Mycobacterium avium subsp. paratuberculosis
cggcggccaccagccggccg

SEQ ID NO: 946445 - RNA, 18 nt, Mycobacterium avium subsp. paratuberculosis
cggcggccauucaucgcg

SEQ ID NO: 946446 - RNA, 19 nt, Mycobacterium avium subsp. paratuberculosis
cggcggccauucaucgcgc

SEQ ID NO: 946447 - RNA, 20 nt, Mycobacterium avium subsp. paratuberculosis
cggcggccacgaucgcggcc

SEQ ID NO: 946448 - RNA, 12 nt, Mycobacterium avium subsp. paratuberculosis
cggcggccacgc

SEQ ID NO: 946449 - RNA, 14 nt, Mycobacterium avium subsp. paratuberculosis
cggcggccacgcag

SEQ ID NO: 946450 - RNA, 15 nt, Mycobacterium avium subsp. paratuberculosis
cggcggccaccgcgc

SEQ ID NO: 946451 - RNA, 16 nt, Mycobacterium avium subsp. paratuberculosis
cggcggccaccgcgcc

SEQ ID NO: 946452 - RNA, 17 nt, Mycobacterium avium subsp. paratuberculosis
cggcggccaccgcgccg

SEQ ID NO: 946453 - RNA, 15 nt, Mycobacterium avium subsp. paratuberculosis
cggcggccaccucgg

SEQ ID NO: 946454 - RNA, 16 nt, Mycobacterium avium subsp. paratuberculosis
cggcggccaccucggc

SEQ ID NO: 946455 - RNA, 17 nt, Mycobacterium avium subsp. paratuberculosis
cggcggccaccucggcg

SEQ ID NO: 946456 - RNA, 19 nt, Mycobacterium avium subsp. paratuberculosis
cggcggauucucgcucugc

SEQ ID NO: 946457 - RNA, 14 nt, Mycobacterium avium subsp. paratuberculosis
cggcggaugggugc

SEQ ID NO: 946458 - RNA, 16 nt, Mycobacterium avium subsp. paratuberculosis
cggcggauccagcacc

SEQ ID NO: 946459 - RNA, 17 nt, Mycobacterium avium subsp. paratuberculosis
cggcggauccagcaccg

SEQ ID NO: 946460 - RNA, 15 nt, Mycobacterium avium subsp. paratuberculosis
cggcggauccaggug

SEQ ID NO: 946461 - RNA, 16 nt, Mycobacterium avium subsp. paratuberculosis
cggcggauccaggugg

SEQ ID NO: 946462 - RNA, 15 nt, Mycobacterium avium subsp. paratuberculosis
cggcggaucagcacc

SEQ ID NO: 946463 - RNA, 16 nt, Mycobacterium avium subsp. paratuberculosis
cggcggaucagcaccg

SEQ ID NO: 946464 - RNA, 17 nt, Mycobacterium avium subsp. paratuberculosis
cggcggaucagcaccga

SEQ ID NO: 946465 - RNA, 23 nt, Mycobacterium avium subsp. paratuberculosis
cggcggaucagcaccgacgcggc

SEQ ID NO: 946466 - RNA, 18 nt, Mycobacterium avium subsp. paratuberculosis
cggcggaucgcgugcguc

SEQ ID NO: 946467 - RNA, 17 nt, Mycobacterium avium subsp. paratuberculosis
cggcggauauagccgac

SEQ ID NO: 946468 - RNA, 18 nt, Mycobacterium avium subsp. paratuberculosis
cggcggaggccugcgcgg

SEQ ID NO: 946469 - RNA, 12 nt, Mycobacterium avium subsp. paratuberculosis
cggcggaggcga

SEQ ID NO: 946470 - RNA, 23 nt, Mycobacterium avium subsp. paratuberculosis
cggcggaggucauggcgaccgcg

SEQ ID NO: 946471 - RNA, 12 nt, Mycobacterium avium subsp. paratuberculosis
cggcggagucgu

SEQ ID NO: 946472 - RNA, 15 nt, Mycobacterium avium subsp. paratuberculosis
cggcgcucaccgcga

SEQ ID NO: 946473 - RNA, 13 nt, Mycobacterium avium subsp. paratuberculosis
cggcgcucaccgg

SEQ ID NO: 946474 - RNA, 18 nt, Mycobacterium avium subsp. paratuberculosis
cggcgcucaccggcgugg

SEQ ID NO: 946475 - RNA, 15 nt, Mycobacterium avium subsp. paratuberculosis
cggcgcguuggcccg

SEQ ID NO: 946476 - RNA, 17 nt, Mycobacterium avium subsp. paratuberculosis
cggcgcuaaagccacca

SEQ ID NO: 946477 - RNA, 20 nt, Mycobacterium avium subsp. paratuberculosis
cggcgcuaaagccaccagcg

SEQ ID NO: 946478 - RNA, 23 nt, Mycobacterium avium subsp. paratuberculosis
cggcgcuaaagccaccagcguuc

SEQ ID NO: 946479 - RNA, 20 nt, Mycobacterium avium subsp. paratuberculosis
cggcgcggggccaccaggcg

SEQ ID NO: 946480 - RNA, 22 nt, Mycobacterium avium subsp. paratuberculosis
cggcgcgggcgauuucgucggc

SEQ ID NO: 946481 - RNA, 24 nt, Mycobacterium avium subsp. paratuberculosis
cggcgcgggcgauuucgucggcgg

SEQ ID NO: 946482 - RNA, 15 nt, Mycobacterium avium subsp. paratuberculosis
cggcgcgggcggcgu

SEQ ID NO: 946483 - RNA, 17 nt, Mycobacterium avium subsp. paratuberculosis
cggcgcgggcggcgucg

SEQ ID NO: 946484 - RNA, 20 nt, Mycobacterium avium subsp. paratuberculosis
cggcgcgggcggcgucggcg

SEQ ID NO: 946485 - RNA, 23 nt, Mycobacterium avium subsp. paratuberculosis
cggcgcgggcggcgucggcgacg

SEQ ID NO: 946486 - RNA, 13 nt, Mycobacterium avium subsp. paratuberculosis
cggcgcgggcgcc

SEQ ID NO: 946487 - RNA, 18 nt, Mycobacterium avium subsp. paratuberculosis
cggcgcgggcgcccucca

SEQ ID NO: 946488 - RNA, 16 nt, Mycobacterium avium subsp. paratuberculosis
cggcgcgggccagcag

SEQ ID NO: 946489 - RNA, 17 nt, Mycobacterium avium subsp. paratuberculosis
cggcgcgggccagcagc

SEQ ID NO: 946490 - RNA, 14 nt, Mycobacterium avium subsp. paratuberculosis
cggcgcgggccgca

SEQ ID NO: 946491 - RNA, 15 nt, Mycobacterium avium subsp. paratuberculosis
cggcgcgggccgcag

SEQ ID NO: 946492 - RNA, 18 nt, Mycobacterium avium subsp. paratuberculosis
cggcgcgggccgcagcgc

SEQ ID NO: 946493 - RNA, 22 nt, Mycobacterium avium subsp. paratuberculosis
cggcgcgggccgcagcgcgcgg

SEQ ID NO: 946494 - RNA, 23 nt, Mycobacterium avium subsp. paratuberculosis
cggcgcgggcaugaaccaggccg

SEQ ID NO: 946495 - RNA, 20 nt, Mycobacterium avium subsp. paratuberculosis
cggcgcggcuuuuggcgucg

SEQ ID NO: 946496 - RNA, 21 nt, Mycobacterium avium subsp. paratuberculosis
cggcgcggcuuuuggcgucgu

SEQ ID NO: 946497 - RNA, 22 nt, Mycobacterium avium subsp. paratuberculosis
cggcgcggcuuuuggcgucguu

SEQ ID NO: 946498 - RNA, 15 nt, Mycobacterium avium subsp. paratuberculosis
cggcgcggacagcgc

SEQ ID NO: 946499 - RNA, 17 nt, Mycobacterium avium subsp. paratuberculosis
cggcgcggacagcgcgg

SEQ ID NO: 946500 - RNA, 18 nt, Mycobacterium avium subsp. paratuberculosis
cggcgcggacagcgcggu

SEQ ID NO: 946501 - RNA, 14 nt, Mycobacterium avium subsp. paratuberculosis
cggcgcggacguga

SEQ ID NO: 946502 - RNA, 15 nt, Mycobacterium avium subsp. paratuberculosis
cggcgcggacgugau

SEQ ID NO: 946503 - RNA, 15 nt, Mycobacterium avium subsp. paratuberculosis
cggcgcggagccggc

SEQ ID NO: 946504 - RNA, 17 nt, Mycobacterium avium subsp. paratuberculosis
cggcgcggagccggccg

SEQ ID NO: 946505 - RNA, 18 nt, Mycobacterium avium subsp. paratuberculosis
cggcgcggagccggccgc

SEQ ID NO: 946506 - RNA, 15 nt, Mycobacterium avium subsp. paratuberculosis
cggcgcggagcgucg

SEQ ID NO: 946507 - RNA, 19 nt, Mycobacterium avium subsp. paratuberculosis
cggcgcggagcgucgcgau

SEQ ID NO: 946508 - RNA, 16 nt, Mycobacterium avium subsp. paratuberculosis
cggcgcggaccccagu

SEQ ID NO: 946509 - RNA, 17 nt, Mycobacterium avium subsp. paratuberculosis
cggcgcggaacagcguc

SEQ ID NO: 946510 - RNA, 21 nt, Mycobacterium avium subsp. paratuberculosis
cggcgcggaacagcgucgccg

SEQ ID NO: 946511 - RNA, 18 nt, Mycobacterium avium subsp. paratuberculosis
cggcgcggaacgcgccgg

SEQ ID NO: 946512 - RNA, 16 nt, Mycobacterium avium subsp. paratuberculosis
cggcgcgcugcggcgu

SEQ ID NO: 946513 - RNA, 17 nt, Mycobacterium avium subsp. paratuberculosis
cggcgcgcugcggcguc

SEQ ID NO: 946514 - RNA, 22 nt, Mycobacterium avium subsp. paratuberculosis
cggcgcggcaggaauuccagcg

SEQ ID NO: 946515 - RNA, 19 nt, Mycobacterium avium subsp. paratuberculosis
cggcgcggcaguccgccgg

SEQ ID NO: 946516 - RNA, 23 nt, Mycobacterium avium subsp. paratuberculosis
cggcgcggcaguccgccggagac

SEQ ID NO: 946517 - RNA, 13 nt, Mycobacterium avium subsp. paratuberculosis
cggcgcggcaucg

SEQ ID NO: 946518 - RNA, 19 nt, Mycobacterium avium subsp. paratuberculosis
cggcgcggcaucggcgacg

SEQ ID NO: 946519 - RNA, 15 nt, Mycobacterium avium subsp. paratuberculosis
cggcgcggaucguca

SEQ ID NO: 946520 - RNA, 18 nt, Mycobacterium avium subsp. paratuberculosis
cggcgcggaucgucaccg

SEQ ID NO: 946521 - RNA, 16 nt, Mycobacterium avium subsp. paratuberculosis
cggcgcggaucucgcg

SEQ ID NO: 946522 - RNA, 20 nt, Mycobacterium avium subsp. paratuberculosis
cggcgcggaucucgcgcagg

SEQ ID NO: 946523 - RNA, 21 nt, Mycobacterium avium subsp. paratuberculosis
cggcgcggaucucgcgcaggu

SEQ ID NO: 946524 - RNA, 17 nt, Mycobacterium avium subsp. paratuberculosis
cggcgcggaugacgugc

SEQ ID NO: 946525 - RNA, 22 nt, Mycobacterium avium subsp. paratuberculosis
cggcgcggaugacgugcaccac

SEQ ID NO: 946526 - RNA, 23 nt, Mycobacterium avium subsp. paratuberculosis
cggcgcggaugacgugcaccacc

SEQ ID NO: 946527 - RNA, 12 nt, Mycobacterium avium subsp. paratuberculosis
cggcgcggcggu

SEQ ID NO: 946528 - RNA, 13 nt, Mycobacterium avium subsp. paratuberculosis
cggcgcggcgguc

SEQ ID NO: 946529 - RNA, 14 nt, Mycobacterium avium subsp. paratuberculosis
cggcgcggcggugg

SEQ ID NO: 946530 - RNA, 14 nt, Mycobacterium avium subsp. paratuberculosis
cggcgcggcggcga

SEQ ID NO: 946531 - RNA, 16 nt, Mycobacterium avium subsp. paratuberculosis
cggcgcggcggcgacg

SEQ ID NO: 946532 - RNA, 20 nt, Mycobacterium avium subsp. paratuberculosis
cggcgcggcggcgacgucga

SEQ ID NO: 946533 - RNA, 23 nt, Mycobacterium avium subsp. paratuberculosis
cggcgcggcggcgacgucgacgg

SEQ ID NO: 946534 - RNA, 15 nt, Mycobacterium avium subsp. paratuberculosis
cggcgcggcggcgcc

SEQ ID NO: 946535 - RNA, 16 nt, Mycobacterium avium subsp. paratuberculosis
cggcgcggcggcgccg

SEQ ID NO: 946536 - RNA, 17 nt, Mycobacterium avium subsp. paratuberculosis
cggcgcggcggcgccgc

SEQ ID NO: 946537 - RNA, 17 nt, Mycobacterium avium subsp. paratuberculosis
cggcgcgcucgucgucg

SEQ ID NO: 946538 - RNA, 18 nt, Mycobacterium avium subsp. paratuberculosis
cggcgcgcugaagcgcga

SEQ ID NO: 946539 - RNA, 15 nt, Mycobacterium avium subsp. paratuberculosis
cggcgcgcggggccg

SEQ ID NO: 946540 - RNA, 17 nt, Mycobacterium avium subsp. paratuberculosis
cggcgcgcggggccggc

SEQ ID NO: 946541 - RNA, 15 nt, Mycobacterium avium subsp. paratuberculosis
cggcgcgcggggugu

SEQ ID NO: 946542 - RNA, 18 nt, Mycobacterium avium subsp. paratuberculosis
cggcgcgcggggugucgc

SEQ ID NO: 946543 - RNA, 22 nt, Mycobacterium avium subsp. paratuberculosis
cggcgcgcggggugucgcggcu

SEQ ID NO: 946544 - RNA, 16 nt, Mycobacterium avium subsp. paratuberculosis
cggcgcgcgguggugu

SEQ ID NO: 946545 - RNA, 19 nt, Mycobacterium avium subsp. paratuberculosis
cggcgcgcggugguguugc

SEQ ID NO: 946546 - RNA, 20 nt, Mycobacterium avium subsp. paratuberculosis
cggcgcgcguauuccagcgc

SEQ ID NO: 946547 - RNA, 13 nt, Mycobacterium avium subsp. paratuberculosis
cggcgcgccaccc

SEQ ID NO: 946548 - RNA, 13 nt, Mycobacterium avium subsp. paratuberculosis
cggcgcgcggccg

SEQ ID NO: 946549 - RNA, 14 nt, Mycobacterium avium subsp. paratuberculosis
cggcgcgcggccgc

SEQ ID NO: 946550 - RNA, 15 nt, Mycobacterium avium subsp. paratuberculosis
cggcgcgcggccgcg

SEQ ID NO: 946551 - RNA, 17 nt, Mycobacterium avium subsp. paratuberculosis
cggcgcgcggccgcgac

SEQ ID NO: 946552 - RNA, 15 nt, Mycobacterium avium subsp. paratuberculosis
cggcgcgcgccgauc

SEQ ID NO: 946553 - RNA, 13 nt, Mycobacterium avium subsp. paratuberculosis
cggcgcgcgccgc

SEQ ID NO: 946554 - RNA, 14 nt, Mycobacterium avium subsp. paratuberculosis
cggcgcgcgccgca

SEQ ID NO: 946555 - RNA, 16 nt, Mycobacterium avium subsp. paratuberculosis
cggcgcgcgccgcagc

SEQ ID NO: 946556 - RNA, 21 nt, Mycobacterium avium subsp. paratuberculosis
cggcgcgcgcgccccagcccc

SEQ ID NO: 946557 - RNA, 13 nt, Mycobacterium avium subsp. paratuberculosis
cggcgcgcgccag

SEQ ID NO: 946558 - RNA, 14 nt, Mycobacterium avium subsp. paratuberculosis
cggcgcgcgccagc

SEQ ID NO: 946559 - RNA, 18 nt, Mycobacterium avium subsp. paratuberculosis
cggcgcgcccgacgaugc

SEQ ID NO: 946560 - RNA, 20 nt, Mycobacterium avium subsp. paratuberculosis
cggcgcgcgagcgucacgcu

SEQ ID NO: 946561 - RNA, 21 nt, Mycobacterium avium subsp. paratuberculosis
cggcgcgcgagcgucacgcug

SEQ ID NO: 946562 - RNA, 23 nt, Mycobacterium avium subsp. paratuberculosis
cggcgcgcgagcgucacgcuggc

SEQ ID NO: 946563 - RNA, 20 nt, Mycobacterium avium subsp. paratuberculosis
cggcgcgcgauggacagcag

SEQ ID NO: 946564 - RNA, 14 nt, Mycobacterium avium subsp. paratuberculosis
cggcgcgcaucgcc

SEQ ID NO: 946565 - RNA, 21 nt, Mycobacterium avium subsp. paratuberculosis
cggcgcgcaucgccguccacg

SEQ ID NO: 946566 - RNA, 22 nt, Mycobacterium avium subsp. paratuberculosis
cggcgcgcaucgccguccacgg

SEQ ID NO: 946567 - RNA, 17 nt, Mycobacterium avium subsp. paratuberculosis
cggcgcgcaucgucgcg

SEQ ID NO: 946568 - RNA, 19 nt, Mycobacterium avium subsp. paratuberculosis
cggcgcgcagcucgcgcag

SEQ ID NO: 946569 - RNA, 20 nt, Mycobacterium avium subsp. paratuberculosis
cggcgcgcagcucgcgcagc

SEQ ID NO: 946570 - RNA, 21 nt, Mycobacterium avium subsp. paratuberculosis
cggcgcgcaggcgcgcggcca

SEQ ID NO: 946571 - RNA, 18 nt, Mycobacterium avium subsp. paratuberculosis
cggcgcgcaggucguccg

SEQ ID NO: 946572 - RNA, 22 nt, Mycobacterium avium subsp. paratuberculosis
cggcgcgcaggucguccgacag

SEQ ID NO: 946573 - RNA, 16 nt, Mycobacterium avium subsp. paratuberculosis
cggcgcgcaucccgau

SEQ ID NO: 946574 - RNA, 13 nt, Mycobacterium avium subsp. paratuberculosis
cggcgcgcagcca

SEQ ID NO: 946575 - RNA, 18 nt, Mycobacterium avium subsp. paratuberculosis
cggcgcgcagcccagcca

SEQ ID NO: 946576 - RNA, 19 nt, Mycobacterium avium subsp. paratuberculosis
cggcgcgcagcccagccag

SEQ ID NO: 946577 - RNA, 21 nt, Mycobacterium avium subsp. paratuberculosis
cggcgcgcagcccagccagcg

SEQ ID NO: 946578 - RNA, 13 nt, Mycobacterium avium subsp. paratuberculosis
cggcgcgcagccg

SEQ ID NO: 946579 - RNA, 14 nt, Mycobacterium avium subsp. paratuberculosis
cggcgcgcagccgg

SEQ ID NO: 946580 - RNA, 14 nt, Mycobacterium avium subsp. paratuberculosis
cggcgcgaccagcg

SEQ ID NO: 946581 - RNA, 16 nt, Mycobacterium avium subsp. paratuberculosis
cggcgcgaccagcggc

SEQ ID NO: 946582 - RNA, 17 nt, Mycobacterium avium subsp. paratuberculosis
cggcgcgaccagcggca

SEQ ID NO: 946583 - RNA, 19 nt, Mycobacterium avium subsp. paratuberculosis
cggcgcgaccagcggcagc

SEQ ID NO: 946584 - RNA, 20 nt, Mycobacterium avium subsp. paratuberculosis
cggcgcgaccagcggcagca

SEQ ID NO: 946585 - RNA, 18 nt, Mycobacterium avium subsp. paratuberculosis
cggcgcgcacggcagccc

SEQ ID NO: 946586 - RNA, 16 nt, Mycobacterium avium subsp. paratuberculosis
cggcgcgcagccggcc

SEQ ID NO: 946587 - RNA, 13 nt, Mycobacterium avium subsp. paratuberculosis
cggcgcgacaccg

SEQ ID NO: 946588 - RNA, 15 nt, Mycobacterium avium subsp. paratuberculosis
cggcgcgacaccgcg

SEQ ID NO: 946589 - RNA, 16 nt, Mycobacterium avium subsp. paratuberculosis
cggcgcgacaccgcgg

SEQ ID NO: 946590 - RNA, 17 nt, Mycobacterium avium subsp. paratuberculosis
cggcgcgacaccgcggc

SEQ ID NO: 946591 - RNA, 21 nt, Mycobacterium avium subsp. paratuberculosis
cggcgcgaagcccucgaagca

SEQ ID NO: 946592 - RNA, 18 nt, Mycobacterium avium subsp. paratuberculosis
cggcgcgaagucgagcag

SEQ ID NO: 946593 - RNA, 16 nt, Mycobacterium avium subsp. paratuberculosis
cggcgcgaaccgggcc

SEQ ID NO: 946594 - RNA, 17 nt, Mycobacterium avium subsp. paratuberculosis
cggcgccuugguccgca

SEQ ID NO: 946595 - RNA, 13 nt, Mycobacterium avium subsp. paratuberculosis
cggcgccugguag

SEQ ID NO: 946596 - RNA, 13 nt, Mycobacterium avium subsp. paratuberculosis
cggcgccugguca

SEQ ID NO: 946597 - RNA, 14 nt, Mycobacterium avium subsp. paratuberculosis
cggcgcacggugcc

SEQ ID NO: 946598 - RNA, 20 nt, Mycobacterium avium subsp. paratuberculosis
cggcgcacggugcccgucgg

SEQ ID NO: 946599 - RNA, 21 nt, Mycobacterium avium subsp. paratuberculosis
cggcgcacggugcccgucggc

SEQ ID NO: 946600 - RNA, 22 nt, Mycobacterium avium subsp. paratuberculosis
cggcgcacggugcccgucggca

SEQ ID NO: 946601 - RNA, 19 nt, Mycobacterium avium subsp. paratuberculosis
cggcgcacguggcugaccg

SEQ ID NO: 946602 - RNA, 17 nt, Mycobacterium avium subsp. paratuberculosis
cggcgcacgcagugccg

SEQ ID NO: 946603 - RNA, 21 nt, Mycobacterium avium subsp. paratuberculosis
cggcgcacgcagugccgcacc

SEQ ID NO: 946604 - RNA, 22 nt, Mycobacterium avium subsp. paratuberculosis
cggcgcacgcagugccgcacca

SEQ ID NO: 946605 - RNA, 15 nt, Mycobacterium avium subsp. paratuberculosis
cggcgcacuccauca

SEQ ID NO: 946606 - RNA, 17 nt, Mycobacterium avium subsp. paratuberculosis
cggcgcacuccaucacg

SEQ ID NO: 946607 - RNA, 20 nt, Mycobacterium avium subsp. paratuberculosis
cggcgcagggcggccggcca

SEQ ID NO: 946608 - RNA, 21 nt, Mycobacterium avium subsp. paratuberculosis
cggcgcagggcggccggccag

SEQ ID NO: 946609 - RNA, 12 nt, Mycobacterium avium subsp. paratuberculosis
cggcgcaggucc

SEQ ID NO: 946610 - RNA, 17 nt, Mycobacterium avium subsp. paratuberculosis
cggcgcagguccggcag

SEQ ID NO: 946611 - RNA, 19 nt, Mycobacterium avium subsp. paratuberculosis
cggcgcagguccggcagcg

SEQ ID NO: 946612 - RNA, 22 nt, Mycobacterium avium subsp. paratuberculosis
cggcgcagguccggcagcgcgc

SEQ ID NO: 946613 - RNA, 16 nt, Mycobacterium avium subsp. paratuberculosis
cggcgcagguugucca

SEQ ID NO: 946614 - RNA, 20 nt, Mycobacterium avium subsp. paratuberculosis
cggcgcagguuguccagccg

SEQ ID NO: 946615 - RNA, 22 nt, Mycobacterium avium subsp. paratuberculosis
cggcgcagguuguccagccggu

SEQ ID NO: 946616 - RNA, 23 nt, Mycobacterium avium subsp. paratuberculosis
cggcgcagguuguccagccggug

SEQ ID NO: 946617 - RNA, 22 nt, Mycobacterium avium subsp. paratuberculosis
cggcgcaggugaucaaagccgg

SEQ ID NO: 946618 - RNA, 20 nt, Mycobacterium avium subsp. paratuberculosis
cggcgcagguguccagcccu

SEQ ID NO: 946619 - RNA, 20 nt, Mycobacterium avium subsp. paratuberculosis
cggcgcagucgaucucgucg

SEQ ID NO: 946620 - RNA, 22 nt, Mycobacterium avium subsp. paratuberculosis
cggcgcagucgaucucgucgca

SEQ ID NO: 946621 - RNA, 14 nt, Mycobacterium avium subsp. paratuberculosis
cggcgcagccagcg

SEQ ID NO: 946622 - RNA, 18 nt, Mycobacterium avium subsp. paratuberculosis
cggcgcagccagcgccgc

SEQ ID NO: 946623 - RNA, 16 nt, Mycobacterium avium subsp. paratuberculosis
cggcgcagccagcucg

SEQ ID NO: 946624 - RNA, 18 nt, Mycobacterium avium subsp. paratuberculosis
cggcgcagccagcucggc

SEQ ID NO: 946625 - RNA, 21 nt, Mycobacterium avium subsp. paratuberculosis
cggcgcagccagcucggcgua

SEQ ID NO: 946626 - RNA, 18 nt, Mycobacterium avium subsp. paratuberculosis
cggcgcagaugaccggcc

SEQ ID NO: 946627 - RNA, 21 nt, Mycobacterium avium subsp. paratuberculosis
cggcgcagaugaccggccugc

SEQ ID NO: 946628 - RNA, 23 nt, Mycobacterium avium subsp. paratuberculosis
cggcgcagaugaccggccugcag

SEQ ID NO: 946629 - RNA, 14 nt, Mycobacterium avium subsp. paratuberculosis
cggcgcagcacggc

SEQ ID NO: 946630 - RNA, 14 nt, Mycobacterium avium subsp. paratuberculosis
cggcgccaccagcc

SEQ ID NO: 946631 - RNA, 18 nt, Mycobacterium avium subsp. paratuberculosis
cggcgcaugaccgauccg

SEQ ID NO: 946632 - RNA, 20 nt, Mycobacterium avium subsp. paratuberculosis
cggcgcaugaccgauccgcc

SEQ ID NO: 946633 - RNA, 22 nt, Mycobacterium avium subsp. paratuberculosis
cggcgcaugaccgauccgccgg

SEQ ID NO: 946634 - RNA, 20 nt, Mycobacterium avium subsp. paratuberculosis
cggcgcaugaucgcccgcuc

SEQ ID NO: 946635 - RNA, 17 nt, Mycobacterium avium subsp. paratuberculosis
cggcgccaacaacucga

SEQ ID NO: 946636 - RNA, 19 nt, Mycobacterium avium subsp. paratuberculosis
cggcgccaacaacucgacg

SEQ ID NO: 946637 - RNA, 22 nt, Mycobacterium avium subsp. paratuberculosis
cggcgccaacaacucgacgcuc

SEQ ID NO: 946638 - RNA, 24 nt, Mycobacterium avium subsp. paratuberculosis
cggcgccaacaacucgacgcucgg

SEQ ID NO: 946639 - RNA, 21 nt, Mycobacterium avium subsp. paratuberculosis
cggcgcaguucgaccggcacc

SEQ ID NO: 946640 - RNA, 16 nt, Mycobacterium avium subsp. paratuberculosis
cggcgcagucggccgg

SEQ ID NO: 946641 - RNA, 17 nt, Mycobacterium avium subsp. paratuberculosis
cggcgcagucggccgga

SEQ ID NO: 946642 - RNA, 15 nt, Mycobacterium avium subsp. paratuberculosis
cggcgauguugacca

SEQ ID NO: 946643 - RNA, 23 nt, Mycobacterium avium subsp. paratuberculosis
cggcgauguugaccacccgcagc

SEQ ID NO: 946644 - RNA, 15 nt, Mycobacterium avium subsp. paratuberculosis
cggcgauggccgaca

SEQ ID NO: 946645 - RNA, 14 nt, Mycobacterium avium subsp. paratuberculosis
cggcgauggccgac

SEQ ID NO: 946646 - RNA, 20 nt, Mycobacterium avium subsp. paratuberculosis
cggcgaugcguugcgccagc

SEQ ID NO: 946647 - RNA, 22 nt, Mycobacterium avium subsp. paratuberculosis
cggcgaugcguugcgccagcac

SEQ ID NO: 946648 - RNA, 19 nt, Mycobacterium avium subsp. paratuberculosis
cggcgauggacguccagcg

SEQ ID NO: 946649 - RNA, 22 nt, Mycobacterium avium subsp. paratuberculosis
cggcgauggaguagcugaccga

SEQ ID NO: 946650 - RNA, 15 nt, Mycobacterium avium subsp. paratuberculosis
cggcgauggcccgcu

SEQ ID NO: 946651 - RNA, 16 nt, Mycobacterium avium subsp. paratuberculosis
cggcgauggcccgcug

SEQ ID NO: 946652 - RNA, 17 nt, Mycobacterium avium subsp. paratuberculosis
cggcgauggcccgcugc

SEQ ID NO: 946653 - RNA, 20 nt, Mycobacterium avium subsp. paratuberculosis
cggcgauggcccgcugcgcc

SEQ ID NO: 946654 - RNA, 23 nt, Mycobacterium avium subsp. paratuberculosis
cggcgauggcccgcugcgccgac

SEQ ID NO: 946655 - RNA, 20 nt, Mycobacterium avium subsp. paratuberculosis
cggcgcaaccaacucgcgau

SEQ ID NO: 946656 - RNA, 21 nt, Mycobacterium avium subsp. paratuberculosis
cggcgcaaccaacucgcgaug

SEQ ID NO: 946657 - RNA, 22 nt, Mycobacterium avium subsp. paratuberculosis
cggcgcaacgggauggcucagc

SEQ ID NO: 946658 - RNA, 18 nt, Mycobacterium avium subsp. paratuberculosis
cggcgauuaggucggugg

SEQ ID NO: 946659 - RNA, 19 nt, Mycobacterium avium subsp. paratuberculosis
cggcgauuaggucgguggc

SEQ ID NO: 946660 - RNA, 20 nt, Mycobacterium avium subsp. paratuberculosis
cggcgauuaggucgguggcc

SEQ ID NO: 946661 - RNA, 22 nt, Mycobacterium avium subsp. paratuberculosis
cggcgauuaggucgguggccac

SEQ ID NO: 946662 - RNA, 19 nt, Mycobacterium avium subsp. paratuberculosis
cggcgaugcgcuccagcag

SEQ ID NO: 946663 - RNA, 18 nt, Mycobacterium avium subsp. paratuberculosis
cggcgaugcgcgccuccg

SEQ ID NO: 946664 - RNA, 14 nt, Mycobacterium avium subsp. paratuberculosis
cggcgaugcgcggc

SEQ ID NO: 946665 - RNA, 17 nt, Mycobacterium avium subsp. paratuberculosis
cggcgaugcgcggcccg

SEQ ID NO: 946666 - RNA, 18 nt, Mycobacterium avium subsp. paratuberculosis
cggcgauccacgccuccg

SEQ ID NO: 946667 - RNA, 15 nt, Mycobacterium avium subsp. paratuberculosis
cggcgaugcgccguc

SEQ ID NO: 946668 - RNA, 16 nt, Mycobacterium avium subsp. paratuberculosis
cggcgaugcgccgucu

SEQ ID NO: 946669 - RNA, 13 nt, Mycobacterium avium subsp. paratuberculosis
cggcgauccggcc

SEQ ID NO: 946670 - RNA, 15 nt, Mycobacterium avium subsp. paratuberculosis
cggcgauccggccgg

SEQ ID NO: 946671 - RNA, 20 nt, Mycobacterium avium subsp. paratuberculosis
cggcgauccggccggcggcg

SEQ ID NO: 946672 - RNA, 18 nt, Mycobacterium avium subsp. paratuberculosis
cggcgaugcgcaccauca

SEQ ID NO: 946673 - RNA, 22 nt, Mycobacterium avium subsp. paratuberculosis
cggcgaugcgcacgucggccgc

SEQ ID NO: 946674 - RNA, 14 nt, Mycobacterium avium subsp. paratuberculosis
cggcgauccgcgcg

SEQ ID NO: 946675 - RNA, 15 nt, Mycobacterium avium subsp. paratuberculosis
cggcgauccgcgcgg

SEQ ID NO: 946676 - RNA, 17 nt, Mycobacterium avium subsp. paratuberculosis
cggcgauccgcgcggcg

SEQ ID NO: 946677 - RNA, 19 nt, Mycobacterium avium subsp. paratuberculosis
cggcgauccgcgcggcgac

SEQ ID NO: 946678 - RNA, 14 nt, Mycobacterium avium subsp. paratuberculosis
cggcgaucaccgcc

SEQ ID NO: 946679 - RNA, 16 nt, Mycobacterium avium subsp. paratuberculosis
cggcgaucaccgccgc

SEQ ID NO: 946680 - RNA, 18 nt, Mycobacterium avium subsp. paratuberculosis
cggcgaucaccgccgcgg

SEQ ID NO: 946681 - RNA, 19 nt, Mycobacterium avium subsp. paratuberculosis
cggcgaucaccgccgcggc

SEQ ID NO: 946682 - RNA, 15 nt, Mycobacterium avium subsp. paratuberculosis
cggcgaucaccggga

SEQ ID NO: 946683 - RNA, 17 nt, Mycobacterium avium subsp. paratuberculosis
cggcgaucaccgggaca

SEQ ID NO: 946684 - RNA, 14 nt, Mycobacterium avium subsp. paratuberculosis
cggcgaucagcagc

SEQ ID NO: 946685 - RNA, 15 nt, Mycobacterium avium subsp. paratuberculosis
cggcgaucagcagca

SEQ ID NO: 946686 - RNA, 14 nt, Mycobacterium avium subsp. paratuberculosis
cggcgaucagcccg

SEQ ID NO: 946687 - RNA, 16 nt, Mycobacterium avium subsp. paratuberculosis
cggcgaucagcccggc

SEQ ID NO: 946688 - RNA, 17 nt, Mycobacterium avium subsp. paratuberculosis
cggcgaucagcccggcc

SEQ ID NO: 946689 - RNA, 23 nt, Mycobacterium avium subsp. paratuberculosis
cggcgaucagcccggcccgcauc

SEQ ID NO: 946690 - RNA, 23 nt, Mycobacterium avium subsp. paratuberculosis
cggcgaucagcuccuccugcggu

SEQ ID NO: 946691 - RNA, 14 nt, Mycobacterium avium subsp. paratuberculosis
cggcgaucagcugc

SEQ ID NO: 946692 - RNA, 20 nt, Mycobacterium avium subsp. paratuberculosis
cggcgaucagcugcccggag

SEQ ID NO: 946693 - RNA, 15 nt, Mycobacterium avium subsp. paratuberculosis
cggcgccucgaugcg

SEQ ID NO: 946694 - RNA, 14 nt, Mycobacterium avium subsp. paratuberculosis
cggcgccucggcgc

SEQ ID NO: 946695 - RNA, 15 nt, Mycobacterium avium subsp. paratuberculosis
cggcgccucggcgcc

SEQ ID NO: 946696 - RNA, 16 nt, Mycobacterium avium subsp. paratuberculosis
cggcgccucggcgccu

SEQ ID NO: 946697 - RNA, 19 nt, Mycobacterium avium subsp. paratuberculosis
cggcgccucggcgccucgg

SEQ ID NO: 946698 - RNA, 15 nt, Mycobacterium avium subsp. paratuberculosis
cggcgccucggcguc

SEQ ID NO: 946699 - RNA, 22 nt, Mycobacterium avium subsp. paratuberculosis
cggcgccguuucggacgagccg

SEQ ID NO: 946700 - RNA, 20 nt, Mycobacterium avium subsp. paratuberculosis
cggcgccgggcagcccgggu

SEQ ID NO: 946701 - RNA, 13 nt, Mycobacterium avium subsp. paratuberculosis
cggcgccgguggu

SEQ ID NO: 946702 - RNA, 20 nt, Mycobacterium avium subsp. paratuberculosis
cggcgccgggcggcccgccu

SEQ ID NO: 946703 - RNA, 13 nt, Mycobacterium avium subsp. paratuberculosis
cggcgccggcggc

SEQ ID NO: 946704 - RNA, 15 nt, Mycobacterium avium subsp. paratuberculosis
cggcgccggcggcca

SEQ ID NO: 946705 - RNA, 17 nt, Mycobacterium avium subsp. paratuberculosis
cggcgccggcggccacg

SEQ ID NO: 946706 - RNA, 13 nt, Mycobacterium avium subsp. paratuberculosis
cggcgccggguca

SEQ ID NO: 946707 - RNA, 23 nt, Mycobacterium avium subsp. paratuberculosis
cggcgccgggucaccggaugcac

SEQ ID NO: 946708 - RNA, 13 nt, Mycobacterium avium subsp. paratuberculosis
cggcgccgggucg

SEQ ID NO: 946709 - RNA, 12 nt, Mycobacterium avium subsp. paratuberculosis
cggcgccgguca

SEQ ID NO: 946710 - RNA, 17 nt, Mycobacterium avium subsp. paratuberculosis
cggcgccggucagcggc

SEQ ID NO: 946711 - RNA, 18 nt, Mycobacterium avium subsp. paratuberculosis
cggcgccggucagcggca

SEQ ID NO: 946712 - RNA, 19 nt, Mycobacterium avium subsp. paratuberculosis
cggcgccggucagcggcaa

SEQ ID NO: 946713 - RNA, 15 nt, Mycobacterium avium subsp. paratuberculosis
cggcgccggucguua

SEQ ID NO: 946714 - RNA, 14 nt, Mycobacterium avium subsp. paratuberculosis
cggcgccggugcag

SEQ ID NO: 946715 - RNA, 15 nt, Mycobacterium avium subsp. paratuberculosis
cggcgccggugcagu

SEQ ID NO: 946716 - RNA, 13 nt, Mycobacterium avium subsp. paratuberculosis
cggcgccggugcc

SEQ ID NO: 946717 - RNA, 14 nt, Mycobacterium avium subsp. paratuberculosis
cggcgccggugccg

SEQ ID NO: 946718 - RNA, 13 nt, Mycobacterium avium subsp. paratuberculosis
cggcgccggcgcg

SEQ ID NO: 946719 - RNA, 17 nt, Mycobacterium avium subsp. paratuberculosis
cggcgccggccgucacg

SEQ ID NO: 946720 - RNA, 13 nt, Mycobacterium avium subsp. paratuberculosis
cggcgccgcagca

SEQ ID NO: 946721 - RNA, 14 nt, Mycobacterium avium subsp. paratuberculosis
cggcgccgccacca

SEQ ID NO: 946722 - RNA, 15 nt, Mycobacterium avium subsp. paratuberculosis
cggcgccgccaccac

SEQ ID NO: 946723 - RNA, 18 nt, Mycobacterium avium subsp. paratuberculosis
cggcgccgaucugcucgg

SEQ ID NO: 946724 - RNA, 18 nt, Mycobacterium avium subsp. paratuberculosis
cggcgccgaugcagcaca

SEQ ID NO: 946725 - RNA, 17 nt, Mycobacterium avium subsp. paratuberculosis
cggcgccgaucacgccg

SEQ ID NO: 946726 - RNA, 21 nt, Mycobacterium avium subsp. paratuberculosis
cggcgccgaucacgccggugg

SEQ ID NO: 946727 - RNA, 18 nt, Mycobacterium avium subsp. paratuberculosis
cggcgccgauggcgaagc

SEQ ID NO: 946728 - RNA, 18 nt, Mycobacterium avium subsp. paratuberculosis
cggcgccgauuccgucgg

SEQ ID NO: 946729 - RNA, 21 nt, Mycobacterium avium subsp. paratuberculosis
cggcgccgauuccgucggugg

SEQ ID NO: 946730 - RNA, 15 nt, Mycobacterium avium subsp. paratuberculosis
cggcgccgagcguca

SEQ ID NO: 946731 - RNA, 16 nt, Mycobacterium avium subsp. paratuberculosis
cggcgccgagcgucac

SEQ ID NO: 946732 - RNA, 19 nt, Mycobacterium avium subsp. paratuberculosis
cggcgccgagcgucacgcu

SEQ ID NO: 946733 - RNA, 17 nt, Mycobacterium avium subsp. paratuberculosis
cggcgccgaagcccgca

SEQ ID NO: 946734 - RNA, 14 nt, Mycobacterium avium subsp. paratuberculosis
cggcgccgaagccg

SEQ ID NO: 946735 - RNA, 15 nt, Mycobacterium avium subsp. paratuberculosis
cggcgccgaagccgu

SEQ ID NO: 946736 - RNA, 18 nt, Mycobacterium avium subsp. paratuberculosis
cggcgccgaagccgucga

SEQ ID NO: 946737 - RNA, 13 nt, Mycobacterium avium subsp. paratuberculosis
cggcgccgacggc

SEQ ID NO: 946738 - RNA, 17 nt, Mycobacterium avium subsp. paratuberculosis
cggcgccgacggccagc

SEQ ID NO: 946739 - RNA, 20 nt, Mycobacterium avium subsp. paratuberculosis
cggcgccgacggccagcagg

SEQ ID NO: 946740 - RNA, 16 nt, Mycobacterium avium subsp. paratuberculosis
cggcgccgacguccug

SEQ ID NO: 946741 - RNA, 15 nt, Mycobacterium avium subsp. paratuberculosis
cggcgccgagcacga

SEQ ID NO: 946742 - RNA, 21 nt, Mycobacterium avium subsp. paratuberculosis
cggcgccgaccaggcucgcga

SEQ ID NO: 946743 - RNA, 19 nt, Mycobacterium avium subsp. paratuberculosis
cggcgccgacccccgccgc

SEQ ID NO: 946744 - RNA, 22 nt, Mycobacterium avium subsp. paratuberculosis
cggcgccgacccccgccgcguc

SEQ ID NO: 946745 - RNA, 18 nt, Mycobacterium avium subsp. paratuberculosis
cggcgccgaccgagggcg

SEQ ID NO: 946746 - RNA, 15 nt, Mycobacterium avium subsp. paratuberculosis
cggcgccgaccucgg

SEQ ID NO: 946747 - RNA, 23 nt, Mycobacterium avium subsp. paratuberculosis
cggcgccgaccucggccagcgug

SEQ ID NO: 946748 - RNA, 14 nt, Mycobacterium avium subsp. paratuberculosis
cggcgccgacgacg

SEQ ID NO: 946749 - RNA, 20 nt, Mycobacterium avium subsp. paratuberculosis
cggcgccgaaaaacgcgacg

SEQ ID NO: 946750 - RNA, 22 nt, Mycobacterium avium subsp. paratuberculosis
cggcgccgaaaaacgcgacggc

SEQ ID NO: 946751 - RNA, 14 nt, Mycobacterium avium subsp. paratuberculosis
cggcgccgaaccgg

SEQ ID NO: 946752 - RNA, 20 nt, Mycobacterium avium subsp. paratuberculosis
cggcgccgaacucggcgccg

SEQ ID NO: 946753 - RNA, 21 nt, Mycobacterium avium subsp. paratuberculosis
cggcgccgaacucggcgccgc

SEQ ID NO: 946754 - RNA, 23 nt, Mycobacterium avium subsp. paratuberculosis
cggcgcccugcgcgcccugcugg

SEQ ID NO: 946755 - RNA, 17 nt, Mycobacterium avium subsp. paratuberculosis
cggcgcccuucccgguc

SEQ ID NO: 946756 - RNA, 13 nt, Mycobacterium avium subsp. paratuberculosis
cggcgcccugcga

SEQ ID NO: 946757 - RNA, 14 nt, Mycobacterium avium subsp. paratuberculosis
cggcgcccugcacc

SEQ ID NO: 946758 - RNA, 17 nt, Mycobacterium avium subsp. paratuberculosis
cggcgcccugcacccag

SEQ ID NO: 946759 - RNA, 19 nt, Mycobacterium avium subsp. paratuberculosis
cggcgcccugcacccagcc

SEQ ID NO: 946760 - RNA, 20 nt, Mycobacterium avium subsp. paratuberculosis
cggcgcccugcacccagccg

SEQ ID NO: 946761 - RNA, 14 nt, Mycobacterium avium subsp. paratuberculosis
cggcgcccucgccg

SEQ ID NO: 946762 - RNA, 19 nt, Mycobacterium avium subsp. paratuberculosis
cggcgcccucgccgaccug

SEQ ID NO: 946763 - RNA, 20 nt, Mycobacterium avium subsp. paratuberculosis
cggcgcccucgccgaccugu

SEQ ID NO: 946764 - RNA, 21 nt, Mycobacterium avium subsp. paratuberculosis
cggcgcccucgccggcggcgc

SEQ ID NO: 946765 - RNA, 14 nt, Mycobacterium avium subsp. paratuberculosis
cggcgccagcggcc

SEQ ID NO: 946766 - RNA, 15 nt, Mycobacterium avium subsp. paratuberculosis
cggcgccagcggccg

SEQ ID NO: 946767 - RNA, 19 nt, Mycobacterium avium subsp. paratuberculosis
cggcgccagcggccgauca

SEQ ID NO: 946768 - RNA, 13 nt, Mycobacterium avium subsp. paratuberculosis
cggcgccagcccg

SEQ ID NO: 946769 - RNA, 19 nt, Mycobacterium avium subsp. paratuberculosis
cggcgccagcccgccgaac

SEQ ID NO: 946770 - RNA, 22 nt, Mycobacterium avium subsp. paratuberculosis
cggcgccagcccggugaucgcc

SEQ ID NO: 946771 - RNA, 13 nt, Mycobacterium avium subsp. paratuberculosis
cggcgccagccgc

SEQ ID NO: 946772 - RNA, 15 nt, Mycobacterium avium subsp. paratuberculosis
cggcgccaccggcug

SEQ ID NO: 946773 - RNA, 14 nt, Mycobacterium avium subsp. paratuberculosis
cggcgccaccggga

SEQ ID NO: 946774 - RNA, 17 nt, Mycobacterium avium subsp. paratuberculosis
cggcgccacgaccagcg

SEQ ID NO: 946775 - RNA, 18 nt, Mycobacterium avium subsp. paratuberculosis
cggcgccacgaccagcgg

SEQ ID NO: 946776 - RNA, 19 nt, Mycobacterium avium subsp. paratuberculosis
cggcgccacgaccagcggc

SEQ ID NO: 946777 - RNA, 20 nt, Mycobacterium avium subsp. paratuberculosis
cggcgccacgaccagcggca

SEQ ID NO: 946778 - RNA, 22 nt, Mycobacterium avium subsp. paratuberculosis
cggcgccacgaccagcggcagc

SEQ ID NO: 946779 - RNA, 15 nt, Mycobacterium avium subsp. paratuberculosis
cggcgccacgacugc

SEQ ID NO: 946780 - RNA, 19 nt, Mycobacterium avium subsp. paratuberculosis
cggcgccacgacugcgcgg

SEQ ID NO: 946781 - RNA, 20 nt, Mycobacterium avium subsp. paratuberculosis
cggcgccacgacugcgcggc

SEQ ID NO: 946782 - RNA, 22 nt, Mycobacterium avium subsp. paratuberculosis
cggcgccacgacugcgcggccg

SEQ ID NO: 946783 - RNA, 17 nt, Mycobacterium avium subsp. paratuberculosis
cggcgccacgcacaccg

SEQ ID NO: 946784 - RNA, 20 nt, Mycobacterium avium subsp. paratuberculosis
cggcgccacgcacaccgcgc

SEQ ID NO: 946785 - RNA, 12 nt, Mycobacterium avium subsp. paratuberculosis
cggcgccacgcc

SEQ ID NO: 946786 - RNA, 16 nt, Mycobacterium avium subsp. paratuberculosis
cggcgccacgccgcga

SEQ ID NO: 946787 - RNA, 18 nt, Mycobacterium avium subsp. paratuberculosis
cggcgccacgccgcgauc

SEQ ID NO: 946788 - RNA, 19 nt, Mycobacterium avium subsp. paratuberculosis
cggcgccacgccgcgaucc

SEQ ID NO: 946789 - RNA, 13 nt, Mycobacterium avium subsp. paratuberculosis
cggcgccacgugg

SEQ ID NO: 946790 - RNA, 17 nt, Mycobacterium avium subsp. paratuberculosis
cggcgccacguggucga

SEQ ID NO: 946791 - RNA, 21 nt, Mycobacterium avium subsp. paratuberculosis
cggcgagaucccugcgcucag

SEQ ID NO: 946792 - RNA, 19 nt, Mycobacterium avium subsp. paratuberculosis
cggcgagauuggccucggc

SEQ ID NO: 946793 - RNA, 20 nt, Mycobacterium avium subsp. paratuberculosis
cggcgagauuggccucggcg

SEQ ID NO: 946794 - RNA, 21 nt, Mycobacterium avium subsp. paratuberculosis
cggcgagauuggccucggcgc

SEQ ID NO: 946795 - RNA, 22 nt, Mycobacterium avium subsp. paratuberculosis
cggcgagauuggccucggcgcg

SEQ ID NO: 946796 - RNA, 20 nt, Mycobacterium avium subsp. paratuberculosis
cggcgagaucuucuccccgc

SEQ ID NO: 946797 - RNA, 21 nt, Mycobacterium avium subsp. paratuberculosis
cggcgagaucuucuccccgcc

SEQ ID NO: 946798 - RNA, 15 nt, Mycobacterium avium subsp. paratuberculosis
cggcgacuccagcag

SEQ ID NO: 946799 - RNA, 18 nt, Mycobacterium avium subsp. paratuberculosis
cggcgagccgggccgggu

SEQ ID NO: 946800 - RNA, 13 nt, Mycobacterium avium subsp. paratuberculosis
cggcgagccgcuc

SEQ ID NO: 946801 - RNA, 14 nt, Mycobacterium avium subsp. paratuberculosis
cggcgagccggccg

SEQ ID NO: 946802 - RNA, 15 nt, Mycobacterium avium subsp. paratuberculosis
cggcgagccggccgu

SEQ ID NO: 946803 - RNA, 16 nt, Mycobacterium avium subsp. paratuberculosis
cggcgagccggccgua

SEQ ID NO: 946804 - RNA, 15 nt, Mycobacterium avium subsp. paratuberculosis
cggcgagcgacgcca

SEQ ID NO: 946805 - RNA, 16 nt, Mycobacterium avium subsp. paratuberculosis
cggcgagcgacgccac

SEQ ID NO: 946806 - RNA, 17 nt, Mycobacterium avium subsp. paratuberculosis
cggcgagcgacgccacg

SEQ ID NO: 946807 - RNA, 17 nt, Mycobacterium avium subsp. paratuberculosis
cggcgagcagcugcagc

SEQ ID NO: 946808 - RNA, 20 nt, Mycobacterium avium subsp. paratuberculosis
cggcgagcagcugcagcguc

SEQ ID NO: 946809 - RNA, 21 nt, Mycobacterium avium subsp. paratuberculosis
cggcgagcagcugcagcgucg

SEQ ID NO: 946810 - RNA, 17 nt, Mycobacterium avium subsp. paratuberculosis
cggcgagcagcagcgcg

SEQ ID NO: 946811 - RNA, 18 nt, Mycobacterium avium subsp. paratuberculosis
cggcgagcagcagcgcgg

SEQ ID NO: 946812 - RNA, 19 nt, Mycobacterium avium subsp. paratuberculosis
cggcgagcagcagcgcggu

SEQ ID NO: 946813 - RNA, 13 nt, Mycobacterium avium subsp. paratuberculosis
cggcgagcagccc

SEQ ID NO: 946814 - RNA, 16 nt, Mycobacterium avium subsp. paratuberculosis
cggcgagcagcccggc

SEQ ID NO: 946815 - RNA, 17 nt, Mycobacterium avium subsp. paratuberculosis
cggcgagcagccgcgcc

SEQ ID NO: 946816 - RNA, 13 nt, Mycobacterium avium subsp. paratuberculosis
cggcgagcagcgc

SEQ ID NO: 946817 - RNA, 18 nt, Mycobacterium avium subsp. paratuberculosis
cggcgagcagcgcgaugc

SEQ ID NO: 946818 - RNA, 19 nt, Mycobacterium avium subsp. paratuberculosis
cggcgagcagcgcgaugcc

SEQ ID NO: 946819 - RNA, 14 nt, Mycobacterium avium subsp. paratuberculosis
cggcgagcaccgug

SEQ ID NO: 946820 - RNA, 17 nt, Mycobacterium avium subsp. paratuberculosis
cggcgagcaccgugccg

SEQ ID NO: 946821 - RNA, 20 nt, Mycobacterium avium subsp. paratuberculosis
cggcgagcaccgugccgucg

SEQ ID NO: 946822 - RNA, 18 nt, Mycobacterium avium subsp. paratuberculosis
cggcgagcacgccgccgg

SEQ ID NO: 946823 - RNA, 17 nt, Mycobacterium avium subsp. paratuberculosis
cggcgagcaaggcgagc

SEQ ID NO: 946824 - RNA, 23 nt, Mycobacterium avium subsp. paratuberculosis
cggcgagcaaggcgagcacggca

SEQ ID NO: 946825 - RNA, 18 nt, Mycobacterium avium subsp. paratuberculosis
cggcgaguucggcggccc

SEQ ID NO: 946826 - RNA, 19 nt, Mycobacterium avium subsp. paratuberculosis
cggcgaguucggcggcccg

SEQ ID NO: 946827 - RNA, 21 nt, Mycobacterium avium subsp. paratuberculosis
cggcgaguucggcggcccgcu

SEQ ID NO: 946828 - RNA, 20 nt, Mycobacterium avium subsp. paratuberculosis
cggcgaguucugguaggcgg

SEQ ID NO: 946829 - RNA, 23 nt, Mycobacterium avium subsp. paratuberculosis
cggcgaguucugguaggcggccg

SEQ ID NO: 946830 - RNA, 16 nt, Mycobacterium avium subsp. paratuberculosis
cggcgauaggcggcca

SEQ ID NO: 946831 - RNA, 19 nt, Mycobacterium avium subsp. paratuberculosis
cggcgauaggcggccagcu

SEQ ID NO: 946832 - RNA, 20 nt, Mycobacterium avium subsp. paratuberculosis
cggcgauaggcggccagcuc

SEQ ID NO: 946833 - RNA, 17 nt, Mycobacterium avium subsp. paratuberculosis
cggcgauacccgggagc

SEQ ID NO: 946834 - RNA, 19 nt, Mycobacterium avium subsp. paratuberculosis
cggcgaggcggucggcgga

SEQ ID NO: 946835 - RNA, 15 nt, Mycobacterium avium subsp. paratuberculosis
cggcgaggugcgcca

SEQ ID NO: 946836 - RNA, 16 nt, Mycobacterium avium subsp. paratuberculosis
cggcgaggugggcacc

SEQ ID NO: 946837 - RNA, 18 nt, Mycobacterium avium subsp. paratuberculosis
cggcgagguagaccgccg

SEQ ID NO: 946838 - RNA, 15 nt, Mycobacterium avium subsp. paratuberculosis
cggcgaggucgucga

SEQ ID NO: 946839 - RNA, 15 nt, Mycobacterium avium subsp. paratuberculosis
cggcgaggucguucg

SEQ ID NO: 946840 - RNA, 19 nt, Mycobacterium avium subsp. paratuberculosis
cggcgaggugaaccgcgac

SEQ ID NO: 946841 - RNA, 16 nt, Mycobacterium avium subsp. paratuberculosis
cggcgaguacccgccg

SEQ ID NO: 946842 - RNA, 17 nt, Mycobacterium avium subsp. paratuberculosis
cggcgaguacccgccgc

SEQ ID NO: 946843 - RNA, 18 nt, Mycobacterium avium subsp. paratuberculosis
cggcgaguacccgccgca

SEQ ID NO: 946844 - RNA, 20 nt, Mycobacterium avium subsp. paratuberculosis
cggcgaguacccgccgcacc

SEQ ID NO: 946845 - RNA, 21 nt, Mycobacterium avium subsp. paratuberculosis
cggcgaguacccgccgcaccu

SEQ ID NO: 946846 - RNA, 16 nt, Mycobacterium avium subsp. paratuberculosis
cggcgagucccggcgc

SEQ ID NO: 946847 - RNA, 17 nt, Mycobacterium avium subsp. paratuberculosis
cggcgagucccggcgca

SEQ ID NO: 946848 - RNA, 18 nt, Mycobacterium avium subsp. paratuberculosis
cggcgagucccggcgcac

SEQ ID NO: 946849 - RNA, 19 nt, Mycobacterium avium subsp. paratuberculosis
cggcgagucccggcgcacc

SEQ ID NO: 946850 - RNA, 16 nt, Mycobacterium avium subsp. paratuberculosis
cggcgaguccggccag

SEQ ID NO: 946851 - RNA, 20 nt, Mycobacterium avium subsp. paratuberculosis
cggcgagucgcggaucauga

SEQ ID NO: 946852 - RNA, 20 nt, Mycobacterium avium subsp. paratuberculosis
cggcgagugaggccgaggcg

SEQ ID NO: 946853 - RNA, 15 nt, Mycobacterium avium subsp. paratuberculosis
cggcgagugcaccuu

SEQ ID NO: 946854 - RNA, 21 nt, Mycobacterium avium subsp. paratuberculosis
cggcgaguucgaccuccaccc

SEQ ID NO: 946855 - RNA, 22 nt, Mycobacterium avium subsp. paratuberculosis
cggcgaguucgaccuccacccg

SEQ ID NO: 946856 - RNA, 14 nt, Mycobacterium avium subsp. paratuberculosis
cggcgaggauggcg

SEQ ID NO: 946857 - RNA, 18 nt, Mycobacterium avium subsp. paratuberculosis
cggcgaggauggcgauca

SEQ ID NO: 946858 - RNA, 14 nt, Mycobacterium avium subsp. paratuberculosis
cggcgaggccaggc

SEQ ID NO: 946859 - RNA, 15 nt, Mycobacterium avium subsp. paratuberculosis
cggcgaggccaggcg

SEQ ID NO: 946860 - RNA, 14 nt, Mycobacterium avium subsp. paratuberculosis
cggcgagcgcgcug

SEQ ID NO: 946861 - RNA, 15 nt, Mycobacterium avium subsp. paratuberculosis
cggcgaggacgucgu

SEQ ID NO: 946862 - RNA, 19 nt, Mycobacterium avium subsp. paratuberculosis
cggcgaggaucgcgauguc

SEQ ID NO: 946863 - RNA, 12 nt, Mycobacterium avium subsp. paratuberculosis
cggcgaggcggu

SEQ ID NO: 946864 - RNA, 18 nt, Mycobacterium avium subsp. paratuberculosis
cggcgaggaacucagcgc

SEQ ID NO: 946865 - RNA, 21 nt, Mycobacterium avium subsp. paratuberculosis
cggcgaggaacucagcgccca

SEQ ID NO: 946866 - RNA, 15 nt, Mycobacterium avium subsp. paratuberculosis
cggcgagcuuggcgg

SEQ ID NO: 946867 - RNA, 17 nt, Mycobacterium avium subsp. paratuberculosis
cggcgagcugaucggcg

SEQ ID NO: 946868 - RNA, 19 nt, Mycobacterium avium subsp. paratuberculosis
cggcgagcugaucggcguu

SEQ ID NO: 946869 - RNA, 23 nt, Mycobacterium avium subsp. paratuberculosis
cggcgagcugaucggcguuggcg

SEQ ID NO: 946870 - RNA, 16 nt, Mycobacterium avium subsp. paratuberculosis
cggcgagccgggaccg

SEQ ID NO: 946871 - RNA, 14 nt, Mycobacterium avium subsp. paratuberculosis
cggcgagcgguucg

SEQ ID NO: 946872 - RNA, 15 nt, Mycobacterium avium subsp. paratuberculosis
cggcgagcgguucga

SEQ ID NO: 946873 - RNA, 15 nt, Mycobacterium avium subsp. paratuberculosis
cggcgagcucgcggc

SEQ ID NO: 946874 - RNA, 16 nt, Mycobacterium avium subsp. paratuberculosis
cggcgagcucgcggcc

SEQ ID NO: 946875 - RNA, 12 nt, Mycobacterium avium subsp. paratuberculosis
cggcgagcgcgu

SEQ ID NO: 946876 - RNA, 14 nt, Mycobacterium avium subsp. paratuberculosis
cggcgagcgcgugc

SEQ ID NO: 946877 - RNA, 15 nt, Mycobacterium avium subsp. paratuberculosis
cggcgagcgcgugca

SEQ ID NO: 946878 - RNA, 20 nt, Mycobacterium avium subsp. paratuberculosis
cggcgagcgcguucuccacc

SEQ ID NO: 946879 - RNA, 22 nt, Mycobacterium avium subsp. paratuberculosis
cggcgagcgcguucuccaccgc

SEQ ID NO: 946880 - RNA, 17 nt, Mycobacterium avium subsp. paratuberculosis
cggcgagcgcuucggga

SEQ ID NO: 946881 - RNA, 20 nt, Mycobacterium avium subsp. paratuberculosis
cggcgagcgcuucgggagca

SEQ ID NO: 946882 - RNA, 23 nt, Mycobacterium avium subsp. paratuberculosis
cggcgagcggcccugcgcggccu

SEQ ID NO: 946883 - RNA, 22 nt, Mycobacterium avium subsp. paratuberculosis
cggcgacggcgucggcggccug

SEQ ID NO: 946884 - RNA, 16 nt, Mycobacterium avium subsp. paratuberculosis
cggcgacggcgucggc

SEQ ID NO: 946885 - RNA, 14 nt, Mycobacterium avium subsp. paratuberculosis
cggcgacggcgguu

SEQ ID NO: 946886 - RNA, 16 nt, Mycobacterium avium subsp. paratuberculosis
cggcgacggcgguucg

SEQ ID NO: 946887 - RNA, 17 nt, Mycobacterium avium subsp. paratuberculosis
cggcgacggcgguucga

SEQ ID NO: 946888 - RNA, 12 nt, Mycobacterium avium subsp. paratuberculosis
cggcgacggcgu

SEQ ID NO: 946889 - RNA, 13 nt, Mycobacterium avium subsp. paratuberculosis
cggcgacggcguc

SEQ ID NO: 946890 - RNA, 16 nt, Mycobacterium avium subsp. paratuberculosis
cggcgacggcguccag

SEQ ID NO: 946891 - RNA, 16 nt, Mycobacterium avium subsp. paratuberculosis
cggcgacggcguccgg

SEQ ID NO: 946892 - RNA, 18 nt, Mycobacterium avium subsp. paratuberculosis
cggcgacggcguccgggc

SEQ ID NO: 946893 - RNA, 19 nt, Mycobacterium avium subsp. paratuberculosis
cggcgacggcguccgggcg

SEQ ID NO: 946894 - RNA, 20 nt, Mycobacterium avium subsp. paratuberculosis
cggcgacggcgcucaccggc

SEQ ID NO: 946895 - RNA, 21 nt, Mycobacterium avium subsp. paratuberculosis
cggcgacggcgcucaccggcg

SEQ ID NO: 946896 - RNA, 14 nt, Mycobacterium avium subsp. paratuberculosis
cggcgacggcggcc

SEQ ID NO: 946897 - RNA, 17 nt, Mycobacterium avium subsp. paratuberculosis
cggcgacggcggccguc

SEQ ID NO: 946898 - RNA, 22 nt, Mycobacterium avium subsp. paratuberculosis
cggcgacggcggggugcgcggc

SEQ ID NO: 946899 - RNA, 13 nt, Mycobacterium avium subsp. paratuberculosis
cggcgacgcuggu

SEQ ID NO: 946900 - RNA, 14 nt, Mycobacterium avium subsp. paratuberculosis
cggcgacgcuggug

SEQ ID NO: 946901 - RNA, 14 nt, Mycobacterium avium subsp. paratuberculosis
cggcgacggccguc

SEQ ID NO: 946902 - RNA, 15 nt, Mycobacterium avium subsp. paratuberculosis
cggcgacggccgucc

SEQ ID NO: 946903 - RNA, 16 nt, Mycobacterium avium subsp. paratuberculosis
cggcgacggccguccg

SEQ ID NO: 946904 - RNA, 15 nt, Mycobacterium avium subsp. paratuberculosis
cggcgacggcgacca

SEQ ID NO: 946905 - RNA, 17 nt, Mycobacterium avium subsp. paratuberculosis
cggcgacggcgaccaca

SEQ ID NO: 946906 - RNA, 14 nt, Mycobacterium avium subsp. paratuberculosis
cggcgacggcgacg

SEQ ID NO: 946907 - RNA, 15 nt, Mycobacterium avium subsp. paratuberculosis
cggcgacggcgacgg

SEQ ID NO: 946908 - RNA, 12 nt, Mycobacterium avium subsp. paratuberculosis
cggcgacggugg

SEQ ID NO: 946909 - RNA, 21 nt, Mycobacterium avium subsp. paratuberculosis
cggcgacgguggcgcccagcg

SEQ ID NO: 946910 - RNA, 23 nt, Mycobacterium avium subsp. paratuberculosis
cggcgacgguggcgcccagcgag

SEQ ID NO: 946911 - RNA, 15 nt, Mycobacterium avium subsp. paratuberculosis
cggcgacgguggcgg

SEQ ID NO: 946912 - RNA, 16 nt, Mycobacterium avium subsp. paratuberculosis
cggcgacgguguccgc

SEQ ID NO: 946913 - RNA, 17 nt, Mycobacterium avium subsp. paratuberculosis
cggcgacguacagcgag

SEQ ID NO: 946914 - RNA, 20 nt, Mycobacterium avium subsp. paratuberculosis
cggcgacguacagcgagccg

SEQ ID NO: 946915 - RNA, 22 nt, Mycobacterium avium subsp. paratuberculosis
cggcgacguacagcgagccguc

SEQ ID NO: 946916 - RNA, 21 nt, Mycobacterium avium subsp. paratuberculosis
cggcgacguccuugaucagca

SEQ ID NO: 946917 - RNA, 14 nt, Mycobacterium avium subsp. paratuberculosis
cggcgacgucgacg

SEQ ID NO: 946918 - RNA, 16 nt, Mycobacterium avium subsp. paratuberculosis
cggcgacgucgacggc

SEQ ID NO: 946919 - RNA, 18 nt, Mycobacterium avium subsp. paratuberculosis
cggcgacgucgacggcag

SEQ ID NO: 946920 - RNA, 14 nt, Mycobacterium avium subsp. paratuberculosis
cggcgacgucgccg

SEQ ID NO: 946921 - RNA, 15 nt, Mycobacterium avium subsp. paratuberculosis
cggcgacgucgccgg

SEQ ID NO: 946922 - RNA, 16 nt, Mycobacterium avium subsp. paratuberculosis
cggcgacgucgccggc

SEQ ID NO: 946923 - RNA, 21 nt, Mycobacterium avium subsp. paratuberculosis
cggcgacgucgccggccugcc

SEQ ID NO: 946924 - RNA, 14 nt, Mycobacterium avium subsp. paratuberculosis
cggcgacgucgucg

SEQ ID NO: 946925 - RNA, 18 nt, Mycobacterium avium subsp. paratuberculosis
cggcgacgucgucgaugc

SEQ ID NO: 946926 - RNA, 14 nt, Mycobacterium avium subsp. paratuberculosis
cggcgacgucgugc

SEQ ID NO: 946927 - RNA, 18 nt, Mycobacterium avium subsp. paratuberculosis
cggcgacgucgugcacgc

SEQ ID NO: 946928 - RNA, 20 nt, Mycobacterium avium subsp. paratuberculosis
cggcgacgucguggcccgga

SEQ ID NO: 946929 - RNA, 21 nt, Mycobacterium avium subsp. paratuberculosis
cggcgacgucguggcccggau

SEQ ID NO: 946930 - RNA, 14 nt, Mycobacterium avium subsp. paratuberculosis
cggcgacgugaucg

SEQ ID NO: 946931 - RNA, 19 nt, Mycobacterium avium subsp. paratuberculosis
cggcgacgugaucggcggc

SEQ ID NO: 946932 - RNA, 20 nt, Mycobacterium avium subsp. paratuberculosis
cggcgacgugaucggcggcc

SEQ ID NO: 946933 - RNA, 22 nt, Mycobacterium avium subsp. paratuberculosis
cggcgacgugaucggcggccug

SEQ ID NO: 946934 - RNA, 20 nt, Mycobacterium avium subsp. paratuberculosis
cggcgacgugauggucgucg

SEQ ID NO: 946935 - RNA, 21 nt, Mycobacterium avium subsp. paratuberculosis
cggcgacgugauggucgucgu

SEQ ID NO: 946936 - RNA, 14 nt, Mycobacterium avium subsp. paratuberculosis
cggcgacgugccgg

SEQ ID NO: 946937 - RNA, 15 nt, Mycobacterium avium subsp. paratuberculosis
cggcgacgugccggc

SEQ ID NO: 946938 - RNA, 16 nt, Mycobacterium avium subsp. paratuberculosis
cggcgacgugccggcg

SEQ ID NO: 946939 - RNA, 17 nt, Mycobacterium avium subsp. paratuberculosis
cggcgacgugccggcgg

SEQ ID NO: 946940 - RNA, 18 nt, Mycobacterium avium subsp. paratuberculosis
cggcgacgugccggcggc

SEQ ID NO: 946941 - RNA, 20 nt, Mycobacterium avium subsp. paratuberculosis
cggcgacgugccggcggcag

SEQ ID NO: 946942 - RNA, 21 nt, Mycobacterium avium subsp. paratuberculosis
cggcgacgugccggcggcagg

SEQ ID NO: 946943 - RNA, 17 nt, Mycobacterium avium subsp. paratuberculosis
cggcgacgccggcgagg

SEQ ID NO: 946944 - RNA, 13 nt, Mycobacterium avium subsp. paratuberculosis
cggcgacgccguc

SEQ ID NO: 946945 - RNA, 14 nt, Mycobacterium avium subsp. paratuberculosis
cggcgacgccgucg

SEQ ID NO: 946946 - RNA, 15 nt, Mycobacterium avium subsp. paratuberculosis
cggcgacgccgucgg

SEQ ID NO: 946947 - RNA, 12 nt, Mycobacterium avium subsp. paratuberculosis
cggcgacgccgc

SEQ ID NO: 946948 - RNA, 13 nt, Mycobacterium avium subsp. paratuberculosis
cggcgacgccgcc

SEQ ID NO: 946949 - RNA, 14 nt, Mycobacterium avium subsp. paratuberculosis
cggcgacgccgccg

SEQ ID NO: 946950 - RNA, 15 nt, Mycobacterium avium subsp. paratuberculosis
cggcgacgccgccgu

SEQ ID NO: 946951 - RNA, 16 nt, Mycobacterium avium subsp. paratuberculosis
cggcgacgccgcgcug

SEQ ID NO: 946952 - RNA, 17 nt, Mycobacterium avium subsp. paratuberculosis
cggcgacgccgcgcugg

SEQ ID NO: 946953 - RNA, 13 nt, Mycobacterium avium subsp. paratuberculosis
cggcgacgcggcg

SEQ ID NO: 946954 - RNA, 15 nt, Mycobacterium avium subsp. paratuberculosis
cggcgacgcggcggg

SEQ ID NO: 946955 - RNA, 18 nt, Mycobacterium avium subsp. paratuberculosis
cggcgacggcaccgccgg

SEQ ID NO: 946956 - RNA, 12 nt, Mycobacterium avium subsp. paratuberculosis
cggcgacggcag

SEQ ID NO: 946957 - RNA, 14 nt, Mycobacterium avium subsp. paratuberculosis
cggcgacggcagcg

SEQ ID NO: 946958 - RNA, 15 nt, Mycobacterium avium subsp. paratuberculosis
cggcgacggcagcgc

SEQ ID NO: 946959 - RNA, 12 nt, Mycobacterium avium subsp. paratuberculosis
cggcgacggcca

SEQ ID NO: 946960 - RNA, 14 nt, Mycobacterium avium subsp. paratuberculosis
cggcgacggccaga

SEQ ID NO: 946961 - RNA, 18 nt, Mycobacterium avium subsp. paratuberculosis
cggcgacggccagcgcgg

SEQ ID NO: 946962 - RNA, 19 nt, Mycobacterium avium subsp. paratuberculosis
cggcgacggccagcgcggc

SEQ ID NO: 946963 - RNA, 21 nt, Mycobacterium avium subsp. paratuberculosis
cggcgacggccagcgcggcgg

SEQ ID NO: 946964 - RNA, 17 nt, Mycobacterium avium subsp. paratuberculosis
cggcgacgaugcggccg

SEQ ID NO: 946965 - RNA, 14 nt, Mycobacterium avium subsp. paratuberculosis
cggcgacgaucggc

SEQ ID NO: 946966 - RNA, 21 nt, Mycobacterium avium subsp. paratuberculosis
cggcgacgauaucggccgcgg

SEQ ID NO: 946967 - RNA, 18 nt, Mycobacterium avium subsp. paratuberculosis
cggcgaccggggcgguga

SEQ ID NO: 946968 - RNA, 20 nt, Mycobacterium avium subsp. paratuberculosis
cggcgaccggggcggugacc

SEQ ID NO: 946969 - RNA, 14 nt, Mycobacterium avium subsp. paratuberculosis
cggcgaccgugccc

SEQ ID NO: 946970 - RNA, 20 nt, Mycobacterium avium subsp. paratuberculosis
cggcgaccgugcccaccagc

SEQ ID NO: 946971 - RNA, 22 nt, Mycobacterium avium subsp. paratuberculosis
cggcgaccgugcccaccagccg

SEQ ID NO: 946972 - RNA, 20 nt, Mycobacterium avium subsp. paratuberculosis
cggcgaccgccuugucggcg

SEQ ID NO: 946973 - RNA, 21 nt, Mycobacterium avium subsp. paratuberculosis
cggcgaccgccuugucggcga

SEQ ID NO: 946974 - RNA, 14 nt, Mycobacterium avium subsp. paratuberculosis
cggcgaccgcgacg

SEQ ID NO: 946975 - RNA, 16 nt, Mycobacterium avium subsp. paratuberculosis
cggcgaccgcgcgcgg

SEQ ID NO: 946976 - RNA, 21 nt, Mycobacterium avium subsp. paratuberculosis
cggcgaccgcgcgcggcgccg

SEQ ID NO: 946977 - RNA, 22 nt, Mycobacterium avium subsp. paratuberculosis
cggcgaccgcgcgcggcgccgc

SEQ ID NO: 946978 - RNA, 21 nt, Mycobacterium avium subsp. paratuberculosis
cggcgaccucggggaugucga

SEQ ID NO: 946979 - RNA, 16 nt, Mycobacterium avium subsp. paratuberculosis
cggcgaccucuaacgu

SEQ ID NO: 946980 - RNA, 16 nt, Mycobacterium avium subsp. paratuberculosis
cggcgaccugcggcuc

SEQ ID NO: 946981 - RNA, 17 nt, Mycobacterium avium subsp. paratuberculosis
cggcgaccugcggcucg

SEQ ID NO: 946982 - RNA, 19 nt, Mycobacterium avium subsp. paratuberculosis
cggcgaccuugcggcgcga

SEQ ID NO: 946983 - RNA, 22 nt, Mycobacterium avium subsp. paratuberculosis
cggcgacgaaauugggcugggu

SEQ ID NO: 946984 - RNA, 23 nt, Mycobacterium avium subsp. paratuberculosis
cggcgacgaaauugggcuggguc

SEQ ID NO: 946985 - RNA, 14 nt, Mycobacterium avium subsp. paratuberculosis
cggcgacgaacgcc

SEQ ID NO: 946986 - RNA, 18 nt, Mycobacterium avium subsp. paratuberculosis
cggcgacgaacgccggca

SEQ ID NO: 946987 - RNA, 23 nt, Mycobacterium avium subsp. paratuberculosis
cggcgacgaacgccggcaucagc

SEQ ID NO: 946988 - RNA, 12 nt, Mycobacterium avium subsp. paratuberculosis
cggcgacgaagc

SEQ ID NO: 946989 - RNA, 21 nt, Mycobacterium avium subsp. paratuberculosis
cggcgacgaagcagcucgcgu

SEQ ID NO: 946990 - RNA, 13 nt, Mycobacterium avium subsp. paratuberculosis
cggcgacgaccac

SEQ ID NO: 946991 - RNA, 15 nt, Mycobacterium avium subsp. paratuberculosis
cggcgacgaccacca

SEQ ID NO: 946992 - RNA, 22 nt, Mycobacterium avium subsp. paratuberculosis
cggcgacgaccaccaggagcac

SEQ ID NO: 946993 - RNA, 12 nt, Mycobacterium avium subsp. paratuberculosis
cggcgacgaccg

SEQ ID NO: 946994 - RNA, 15 nt, Mycobacterium avium subsp. paratuberculosis
cggcgacgaccgcac

SEQ ID NO: 946995 - RNA, 18 nt, Mycobacterium avium subsp. paratuberculosis
cggcgacgaccgcaccga

SEQ ID NO: 946996 - RNA, 21 nt, Mycobacterium avium subsp. paratuberculosis
cggcgacgaccgcaccgacca

SEQ ID NO: 946997 - RNA, 13 nt, Mycobacterium avium subsp. paratuberculosis
cggcgaccgccac

SEQ ID NO: 946998 - RNA, 14 nt, Mycobacterium avium subsp. paratuberculosis
cggcgaccgcccgg

SEQ ID NO: 946999 - RNA, 23 nt, Mycobacterium avium subsp. paratuberculosis
cggcgaccgcccggggcgcggac

SEQ ID NO: 947000 - RNA, 15 nt, Mycobacterium avium subsp. paratuberculosis
cggcgaccgccggug

SEQ ID NO: 947001 - RNA, 18 nt, Mycobacterium avium subsp. paratuberculosis
cggcgaccccguucgccg

SEQ ID NO: 947002 - RNA, 23 nt, Mycobacterium avium subsp. paratuberculosis
cggcgaccccguucgccgacagc

SEQ ID NO: 947003 - RNA, 19 nt, Mycobacterium avium subsp. paratuberculosis
cggcgacccgcacgaugcc

SEQ ID NO: 947004 - RNA, 16 nt, Mycobacterium avium subsp. paratuberculosis
cggcgacccgcuucgc

SEQ ID NO: 947005 - RNA, 19 nt, Mycobacterium avium subsp. paratuberculosis
cggcgacccgcuucgcccg

SEQ ID NO: 947006 - RNA, 20 nt, Mycobacterium avium subsp. paratuberculosis
cggcgacccgcuucgcccgg

SEQ ID NO: 947007 - RNA, 23 nt, Mycobacterium avium subsp. paratuberculosis
cggcgacccgcuucgcccggcug

SEQ ID NO: 947008 - RNA, 14 nt, Mycobacterium avium subsp. paratuberculosis
cggcgacccgcuug

SEQ ID NO: 947009 - RNA, 17 nt, Mycobacterium avium subsp. paratuberculosis
cggcgacccgcuuggug

SEQ ID NO: 947010 - RNA, 22 nt, Mycobacterium avium subsp. paratuberculosis
cggcgaccaugccguagcgguc

SEQ ID NO: 947011 - RNA, 13 nt, Mycobacterium avium subsp. paratuberculosis
cggcgaccagcag

SEQ ID NO: 947012 - RNA, 12 nt, Mycobacterium avium subsp. paratuberculosis
cggcgaccagcc

SEQ ID NO: 947013 - RNA, 13 nt, Mycobacterium avium subsp. paratuberculosis
cggcgaccagccc

SEQ ID NO: 947014 - RNA, 17 nt, Mycobacterium avium subsp. paratuberculosis
cggcgaccagcgacggc

SEQ ID NO: 947015 - RNA, 19 nt, Mycobacterium avium subsp. paratuberculosis
cggcgaccagcgacggcag

SEQ ID NO: 947016 - RNA, 21 nt, Mycobacterium avium subsp. paratuberculosis
cggcgaccagcgacggcaggu

SEQ ID NO: 947017 - RNA, 24 nt, Mycobacterium avium subsp. paratuberculosis
cggcgaccagcgacggcaggucgg

SEQ ID NO: 947018 - RNA, 20 nt, Mycobacterium avium subsp. paratuberculosis
cggcgaccagcgagcccagc

SEQ ID NO: 947019 - RNA, 14 nt, Mycobacterium avium subsp. paratuberculosis
cggcgaaccagcau

SEQ ID NO: 947020 - RNA, 22 nt, Mycobacterium avium subsp. paratuberculosis
cggcgaaccagcaugcgccaga

SEQ ID NO: 947021 - RNA, 23 nt, Mycobacterium avium subsp. paratuberculosis
cggcgaaccagggcagccagccc

SEQ ID NO: 947022 - RNA, 22 nt, Mycobacterium avium subsp. paratuberculosis
cggcgaacagugcacugccgac

SEQ ID NO: 947023 - RNA, 13 nt, Mycobacterium avium subsp. paratuberculosis
cggcgaacagcgg

SEQ ID NO: 947024 - RNA, 18 nt, Mycobacterium avium subsp. paratuberculosis
cggcgaacagcggggugc

SEQ ID NO: 947025 - RNA, 13 nt, Mycobacterium avium subsp. paratuberculosis
cggcgaacaccac

SEQ ID NO: 947026 - RNA, 17 nt, Mycobacterium avium subsp. paratuberculosis
cggcgaacaccacgguc

SEQ ID NO: 947027 - RNA, 22 nt, Mycobacterium avium subsp. paratuberculosis
cggcgaacaccacgguccccgc

SEQ ID NO: 947028 - RNA, 15 nt, Mycobacterium avium subsp. paratuberculosis
cggcgaacaccagca

SEQ ID NO: 947029 - RNA, 17 nt, Mycobacterium avium subsp. paratuberculosis
cggcgaacaccagcacc

SEQ ID NO: 947030 - RNA, 19 nt, Mycobacterium avium subsp. paratuberculosis
cggcgaacaccucggcgau

SEQ ID NO: 947031 - RNA, 22 nt, Mycobacterium avium subsp. paratuberculosis
cggcgaacccgagcaccccggc

SEQ ID NO: 947032 - RNA, 17 nt, Mycobacterium avium subsp. paratuberculosis
cggcgaaccgccgcacc

SEQ ID NO: 947033 - RNA, 20 nt, Mycobacterium avium subsp. paratuberculosis
cggcgaaccgccgcacccag

SEQ ID NO: 947034 - RNA, 20 nt, Mycobacterium avium subsp. paratuberculosis
cggcgaaccgggcccguagg

SEQ ID NO: 947035 - RNA, 19 nt, Mycobacterium avium subsp. paratuberculosis
cggcgaaccguucgucguc

SEQ ID NO: 947036 - RNA, 20 nt, Mycobacterium avium subsp. paratuberculosis
cggcgaaccguucgucgucg

SEQ ID NO: 947037 - RNA, 18 nt, Mycobacterium avium subsp. paratuberculosis
cggcgaacgacgucgagg

SEQ ID NO: 947038 - RNA, 16 nt, Mycobacterium avium subsp. paratuberculosis
cggcgaacgcccgguc

SEQ ID NO: 947039 - RNA, 17 nt, Mycobacterium avium subsp. paratuberculosis
cggcgaacgcccggucg

SEQ ID NO: 947040 - RNA, 18 nt, Mycobacterium avium subsp. paratuberculosis
cggcgaacgcccggucga

SEQ ID NO: 947041 - RNA, 14 nt, Mycobacterium avium subsp. paratuberculosis
cggcgaacgccgcc

SEQ ID NO: 947042 - RNA, 15 nt, Mycobacterium avium subsp. paratuberculosis
cggcgaacgccgccg

SEQ ID NO: 947043 - RNA, 14 nt, Mycobacterium avium subsp. paratuberculosis
cggcgaacgcgcgg

SEQ ID NO: 947044 - RNA, 16 nt, Mycobacterium avium subsp. paratuberculosis
cggcgaacgcgcgguc

SEQ ID NO: 947045 - RNA, 20 nt, Mycobacterium avium subsp. paratuberculosis
cggcgaacgcgcggucgucg

SEQ ID NO: 947046 - RNA, 21 nt, Mycobacterium avium subsp. paratuberculosis
cggcgaacgcgcggucgucgc

SEQ ID NO: 947047 - RNA, 23 nt, Mycobacterium avium subsp. paratuberculosis
cggcgaacgcgcggucgucgccc

SEQ ID NO: 947048 - RNA, 13 nt, Mycobacterium avium subsp. paratuberculosis
cggcgaacgcguc

SEQ ID NO: 947049 - RNA, 13 nt, Mycobacterium avium subsp. paratuberculosis
cggcgaagacguc

SEQ ID NO: 947050 - RNA, 15 nt, Mycobacterium avium subsp. paratuberculosis
cggcgaagacgucgg

SEQ ID NO: 947051 - RNA, 16 nt, Mycobacterium avium subsp. paratuberculosis
cggcgaagacgucggc

SEQ ID NO: 947052 - RNA, 20 nt, Mycobacterium avium subsp. paratuberculosis
cggcgaagacgucggcgcgg

SEQ ID NO: 947053 - RNA, 21 nt, Mycobacterium avium subsp. paratuberculosis
cggcgaagacgucggcgcggu

SEQ ID NO: 947054 - RNA, 23 nt, Mycobacterium avium subsp. paratuberculosis
cggcgaagacgucggcgcggucg

SEQ ID NO: 947055 - RNA, 19 nt, Mycobacterium avium subsp. paratuberculosis
cggcgaagccggccccgcc

SEQ ID NO: 947056 - RNA, 16 nt, Mycobacterium avium subsp. paratuberculosis
cggcgaagccggcguc

SEQ ID NO: 947057 - RNA, 17 nt, Mycobacterium avium subsp. paratuberculosis
cggcgaagccggcguca

SEQ ID NO: 947058 - RNA, 18 nt, Mycobacterium avium subsp. paratuberculosis
cggcgaagccggcgucaa

SEQ ID NO: 947059 - RNA, 13 nt, Mycobacterium avium subsp. paratuberculosis
cggcgaagcaggc

SEQ ID NO: 947060 - RNA, 15 nt, Mycobacterium avium subsp. paratuberculosis
cggcgaagcaggcca

SEQ ID NO: 947061 - RNA, 20 nt, Mycobacterium avium subsp. paratuberculosis
cggcgaagcaggccaggugc

SEQ ID NO: 947062 - RNA, 15 nt, Mycobacterium avium subsp. paratuberculosis
cggcgaagcucgacg

SEQ ID NO: 947063 - RNA, 15 nt, Mycobacterium avium subsp. paratuberculosis
cggcgaaggacagcc

SEQ ID NO: 947064 - RNA, 16 nt, Mycobacterium avium subsp. paratuberculosis
cggcgaaggacagccg

SEQ ID NO: 947065 - RNA, 17 nt, Mycobacterium avium subsp. paratuberculosis
cggcgaaggacagccgg

SEQ ID NO: 947066 - RNA, 16 nt, Mycobacterium avium subsp. paratuberculosis
cggcgaacucgcggcg

SEQ ID NO: 947067 - RNA, 20 nt, Mycobacterium avium subsp. paratuberculosis
cggcgaacucgcggcggguc

SEQ ID NO: 947068 - RNA, 16 nt, Mycobacterium avium subsp. paratuberculosis
cggcgaacgccucggu

SEQ ID NO: 947069 - RNA, 19 nt, Mycobacterium avium subsp. paratuberculosis
cggcgaacgccucgguggu

SEQ ID NO: 947070 - RNA, 22 nt, Mycobacterium avium subsp. paratuberculosis
cggcgaacgccucgguggucga

SEQ ID NO: 947071 - RNA, 15 nt, Mycobacterium avium subsp. paratuberculosis
cggcgaacggccagu

SEQ ID NO: 947072 - RNA, 14 nt, Mycobacterium avium subsp. paratuberculosis
cggcgaacggccgc

SEQ ID NO: 947073 - RNA, 16 nt, Mycobacterium avium subsp. paratuberculosis
cggcgaacggccgcga

SEQ ID NO: 947074 - RNA, 20 nt, Mycobacterium avium subsp. paratuberculosis
cggcgaacggccgcgauguc

SEQ ID NO: 947075 - RNA, 15 nt, Mycobacterium avium subsp. paratuberculosis
cggcgaacgucgaug

SEQ ID NO: 947076 - RNA, 15 nt, Mycobacterium avium subsp. paratuberculosis
cggcgaacuccaccc

SEQ ID NO: 947077 - RNA, 22 nt, Mycobacterium avium subsp. paratuberculosis
cggcgaacuccacccugccgac

SEQ ID NO: 947078 - RNA, 16 nt, Mycobacterium avium subsp. paratuberculosis
cggcgaacuccagauc

SEQ ID NO: 947079 - RNA, 21 nt, Mycobacterium avium subsp. paratuberculosis
cggcgaacuccagaucgccgc

SEQ ID NO: 947080 - RNA, 22 nt, Mycobacterium avium subsp. paratuberculosis
cggcgaacuccagaucgccgcc

SEQ ID NO: 947081 - RNA, 13 nt, Mycobacterium avium subsp. paratuberculosis
cggcgacaucgcc

SEQ ID NO: 947082 - RNA, 16 nt, Mycobacterium avium subsp. paratuberculosis
cggcgacaucgccgag

SEQ ID NO: 947083 - RNA, 14 nt, Mycobacterium avium subsp. paratuberculosis
cggcgacacgccga

SEQ ID NO: 947084 - RNA, 17 nt, Mycobacterium avium subsp. paratuberculosis
cggcgacacgccgacga

SEQ ID NO: 947085 - RNA, 18 nt, Mycobacterium avium subsp. paratuberculosis
cggcgacacgccgacgau

SEQ ID NO: 947086 - RNA, 21 nt, Mycobacterium avium subsp. paratuberculosis
cggcgacacgccgacgauccg

SEQ ID NO: 947087 - RNA, 14 nt, Mycobacterium avium subsp. paratuberculosis
cggcgacacccagc

SEQ ID NO: 947088 - RNA, 13 nt, Mycobacterium avium subsp. paratuberculosis
cggcgacaccgca

SEQ ID NO: 947089 - RNA, 14 nt, Mycobacterium avium subsp. paratuberculosis
cggcgacaccgcau

SEQ ID NO: 947090 - RNA, 16 nt, Mycobacterium avium subsp. paratuberculosis
cggcgacaccgcaugg

SEQ ID NO: 947091 - RNA, 18 nt, Mycobacterium avium subsp. paratuberculosis
cggcgacaccgcauggcc

SEQ ID NO: 947092 - RNA, 23 nt, Mycobacterium avium subsp. paratuberculosis
cggcgacaccgcauggccggcga

SEQ ID NO: 947093 - RNA, 22 nt, Mycobacterium avium subsp. paratuberculosis
cggcgaccaaugcccugacccc

SEQ ID NO: 947094 - RNA, 20 nt, Mycobacterium avium subsp. paratuberculosis
cggcgaccaauugcgagcag

SEQ ID NO: 947095 - RNA, 17 nt, Mycobacterium avium subsp. paratuberculosis
cggcgaccacaccgucg

SEQ ID NO: 947096 - RNA, 18 nt, Mycobacterium avium subsp. paratuberculosis
cggcgaccacaccgucga

SEQ ID NO: 947097 - RNA, 23 nt, Mycobacterium avium subsp. paratuberculosis
cggcgaccacaccgucgacgacg

SEQ ID NO: 947098 - RNA, 15 nt, Mycobacterium avium subsp. paratuberculosis
cggcgaccaccaccg

SEQ ID NO: 947099 - RNA, 21 nt, Mycobacterium avium subsp. paratuberculosis
cggcgaccaccaccgcccaca

SEQ ID NO: 947100 - RNA, 17 nt, Mycobacterium avium subsp. paratuberculosis
cggcgacauuggccgcg

SEQ ID NO: 947101 - RNA, 21 nt, Mycobacterium avium subsp. paratuberculosis
cggcgaccacccucaccacga

SEQ ID NO: 947102 - RNA, 22 nt, Mycobacterium avium subsp. paratuberculosis
cggcgaccacccucaccacgau

SEQ ID NO: 947103 - RNA, 14 nt, Mycobacterium avium subsp. paratuberculosis
cggcgaccaccucg

SEQ ID NO: 947104 - RNA, 15 nt, Mycobacterium avium subsp. paratuberculosis
cggcgaccaccucgg

SEQ ID NO: 947105 - RNA, 18 nt, Mycobacterium avium subsp. paratuberculosis
cggcgaccaccucggcga

SEQ ID NO: 947106 - RNA, 19 nt, Mycobacterium avium subsp. paratuberculosis
cggcgaccaccucggcgac

SEQ ID NO: 947107 - RNA, 20 nt, Mycobacterium avium subsp. paratuberculosis
cggcgaaguugcgguugacg

SEQ ID NO: 947108 - RNA, 16 nt, Mycobacterium avium subsp. paratuberculosis
cggcgaagucaucacc

SEQ ID NO: 947109 - RNA, 20 nt, Mycobacterium avium subsp. paratuberculosis
cggcgaaggugccccgcugg

SEQ ID NO: 947110 - RNA, 23 nt, Mycobacterium avium subsp. paratuberculosis
cggcgaaggugccccgcuggauc

SEQ ID NO: 947111 - RNA, 20 nt, Mycobacterium avium subsp. paratuberculosis
cggcgaagguguccucgagc

SEQ ID NO: 947112 - RNA, 16 nt, Mycobacterium avium subsp. paratuberculosis
cggcgaaggccagcga

SEQ ID NO: 947113 - RNA, 22 nt, Mycobacterium avium subsp. paratuberculosis
cggcgaaggccagcgauacccg

SEQ ID NO: 947114 - RNA, 19 nt, Mycobacterium avium subsp. paratuberculosis
cggcgaagcuaaaccccac

SEQ ID NO: 947115 - RNA, 17 nt, Mycobacterium avium subsp. paratuberculosis
cggcgaaggcgcgcagg

SEQ ID NO: 947116 - RNA, 21 nt, Mycobacterium avium subsp. paratuberculosis
cggcgaaggcgcgcagggcga

SEQ ID NO: 947117 - RNA, 15 nt, Mycobacterium avium subsp. paratuberculosis
cggcgaaucagcagc

SEQ ID NO: 947118 - RNA, 15 nt, Mycobacterium avium subsp. paratuberculosis
cggcgaauccgaccg

SEQ ID NO: 947119 - RNA, 18 nt, Mycobacterium avium subsp. paratuberculosis
cggcgaauccgaccggcu

SEQ ID NO: 947120 - RNA, 21 nt, Mycobacterium avium subsp. paratuberculosis
cggcgaauccgagcaucgggu

SEQ ID NO: 947121 - RNA, 20 nt, Mycobacterium avium subsp. paratuberculosis
cggcgaauccgaguuggccg

SEQ ID NO: 947122 - RNA, 22 nt, Mycobacterium avium subsp. paratuberculosis
cggcgaauccgaguuggccggc

SEQ ID NO: 947123 - RNA, 23 nt, Mycobacterium avium subsp. paratuberculosis
cggcgaauccgaguuggccggca

SEQ ID NO: 947124 - RNA, 17 nt, Mycobacterium avium subsp. paratuberculosis
cggcgaauauuucgccg

SEQ ID NO: 947125 - RNA, 20 nt, Mycobacterium avium subsp. paratuberculosis
cggcgaauauuucgccgauc

SEQ ID NO: 947126 - RNA, 17 nt, Mycobacterium avium subsp. paratuberculosis
cggcgaauauuucgugu

SEQ ID NO: 947127 - RNA, 15 nt, Mycobacterium avium subsp. paratuberculosis
cggcgaaucgguccg

SEQ ID NO: 947128 - RNA, 18 nt, Mycobacterium avium subsp. paratuberculosis
cggcgacaacagcgccga

SEQ ID NO: 947129 - RNA, 19 nt, Mycobacterium avium subsp. paratuberculosis
cggcgacaacagcgccgag

SEQ ID NO: 947130 - RNA, 23 nt, Mycobacterium avium subsp. paratuberculosis
cggcgaaauaaccguucaccucu

SEQ ID NO: 947131 - RNA, 17 nt, Mycobacterium avium subsp. paratuberculosis
cggcgaaaucggugaag

SEQ ID NO: 947132 - RNA, 17 nt, Mycobacterium avium subsp. paratuberculosis
cggccuugcgggccgga

SEQ ID NO: 947133 - RNA, 21 nt, Mycobacterium avium subsp. paratuberculosis
cggccuugcgggccggagccu

SEQ ID NO: 947134 - RNA, 15 nt, Mycobacterium avium subsp. paratuberculosis
cggccuugcucgccg

SEQ ID NO: 947135 - RNA, 18 nt, Mycobacterium avium subsp. paratuberculosis
cggccuugcucgccgcgu

SEQ ID NO: 947136 - RNA, 14 nt, Mycobacterium avium subsp. paratuberculosis
cggccuugcgcacc

SEQ ID NO: 947137 - RNA, 15 nt, Mycobacterium avium subsp. paratuberculosis
cggccuugcgcaccg

SEQ ID NO: 947138 - RNA, 17 nt, Mycobacterium avium subsp. paratuberculosis
cggccuugcgcaccgga

SEQ ID NO: 947139 - RNA, 19 nt, Mycobacterium avium subsp. paratuberculosis
cggccuugcgcaccggagc

SEQ ID NO: 947140 - RNA, 21 nt, Mycobacterium avium subsp. paratuberculosis
cggccuugcgcaccggagccu

SEQ ID NO: 947141 - RNA, 16 nt, Mycobacterium avium subsp. paratuberculosis
cggccuugcgagccgg

SEQ ID NO: 947142 - RNA, 19 nt, Mycobacterium avium subsp. paratuberculosis
cggccuugcgagccggagc

SEQ ID NO: 947143 - RNA, 21 nt, Mycobacterium avium subsp. paratuberculosis
cggccuugcgagccggagccu

SEQ ID NO: 947144 - RNA, 20 nt, Mycobacterium avium subsp. paratuberculosis
cggccuugccgaucagcugg

SEQ ID NO: 947145 - RNA, 14 nt, Mycobacterium avium subsp. paratuberculosis
cggccuugccgcug

SEQ ID NO: 947146 - RNA, 19 nt, Mycobacterium avium subsp. paratuberculosis
cggccugcgucacuccucg

SEQ ID NO: 947147 - RNA, 15 nt, Mycobacterium avium subsp. paratuberculosis
cggccuggcccagcc

SEQ ID NO: 947148 - RNA, 18 nt, Mycobacterium avium subsp. paratuberculosis
cggccuggcccagccgcg

SEQ ID NO: 947149 - RNA, 17 nt, Mycobacterium avium subsp. paratuberculosis
cggccuugagccggucg

SEQ ID NO: 947150 - RNA, 18 nt, Mycobacterium avium subsp. paratuberculosis
cggccuugagccggucgu

SEQ ID NO: 947151 - RNA, 14 nt, Mycobacterium avium subsp. paratuberculosis
cggccuggccgucg

SEQ ID NO: 947152 - RNA, 22 nt, Mycobacterium avium subsp. paratuberculosis
cggccuggccgucgcggcgcgg

SEQ ID NO: 947153 - RNA, 21 nt, Mycobacterium avium subsp. paratuberculosis
cggccugcuucucgccgucgu

SEQ ID NO: 947154 - RNA, 20 nt, Mycobacterium avium subsp. paratuberculosis
cggccugcuugaccgccaga

SEQ ID NO: 947155 - RNA, 20 nt, Mycobacterium avium subsp. paratuberculosis
cggccugcuuggucgccugc

SEQ ID NO: 947156 - RNA, 18 nt, Mycobacterium avium subsp. paratuberculosis
cggccugcuuuucggccg

SEQ ID NO: 947157 - RNA, 19 nt, Mycobacterium avium subsp. paratuberculosis
cggccugcuuuucggccga

SEQ ID NO: 947158 - RNA, 20 nt, Mycobacterium avium subsp. paratuberculosis
cggccugcuccagcgagucg

SEQ ID NO: 947159 - RNA, 13 nt, Mycobacterium avium subsp. paratuberculosis
cggccugcucgaa

SEQ ID NO: 947160 - RNA, 17 nt, Mycobacterium avium subsp. paratuberculosis
cggccugcgggcgccgg

SEQ ID NO: 947161 - RNA, 18 nt, Mycobacterium avium subsp. paratuberculosis
cggccugcgggcgccggc

SEQ ID NO: 947162 - RNA, 20 nt, Mycobacterium avium subsp. paratuberculosis
cggccugcgggcgccggcug

SEQ ID NO: 947163 - RNA, 15 nt, Mycobacterium avium subsp. paratuberculosis
cggccugcggcggca

SEQ ID NO: 947164 - RNA, 16 nt, Mycobacterium avium subsp. paratuberculosis
cggccugcggcggcaa

SEQ ID NO: 947165 - RNA, 13 nt, Mycobacterium avium subsp. paratuberculosis
cggccugcgcccg

SEQ ID NO: 947166 - RNA, 14 nt, Mycobacterium avium subsp. paratuberculosis
cggccggccuggug

SEQ ID NO: 947167 - RNA, 15 nt, Mycobacterium avium subsp. paratuberculosis
cggccggccuggugc

SEQ ID NO: 947168 - RNA, 18 nt, Mycobacterium avium subsp. paratuberculosis
cggccggcgaagccgcuc

SEQ ID NO: 947169 - RNA, 17 nt, Mycobacterium avium subsp. paratuberculosis
cggccggcgacgccgcg

SEQ ID NO: 947170 - RNA, 20 nt, Mycobacterium avium subsp. paratuberculosis
cggccggcgacgccgcgcug

SEQ ID NO: 947171 - RNA, 12 nt, Mycobacterium avium subsp. paratuberculosis
cggccggcgagg

SEQ ID NO: 947172 - RNA, 16 nt, Mycobacterium avium subsp. paratuberculosis
cggccggcgagucgcg

SEQ ID NO: 947173 - RNA, 15 nt, Mycobacterium avium subsp. paratuberculosis
cggccggcgcagccg

SEQ ID NO: 947174 - RNA, 15 nt, Mycobacterium avium subsp. paratuberculosis
cggccggcgccgacc

SEQ ID NO: 947175 - RNA, 16 nt, Mycobacterium avium subsp. paratuberculosis
cggccggcgccgaccg

SEQ ID NO: 947176 - RNA, 19 nt, Mycobacterium avium subsp. paratuberculosis
cggccugccggccgccgcg

SEQ ID NO: 947177 - RNA, 14 nt, Mycobacterium avium subsp. paratuberculosis
cggccggccggccg

SEQ ID NO: 947178 - RNA, 15 nt, Mycobacterium avium subsp. paratuberculosis
cggccggccggccug

SEQ ID NO: 947179 - RNA, 14 nt, Mycobacterium avium subsp. paratuberculosis
cggccggccgcgcc

SEQ ID NO: 947180 - RNA, 15 nt, Mycobacterium avium subsp. paratuberculosis
cggccggccgcgccc

SEQ ID NO: 947181 - RNA, 13 nt, Mycobacterium avium subsp. paratuberculosis
cggccggccagcg

SEQ ID NO: 947182 - RNA, 15 nt, Mycobacterium avium subsp. paratuberculosis
cggccggccagcgcg

SEQ ID NO: 947183 - RNA, 17 nt, Mycobacterium avium subsp. paratuberculosis
cggccggcacgauggcg

SEQ ID NO: 947184 - RNA, 18 nt, Mycobacterium avium subsp. paratuberculosis
cggccggccagcagccgg

SEQ ID NO: 947185 - RNA, 13 nt, Mycobacterium avium subsp. paratuberculosis
cggccggccgccg

SEQ ID NO: 947186 - RNA, 16 nt, Mycobacterium avium subsp. paratuberculosis
cggccggccgccggcg

SEQ ID NO: 947187 - RNA, 13 nt, Mycobacterium avium subsp. paratuberculosis
cggccggccgcgc

SEQ ID NO: 947188 - RNA, 18 nt, Mycobacterium avium subsp. paratuberculosis
cggccggcccugcacgca

SEQ ID NO: 947189 - RNA, 13 nt, Mycobacterium avium subsp. paratuberculosis
cggccggccgaac

SEQ ID NO: 947190 - RNA, 14 nt, Mycobacterium avium subsp. paratuberculosis
cggccggccgaaca

SEQ ID NO: 947191 - RNA, 13 nt, Mycobacterium avium subsp. paratuberculosis
cggccggccgaca

SEQ ID NO: 947192 - RNA, 14 nt, Mycobacterium avium subsp. paratuberculosis
cggccggccgacaa

SEQ ID NO: 947193 - RNA, 21 nt, Mycobacterium avium subsp. paratuberculosis
cggccggccgacaacgacagc

SEQ ID NO: 947194 - RNA, 16 nt, Mycobacterium avium subsp. paratuberculosis
cggccggccgacaccc

SEQ ID NO: 947195 - RNA, 19 nt, Mycobacterium avium subsp. paratuberculosis
cggccggccgacaccccga

SEQ ID NO: 947196 - RNA, 13 nt, Mycobacterium avium subsp. paratuberculosis
cggccggccgagc

SEQ ID NO: 947197 - RNA, 16 nt, Mycobacterium avium subsp. paratuberculosis
cggccggccgagccga

SEQ ID NO: 947198 - RNA, 19 nt, Mycobacterium avium subsp. paratuberculosis
cggccggcaguuccucgcc

SEQ ID NO: 947199 - RNA, 20 nt, Mycobacterium avium subsp. paratuberculosis
cggccggcaguuccucgccg

SEQ ID NO: 947200 - RNA, 16 nt, Mycobacterium avium subsp. paratuberculosis
cggccggccacgcucg

SEQ ID NO: 947201 - RNA, 13 nt, Mycobacterium avium subsp. paratuberculosis
cggccggccagca

SEQ ID NO: 947202 - RNA, 17 nt, Mycobacterium avium subsp. paratuberculosis
cggccggccccgcccgg

SEQ ID NO: 947203 - RNA, 21 nt, Mycobacterium avium subsp. paratuberculosis
cggccggccccgcccggcgcg

SEQ ID NO: 947204 - RNA, 13 nt, Mycobacterium avium subsp. paratuberculosis
cggccggccccgg

SEQ ID NO: 947205 - RNA, 16 nt, Mycobacterium avium subsp. paratuberculosis
cggccggccccggccg

SEQ ID NO: 947206 - RNA, 17 nt, Mycobacterium avium subsp. paratuberculosis
cggccggccccggccgg

SEQ ID NO: 947207 - RNA, 20 nt, Mycobacterium avium subsp. paratuberculosis
cggccggccccggccgggcg

SEQ ID NO: 947208 - RNA, 14 nt, Mycobacterium avium subsp. paratuberculosis
cggccggccccggg

SEQ ID NO: 947209 - RNA, 18 nt, Mycobacterium avium subsp. paratuberculosis
cggccggccccuaccgcc

SEQ ID NO: 947210 - RNA, 19 nt, Mycobacterium avium subsp. paratuberculosis
cggccggccccuaccgccg

SEQ ID NO: 947211 - RNA, 15 nt, Mycobacterium avium subsp. paratuberculosis
cggccggcccgcccg

SEQ ID NO: 947212 - RNA, 17 nt, Mycobacterium avium subsp. paratuberculosis
cggccggcccgcccggc

SEQ ID NO: 947213 - RNA, 20 nt, Mycobacterium avium subsp. paratuberculosis
cggccggcccgcccggcggc

SEQ ID NO: 947214 - RNA, 22 nt, Mycobacterium avium subsp. paratuberculosis
cggccggcccgcccggcggcgc

SEQ ID NO: 947215 - RNA, 15 nt, Mycobacterium avium subsp. paratuberculosis
cggccggcaggucga

SEQ ID NO: 947216 - RNA, 15 nt, Mycobacterium avium subsp. paratuberculosis
cggccggcaggccgc

SEQ ID NO: 947217 - RNA, 18 nt, Mycobacterium avium subsp. paratuberculosis
cggccggcaggccgcccg

SEQ ID NO: 947218 - RNA, 19 nt, Mycobacterium avium subsp. paratuberculosis
cggccggcaggccgcccga

SEQ ID NO: 947219 - RNA, 19 nt, Mycobacterium avium subsp. paratuberculosis
cggccggcagcugcccguc

SEQ ID NO: 947220 - RNA, 20 nt, Mycobacterium avium subsp. paratuberculosis
cggccggcagcugcccgucg

SEQ ID NO: 947221 - RNA, 20 nt, Mycobacterium avium subsp. paratuberculosis
cggccggcacuaccgccucg

SEQ ID NO: 947222 - RNA, 12 nt, Mycobacterium avium subsp. paratuberculosis
aacccaccccga

SEQ ID NO: 947223 - RNA, 15 nt, Mycobacterium avium subsp. paratuberculosis
cggguuucggcccgg

SEQ ID NO: 947224 - RNA, 16 nt, Mycobacterium avium subsp. paratuberculosis
cggguuucggcccggc

SEQ ID NO: 947225 - RNA, 18 nt, Mycobacterium avium subsp. paratuberculosis
cggguuuggccgcgggcg

SEQ ID NO: 947226 - RNA, 19 nt, Mycobacterium avium subsp. paratuberculosis
cggguuuggccgcgggcgg

SEQ ID NO: 947227 - RNA, 16 nt, Mycobacterium avium subsp. paratuberculosis
cggguuuguccggcca

SEQ ID NO: 947228 - RNA, 19 nt, Mycobacterium avium subsp. paratuberculosis
cggguuuucgggccgguca

SEQ ID NO: 947229 - RNA, 17 nt, Mycobacterium avium subsp. paratuberculosis
cgguaaaacuggccagc

SEQ ID NO: 947230 - RNA, 18 nt, Mycobacterium avium subsp. paratuberculosis
cgguaaaacuggccagca

SEQ ID NO: 947231 - RNA, 19 nt, Mycobacterium avium subsp. paratuberculosis
aaccaugccagucaagcgc

SEQ ID NO: 947232 - RNA, 14 nt, Mycobacterium avium subsp. paratuberculosis
cggguuggugucga

SEQ ID NO: 947233 - RNA, 14 nt, Mycobacterium avium subsp. paratuberculosis
cggguuucgaagac

SEQ ID NO: 947234 - RNA, 12 nt, Mycobacterium avium subsp. paratuberculosis
cggguuucgcgg

SEQ ID NO: 947235 - RNA, 19 nt, Mycobacterium avium subsp. paratuberculosis
cggguuguucuccagcggc

SEQ ID NO: 947236 - RNA, 19 nt, Mycobacterium avium subsp. paratuberculosis
cggguuguuguccgaccag

SEQ ID NO: 947237 - RNA, 16 nt, Mycobacterium avium subsp. paratuberculosis
cggguugcacaggucg

SEQ ID NO: 947238 - RNA, 16 nt, Mycobacterium avium subsp. paratuberculosis
cggguuggucggcgcg

SEQ ID NO: 947239 - RNA, 20 nt, Mycobacterium avium subsp. paratuberculosis
cggguuguagcaggcggugg

SEQ ID NO: 947240 - RNA, 14 nt, Mycobacterium avium subsp. paratuberculosis
cggguugucgacgu

SEQ ID NO: 947241 - RNA, 16 nt, Mycobacterium avium subsp. paratuberculosis
cggguugcugagccgc

SEQ ID NO: 947242 - RNA, 20 nt, Mycobacterium avium subsp. paratuberculosis
cggguugcugagccgccgag

SEQ ID NO: 947243 - RNA, 23 nt, Mycobacterium avium subsp. paratuberculosis
cggguugcugagccgccgagccg

SEQ ID NO: 947244 - RNA, 15 nt, Mycobacterium avium subsp. paratuberculosis
cggguuggccagggc

SEQ ID NO: 947245 - RNA, 18 nt, Mycobacterium avium subsp. paratuberculosis
cggguugggcgccagcag

SEQ ID NO: 947246 - RNA, 20 nt, Mycobacterium avium subsp. paratuberculosis
cggguugggcgccagcagca

SEQ ID NO: 947247 - RNA, 21 nt, Mycobacterium avium subsp. paratuberculosis
cggguugggcgccagcagcac

SEQ ID NO: 947248 - RNA, 18 nt, Mycobacterium avium subsp. paratuberculosis
cggguugggcggcggcca

SEQ ID NO: 947249 - RNA, 20 nt, Mycobacterium avium subsp. paratuberculosis
cggguugggcggcggccacc

SEQ ID NO: 947250 - RNA, 15 nt, Mycobacterium avium subsp. paratuberculosis
cggguuggggccgcg

SEQ ID NO: 947251 - RNA, 16 nt, Mycobacterium avium subsp. paratuberculosis
cggguuggggccgcgg

SEQ ID NO: 947252 - RNA, 17 nt, Mycobacterium avium subsp. paratuberculosis
cggguuggggccgcgga

SEQ ID NO: 947253 - RNA, 13 nt, Mycobacterium avium subsp. paratuberculosis
cgguaacagagcg

SEQ ID NO: 947254 - RNA, 13 nt, Mycobacterium avium subsp. paratuberculosis
cgguaaccacccg

SEQ ID NO: 947255 - RNA, 18 nt, Mycobacterium avium subsp. paratuberculosis
cgguaaagucuucggcga

SEQ ID NO: 947256 - RNA, 20 nt, Mycobacterium avium subsp. paratuberculosis
cgguaaauugaacgccgcca

SEQ ID NO: 947257 - RNA, 22 nt, Mycobacterium avium subsp. paratuberculosis
cgguaaauugaacgccgccaac

SEQ ID NO: 947258 - RNA, 13 nt, Mycobacterium avium subsp. paratuberculosis
cgguaauccggcc

SEQ ID NO: 947259 - RNA, 15 nt, Mycobacterium avium subsp. paratuberculosis
cgguaaucggcggug

SEQ ID NO: 947260 - RNA, 16 nt, Mycobacterium avium subsp. paratuberculosis
cgguaaucggcggugg

SEQ ID NO: 947261 - RNA, 16 nt, Mycobacterium avium subsp. paratuberculosis
cgguacacguggccga

SEQ ID NO: 947262 - RNA, 22 nt, Mycobacterium avium subsp. paratuberculosis
cgguacaggucgcugcccggcg

SEQ ID NO: 947263 - RNA, 18 nt, Mycobacterium avium subsp. paratuberculosis
cgguacaucgacgcgacc

SEQ ID NO: 947264 - RNA, 22 nt, Mycobacterium avium subsp. paratuberculosis
cgguacaucgacgcgaccggcc

SEQ ID NO: 947265 - RNA, 15 nt, Mycobacterium avium subsp. paratuberculosis
cgguacaucccgccg

SEQ ID NO: 947266 - RNA, 20 nt, Mycobacterium avium subsp. paratuberculosis
cgguacaucccgccgggcau

SEQ ID NO: 947267 - RNA, 21 nt, Mycobacterium avium subsp. paratuberculosis
cgguacagcgacuccagcgcg

SEQ ID NO: 947268 - RNA, 12 nt, Mycobacterium avium subsp. paratuberculosis
cgguacagcgcc

SEQ ID NO: 947269 - RNA, 19 nt, Mycobacterium avium subsp. paratuberculosis
cgguaccagggcagcgccu

SEQ ID NO: 947270 - RNA, 19 nt, Mycobacterium avium subsp. paratuberculosis
cgguaccacgccgucgacg

SEQ ID NO: 947271 - RNA, 15 nt, Mycobacterium avium subsp. paratuberculosis
cgguacccccgccgg

SEQ ID NO: 947272 - RNA, 20 nt, Mycobacterium avium subsp. paratuberculosis
cgguacccccgccggggccg

SEQ ID NO: 947273 - RNA, 17 nt, Mycobacterium avium subsp. paratuberculosis
cgguaccgccgaucgug

SEQ ID NO: 947274 - RNA, 14 nt, Mycobacterium avium subsp. paratuberculosis
cgguaccgccggcc

SEQ ID NO: 947275 - RNA, 22 nt, Mycobacterium avium subsp. paratuberculosis
cgguaccgccggccaggcgacu

SEQ ID NO: 947276 - RNA, 13 nt, Mycobacterium avium subsp. paratuberculosis
cgguaccgccggc

SEQ ID NO: 947277 - RNA, 15 nt, Mycobacterium avium subsp. paratuberculosis
cggucaacaccggga

SEQ ID NO: 947278 - RNA, 18 nt, Mycobacterium avium subsp. paratuberculosis
cggucaacacgaagccgg

SEQ ID NO: 947279 - RNA, 20 nt, Mycobacterium avium subsp. paratuberculosis
cggucaacacgaagccggug

SEQ ID NO: 947280 - RNA, 13 nt, Mycobacterium avium subsp. paratuberculosis
cggucaacccgau

SEQ ID NO: 947281 - RNA, 15 nt, Mycobacterium avium subsp. paratuberculosis
cgguaugcggcgacg

SEQ ID NO: 947282 - RNA, 15 nt, Mycobacterium avium subsp. paratuberculosis
cgguaugccaagcca

SEQ ID NO: 947283 - RNA, 23 nt, Mycobacterium avium subsp. paratuberculosis
cgguaucgguggauccggugacc

SEQ ID NO: 947284 - RNA, 17 nt, Mycobacterium avium subsp. paratuberculosis
cgguaugcccgggccgu

SEQ ID NO: 947285 - RNA, 20 nt, Mycobacterium avium subsp. paratuberculosis
cgguaugcccgggccgucau

SEQ ID NO: 947286 - RNA, 21 nt, Mycobacterium avium subsp. paratuberculosis
cgguaugcccgggccgucauc

SEQ ID NO: 947287 - RNA, 19 nt, Mycobacterium avium subsp. paratuberculosis
cgguaugcgaucgcgucga

SEQ ID NO: 947288 - RNA, 17 nt, Mycobacterium avium subsp. paratuberculosis
cgguaucgggucaccgu

SEQ ID NO: 947289 - RNA, 17 nt, Mycobacterium avium subsp. paratuberculosis
cgguauacccccgguga

SEQ ID NO: 947290 - RNA, 17 nt, Mycobacterium avium subsp. paratuberculosis
cgguauauucgcgaugg

SEQ ID NO: 947291 - RNA, 13 nt, Mycobacterium avium subsp. paratuberculosis
cgguaggcggcga

SEQ ID NO: 947292 - RNA, 12 nt, Mycobacterium avium subsp. paratuberculosis
cgguagggccgg

SEQ ID NO: 947293 - RNA, 15 nt, Mycobacterium avium subsp. paratuberculosis
cgguagggccgguca

SEQ ID NO: 947294 - RNA, 21 nt, Mycobacterium avium subsp. paratuberculosis
cgguagggucgggugcggcgg

SEQ ID NO: 947295 - RNA, 14 nt, Mycobacterium avium subsp. paratuberculosis
cgguaggugccggc

SEQ ID NO: 947296 - RNA, 14 nt, Mycobacterium avium subsp. paratuberculosis
cgguaggcggccag

SEQ ID NO: 947297 - RNA, 15 nt, Mycobacterium avium subsp. paratuberculosis
cgguaggcggccagc

SEQ ID NO: 947298 - RNA, 16 nt, Mycobacterium avium subsp. paratuberculosis
cgguaggcgcggucgg

SEQ ID NO: 947299 - RNA, 18 nt, Mycobacterium avium subsp. paratuberculosis
cgguaggccgccgcgacc

SEQ ID NO: 947300 - RNA, 14 nt, Mycobacterium avium subsp. paratuberculosis
cgguaggccgcgcc

SEQ ID NO: 947301 - RNA, 15 nt, Mycobacterium avium subsp. paratuberculosis
cgguaggccgcgccg

SEQ ID NO: 947302 - RNA, 18 nt, Mycobacterium avium subsp. paratuberculosis
cgguaggccgcgccgauc

SEQ ID NO: 947303 - RNA, 22 nt, Mycobacterium avium subsp. paratuberculosis
cgguaggccgcgccgaucacga

SEQ ID NO: 947304 - RNA, 17 nt, Mycobacterium avium subsp. paratuberculosis
cgguaggccggccgcag

SEQ ID NO: 947305 - RNA, 17 nt, Mycobacterium avium subsp. paratuberculosis
cgguaggcgcaccgccg

SEQ ID NO: 947306 - RNA, 17 nt, Mycobacterium avium subsp. paratuberculosis
cgguacgcgcaauccug

SEQ ID NO: 947307 - RNA, 19 nt, Mycobacterium avium subsp. paratuberculosis
cgguacggccgacgcccag

SEQ ID NO: 947308 - RNA, 20 nt, Mycobacterium avium subsp. paratuberculosis
cgguacggcucaacggccgg

SEQ ID NO: 947309 - RNA, 18 nt, Mycobacterium avium subsp. paratuberculosis
cgguagacaccgccguug

SEQ ID NO: 947310 - RNA, 16 nt, Mycobacterium avium subsp. paratuberculosis
cgguagagcggcacca

SEQ ID NO: 947311 - RNA, 15 nt, Mycobacterium avium subsp. paratuberculosis
cgguagaucagcgcc

SEQ ID NO: 947312 - RNA, 22 nt, Mycobacterium avium subsp. paratuberculosis
cgguagaaccaacgcggcgccg

SEQ ID NO: 947313 - RNA, 19 nt, Mycobacterium avium subsp. paratuberculosis
cgguagaagaugcgccggg

SEQ ID NO: 947314 - RNA, 21 nt, Mycobacterium avium subsp. paratuberculosis
cgguacgugcgccggcggugc

SEQ ID NO: 947315 - RNA, 22 nt, Mycobacterium avium subsp. paratuberculosis
cgguagcgcucgucguagucga

SEQ ID NO: 947316 - RNA, 16 nt, Mycobacterium avium subsp. paratuberculosis
cgguagcgcagcacca

SEQ ID NO: 947317 - RNA, 17 nt, Mycobacterium avium subsp. paratuberculosis
cgguagcgcagcaccag

SEQ ID NO: 947318 - RNA, 22 nt, Mycobacterium avium subsp. paratuberculosis
cgguagccgcucgcccagcgcg

SEQ ID NO: 947319 - RNA, 23 nt, Mycobacterium avium subsp. paratuberculosis
cgguagccgcucgcccagcgcgg

SEQ ID NO: 947320 - RNA, 13 nt, Mycobacterium avium subsp. paratuberculosis
cgguagccagcac

SEQ ID NO: 947321 - RNA, 22 nt, Mycobacterium avium subsp. paratuberculosis
cggucagcacgcugaucaccac

SEQ ID NO: 947322 - RNA, 19 nt, Mycobacterium avium subsp. paratuberculosis
cggucagcaccgcgcggcg

SEQ ID NO: 947323 - RNA, 16 nt, Mycobacterium avium subsp. paratuberculosis
cggucagcaucgggua

SEQ ID NO: 947324 - RNA, 16 nt, Mycobacterium avium subsp. paratuberculosis
cggucagcaggcgccg

SEQ ID NO: 947325 - RNA, 16 nt, Mycobacterium avium subsp. paratuberculosis
cggucaaguccgcgag

SEQ ID NO: 947326 - RNA, 19 nt, Mycobacterium avium subsp. paratuberculosis
cggucagaccuucgcgauc

SEQ ID NO: 947327 - RNA, 21 nt, Mycobacterium avium subsp. paratuberculosis
cggucagaccuucgcgaucac

SEQ ID NO: 947328 - RNA, 14 nt, Mycobacterium avium subsp. paratuberculosis
cggucagacgaugg

SEQ ID NO: 947329 - RNA, 19 nt, Mycobacterium avium subsp. paratuberculosis
cggucagacgaugggccgc

SEQ ID NO: 947330 - RNA, 17 nt, Mycobacterium avium subsp. paratuberculosis
cggucagcccccaccgc

SEQ ID NO: 947331 - RNA, 20 nt, Mycobacterium avium subsp. paratuberculosis
cggucagcccccaccgcgcc

SEQ ID NO: 947332 - RNA, 14 nt, Mycobacterium avium subsp. paratuberculosis
cggucagcccgccc

SEQ ID NO: 947333 - RNA, 13 nt, Mycobacterium avium subsp. paratuberculosis
cggucagccggcu

SEQ ID NO: 947334 - RNA, 16 nt, Mycobacterium avium subsp. paratuberculosis
cggucagccggcucgg

SEQ ID NO: 947335 - RNA, 13 nt, Mycobacterium avium subsp. paratuberculosis
cggucagcgagcg

SEQ ID NO: 947336 - RNA, 22 nt, Mycobacterium avium subsp. paratuberculosis
cggucagcgagcgguuggcgac

SEQ ID NO: 947337 - RNA, 13 nt, Mycobacterium avium subsp. paratuberculosis
cggucagcgccag

SEQ ID NO: 947338 - RNA, 16 nt, Mycobacterium avium subsp. paratuberculosis
cggucagcgccagcau

SEQ ID NO: 947339 - RNA, 19 nt, Mycobacterium avium subsp. paratuberculosis
cggucagcgccagcaugcc

SEQ ID NO: 947340 - RNA, 16 nt, Mycobacterium avium subsp. paratuberculosis
cggucagcgcgccguc

SEQ ID NO: 947341 - RNA, 21 nt, Mycobacterium avium subsp. paratuberculosis
cggucagcgcgucggcgaccg

SEQ ID NO: 947342 - RNA, 22 nt, Mycobacterium avium subsp. paratuberculosis
cggucagcggcaacacgccggc

SEQ ID NO: 947343 - RNA, 17 nt, Mycobacterium avium subsp. paratuberculosis
cggucagcggccagccc

SEQ ID NO: 947344 - RNA, 19 nt, Mycobacterium avium subsp. paratuberculosis
cggucagcggccagcccau

SEQ ID NO: 947345 - RNA, 15 nt, Mycobacterium avium subsp. paratuberculosis
cggucagcggcgugc

SEQ ID NO: 947346 - RNA, 18 nt, Mycobacterium avium subsp. paratuberculosis
cggucaccucgucgaucc

SEQ ID NO: 947347 - RNA, 19 nt, Mycobacterium avium subsp. paratuberculosis
cggucacgcuggcgugacg

SEQ ID NO: 947348 - RNA, 18 nt, Mycobacterium avium subsp. paratuberculosis
cggucacggacagccggc

SEQ ID NO: 947349 - RNA, 17 nt, Mycobacterium avium subsp. paratuberculosis
cggucacggccgccagc

SEQ ID NO: 947350 - RNA, 23 nt, Mycobacterium avium subsp. paratuberculosis
cggucacggucuggcuggugacc

SEQ ID NO: 947351 - RNA, 17 nt, Mycobacterium avium subsp. paratuberculosis
cggucacggugacgguu

SEQ ID NO: 947352 - RNA, 20 nt, Mycobacterium avium subsp. paratuberculosis
cggucacguagcucagcgga

SEQ ID NO: 947353 - RNA, 14 nt, Mycobacterium avium subsp. paratuberculosis
cggucacguagugc

SEQ ID NO: 947354 - RNA, 15 nt, Mycobacterium avium subsp. paratuberculosis
cggucaccggcucgg

SEQ ID NO: 947355 - RNA, 12 nt, Mycobacterium avium subsp. paratuberculosis
cggucaccgguc

SEQ ID NO: 947356 - RNA, 14 nt, Mycobacterium avium subsp. paratuberculosis
cggucaccgguccg

SEQ ID NO: 947357 - RNA, 16 nt, Mycobacterium avium subsp. paratuberculosis
cggucaccggucgcgu

SEQ ID NO: 947358 - RNA, 23 nt, Mycobacterium avium subsp. paratuberculosis
cggucaccggugucacgcuggcg

SEQ ID NO: 947359 - RNA, 17 nt, Mycobacterium avium subsp. paratuberculosis
cggucaccccgaguucg

SEQ ID NO: 947360 - RNA, 22 nt, Mycobacterium avium subsp. paratuberculosis
cggucaccccgaguucggccag

SEQ ID NO: 947361 - RNA, 23 nt, Mycobacterium avium subsp. paratuberculosis
cggucaccccggagauccggccg

SEQ ID NO: 947362 - RNA, 15 nt, Mycobacterium avium subsp. paratuberculosis
cggucaccccggcca

SEQ ID NO: 947363 - RNA, 17 nt, Mycobacterium avium subsp. paratuberculosis
cggucaccccggccauc

SEQ ID NO: 947364 - RNA, 16 nt, Mycobacterium avium subsp. paratuberculosis
cggucacccaggccga

SEQ ID NO: 947365 - RNA, 14 nt, Mycobacterium avium subsp. paratuberculosis
cggucaccagcggc

SEQ ID NO: 947366 - RNA, 23 nt, Mycobacterium avium subsp. paratuberculosis
cggucaccagcucccacgacgac

SEQ ID NO: 947367 - RNA, 14 nt, Mycobacterium avium subsp. paratuberculosis
cggucaccaucagc

SEQ ID NO: 947368 - RNA, 18 nt, Mycobacterium avium subsp. paratuberculosis
cggucaccaucagcaccg

SEQ ID NO: 947369 - RNA, 19 nt, Mycobacterium avium subsp. paratuberculosis
cggucaccaucagcaccgc

SEQ ID NO: 947370 - RNA, 15 nt, Mycobacterium avium subsp. paratuberculosis
cggucacccgugggc

SEQ ID NO: 947371 - RNA, 23 nt, Mycobacterium avium subsp. paratuberculosis
cggucacccgugggccgaccggc

SEQ ID NO: 947372 - RNA, 14 nt, Mycobacterium avium subsp. paratuberculosis
cggucaccgagcgg

SEQ ID NO: 947373 - RNA, 15 nt, Mycobacterium avium subsp. paratuberculosis
cggucaccgagcggc

SEQ ID NO: 947374 - RNA, 17 nt, Mycobacterium avium subsp. paratuberculosis
cggucaccgagcggccg

SEQ ID NO: 947375 - RNA, 18 nt, Mycobacterium avium subsp. paratuberculosis
cggucaccgagcggccgu

SEQ ID NO: 947376 - RNA, 20 nt, Mycobacterium avium subsp. paratuberculosis
cggucaccgagcucauggug

SEQ ID NO: 947377 - RNA, 21 nt, Mycobacterium avium subsp. paratuberculosis
cggucaagaacgaaucgucgc

SEQ ID NO: 947378 - RNA, 22 nt, Mycobacterium avium subsp. paratuberculosis
cggucaagaacgcaaucgccca

SEQ ID NO: 947379 - RNA, 19 nt, Mycobacterium avium subsp. paratuberculosis
cggucaagccggccagcag

SEQ ID NO: 947380 - RNA, 20 nt, Mycobacterium avium subsp. paratuberculosis
cggucaagccggccagcagc

SEQ ID NO: 947381 - RNA, 19 nt, Mycobacterium avium subsp. paratuberculosis
cggucaagcgcuuucgccg

SEQ ID NO: 947382 - RNA, 22 nt, Mycobacterium avium subsp. paratuberculosis
cggucaagcgcuuucgccgaau

SEQ ID NO: 947383 - RNA, 14 nt, Mycobacterium avium subsp. paratuberculosis
cggucaccaaggcg

SEQ ID NO: 947384 - RNA, 16 nt, Mycobacterium avium subsp. paratuberculosis
cggucaccaaggcgau

SEQ ID NO: 947385 - RNA, 17 nt, Mycobacterium avium subsp. paratuberculosis
cggucagcucgggguag

SEQ ID NO: 947386 - RNA, 22 nt, Mycobacterium avium subsp. paratuberculosis
cggucagcucgaaggugaccau

SEQ ID NO: 947387 - RNA, 18 nt, Mycobacterium avium subsp. paratuberculosis
cggucagcucgaucgccg

SEQ ID NO: 947388 - RNA, 15 nt, Mycobacterium avium subsp. paratuberculosis
cggucagcucgcgcc

SEQ ID NO: 947389 - RNA, 18 nt, Mycobacterium avium subsp. paratuberculosis
cggucagcucgcgcccgg

SEQ ID NO: 947390 - RNA, 14 nt, Mycobacterium avium subsp. paratuberculosis
cggucagcguccag

SEQ ID NO: 947391 - RNA, 19 nt, Mycobacterium avium subsp. paratuberculosis
cggucagcguccaguccgg

SEQ ID NO: 947392 - RNA, 17 nt, Mycobacterium avium subsp. paratuberculosis
cggucagcgucgccgcc

SEQ ID NO: 947393 - RNA, 16 nt, Mycobacterium avium subsp. paratuberculosis
cggucagcgucuggcg

SEQ ID NO: 947394 - RNA, 14 nt, Mycobacterium avium subsp. paratuberculosis
cggucagcguggcg

SEQ ID NO: 947395 - RNA, 18 nt, Mycobacterium avium subsp. paratuberculosis
cggucagcguggcgucgg

SEQ ID NO: 947396 - RNA, 22 nt, Mycobacterium avium subsp. paratuberculosis
cggucagcucaggaacggccgg

SEQ ID NO: 947397 - RNA, 23 nt, Mycobacterium avium subsp. paratuberculosis
cggucaggaucgacuccgggugg

SEQ ID NO: 947398 - RNA, 17 nt, Mycobacterium avium subsp. paratuberculosis
cggucaggcacucgauc

SEQ ID NO: 947399 - RNA, 22 nt, Mycobacterium avium subsp. paratuberculosis
cggucaggcacucgaucagcac

SEQ ID NO: 947400 - RNA, 21 nt, Mycobacterium avium subsp. paratuberculosis
cggucaggaacccggcccgga

SEQ ID NO: 947401 - RNA, 13 nt, Mycobacterium avium subsp. paratuberculosis
cggucaggaacgc

SEQ ID NO: 947402 - RNA, 23 nt, Mycobacterium avium subsp. paratuberculosis
cggucaggcauuccaccgcgcgg

SEQ ID NO: 947403 - RNA, 20 nt, Mycobacterium avium subsp. paratuberculosis
cggucagucgcgccgccagc

SEQ ID NO: 947404 - RNA, 22 nt, Mycobacterium avium subsp. paratuberculosis
cggucagucgcgccgccagcaa

SEQ ID NO: 947405 - RNA, 18 nt, Mycobacterium avium subsp. paratuberculosis
cggucagguugacgccga

SEQ ID NO: 947406 - RNA, 18 nt, Mycobacterium avium subsp. paratuberculosis
cggucaggccggcgccgg

SEQ ID NO: 947407 - RNA, 21 nt, Mycobacterium avium subsp. paratuberculosis
cggucaggccggcgccgggaa

SEQ ID NO: 947408 - RNA, 13 nt, Mycobacterium avium subsp. paratuberculosis
cggucaggccguc

SEQ ID NO: 947409 - RNA, 16 nt, Mycobacterium avium subsp. paratuberculosis
cggucaggcgcagcca

SEQ ID NO: 947410 - RNA, 16 nt, Mycobacterium avium subsp. paratuberculosis
cggucagggccagcaa

SEQ ID NO: 947411 - RNA, 17 nt, Mycobacterium avium subsp. paratuberculosis
cggucagggccagcaac

SEQ ID NO: 947412 - RNA, 15 nt, Mycobacterium avium subsp. paratuberculosis
cggucagggcucgca

SEQ ID NO: 947413 - RNA, 15 nt, Mycobacterium avium subsp. paratuberculosis
cgguccacgccggcg

SEQ ID NO: 947414 - RNA, 16 nt, Mycobacterium avium subsp. paratuberculosis
cgguccacgccggcga

SEQ ID NO: 947415 - RNA, 17 nt, Mycobacterium avium subsp. paratuberculosis
cgguccacgccggcgau

SEQ ID NO: 947416 - RNA, 19 nt, Mycobacterium avium subsp. paratuberculosis
cgguccacggucagcgcgu

SEQ ID NO: 947417 - RNA, 21 nt, Mycobacterium avium subsp. paratuberculosis
cgguccacggucagcgcgucg

SEQ ID NO: 947418 - RNA, 18 nt, Mycobacterium avium subsp. paratuberculosis
cgguccacgguggcgccg

SEQ ID NO: 947419 - RNA, 18 nt, Mycobacterium avium subsp. paratuberculosis
cgguccacucgucggcgg

SEQ ID NO: 947420 - RNA, 19 nt, Mycobacterium avium subsp. paratuberculosis
cgguccacucgucggcggu

SEQ ID NO: 947421 - RNA, 22 nt, Mycobacterium avium subsp. paratuberculosis
cgguccaacgggcucagcacca

SEQ ID NO: 947422 - RNA, 23 nt, Mycobacterium avium subsp. paratuberculosis
cgguccaacgggcucagcaccac

SEQ ID NO: 947423 - RNA, 17 nt, Mycobacterium avium subsp. paratuberculosis
cgguccaccaauggcgg

SEQ ID NO: 947424 - RNA, 16 nt, Mycobacterium avium subsp. paratuberculosis
cggucaugccgagccg

SEQ ID NO: 947425 - RNA, 17 nt, Mycobacterium avium subsp. paratuberculosis
cggucaugccgagccgc

SEQ ID NO: 947426 - RNA, 21 nt, Mycobacterium avium subsp. paratuberculosis
cggucauugaucuccgcggcg

SEQ ID NO: 947427 - RNA, 23 nt, Mycobacterium avium subsp. paratuberculosis
cggucauugaugccccgggugac

SEQ ID NO: 947428 - RNA, 20 nt, Mycobacterium avium subsp. paratuberculosis
cggucaucgugaucgcccac

SEQ ID NO: 947429 - RNA, 15 nt, Mycobacterium avium subsp. paratuberculosis
cggucaugcgcgggc

SEQ ID NO: 947430 - RNA, 16 nt, Mycobacterium avium subsp. paratuberculosis
cggucaugcgcgggca

SEQ ID NO: 947431 - RNA, 17 nt, Mycobacterium avium subsp. paratuberculosis
cggucaugcgcgggcaa

SEQ ID NO: 947432 - RNA, 16 nt, Mycobacterium avium subsp. paratuberculosis
cggucauccucgccgc

SEQ ID NO: 947433 - RNA, 17 nt, Mycobacterium avium subsp. paratuberculosis
cggucauccucgccgcg

SEQ ID NO: 947434 - RNA, 20 nt, Mycobacterium avium subsp. paratuberculosis
cggucauccucgccgcgcca

SEQ ID NO: 947435 - RNA, 14 nt, Mycobacterium avium subsp. paratuberculosis
cggucaucgagccg

SEQ ID NO: 947436 - RNA, 15 nt, Mycobacterium avium subsp. paratuberculosis
cggucaucgagccgg

SEQ ID NO: 947437 - RNA, 16 nt, Mycobacterium avium subsp. paratuberculosis
cggucauaggccgcgc

SEQ ID NO: 947438 - RNA, 18 nt, Mycobacterium avium subsp. paratuberculosis
cggucauaggccgcgcag

SEQ ID NO: 947439 - RNA, 17 nt, Mycobacterium avium subsp. paratuberculosis
cggucauccgggccacc

SEQ ID NO: 947440 - RNA, 20 nt, Mycobacterium avium subsp. paratuberculosis
cggucauccgggccaccacc

SEQ ID NO: 947441 - RNA, 18 nt, Mycobacterium avium subsp. paratuberculosis
cggucgaggucgccgaca

SEQ ID NO: 947442 - RNA, 16 nt, Mycobacterium avium subsp. paratuberculosis
cggucgaggucggcca

SEQ ID NO: 947443 - RNA, 14 nt, Mycobacterium avium subsp. paratuberculosis
cggucgaugacgcc

SEQ ID NO: 947444 - RNA, 20 nt, Mycobacterium avium subsp. paratuberculosis
cggucgaugacgccgcgccg

SEQ ID NO: 947445 - RNA, 23 nt, Mycobacterium avium subsp. paratuberculosis
cggucgaugagcuggugcagcga

SEQ ID NO: 947446 - RNA, 23 nt, Mycobacterium avium subsp. paratuberculosis
cggucgagucguagaggggccgg

SEQ ID NO: 947447 - RNA, 15 nt, Mycobacterium avium subsp. paratuberculosis
cggucgaugucggcg

SEQ ID NO: 947448 - RNA, 18 nt, Mycobacterium avium subsp. paratuberculosis
cggucgaugucggcgaac

SEQ ID NO: 947449 - RNA, 18 nt, Mycobacterium avium subsp. paratuberculosis
cggucgaucaccucgucg

SEQ ID NO: 947450 - RNA, 22 nt, Mycobacterium avium subsp. paratuberculosis
cggucgaugaucuggcgguccc

SEQ ID NO: 947451 - RNA, 16 nt, Mycobacterium avium subsp. paratuberculosis
cggucgacacgaucgg

SEQ ID NO: 947452 - RNA, 17 nt, Mycobacterium avium subsp. paratuberculosis
cggucgacacgaucggc

SEQ ID NO: 947453 - RNA, 23 nt, Mycobacterium avium subsp. paratuberculosis
cggucgaccucgagcgucacgcu

SEQ ID NO: 947454 - RNA, 17 nt, Mycobacterium avium subsp. paratuberculosis
cggucgacgauggcccg

SEQ ID NO: 947455 - RNA, 22 nt, Mycobacterium avium subsp. paratuberculosis
cggucgacgauggcccgggcca

SEQ ID NO: 947456 - RNA, 14 nt, Mycobacterium avium subsp. paratuberculosis
cggucgacgcgggg

SEQ ID NO: 947457 - RNA, 17 nt, Mycobacterium avium subsp. paratuberculosis
cggucgacgcggggcgg

SEQ ID NO: 947458 - RNA, 20 nt, Mycobacterium avium subsp. paratuberculosis
cggucgacgcggggcggcgg

SEQ ID NO: 947459 - RNA, 21 nt, Mycobacterium avium subsp. paratuberculosis
cggucgacgcggggcggcggc

SEQ ID NO: 947460 - RNA, 22 nt, Mycobacterium avium subsp. paratuberculosis
cggucgacgcggggcggcggcg

SEQ ID NO: 947461 - RNA, 14 nt, Mycobacterium avium subsp. paratuberculosis
cggucgacgacgaa

SEQ ID NO: 947462 - RNA, 16 nt, Mycobacterium avium subsp. paratuberculosis
cggucgacuugggcgg

SEQ ID NO: 947463 - RNA, 19 nt, Mycobacterium avium subsp. paratuberculosis
cggucgacuugggcggggg

SEQ ID NO: 947464 - RNA, 14 nt, Mycobacterium avium subsp. paratuberculosis
cgguccuuggcgua

SEQ ID NO: 947465 - RNA, 18 nt, Mycobacterium avium subsp. paratuberculosis
cggucgaacgccagcgcc

SEQ ID NO: 947466 - RNA, 20 nt, Mycobacterium avium subsp. paratuberculosis
cggucgaacgccagcgccgc

SEQ ID NO: 947467 - RNA, 12 nt, Mycobacterium avium subsp. paratuberculosis
cggucgaacgcg

SEQ ID NO: 947468 - RNA, 15 nt, Mycobacterium avium subsp. paratuberculosis
cggucgaacgcggcg

SEQ ID NO: 947469 - RNA, 17 nt, Mycobacterium avium subsp. paratuberculosis
cggucgaacgcggcgcc

SEQ ID NO: 947470 - RNA, 20 nt, Mycobacterium avium subsp. paratuberculosis
cggucgaacgcggcgccgac

SEQ ID NO: 947471 - RNA, 19 nt, Mycobacterium avium subsp. paratuberculosis
cggucgaacaacgcgguga

SEQ ID NO: 947472 - RNA, 18 nt, Mycobacterium avium subsp. paratuberculosis
cggucgaaggaggccagc

SEQ ID NO: 947473 - RNA, 16 nt, Mycobacterium avium subsp. paratuberculosis
cggucgaaggccccgg

SEQ ID NO: 947474 - RNA, 17 nt, Mycobacterium avium subsp. paratuberculosis
cggucgaaggccccggu

SEQ ID NO: 947475 - RNA, 14 nt, Mycobacterium avium subsp. paratuberculosis
cgguccucucgaag

SEQ ID NO: 947476 - RNA, 16 nt, Mycobacterium avium subsp. paratuberculosis
cgguccucucgaagcg

SEQ ID NO: 947477 - RNA, 16 nt, Mycobacterium avium subsp. paratuberculosis
cgguccucugcgacca

SEQ ID NO: 947478 - RNA, 16 nt, Mycobacterium avium subsp. paratuberculosis
cgguccugggccuccg

SEQ ID NO: 947479 - RNA, 20 nt, Mycobacterium avium subsp. paratuberculosis
cgguccugggccuccggcgg

SEQ ID NO: 947480 - RNA, 21 nt, Mycobacterium avium subsp. paratuberculosis
cgguccugggccuccggcggc

SEQ ID NO: 947481 - RNA, 22 nt, Mycobacterium avium subsp. paratuberculosis
cgguccugggccuccggcggca

SEQ ID NO: 947482 - RNA, 15 nt, Mycobacterium avium subsp. paratuberculosis
cgguccuucucgcac

SEQ ID NO: 947483 - RNA, 22 nt, Mycobacterium avium subsp. paratuberculosis
cgguccuucucgcacagcacca

SEQ ID NO: 947484 - RNA, 22 nt, Mycobacterium avium subsp. paratuberculosis
cgguccuugagguagucgcgca

SEQ ID NO: 947485 - RNA, 16 nt, Mycobacterium avium subsp. paratuberculosis
cgguccugcggcgaca

SEQ ID NO: 947486 - RNA, 21 nt, Mycobacterium avium subsp. paratuberculosis
cgguccugcggcgacaacgcg

SEQ ID NO: 947487 - RNA, 22 nt, Mycobacterium avium subsp. paratuberculosis
cgguccuccccgcuggcgccgg

SEQ ID NO: 947488 - RNA, 14 nt, Mycobacterium avium subsp. paratuberculosis
cgguccucgaaccg

SEQ ID NO: 947489 - RNA, 19 nt, Mycobacterium avium subsp. paratuberculosis
cgguccucgagcuggccgu

SEQ ID NO: 947490 - RNA, 18 nt, Mycobacterium avium subsp. paratuberculosis
cgguccggcccuggucgg

SEQ ID NO: 947491 - RNA, 13 nt, Mycobacterium avium subsp. paratuberculosis
cgguccggccgug

SEQ ID NO: 947492 - RNA, 16 nt, Mycobacterium avium subsp. paratuberculosis
cgguccggccgugccg

SEQ ID NO: 947493 - RNA, 12 nt, Mycobacterium avium subsp. paratuberculosis
cgguccgugcca

SEQ ID NO: 947494 - RNA, 19 nt, Mycobacterium avium subsp. paratuberculosis
cgguccgugccacggccgc

SEQ ID NO: 947495 - RNA, 21 nt, Mycobacterium avium subsp. paratuberculosis
cgguccgugccacggccgcgg

SEQ ID NO: 947496 - RNA, 13 nt, Mycobacterium avium subsp. paratuberculosis
cgguccagcguga

SEQ ID NO: 947497 - RNA, 18 nt, Mycobacterium avium subsp. paratuberculosis
cgguccaggauccgcacc

SEQ ID NO: 947498 - RNA, 18 nt, Mycobacterium avium subsp. paratuberculosis
cgguccaucuccagcucc

SEQ ID NO: 947499 - RNA, 19 nt, Mycobacterium avium subsp. paratuberculosis
cgguccaucuccagcuccg

SEQ ID NO: 947500 - RNA, 15 nt, Mycobacterium avium subsp. paratuberculosis
cggucccacucggga

SEQ ID NO: 947501 - RNA, 16 nt, Mycobacterium avium subsp. paratuberculosis
cggucccaguccccgg

SEQ ID NO: 947502 - RNA, 19 nt, Mycobacterium avium subsp. paratuberculosis
cggucccaguccccgguuc

SEQ ID NO: 947503 - RNA, 14 nt, Mycobacterium avium subsp. paratuberculosis
cgguccccgcgccc

SEQ ID NO: 947504 - RNA, 18 nt, Mycobacterium avium subsp. paratuberculosis
cgguccccgcgcccgccg

SEQ ID NO: 947505 - RNA, 16 nt, Mycobacterium avium subsp. paratuberculosis
cgguccaggcgaccgg

SEQ ID NO: 947506 - RNA, 18 nt, Mycobacterium avium subsp. paratuberculosis
cgguccaggcgaccggcc

SEQ ID NO: 947507 - RNA, 20 nt, Mycobacterium avium subsp. paratuberculosis
cgguccaggcgaccggcccc

SEQ ID NO: 947508 - RNA, 18 nt, Mycobacterium avium subsp. paratuberculosis
cgguccaggugggguggu

SEQ ID NO: 947509 - RNA, 21 nt, Mycobacterium avium subsp. paratuberculosis
cgguccagugccggcgagugc

SEQ ID NO: 947510 - RNA, 15 nt, Mycobacterium avium subsp. paratuberculosis
cgguccaucagcacc

SEQ ID NO: 947511 - RNA, 17 nt, Mycobacterium avium subsp. paratuberculosis
cgguccaucagcaccga

SEQ ID NO: 947512 - RNA, 15 nt, Mycobacterium avium subsp. paratuberculosis
cgguccauccagcgc

SEQ ID NO: 947513 - RNA, 16 nt, Mycobacterium avium subsp. paratuberculosis
cgguccauccagcgcc

SEQ ID NO: 947514 - RNA, 21 nt, Mycobacterium avium subsp. paratuberculosis
cgguccauccagcgccgcagc

SEQ ID NO: 947515 - RNA, 22 nt, Mycobacterium avium subsp. paratuberculosis
cgguccaccuggcugugcacga

SEQ ID NO: 947516 - RNA, 20 nt, Mycobacterium avium subsp. paratuberculosis
cgguccagaucggcgcgcgg

SEQ ID NO: 947517 - RNA, 12 nt, Mycobacterium avium subsp. paratuberculosis
cgguccagcccg

SEQ ID NO: 947518 - RNA, 16 nt, Mycobacterium avium subsp. paratuberculosis
cggucccgcggcggcg

SEQ ID NO: 947519 - RNA, 18 nt, Mycobacterium avium subsp. paratuberculosis
cggucccgcggcggcgcc

SEQ ID NO: 947520 - RNA, 12 nt, Mycobacterium avium subsp. paratuberculosis
cggucccggcgg

SEQ ID NO: 947521 - RNA, 13 nt, Mycobacterium avium subsp. paratuberculosis
cggucccggcggg

SEQ ID NO: 947522 - RNA, 14 nt, Mycobacterium avium subsp. paratuberculosis
cggucccggcgggg

SEQ ID NO: 947523 - RNA, 21 nt, Mycobacterium avium subsp. paratuberculosis
cggucccggcgggggcggcgg

SEQ ID NO: 947524 - RNA, 13 nt, Mycobacterium avium subsp. paratuberculosis
cgguccgacaccg

SEQ ID NO: 947525 - RNA, 13 nt, Mycobacterium avium subsp. paratuberculosis
cgguccgaccagc

SEQ ID NO: 947526 - RNA, 14 nt, Mycobacterium avium subsp. paratuberculosis
cgguccgaccagcg

SEQ ID NO: 947527 - RNA, 16 nt, Mycobacterium avium subsp. paratuberculosis
cgguccgaccagcggc

SEQ ID NO: 947528 - RNA, 17 nt, Mycobacterium avium subsp. paratuberculosis
cgguccgaccagcggcc

SEQ ID NO: 947529 - RNA, 18 nt, Mycobacterium avium subsp. paratuberculosis
cgguccgaccagcggccc

SEQ ID NO: 947530 - RNA, 19 nt, Mycobacterium avium subsp. paratuberculosis
cgguccgaccagcggccca

SEQ ID NO: 947531 - RNA, 15 nt, Mycobacterium avium subsp. paratuberculosis
cgguccgaccgccac

SEQ ID NO: 947532 - RNA, 19 nt, Mycobacterium avium subsp. paratuberculosis
cgguccgaccgccaccacc

SEQ ID NO: 947533 - RNA, 22 nt, Mycobacterium avium subsp. paratuberculosis
cgguccgaccgccaccacccgg

SEQ ID NO: 947534 - RNA, 14 nt, Mycobacterium avium subsp. paratuberculosis
cgguccgacggcug

SEQ ID NO: 947535 - RNA, 16 nt, Mycobacterium avium subsp. paratuberculosis
cgguccgacggcugcg

SEQ ID NO: 947536 - RNA, 13 nt, Mycobacterium avium subsp. paratuberculosis
cggucccgacgcg

SEQ ID NO: 947537 - RNA, 16 nt, Mycobacterium avium subsp. paratuberculosis
cggucccgacgcggcg

SEQ ID NO: 947538 - RNA, 19 nt, Mycobacterium avium subsp. paratuberculosis
cggucccgacgcggcgcga

SEQ ID NO: 947539 - RNA, 14 nt, Mycobacterium avium subsp. paratuberculosis
cggucccgacgcug

SEQ ID NO: 947540 - RNA, 22 nt, Mycobacterium avium subsp. paratuberculosis
cggucccgcauguccgggguga

SEQ ID NO: 947541 - RNA, 18 nt, Mycobacterium avium subsp. paratuberculosis
cggucccguccaucgccg

SEQ ID NO: 947542 - RNA, 16 nt, Mycobacterium avium subsp. paratuberculosis
cggucccgugcgccgc

SEQ ID NO: 947543 - RNA, 19 nt, Mycobacterium avium subsp. paratuberculosis
cggucccgugcgccgccca

SEQ ID NO: 947544 - RNA, 20 nt, Mycobacterium avium subsp. paratuberculosis
cggucccgugcgccgcccac

SEQ ID NO: 947545 - RNA, 14 nt, Mycobacterium avium subsp. paratuberculosis
cgguccgccgucgg

SEQ ID NO: 947546 - RNA, 15 nt, Mycobacterium avium subsp. paratuberculosis
cgguccgccgucggg

SEQ ID NO: 947547 - RNA, 20 nt, Mycobacterium avium subsp. paratuberculosis
cgguccgccgcagcggcgcc

SEQ ID NO: 947548 - RNA, 21 nt, Mycobacterium avium subsp. paratuberculosis
cgguccgccgcagcggcgccg

SEQ ID NO: 947549 - RNA, 14 nt, Mycobacterium avium subsp. paratuberculosis
cgguccgccgccgg

SEQ ID NO: 947550 - RNA, 18 nt, Mycobacterium avium subsp. paratuberculosis
cgguccgccgccggcgga

SEQ ID NO: 947551 - RNA, 20 nt, Mycobacterium avium subsp. paratuberculosis
cgguccgcccagacgcgggc

SEQ ID NO: 947552 - RNA, 14 nt, Mycobacterium avium subsp. paratuberculosis
cgguccgcccggac

SEQ ID NO: 947553 - RNA, 23 nt, Mycobacterium avium subsp. paratuberculosis
cgguccgcucaucgucguuggcg

SEQ ID NO: 947554 - RNA, 17 nt, Mycobacterium avium subsp. paratuberculosis
cgguccgcuccaccagc

SEQ ID NO: 947555 - RNA, 14 nt, Mycobacterium avium subsp. paratuberculosis
cgguccggcggcac

SEQ ID NO: 947556 - RNA, 15 nt, Mycobacterium avium subsp. paratuberculosis
cgguccggcugaacg

SEQ ID NO: 947557 - RNA, 20 nt, Mycobacterium avium subsp. paratuberculosis
cgguccggcugaacgccagc

SEQ ID NO: 947558 - RNA, 22 nt, Mycobacterium avium subsp. paratuberculosis
cgguccggcugaacgccagcag

SEQ ID NO: 947559 - RNA, 22 nt, Mycobacterium avium subsp. paratuberculosis
cgguccggcuggucggccuggc

SEQ ID NO: 947560 - RNA, 19 nt, Mycobacterium avium subsp. paratuberculosis
cggguuccgguuggccagg

SEQ ID NO: 947561 - RNA, 21 nt, Mycobacterium avium subsp. paratuberculosis
cggguguuggagccguccggg

SEQ ID NO: 947562 - RNA, 13 nt, Mycobacterium avium subsp. paratuberculosis
cggguucgacgcc

SEQ ID NO: 947563 - RNA, 17 nt, Mycobacterium avium subsp. paratuberculosis
cggguucgacgccucgg

SEQ ID NO: 947564 - RNA, 22 nt, Mycobacterium avium subsp. paratuberculosis
cggguucgacgccucggugcgg

SEQ ID NO: 947565 - RNA, 23 nt, Mycobacterium avium subsp. paratuberculosis
cggguucgacgccucggugcgga

SEQ ID NO: 947566 - RNA, 22 nt, Mycobacterium avium subsp. paratuberculosis
cggguucgcccuccccggccag

SEQ ID NO: 947567 - RNA, 15 nt, Mycobacterium avium subsp. paratuberculosis
cggguucggucucgg

SEQ ID NO: 947568 - RNA, 23 nt, Mycobacterium avium subsp. paratuberculosis
cggguucugauacaccacccggu

SEQ ID NO: 947569 - RNA, 14 nt, Mycobacterium avium subsp. paratuberculosis
cggguugcgggcca

SEQ ID NO: 947570 - RNA, 20 nt, Mycobacterium avium subsp. paratuberculosis
cggguugcgggccaggcacg

SEQ ID NO: 947571 - RNA, 14 nt, Mycobacterium avium subsp. paratuberculosis
cggguugcggucca

SEQ ID NO: 947572 - RNA, 13 nt, Mycobacterium avium subsp. paratuberculosis
cggguugccggcg

SEQ ID NO: 947573 - RNA, 17 nt, Mycobacterium avium subsp. paratuberculosis
cggguugccgucgacga

SEQ ID NO: 947574 - RNA, 20 nt, Mycobacterium avium subsp. paratuberculosis
cggguugcggaucggugcag

SEQ ID NO: 947575 - RNA, 22 nt, Mycobacterium avium subsp. paratuberculosis
cggguugcggaucggugcaggc

SEQ ID NO: 947576 - RNA, 13 nt, Mycobacterium avium subsp. paratuberculosis
cggguugcaggcg

SEQ ID NO: 947577 - RNA, 15 nt, Mycobacterium avium subsp. paratuberculosis
cggguugagcagguc

SEQ ID NO: 947578 - RNA, 22 nt, Mycobacterium avium subsp. paratuberculosis
cggguucuggccguggucggcg

SEQ ID NO: 947579 - RNA, 20 nt, Mycobacterium avium subsp. paratuberculosis
cggguucuucagggcggugc

SEQ ID NO: 947580 - RNA, 22 nt, Mycobacterium avium subsp. paratuberculosis
cggguucuucagggcggugcgg

SEQ ID NO: 947581 - RNA, 21 nt, Mycobacterium avium subsp. paratuberculosis
cggguguuucggucggcgucg

SEQ ID NO: 947582 - RNA, 22 nt, Mycobacterium avium subsp. paratuberculosis
cggguguuucggucggcgucga

SEQ ID NO: 947583 - RNA, 19 nt, Mycobacterium avium subsp. paratuberculosis
cggguguugaccuugucga

SEQ ID NO: 947584 - RNA, 22 nt, Mycobacterium avium subsp. paratuberculosis
cggguguugaccuugucgaagg

SEQ ID NO: 947585 - RNA, 17 nt, Mycobacterium avium subsp. paratuberculosis
cggguguugcgcagcgu

SEQ ID NO: 947586 - RNA, 18 nt, Mycobacterium avium subsp. paratuberculosis
cggguguugcgcagcguc

SEQ ID NO: 947587 - RNA, 15 nt, Mycobacterium avium subsp. paratuberculosis
cggguguucagcccc

SEQ ID NO: 947588 - RNA, 14 nt, Mycobacterium avium subsp. paratuberculosis
cggguguggcgccg

SEQ ID NO: 947589 - RNA, 15 nt, Mycobacterium avium subsp. paratuberculosis
cggguguggcgccgu

SEQ ID NO: 947590 - RNA, 15 nt, Mycobacterium avium subsp. paratuberculosis
cgggugugggcgccg

SEQ ID NO: 947591 - RNA, 16 nt, Mycobacterium avium subsp. paratuberculosis
cgggugugggcgccgu

SEQ ID NO: 947592 - RNA, 18 nt, Mycobacterium avium subsp. paratuberculosis
cgggugugauugccagcu

SEQ ID NO: 947593 - RNA, 17 nt, Mycobacterium avium subsp. paratuberculosis
cgggugggccgaccugc

SEQ ID NO: 947594 - RNA, 22 nt, Mycobacterium avium subsp. paratuberculosis
cgggugggccgaccugcacgcu

SEQ ID NO: 947595 - RNA, 18 nt, Mycobacterium avium subsp. paratuberculosis
cgggugguguggcgucgg

SEQ ID NO: 947596 - RNA, 19 nt, Mycobacterium avium subsp. paratuberculosis
cgggugguguggcgucggc

SEQ ID NO: 947597 - RNA, 20 nt, Mycobacterium avium subsp. paratuberculosis
cgggugguguggcgucggcc

SEQ ID NO: 947598 - RNA, 16 nt, Mycobacterium avium subsp. paratuberculosis
cgggugguuggccgcc

SEQ ID NO: 947599 - RNA, 16 nt, Mycobacterium avium subsp. paratuberculosis
cggguguauucgccca

SEQ ID NO: 947600 - RNA, 22 nt, Mycobacterium avium subsp. paratuberculosis
cggguguauucgcccaccccgg

SEQ ID NO: 947601 - RNA, 16 nt, Mycobacterium avium subsp. paratuberculosis
cgggugucaggucggc

SEQ ID NO: 947602 - RNA, 17 nt, Mycobacterium avium subsp. paratuberculosis
cgggugucaggucggcg

SEQ ID NO: 947603 - RNA, 13 nt, Mycobacterium avium subsp. paratuberculosis
cgggugucgacgc

SEQ ID NO: 947604 - RNA, 17 nt, Mycobacterium avium subsp. paratuberculosis
cgggugucgagccacca

SEQ ID NO: 947605 - RNA, 13 nt, Mycobacterium avium subsp. paratuberculosis
cgggugucgccga

SEQ ID NO: 947606 - RNA, 14 nt, Mycobacterium avium subsp. paratuberculosis
cgggugucgccgag

SEQ ID NO: 947607 - RNA, 21 nt, Mycobacterium avium subsp. paratuberculosis
cgggugucgccgagccgcacc

SEQ ID NO: 947608 - RNA, 13 nt, Mycobacterium avium subsp. paratuberculosis
cgggugucgccgg

SEQ ID NO: 947609 - RNA, 14 nt, Mycobacterium avium subsp. paratuberculosis
cgggugucgccggu

SEQ ID NO: 947610 - RNA, 19 nt, Mycobacterium avium subsp. paratuberculosis
cgggugucgccgguggugc

SEQ ID NO: 947611 - RNA, 20 nt, Mycobacterium avium subsp. paratuberculosis
cgggugcgauggcaacgccg

SEQ ID NO: 947612 - RNA, 13 nt, Mycobacterium avium subsp. paratuberculosis
cgggugcgacggc

SEQ ID NO: 947613 - RNA, 16 nt, Mycobacterium avium subsp. paratuberculosis
cgggugcgcgucgcgg

SEQ ID NO: 947614 - RNA, 23 nt, Mycobacterium avium subsp. paratuberculosis
cgggugcgcgucgcgguggagca

SEQ ID NO: 947615 - RNA, 16 nt, Mycobacterium avium subsp. paratuberculosis
cgggugcgcugcagcg

SEQ ID NO: 947616 - RNA, 20 nt, Mycobacterium avium subsp. paratuberculosis
cgggugcgcugcagcgagac

SEQ ID NO: 947617 - RNA, 15 nt, Mycobacterium avium subsp. paratuberculosis
cgggugcucagccua

SEQ ID NO: 947618 - RNA, 22 nt, Mycobacterium avium subsp. paratuberculosis
cgggugcucagguugcgcagca

SEQ ID NO: 947619 - RNA, 14 nt, Mycobacterium avium subsp. paratuberculosis
cgggugcugaacgc

SEQ ID NO: 947620 - RNA, 22 nt, Mycobacterium avium subsp. paratuberculosis
cgggugcugaacgccugccggc

SEQ ID NO: 947621 - RNA, 12 nt, Mycobacterium avium subsp. paratuberculosis
cgggugcgggcg

SEQ ID NO: 947622 - RNA, 20 nt, Mycobacterium avium subsp. paratuberculosis
cgggugcgggcugacgucga

SEQ ID NO: 947623 - RNA, 23 nt, Mycobacterium avium subsp. paratuberculosis
cgggugcgggcugacgucgaagg

SEQ ID NO: 947624 - RNA, 13 nt, Mycobacterium avium subsp. paratuberculosis
cgggugcgggugc

SEQ ID NO: 947625 - RNA, 18 nt, Mycobacterium avium subsp. paratuberculosis
cgggugcgggugcggccg

SEQ ID NO: 947626 - RNA, 15 nt, Mycobacterium avium subsp. paratuberculosis
cgggugcggugcagc

SEQ ID NO: 947627 - RNA, 22 nt, Mycobacterium avium subsp. paratuberculosis
cgggugcggugcagccgcgguc

SEQ ID NO: 947628 - RNA, 20 nt, Mycobacterium avium subsp. paratuberculosis
cgggugcguccagaccggcc

SEQ ID NO: 947629 - RNA, 22 nt, Mycobacterium avium subsp. paratuberculosis
cgggugcguccagaccggccgg

SEQ ID NO: 947630 - RNA, 11 nt, Mycobacterium avium subsp. paratuberculosis
cgggugcggca

SEQ ID NO: 947631 - RNA, 12 nt, Mycobacterium avium subsp. paratuberculosis
cgggugcggcac

SEQ ID NO: 947632 - RNA, 13 nt, Mycobacterium avium subsp. paratuberculosis
cgggugcggccag

SEQ ID NO: 947633 - RNA, 14 nt, Mycobacterium avium subsp. paratuberculosis
cgggugcggccagc

SEQ ID NO: 947634 - RNA, 15 nt, Mycobacterium avium subsp. paratuberculosis
cgggugcggccagcg

SEQ ID NO: 947635 - RNA, 16 nt, Mycobacterium avium subsp. paratuberculosis
cgggugcggccagcgc

SEQ ID NO: 947636 - RNA, 12 nt, Mycobacterium avium subsp. paratuberculosis
cgggugcggccc

SEQ ID NO: 947637 - RNA, 13 nt, Mycobacterium avium subsp. paratuberculosis
cgggugcggccgg

SEQ ID NO: 947638 - RNA, 15 nt, Mycobacterium avium subsp. paratuberculosis
cgggugcggcgcucg

SEQ ID NO: 947639 - RNA, 14 nt, Mycobacterium avium subsp. paratuberculosis
cgggugcggcgcug

SEQ ID NO: 947640 - RNA, 18 nt, Mycobacterium avium subsp. paratuberculosis
cgggugcggcgcugccgg

SEQ ID NO: 947641 - RNA, 15 nt, Mycobacterium avium subsp. paratuberculosis
cgggugcggcggugu

SEQ ID NO: 947642 - RNA, 18 nt, Mycobacterium avium subsp. paratuberculosis
cgggugcgggccagcagc

SEQ ID NO: 947643 - RNA, 13 nt, Mycobacterium avium subsp. paratuberculosis
cgggugggcggca

SEQ ID NO: 947644 - RNA, 21 nt, Mycobacterium avium subsp. paratuberculosis
cggguggggaagacgugcacg

SEQ ID NO: 947645 - RNA, 17 nt, Mycobacterium avium subsp. paratuberculosis
cgggugggcagccccag

SEQ ID NO: 947646 - RNA, 14 nt, Mycobacterium avium subsp. paratuberculosis
cgggugggcagcgc

SEQ ID NO: 947647 - RNA, 15 nt, Mycobacterium avium subsp. paratuberculosis
cgggugggcagcgcg

SEQ ID NO: 947648 - RNA, 20 nt, Mycobacterium avium subsp. paratuberculosis
cgggugggcagcgcgauccg

SEQ ID NO: 947649 - RNA, 23 nt, Mycobacterium avium subsp. paratuberculosis
cgggugggcagcgcgauccgcgc

SEQ ID NO: 947650 - RNA, 13 nt, Mycobacterium avium subsp. paratuberculosis
cggguggcgucgc

SEQ ID NO: 947651 - RNA, 14 nt, Mycobacterium avium subsp. paratuberculosis
cggguggcgucgcc

SEQ ID NO: 947652 - RNA, 15 nt, Mycobacterium avium subsp. paratuberculosis
cggguggcgucgccg

SEQ ID NO: 947653 - RNA, 22 nt, Mycobacterium avium subsp. paratuberculosis
cggguggcgucgccgccggugc

SEQ ID NO: 947654 - RNA, 20 nt, Mycobacterium avium subsp. paratuberculosis
cggguggaucuugacggcga

SEQ ID NO: 947655 - RNA, 14 nt, Mycobacterium avium subsp. paratuberculosis
cggguggcccgcac

SEQ ID NO: 947656 - RNA, 22 nt, Mycobacterium avium subsp. paratuberculosis
cggguggcccgcacguagacgg

SEQ ID NO: 947657 - RNA, 15 nt, Mycobacterium avium subsp. paratuberculosis
cggguggccuccgga

SEQ ID NO: 947658 - RNA, 13 nt, Mycobacterium avium subsp. paratuberculosis
cggguggcgauga

SEQ ID NO: 947659 - RNA, 13 nt, Mycobacterium avium subsp. paratuberculosis
cggguggcggccg

SEQ ID NO: 947660 - RNA, 14 nt, Mycobacterium avium subsp. paratuberculosis
cggguggcggccgg

SEQ ID NO: 947661 - RNA, 14 nt, Mycobacterium avium subsp. paratuberculosis
cggguggcggggcg

SEQ ID NO: 947662 - RNA, 20 nt, Mycobacterium avium subsp. paratuberculosis
cggguggcguccagaugccg

SEQ ID NO: 947663 - RNA, 16 nt, Mycobacterium avium subsp. paratuberculosis
cggguggccgccacgu

SEQ ID NO: 947664 - RNA, 16 nt, Mycobacterium avium subsp. paratuberculosis
cggguggccgggucgc

SEQ ID NO: 947665 - RNA, 18 nt, Mycobacterium avium subsp. paratuberculosis
cggguggccgggucgccg

SEQ ID NO: 947666 - RNA, 13 nt, Mycobacterium avium subsp. paratuberculosis
cggguggccguga

SEQ ID NO: 947667 - RNA, 14 nt, Mycobacterium avium subsp. paratuberculosis
cggguggccagcac

SEQ ID NO: 947668 - RNA, 16 nt, Mycobacterium avium subsp. paratuberculosis
cggguggccagcacca

SEQ ID NO: 947669 - RNA, 21 nt, Mycobacterium avium subsp. paratuberculosis
cggguggccagcaccagcccg

SEQ ID NO: 947670 - RNA, 15 nt, Mycobacterium avium subsp. paratuberculosis
cggguggccagccag

SEQ ID NO: 947671 - RNA, 17 nt, Mycobacterium avium subsp. paratuberculosis
cggguggacgcccgcga

SEQ ID NO: 947672 - RNA, 12 nt, Mycobacterium avium subsp. paratuberculosis
cgggugcugggc

SEQ ID NO: 947673 - RNA, 19 nt, Mycobacterium avium subsp. paratuberculosis
cgggugcuggucagcaucg

SEQ ID NO: 947674 - RNA, 22 nt, Mycobacterium avium subsp. paratuberculosis
cgggugcuuucgcgucugcucg

SEQ ID NO: 947675 - RNA, 22 nt, Mycobacterium avium subsp. paratuberculosis
cggguggaacuggacgccgugg

SEQ ID NO: 947676 - RNA, 14 nt, Mycobacterium avium subsp. paratuberculosis
cggguggacaccgc

SEQ ID NO: 947677 - RNA, 16 nt, Mycobacterium avium subsp. paratuberculosis
cggguggacaccgcga

SEQ ID NO: 947678 - RNA, 18 nt, Mycobacterium avium subsp. paratuberculosis
cggguggacaccgcgauc

SEQ ID NO: 947679 - RNA, 21 nt, Mycobacterium avium subsp. paratuberculosis
cggguggacaccgcgaucacc

SEQ ID NO: 947680 - RNA, 22 nt, Mycobacterium avium subsp. paratuberculosis
cggguggacaccgcgaucacca

SEQ ID NO: 947681 - RNA, 15 nt, Mycobacterium avium subsp. paratuberculosis
cgggugaaucgacac

SEQ ID NO: 947682 - RNA, 22 nt, Mycobacterium avium subsp. paratuberculosis
cgggugacaacggugguggcga

SEQ ID NO: 947683 - RNA, 22 nt, Mycobacterium avium subsp. paratuberculosis
cgggugaacccgacguugccgc

SEQ ID NO: 947684 - RNA, 22 nt, Mycobacterium avium subsp. paratuberculosis
cgggucuagaucuccaggcucg

SEQ ID NO: 947685 - RNA, 20 nt, Mycobacterium avium subsp. paratuberculosis
cgggugaacgaggccgcgcc

SEQ ID NO: 947686 - RNA, 21 nt, Mycobacterium avium subsp. paratuberculosis
cgggugaacgaggccgcgccg

SEQ ID NO: 947687 - RNA, 14 nt, Mycobacterium avium subsp. paratuberculosis
cgggucugccacgc

SEQ ID NO: 947688 - RNA, 15 nt, Mycobacterium avium subsp. paratuberculosis
cgggucugccacgcc

SEQ ID NO: 947689 - RNA, 17 nt, Mycobacterium avium subsp. paratuberculosis
cgggucugccacgccca

SEQ ID NO: 947690 - RNA, 17 nt, Mycobacterium avium subsp. paratuberculosis
cgggucucgcgccacca

SEQ ID NO: 947691 - RNA, 19 nt, Mycobacterium avium subsp. paratuberculosis
cgggucuggcucggcacca

SEQ ID NO: 947692 - RNA, 20 nt, Mycobacterium avium subsp. paratuberculosis
cgggucuuccacgccgguga

SEQ ID NO: 947693 - RNA, 19 nt, Mycobacterium avium subsp. paratuberculosis
cgggucucgaaccgggcgg

SEQ ID NO: 947694 - RNA, 14 nt, Mycobacterium avium subsp. paratuberculosis
cgggucgucgaugc

SEQ ID NO: 947695 - RNA, 17 nt, Mycobacterium avium subsp. paratuberculosis
cgggucgcuggccgcga

SEQ ID NO: 947696 - RNA, 14 nt, Mycobacterium avium subsp. paratuberculosis
cgggucgugcggcg

SEQ ID NO: 947697 - RNA, 20 nt, Mycobacterium avium subsp. paratuberculosis
cgggucguuggcggcggugg

SEQ ID NO: 947698 - RNA, 20 nt, Mycobacterium avium subsp. paratuberculosis
cgggucgucggugccgaagc

SEQ ID NO: 947699 - RNA, 18 nt, Mycobacterium avium subsp. paratuberculosis
cgggucgugcaucggcgc

SEQ ID NO: 947700 - RNA, 12 nt, Mycobacterium avium subsp. paratuberculosis
cgggucgucgau

SEQ ID NO: 947701 - RNA, 13 nt, Mycobacterium avium subsp. paratuberculosis
cgggucgucgcgg

SEQ ID NO: 947702 - RNA, 17 nt, Mycobacterium avium subsp. paratuberculosis
cgggucgucgcggaacc

SEQ ID NO: 947703 - RNA, 11 nt, Mycobacterium avium subsp. paratuberculosis
cgggucgucgg

SEQ ID NO: 947704 - RNA, 17 nt, Mycobacterium avium subsp. paratuberculosis
cgggucgucggcgucgg

SEQ ID NO: 947705 - RNA, 15 nt, Mycobacterium avium subsp. paratuberculosis
cgggucgucgggccg

SEQ ID NO: 947706 - RNA, 16 nt, Mycobacterium avium subsp. paratuberculosis
cgggucgucgggccgg

SEQ ID NO: 947707 - RNA, 15 nt, Mycobacterium avium subsp. paratuberculosis
cgggucgucgggcgg

SEQ ID NO: 947708 - RNA, 14 nt, Mycobacterium avium subsp. paratuberculosis
cgggucguccgcga

SEQ ID NO: 947709 - RNA, 15 nt, Mycobacterium avium subsp. paratuberculosis
cgggucguccgcgac

SEQ ID NO: 947710 - RNA, 13 nt, Mycobacterium avium subsp. paratuberculosis
cgggucguagccg

SEQ ID NO: 947711 - RNA, 20 nt, Mycobacterium avium subsp. paratuberculosis
cgggucguagccgaagccgc

SEQ ID NO: 947712 - RNA, 23 nt, Mycobacterium avium subsp. paratuberculosis
cgggucguagccgaagccgccgu

SEQ ID NO: 947713 - RNA, 16 nt, Mycobacterium avium subsp. paratuberculosis
cgggucguaggccgga

SEQ ID NO: 947714 - RNA, 18 nt, Mycobacterium avium subsp. paratuberculosis
cgggucguaggccggauc

SEQ ID NO: 947715 - RNA, 21 nt, Mycobacterium avium subsp. paratuberculosis
cgggucgggggugggcuccca

SEQ ID NO: 947716 - RNA, 15 nt, Mycobacterium avium subsp. paratuberculosis
cgggucggucggccc

SEQ ID NO: 947717 - RNA, 14 nt, Mycobacterium avium subsp. paratuberculosis
cgggucggcgacca

SEQ ID NO: 947718 - RNA, 15 nt, Mycobacterium avium subsp. paratuberculosis
cgggucggcgaccau

SEQ ID NO: 947719 - RNA, 22 nt, Mycobacterium avium subsp. paratuberculosis
cgggucggcgccggccagcggc

SEQ ID NO: 947720 - RNA, 20 nt, Mycobacterium avium subsp. paratuberculosis
cgggucgggaccgaugccgc

SEQ ID NO: 947721 - RNA, 12 nt, Mycobacterium avium subsp. paratuberculosis
cgggucggccgg

SEQ ID NO: 947722 - RNA, 13 nt, Mycobacterium avium subsp. paratuberculosis
cgggucggccggc

SEQ ID NO: 947723 - RNA, 14 nt, Mycobacterium avium subsp. paratuberculosis
cgggucggccggcg

SEQ ID NO: 947724 - RNA, 15 nt, Mycobacterium avium subsp. paratuberculosis
cgggucggcgacggc

SEQ ID NO: 947725 - RNA, 16 nt, Mycobacterium avium subsp. paratuberculosis
cgggucggcgacggcg

SEQ ID NO: 947726 - RNA, 17 nt, Mycobacterium avium subsp. paratuberculosis
cgggucggcgacggcgc

SEQ ID NO: 947727 - RNA, 19 nt, Mycobacterium avium subsp. paratuberculosis
cgggucggcgacggcgcuc

SEQ ID NO: 947728 - RNA, 20 nt, Mycobacterium avium subsp. paratuberculosis
cgggucggcgacggcgcuca

SEQ ID NO: 947729 - RNA, 21 nt, Mycobacterium avium subsp. paratuberculosis
cgggucggcgagcagccgcgc

SEQ ID NO: 947730 - RNA, 22 nt, Mycobacterium avium subsp. paratuberculosis
cgggucggcgagcagccgcgcc

SEQ ID NO: 947731 - RNA, 23 nt, Mycobacterium avium subsp. paratuberculosis
cgggucggcgagcagccgcgccg

SEQ ID NO: 947732 - RNA, 13 nt, Mycobacterium avium subsp. paratuberculosis
cgggucggcgccg

SEQ ID NO: 947733 - RNA, 22 nt, Mycobacterium avium subsp. paratuberculosis
cgggucgcggugggcucggcgc

SEQ ID NO: 947734 - RNA, 13 nt, Mycobacterium avium subsp. paratuberculosis
cgggucgcgguuc

SEQ ID NO: 947735 - RNA, 23 nt, Mycobacterium avium subsp. paratuberculosis
cgggucgcugagcaauucgguga

SEQ ID NO: 947736 - RNA, 14 nt, Mycobacterium avium subsp. paratuberculosis
cgggucgcggccca

SEQ ID NO: 947737 - RNA, 20 nt, Mycobacterium avium subsp. paratuberculosis
cgggucgcggcccaccgcgu

SEQ ID NO: 947738 - RNA, 14 nt, Mycobacterium avium subsp. paratuberculosis
cgggucgcggaucu

SEQ ID NO: 947739 - RNA, 20 nt, Mycobacterium avium subsp. paratuberculosis
cgggucgcggaucucgucgg

SEQ ID NO: 947740 - RNA, 14 nt, Mycobacterium avium subsp. paratuberculosis
cgggucgccggucu

SEQ ID NO: 947741 - RNA, 13 nt, Mycobacterium avium subsp. paratuberculosis
aaccaggccgcgc

SEQ ID NO: 947742 - RNA, 18 nt, Mycobacterium avium subsp. paratuberculosis
cgggugaccggcggccag

SEQ ID NO: 947743 - RNA, 14 nt, Mycobacterium avium subsp. paratuberculosis
aaccaggucgcggc

SEQ ID NO: 947744 - RNA, 14 nt, Mycobacterium avium subsp. paratuberculosis
aaccagcgacgcca

SEQ ID NO: 947745 - RNA, 24 nt, Mycobacterium avium subsp. paratuberculosis
cgggugaccgccuuggcgcgcucg

SEQ ID NO: 947746 - RNA, 14 nt, Mycobacterium avium subsp. paratuberculosis
cgggugaccggcgc

SEQ ID NO: 947747 - RNA, 15 nt, Mycobacterium avium subsp. paratuberculosis
cgggugaccggcgcc

SEQ ID NO: 947748 - RNA, 16 nt, Mycobacterium avium subsp. paratuberculosis
cgggugaccggcgccg

SEQ ID NO: 947749 - RNA, 17 nt, Mycobacterium avium subsp. paratuberculosis
cgggugaccggcgccgg

SEQ ID NO: 947750 - RNA, 16 nt, Mycobacterium avium subsp. paratuberculosis
cgggugaccggcgcgc

SEQ ID NO: 947751 - RNA, 17 nt, Mycobacterium avium subsp. paratuberculosis
cgggugaccggcggcca

SEQ ID NO: 947752 - RNA, 14 nt, Mycobacterium avium subsp. paratuberculosis
aaccagcagcgcca

SEQ ID NO: 947753 - RNA, 17 nt, Mycobacterium avium subsp. paratuberculosis
cgggugauuucggcuug

SEQ ID NO: 947754 - RNA, 15 nt, Mycobacterium avium subsp. paratuberculosis
cgggugauggccgcc

SEQ ID NO: 947755 - RNA, 17 nt, Mycobacterium avium subsp. paratuberculosis
cgggugauggccgccgc

SEQ ID NO: 947756 - RNA, 18 nt, Mycobacterium avium subsp. paratuberculosis
cgggugauggucucccgg

SEQ ID NO: 947757 - RNA, 21 nt, Mycobacterium avium subsp. paratuberculosis
cgggugauggucucccgggcg

SEQ ID NO: 947758 - RNA, 22 nt, Mycobacterium avium subsp. paratuberculosis
cgggugauggucucccgggcgg

SEQ ID NO: 947759 - RNA, 18 nt, Mycobacterium avium subsp. paratuberculosis
cgggugaugucgccgacc

SEQ ID NO: 947760 - RNA, 13 nt, Mycobacterium avium subsp. paratuberculosis
cgggugcccgcgu

SEQ ID NO: 947761 - RNA, 18 nt, Mycobacterium avium subsp. paratuberculosis
cgggugcccgcguacagc

SEQ ID NO: 947762 - RNA, 12 nt, Mycobacterium avium subsp. paratuberculosis
cgggugcccggc

SEQ ID NO: 947763 - RNA, 20 nt, Mycobacterium avium subsp. paratuberculosis
cgggugcgaacagccacggu

SEQ ID NO: 947764 - RNA, 22 nt, Mycobacterium avium subsp. paratuberculosis
cgggugauccagcccugcucgg

SEQ ID NO: 947765 - RNA, 13 nt, Mycobacterium avium subsp. paratuberculosis
cgggugaucccga

SEQ ID NO: 947766 - RNA, 21 nt, Mycobacterium avium subsp. paratuberculosis
cgggugaucccgaugccgcgc

SEQ ID NO: 947767 - RNA, 14 nt, Mycobacterium avium subsp. paratuberculosis
cgggugaucaacgc

SEQ ID NO: 947768 - RNA, 17 nt, Mycobacterium avium subsp. paratuberculosis
cgggugauaccggccca

SEQ ID NO: 947769 - RNA, 16 nt, Mycobacterium avium subsp. paratuberculosis
cgggugagacggccag

SEQ ID NO: 947770 - RNA, 17 nt, Mycobacterium avium subsp. paratuberculosis
cgggugagacggccagc

SEQ ID NO: 947771 - RNA, 17 nt, Mycobacterium avium subsp. paratuberculosis
cgggugaggggcgcgcg

SEQ ID NO: 947772 - RNA, 18 nt, Mycobacterium avium subsp. paratuberculosis
cgggugaguaguccagca

SEQ ID NO: 947773 - RNA, 16 nt, Mycobacterium avium subsp. paratuberculosis
cgggugagccggucga

SEQ ID NO: 947774 - RNA, 18 nt, Mycobacterium avium subsp. paratuberculosis
cgggugaggacgcccggc

SEQ ID NO: 947775 - RNA, 19 nt, Mycobacterium avium subsp. paratuberculosis
cgggugaggacgcccggcg

SEQ ID NO: 947776 - RNA, 20 nt, Mycobacterium avium subsp. paratuberculosis
cgggugaggacgcccggcga

SEQ ID NO: 947777 - RNA, 14 nt, Mycobacterium avium subsp. paratuberculosis
cgggugaggccagg

SEQ ID NO: 947778 - RNA, 21 nt, Mycobacterium avium subsp. paratuberculosis
cgggugacgaccauggucagg

SEQ ID NO: 947779 - RNA, 19 nt, Mycobacterium avium subsp. paratuberculosis
cgggugacgaucaccgcug

SEQ ID NO: 947780 - RNA, 22 nt, Mycobacterium avium subsp. paratuberculosis
cgggugacgccucaggcgagca

SEQ ID NO: 947781 - RNA, 23 nt, Mycobacterium avium subsp. paratuberculosis
cgggugacgccucaggcgagcac

SEQ ID NO: 947782 - RNA, 19 nt, Mycobacterium avium subsp. paratuberculosis
cgggugagaaagucgaucu

SEQ ID NO: 947783 - RNA, 13 nt, Mycobacterium avium subsp. paratuberculosis
aaccaagaccgcg

SEQ ID NO: 947784 - RNA, 11 nt, Mycobacterium avium subsp. paratuberculosis
aaccaacgcgg

SEQ ID NO: 947785 - RNA, 16 nt, Mycobacterium avium subsp. paratuberculosis
cgggguguuugaucac

SEQ ID NO: 947786 - RNA, 15 nt, Mycobacterium avium subsp. paratuberculosis
cggggugugcucggc

SEQ ID NO: 947787 - RNA, 16 nt, Mycobacterium avium subsp. paratuberculosis
cggggugugcucggcg

SEQ ID NO: 947788 - RNA, 18 nt, Mycobacterium avium subsp. paratuberculosis
cggggugugcucggcggc

SEQ ID NO: 947789 - RNA, 16 nt, Mycobacterium avium subsp. paratuberculosis
cgggguggccggccag

SEQ ID NO: 947790 - RNA, 17 nt, Mycobacterium avium subsp. paratuberculosis
cgggguguucaccgcgc

SEQ ID NO: 947791 - RNA, 19 nt, Mycobacterium avium subsp. paratuberculosis
cgggguguucaccgcgccg

SEQ ID NO: 947792 - RNA, 13 nt, Mycobacterium avium subsp. paratuberculosis
cggggugugcggc

SEQ ID NO: 947793 - RNA, 18 nt, Mycobacterium avium subsp. paratuberculosis
cggggugugcggcacggc

SEQ ID NO: 947794 - RNA, 22 nt, Mycobacterium avium subsp. paratuberculosis
cggggugugcggcacggcgagg

SEQ ID NO: 947795 - RNA, 18 nt, Mycobacterium avium subsp. paratuberculosis
cgggguggugugcaaggc

SEQ ID NO: 947796 - RNA, 19 nt, Mycobacterium avium subsp. paratuberculosis
cgggguguaggcgucggcg

SEQ ID NO: 947797 - RNA, 16 nt, Mycobacterium avium subsp. paratuberculosis
cgggguguccagcggg

SEQ ID NO: 947798 - RNA, 15 nt, Mycobacterium avium subsp. paratuberculosis
cggggugucgaccca

SEQ ID NO: 947799 - RNA, 17 nt, Mycobacterium avium subsp. paratuberculosis
cggggugucgcggcugc

SEQ ID NO: 947800 - RNA, 19 nt, Mycobacterium avium subsp. paratuberculosis
cggggugugcccgaacgcg

SEQ ID NO: 947801 - RNA, 16 nt, Mycobacterium avium subsp. paratuberculosis
cggggugggcacgucg

SEQ ID NO: 947802 - RNA, 17 nt, Mycobacterium avium subsp. paratuberculosis
cggggugggcacgucgg

SEQ ID NO: 947803 - RNA, 16 nt, Mycobacterium avium subsp. paratuberculosis
cggggugggcgacguc

SEQ ID NO: 947804 - RNA, 23 nt, Mycobacterium avium subsp. paratuberculosis
cggggugggcgacgucgucgccc

SEQ ID NO: 947805 - RNA, 19 nt, Mycobacterium avium subsp. paratuberculosis
cgggguggggacgacgccg

SEQ ID NO: 947806 - RNA, 19 nt, Mycobacterium avium subsp. paratuberculosis
cggggugguggacgucagg

SEQ ID NO: 947807 - RNA, 22 nt, Mycobacterium avium subsp. paratuberculosis
cggggugguggacgucaggccg

SEQ ID NO: 947808 - RNA, 17 nt, Mycobacterium avium subsp. paratuberculosis
cgggguggugggcgcga

SEQ ID NO: 947809 - RNA, 15 nt, Mycobacterium avium subsp. paratuberculosis
aaccaccgcgcccac

SEQ ID NO: 947810 - RNA, 19 nt, Mycobacterium avium subsp. paratuberculosis
aaccaccggaaggccaggu

SEQ ID NO: 947811 - RNA, 19 nt, Mycobacterium avium subsp. paratuberculosis
cggguagacgaucaccggc

SEQ ID NO: 947812 - RNA, 21 nt, Mycobacterium avium subsp. paratuberculosis
cggguagacguucuccccgcc

SEQ ID NO: 947813 - RNA, 23 nt, Mycobacterium avium subsp. paratuberculosis
cggguagacguucuccccgccgg

SEQ ID NO: 947814 - RNA, 17 nt, Mycobacterium avium subsp. paratuberculosis
cggguagaucuccucgg

SEQ ID NO: 947815 - RNA, 15 nt, Mycobacterium avium subsp. paratuberculosis
aaccaccguggcccc

SEQ ID NO: 947816 - RNA, 15 nt, Mycobacterium avium subsp. paratuberculosis
aaccaccugaccgcg

SEQ ID NO: 947817 - RNA, 23 nt, Mycobacterium avium subsp. paratuberculosis
aaccaccugccgcaacgggccgc

SEQ ID NO: 947818 - RNA, 14 nt, Mycobacterium avium subsp. paratuberculosis
aaccacaccccggc

SEQ ID NO: 947819 - RNA, 17 nt, Mycobacterium avium subsp. paratuberculosis
cggggugcgccaggcag

SEQ ID NO: 947820 - RNA, 22 nt, Mycobacterium avium subsp. paratuberculosis
cggggugcgccaggcaggcggc

SEQ ID NO: 947821 - RNA, 19 nt, Mycobacterium avium subsp. paratuberculosis
cgggguggaauaggccgcg

SEQ ID NO: 947822 - RNA, 20 nt, Mycobacterium avium subsp. paratuberculosis
cgggguggaauaggccgcgu

SEQ ID NO: 947823 - RNA, 14 nt, Mycobacterium avium subsp. paratuberculosis
cgggguggacgcga

SEQ ID NO: 947824 - RNA, 19 nt, Mycobacterium avium subsp. paratuberculosis
cgggguggacgcgaccagg

SEQ ID NO: 947825 - RNA, 20 nt, Mycobacterium avium subsp. paratuberculosis
cgggguggacgcgaccaggc

SEQ ID NO: 947826 - RNA, 19 nt, Mycobacterium avium subsp. paratuberculosis
cggggugcgcggcgagcgc

SEQ ID NO: 947827 - RNA, 16 nt, Mycobacterium avium subsp. paratuberculosis
cggggugcggucggcg

SEQ ID NO: 947828 - RNA, 17 nt, Mycobacterium avium subsp. paratuberculosis
cggggugcggucggcga

SEQ ID NO: 947829 - RNA, 19 nt, Mycobacterium avium subsp. paratuberculosis
cggggugcggucggcgacg

SEQ ID NO: 947830 - RNA, 21 nt, Mycobacterium avium subsp. paratuberculosis
cggggugcgugacgggcugau

SEQ ID NO: 947831 - RNA, 18 nt, Mycobacterium avium subsp. paratuberculosis
cggggugcucgaucggcg

SEQ ID NO: 947832 - RNA, 20 nt, Mycobacterium avium subsp. paratuberculosis
cggggugcucgaucggcgcg

SEQ ID NO: 947833 - RNA, 21 nt, Mycobacterium avium subsp. paratuberculosis
cggggugcucgaucggcgcgc

SEQ ID NO: 947834 - RNA, 23 nt, Mycobacterium avium subsp. paratuberculosis
cggggugcucgaucggcgcgccg

SEQ ID NO: 947835 - RNA, 16 nt, Mycobacterium avium subsp. paratuberculosis
cgggguggaucgccca

SEQ ID NO: 947836 - RNA, 23 nt, Mycobacterium avium subsp. paratuberculosis
cgggguggccuuguggucgaucc

SEQ ID NO: 947837 - RNA, 14 nt, Mycobacterium avium subsp. paratuberculosis
cgggguggcgccgg

SEQ ID NO: 947838 - RNA, 17 nt, Mycobacterium avium subsp. paratuberculosis
cgggguggcgccggcca

SEQ ID NO: 947839 - RNA, 18 nt, Mycobacterium avium subsp. paratuberculosis
cgggguggcgccggccag

SEQ ID NO: 947840 - RNA, 15 nt, Mycobacterium avium subsp. paratuberculosis
cgggguggucaccgg

SEQ ID NO: 947841 - RNA, 17 nt, Mycobacterium avium subsp. paratuberculosis
cgggguggucaccggca

SEQ ID NO: 947842 - RNA, 19 nt, Mycobacterium avium subsp. paratuberculosis
cgggguggucaccggcaag

SEQ ID NO: 947843 - RNA, 12 nt, Mycobacterium avium subsp. paratuberculosis
cggggucggccg

SEQ ID NO: 947844 - RNA, 14 nt, Mycobacterium avium subsp. paratuberculosis
cggggucggccgag

SEQ ID NO: 947845 - RNA, 13 nt, Mycobacterium avium subsp. paratuberculosis
cggggucgcggcc

SEQ ID NO: 947846 - RNA, 14 nt, Mycobacterium avium subsp. paratuberculosis
cggggucgcggccc

SEQ ID NO: 947847 - RNA, 14 nt, Mycobacterium avium subsp. paratuberculosis
cggggugcaccgug

SEQ ID NO: 947848 - RNA, 13 nt, Mycobacterium avium subsp. paratuberculosis
cggggucgcgcgc

SEQ ID NO: 947849 - RNA, 15 nt, Mycobacterium avium subsp. paratuberculosis
cggggucgccgucgu

SEQ ID NO: 947850 - RNA, 20 nt, Mycobacterium avium subsp. paratuberculosis
cggggucgccgucgugcucg

SEQ ID NO: 947851 - RNA, 12 nt, Mycobacterium avium subsp. paratuberculosis
cggggucgcgcc

SEQ ID NO: 947852 - RNA, 13 nt, Mycobacterium avium subsp. paratuberculosis
cggggucgcgccg

SEQ ID NO: 947853 - RNA, 13 nt, Mycobacterium avium subsp. paratuberculosis
cggggugcagcac

SEQ ID NO: 947854 - RNA, 14 nt, Mycobacterium avium subsp. paratuberculosis
cggggugcagcacc

SEQ ID NO: 947855 - RNA, 15 nt, Mycobacterium avium subsp. paratuberculosis
cggggugcccggcga

SEQ ID NO: 947856 - RNA, 16 nt, Mycobacterium avium subsp. paratuberculosis
cggggugcccggcgag

SEQ ID NO: 947857 - RNA, 16 nt, Mycobacterium avium subsp. paratuberculosis
cggggugcccgggccg

SEQ ID NO: 947858 - RNA, 19 nt, Mycobacterium avium subsp. paratuberculosis
cggggugcccgggccgcag

SEQ ID NO: 947859 - RNA, 13 nt, Mycobacterium avium subsp. paratuberculosis
cggggugccgccg

SEQ ID NO: 947860 - RNA, 21 nt, Mycobacterium avium subsp. paratuberculosis
cggggucacggauacccgcgg

SEQ ID NO: 947861 - RNA, 21 nt, Mycobacterium avium subsp. paratuberculosis
cgggguaguucuugacgccga

SEQ ID NO: 947862 - RNA, 13 nt, Mycobacterium avium subsp. paratuberculosis
cgggguccaccgg

SEQ ID NO: 947863 - RNA, 16 nt, Mycobacterium avium subsp. paratuberculosis
cgggguccaccggccg

SEQ ID NO: 947864 - RNA, 22 nt, Mycobacterium avium subsp. paratuberculosis
cgggguccaccggccgauggcc

SEQ ID NO: 947865 - RNA, 16 nt, Mycobacterium avium subsp. paratuberculosis
cgggguccgcaacgcc

SEQ ID NO: 947866 - RNA, 17 nt, Mycobacterium avium subsp. paratuberculosis
cgggguccgcaacgccg

SEQ ID NO: 947867 - RNA, 21 nt, Mycobacterium avium subsp. paratuberculosis
cgggguccgcaacgccggcgu

SEQ ID NO: 947868 - RNA, 24 nt, Mycobacterium avium subsp. paratuberculosis
cgggguccgcaacgccggcgugca

SEQ ID NO: 947869 - RNA, 14 nt, Mycobacterium avium subsp. paratuberculosis
cggggucagggcgc

SEQ ID NO: 947870 - RNA, 22 nt, Mycobacterium avium subsp. paratuberculosis
cgggguccucucggcgccgucc

SEQ ID NO: 947871 - RNA, 12 nt, Mycobacterium avium subsp. paratuberculosis
cggggucgaagu

SEQ ID NO: 947872 - RNA, 18 nt, Mycobacterium avium subsp. paratuberculosis
cggggucgaaguccugcg

SEQ ID NO: 947873 - RNA, 17 nt, Mycobacterium avium subsp. paratuberculosis
cggggucgacagccuga

SEQ ID NO: 947874 - RNA, 16 nt, Mycobacterium avium subsp. paratuberculosis
cggggucgagaagccc

SEQ ID NO: 947875 - RNA, 14 nt, Mycobacterium avium subsp. paratuberculosis
cggggucgaucacc

SEQ ID NO: 947876 - RNA, 20 nt, Mycobacterium avium subsp. paratuberculosis
cgggcucggcguacaggccg

SEQ ID NO: 947877 - RNA, 14 nt, Mycobacterium avium subsp. paratuberculosis
cgggcucgucguga

SEQ ID NO: 947878 - RNA, 16 nt, Mycobacterium avium subsp. paratuberculosis
cgggcucggccgccga

SEQ ID NO: 947879 - RNA, 17 nt, Mycobacterium avium subsp. paratuberculosis
cgggcucggccgccgac

SEQ ID NO: 947880 - RNA, 18 nt, Mycobacterium avium subsp. paratuberculosis
cgggcucggccgccgaca

SEQ ID NO: 947881 - RNA, 23 nt, Mycobacterium avium subsp. paratuberculosis
cgggcucggccgccgacaccacc

SEQ ID NO: 947882 - RNA, 16 nt, Mycobacterium avium subsp. paratuberculosis
cgggcucggacgacuc

SEQ ID NO: 947883 - RNA, 22 nt, Mycobacterium avium subsp. paratuberculosis
cgggcucggacgacucguucga

SEQ ID NO: 947884 - RNA, 17 nt, Mycobacterium avium subsp. paratuberculosis
cgggcucgcgcuggcgg

SEQ ID NO: 947885 - RNA, 18 nt, Mycobacterium avium subsp. paratuberculosis
cgggcucgcgcuggcggc

SEQ ID NO: 947886 - RNA, 18 nt, Mycobacterium avium subsp. paratuberculosis
cgggcucgcggccugcgg

SEQ ID NO: 947887 - RNA, 12 nt, Mycobacterium avium subsp. paratuberculosis
cgggcucgcggu

SEQ ID NO: 947888 - RNA, 13 nt, Mycobacterium avium subsp. paratuberculosis
cgggcucgcgguc

SEQ ID NO: 947889 - RNA, 19 nt, Mycobacterium avium subsp. paratuberculosis
cgggcucgcggucggggaa

SEQ ID NO: 947890 - RNA, 14 nt, Mycobacterium avium subsp. paratuberculosis
cgggucagcgucgc

SEQ ID NO: 947891 - RNA, 21 nt, Mycobacterium avium subsp. paratuberculosis
cgggucaggaacaccgagccg

SEQ ID NO: 947892 - RNA, 15 nt, Mycobacterium avium subsp. paratuberculosis
cgggucaguucgcgg

SEQ ID NO: 947893 - RNA, 17 nt, Mycobacterium avium subsp. paratuberculosis
cgggucaguucgcggcg

SEQ ID NO: 947894 - RNA, 17 nt, Mycobacterium avium subsp. paratuberculosis
cgggucauccccgugcg

SEQ ID NO: 947895 - RNA, 17 nt, Mycobacterium avium subsp. paratuberculosis
cgggucagaccgcggcg

SEQ ID NO: 947896 - RNA, 14 nt, Mycobacterium avium subsp. paratuberculosis
cgggucagcaccac

SEQ ID NO: 947897 - RNA, 20 nt, Mycobacterium avium subsp. paratuberculosis
cgggucagcaccaccaacag

SEQ ID NO: 947898 - RNA, 23 nt, Mycobacterium avium subsp. paratuberculosis
cgggucagcacccgcagccgcga

SEQ ID NO: 947899 - RNA, 19 nt, Mycobacterium avium subsp. paratuberculosis
cgggucagcagcgucugcg

SEQ ID NO: 947900 - RNA, 20 nt, Mycobacterium avium subsp. paratuberculosis
cgggucaccggaugcaccgg

SEQ ID NO: 947901 - RNA, 15 nt, Mycobacterium avium subsp. paratuberculosis
cgggucaccggccga

SEQ ID NO: 947902 - RNA, 19 nt, Mycobacterium avium subsp. paratuberculosis
cgggucaccggccgagccg

SEQ ID NO: 947903 - RNA, 22 nt, Mycobacterium avium subsp. paratuberculosis
cgggucaccgugcgggucgcgc

SEQ ID NO: 947904 - RNA, 23 nt, Mycobacterium avium subsp. paratuberculosis
cgggucaccgugcgggucgcgcu

SEQ ID NO: 947905 - RNA, 21 nt, Mycobacterium avium subsp. paratuberculosis
cgggucacgaacuccuugacc

SEQ ID NO: 947906 - RNA, 23 nt, Mycobacterium avium subsp. paratuberculosis
cgggucacgaacuccuugacccg

SEQ ID NO: 947907 - RNA, 15 nt, Mycobacterium avium subsp. paratuberculosis
cgggucacggucagg

SEQ ID NO: 947908 - RNA, 18 nt, Mycobacterium avium subsp. paratuberculosis
cgggucaauugccacagc

SEQ ID NO: 947909 - RNA, 20 nt, Mycobacterium avium subsp. paratuberculosis
cgggucaauugccacagccg

SEQ ID NO: 947910 - RNA, 16 nt, Mycobacterium avium subsp. paratuberculosis
aaccagaucggcgggu

SEQ ID NO: 947911 - RNA, 20 nt, Mycobacterium avium subsp. paratuberculosis
cggguaucgacagucccgcg

SEQ ID NO: 947912 - RNA, 19 nt, Mycobacterium avium subsp. paratuberculosis
cggguagggcgccgucggc

SEQ ID NO: 947913 - RNA, 20 nt, Mycobacterium avium subsp. paratuberculosis
cggguagggcgccgucggcg

SEQ ID NO: 947914 - RNA, 13 nt, Mycobacterium avium subsp. paratuberculosis
aaccagcaccgcc

SEQ ID NO: 947915 - RNA, 20 nt, Mycobacterium avium subsp. paratuberculosis
cggguagccaugggucucgg

SEQ ID NO: 947916 - RNA, 16 nt, Mycobacterium avium subsp. paratuberculosis
cggguagcccgcgugc

SEQ ID NO: 947917 - RNA, 18 nt, Mycobacterium avium subsp. paratuberculosis
cggguagcccgcgugcac

SEQ ID NO: 947918 - RNA, 20 nt, Mycobacterium avium subsp. paratuberculosis
cggguagcccgucgacgggc

SEQ ID NO: 947919 - RNA, 16 nt, Mycobacterium avium subsp. paratuberculosis
cggguagcgccgccgg

SEQ ID NO: 947920 - RNA, 21 nt, Mycobacterium avium subsp. paratuberculosis
cggguaggcgccgaugcccgc

SEQ ID NO: 947921 - RNA, 17 nt, Mycobacterium avium subsp. paratuberculosis
cggguaggcgucgcgca

SEQ ID NO: 947922 - RNA, 23 nt, Mycobacterium avium subsp. paratuberculosis
cggguaggcgucgcgcagcagcg

SEQ ID NO: 947923 - RNA, 14 nt, Mycobacterium avium subsp. paratuberculosis
cgggucgagagccg

SEQ ID NO: 947924 - RNA, 15 nt, Mycobacterium avium subsp. paratuberculosis
cgggucgagcgcgcc

SEQ ID NO: 947925 - RNA, 20 nt, Mycobacterium avium subsp. paratuberculosis
cgggucgagcggcccgcacc

SEQ ID NO: 947926 - RNA, 17 nt, Mycobacterium avium subsp. paratuberculosis
cgggucgagggucgcca

SEQ ID NO: 947927 - RNA, 22 nt, Mycobacterium avium subsp. paratuberculosis
cgggucgagggucgccaggcca

SEQ ID NO: 947928 - RNA, 22 nt, Mycobacterium avium subsp. paratuberculosis
cgggucgauaugcugcaacggc

SEQ ID NO: 947929 - RNA, 23 nt, Mycobacterium avium subsp. paratuberculosis
cgggucgauaugcugcaacggcu

SEQ ID NO: 947930 - RNA, 17 nt, Mycobacterium avium subsp. paratuberculosis
cgggucgaucucggcgc

SEQ ID NO: 947931 - RNA, 18 nt, Mycobacterium avium subsp. paratuberculosis
cgggucgaucucggcgca

SEQ ID NO: 947932 - RNA, 19 nt, Mycobacterium avium subsp. paratuberculosis
cgggucgaucucggcgcag

SEQ ID NO: 947933 - RNA, 14 nt, Mycobacterium avium subsp. paratuberculosis
cgggucgccgucga

SEQ ID NO: 947934 - RNA, 16 nt, Mycobacterium avium subsp. paratuberculosis
cgggucgccgucgagg

SEQ ID NO: 947935 - RNA, 16 nt, Mycobacterium avium subsp. paratuberculosis
cgggucgccguggccg

SEQ ID NO: 947936 - RNA, 17 nt, Mycobacterium avium subsp. paratuberculosis
cgggucgccguggccga

SEQ ID NO: 947937 - RNA, 19 nt, Mycobacterium avium subsp. paratuberculosis
cgggucgccguggccgaac

SEQ ID NO: 947938 - RNA, 15 nt, Mycobacterium avium subsp. paratuberculosis
cgggucgcacgccgg

SEQ ID NO: 947939 - RNA, 19 nt, Mycobacterium avium subsp. paratuberculosis
cgggucgcacgccgguagc

SEQ ID NO: 947940 - RNA, 22 nt, Mycobacterium avium subsp. paratuberculosis
cgggucgcacgccgguagccgc

SEQ ID NO: 947941 - RNA, 14 nt, Mycobacterium avium subsp. paratuberculosis
cgggucgcagcggc

SEQ ID NO: 947942 - RNA, 16 nt, Mycobacterium avium subsp. paratuberculosis
cgggucgcagcggcac

SEQ ID NO: 947943 - RNA, 15 nt, Mycobacterium avium subsp. paratuberculosis
cgggucgcaggcagc

SEQ ID NO: 947944 - RNA, 21 nt, Mycobacterium avium subsp. paratuberculosis
cgggucgcaggcagcagcacc

SEQ ID NO: 947945 - RNA, 22 nt, Mycobacterium avium subsp. paratuberculosis
cgggucgccaaggucgucaacg

SEQ ID NO: 947946 - RNA, 14 nt, Mycobacterium avium subsp. paratuberculosis
cgggucgccgauca

SEQ ID NO: 947947 - RNA, 14 nt, Mycobacterium avium subsp. paratuberculosis
cgggucgccgaucu

SEQ ID NO: 947948 - RNA, 21 nt, Mycobacterium avium subsp. paratuberculosis
cgggucgaagugcucgagcac

SEQ ID NO: 947949 - RNA, 15 nt, Mycobacterium avium subsp. paratuberculosis
cggguccuggaucag

SEQ ID NO: 947950 - RNA, 12 nt, Mycobacterium avium subsp. paratuberculosis
cgggucgaccgc

SEQ ID NO: 947951 - RNA, 13 nt, Mycobacterium avium subsp. paratuberculosis
cgggucgaccgcc

SEQ ID NO: 947952 - RNA, 14 nt, Mycobacterium avium subsp. paratuberculosis
cgggucgaccgccg

SEQ ID NO: 947953 - RNA, 16 nt, Mycobacterium avium subsp. paratuberculosis
cgggucgacgagcagg

SEQ ID NO: 947954 - RNA, 13 nt, Mycobacterium avium subsp. paratuberculosis
cggguccaucgcc

SEQ ID NO: 947955 - RNA, 17 nt, Mycobacterium avium subsp. paratuberculosis
cggguccagccgccggc

SEQ ID NO: 947956 - RNA, 15 nt, Mycobacterium avium subsp. paratuberculosis
cggguccagcgccga

SEQ ID NO: 947957 - RNA, 16 nt, Mycobacterium avium subsp. paratuberculosis
cgggucccagaugcgc

SEQ ID NO: 947958 - RNA, 20 nt, Mycobacterium avium subsp. paratuberculosis
cgggucccagaugcgcgacg

SEQ ID NO: 947959 - RNA, 22 nt, Mycobacterium avium subsp. paratuberculosis
cgggucccagaugcgcgacggc

SEQ ID NO: 947960 - RNA, 20 nt, Mycobacterium avium subsp. paratuberculosis
cgggucccagugccaguacc

SEQ ID NO: 947961 - RNA, 13 nt, Mycobacterium avium subsp. paratuberculosis
cgggucccccgcc

SEQ ID NO: 947962 - RNA, 16 nt, Mycobacterium avium subsp. paratuberculosis
cgggucccccgccgac

SEQ ID NO: 947963 - RNA, 16 nt, Mycobacterium avium subsp. paratuberculosis
cggguccccgccgccg

SEQ ID NO: 947964 - RNA, 22 nt, Mycobacterium avium subsp. paratuberculosis
cgggucccggcaacaccggcgg

SEQ ID NO: 947965 - RNA, 14 nt, Mycobacterium avium subsp. paratuberculosis
cggguccgaccagc

SEQ ID NO: 947966 - RNA, 15 nt, Mycobacterium avium subsp. paratuberculosis
cggguccgaccagca

SEQ ID NO: 947967 - RNA, 16 nt, Mycobacterium avium subsp. paratuberculosis
cggguccgaccagcac

SEQ ID NO: 947968 - RNA, 17 nt, Mycobacterium avium subsp. paratuberculosis
cggguccgaccagcacc

SEQ ID NO: 947969 - RNA, 12 nt, Mycobacterium avium subsp. paratuberculosis
cggguccgcacc

SEQ ID NO: 947970 - RNA, 12 nt, Mycobacterium avium subsp. paratuberculosis
cggguccgcccc

SEQ ID NO: 947971 - RNA, 13 nt, Mycobacterium avium subsp. paratuberculosis
cggguccgcggug

SEQ ID NO: 947972 - RNA, 14 nt, Mycobacterium avium subsp. paratuberculosis
cggguccgcgguga

SEQ ID NO: 947973 - RNA, 24 nt, Mycobacterium avium subsp. paratuberculosis
cggguccgcggugaugccgaguuc

SEQ ID NO: 947974 - RNA, 15 nt, Mycobacterium avium subsp. paratuberculosis
cggcuaagccggcgu

SEQ ID NO: 947975 - RNA, 19 nt, Mycobacterium avium subsp. paratuberculosis
cggcuacagcaacauccug

SEQ ID NO: 947976 - RNA, 19 nt, Mycobacterium avium subsp. paratuberculosis
cggcuaauucgggccgccg

SEQ ID NO: 947977 - RNA, 13 nt, Mycobacterium avium subsp. paratuberculosis
cggcuaccggcgc

SEQ ID NO: 947978 - RNA, 17 nt, Mycobacterium avium subsp. paratuberculosis
cggcuaccuaggcgucg

SEQ ID NO: 947979 - RNA, 20 nt, Mycobacterium avium subsp. paratuberculosis
cggcuaccuaggcgucgucg

SEQ ID NO: 947980 - RNA, 23 nt, Mycobacterium avium subsp. paratuberculosis
cggcuaccuaggcgucgucggcc

SEQ ID NO: 947981 - RNA, 17 nt, Mycobacterium avium subsp. paratuberculosis
cggcuaccugaccagcg

SEQ ID NO: 947982 - RNA, 19 nt, Mycobacterium avium subsp. paratuberculosis
cggcuaccugaccagcggc

SEQ ID NO: 947983 - RNA, 20 nt, Mycobacterium avium subsp. paratuberculosis
cggcuaccugaccagcggcg

SEQ ID NO: 947984 - RNA, 23 nt, Mycobacterium avium subsp. paratuberculosis
cggcuaccugaccagcggcgcgc

SEQ ID NO: 947985 - RNA, 15 nt, Mycobacterium avium subsp. paratuberculosis
cggcguuguggccac

SEQ ID NO: 947986 - RNA, 17 nt, Mycobacterium avium subsp. paratuberculosis
cggcguuguggccaccg

SEQ ID NO: 947987 - RNA, 23 nt, Mycobacterium avium subsp. paratuberculosis
cggcguuguggccaccgaugccc

SEQ ID NO: 947988 - RNA, 14 nt, Mycobacterium avium subsp. paratuberculosis
cggcguugguccac

SEQ ID NO: 947989 - RNA, 19 nt, Mycobacterium avium subsp. paratuberculosis
cggcguugguccacacguc

SEQ ID NO: 947990 - RNA, 15 nt, Mycobacterium avium subsp. paratuberculosis
cggcguuggcggcgu

SEQ ID NO: 947991 - RNA, 16 nt, Mycobacterium avium subsp. paratuberculosis
cggcguuggcggcguc

SEQ ID NO: 947992 - RNA, 20 nt, Mycobacterium avium subsp. paratuberculosis
cggcguuggcguagucgacu

SEQ ID NO: 947993 - RNA, 19 nt, Mycobacterium avium subsp. paratuberculosis
cggcguuggacagcucgac

SEQ ID NO: 947994 - RNA, 21 nt, Mycobacterium avium subsp. paratuberculosis
cggcguuggacagcucgacga

SEQ ID NO: 947995 - RNA, 23 nt, Mycobacterium avium subsp. paratuberculosis
cggcguugcuggcgcgauagccg

SEQ ID NO: 947996 - RNA, 18 nt, Mycobacterium avium subsp. paratuberculosis
cggcguuggccgccgccu

SEQ ID NO: 947997 - RNA, 15 nt, Mycobacterium avium subsp. paratuberculosis
cggcguugccgccgg

SEQ ID NO: 947998 - RNA, 13 nt, Mycobacterium avium subsp. paratuberculosis
cggcguugccgcc

SEQ ID NO: 947999 - RNA, 20 nt, Mycobacterium avium subsp. paratuberculosis
cggcguugcauuucggcguc

SEQ ID NO: 948000 - RNA, 21 nt, Mycobacterium avium subsp. paratuberculosis
cggcguugcauuucggcgucc

SEQ ID NO: 948001 - RNA, 19 nt, Mycobacterium avium subsp. paratuberculosis
cggcguugccgccggcgcg

SEQ ID NO: 948002 - RNA, 19 nt, Mycobacterium avium subsp. paratuberculosis
cggcguugcccgcugcggc

SEQ ID NO: 948003 - RNA, 16 nt, Mycobacterium avium subsp. paratuberculosis
cggcguugcccggguc

SEQ ID NO: 948004 - RNA, 17 nt, Mycobacterium avium subsp. paratuberculosis
cggcguugcccgggucc

SEQ ID NO: 948005 - RNA, 18 nt, Mycobacterium avium subsp. paratuberculosis
cggcguuauuugugcgcu

SEQ ID NO: 948006 - RNA, 21 nt, Mycobacterium avium subsp. paratuberculosis
cggcguucggugcccgggguc

SEQ ID NO: 948007 - RNA, 16 nt, Mycobacterium avium subsp. paratuberculosis
cggcguucuccagcac

SEQ ID NO: 948008 - RNA, 16 nt, Mycobacterium avium subsp. paratuberculosis
cggcguugaccaacgc

SEQ ID NO: 948009 - RNA, 20 nt, Mycobacterium avium subsp. paratuberculosis
cggcguugaccaacgccgcc

SEQ ID NO: 948010 - RNA, 15 nt, Mycobacterium avium subsp. paratuberculosis
cggcguugaccgggc

SEQ ID NO: 948011 - RNA, 15 nt, Mycobacterium avium subsp. paratuberculosis
cggcguugagccggc

SEQ ID NO: 948012 - RNA, 16 nt, Mycobacterium avium subsp. paratuberculosis
cggcguugagccggcg

SEQ ID NO: 948013 - RNA, 21 nt, Mycobacterium avium subsp. paratuberculosis
cggcguugagccggcgcaccg

SEQ ID NO: 948014 - RNA, 16 nt, Mycobacterium avium subsp. paratuberculosis
cggcguucagcagcgc

SEQ ID NO: 948015 - RNA, 21 nt, Mycobacterium avium subsp. paratuberculosis
cggcguucagccggagccggc

SEQ ID NO: 948016 - RNA, 23 nt, Mycobacterium avium subsp. paratuberculosis
cggcguucagccggagccggccu

SEQ ID NO: 948017 - RNA, 18 nt, Mycobacterium avium subsp. paratuberculosis
cggcguucagcggcaccg

SEQ ID NO: 948018 - RNA, 15 nt, Mycobacterium avium subsp. paratuberculosis
cggcguuccagcgca

SEQ ID NO: 948019 - RNA, 23 nt, Mycobacterium avium subsp. paratuberculosis
cggcguuacccgaacccagcgcc

SEQ ID NO: 948020 - RNA, 19 nt, Mycobacterium avium subsp. paratuberculosis
cggcguguuccuugcggcc

SEQ ID NO: 948021 - RNA, 20 nt, Mycobacterium avium subsp. paratuberculosis
cggcguguuccuugcggccg

SEQ ID NO: 948022 - RNA, 24 nt, Mycobacterium avium subsp. paratuberculosis
cggcguguuccuugcggccgccga

SEQ ID NO: 948023 - RNA, 15 nt, Mycobacterium avium subsp. paratuberculosis
cggcgugucgcgugc

SEQ ID NO: 948024 - RNA, 14 nt, Mycobacterium avium subsp. paratuberculosis
cggcgugucggcgc

SEQ ID NO: 948025 - RNA, 18 nt, Mycobacterium avium subsp. paratuberculosis
cggcgugucggcgccacc

SEQ ID NO: 948026 - RNA, 15 nt, Mycobacterium avium subsp. paratuberculosis
cggcgugucgggugc

SEQ ID NO: 948027 - RNA, 23 nt, Mycobacterium avium subsp. paratuberculosis
cggcgugucgggugcuuucgcgu

SEQ ID NO: 948028 - RNA, 21 nt, Mycobacterium avium subsp. paratuberculosis
cggcguguaguacugcucgac

SEQ ID NO: 948029 - RNA, 16 nt, Mycobacterium avium subsp. paratuberculosis
cggcguggucggcgaa

SEQ ID NO: 948030 - RNA, 18 nt, Mycobacterium avium subsp. paratuberculosis
cggcguggucggcgaagc

SEQ ID NO: 948031 - RNA, 13 nt, Mycobacterium avium subsp. paratuberculosis
cggcgugcugggc

SEQ ID NO: 948032 - RNA, 15 nt, Mycobacterium avium subsp. paratuberculosis
cggcgugcugggcca

SEQ ID NO: 948033 - RNA, 22 nt, Mycobacterium avium subsp. paratuberculosis
cggcgugcugggccacgauccg

SEQ ID NO: 948034 - RNA, 18 nt, Mycobacterium avium subsp. paratuberculosis
cggcgugcugcgcagcag

SEQ ID NO: 948035 - RNA, 16 nt, Mycobacterium avium subsp. paratuberculosis
cggcgugcuccagcag

SEQ ID NO: 948036 - RNA, 21 nt, Mycobacterium avium subsp. paratuberculosis
cggcgugcuccagcaggcgcg

SEQ ID NO: 948037 - RNA, 24 nt, Mycobacterium avium subsp. paratuberculosis
cggcgugcuccagcaggcgcgccg

SEQ ID NO: 948038 - RNA, 16 nt, Mycobacterium avium subsp. paratuberculosis
cggcgugcucggccac

SEQ ID NO: 948039 - RNA, 22 nt, Mycobacterium avium subsp. paratuberculosis
cggcgugcucggccacgacgcg

SEQ ID NO: 948040 - RNA, 14 nt, Mycobacterium avium subsp. paratuberculosis
cggcgugcggucgc

SEQ ID NO: 948041 - RNA, 22 nt, Mycobacterium avium subsp. paratuberculosis
cggcgugcgccaguuugccguc

SEQ ID NO: 948042 - RNA, 12 nt, Mycobacterium avium subsp. paratuberculosis
cggcgugccgcc

SEQ ID NO: 948043 - RNA, 13 nt, Mycobacterium avium subsp. paratuberculosis
cggcgugccgccc

SEQ ID NO: 948044 - RNA, 17 nt, Mycobacterium avium subsp. paratuberculosis
cggcgugccgcccggac

SEQ ID NO: 948045 - RNA, 19 nt, Mycobacterium avium subsp. paratuberculosis
cggcgugccgcccggaccg

SEQ ID NO: 948046 - RNA, 13 nt, Mycobacterium avium subsp. paratuberculosis
cggcgugccggac

SEQ ID NO: 948047 - RNA, 21 nt, Mycobacterium avium subsp. paratuberculosis
cggcguacagcaauccgcuga

SEQ ID NO: 948048 - RNA, 16 nt, Mycobacterium avium subsp. paratuberculosis
cggcguacagcccgcg

SEQ ID NO: 948049 - RNA, 17 nt, Mycobacterium avium subsp. paratuberculosis
cggcguacagcccgcgg

SEQ ID NO: 948050 - RNA, 20 nt, Mycobacterium avium subsp. paratuberculosis
cggcguacagcccgcggauc

SEQ ID NO: 948051 - RNA, 23 nt, Mycobacterium avium subsp. paratuberculosis
cggcguacccgcccaugcacgau

SEQ ID NO: 948052 - RNA, 16 nt, Mycobacterium avium subsp. paratuberculosis
cggcguacaggccguc

SEQ ID NO: 948053 - RNA, 17 nt, Mycobacterium avium subsp. paratuberculosis
cggcguacaggccgucg

SEQ ID NO: 948054 - RNA, 13 nt, Mycobacterium avium subsp. paratuberculosis
cggcguaccgcgg

SEQ ID NO: 948055 - RNA, 17 nt, Mycobacterium avium subsp. paratuberculosis
cggcguacgacaucucg

SEQ ID NO: 948056 - RNA, 18 nt, Mycobacterium avium subsp. paratuberculosis
cggcguacgacaucucga

SEQ ID NO: 948057 - RNA, 14 nt, Mycobacterium avium subsp. paratuberculosis
cggcguacgcgaug

SEQ ID NO: 948058 - RNA, 16 nt, Mycobacterium avium subsp. paratuberculosis
cggcguacgcgauggc

SEQ ID NO: 948059 - RNA, 17 nt, Mycobacterium avium subsp. paratuberculosis
cggcguacgcgauggcg

SEQ ID NO: 948060 - RNA, 16 nt, Mycobacterium avium subsp. paratuberculosis
cggcguacucgcacag

SEQ ID NO: 948061 - RNA, 17 nt, Mycobacterium avium subsp. paratuberculosis
cggcguacucgcacagc

SEQ ID NO: 948062 - RNA, 23 nt, Mycobacterium avium subsp. paratuberculosis
cggcguacucgcacagccggcgc

SEQ ID NO: 948063 - RNA, 20 nt, Mycobacterium avium subsp. paratuberculosis
cggcggccgaauccggccgg

SEQ ID NO: 948064 - RNA, 21 nt, Mycobacterium avium subsp. paratuberculosis
cggcggccgaauccggccgga

SEQ ID NO: 948065 - RNA, 12 nt, Mycobacterium avium subsp. paratuberculosis
cggcggccgaca

SEQ ID NO: 948066 - RNA, 13 nt, Mycobacterium avium subsp. paratuberculosis
cggcggccgacag

SEQ ID NO: 948067 - RNA, 15 nt, Mycobacterium avium subsp. paratuberculosis
cggcggccgacccug

SEQ ID NO: 948068 - RNA, 21 nt, Mycobacterium avium subsp. paratuberculosis
cggcggccgacccugcguccg

SEQ ID NO: 948069 - RNA, 13 nt, Mycobacterium avium subsp. paratuberculosis
cggcggccccggu

SEQ ID NO: 948070 - RNA, 23 nt, Mycobacterium avium subsp. paratuberculosis
cggcggccccgguagccagcacc

SEQ ID NO: 948071 - RNA, 19 nt, Mycobacterium avium subsp. paratuberculosis
cggcggccccuucgauguc

SEQ ID NO: 948072 - RNA, 13 nt, Mycobacterium avium subsp. paratuberculosis
cggcggcccgcuu

SEQ ID NO: 948073 - RNA, 15 nt, Mycobacterium avium subsp. paratuberculosis
cggcggcccgcuugc

SEQ ID NO: 948074 - RNA, 21 nt, Mycobacterium avium subsp. paratuberculosis
cggcggcccgcaggaucgagc

SEQ ID NO: 948075 - RNA, 12 nt, Mycobacterium avium subsp. paratuberculosis
cggcggcccgcc

SEQ ID NO: 948076 - RNA, 13 nt, Mycobacterium avium subsp. paratuberculosis
cggcggcccgccg

SEQ ID NO: 948077 - RNA, 14 nt, Mycobacterium avium subsp. paratuberculosis
cggcggcccgccgc

SEQ ID NO: 948078 - RNA, 17 nt, Mycobacterium avium subsp. paratuberculosis
cggcggcccgccgcgcc

SEQ ID NO: 948079 - RNA, 19 nt, Mycobacterium avium subsp. paratuberculosis
cggcggcccgccgcgcccg

SEQ ID NO: 948080 - RNA, 22 nt, Mycobacterium avium subsp. paratuberculosis
cggcggcccgccgcgcccggcu

SEQ ID NO: 948081 - RNA, 15 nt, Mycobacterium avium subsp. paratuberculosis
cggcggcccgccgga

SEQ ID NO: 948082 - RNA, 15 nt, Mycobacterium avium subsp. paratuberculosis
cggcggcccgcgcgg

SEQ ID NO: 948083 - RNA, 20 nt, Mycobacterium avium subsp. paratuberculosis
cggcggcccggcgucacgcu

SEQ ID NO: 948084 - RNA, 20 nt, Mycobacterium avium subsp. paratuberculosis
cggcggcccguccgccccgc

SEQ ID NO: 948085 - RNA, 22 nt, Mycobacterium avium subsp. paratuberculosis
cggcggcccguccgccccgcug

SEQ ID NO: 948086 - RNA, 13 nt, Mycobacterium avium subsp. paratuberculosis
cggcggcccgucg

SEQ ID NO: 948087 - RNA, 22 nt, Mycobacterium avium subsp. paratuberculosis
cggcggcccgucgccaccacgg

SEQ ID NO: 948088 - RNA, 19 nt, Mycobacterium avium subsp. paratuberculosis
cggcgucacucuggcguga

SEQ ID NO: 948089 - RNA, 17 nt, Mycobacterium avium subsp. paratuberculosis
cggcgucacugcccagc

SEQ ID NO: 948090 - RNA, 19 nt, Mycobacterium avium subsp. paratuberculosis
cggcgucacgcuggcguga

SEQ ID NO: 948091 - RNA, 16 nt, Mycobacterium avium subsp. paratuberculosis
cggcgucaggggugcc

SEQ ID NO: 948092 - RNA, 21 nt, Mycobacterium avium subsp. paratuberculosis
cggcgucaggggugccagccg

SEQ ID NO: 948093 - RNA, 20 nt, Mycobacterium avium subsp. paratuberculosis
cggcguacugcgcgagcucg

SEQ ID NO: 948094 - RNA, 21 nt, Mycobacterium avium subsp. paratuberculosis
cggcguacugcgcgagcucgu

SEQ ID NO: 948095 - RNA, 16 nt, Mycobacterium avium subsp. paratuberculosis
cggcgucaccaggcug

SEQ ID NO: 948096 - RNA, 17 nt, Mycobacterium avium subsp. paratuberculosis
cggcgucaccaggcugc

SEQ ID NO: 948097 - RNA, 12 nt, Mycobacterium avium subsp. paratuberculosis
cggcgucaccgc

SEQ ID NO: 948098 - RNA, 21 nt, Mycobacterium avium subsp. paratuberculosis
cggcgucaucgacuugccgcc

SEQ ID NO: 948099 - RNA, 22 nt, Mycobacterium avium subsp. paratuberculosis
cggcgucaucgacuugccgccg

SEQ ID NO: 948100 - RNA, 18 nt, Mycobacterium avium subsp. paratuberculosis
cggcgucauggugcgcgg

SEQ ID NO: 948101 - RNA, 21 nt, Mycobacterium avium subsp. paratuberculosis
cggcgucauggugcgcggguu

SEQ ID NO: 948102 - RNA, 14 nt, Mycobacterium avium subsp. paratuberculosis
cggcguccaccagc

SEQ ID NO: 948103 - RNA, 19 nt, Mycobacterium avium subsp. paratuberculosis
cggcguccaccagcacgcc

SEQ ID NO: 948104 - RNA, 16 nt, Mycobacterium avium subsp. paratuberculosis
cggcguccaccggucg

SEQ ID NO: 948105 - RNA, 17 nt, Mycobacterium avium subsp. paratuberculosis
cggcguccaccggucga

SEQ ID NO: 948106 - RNA, 13 nt, Mycobacterium avium subsp. paratuberculosis
cggcguccacgcc

SEQ ID NO: 948107 - RNA, 17 nt, Mycobacterium avium subsp. paratuberculosis
cggcguccacgccgugu

SEQ ID NO: 948108 - RNA, 19 nt, Mycobacterium avium subsp. paratuberculosis
cggcgucaucccccgcagc

SEQ ID NO: 948109 - RNA, 22 nt, Mycobacterium avium subsp. paratuberculosis
cggcguccagcgccgccacggc

SEQ ID NO: 948110 - RNA, 19 nt, Mycobacterium avium subsp. paratuberculosis
cggcguccucgaccacccg

SEQ ID NO: 948111 - RNA, 16 nt, Mycobacterium avium subsp. paratuberculosis
cggcguccucgacgcc

SEQ ID NO: 948112 - RNA, 17 nt, Mycobacterium avium subsp. paratuberculosis
cggcguccucgacgccg

SEQ ID NO: 948113 - RNA, 18 nt, Mycobacterium avium subsp. paratuberculosis
cggcguccucgacgccgc

SEQ ID NO: 948114 - RNA, 20 nt, Mycobacterium avium subsp. paratuberculosis
cggcguccucgacgccgcgc

SEQ ID NO: 948115 - RNA, 22 nt, Mycobacterium avium subsp. paratuberculosis
cggcguccucgacgccgcgcac

SEQ ID NO: 948116 - RNA, 17 nt, Mycobacterium avium subsp. paratuberculosis
cggcguccucgaugacg

SEQ ID NO: 948117 - RNA, 15 nt, Mycobacterium avium subsp. paratuberculosis
cggcgucuugaucuc

SEQ ID NO: 948118 - RNA, 21 nt, Mycobacterium avium subsp. paratuberculosis
cggcgucuugaucucggcggc

SEQ ID NO: 948119 - RNA, 16 nt, Mycobacterium avium subsp. paratuberculosis
cggcgucuugcugcgg

SEQ ID NO: 948120 - RNA, 20 nt, Mycobacterium avium subsp. paratuberculosis
cggcgucuugcugcggaacc

SEQ ID NO: 948121 - RNA, 14 nt, Mycobacterium avium subsp. paratuberculosis
cggcgucuugggga

SEQ ID NO: 948122 - RNA, 22 nt, Mycobacterium avium subsp. paratuberculosis
cggcgucuuggggauggucccc

SEQ ID NO: 948123 - RNA, 16 nt, Mycobacterium avium subsp. paratuberculosis
cggcgugccagggcag

SEQ ID NO: 948124 - RNA, 19 nt, Mycobacterium avium subsp. paratuberculosis
cggcgugccagggcagcgc

SEQ ID NO: 948125 - RNA, 20 nt, Mycobacterium avium subsp. paratuberculosis
cggcgugccagggcagcgcg

SEQ ID NO: 948126 - RNA, 21 nt, Mycobacterium avium subsp. paratuberculosis
cggcgugccagggcagcgcga

SEQ ID NO: 948127 - RNA, 22 nt, Mycobacterium avium subsp. paratuberculosis
cggcgugccagggcagcgcgac

SEQ ID NO: 948128 - RNA, 14 nt, Mycobacterium avium subsp. paratuberculosis
cggcgugcccgccg

SEQ ID NO: 948129 - RNA, 16 nt, Mycobacterium avium subsp. paratuberculosis
cggcgugcccgccgaa

SEQ ID NO: 948130 - RNA, 14 nt, Mycobacterium avium subsp. paratuberculosis
cggcgucggcgauc

SEQ ID NO: 948131 - RNA, 18 nt, Mycobacterium avium subsp. paratuberculosis
cggcgucuggccggagcg

SEQ ID NO: 948132 - RNA, 16 nt, Mycobacterium avium subsp. paratuberculosis
cggcgucggcgcgugc

SEQ ID NO: 948133 - RNA, 14 nt, Mycobacterium avium subsp. paratuberculosis
cggcgucggcggcc

SEQ ID NO: 948134 - RNA, 15 nt, Mycobacterium avium subsp. paratuberculosis
cggcgucggcggccu

SEQ ID NO: 948135 - RNA, 15 nt, Mycobacterium avium subsp. paratuberculosis
cggcgucggcgucca

SEQ ID NO: 948136 - RNA, 14 nt, Mycobacterium avium subsp. paratuberculosis
cggcgucggcgucg

SEQ ID NO: 948137 - RNA, 17 nt, Mycobacterium avium subsp. paratuberculosis
cggcgucggcgucgggc

SEQ ID NO: 948138 - RNA, 19 nt, Mycobacterium avium subsp. paratuberculosis
cggcgucucagucggccac

SEQ ID NO: 948139 - RNA, 21 nt, Mycobacterium avium subsp. paratuberculosis
cggcgucucagucggccaccg

SEQ ID NO: 948140 - RNA, 23 nt, Mycobacterium avium subsp. paratuberculosis
cggcgucucagucggccaccgcg

SEQ ID NO: 948141 - RNA, 15 nt, Mycobacterium avium subsp. paratuberculosis
cggcgucucggcccg

SEQ ID NO: 948142 - RNA, 14 nt, Mycobacterium avium subsp. paratuberculosis
cggcgucucggcgu

SEQ ID NO: 948143 - RNA, 15 nt, Mycobacterium avium subsp. paratuberculosis
cggcgucucggcguc

SEQ ID NO: 948144 - RNA, 16 nt, Mycobacterium avium subsp. paratuberculosis
cggcgucucggcgucu

SEQ ID NO: 948145 - RNA, 22 nt, Mycobacterium avium subsp. paratuberculosis
cggcgucucggcgucucggcgu

SEQ ID NO: 948146 - RNA, 15 nt, Mycobacterium avium subsp. paratuberculosis
cggcgucugcauccg

SEQ ID NO: 948147 - RNA, 14 nt, Mycobacterium avium subsp. paratuberculosis
cggcgucggcgacg

SEQ ID NO: 948148 - RNA, 15 nt, Mycobacterium avium subsp. paratuberculosis
cggcgucggcgacgg

SEQ ID NO: 948149 - RNA, 18 nt, Mycobacterium avium subsp. paratuberculosis
cggcgucggcgacggcgu

SEQ ID NO: 948150 - RNA, 20 nt, Mycobacterium avium subsp. paratuberculosis
cggcgucggcgacggcgucc

SEQ ID NO: 948151 - RNA, 13 nt, Mycobacterium avium subsp. paratuberculosis
cggcgucggcgag

SEQ ID NO: 948152 - RNA, 16 nt, Mycobacterium avium subsp. paratuberculosis
cggcgucggccaccgc

SEQ ID NO: 948153 - RNA, 18 nt, Mycobacterium avium subsp. paratuberculosis
cggcgucggccaccgcgc

SEQ ID NO: 948154 - RNA, 17 nt, Mycobacterium avium subsp. paratuberculosis
cggcgucggccgggcug

SEQ ID NO: 948155 - RNA, 12 nt, Mycobacterium avium subsp. paratuberculosis
cggcgucggcga

SEQ ID NO: 948156 - RNA, 22 nt, Mycobacterium avium subsp. paratuberculosis
cggcgucgcucauguugugcag

SEQ ID NO: 948157 - RNA, 19 nt, Mycobacterium avium subsp. paratuberculosis
cggcgucggagaugcgggc

SEQ ID NO: 948158 - RNA, 17 nt, Mycobacterium avium subsp. paratuberculosis
cggcgucggaggcggcg

SEQ ID NO: 948159 - RNA, 18 nt, Mycobacterium avium subsp. paratuberculosis
cggcgucggaggcggcgu

SEQ ID NO: 948160 - RNA, 19 nt, Mycobacterium avium subsp. paratuberculosis
cggcgucggaggcggcgua

SEQ ID NO: 948161 - RNA, 15 nt, Mycobacterium avium subsp. paratuberculosis
cggcgucggagucgc

SEQ ID NO: 948162 - RNA, 13 nt, Mycobacterium avium subsp. paratuberculosis
cggcgucggccac

SEQ ID NO: 948163 - RNA, 13 nt, Mycobacterium avium subsp. paratuberculosis
cggcgucgccgcu

SEQ ID NO: 948164 - RNA, 15 nt, Mycobacterium avium subsp. paratuberculosis
cggcgucgccgcugg

SEQ ID NO: 948165 - RNA, 16 nt, Mycobacterium avium subsp. paratuberculosis
cggcgucgccgcuggu

SEQ ID NO: 948166 - RNA, 17 nt, Mycobacterium avium subsp. paratuberculosis
cggcgucgccgagccgc

SEQ ID NO: 948167 - RNA, 16 nt, Mycobacterium avium subsp. paratuberculosis
cggcgucgccgagcuc

SEQ ID NO: 948168 - RNA, 20 nt, Mycobacterium avium subsp. paratuberculosis
cggcgucgacgacggcgccg

SEQ ID NO: 948169 - RNA, 15 nt, Mycobacterium avium subsp. paratuberculosis
cggcgucgacgucgg

SEQ ID NO: 948170 - RNA, 15 nt, Mycobacterium avium subsp. paratuberculosis
cggcgucgaccgccc

SEQ ID NO: 948171 - RNA, 18 nt, Mycobacterium avium subsp. paratuberculosis
cggcgucgaacggcgucu

SEQ ID NO: 948172 - RNA, 17 nt, Mycobacterium avium subsp. paratuberculosis
cggcgucgaagcgcaug

SEQ ID NO: 948173 - RNA, 18 nt, Mycobacterium avium subsp. paratuberculosis
cggcguccugcagcagcc

SEQ ID NO: 948174 - RNA, 23 nt, Mycobacterium avium subsp. paratuberculosis
cggcguccugcagcagccggacc

SEQ ID NO: 948175 - RNA, 21 nt, Mycobacterium avium subsp. paratuberculosis
cggcguccuugcccgagguca

SEQ ID NO: 948176 - RNA, 23 nt, Mycobacterium avium subsp. paratuberculosis
cggcgucgaaauagcggcgcacc

SEQ ID NO: 948177 - RNA, 17 nt, Mycobacterium avium subsp. paratuberculosis
cggcgucgacacccggg

SEQ ID NO: 948178 - RNA, 19 nt, Mycobacterium avium subsp. paratuberculosis
cggcgucgacacccgggcg

SEQ ID NO: 948179 - RNA, 12 nt, Mycobacterium avium subsp. paratuberculosis
cggcgucgacag

SEQ ID NO: 948180 - RNA, 14 nt, Mycobacterium avium subsp. paratuberculosis
cggcgucgacagcc

SEQ ID NO: 948181 - RNA, 16 nt, Mycobacterium avium subsp. paratuberculosis
cggcgucgacagccgg

SEQ ID NO: 948182 - RNA, 23 nt, Mycobacterium avium subsp. paratuberculosis
cggcgucgacagccggucgcgca

SEQ ID NO: 948183 - RNA, 13 nt, Mycobacterium avium subsp. paratuberculosis
cggcuccggccgc

SEQ ID NO: 948184 - RNA, 14 nt, Mycobacterium avium subsp. paratuberculosis
cggcuccggccgcg

SEQ ID NO: 948185 - RNA, 15 nt, Mycobacterium avium subsp. paratuberculosis
cggcuccggccgcgc

SEQ ID NO: 948186 - RNA, 17 nt, Mycobacterium avium subsp. paratuberculosis
cggcuccuaugucggug

SEQ ID NO: 948187 - RNA, 22 nt, Mycobacterium avium subsp. paratuberculosis
cggcuccuaugucggugcggcg

SEQ ID NO: 948188 - RNA, 23 nt, Mycobacterium avium subsp. paratuberculosis
cggcuccuaugucggugcggcgg

SEQ ID NO: 948189 - RNA, 15 nt, Mycobacterium avium subsp. paratuberculosis
cggcucgcccgcgac

SEQ ID NO: 948190 - RNA, 11 nt, Mycobacterium avium subsp. paratuberculosis
cggcucgccga

SEQ ID NO: 948191 - RNA, 16 nt, Mycobacterium avium subsp. paratuberculosis
cggcucgagcucgucg

SEQ ID NO: 948192 - RNA, 17 nt, Mycobacterium avium subsp. paratuberculosis
cggcucgagcucgucgg

SEQ ID NO: 948193 - RNA, 20 nt, Mycobacterium avium subsp. paratuberculosis
cggcucgagcucgucgggug

SEQ ID NO: 948194 - RNA, 16 nt, Mycobacterium avium subsp. paratuberculosis
cggcucgaucgcgguc

SEQ ID NO: 948195 - RNA, 19 nt, Mycobacterium avium subsp. paratuberculosis
cggcucgauggacgccagc

SEQ ID NO: 948196 - RNA, 21 nt, Mycobacterium avium subsp. paratuberculosis
cggcucgauggacgccagcau

SEQ ID NO: 948197 - RNA, 17 nt, Mycobacterium avium subsp. paratuberculosis
cggcuccuugcgccgca

SEQ ID NO: 948198 - RNA, 16 nt, Mycobacterium avium subsp. paratuberculosis
cggcucggcggcgucg

SEQ ID NO: 948199 - RNA, 15 nt, Mycobacterium avium subsp. paratuberculosis
cggcucggcggcuca

SEQ ID NO: 948200 - RNA, 13 nt, Mycobacterium avium subsp. paratuberculosis
cggcucggcucgg

SEQ ID NO: 948201 - RNA, 16 nt, Mycobacterium avium subsp. paratuberculosis
cggcucggcucggccg

SEQ ID NO: 948202 - RNA, 17 nt, Mycobacterium avium subsp. paratuberculosis
cggcucggcucggccgg

SEQ ID NO: 948203 - RNA, 12 nt, Mycobacterium avium subsp. paratuberculosis
cggcucggcgac

SEQ ID NO: 948204 - RNA, 21 nt, Mycobacterium avium subsp. paratuberculosis
cggcucggcgacaacagcgcc

SEQ ID NO: 948205 - RNA, 12 nt, Mycobacterium avium subsp. paratuberculosis
cggcucggcgcc

SEQ ID NO: 948206 - RNA, 13 nt, Mycobacterium avium subsp. paratuberculosis
cggcucggcgccc

SEQ ID NO: 948207 - RNA, 14 nt, Mycobacterium avium subsp. paratuberculosis
cggcucggcgcccc

SEQ ID NO: 948208 - RNA, 15 nt, Mycobacterium avium subsp. paratuberculosis
cggcucggcgcccca

SEQ ID NO: 948209 - RNA, 19 nt, Mycobacterium avium subsp. paratuberculosis
cggcucggcgccccacgcc

SEQ ID NO: 948210 - RNA, 13 nt, Mycobacterium avium subsp. paratuberculosis
cggcucggaaccg

SEQ ID NO: 948211 - RNA, 14 nt, Mycobacterium avium subsp. paratuberculosis
cggcucggccggcc

SEQ ID NO: 948212 - RNA, 16 nt, Mycobacterium avium subsp. paratuberculosis
cggcucggccggccgg

SEQ ID NO: 948213 - RNA, 15 nt, Mycobacterium avium subsp. paratuberculosis
cggcucgcgggcgau

SEQ ID NO: 948214 - RNA, 22 nt, Mycobacterium avium subsp. paratuberculosis
cggcucgcgggcgaugcggccc

SEQ ID NO: 948215 - RNA, 15 nt, Mycobacterium avium subsp. paratuberculosis
cggcucgcggggugu

SEQ ID NO: 948216 - RNA, 17 nt, Mycobacterium avium subsp. paratuberculosis
cggcucgcggggugucg

SEQ ID NO: 948217 - RNA, 21 nt, Mycobacterium avium subsp. paratuberculosis
cggcucgcggggugucgugca

SEQ ID NO: 948218 - RNA, 17 nt, Mycobacterium avium subsp. paratuberculosis
cggcucgcgggugcggc

SEQ ID NO: 948219 - RNA, 19 nt, Mycobacterium avium subsp. paratuberculosis
cggcucgccggcgcgcacc

SEQ ID NO: 948220 - RNA, 12 nt, Mycobacterium avium subsp. paratuberculosis
cggcucgcgcgg

SEQ ID NO: 948221 - RNA, 21 nt, Mycobacterium avium subsp. paratuberculosis
cggcucgccguugcgggucgg

SEQ ID NO: 948222 - RNA, 16 nt, Mycobacterium avium subsp. paratuberculosis
cggcucgcgcgguguu

SEQ ID NO: 948223 - RNA, 12 nt, Mycobacterium avium subsp. paratuberculosis
cggcucgccugc

SEQ ID NO: 948224 - RNA, 14 nt, Mycobacterium avium subsp. paratuberculosis
cggcucgccugcga

SEQ ID NO: 948225 - RNA, 20 nt, Mycobacterium avium subsp. paratuberculosis
cggcucgccugcgagcguga

SEQ ID NO: 948226 - RNA, 15 nt, Mycobacterium avium subsp. paratuberculosis
cggcucgcgacgcgg

SEQ ID NO: 948227 - RNA, 19 nt, Mycobacterium avium subsp. paratuberculosis
cggcucgcgacgcggcucg

SEQ ID NO: 948228 - RNA, 15 nt, Mycobacterium avium subsp. paratuberculosis
cggcucgccgcgcau

SEQ ID NO: 948229 - RNA, 15 nt, Mycobacterium avium subsp. paratuberculosis
cggcucgccggcgcg

SEQ ID NO: 948230 - RNA, 23 nt, Mycobacterium avium subsp. paratuberculosis
cggcucaacggccggcgccgccg

SEQ ID NO: 948231 - RNA, 15 nt, Mycobacterium avium subsp. paratuberculosis
cggcucacagcgcgg

SEQ ID NO: 948232 - RNA, 17 nt, Mycobacterium avium subsp. paratuberculosis
cggcucacagcgcggcg

SEQ ID NO: 948233 - RNA, 18 nt, Mycobacterium avium subsp. paratuberculosis
cggcucacagcgcggcgg

SEQ ID NO: 948234 - RNA, 19 nt, Mycobacterium avium subsp. paratuberculosis
cggcucacagcgcggcggu

SEQ ID NO: 948235 - RNA, 15 nt, Mycobacterium avium subsp. paratuberculosis
cggcucaccaggucc

SEQ ID NO: 948236 - RNA, 20 nt, Mycobacterium avium subsp. paratuberculosis
cggcuauucgggccugacca

SEQ ID NO: 948237 - RNA, 19 nt, Mycobacterium avium subsp. paratuberculosis
cggcuacucggacgccggc

SEQ ID NO: 948238 - RNA, 21 nt, Mycobacterium avium subsp. paratuberculosis
cggcuacucggacgccggcag

SEQ ID NO: 948239 - RNA, 14 nt, Mycobacterium avium subsp. paratuberculosis
cggcuagacgcgca

SEQ ID NO: 948240 - RNA, 20 nt, Mycobacterium avium subsp. paratuberculosis
cggcuagcagcuccggucgg

SEQ ID NO: 948241 - RNA, 24 nt, Mycobacterium avium subsp. paratuberculosis
cggcuagcagcuccggucggcgcu

SEQ ID NO: 948242 - RNA, 20 nt, Mycobacterium avium subsp. paratuberculosis
cggcuagcggcugacccgcc

SEQ ID NO: 948243 - RNA, 14 nt, Mycobacterium avium subsp. paratuberculosis
cggcuccaccgcgc

SEQ ID NO: 948244 - RNA, 16 nt, Mycobacterium avium subsp. paratuberculosis
cggcuccaccgcgccg

SEQ ID NO: 948245 - RNA, 17 nt, Mycobacterium avium subsp. paratuberculosis
cggcuccaccgcgccgg

SEQ ID NO: 948246 - RNA, 19 nt, Mycobacterium avium subsp. paratuberculosis
cggcuccaccgcgccggcg

SEQ ID NO: 948247 - RNA, 23 nt, Mycobacterium avium subsp. paratuberculosis
cggcuccaccgcgccggcggcgg

SEQ ID NO: 948248 - RNA, 19 nt, Mycobacterium avium subsp. paratuberculosis
cggcucagcccggcgcuca

SEQ ID NO: 948249 - RNA, 18 nt, Mycobacterium avium subsp. paratuberculosis
cggcucagcaacccgccg

SEQ ID NO: 948250 - RNA, 19 nt, Mycobacterium avium subsp. paratuberculosis
cggcucagcaacccgccga

SEQ ID NO: 948251 - RNA, 13 nt, Mycobacterium avium subsp. paratuberculosis
cggcucagcggca

SEQ ID NO: 948252 - RNA, 16 nt, Mycobacterium avium subsp. paratuberculosis
cggcucagggugcgcu

SEQ ID NO: 948253 - RNA, 21 nt, Mycobacterium avium subsp. paratuberculosis
cggcucagggugcgcuggccg

SEQ ID NO: 948254 - RNA, 23 nt, Mycobacterium avium subsp. paratuberculosis
cggcucagggugcgcuggccgac

SEQ ID NO: 948255 - RNA, 13 nt, Mycobacterium avium subsp. paratuberculosis
cggcuccagcgcc

SEQ ID NO: 948256 - RNA, 19 nt, Mycobacterium avium subsp. paratuberculosis
cggcuccagcgcccgccgc

SEQ ID NO: 948257 - RNA, 15 nt, Mycobacterium avium subsp. paratuberculosis
cggcuccacgaugcc

SEQ ID NO: 948258 - RNA, 22 nt, Mycobacterium avium subsp. paratuberculosis
cggcuccacgaugcccgucacg

SEQ ID NO: 948259 - RNA, 13 nt, Mycobacterium avium subsp. paratuberculosis
cggcuccagcagc

SEQ ID NO: 948260 - RNA, 14 nt, Mycobacterium avium subsp. paratuberculosis
cggcuccagcagcg

SEQ ID NO: 948261 - RNA, 16 nt, Mycobacterium avium subsp. paratuberculosis
cggcuccagcagcggc

SEQ ID NO: 948262 - RNA, 20 nt, Mycobacterium avium subsp. paratuberculosis
cggcuccagcagcggcucgg

SEQ ID NO: 948263 - RNA, 19 nt, Mycobacterium avium subsp. paratuberculosis
cggcuccagguagggcaca

SEQ ID NO: 948264 - RNA, 18 nt, Mycobacterium avium subsp. paratuberculosis
cggcuccauguccggagc

SEQ ID NO: 948265 - RNA, 14 nt, Mycobacterium avium subsp. paratuberculosis
cggcucccaggccc

SEQ ID NO: 948266 - RNA, 17 nt, Mycobacterium avium subsp. paratuberculosis
cggcucccaggcccauc

SEQ ID NO: 948267 - RNA, 23 nt, Mycobacterium avium subsp. paratuberculosis
cggcucccaggcccaucgcgguc

SEQ ID NO: 948268 - RNA, 16 nt, Mycobacterium avium subsp. paratuberculosis
cggcucgucggcgaac

SEQ ID NO: 948269 - RNA, 16 nt, Mycobacterium avium subsp. paratuberculosis
cggcucguguccgaug

SEQ ID NO: 948270 - RNA, 19 nt, Mycobacterium avium subsp. paratuberculosis
cggcucguagcgggcgaac

SEQ ID NO: 948271 - RNA, 19 nt, Mycobacterium avium subsp. paratuberculosis
cggcucguccaucagcagc

SEQ ID NO: 948272 - RNA, 18 nt, Mycobacterium avium subsp. paratuberculosis
cggcucgggaacggucag

SEQ ID NO: 948273 - RNA, 13 nt, Mycobacterium avium subsp. paratuberculosis
cggcucgggccaa

SEQ ID NO: 948274 - RNA, 12 nt, Mycobacterium avium subsp. paratuberculosis
cggcucgggcgg

SEQ ID NO: 948275 - RNA, 21 nt, Mycobacterium avium subsp. paratuberculosis
cggcucgggcgguggcgccgg

SEQ ID NO: 948276 - RNA, 22 nt, Mycobacterium avium subsp. paratuberculosis
cggcucgggcgguggcgccggg

SEQ ID NO: 948277 - RNA, 14 nt, Mycobacterium avium subsp. paratuberculosis
cggcucgggggugu

SEQ ID NO: 948278 - RNA, 17 nt, Mycobacterium avium subsp. paratuberculosis
cggcucggggucggccg

SEQ ID NO: 948279 - RNA, 21 nt, Mycobacterium avium subsp. paratuberculosis
cggcucggggucggccgaggu

SEQ ID NO: 948280 - RNA, 21 nt, Mycobacterium avium subsp. paratuberculosis
cggcucggucaagccggccag

SEQ ID NO: 948281 - RNA, 14 nt, Mycobacterium avium subsp. paratuberculosis
cggcucggucgcga

SEQ ID NO: 948282 - RNA, 17 nt, Mycobacterium avium subsp. paratuberculosis
cggcucggucuccucca

SEQ ID NO: 948283 - RNA, 13 nt, Mycobacterium avium subsp. paratuberculosis
cggcucggugccg

SEQ ID NO: 948284 - RNA, 14 nt, Mycobacterium avium subsp. paratuberculosis
cggcucuucggcgc

SEQ ID NO: 948285 - RNA, 16 nt, Mycobacterium avium subsp. paratuberculosis
cggcucuucggcgccg

SEQ ID NO: 948286 - RNA, 16 nt, Mycobacterium avium subsp. paratuberculosis
cggcucuuggcgaccu

SEQ ID NO: 948287 - RNA, 15 nt, Mycobacterium avium subsp. paratuberculosis
cggcucugccugcag

SEQ ID NO: 948288 - RNA, 22 nt, Mycobacterium avium subsp. paratuberculosis
cggcugaaccugcugggcggca

SEQ ID NO: 948289 - RNA, 18 nt, Mycobacterium avium subsp. paratuberculosis
cggcugaacgccagcagc

SEQ ID NO: 948290 - RNA, 19 nt, Mycobacterium avium subsp. paratuberculosis
cggcugaacgccagcagcc

SEQ ID NO: 948291 - RNA, 21 nt, Mycobacterium avium subsp. paratuberculosis
cggcugaacgccagcagccgc

SEQ ID NO: 948292 - RNA, 16 nt, Mycobacterium avium subsp. paratuberculosis
cggcugaaccaccgcg

SEQ ID NO: 948293 - RNA, 19 nt, Mycobacterium avium subsp. paratuberculosis
cggcugaaccaccgcgccc

SEQ ID NO: 948294 - RNA, 15 nt, Mycobacterium avium subsp. paratuberculosis
cggcugcccaggauc

SEQ ID NO: 948295 - RNA, 22 nt, Mycobacterium avium subsp. paratuberculosis
cggcugcuguucguccgugcug

SEQ ID NO: 948296 - RNA, 21 nt, Mycobacterium avium subsp. paratuberculosis
cggcugcgcacguagcccagc

SEQ ID NO: 948297 - RNA, 15 nt, Mycobacterium avium subsp. paratuberculosis
cggcugcgcagcgca

SEQ ID NO: 948298 - RNA, 18 nt, Mycobacterium avium subsp. paratuberculosis
cggcugcgcagcgcagca

SEQ ID NO: 948299 - RNA, 15 nt, Mycobacterium avium subsp. paratuberculosis
cggcugcgccgcgcu

SEQ ID NO: 948300 - RNA, 18 nt, Mycobacterium avium subsp. paratuberculosis
cggcuggcaggucgcgcc

SEQ ID NO: 948301 - RNA, 16 nt, Mycobacterium avium subsp. paratuberculosis
cggcuggaaucccgcc

SEQ ID NO: 948302 - RNA, 21 nt, Mycobacterium avium subsp. paratuberculosis
cggcuggaaucccgccucggc

SEQ ID NO: 948303 - RNA, 23 nt, Mycobacterium avium subsp. paratuberculosis
cggcuggaaucccgccucggcgg

SEQ ID NO: 948304 - RNA, 13 nt, Mycobacterium avium subsp. paratuberculosis
cggcuggacaccc

SEQ ID NO: 948305 - RNA, 16 nt, Mycobacterium avium subsp. paratuberculosis
cggcuggacacccccg

SEQ ID NO: 948306 - RNA, 14 nt, Mycobacterium avium subsp. paratuberculosis
cggcugccucgacg

SEQ ID NO: 948307 - RNA, 17 nt, Mycobacterium avium subsp. paratuberculosis
cggcugccucgacgaug

SEQ ID NO: 948308 - RNA, 18 nt, Mycobacterium avium subsp. paratuberculosis
cggcugccucgacgaugg

SEQ ID NO: 948309 - RNA, 14 nt, Mycobacterium avium subsp. paratuberculosis
cggcugccggccaa

SEQ ID NO: 948310 - RNA, 14 nt, Mycobacterium avium subsp. paratuberculosis
cggcugcccuggga

SEQ ID NO: 948311 - RNA, 22 nt, Mycobacterium avium subsp. paratuberculosis
cggcugccgaccucgauggcga

SEQ ID NO: 948312 - RNA, 23 nt, Mycobacterium avium subsp. paratuberculosis
cggcugccgaccucgauggcgac

SEQ ID NO: 948313 - RNA, 22 nt, Mycobacterium avium subsp. paratuberculosis
cggcugccccagggaccagugg

SEQ ID NO: 948314 - RNA, 19 nt, Mycobacterium avium subsp. paratuberculosis
cggcugcccgacccgcacc

SEQ ID NO: 948315 - RNA, 20 nt, Mycobacterium avium subsp. paratuberculosis
cggcugcccgacccgcacca

SEQ ID NO: 948316 - RNA, 21 nt, Mycobacterium avium subsp. paratuberculosis
cggcugcccgacccgcaccac

SEQ ID NO: 948317 - RNA, 13 nt, Mycobacterium avium subsp. paratuberculosis
cggcugcccgcga

SEQ ID NO: 948318 - RNA, 20 nt, Mycobacterium avium subsp. paratuberculosis
cggcugcccgcgacugucgg

SEQ ID NO: 948319 - RNA, 19 nt, Mycobacterium avium subsp. paratuberculosis
cggcugcccggcccgccgc

SEQ ID NO: 948320 - RNA, 15 nt, Mycobacterium avium subsp. paratuberculosis
cggcuuccgagacgu

SEQ ID NO: 948321 - RNA, 20 nt, Mycobacterium avium subsp. paratuberculosis
cggcuuccgagccggugaug

SEQ ID NO: 948322 - RNA, 13 nt, Mycobacterium avium subsp. paratuberculosis
cggcuuccgcgga

SEQ ID NO: 948323 - RNA, 19 nt, Mycobacterium avium subsp. paratuberculosis
cggcuuccgcggacggguu

SEQ ID NO: 948324 - RNA, 17 nt, Mycobacterium avium subsp. paratuberculosis
cggcuuccuccucggcg

SEQ ID NO: 948325 - RNA, 19 nt, Mycobacterium avium subsp. paratuberculosis
cggcuuccuccucggcgcg

SEQ ID NO: 948326 - RNA, 18 nt, Mycobacterium avium subsp. paratuberculosis
cggcuuccucgcggaacc

SEQ ID NO: 948327 - RNA, 14 nt, Mycobacterium avium subsp. paratuberculosis
cggcuucgccgccg

SEQ ID NO: 948328 - RNA, 15 nt, Mycobacterium avium subsp. paratuberculosis
cggcuucgccgccgc

SEQ ID NO: 948329 - RNA, 19 nt, Mycobacterium avium subsp. paratuberculosis
cggcuucgccgccgcaccg

SEQ ID NO: 948330 - RNA, 22 nt, Mycobacterium avium subsp. paratuberculosis
cggcuucgccgccgcaccggcc

SEQ ID NO: 948331 - RNA, 13 nt, Mycobacterium avium subsp. paratuberculosis
cggcuucgccgcg

SEQ ID NO: 948332 - RNA, 15 nt, Mycobacterium avium subsp. paratuberculosis
cggcuucgccgcgcu

SEQ ID NO: 948333 - RNA, 14 nt, Mycobacterium avium subsp. paratuberculosis
cggcuucggccaag

SEQ ID NO: 948334 - RNA, 19 nt, Mycobacterium avium subsp. paratuberculosis
cggcuucgggaucagcggg

SEQ ID NO: 948335 - RNA, 18 nt, Mycobacterium avium subsp. paratuberculosis
cggcuucguacggcccgg

SEQ ID NO: 948336 - RNA, 21 nt, Mycobacterium avium subsp. paratuberculosis
cggcuucguacggcccgggaa

SEQ ID NO: 948337 - RNA, 23 nt, Mycobacterium avium subsp. paratuberculosis
cggcuucgccgcgcuugcgaccg

SEQ ID NO: 948338 - RNA, 14 nt, Mycobacterium avium subsp. paratuberculosis
cggcuucgcugcgc

SEQ ID NO: 948339 - RNA, 15 nt, Mycobacterium avium subsp. paratuberculosis
cggcuucgcugcgcc

SEQ ID NO: 948340 - RNA, 16 nt, Mycobacterium avium subsp. paratuberculosis
cggcuucgcugcgccg

SEQ ID NO: 948341 - RNA, 20 nt, Mycobacterium avium subsp. paratuberculosis
cggcuucgcugcgccggcgg

SEQ ID NO: 948342 - RNA, 23 nt, Mycobacterium avium subsp. paratuberculosis
cggcuucgcugcgccggcgguau

SEQ ID NO: 948343 - RNA, 13 nt, Mycobacterium avium subsp. paratuberculosis
cggcuguagcacc

SEQ ID NO: 948344 - RNA, 17 nt, Mycobacterium avium subsp. paratuberculosis
cggcuguagcacccggc

SEQ ID NO: 948345 - RNA, 19 nt, Mycobacterium avium subsp. paratuberculosis
cggcuguagcacccggccg

SEQ ID NO: 948346 - RNA, 21 nt, Mycobacterium avium subsp. paratuberculosis
cggcuguagcacccggccggc

SEQ ID NO: 948347 - RNA, 22 nt, Mycobacterium avium subsp. paratuberculosis
cggcuguagcacccggccggcg

SEQ ID NO: 948348 - RNA, 15 nt, Mycobacterium avium subsp. paratuberculosis
cggcuggugccgccg

SEQ ID NO: 948349 - RNA, 17 nt, Mycobacterium avium subsp. paratuberculosis
cggcuggugccgccggc

SEQ ID NO: 948350 - RNA, 21 nt, Mycobacterium avium subsp. paratuberculosis
cggcuggugccgccggcgauc

SEQ ID NO: 948351 - RNA, 15 nt, Mycobacterium avium subsp. paratuberculosis
cggcuggugcagcag

SEQ ID NO: 948352 - RNA, 12 nt, Mycobacterium avium subsp. paratuberculosis
cggcuggccgcg

SEQ ID NO: 948353 - RNA, 13 nt, Mycobacterium avium subsp. paratuberculosis
cggcuggcccggc

SEQ ID NO: 948354 - RNA, 15 nt, Mycobacterium avium subsp. paratuberculosis
cggcuggcccggcgc

SEQ ID NO: 948355 - RNA, 18 nt, Mycobacterium avium subsp. paratuberculosis
cggcuggcccggcgcggc

SEQ ID NO: 948356 - RNA, 19 nt, Mycobacterium avium subsp. paratuberculosis
cggcuggcccggcgcggcg

SEQ ID NO: 948357 - RNA, 14 nt, Mycobacterium avium subsp. paratuberculosis
cggcuggccgagcg

SEQ ID NO: 948358 - RNA, 15 nt, Mycobacterium avium subsp. paratuberculosis
cggcuggccgagcgg

SEQ ID NO: 948359 - RNA, 14 nt, Mycobacterium avium subsp. paratuberculosis
cggcuggccgcggc

SEQ ID NO: 948360 - RNA, 12 nt, Mycobacterium avium subsp. paratuberculosis
cggcuggccgga

SEQ ID NO: 948361 - RNA, 20 nt, Mycobacterium avium subsp. paratuberculosis
cggcuggguggacaccuugg

SEQ ID NO: 948362 - RNA, 13 nt, Mycobacterium avium subsp. paratuberculosis
cggcuggucggcg

SEQ ID NO: 948363 - RNA, 15 nt, Mycobacterium avium subsp. paratuberculosis
cggcuggucggcggc

SEQ ID NO: 948364 - RNA, 16 nt, Mycobacterium avium subsp. paratuberculosis
cgggcaggccgggaua

SEQ ID NO: 948365 - RNA, 15 nt, Mycobacterium avium subsp. paratuberculosis
cgggcaggccggugc

SEQ ID NO: 948366 - RNA, 14 nt, Mycobacterium avium subsp. paratuberculosis
cgggcaggcccgag

SEQ ID NO: 948367 - RNA, 20 nt, Mycobacterium avium subsp. paratuberculosis
cgggcaggcccgagcccgac

SEQ ID NO: 948368 - RNA, 21 nt, Mycobacterium avium subsp. paratuberculosis
cgggcaggcccgagcccgacg

SEQ ID NO: 948369 - RNA, 22 nt, Mycobacterium avium subsp. paratuberculosis
cgggcagguacugcuugccgcc

SEQ ID NO: 948370 - RNA, 20 nt, Mycobacterium avium subsp. paratuberculosis
cgggcaugcccguagaugcc

SEQ ID NO: 948371 - RNA, 13 nt, Mycobacterium avium subsp. paratuberculosis
cgggcaugccggc

SEQ ID NO: 948372 - RNA, 19 nt, Mycobacterium avium subsp. paratuberculosis
cgggcagcuuccgccucgg

SEQ ID NO: 948373 - RNA, 20 nt, Mycobacterium avium subsp. paratuberculosis
cgggcagcuuccgccucggc

SEQ ID NO: 948374 - RNA, 17 nt, Mycobacterium avium subsp. paratuberculosis
cgggcaggaugccgcgu

SEQ ID NO: 948375 - RNA, 15 nt, Mycobacterium avium subsp. paratuberculosis
cgggcaggcacggug

SEQ ID NO: 948376 - RNA, 16 nt, Mycobacterium avium subsp. paratuberculosis
cgggcacggcgaugua

SEQ ID NO: 948377 - RNA, 14 nt, Mycobacterium avium subsp. paratuberculosis
cgggcacgccgccg

SEQ ID NO: 948378 - RNA, 16 nt, Mycobacterium avium subsp. paratuberculosis
cgggcacgcagcggcg

SEQ ID NO: 948379 - RNA, 21 nt, Mycobacterium avium subsp. paratuberculosis
cgggcacgcagcggcgucacg

SEQ ID NO: 948380 - RNA, 14 nt, Mycobacterium avium subsp. paratuberculosis
cgggcaccgacgag

SEQ ID NO: 948381 - RNA, 13 nt, Mycobacterium avium subsp. paratuberculosis
cgggcaccgcgcc

SEQ ID NO: 948382 - RNA, 21 nt, Mycobacterium avium subsp. paratuberculosis
cgggcacccgcgcgucgcgca

SEQ ID NO: 948383 - RNA, 16 nt, Mycobacterium avium subsp. paratuberculosis
cgggcacccggcgcgg

SEQ ID NO: 948384 - RNA, 17 nt, Mycobacterium avium subsp. paratuberculosis
cgggcacccggcgcggc

SEQ ID NO: 948385 - RNA, 12 nt, Mycobacterium avium subsp. paratuberculosis
cgggcacccggg

SEQ ID NO: 948386 - RNA, 14 nt, Mycobacterium avium subsp. paratuberculosis
cgggcacccgggcg

SEQ ID NO: 948387 - RNA, 15 nt, Mycobacterium avium subsp. paratuberculosis
cgggcacccgggcga

SEQ ID NO: 948388 - RNA, 16 nt, Mycobacterium avium subsp. paratuberculosis
cgggcacccgggcgac

SEQ ID NO: 948389 - RNA, 15 nt, Mycobacterium avium subsp. paratuberculosis
cgggcaccgucgucg

SEQ ID NO: 948390 - RNA, 17 nt, Mycobacterium avium subsp. paratuberculosis
cgggcaccgucgucgca

SEQ ID NO: 948391 - RNA, 21 nt, Mycobacterium avium subsp. paratuberculosis
cgggcaccgucgucgcaccgg

SEQ ID NO: 948392 - RNA, 23 nt, Mycobacterium avium subsp. paratuberculosis
cgggcaccgucgucgcaccggca

SEQ ID NO: 948393 - RNA, 14 nt, Mycobacterium avium subsp. paratuberculosis
cgggcaccucggcg

SEQ ID NO: 948394 - RNA, 18 nt, Mycobacterium avium subsp. paratuberculosis
cgggcaccucggcgucgg

SEQ ID NO: 948395 - RNA, 15 nt, Mycobacterium avium subsp. paratuberculosis
cgggcaccugauagg

SEQ ID NO: 948396 - RNA, 23 nt, Mycobacterium avium subsp. paratuberculosis
cgggcacgaauucgguggcgaug

SEQ ID NO: 948397 - RNA, 19 nt, Mycobacterium avium subsp. paratuberculosis
cgggcacgacggucagcac

SEQ ID NO: 948398 - RNA, 23 nt, Mycobacterium avium subsp. paratuberculosis
cgggcacgacggucagcacgcug

SEQ ID NO: 948399 - RNA, 17 nt, Mycobacterium avium subsp. paratuberculosis
cgggcacccccggggug

SEQ ID NO: 948400 - RNA, 15 nt, Mycobacterium avium subsp. paratuberculosis
cgggcaccaccaccg

SEQ ID NO: 948401 - RNA, 20 nt, Mycobacterium avium subsp. paratuberculosis
cgggcaccagcgacagcacc

SEQ ID NO: 948402 - RNA, 22 nt, Mycobacterium avium subsp. paratuberculosis
cgggcaccagcgacagcacccg

SEQ ID NO: 948403 - RNA, 14 nt, Mycobacterium avium subsp. paratuberculosis
cgggcaccagcgcg

SEQ ID NO: 948404 - RNA, 15 nt, Mycobacterium avium subsp. paratuberculosis
cgggcaccagcgcga

SEQ ID NO: 948405 - RNA, 16 nt, Mycobacterium avium subsp. paratuberculosis
cgggcaccagcgcgac

SEQ ID NO: 948406 - RNA, 18 nt, Mycobacterium avium subsp. paratuberculosis
cgggcaccagcgcgacgg

SEQ ID NO: 948407 - RNA, 17 nt, Mycobacterium avium subsp. paratuberculosis
cgggcaccccggucacc

SEQ ID NO: 948408 - RNA, 19 nt, Mycobacterium avium subsp. paratuberculosis
cgggcaccccggucaccgg

SEQ ID NO: 948409 - RNA, 22 nt, Mycobacterium avium subsp. paratuberculosis
cgggcaccccggucaccggucc

SEQ ID NO: 948410 - RNA, 18 nt, Mycobacterium avium subsp. paratuberculosis
cgggcaccccugccgcca

SEQ ID NO: 948411 - RNA, 19 nt, Mycobacterium avium subsp. paratuberculosis
cgggcaccccugccgccac

SEQ ID NO: 948412 - RNA, 22 nt, Mycobacterium avium subsp. paratuberculosis
cgggcaccccugccgccaccgc

SEQ ID NO: 948413 - RNA, 17 nt, Mycobacterium avium subsp. paratuberculosis
cgggcacccgacgucga

SEQ ID NO: 948414 - RNA, 19 nt, Mycobacterium avium subsp. paratuberculosis
cgggcacccgacgucgacg

SEQ ID NO: 948415 - RNA, 14 nt, Mycobacterium avium subsp. paratuberculosis
cgggcaccacgccg

SEQ ID NO: 948416 - RNA, 16 nt, Mycobacterium avium subsp. paratuberculosis
cgggcaccacgccgac

SEQ ID NO: 948417 - RNA, 17 nt, Mycobacterium avium subsp. paratuberculosis
cgggcaccacgccgacg

SEQ ID NO: 948418 - RNA, 19 nt, Mycobacterium avium subsp. paratuberculosis
cgggcaccacgccgacgug

SEQ ID NO: 948419 - RNA, 20 nt, Mycobacterium avium subsp. paratuberculosis
cgggcaccacgccgacgugg

SEQ ID NO: 948420 - RNA, 17 nt, Mycobacterium avium subsp. paratuberculosis
cgggcaccacggcggca

SEQ ID NO: 948421 - RNA, 19 nt, Mycobacterium avium subsp. paratuberculosis
cgggcaccacggcggcaug

SEQ ID NO: 948422 - RNA, 16 nt, Mycobacterium avium subsp. paratuberculosis
cgggcacaucccgcaa

SEQ ID NO: 948423 - RNA, 13 nt, Mycobacterium avium subsp. paratuberculosis
cgggcaccagcac

SEQ ID NO: 948424 - RNA, 14 nt, Mycobacterium avium subsp. paratuberculosis
cgggcaccagcacc

SEQ ID NO: 948425 - RNA, 15 nt, Mycobacterium avium subsp. paratuberculosis
cgggcaccagcaccg

SEQ ID NO: 948426 - RNA, 16 nt, Mycobacterium avium subsp. paratuberculosis
cgggcaccagcaccga

SEQ ID NO: 948427 - RNA, 17 nt, Mycobacterium avium subsp. paratuberculosis
cgggcaccagcaccgag

SEQ ID NO: 948428 - RNA, 13 nt, Mycobacterium avium subsp. paratuberculosis
cgggcauggucac

SEQ ID NO: 948429 - RNA, 17 nt, Mycobacterium avium subsp. paratuberculosis
cgggcaugguuccucgu

SEQ ID NO: 948430 - RNA, 22 nt, Mycobacterium avium subsp. paratuberculosis
cgggcauuggcagcucgggcag

SEQ ID NO: 948431 - RNA, 23 nt, Mycobacterium avium subsp. paratuberculosis
cgggcauuggcagcucgggcagc

SEQ ID NO: 948432 - RNA, 17 nt, Mycobacterium avium subsp. paratuberculosis
cgggcaugccggccggc

SEQ ID NO: 948433 - RNA, 15 nt, Mycobacterium avium subsp. paratuberculosis
cgggcaugccgucgg

SEQ ID NO: 948434 - RNA, 19 nt, Mycobacterium avium subsp. paratuberculosis
cgggcaugccgucggcgcc

SEQ ID NO: 948435 - RNA, 23 nt, Mycobacterium avium subsp. paratuberculosis
cgggcaugccgucggcgcccggc

SEQ ID NO: 948436 - RNA, 22 nt, Mycobacterium avium subsp. paratuberculosis
cgggcaugccguucagcgcggc

SEQ ID NO: 948437 - RNA, 22 nt, Mycobacterium avium subsp. paratuberculosis
cgggccaaaucgcuugcgccgc

SEQ ID NO: 948438 - RNA, 17 nt, Mycobacterium avium subsp. paratuberculosis
cgggccaagcaccggga

SEQ ID NO: 948439 - RNA, 21 nt, Mycobacterium avium subsp. paratuberculosis
cgggccaauuacgcugcggcg

SEQ ID NO: 948440 - RNA, 21 nt, Mycobacterium avium subsp. paratuberculosis
cgggccacaacaaggugugga

SEQ ID NO: 948441 - RNA, 16 nt, Mycobacterium avium subsp. paratuberculosis
cgggccacacccgucg

SEQ ID NO: 948442 - RNA, 19 nt, Mycobacterium avium subsp. paratuberculosis
cgggccacacccgucgacu

SEQ ID NO: 948443 - RNA, 15 nt, Mycobacterium avium subsp. paratuberculosis
cgggccacagcggcg

SEQ ID NO: 948444 - RNA, 17 nt, Mycobacterium avium subsp. paratuberculosis
cgggccacagcggcgac

SEQ ID NO: 948445 - RNA, 13 nt, Mycobacterium avium subsp. paratuberculosis
cgggccagacugc

SEQ ID NO: 948446 - RNA, 18 nt, Mycobacterium avium subsp. paratuberculosis
cgggccagacugcgcacc

SEQ ID NO: 948447 - RNA, 21 nt, Mycobacterium avium subsp. paratuberculosis
cgggccagacugcgcaccgcc

SEQ ID NO: 948448 - RNA, 21 nt, Mycobacterium avium subsp. paratuberculosis
cgggccaccgucccggugucg

SEQ ID NO: 948449 - RNA, 14 nt, Mycobacterium avium subsp. paratuberculosis
cgggccaccgucuu

SEQ ID NO: 948450 - RNA, 15 nt, Mycobacterium avium subsp. paratuberculosis
cgggccacgcagucg

SEQ ID NO: 948451 - RNA, 16 nt, Mycobacterium avium subsp. paratuberculosis
cgggccacgcagucgu

SEQ ID NO: 948452 - RNA, 19 nt, Mycobacterium avium subsp. paratuberculosis
cgggccacgcagucgucga

SEQ ID NO: 948453 - RNA, 20 nt, Mycobacterium avium subsp. paratuberculosis
cgggccaccacaguggccgc

SEQ ID NO: 948454 - RNA, 22 nt, Mycobacterium avium subsp. paratuberculosis
cgggccaccaccacggccgccg

SEQ ID NO: 948455 - RNA, 13 nt, Mycobacterium avium subsp. paratuberculosis
cgggccaccagcg

SEQ ID NO: 948456 - RNA, 15 nt, Mycobacterium avium subsp. paratuberculosis
cgggccaccagcgca

SEQ ID NO: 948457 - RNA, 18 nt, Mycobacterium avium subsp. paratuberculosis
cgggccaccagcgcaggu

SEQ ID NO: 948458 - RNA, 20 nt, Mycobacterium avium subsp. paratuberculosis
cgggccaccagcgcaggucc

SEQ ID NO: 948459 - RNA, 15 nt, Mycobacterium avium subsp. paratuberculosis
cgggccaccgcggcg

SEQ ID NO: 948460 - RNA, 22 nt, Mycobacterium avium subsp. paratuberculosis
cgggccaccgcggcguugcccg

SEQ ID NO: 948461 - RNA, 15 nt, Mycobacterium avium subsp. paratuberculosis
cgggccaccggcgcc

SEQ ID NO: 948462 - RNA, 16 nt, Mycobacterium avium subsp. paratuberculosis
cgggccaccggcgcca

SEQ ID NO: 948463 - RNA, 22 nt, Mycobacterium avium subsp. paratuberculosis
cgggcccgcucaccugcggccc

SEQ ID NO: 948464 - RNA, 23 nt, Mycobacterium avium subsp. paratuberculosis
cgggcccgcucaccugcggcccg

SEQ ID NO: 948465 - RNA, 14 nt, Mycobacterium avium subsp. paratuberculosis
cgggcccgucgccg

SEQ ID NO: 948466 - RNA, 18 nt, Mycobacterium avium subsp. paratuberculosis
cgggcccgucgccggcgc

SEQ ID NO: 948467 - RNA, 21 nt, Mycobacterium avium subsp. paratuberculosis
cgggccgaucagugccgcgcc

SEQ ID NO: 948468 - RNA, 14 nt, Mycobacterium avium subsp. paratuberculosis
cgggcccggccgcc

SEQ ID NO: 948469 - RNA, 15 nt, Mycobacterium avium subsp. paratuberculosis
cgggcccggccgcca

SEQ ID NO: 948470 - RNA, 18 nt, Mycobacterium avium subsp. paratuberculosis
cgggcccgcugcagcgcc

SEQ ID NO: 948471 - RNA, 15 nt, Mycobacterium avium subsp. paratuberculosis
cgggcccggcgaugc

SEQ ID NO: 948472 - RNA, 23 nt, Mycobacterium avium subsp. paratuberculosis
cgggcccggcgaugcgcacgucg

SEQ ID NO: 948473 - RNA, 13 nt, Mycobacterium avium subsp. paratuberculosis
cgggcccgggcca

SEQ ID NO: 948474 - RNA, 13 nt, Mycobacterium avium subsp. paratuberculosis
cgggcccgggcgc

SEQ ID NO: 948475 - RNA, 13 nt, Mycobacterium avium subsp. paratuberculosis
cgggcccgggcug

SEQ ID NO: 948476 - RNA, 13 nt, Mycobacterium avium subsp. paratuberculosis
cgggcccggggug

SEQ ID NO: 948477 - RNA, 16 nt, Mycobacterium avium subsp. paratuberculosis
cgggcccggucccgcg

SEQ ID NO: 948478 - RNA, 19 nt, Mycobacterium avium subsp. paratuberculosis
cgggcccggucccgcguca

SEQ ID NO: 948479 - RNA, 17 nt, Mycobacterium avium subsp. paratuberculosis
cgggcccguagcucgcg

SEQ ID NO: 948480 - RNA, 21 nt, Mycobacterium avium subsp. paratuberculosis
cgggcccguagcucgcgccga

SEQ ID NO: 948481 - RNA, 22 nt, Mycobacterium avium subsp. paratuberculosis
cgggcccguagcucgcgccgac

SEQ ID NO: 948482 - RNA, 22 nt, Mycobacterium avium subsp. paratuberculosis
cgggcccguagguugccccaca

SEQ ID NO: 948483 - RNA, 13 nt, Mycobacterium avium subsp. paratuberculosis
cgggcccgcgccg

SEQ ID NO: 948484 - RNA, 14 nt, Mycobacterium avium subsp. paratuberculosis
cgggcccgcgccgc

SEQ ID NO: 948485 - RNA, 21 nt, Mycobacterium avium subsp. paratuberculosis
cgggcccgcgccgcgucgucg

SEQ ID NO: 948486 - RNA, 16 nt, Mycobacterium avium subsp. paratuberculosis
cgggcccgcgccuucu

SEQ ID NO: 948487 - RNA, 13 nt, Mycobacterium avium subsp. paratuberculosis
cgggcccgcgcgg

SEQ ID NO: 948488 - RNA, 15 nt, Mycobacterium avium subsp. paratuberculosis
cgggcccgcgcggcg

SEQ ID NO: 948489 - RNA, 13 nt, Mycobacterium avium subsp. paratuberculosis
cgggcccgccgua

SEQ ID NO: 948490 - RNA, 13 nt, Mycobacterium avium subsp. paratuberculosis
cgggcccgcggga

SEQ ID NO: 948491 - RNA, 20 nt, Mycobacterium avium subsp. paratuberculosis
cgggcccgcguaaccggcgg

SEQ ID NO: 948492 - RNA, 23 nt, Mycobacterium avium subsp. paratuberculosis
cgggcccgcguaaccggcggcgg

SEQ ID NO: 948493 - RNA, 22 nt, Mycobacterium avium subsp. paratuberculosis
cgggcccgcccgcagcggcggu

SEQ ID NO: 948494 - RNA, 15 nt, Mycobacterium avium subsp. paratuberculosis
cgggccagcaacagc

SEQ ID NO: 948495 - RNA, 21 nt, Mycobacterium avium subsp. paratuberculosis
cgggccagcaacagcagcggc

SEQ ID NO: 948496 - RNA, 22 nt, Mycobacterium avium subsp. paratuberculosis
cgggccagcaacagcagcggca

SEQ ID NO: 948497 - RNA, 13 nt, Mycobacterium avium subsp. paratuberculosis
cgggccagcacga

SEQ ID NO: 948498 - RNA, 14 nt, Mycobacterium avium subsp. paratuberculosis
cgggccagcacgac

SEQ ID NO: 948499 - RNA, 16 nt, Mycobacterium avium subsp. paratuberculosis
cgggccagcacgaccc

SEQ ID NO: 948500 - RNA, 22 nt, Mycobacterium avium subsp. paratuberculosis
cgggccagcagcagcaggucgu

SEQ ID NO: 948501 - RNA, 14 nt, Mycobacterium avium subsp. paratuberculosis
cgggccagcagccg

SEQ ID NO: 948502 - RNA, 23 nt, Mycobacterium avium subsp. paratuberculosis
cgggccagcagccgcgcgagcau

SEQ ID NO: 948503 - RNA, 16 nt, Mycobacterium avium subsp. paratuberculosis
cgggccagcagccggg

SEQ ID NO: 948504 - RNA, 18 nt, Mycobacterium avium subsp. paratuberculosis
cgggccagcagccggguc

SEQ ID NO: 948505 - RNA, 13 nt, Mycobacterium avium subsp. paratuberculosis
cgggccagcagcu

SEQ ID NO: 948506 - RNA, 15 nt, Mycobacterium avium subsp. paratuberculosis
cgggaucggaccgca

SEQ ID NO: 948507 - RNA, 16 nt, Mycobacterium avium subsp. paratuberculosis
cgggaucggaccgcac

SEQ ID NO: 948508 - RNA, 13 nt, Mycobacterium avium subsp. paratuberculosis
cgggaucggcagc

SEQ ID NO: 948509 - RNA, 17 nt, Mycobacterium avium subsp. paratuberculosis
cgggaucggcagcgcgc

SEQ ID NO: 948510 - RNA, 19 nt, Mycobacterium avium subsp. paratuberculosis
cgggaucggcagcgcgccc

SEQ ID NO: 948511 - RNA, 22 nt, Mycobacterium avium subsp. paratuberculosis
cgggaucggcagcgcgcccucg

SEQ ID NO: 948512 - RNA, 13 nt, Mycobacterium avium subsp. paratuberculosis
cgggaucggccgg

SEQ ID NO: 948513 - RNA, 16 nt, Mycobacterium avium subsp. paratuberculosis
cgggaucggccggcga

SEQ ID NO: 948514 - RNA, 15 nt, Mycobacterium avium subsp. paratuberculosis
cgggaucggcgccca

SEQ ID NO: 948515 - RNA, 21 nt, Mycobacterium avium subsp. paratuberculosis
cgggaucggcgcccaccgcgg

SEQ ID NO: 948516 - RNA, 23 nt, Mycobacterium avium subsp. paratuberculosis
cgggaucggcgcccaccgcggcg

SEQ ID NO: 948517 - RNA, 17 nt, Mycobacterium avium subsp. paratuberculosis
cgggaucggcgcgucgg

SEQ ID NO: 948518 - RNA, 19 nt, Mycobacterium avium subsp. paratuberculosis
cgggaucggcgcgucggcg

SEQ ID NO: 948519 - RNA, 14 nt, Mycobacterium avium subsp. paratuberculosis
cgggaucggcggcg

SEQ ID NO: 948520 - RNA, 17 nt, Mycobacterium avium subsp. paratuberculosis
cgggaucgaucccgucg

SEQ ID NO: 948521 - RNA, 21 nt, Mycobacterium avium subsp. paratuberculosis
cgggaucgaucccgucggcca

SEQ ID NO: 948522 - RNA, 13 nt, Mycobacterium avium subsp. paratuberculosis
cgggaucgccgaa

SEQ ID NO: 948523 - RNA, 14 nt, Mycobacterium avium subsp. paratuberculosis
cgggaucgccgaag

SEQ ID NO: 948524 - RNA, 14 nt, Mycobacterium avium subsp. paratuberculosis
cgggaucgcggcgg

SEQ ID NO: 948525 - RNA, 16 nt, Mycobacterium avium subsp. paratuberculosis
cgggaucgcggcgguc

SEQ ID NO: 948526 - RNA, 17 nt, Mycobacterium avium subsp. paratuberculosis
cgggaucgcggcgguca

SEQ ID NO: 948527 - RNA, 19 nt, Mycobacterium avium subsp. paratuberculosis
cgggaucguguggccgccc

SEQ ID NO: 948528 - RNA, 22 nt, Mycobacterium avium subsp. paratuberculosis
cgggaucguguggccgcccucg

SEQ ID NO: 948529 - RNA, 17 nt, Mycobacterium avium subsp. paratuberculosis
cgggaucggggugccgc

SEQ ID NO: 948530 - RNA, 19 nt, Mycobacterium avium subsp. paratuberculosis
cgggaucggggugccgccg

SEQ ID NO: 948531 - RNA, 15 nt, Mycobacterium avium subsp. paratuberculosis
cgggaucggugccga

SEQ ID NO: 948532 - RNA, 13 nt, Mycobacterium avium subsp. paratuberculosis
cgggaucgucgcc

SEQ ID NO: 948533 - RNA, 16 nt, Mycobacterium avium subsp. paratuberculosis
cgggaugacaccgcgg

SEQ ID NO: 948534 - RNA, 19 nt, Mycobacterium avium subsp. paratuberculosis
cgggaugacaccgcggacc

SEQ ID NO: 948535 - RNA, 15 nt, Mycobacterium avium subsp. paratuberculosis
cgggaugaucggcgc

SEQ ID NO: 948536 - RNA, 14 nt, Mycobacterium avium subsp. paratuberculosis
cgggaugccagucc

SEQ ID NO: 948537 - RNA, 22 nt, Mycobacterium avium subsp. paratuberculosis
cgggaugaacucgugcggcgcc

SEQ ID NO: 948538 - RNA, 23 nt, Mycobacterium avium subsp. paratuberculosis
cgggaugaacucgugcggcgccg

SEQ ID NO: 948539 - RNA, 17 nt, Mycobacterium avium subsp. paratuberculosis
cgggcacagccagcgcc

SEQ ID NO: 948540 - RNA, 20 nt, Mycobacterium avium subsp. paratuberculosis
cgggcacagccagcgcccgg

SEQ ID NO: 948541 - RNA, 21 nt, Mycobacterium avium subsp. paratuberculosis
cgggcacagccagcgcccggc

SEQ ID NO: 948542 - RNA, 22 nt, Mycobacterium avium subsp. paratuberculosis
cgggcacagccagcgcccggcg

SEQ ID NO: 948543 - RNA, 17 nt, Mycobacterium avium subsp. paratuberculosis
cgggcaacgcgccggcg

SEQ ID NO: 948544 - RNA, 22 nt, Mycobacterium avium subsp. paratuberculosis
cgggcaacgcgccggcggucga

SEQ ID NO: 948545 - RNA, 12 nt, Mycobacterium avium subsp. paratuberculosis
cgggcacacgcg

SEQ ID NO: 948546 - RNA, 15 nt, Mycobacterium avium subsp. paratuberculosis
cgggcaacagcgcgc

SEQ ID NO: 948547 - RNA, 22 nt, Mycobacterium avium subsp. paratuberculosis
cgggcaacagcgcgccggccgg

SEQ ID NO: 948548 - RNA, 17 nt, Mycobacterium avium subsp. paratuberculosis
cgggcaaccacagcggc

SEQ ID NO: 948549 - RNA, 20 nt, Mycobacterium avium subsp. paratuberculosis
cgggauuuggcuagcgggcg

SEQ ID NO: 948550 - RNA, 16 nt, Mycobacterium avium subsp. paratuberculosis
cgggaugccgagcagc

SEQ ID NO: 948551 - RNA, 16 nt, Mycobacterium avium subsp. paratuberculosis
cgggaugccgccgguc

SEQ ID NO: 948552 - RNA, 20 nt, Mycobacterium avium subsp. paratuberculosis
cgggaugccgccggucacgg

SEQ ID NO: 948553 - RNA, 21 nt, Mycobacterium avium subsp. paratuberculosis
cgggaugccgccggucacggc

SEQ ID NO: 948554 - RNA, 22 nt, Mycobacterium avium subsp. paratuberculosis
cgggaugccgccggucacggcg

SEQ ID NO: 948555 - RNA, 23 nt, Mycobacterium avium subsp. paratuberculosis
cgggaugccgccggucacggcgu

SEQ ID NO: 948556 - RNA, 15 nt, Mycobacterium avium subsp. paratuberculosis
cgggauccggcgcgc

SEQ ID NO: 948557 - RNA, 17 nt, Mycobacterium avium subsp. paratuberculosis
cgggauccggcgcgccg

SEQ ID NO: 948558 - RNA, 22 nt, Mycobacterium avium subsp. paratuberculosis
cgggauccucgccgcgggccag

SEQ ID NO: 948559 - RNA, 16 nt, Mycobacterium avium subsp. paratuberculosis
cgggaucccgcagccg

SEQ ID NO: 948560 - RNA, 18 nt, Mycobacterium avium subsp. paratuberculosis
cgggaucccgcagccgcg

SEQ ID NO: 948561 - RNA, 21 nt, Mycobacterium avium subsp. paratuberculosis
cgggaucccgcagccgcgacg

SEQ ID NO: 948562 - RNA, 15 nt, Mycobacterium avium subsp. paratuberculosis
cgggauccgaggcgu

SEQ ID NO: 948563 - RNA, 18 nt, Mycobacterium avium subsp. paratuberculosis
cgggagucgggcccgccc

SEQ ID NO: 948564 - RNA, 14 nt, Mycobacterium avium subsp. paratuberculosis
cgggagugcggccc

SEQ ID NO: 948565 - RNA, 18 nt, Mycobacterium avium subsp. paratuberculosis
cgggagugcggcccaccc

SEQ ID NO: 948566 - RNA, 21 nt, Mycobacterium avium subsp. paratuberculosis
cgggagugcuggacggcccga

SEQ ID NO: 948567 - RNA, 22 nt, Mycobacterium avium subsp. paratuberculosis
cgggagugcuggacggcccgac

SEQ ID NO: 948568 - RNA, 13 nt, Mycobacterium avium subsp. paratuberculosis
cgggaguggccgg

SEQ ID NO: 948569 - RNA, 19 nt, Mycobacterium avium subsp. paratuberculosis
cgggaguggccggcgucca

SEQ ID NO: 948570 - RNA, 13 nt, Mycobacterium avium subsp. paratuberculosis
cgggagcgcuggu

SEQ ID NO: 948571 - RNA, 21 nt, Mycobacterium avium subsp. paratuberculosis
cgggagcgcuggucggcgaac

SEQ ID NO: 948572 - RNA, 17 nt, Mycobacterium avium subsp. paratuberculosis
cgggaccgucgcgcagc

SEQ ID NO: 948573 - RNA, 21 nt, Mycobacterium avium subsp. paratuberculosis
cgggaccgucgcgcagcccga

SEQ ID NO: 948574 - RNA, 18 nt, Mycobacterium avium subsp. paratuberculosis
cgggaccgggcccggcgc

SEQ ID NO: 948575 - RNA, 15 nt, Mycobacterium avium subsp. paratuberculosis
cgggaccgugcgacu

SEQ ID NO: 948576 - RNA, 18 nt, Mycobacterium avium subsp. paratuberculosis
cgggagccggcggcggug

SEQ ID NO: 948577 - RNA, 16 nt, Mycobacterium avium subsp. paratuberculosis
cgggaggacagcgcgg

SEQ ID NO: 948578 - RNA, 20 nt, Mycobacterium avium subsp. paratuberculosis
cgggaggacagcgcgguggu

SEQ ID NO: 948579 - RNA, 14 nt, Mycobacterium avium subsp. paratuberculosis
cgggaggcagcgcg

SEQ ID NO: 948580 - RNA, 12 nt, Mycobacterium avium subsp. paratuberculosis
cgggaggccagc

SEQ ID NO: 948581 - RNA, 14 nt, Mycobacterium avium subsp. paratuberculosis
cgggaggccagcac

SEQ ID NO: 948582 - RNA, 16 nt, Mycobacterium avium subsp. paratuberculosis
cgggaggccagcaccu

SEQ ID NO: 948583 - RNA, 17 nt, Mycobacterium avium subsp. paratuberculosis
cgggaggcccaguagcg

SEQ ID NO: 948584 - RNA, 15 nt, Mycobacterium avium subsp. paratuberculosis
cggcuucucggcgug

SEQ ID NO: 948585 - RNA, 16 nt, Mycobacterium avium subsp. paratuberculosis
cggcuucucggcgugc

SEQ ID NO: 948586 - RNA, 22 nt, Mycobacterium avium subsp. paratuberculosis
cggcuucucggcgugcccgccg

SEQ ID NO: 948587 - RNA, 16 nt, Mycobacterium avium subsp. paratuberculosis
cggcuugacuucgucg

SEQ ID NO: 948588 - RNA, 18 nt, Mycobacterium avium subsp. paratuberculosis
cggcuugagcgccagcgc

SEQ ID NO: 948589 - RNA, 20 nt, Mycobacterium avium subsp. paratuberculosis
cggcuugagcgccagcgcgg

SEQ ID NO: 948590 - RNA, 22 nt, Mycobacterium avium subsp. paratuberculosis
cggcuugccccggucccggggc

SEQ ID NO: 948591 - RNA, 20 nt, Mycobacterium avium subsp. paratuberculosis
cggcuugccgaucgccgcgg

SEQ ID NO: 948592 - RNA, 21 nt, Mycobacterium avium subsp. paratuberculosis
cggcuugccgaucgccgcggc

SEQ ID NO: 948593 - RNA, 16 nt, Mycobacterium avium subsp. paratuberculosis
cgggacaccgcuggcc

SEQ ID NO: 948594 - RNA, 13 nt, Mycobacterium avium subsp. paratuberculosis
cgggacacggcgg

SEQ ID NO: 948595 - RNA, 14 nt, Mycobacterium avium subsp. paratuberculosis
cgggacacggcggc

SEQ ID NO: 948596 - RNA, 18 nt, Mycobacterium avium subsp. paratuberculosis
cgggacacggcggcgcgg

SEQ ID NO: 948597 - RNA, 14 nt, Mycobacterium avium subsp. paratuberculosis
cgggaccggcguca

SEQ ID NO: 948598 - RNA, 13 nt, Mycobacterium avium subsp. paratuberculosis
cgggaccgcgggc

SEQ ID NO: 948599 - RNA, 16 nt, Mycobacterium avium subsp. paratuberculosis
cgggaccgcgggcgca

SEQ ID NO: 948600 - RNA, 14 nt, Mycobacterium avium subsp. paratuberculosis
cgggaccgaggugc

SEQ ID NO: 948601 - RNA, 15 nt, Mycobacterium avium subsp. paratuberculosis
cgggaccgaugccgc

SEQ ID NO: 948602 - RNA, 17 nt, Mycobacterium avium subsp. paratuberculosis
cgggaccgaugccgcug

SEQ ID NO: 948603 - RNA, 15 nt, Mycobacterium avium subsp. paratuberculosis
cgggaccgcacgccg

SEQ ID NO: 948604 - RNA, 16 nt, Mycobacterium avium subsp. paratuberculosis
cgggaccgcacgccgg

SEQ ID NO: 948605 - RNA, 16 nt, Mycobacterium avium subsp. paratuberculosis
cgggaccagcgccucg

SEQ ID NO: 948606 - RNA, 15 nt, Mycobacterium avium subsp. paratuberculosis
cgggaccagcgcggu

SEQ ID NO: 948607 - RNA, 17 nt, Mycobacterium avium subsp. paratuberculosis
cgggaccagcgcggugc

SEQ ID NO: 948608 - RNA, 21 nt, Mycobacterium avium subsp. paratuberculosis
cgggaccagcgcggugccggu

SEQ ID NO: 948609 - RNA, 14 nt, Mycobacterium avium subsp. paratuberculosis
cgggacccgcgacc

SEQ ID NO: 948610 - RNA, 19 nt, Mycobacterium avium subsp. paratuberculosis
cgggacaucgucgcgccca

SEQ ID NO: 948611 - RNA, 22 nt, Mycobacterium avium subsp. paratuberculosis
cgggaccacccgcagcgcggcg

SEQ ID NO: 948612 - RNA, 15 nt, Mycobacterium avium subsp. paratuberculosis
cgggacagcaaucgg

SEQ ID NO: 948613 - RNA, 17 nt, Mycobacterium avium subsp. paratuberculosis
cgggacagcaccaccag

SEQ ID NO: 948614 - RNA, 17 nt, Mycobacterium avium subsp. paratuberculosis
cgggacagccgcgccga

SEQ ID NO: 948615 - RNA, 15 nt, Mycobacterium avium subsp. paratuberculosis
cgggccguucagcgg

SEQ ID NO: 948616 - RNA, 19 nt, Mycobacterium avium subsp. paratuberculosis
cgggccuccuguuggcccu

SEQ ID NO: 948617 - RNA, 14 nt, Mycobacterium avium subsp. paratuberculosis
cgggccucgccgcu

SEQ ID NO: 948618 - RNA, 16 nt, Mycobacterium avium subsp. paratuberculosis
cgggcgaacgucgggu

SEQ ID NO: 948619 - RNA, 18 nt, Mycobacterium avium subsp. paratuberculosis
cgggcgaacgucgggucg

SEQ ID NO: 948620 - RNA, 15 nt, Mycobacterium avium subsp. paratuberculosis
cgggcgaagucgccg

SEQ ID NO: 948621 - RNA, 17 nt, Mycobacterium avium subsp. paratuberculosis
cgggcgaagucgccggc

SEQ ID NO: 948622 - RNA, 18 nt, Mycobacterium avium subsp. paratuberculosis
cgggccuaggaccccggc

SEQ ID NO: 948623 - RNA, 21 nt, Mycobacterium avium subsp. paratuberculosis
cgggccuaggaccccggcugc

SEQ ID NO: 948624 - RNA, 16 nt, Mycobacterium avium subsp. paratuberculosis
cgggccguggcaccgg

SEQ ID NO: 948625 - RNA, 19 nt, Mycobacterium avium subsp. paratuberculosis
cgggccggcgucgcgguga

SEQ ID NO: 948626 - RNA, 16 nt, Mycobacterium avium subsp. paratuberculosis
cgggccggcgucgucg

SEQ ID NO: 948627 - RNA, 13 nt, Mycobacterium avium subsp. paratuberculosis
cgggccgucaucg

SEQ ID NO: 948628 - RNA, 15 nt, Mycobacterium avium subsp. paratuberculosis
cgggccgucaucgcc

SEQ ID NO: 948629 - RNA, 17 nt, Mycobacterium avium subsp. paratuberculosis
cgggccgucaucgccga

SEQ ID NO: 948630 - RNA, 18 nt, Mycobacterium avium subsp. paratuberculosis
cgggccgucaucgccgac

SEQ ID NO: 948631 - RNA, 20 nt, Mycobacterium avium subsp. paratuberculosis
cgggccgucaucgccgacgg

SEQ ID NO: 948632 - RNA, 22 nt, Mycobacterium avium subsp. paratuberculosis
cgggccgucaucgccgacggug

SEQ ID NO: 948633 - RNA, 16 nt, Mycobacterium avium subsp. paratuberculosis
cgggccguccgccggc

SEQ ID NO: 948634 - RNA, 21 nt, Mycobacterium avium subsp. paratuberculosis
cgggccguccgccggcuggcg

SEQ ID NO: 948635 - RNA, 17 nt, Mycobacterium avium subsp. paratuberculosis
cgggccguccgggugcg

SEQ ID NO: 948636 - RNA, 13 nt, Mycobacterium avium subsp. paratuberculosis
cgggcgcaccacg

SEQ ID NO: 948637 - RNA, 17 nt, Mycobacterium avium subsp. paratuberculosis
cgggcgauuucgucggc

SEQ ID NO: 948638 - RNA, 18 nt, Mycobacterium avium subsp. paratuberculosis
cgggcgauuucgucggcg

SEQ ID NO: 948639 - RNA, 21 nt, Mycobacterium avium subsp. paratuberculosis
cgggcgauucccggaugcugc

SEQ ID NO: 948640 - RNA, 18 nt, Mycobacterium avium subsp. paratuberculosis
cgggcgauucgucgucgu

SEQ ID NO: 948641 - RNA, 18 nt, Mycobacterium avium subsp. paratuberculosis
cgggcgacgucaacuucc

SEQ ID NO: 948642 - RNA, 20 nt, Mycobacterium avium subsp. paratuberculosis
cgggcgaugcggcccggcca

SEQ ID NO: 948643 - RNA, 19 nt, Mycobacterium avium subsp. paratuberculosis
cgggcgauggcgggccgcu

SEQ ID NO: 948644 - RNA, 19 nt, Mycobacterium avium subsp. paratuberculosis
cgggcgauggugccgccgg

SEQ ID NO: 948645 - RNA, 22 nt, Mycobacterium avium subsp. paratuberculosis
cgggcgauggugccgccgguga

SEQ ID NO: 948646 - RNA, 19 nt, Mycobacterium avium subsp. paratuberculosis
cgggcgacuucuucgccgg

SEQ ID NO: 948647 - RNA, 13 nt, Mycobacterium avium subsp. paratuberculosis
cgggcgacgacgc

SEQ ID NO: 948648 - RNA, 20 nt, Mycobacterium avium subsp. paratuberculosis
cgggcgacgacgcggucguc

SEQ ID NO: 948649 - RNA, 15 nt, Mycobacterium avium subsp. paratuberculosis
cgggcgaccugcggg

SEQ ID NO: 948650 - RNA, 21 nt, Mycobacterium avium subsp. paratuberculosis
cgggcgacaccccgcgaguca

SEQ ID NO: 948651 - RNA, 16 nt, Mycobacterium avium subsp. paratuberculosis
cgggcgaccccggcca

SEQ ID NO: 948652 - RNA, 12 nt, Mycobacterium avium subsp. paratuberculosis
cgggcgacccgc

SEQ ID NO: 948653 - RNA, 14 nt, Mycobacterium avium subsp. paratuberculosis
cgggcgacaucucg

SEQ ID NO: 948654 - RNA, 19 nt, Mycobacterium avium subsp. paratuberculosis
cgggcgacaucucggugag

SEQ ID NO: 948655 - RNA, 17 nt, Mycobacterium avium subsp. paratuberculosis
cgggcgacaugcccgcg

SEQ ID NO: 948656 - RNA, 12 nt, Mycobacterium avium subsp. paratuberculosis
cgggccgggcgg

SEQ ID NO: 948657 - RNA, 15 nt, Mycobacterium avium subsp. paratuberculosis
cgggccgggcgggca

SEQ ID NO: 948658 - RNA, 21 nt, Mycobacterium avium subsp. paratuberculosis
cgggccgggcgggcaccccau

SEQ ID NO: 948659 - RNA, 17 nt, Mycobacterium avium subsp. paratuberculosis
cgggccgggggcggcgg

SEQ ID NO: 948660 - RNA, 19 nt, Mycobacterium avium subsp. paratuberculosis
cgggccgggggcggcggcg

SEQ ID NO: 948661 - RNA, 18 nt, Mycobacterium avium subsp. paratuberculosis
cgggccggguccacgccg

SEQ ID NO: 948662 - RNA, 19 nt, Mycobacterium avium subsp. paratuberculosis
cgggccggguccacgccga

SEQ ID NO: 948663 - RNA, 18 nt, Mycobacterium avium subsp. paratuberculosis
cgggccggucagcgcgac

SEQ ID NO: 948664 - RNA, 17 nt, Mycobacterium avium subsp. paratuberculosis
cgggccggucggucagu

SEQ ID NO: 948665 - RNA, 15 nt, Mycobacterium avium subsp. paratuberculosis
cgggccgggcaccgc

SEQ ID NO: 948666 - RNA, 16 nt, Mycobacterium avium subsp. paratuberculosis
cgggccgggcaccgcg

SEQ ID NO: 948667 - RNA, 13 nt, Mycobacterium avium subsp. paratuberculosis
cgggccgggcacg

SEQ ID NO: 948668 - RNA, 19 nt, Mycobacterium avium subsp. paratuberculosis
cgggccgggcacgucgacg

SEQ ID NO: 948669 - RNA, 22 nt, Mycobacterium avium subsp. paratuberculosis
cgggccgggcacgucgacgccc

SEQ ID NO: 948670 - RNA, 12 nt, Mycobacterium avium subsp. paratuberculosis
cgggccggcggg

SEQ ID NO: 948671 - RNA, 16 nt, Mycobacterium avium subsp. paratuberculosis
cgggccggcggugauc

SEQ ID NO: 948672 - RNA, 15 nt, Mycobacterium avium subsp. paratuberculosis
cgggccggcgccggu

SEQ ID NO: 948673 - RNA, 16 nt, Mycobacterium avium subsp. paratuberculosis
cgggccggcgccggug

SEQ ID NO: 948674 - RNA, 23 nt, Mycobacterium avium subsp. paratuberculosis
cgggccggcgccggugccgcagc

SEQ ID NO: 948675 - RNA, 14 nt, Mycobacterium avium subsp. paratuberculosis
cgggccggcgccga

SEQ ID NO: 948676 - RNA, 15 nt, Mycobacterium avium subsp. paratuberculosis
cgggccggcgccgac

SEQ ID NO: 948677 - RNA, 16 nt, Mycobacterium avium subsp. paratuberculosis
cgggccggcgccgacg

SEQ ID NO: 948678 - RNA, 14 nt, Mycobacterium avium subsp. paratuberculosis
cgggccggcgccgg

SEQ ID NO: 948679 - RNA, 14 nt, Mycobacterium avium subsp. paratuberculosis
cgggccggcacccg

SEQ ID NO: 948680 - RNA, 12 nt, Mycobacterium avium subsp. paratuberculosis
cgggccggcagc

SEQ ID NO: 948681 - RNA, 16 nt, Mycobacterium avium subsp. paratuberculosis
cgggccggcagccggc

SEQ ID NO: 948682 - RNA, 17 nt, Mycobacterium avium subsp. paratuberculosis
cgggccggcagccggcc

SEQ ID NO: 948683 - RNA, 12 nt, Mycobacterium avium subsp. paratuberculosis
cgggccggccag

SEQ ID NO: 948684 - RNA, 14 nt, Mycobacterium avium subsp. paratuberculosis
cgggccgcuggccg

SEQ ID NO: 948685 - RNA, 13 nt, Mycobacterium avium subsp. paratuberculosis
cgggccgcuggug

SEQ ID NO: 948686 - RNA, 14 nt, Mycobacterium avium subsp. paratuberculosis
cgggccgcugguga

SEQ ID NO: 948687 - RNA, 13 nt, Mycobacterium avium subsp. paratuberculosis
cgggccggacacg

SEQ ID NO: 948688 - RNA, 20 nt, Mycobacterium avium subsp. paratuberculosis
cgggccggacacggcugcac

SEQ ID NO: 948689 - RNA, 18 nt, Mycobacterium avium subsp. paratuberculosis
cgggccggacagcggccc

SEQ ID NO: 948690 - RNA, 17 nt, Mycobacterium avium subsp. paratuberculosis
cgggccgcggccagcuc

SEQ ID NO: 948691 - RNA, 18 nt, Mycobacterium avium subsp. paratuberculosis
cgggccgcggccagcucc

SEQ ID NO: 948692 - RNA, 13 nt, Mycobacterium avium subsp. paratuberculosis
cgggccgcuggcc

SEQ ID NO: 948693 - RNA, 17 nt, Mycobacterium avium subsp. paratuberculosis
cgggccggaucagcagu

SEQ ID NO: 948694 - RNA, 17 nt, Mycobacterium avium subsp. paratuberculosis
cgggccgcagcacggca

SEQ ID NO: 948695 - RNA, 16 nt, Mycobacterium avium subsp. paratuberculosis
cgggccgcgccgaggc

SEQ ID NO: 948696 - RNA, 13 nt, Mycobacterium avium subsp. paratuberculosis
cgggccgcgccca

SEQ ID NO: 948697 - RNA, 14 nt, Mycobacterium avium subsp. paratuberculosis
cgggccgcggcggu

SEQ ID NO: 948698 - RNA, 12 nt, Mycobacterium avium subsp. paratuberculosis
cgggccgcgggc

SEQ ID NO: 948699 - RNA, 18 nt, Mycobacterium avium subsp. paratuberculosis
cgggccgcgggcccaccg

SEQ ID NO: 948700 - RNA, 21 nt, Mycobacterium avium subsp. paratuberculosis
cgggccgcgggcccaccgcca

SEQ ID NO: 948701 - RNA, 15 nt, Mycobacterium avium subsp. paratuberculosis
cgggccgcgucggcc

SEQ ID NO: 948702 - RNA, 14 nt, Mycobacterium avium subsp. paratuberculosis
cgggccgccgaugc

SEQ ID NO: 948703 - RNA, 15 nt, Mycobacterium avium subsp. paratuberculosis
cgggccgccgaugcg

SEQ ID NO: 948704 - RNA, 16 nt, Mycobacterium avium subsp. paratuberculosis
cgggccgccgaugcgc

SEQ ID NO: 948705 - RNA, 22 nt, Mycobacterium avium subsp. paratuberculosis
cgggccgccgaugcgcccgcug

SEQ ID NO: 948706 - RNA, 15 nt, Mycobacterium avium subsp. paratuberculosis
cgggccgccgcgcgg

SEQ ID NO: 948707 - RNA, 15 nt, Mycobacterium avium subsp. paratuberculosis
cgggccgccgcggac

SEQ ID NO: 948708 - RNA, 13 nt, Mycobacterium avium subsp. paratuberculosis
cgggccgccggcc

SEQ ID NO: 948709 - RNA, 15 nt, Mycobacterium avium subsp. paratuberculosis
cgggccgccggccgc

SEQ ID NO: 948710 - RNA, 17 nt, Mycobacterium avium subsp. paratuberculosis
cgggccgccggccgcgg

SEQ ID NO: 948711 - RNA, 19 nt, Mycobacterium avium subsp. paratuberculosis
cgggccgccggccgcggcg

SEQ ID NO: 948712 - RNA, 19 nt, Mycobacterium avium subsp. paratuberculosis
cgggccgcccgcgcguggu

SEQ ID NO: 948713 - RNA, 13 nt, Mycobacterium avium subsp. paratuberculosis
cgggccgcccggc

SEQ ID NO: 948714 - RNA, 19 nt, Mycobacterium avium subsp. paratuberculosis
cgggccgcccggcgcgccg

SEQ ID NO: 948715 - RNA, 17 nt, Mycobacterium avium subsp. paratuberculosis
cgggccgccucacgcag

SEQ ID NO: 948716 - RNA, 22 nt, Mycobacterium avium subsp. paratuberculosis
cgggccgccucgaagucgccgg

SEQ ID NO: 948717 - RNA, 23 nt, Mycobacterium avium subsp. paratuberculosis
cgggccgccucgaagucgccggc

SEQ ID NO: 948718 - RNA, 16 nt, Mycobacterium avium subsp. paratuberculosis
cgggccgccuucuccg

SEQ ID NO: 948719 - RNA, 13 nt, Mycobacterium avium subsp. paratuberculosis
cgggccgcagccg

SEQ ID NO: 948720 - RNA, 15 nt, Mycobacterium avium subsp. paratuberculosis
cgggccgaugaacau

SEQ ID NO: 948721 - RNA, 17 nt, Mycobacterium avium subsp. paratuberculosis
cgggccgcagcgcgcgg

SEQ ID NO: 948722 - RNA, 20 nt, Mycobacterium avium subsp. paratuberculosis
cgggccgcagcucgcccagc

SEQ ID NO: 948723 - RNA, 19 nt, Mycobacterium avium subsp. paratuberculosis
cgggccgcaggguggccag

SEQ ID NO: 948724 - RNA, 15 nt, Mycobacterium avium subsp. paratuberculosis
cgggccgcauccagc

SEQ ID NO: 948725 - RNA, 16 nt, Mycobacterium avium subsp. paratuberculosis
cgggccgcauccagcg

SEQ ID NO: 948726 - RNA, 22 nt, Mycobacterium avium subsp. paratuberculosis
cgggccgcauccagcgccgcca

SEQ ID NO: 948727 - RNA, 17 nt, Mycobacterium avium subsp. paratuberculosis
cgggccgcauccgcgag

SEQ ID NO: 948728 - RNA, 12 nt, Mycobacterium avium subsp. paratuberculosis
cgggccgccacg

SEQ ID NO: 948729 - RNA, 17 nt, Mycobacterium avium subsp. paratuberculosis
cgggccgccagguuggc

SEQ ID NO: 948730 - RNA, 18 nt, Mycobacterium avium subsp. paratuberculosis
cgggccgccaucaccgcg

SEQ ID NO: 948731 - RNA, 16 nt, Mycobacterium avium subsp. paratuberculosis
cgggccgccgacgucg

SEQ ID NO: 948732 - RNA, 21 nt, Mycobacterium avium subsp. paratuberculosis
cgggccgccgacgucgugggc

SEQ ID NO: 948733 - RNA, 22 nt, Mycobacterium avium subsp. paratuberculosis
cgggccgccgacgucgugggcg

SEQ ID NO: 948734 - RNA, 19 nt, Mycobacterium avium subsp. paratuberculosis
cgggcguguagccugcggc

SEQ ID NO: 948735 - RNA, 21 nt, Mycobacterium avium subsp. paratuberculosis
cgggcguguaguccaggucga

SEQ ID NO: 948736 - RNA, 22 nt, Mycobacterium avium subsp. paratuberculosis
cgggcguucaucaccuggucgg

SEQ ID NO: 948737 - RNA, 13 nt, Mycobacterium avium subsp. paratuberculosis
cgggcguucccgc

SEQ ID NO: 948738 - RNA, 17 nt, Mycobacterium avium subsp. paratuberculosis
cgggcguucccgcgcgc

SEQ ID NO: 948739 - RNA, 16 nt, Mycobacterium avium subsp. paratuberculosis
cgggcguugcccgccg

SEQ ID NO: 948740 - RNA, 19 nt, Mycobacterium avium subsp. paratuberculosis
cgggcguugcccgccgcgg

SEQ ID NO: 948741 - RNA, 15 nt, Mycobacterium avium subsp. paratuberculosis
cgggcguugcgccgc

SEQ ID NO: 948742 - RNA, 21 nt, Mycobacterium avium subsp. paratuberculosis
cgggcguugcgccgcgagcgc

SEQ ID NO: 948743 - RNA, 22 nt, Mycobacterium avium subsp. paratuberculosis
cgggcguugcgccgcgagcgca

SEQ ID NO: 948744 - RNA, 15 nt, Mycobacterium avium subsp. paratuberculosis
cgggcguggcggucg

SEQ ID NO: 948745 - RNA, 22 nt, Mycobacterium avium subsp. paratuberculosis
cgggcguggcuugaucgcaccc

SEQ ID NO: 948746 - RNA, 23 nt, Mycobacterium avium subsp. paratuberculosis
cgggcgucacguccaucauggcg

SEQ ID NO: 948747 - RNA, 20 nt, Mycobacterium avium subsp. paratuberculosis
cgggcgucacucuggcguga

SEQ ID NO: 948748 - RNA, 22 nt, Mycobacterium avium subsp. paratuberculosis
cgggcgucacucuggcgugacg

SEQ ID NO: 948749 - RNA, 17 nt, Mycobacterium avium subsp. paratuberculosis
cgggcgucacgccagcg

SEQ ID NO: 948750 - RNA, 22 nt, Mycobacterium avium subsp. paratuberculosis
cgggcgucacgccagcgugacg

SEQ ID NO: 948751 - RNA, 22 nt, Mycobacterium avium subsp. paratuberculosis
cgggcuaagucguugcccgcca

SEQ ID NO: 948752 - RNA, 17 nt, Mycobacterium avium subsp. paratuberculosis
cgggcucgccggcccga

SEQ ID NO: 948753 - RNA, 18 nt, Mycobacterium avium subsp. paratuberculosis
cgggcucgccggcccgac

SEQ ID NO: 948754 - RNA, 14 nt, Mycobacterium avium subsp. paratuberculosis
cgggcucgcgcacc

SEQ ID NO: 948755 - RNA, 21 nt, Mycobacterium avium subsp. paratuberculosis
cgggcguugcgcucuguuggc

SEQ ID NO: 948756 - RNA, 14 nt, Mycobacterium avium subsp. paratuberculosis
cgggcgggccgaac

SEQ ID NO: 948757 - RNA, 13 nt, Mycobacterium avium subsp. paratuberculosis
cgggcgggccgca

SEQ ID NO: 948758 - RNA, 15 nt, Mycobacterium avium subsp. paratuberculosis
cgggcgggccgcagc

SEQ ID NO: 948759 - RNA, 19 nt, Mycobacterium avium subsp. paratuberculosis
cgggcggggcccgggccgg

SEQ ID NO: 948760 - RNA, 20 nt, Mycobacterium avium subsp. paratuberculosis
cgggcggggcccgggccgga

SEQ ID NO: 948761 - RNA, 15 nt, Mycobacterium avium subsp. paratuberculosis
cgggcggggcgccga

SEQ ID NO: 948762 - RNA, 22 nt, Mycobacterium avium subsp. paratuberculosis
cgggcgggggaucggcgggacc

SEQ ID NO: 948763 - RNA, 21 nt, Mycobacterium avium subsp. paratuberculosis
cgggcggggggcgagccggcc

SEQ ID NO: 948764 - RNA, 20 nt, Mycobacterium avium subsp. paratuberculosis
cgggcgggguggccaccaca

SEQ ID NO: 948765 - RNA, 16 nt, Mycobacterium avium subsp. paratuberculosis
cgggcgggguggugga

SEQ ID NO: 948766 - RNA, 19 nt, Mycobacterium avium subsp. paratuberculosis
cgggcggggugguggacgu

SEQ ID NO: 948767 - RNA, 20 nt, Mycobacterium avium subsp. paratuberculosis
cgggcggggugugcggcacg

SEQ ID NO: 948768 - RNA, 22 nt, Mycobacterium avium subsp. paratuberculosis
cgggcggggugugcggcacggc

SEQ ID NO: 948769 - RNA, 17 nt, Mycobacterium avium subsp. paratuberculosis
cgggcgguggcgccggg

SEQ ID NO: 948770 - RNA, 15 nt, Mycobacterium avium subsp. paratuberculosis
cgggcgguuuccacg

SEQ ID NO: 948771 - RNA, 21 nt, Mycobacterium avium subsp. paratuberculosis
cgggcgguuuccacgaugacg

SEQ ID NO: 948772 - RNA, 16 nt, Mycobacterium avium subsp. paratuberculosis
cgggcguagucgaugg

SEQ ID NO: 948773 - RNA, 20 nt, Mycobacterium avium subsp. paratuberculosis
cgggcggguggaucuugacg

SEQ ID NO: 948774 - RNA, 18 nt, Mycobacterium avium subsp. paratuberculosis
cgggcggugaccacgccg

SEQ ID NO: 948775 - RNA, 13 nt, Mycobacterium avium subsp. paratuberculosis
cgggcggugaugg

SEQ ID NO: 948776 - RNA, 20 nt, Mycobacterium avium subsp. paratuberculosis
cgggcggugauggucaccgu

SEQ ID NO: 948777 - RNA, 16 nt, Mycobacterium avium subsp. paratuberculosis
cgggcgguccaccgac

SEQ ID NO: 948778 - RNA, 22 nt, Mycobacterium avium subsp. paratuberculosis
cgggcgguccaguacaccgcga

SEQ ID NO: 948779 - RNA, 14 nt, Mycobacterium avium subsp. paratuberculosis
cgggcggucgcgca

SEQ ID NO: 948780 - RNA, 15 nt, Mycobacterium avium subsp. paratuberculosis
cgggcggucgcgcag

SEQ ID NO: 948781 - RNA, 16 nt, Mycobacterium avium subsp. paratuberculosis
cgggcggucgcgcagc

SEQ ID NO: 948782 - RNA, 18 nt, Mycobacterium avium subsp. paratuberculosis
cgggcggucgcgcagccg

SEQ ID NO: 948783 - RNA, 22 nt, Mycobacterium avium subsp. paratuberculosis
cgggcggucgcgcagccgccgg

SEQ ID NO: 948784 - RNA, 18 nt, Mycobacterium avium subsp. paratuberculosis
cgggcggucgcgucgucg

SEQ ID NO: 948785 - RNA, 14 nt, Mycobacterium avium subsp. paratuberculosis
cgggcggucggacg

SEQ ID NO: 948786 - RNA, 14 nt, Mycobacterium avium subsp. paratuberculosis
cgggcggcagcagc

SEQ ID NO: 948787 - RNA, 15 nt, Mycobacterium avium subsp. paratuberculosis
cgggcggcagcagcu

SEQ ID NO: 948788 - RNA, 13 nt, Mycobacterium avium subsp. paratuberculosis
cgggcggcagcca

SEQ ID NO: 948789 - RNA, 21 nt, Mycobacterium avium subsp. paratuberculosis
cgggcggcagggccagcacca

SEQ ID NO: 948790 - RNA, 14 nt, Mycobacterium avium subsp. paratuberculosis
cgggcggcaggugg

SEQ ID NO: 948791 - RNA, 17 nt, Mycobacterium avium subsp. paratuberculosis
cgggcggaugucggugu

SEQ ID NO: 948792 - RNA, 20 nt, Mycobacterium avium subsp. paratuberculosis
cgggcggaugucggugugga

SEQ ID NO: 948793 - RNA, 24 nt, Mycobacterium avium subsp. paratuberculosis
cgggcggaugucgguguggaccgc

SEQ ID NO: 948794 - RNA, 16 nt, Mycobacterium avium subsp. paratuberculosis
cgggcggcaccgcugc

SEQ ID NO: 948795 - RNA, 18 nt, Mycobacterium avium subsp. paratuberculosis
cgggcggcaccgcugccg

SEQ ID NO: 948796 - RNA, 13 nt, Mycobacterium avium subsp. paratuberculosis
cgggcggcgucgu

SEQ ID NO: 948797 - RNA, 14 nt, Mycobacterium avium subsp. paratuberculosis
cgggcggcaucgcg

SEQ ID NO: 948798 - RNA, 18 nt, Mycobacterium avium subsp. paratuberculosis
cgggcggcaucgcgccgc

SEQ ID NO: 948799 - RNA, 19 nt, Mycobacterium avium subsp. paratuberculosis
cgggcggcaucgcgccgca

SEQ ID NO: 948800 - RNA, 19 nt, Mycobacterium avium subsp. paratuberculosis
cgggcggcgucggcgacgg

SEQ ID NO: 948801 - RNA, 12 nt, Mycobacterium avium subsp. paratuberculosis
cgggcgccggcc

SEQ ID NO: 948802 - RNA, 15 nt, Mycobacterium avium subsp. paratuberculosis
cgggcgccggccggc

SEQ ID NO: 948803 - RNA, 16 nt, Mycobacterium avium subsp. paratuberculosis
cgggcgccggccggcg

SEQ ID NO: 948804 - RNA, 17 nt, Mycobacterium avium subsp. paratuberculosis
cgggcgccggccggcgc

SEQ ID NO: 948805 - RNA, 16 nt, Mycobacterium avium subsp. paratuberculosis
cgggcgccggcgauga

SEQ ID NO: 948806 - RNA, 12 nt, Mycobacterium avium subsp. paratuberculosis
cgggcgcccagc

SEQ ID NO: 948807 - RNA, 20 nt, Mycobacterium avium subsp. paratuberculosis
cgggcgccucgaacaucggc

SEQ ID NO: 948808 - RNA, 17 nt, Mycobacterium avium subsp. paratuberculosis
cgggcggacggcaccga

SEQ ID NO: 948809 - RNA, 18 nt, Mycobacterium avium subsp. paratuberculosis
cgggcggacggcaccgac

SEQ ID NO: 948810 - RNA, 15 nt, Mycobacterium avium subsp. paratuberculosis
cgggcggaagucggu

SEQ ID NO: 948811 - RNA, 21 nt, Mycobacterium avium subsp. paratuberculosis
cgggcgccggcugcccgcgac

SEQ ID NO: 948812 - RNA, 14 nt, Mycobacterium avium subsp. paratuberculosis
cgggcgccggucgg

SEQ ID NO: 948813 - RNA, 16 nt, Mycobacterium avium subsp. paratuberculosis
cgggcgccggucggcg

SEQ ID NO: 948814 - RNA, 17 nt, Mycobacterium avium subsp. paratuberculosis
cgggcgccguaggccgc

SEQ ID NO: 948815 - RNA, 22 nt, Mycobacterium avium subsp. paratuberculosis
cgggcgcccuccacgucgucgg

SEQ ID NO: 948816 - RNA, 23 nt, Mycobacterium avium subsp. paratuberculosis
cgggcgccgaacgucgagcgcgg

SEQ ID NO: 948817 - RNA, 14 nt, Mycobacterium avium subsp. paratuberculosis
cgggcgccgagaac

SEQ ID NO: 948818 - RNA, 14 nt, Mycobacterium avium subsp. paratuberculosis
cgggcgccgagucc

SEQ ID NO: 948819 - RNA, 16 nt, Mycobacterium avium subsp. paratuberculosis
cgggcgcccgagccgc

SEQ ID NO: 948820 - RNA, 21 nt, Mycobacterium avium subsp. paratuberculosis
cgggcgccauccgcagcccgu

SEQ ID NO: 948821 - RNA, 16 nt, Mycobacterium avium subsp. paratuberculosis
cgggcgccauccgcca

SEQ ID NO: 948822 - RNA, 21 nt, Mycobacterium avium subsp. paratuberculosis
cgggcgccauccgccacccgc

SEQ ID NO: 948823 - RNA, 22 nt, Mycobacterium avium subsp. paratuberculosis
cgggcgcagaaaugggccaugc

SEQ ID NO: 948824 - RNA, 15 nt, Mycobacterium avium subsp. paratuberculosis
cgggcgccacgcugg

SEQ ID NO: 948825 - RNA, 20 nt, Mycobacterium avium subsp. paratuberculosis
cgggcgccacgcuggcguga

SEQ ID NO: 948826 - RNA, 14 nt, Mycobacterium avium subsp. paratuberculosis
cgggcgcagcucgu

SEQ ID NO: 948827 - RNA, 16 nt, Mycobacterium avium subsp. paratuberculosis
cgggcgcagcucgucg

SEQ ID NO: 948828 - RNA, 15 nt, Mycobacterium avium subsp. paratuberculosis
cgggcgcaccgcgcg

SEQ ID NO: 948829 - RNA, 16 nt, Mycobacterium avium subsp. paratuberculosis
cgggcgcaccgcgcgc

SEQ ID NO: 948830 - RNA, 22 nt, Mycobacterium avium subsp. paratuberculosis
cggaaaaagcguugcgccagca

SEQ ID NO: 948831 - RNA, 17 nt, Mycobacterium avium subsp. paratuberculosis
cggaaaaccccaccccg

SEQ ID NO: 948832 - RNA, 20 nt, Mycobacterium avium subsp. paratuberculosis
cggaaacgacgucgccacca

SEQ ID NO: 948833 - RNA, 14 nt, Mycobacterium avium subsp. paratuberculosis
cggaacagccggcu

SEQ ID NO: 948834 - RNA, 16 nt, Mycobacterium avium subsp. paratuberculosis
cggaacagcgucgccg

SEQ ID NO: 948835 - RNA, 19 nt, Mycobacterium avium subsp. paratuberculosis
cggaacagcgucgccgacg

SEQ ID NO: 948836 - RNA, 21 nt, Mycobacterium avium subsp. paratuberculosis
cggaacagcuuggcgcagccg

SEQ ID NO: 948837 - RNA, 16 nt, Mycobacterium avium subsp. paratuberculosis
cggaaaugcccgcgcc

SEQ ID NO: 948838 - RNA, 14 nt, Mycobacterium avium subsp. paratuberculosis
cgcuugucggcgug

SEQ ID NO: 948839 - RNA, 17 nt, Mycobacterium avium subsp. paratuberculosis
cgcuugucggcguggcc

SEQ ID NO: 948840 - RNA, 23 nt, Mycobacterium avium subsp. paratuberculosis
cgcuugugccggaagcggcggua

SEQ ID NO: 948841 - RNA, 14 nt, Mycobacterium avium subsp. paratuberculosis
cgcuugggucgccg

SEQ ID NO: 948842 - RNA, 15 nt, Mycobacterium avium subsp. paratuberculosis
cgcuugguggcgccg

SEQ ID NO: 948843 - RNA, 18 nt, Mycobacterium avium subsp. paratuberculosis
cgcuugguggcgccgguu

SEQ ID NO: 948844 - RNA, 15 nt, Mycobacterium avium subsp. paratuberculosis
cgcuugcgaccgccg

SEQ ID NO: 948845 - RNA, 13 nt, Mycobacterium avium subsp. paratuberculosis
cgcuugcgaucgc

SEQ ID NO: 948846 - RNA, 18 nt, Mycobacterium avium subsp. paratuberculosis
cgcuugcguucccagccc

SEQ ID NO: 948847 - RNA, 21 nt, Mycobacterium avium subsp. paratuberculosis
cgcuugcguucccagcccggc

SEQ ID NO: 948848 - RNA, 14 nt, Mycobacterium avium subsp. paratuberculosis
cgcuugcgcucggu

SEQ ID NO: 948849 - RNA, 19 nt, Mycobacterium avium subsp. paratuberculosis
cgcuuuccaccccggcggu

SEQ ID NO: 948850 - RNA, 21 nt, Mycobacterium avium subsp. paratuberculosis
cgcuuugaauugagcgccggg

SEQ ID NO: 948851 - RNA, 22 nt, Mycobacterium avium subsp. paratuberculosis
cgcuuugaauugagcgccgggg

SEQ ID NO: 948852 - RNA, 20 nt, Mycobacterium avium subsp. paratuberculosis
cgcuuucgaagugacgccgc

SEQ ID NO: 948853 - RNA, 13 nt, Mycobacterium avium subsp. paratuberculosis
cgcuuucgccggg

SEQ ID NO: 948854 - RNA, 16 nt, Mycobacterium avium subsp. paratuberculosis
cgcuuucgccgggcgu

SEQ ID NO: 948855 - RNA, 18 nt, Mycobacterium avium subsp. paratuberculosis
cgcuuucgccgggcguca

SEQ ID NO: 948856 - RNA, 14 nt, Mycobacterium avium subsp. paratuberculosis
cgcuuucgcugguc

SEQ ID NO: 948857 - RNA, 16 nt, Mycobacterium avium subsp. paratuberculosis
cgcuuucgcuggucgc

SEQ ID NO: 948858 - RNA, 17 nt, Mycobacterium avium subsp. paratuberculosis
cggaauuuucgccguca

SEQ ID NO: 948859 - RNA, 21 nt, Mycobacterium avium subsp. paratuberculosis
cggaauugaagaagcgggcca

SEQ ID NO: 948860 - RNA, 20 nt, Mycobacterium avium subsp. paratuberculosis
cggaauucagugaggccagc

SEQ ID NO: 948861 - RNA, 13 nt, Mycobacterium avium subsp. paratuberculosis
cggaauucgcggg

SEQ ID NO: 948862 - RNA, 14 nt, Mycobacterium avium subsp. paratuberculosis
cggaauucgggugc

SEQ ID NO: 948863 - RNA, 18 nt, Mycobacterium avium subsp. paratuberculosis
cggaaugaacgcggccag

SEQ ID NO: 948864 - RNA, 15 nt, Mycobacterium avium subsp. paratuberculosis
cggaaugcucgacac

SEQ ID NO: 948865 - RNA, 18 nt, Mycobacterium avium subsp. paratuberculosis
cggaauggcaaggccagc

SEQ ID NO: 948866 - RNA, 17 nt, Mycobacterium avium subsp. paratuberculosis
cggaagugccggcgaac

SEQ ID NO: 948867 - RNA, 20 nt, Mycobacterium avium subsp. paratuberculosis
cggaaucacuuccgcggcaa

SEQ ID NO: 948868 - RNA, 19 nt, Mycobacterium avium subsp. paratuberculosis
cggaaucgauuggugcgca

SEQ ID NO: 948869 - RNA, 20 nt, Mycobacterium avium subsp. paratuberculosis
cggaaucgcgggaucggccg

SEQ ID NO: 948870 - RNA, 14 nt, Mycobacterium avium subsp. paratuberculosis
cggaaucgucggcc

SEQ ID NO: 948871 - RNA, 16 nt, Mycobacterium avium subsp. paratuberculosis
cggaaucgucggccac

SEQ ID NO: 948872 - RNA, 20 nt, Mycobacterium avium subsp. paratuberculosis
cggaacccacgugcggcgcc

SEQ ID NO: 948873 - RNA, 20 nt, Mycobacterium avium subsp. paratuberculosis
cggaacccggguggcccgca

SEQ ID NO: 948874 - RNA, 14 nt, Mycobacterium avium subsp. paratuberculosis
cggaaccgggccgc

SEQ ID NO: 948875 - RNA, 19 nt, Mycobacterium avium subsp. paratuberculosis
cggaaccgggggccgucac

SEQ ID NO: 948876 - RNA, 15 nt, Mycobacterium avium subsp. paratuberculosis
cggaacgacgcgucc

SEQ ID NO: 948877 - RNA, 13 nt, Mycobacterium avium subsp. paratuberculosis
cggaacgggucga

SEQ ID NO: 948878 - RNA, 18 nt, Mycobacterium avium subsp. paratuberculosis
cggaacggucggggcggc

SEQ ID NO: 948879 - RNA, 19 nt, Mycobacterium avium subsp. paratuberculosis
cggaacggucggggcggcg

SEQ ID NO: 948880 - RNA, 22 nt, Mycobacterium avium subsp. paratuberculosis
cggaacggucggggcggcgggc

SEQ ID NO: 948881 - RNA, 12 nt, Mycobacterium avium subsp. paratuberculosis
cggaacggcggg

SEQ ID NO: 948882 - RNA, 19 nt, Mycobacterium avium subsp. paratuberculosis
cggaacggcuugcgcucgg

SEQ ID NO: 948883 - RNA, 21 nt, Mycobacterium avium subsp. paratuberculosis
cggaacggcuugcgcucggcc

SEQ ID NO: 948884 - RNA, 23 nt, Mycobacterium avium subsp. paratuberculosis
cggaacggcuugcgcucggccgg

SEQ ID NO: 948885 - RNA, 18 nt, Mycobacterium avium subsp. paratuberculosis
cggaaccgcugcaugccg

SEQ ID NO: 948886 - RNA, 13 nt, Mycobacterium avium subsp. paratuberculosis
cggaacgcgccgg

SEQ ID NO: 948887 - RNA, 15 nt, Mycobacterium avium subsp. paratuberculosis
cggaacgcgucgccc

SEQ ID NO: 948888 - RNA, 13 nt, Mycobacterium avium subsp. paratuberculosis
cggaagaucagca

SEQ ID NO: 948889 - RNA, 17 nt, Mycobacterium avium subsp. paratuberculosis
cggaagccccaggcccg

SEQ ID NO: 948890 - RNA, 13 nt, Mycobacterium avium subsp. paratuberculosis
cggaagcccuugc

SEQ ID NO: 948891 - RNA, 13 nt, Mycobacterium avium subsp. paratuberculosis
cggaagccgucgg

SEQ ID NO: 948892 - RNA, 21 nt, Mycobacterium avium subsp. paratuberculosis
cggaacugcucccaggcgucg

SEQ ID NO: 948893 - RNA, 21 nt, Mycobacterium avium subsp. paratuberculosis
cggaagaacaguuccucggcg

SEQ ID NO: 948894 - RNA, 12 nt, Mycobacterium avium subsp. paratuberculosis
cggaagcggcgg

SEQ ID NO: 948895 - RNA, 15 nt, Mycobacterium avium subsp. paratuberculosis
cggaaggccgcgcgg

SEQ ID NO: 948896 - RNA, 19 nt, Mycobacterium avium subsp. paratuberculosis
cggaaggccgcgcgggcgg

SEQ ID NO: 948897 - RNA, 22 nt, Mycobacterium avium subsp. paratuberculosis
cggaagcugccguugcgccagc

SEQ ID NO: 948898 - RNA, 18 nt, Mycobacterium avium subsp. paratuberculosis
cggaaggccaaggccagc

SEQ ID NO: 948899 - RNA, 16 nt, Mycobacterium avium subsp. paratuberculosis
cgcuguccacguccug

SEQ ID NO: 948900 - RNA, 15 nt, Mycobacterium avium subsp. paratuberculosis
cgcuguaggcggcgu

SEQ ID NO: 948901 - RNA, 17 nt, Mycobacterium avium subsp. paratuberculosis
cgcuguaggcggcgugc

SEQ ID NO: 948902 - RNA, 22 nt, Mycobacterium avium subsp. paratuberculosis
cgcuguagggccaccacgccag

SEQ ID NO: 948903 - RNA, 17 nt, Mycobacterium avium subsp. paratuberculosis
cgcuguaggccagcccg

SEQ ID NO: 948904 - RNA, 16 nt, Mycobacterium avium subsp. paratuberculosis
cgcuguaggccagccc

SEQ ID NO: 948905 - RNA, 19 nt, Mycobacterium avium subsp. paratuberculosis
cgcuguaggccagcccggc

SEQ ID NO: 948906 - RNA, 23 nt, Mycobacterium avium subsp. paratuberculosis
cgcuguaggccagcccggcgugc

SEQ ID NO: 948907 - RNA, 24 nt, Mycobacterium avium subsp. paratuberculosis
cgcuguaggccagcccggcgugca

SEQ ID NO: 948908 - RNA, 17 nt, Mycobacterium avium subsp. paratuberculosis
cgcugucgacgcguugu

SEQ ID NO: 948909 - RNA, 21 nt, Mycobacterium avium subsp. paratuberculosis
cgcugucgcccucgaucgcga

SEQ ID NO: 948910 - RNA, 23 nt, Mycobacterium avium subsp. paratuberculosis
cgcuguccucgagcgcgucgacc

SEQ ID NO: 948911 - RNA, 20 nt, Mycobacterium avium subsp. paratuberculosis
cgcuguccucgucggaggcg

SEQ ID NO: 948912 - RNA, 23 nt, Mycobacterium avium subsp. paratuberculosis
cgcuguccugccgggcgucgacg

SEQ ID NO: 948913 - RNA, 15 nt, Mycobacterium avium subsp. paratuberculosis
cgcuguccuggucgc

SEQ ID NO: 948914 - RNA, 14 nt, Mycobacterium avium subsp. paratuberculosis
cgcuggucggcggg

SEQ ID NO: 948915 - RNA, 18 nt, Mycobacterium avium subsp. paratuberculosis
cgcuggucggcgggcagc

SEQ ID NO: 948916 - RNA, 18 nt, Mycobacterium avium subsp. paratuberculosis
cgcugguccucggggaug

SEQ ID NO: 948917 - RNA, 15 nt, Mycobacterium avium subsp. paratuberculosis
cgcuggucgaacgcc

SEQ ID NO: 948918 - RNA, 14 nt, Mycobacterium avium subsp. paratuberculosis
cgcuggugcagcag

SEQ ID NO: 948919 - RNA, 21 nt, Mycobacterium avium subsp. paratuberculosis
cgcuggugcagcagggcgcgc

SEQ ID NO: 948920 - RNA, 20 nt, Mycobacterium avium subsp. paratuberculosis
cgcuggugacgugcaccugc

SEQ ID NO: 948921 - RNA, 17 nt, Mycobacterium avium subsp. paratuberculosis
cgcuggugaggucgcgc

SEQ ID NO: 948922 - RNA, 17 nt, Mycobacterium avium subsp. paratuberculosis
cgcuggugugacgcucg

SEQ ID NO: 948923 - RNA, 15 nt, Mycobacterium avium subsp. paratuberculosis
cgcugguugucgacg

SEQ ID NO: 948924 - RNA, 16 nt, Mycobacterium avium subsp. paratuberculosis
cgcugguugucgacgc

SEQ ID NO: 948925 - RNA, 15 nt, Mycobacterium avium subsp. paratuberculosis
cgcugguggugagaa

SEQ ID NO: 948926 - RNA, 11 nt, Mycobacterium avium subsp. paratuberculosis
cgcugguggcc

SEQ ID NO: 948927 - RNA, 15 nt, Mycobacterium avium subsp. paratuberculosis
cgcuggugcgcgccg

SEQ ID NO: 948928 - RNA, 17 nt, Mycobacterium avium subsp. paratuberculosis
cgcuggugcgcgccggc

SEQ ID NO: 948929 - RNA, 18 nt, Mycobacterium avium subsp. paratuberculosis
cgcuggugcgcgccggcg

SEQ ID NO: 948930 - RNA, 22 nt, Mycobacterium avium subsp. paratuberculosis
cgcuggugcgcgccggcgucgg

SEQ ID NO: 948931 - RNA, 13 nt, Mycobacterium avium subsp. paratuberculosis
cgcuggugcgggc

SEQ ID NO: 948932 - RNA, 20 nt, Mycobacterium avium subsp. paratuberculosis
cgcuggugcgggccagcacg

SEQ ID NO: 948933 - RNA, 13 nt, Mycobacterium avium subsp. paratuberculosis
cgcugguggccga

SEQ ID NO: 948934 - RNA, 16 nt, Mycobacterium avium subsp. paratuberculosis
cgcugguggccgacgu

SEQ ID NO: 948935 - RNA, 21 nt, Mycobacterium avium subsp. paratuberculosis
cgcugguggccgacgugccgg

SEQ ID NO: 948936 - RNA, 18 nt, Mycobacterium avium subsp. paratuberculosis
cgcugugauagcggcgua

SEQ ID NO: 948937 - RNA, 17 nt, Mycobacterium avium subsp. paratuberculosis
cgcugucgcccucgauc

SEQ ID NO: 948938 - RNA, 14 nt, Mycobacterium avium subsp. paratuberculosis
cgcugucggcgaaa

SEQ ID NO: 948939 - RNA, 16 nt, Mycobacterium avium subsp. paratuberculosis
cgcugucggggucgcg

SEQ ID NO: 948940 - RNA, 17 nt, Mycobacterium avium subsp. paratuberculosis
cgcuguggccguugauc

SEQ ID NO: 948941 - RNA, 22 nt, Mycobacterium avium subsp. paratuberculosis
cgcuguggccguugaucgagca

SEQ ID NO: 948942 - RNA, 18 nt, Mycobacterium avium subsp. paratuberculosis
cgcugugguccucgucac

SEQ ID NO: 948943 - RNA, 20 nt, Mycobacterium avium subsp. paratuberculosis
cgcugugguccucgucaccg

SEQ ID NO: 948944 - RNA, 21 nt, Mycobacterium avium subsp. paratuberculosis
cgcugugguccucgucaccgu

SEQ ID NO: 948945 - RNA, 13 nt, Mycobacterium avium subsp. paratuberculosis
cgcugugcgccuu

SEQ ID NO: 948946 - RNA, 23 nt, Mycobacterium avium subsp. paratuberculosis
cgcugugcgccuugccgucgagc

SEQ ID NO: 948947 - RNA, 14 nt, Mycobacterium avium subsp. paratuberculosis
cgcugugcggcccg

SEQ ID NO: 948948 - RNA, 15 nt, Mycobacterium avium subsp. paratuberculosis
cgcugugcggcccgg

SEQ ID NO: 948949 - RNA, 16 nt, Mycobacterium avium subsp. paratuberculosis
cgcuguggacaggucg

SEQ ID NO: 948950 - RNA, 17 nt, Mycobacterium avium subsp. paratuberculosis
cgcuguggacaggucga

SEQ ID NO: 948951 - RNA, 19 nt, Mycobacterium avium subsp. paratuberculosis
cgcuguggacaggucgaug

SEQ ID NO: 948952 - RNA, 23 nt, Mycobacterium avium subsp. paratuberculosis
cgcuguggacaggucgaugaugu

SEQ ID NO: 948953 - RNA, 17 nt, Mycobacterium avium subsp. paratuberculosis
cgcugugcgggugaggc

SEQ ID NO: 948954 - RNA, 20 nt, Mycobacterium avium subsp. paratuberculosis
cgcuguuggcgacggcgcug

SEQ ID NO: 948955 - RNA, 19 nt, Mycobacterium avium subsp. paratuberculosis
cgcuugauggcggcgcgga

SEQ ID NO: 948956 - RNA, 19 nt, Mycobacterium avium subsp. paratuberculosis
cgcuugcagcuuggcggug

SEQ ID NO: 948957 - RNA, 18 nt, Mycobacterium avium subsp. paratuberculosis
cgcuugacgaacgccacc

SEQ ID NO: 948958 - RNA, 23 nt, Mycobacterium avium subsp. paratuberculosis
cgcuugacgaacgccaccacggc

SEQ ID NO: 948959 - RNA, 13 nt, Mycobacterium avium subsp. paratuberculosis
cgcuugacggccg

SEQ ID NO: 948960 - RNA, 14 nt, Mycobacterium avium subsp. paratuberculosis
cgcuugacggccgg

SEQ ID NO: 948961 - RNA, 12 nt, Mycobacterium avium subsp. paratuberculosis
cgcuugcgaucg

SEQ ID NO: 948962 - RNA, 21 nt, Mycobacterium avium subsp. paratuberculosis
cgcuugccgaaguccuugacc

SEQ ID NO: 948963 - RNA, 14 nt, Mycobacterium avium subsp. paratuberculosis
cgcuugcgccgcag

SEQ ID NO: 948964 - RNA, 19 nt, Mycobacterium avium subsp. paratuberculosis
cgcuugcgccgcagcggug

SEQ ID NO: 948965 - RNA, 22 nt, Mycobacterium avium subsp. paratuberculosis
cgcuugccggauugcgagccgg

SEQ ID NO: 948966 - RNA, 17 nt, Mycobacterium avium subsp. paratuberculosis
cgcuugccagccgggcc

SEQ ID NO: 948967 - RNA, 14 nt, Mycobacterium avium subsp. paratuberculosis
cgcuucgucgccgg

SEQ ID NO: 948968 - RNA, 18 nt, Mycobacterium avium subsp. paratuberculosis
cgcuucgucgccggccgc

SEQ ID NO: 948969 - RNA, 20 nt, Mycobacterium avium subsp. paratuberculosis
cgcuucuggcgggcgaagcg

SEQ ID NO: 948970 - RNA, 23 nt, Mycobacterium avium subsp. paratuberculosis
cgcuucguggacgaacgcggcga

SEQ ID NO: 948971 - RNA, 11 nt, Mycobacterium avium subsp. paratuberculosis
cgcuucggcca

SEQ ID NO: 948972 - RNA, 12 nt, Mycobacterium avium subsp. paratuberculosis
cgcuucggccag

SEQ ID NO: 948973 - RNA, 13 nt, Mycobacterium avium subsp. paratuberculosis
cgcuucggccagc

SEQ ID NO: 948974 - RNA, 16 nt, Mycobacterium avium subsp. paratuberculosis
cgcuucggccagcgcg

SEQ ID NO: 948975 - RNA, 17 nt, Mycobacterium avium subsp. paratuberculosis
cgcuucggccagcgcgu

SEQ ID NO: 948976 - RNA, 18 nt, Mycobacterium avium subsp. paratuberculosis
cgcuucggccagcgcguc

SEQ ID NO: 948977 - RNA, 14 nt, Mycobacterium avium subsp. paratuberculosis
cgcuuccagcgcgg

SEQ ID NO: 948978 - RNA, 16 nt, Mycobacterium avium subsp. paratuberculosis
cgcuuccagcgcggcg

SEQ ID NO: 948979 - RNA, 12 nt, Mycobacterium avium subsp. paratuberculosis
cgcuucccacag

SEQ ID NO: 948980 - RNA, 14 nt, Mycobacterium avium subsp. paratuberculosis
cgcuucccacccgg

SEQ ID NO: 948981 - RNA, 19 nt, Mycobacterium avium subsp. paratuberculosis
cgcuucgcccggcugcgcc

SEQ ID NO: 948982 - RNA, 21 nt, Mycobacterium avium subsp. paratuberculosis
cgcuucgcccggcugcgccgc

SEQ ID NO: 948983 - RNA, 18 nt, Mycobacterium avium subsp. paratuberculosis
cgcugcauagucggcccg

SEQ ID NO: 948984 - RNA, 19 nt, Mycobacterium avium subsp. paratuberculosis
cgcugcagguggcccacac

SEQ ID NO: 948985 - RNA, 16 nt, Mycobacterium avium subsp. paratuberculosis
cgcugcaguagccggc

SEQ ID NO: 948986 - RNA, 19 nt, Mycobacterium avium subsp. paratuberculosis
cgcugcaguagccggccag

SEQ ID NO: 948987 - RNA, 20 nt, Mycobacterium avium subsp. paratuberculosis
cgcugcaguagccggccagc

SEQ ID NO: 948988 - RNA, 20 nt, Mycobacterium avium subsp. paratuberculosis
cgcugcaggcccggguagcg

SEQ ID NO: 948989 - RNA, 19 nt, Mycobacterium avium subsp. paratuberculosis
cgcugcagcauggacccga

SEQ ID NO: 948990 - RNA, 17 nt, Mycobacterium avium subsp. paratuberculosis
cgcugcagcugcucguc

SEQ ID NO: 948991 - RNA, 23 nt, Mycobacterium avium subsp. paratuberculosis
cgcugcagcugcucguccuggcg

SEQ ID NO: 948992 - RNA, 15 nt, Mycobacterium avium subsp. paratuberculosis
cgcugcauccgcagc

SEQ ID NO: 948993 - RNA, 20 nt, Mycobacterium avium subsp. paratuberculosis
cgcugcauccgcagcaccag

SEQ ID NO: 948994 - RNA, 14 nt, Mycobacterium avium subsp. paratuberculosis
cgcugcaugccggu

SEQ ID NO: 948995 - RNA, 18 nt, Mycobacterium avium subsp. paratuberculosis
cgcugcaugccggugucg

SEQ ID NO: 948996 - RNA, 23 nt, Mycobacterium avium subsp. paratuberculosis
cgcugcaugccggugucggugcg

SEQ ID NO: 948997 - RNA, 18 nt, Mycobacterium avium subsp. paratuberculosis
cgcugcaugccgucgauc

SEQ ID NO: 948998 - RNA, 17 nt, Mycobacterium avium subsp. paratuberculosis
cgcugcagccgguccgg

SEQ ID NO: 948999 - RNA, 19 nt, Mycobacterium avium subsp. paratuberculosis
cgcugcagccgguccggcg

SEQ ID NO: 949000 - RNA, 21 nt, Mycobacterium avium subsp. paratuberculosis
cgcugcagccgguccggcggc

SEQ ID NO: 949001 - RNA, 22 nt, Mycobacterium avium subsp. paratuberculosis
cgcugcagcgagaccucccggc

SEQ ID NO: 949002 - RNA, 13 nt, Mycobacterium avium subsp. paratuberculosis
cgcugcagcgccg

SEQ ID NO: 949003 - RNA, 15 nt, Mycobacterium avium subsp. paratuberculosis
cgcugcagcgccgag

SEQ ID NO: 949004 - RNA, 14 nt, Mycobacterium avium subsp. paratuberculosis
cgcugcagcgccgc

SEQ ID NO: 949005 - RNA, 15 nt, Mycobacterium avium subsp. paratuberculosis
cgcugcagcgccgcc

SEQ ID NO: 949006 - RNA, 16 nt, Mycobacterium avium subsp. paratuberculosis
cgcugcagcgccgccc

SEQ ID NO: 949007 - RNA, 18 nt, Mycobacterium avium subsp. paratuberculosis
cgcugcagcgccgcccgc

SEQ ID NO: 949008 - RNA, 21 nt, Mycobacterium avium subsp. paratuberculosis
cgcugcagcgccgcccgcacc

SEQ ID NO: 949009 - RNA, 14 nt, Mycobacterium avium subsp. paratuberculosis
cgcugcagcggcgg

SEQ ID NO: 949010 - RNA, 17 nt, Mycobacterium avium subsp. paratuberculosis
cgcugcagcggcggcca

SEQ ID NO: 949011 - RNA, 21 nt, Mycobacterium avium subsp. paratuberculosis
cgcugcagcggcggccaguug

SEQ ID NO: 949012 - RNA, 13 nt, Mycobacterium avium subsp. paratuberculosis
cgcugcagcagcc

SEQ ID NO: 949013 - RNA, 22 nt, Mycobacterium avium subsp. paratuberculosis
cgcugcacgcguugcagcgccg

SEQ ID NO: 949014 - RNA, 15 nt, Mycobacterium avium subsp. paratuberculosis
cgcugauggcgagga

SEQ ID NO: 949015 - RNA, 23 nt, Mycobacterium avium subsp. paratuberculosis
cgcugauggcgaggaaguccggc

SEQ ID NO: 949016 - RNA, 14 nt, Mycobacterium avium subsp. paratuberculosis
cgcugaugcggccg

SEQ ID NO: 949017 - RNA, 15 nt, Mycobacterium avium subsp. paratuberculosis
cgcugaugcggccgg

SEQ ID NO: 949018 - RNA, 14 nt, Mycobacterium avium subsp. paratuberculosis
cgcugaugccgccg

SEQ ID NO: 949019 - RNA, 22 nt, Mycobacterium avium subsp. paratuberculosis
cgcugaugccgccgaagcggcg

SEQ ID NO: 949020 - RNA, 19 nt, Mycobacterium avium subsp. paratuberculosis
cgcugaucugcggcaccac

SEQ ID NO: 949021 - RNA, 14 nt, Mycobacterium avium subsp. paratuberculosis
cgcugaucgcgauc

SEQ ID NO: 949022 - RNA, 23 nt, Mycobacterium avium subsp. paratuberculosis
cgcugaucgcgauccgggcgccg

SEQ ID NO: 949023 - RNA, 15 nt, Mycobacterium avium subsp. paratuberculosis
cgcugcaccagcccg

SEQ ID NO: 949024 - RNA, 20 nt, Mycobacterium avium subsp. paratuberculosis
cgcugcaccagcccgucggc

SEQ ID NO: 949025 - RNA, 15 nt, Mycobacterium avium subsp. paratuberculosis
cgcugaugccguccu

SEQ ID NO: 949026 - RNA, 16 nt, Mycobacterium avium subsp. paratuberculosis
cgcugcaaccgguagc

SEQ ID NO: 949027 - RNA, 19 nt, Mycobacterium avium subsp. paratuberculosis
cgcugcaaccgguccgccg

SEQ ID NO: 949028 - RNA, 16 nt, Mycobacterium avium subsp. paratuberculosis
cgcuccugcagcgcgg

SEQ ID NO: 949029 - RNA, 14 nt, Mycobacterium avium subsp. paratuberculosis
cgcuccuccucgcg

SEQ ID NO: 949030 - RNA, 16 nt, Mycobacterium avium subsp. paratuberculosis
cgcuccuggccggacg

SEQ ID NO: 949031 - RNA, 23 nt, Mycobacterium avium subsp. paratuberculosis
cgcucgaacucaccgguggccgc

SEQ ID NO: 949032 - RNA, 16 nt, Mycobacterium avium subsp. paratuberculosis
cgcucgaacacccggc

SEQ ID NO: 949033 - RNA, 20 nt, Mycobacterium avium subsp. paratuberculosis
cgcucgaacacccggcuucg

SEQ ID NO: 949034 - RNA, 17 nt, Mycobacterium avium subsp. paratuberculosis
cgcugaggaugguggug

SEQ ID NO: 949035 - RNA, 18 nt, Mycobacterium avium subsp. paratuberculosis
cgcugaggaugguggugc

SEQ ID NO: 949036 - RNA, 22 nt, Mycobacterium avium subsp. paratuberculosis
cgcugaggaugguggugcaggc

SEQ ID NO: 949037 - RNA, 15 nt, Mycobacterium avium subsp. paratuberculosis
cgcucgaccucggcg

SEQ ID NO: 949038 - RNA, 22 nt, Mycobacterium avium subsp. paratuberculosis
cgcugagucuacuuggccagcu

SEQ ID NO: 949039 - RNA, 18 nt, Mycobacterium avium subsp. paratuberculosis
cgcugaucgaccgguucg

SEQ ID NO: 949040 - RNA, 16 nt, Mycobacterium avium subsp. paratuberculosis
cgcugauccagcagcg

SEQ ID NO: 949041 - RNA, 16 nt, Mycobacterium avium subsp. paratuberculosis
cgcugaucuacgucgg

SEQ ID NO: 949042 - RNA, 17 nt, Mycobacterium avium subsp. paratuberculosis
cgcugaucuacgucggc

SEQ ID NO: 949043 - RNA, 18 nt, Mycobacterium avium subsp. paratuberculosis
cgcugaucuacgucggcu

SEQ ID NO: 949044 - RNA, 16 nt, Mycobacterium avium subsp. paratuberculosis
cgcugaucucgacggu

SEQ ID NO: 949045 - RNA, 18 nt, Mycobacterium avium subsp. paratuberculosis
cgcugaucucgacggugg

SEQ ID NO: 949046 - RNA, 20 nt, Mycobacterium avium subsp. paratuberculosis
cgcugaucucgacgguggcc

SEQ ID NO: 949047 - RNA, 23 nt, Mycobacterium avium subsp. paratuberculosis
cgcugaucagcucuucgauggcc

SEQ ID NO: 949048 - RNA, 22 nt, Mycobacterium avium subsp. paratuberculosis
cgcugaucaccaaauagccguc

SEQ ID NO: 949049 - RNA, 19 nt, Mycobacterium avium subsp. paratuberculosis
cgcugaucaccacggucag

SEQ ID NO: 949050 - RNA, 22 nt, Mycobacterium avium subsp. paratuberculosis
cgcugccaggcgguggccgaac

SEQ ID NO: 949051 - RNA, 15 nt, Mycobacterium avium subsp. paratuberculosis
cgcugccagggccgg

SEQ ID NO: 949052 - RNA, 17 nt, Mycobacterium avium subsp. paratuberculosis
cgcugccagggccgggc

SEQ ID NO: 949053 - RNA, 23 nt, Mycobacterium avium subsp. paratuberculosis
cgcugcccagauacgccgcgacg

SEQ ID NO: 949054 - RNA, 14 nt, Mycobacterium avium subsp. paratuberculosis
cgcugcccagcgcg

SEQ ID NO: 949055 - RNA, 16 nt, Mycobacterium avium subsp. paratuberculosis
cgcugcccagcgcggu

SEQ ID NO: 949056 - RNA, 17 nt, Mycobacterium avium subsp. paratuberculosis
cgcugcccaacgucgac

SEQ ID NO: 949057 - RNA, 23 nt, Mycobacterium avium subsp. paratuberculosis
cgcugccacgguuucgccguaca

SEQ ID NO: 949058 - RNA, 23 nt, Mycobacterium avium subsp. paratuberculosis
cgcugccaaaguuggcaucccgc

SEQ ID NO: 949059 - RNA, 14 nt, Mycobacterium avium subsp. paratuberculosis
cgcugccgagcacc

SEQ ID NO: 949060 - RNA, 15 nt, Mycobacterium avium subsp. paratuberculosis
cgcugccgagcaccu

SEQ ID NO: 949061 - RNA, 20 nt, Mycobacterium avium subsp. paratuberculosis
cgcugccgcccccgcuggcg

SEQ ID NO: 949062 - RNA, 21 nt, Mycobacterium avium subsp. paratuberculosis
cgcugccgcccccgcuggcga

SEQ ID NO: 949063 - RNA, 23 nt, Mycobacterium avium subsp. paratuberculosis
cgcugccgacgaugucggcuucg

SEQ ID NO: 949064 - RNA, 15 nt, Mycobacterium avium subsp. paratuberculosis
cgcugcccucggucg

SEQ ID NO: 949065 - RNA, 18 nt, Mycobacterium avium subsp. paratuberculosis
cgcugcccucggucgccg

SEQ ID NO: 949066 - RNA, 19 nt, Mycobacterium avium subsp. paratuberculosis
cgcugcccucggucgccga

SEQ ID NO: 949067 - RNA, 20 nt, Mycobacterium avium subsp. paratuberculosis
cgcugccgagguacgcgcug

SEQ ID NO: 949068 - RNA, 12 nt, Mycobacterium avium subsp. paratuberculosis
cgcugccgccgc

SEQ ID NO: 949069 - RNA, 13 nt, Mycobacterium avium subsp. paratuberculosis
cgcugccgccgcc

SEQ ID NO: 949070 - RNA, 14 nt, Mycobacterium avium subsp. paratuberculosis
cgcugccgccgccg

SEQ ID NO: 949071 - RNA, 17 nt, Mycobacterium avium subsp. paratuberculosis
cgcugccgccgccgcug

SEQ ID NO: 949072 - RNA, 16 nt, Mycobacterium avium subsp. paratuberculosis
cgcugccgccgccggc

SEQ ID NO: 949073 - RNA, 17 nt, Mycobacterium avium subsp. paratuberculosis
cgcugccgccgccggcg

SEQ ID NO: 949074 - RNA, 19 nt, Mycobacterium avium subsp. paratuberculosis
cgcugccgccgccggcggu

SEQ ID NO: 949075 - RNA, 13 nt, Mycobacterium avium subsp. paratuberculosis
cgcugcccggcgc

SEQ ID NO: 949076 - RNA, 14 nt, Mycobacterium avium subsp. paratuberculosis
cgcugcccgggcau

SEQ ID NO: 949077 - RNA, 16 nt, Mycobacterium avium subsp. paratuberculosis
cgcugcccgggcaucc

SEQ ID NO: 949078 - RNA, 22 nt, Mycobacterium avium subsp. paratuberculosis
cgcugcccgggcaucccgccga

SEQ ID NO: 949079 - RNA, 13 nt, Mycobacterium avium subsp. paratuberculosis
cgcugcccgccgc

SEQ ID NO: 949080 - RNA, 15 nt, Mycobacterium avium subsp. paratuberculosis
cgcugcccgccgcgu

SEQ ID NO: 949081 - RNA, 21 nt, Mycobacterium avium subsp. paratuberculosis
cgcugcccgccgcguacagca

SEQ ID NO: 949082 - RNA, 15 nt, Mycobacterium avium subsp. paratuberculosis
cgcugcccgcgaucg

SEQ ID NO: 949083 - RNA, 22 nt, Mycobacterium avium subsp. paratuberculosis
cgcugcccgcgaucgccagcgc

SEQ ID NO: 949084 - RNA, 14 nt, Mycobacterium avium subsp. paratuberculosis
cgcugcccggcgcu

SEQ ID NO: 949085 - RNA, 14 nt, Mycobacterium avium subsp. paratuberculosis
cgcugcccggcgug

SEQ ID NO: 949086 - RNA, 18 nt, Mycobacterium avium subsp. paratuberculosis
cgcugccccagccacagc

SEQ ID NO: 949087 - RNA, 14 nt, Mycobacterium avium subsp. paratuberculosis
cgcugccccggcga

SEQ ID NO: 949088 - RNA, 15 nt, Mycobacterium avium subsp. paratuberculosis
cgcugccccggcgag

SEQ ID NO: 949089 - RNA, 18 nt, Mycobacterium avium subsp. paratuberculosis
cgcugccccggcgaggcc

SEQ ID NO: 949090 - RNA, 19 nt, Mycobacterium avium subsp. paratuberculosis
cgcugccccggcgaggcca

SEQ ID NO: 949091 - RNA, 18 nt, Mycobacterium avium subsp. paratuberculosis
cgcugccggugcugcucg

SEQ ID NO: 949092 - RNA, 17 nt, Mycobacterium avium subsp. paratuberculosis
cgcugccgguggucccg

SEQ ID NO: 949093 - RNA, 23 nt, Mycobacterium avium subsp. paratuberculosis
cgcugccgguggucccggucagc

SEQ ID NO: 949094 - RNA, 13 nt, Mycobacterium avium subsp. paratuberculosis
cgcugccggggug

SEQ ID NO: 949095 - RNA, 14 nt, Mycobacterium avium subsp. paratuberculosis
cgcugccggggugc

SEQ ID NO: 949096 - RNA, 18 nt, Mycobacterium avium subsp. paratuberculosis
cgcugccggggugcagca

SEQ ID NO: 949097 - RNA, 20 nt, Mycobacterium avium subsp. paratuberculosis
cgcugccggggugcagcacc

SEQ ID NO: 949098 - RNA, 16 nt, Mycobacterium avium subsp. paratuberculosis
cgcugccguagcgcug

SEQ ID NO: 949099 - RNA, 19 nt, Mycobacterium avium subsp. paratuberculosis
cgcugccguagcgcugggu

SEQ ID NO: 949100 - RNA, 13 nt, Mycobacterium avium subsp. paratuberculosis
cgcugccguccac

SEQ ID NO: 949101 - RNA, 15 nt, Mycobacterium avium subsp. paratuberculosis
cgcugccguccaccc

SEQ ID NO: 949102 - RNA, 21 nt, Mycobacterium avium subsp. paratuberculosis
cgcugccguccacccggccca

SEQ ID NO: 949103 - RNA, 12 nt, Mycobacterium avium subsp. paratuberculosis
cgcugccguccg

SEQ ID NO: 949104 - RNA, 14 nt, Mycobacterium avium subsp. paratuberculosis
cgcugccguccggc

SEQ ID NO: 949105 - RNA, 15 nt, Mycobacterium avium subsp. paratuberculosis
cgcugccguccggcg

SEQ ID NO: 949106 - RNA, 12 nt, Mycobacterium avium subsp. paratuberculosis
cgcugccguccu

SEQ ID NO: 949107 - RNA, 18 nt, Mycobacterium avium subsp. paratuberculosis
cgcugccguucgccggua

SEQ ID NO: 949108 - RNA, 16 nt, Mycobacterium avium subsp. paratuberculosis
cgcugccggcgcaccc

SEQ ID NO: 949109 - RNA, 17 nt, Mycobacterium avium subsp. paratuberculosis
cgcugccggccggggcg

SEQ ID NO: 949110 - RNA, 23 nt, Mycobacterium avium subsp. paratuberculosis
cgcugccggccggggcggcggua

SEQ ID NO: 949111 - RNA, 13 nt, Mycobacterium avium subsp. paratuberculosis
cgcugccgcuggc

SEQ ID NO: 949112 - RNA, 16 nt, Mycobacterium avium subsp. paratuberculosis
cgcugccggaccucga

SEQ ID NO: 949113 - RNA, 13 nt, Mycobacterium avium subsp. paratuberculosis
cgcugccggcccg

SEQ ID NO: 949114 - RNA, 15 nt, Mycobacterium avium subsp. paratuberculosis
cgcugccggcccgau

SEQ ID NO: 949115 - RNA, 14 nt, Mycobacterium avium subsp. paratuberculosis
cgcugccgcgccgc

SEQ ID NO: 949116 - RNA, 16 nt, Mycobacterium avium subsp. paratuberculosis
cgcugccgcgccgcca

SEQ ID NO: 949117 - RNA, 20 nt, Mycobacterium avium subsp. paratuberculosis
cgcugccgcgccgccacacc

SEQ ID NO: 949118 - RNA, 15 nt, Mycobacterium avium subsp. paratuberculosis
cgcugccgcgcgccg

SEQ ID NO: 949119 - RNA, 18 nt, Mycobacterium avium subsp. paratuberculosis
cgcugccgcgcgccgaca

SEQ ID NO: 949120 - RNA, 20 nt, Mycobacterium avium subsp. paratuberculosis
cgcugccgccgccggcggug

SEQ ID NO: 949121 - RNA, 14 nt, Mycobacterium avium subsp. paratuberculosis
cgcugccgccggcc

SEQ ID NO: 949122 - RNA, 17 nt, Mycobacterium avium subsp. paratuberculosis
cgcugccgccggccucg

SEQ ID NO: 949123 - RNA, 19 nt, Mycobacterium avium subsp. paratuberculosis
cgcugcgacaggucggcgg

SEQ ID NO: 949124 - RNA, 22 nt, Mycobacterium avium subsp. paratuberculosis
cgcugcgacaggucggcggucg

SEQ ID NO: 949125 - RNA, 23 nt, Mycobacterium avium subsp. paratuberculosis
cgcugcgacaggucggcggucgc

SEQ ID NO: 949126 - RNA, 18 nt, Mycobacterium avium subsp. paratuberculosis
cgcugcgagcccggccag

SEQ ID NO: 949127 - RNA, 19 nt, Mycobacterium avium subsp. paratuberculosis
cgcugcgauugguggcccg

SEQ ID NO: 949128 - RNA, 13 nt, Mycobacterium avium subsp. paratuberculosis
cgcugcgcacccg

SEQ ID NO: 949129 - RNA, 23 nt, Mycobacterium avium subsp. paratuberculosis
cgcugcgcacccgguccggcugg

SEQ ID NO: 949130 - RNA, 14 nt, Mycobacterium avium subsp. paratuberculosis
cgcugcgccagccg

SEQ ID NO: 949131 - RNA, 21 nt, Mycobacterium avium subsp. paratuberculosis
cgcugcgccagccgucgccgc

SEQ ID NO: 949132 - RNA, 12 nt, Mycobacterium avium subsp. paratuberculosis
cgcugcgcccgc

SEQ ID NO: 949133 - RNA, 14 nt, Mycobacterium avium subsp. paratuberculosis
cgcugcgcccgccg

SEQ ID NO: 949134 - RNA, 23 nt, Mycobacterium avium subsp. paratuberculosis
cgcugcgcccgccgccaccacgg

SEQ ID NO: 949135 - RNA, 23 nt, Mycobacterium avium subsp. paratuberculosis
cgcugcgccgaacgugcacucag

SEQ ID NO: 949136 - RNA, 19 nt, Mycobacterium avium subsp. paratuberculosis
cgcuggcgaucaccuugcg

SEQ ID NO: 949137 - RNA, 22 nt, Mycobacterium avium subsp. paratuberculosis
cgcuggcgaucaccuugcggcc

SEQ ID NO: 949138 - RNA, 17 nt, Mycobacterium avium subsp. paratuberculosis
cgcuggccuugaucggg

SEQ ID NO: 949139 - RNA, 21 nt, Mycobacterium avium subsp. paratuberculosis
cgcuggcgaauuccccguagu

SEQ ID NO: 949140 - RNA, 12 nt, Mycobacterium avium subsp. paratuberculosis
cgcuggccucca

SEQ ID NO: 949141 - RNA, 15 nt, Mycobacterium avium subsp. paratuberculosis
cgcuggccgcggcca

SEQ ID NO: 949142 - RNA, 14 nt, Mycobacterium avium subsp. paratuberculosis
cgcuggccggcagc

SEQ ID NO: 949143 - RNA, 15 nt, Mycobacterium avium subsp. paratuberculosis
cgcuggccggcagcg

SEQ ID NO: 949144 - RNA, 14 nt, Mycobacterium avium subsp. paratuberculosis
cgcuggccggccac

SEQ ID NO: 949145 - RNA, 18 nt, Mycobacterium avium subsp. paratuberculosis
cgcuggccggccaccagc

SEQ ID NO: 949146 - RNA, 20 nt, Mycobacterium avium subsp. paratuberculosis
cgcuggccggccaccagcgg

SEQ ID NO: 949147 - RNA, 15 nt, Mycobacterium avium subsp. paratuberculosis
cgcuggccgcgacgu

SEQ ID NO: 949148 - RNA, 15 nt, Mycobacterium avium subsp. paratuberculosis
cgcuggccgcgccac

SEQ ID NO: 949149 - RNA, 18 nt, Mycobacterium avium subsp. paratuberculosis
cgcuggcggccaucgccg

SEQ ID NO: 949150 - RNA, 13 nt, Mycobacterium avium subsp. paratuberculosis
cgcuggcggggcg

SEQ ID NO: 949151 - RNA, 13 nt, Mycobacterium avium subsp. paratuberculosis
cgcuggcgguguc

SEQ ID NO: 949152 - RNA, 23 nt, Mycobacterium avium subsp. paratuberculosis
cgcuggcggugucgaagaccggu

SEQ ID NO: 949153 - RNA, 13 nt, Mycobacterium avium subsp. paratuberculosis
cgcuggcguacgc

SEQ ID NO: 949154 - RNA, 16 nt, Mycobacterium avium subsp. paratuberculosis
cgcuggcguagaucug

SEQ ID NO: 949155 - RNA, 19 nt, Mycobacterium avium subsp. paratuberculosis
cgcuggcgugacagucgag

SEQ ID NO: 949156 - RNA, 16 nt, Mycobacterium avium subsp. paratuberculosis
cgcuggcgugacgcuc

SEQ ID NO: 949157 - RNA, 17 nt, Mycobacterium avium subsp. paratuberculosis
cgcuggcgugacgcucg

SEQ ID NO: 949158 - RNA, 19 nt, Mycobacterium avium subsp. paratuberculosis
cgcuggcgugacgcucgag

SEQ ID NO: 949159 - RNA, 20 nt, Mycobacterium avium subsp. paratuberculosis
cgcuggcgugacgcucgccg

SEQ ID NO: 949160 - RNA, 23 nt, Mycobacterium avium subsp. paratuberculosis
cgcuggcgugacgcucgccggcg

SEQ ID NO: 949161 - RNA, 20 nt, Mycobacterium avium subsp. paratuberculosis
cgcuggcgugacgcucggcc

SEQ ID NO: 949162 - RNA, 23 nt, Mycobacterium avium subsp. paratuberculosis
cgcuggcgugacgcucggccgug

SEQ ID NO: 949163 - RNA, 20 nt, Mycobacterium avium subsp. paratuberculosis
cgcuggcgugacgcucgggg

SEQ ID NO: 949164 - RNA, 14 nt, Mycobacterium avium subsp. paratuberculosis
cgcuggcgugacgu

SEQ ID NO: 949165 - RNA, 14 nt, Mycobacterium avium subsp. paratuberculosis
cgcuggcguggcac

SEQ ID NO: 949166 - RNA, 17 nt, Mycobacterium avium subsp. paratuberculosis
cgcuggcguggcgccgg

SEQ ID NO: 949167 - RNA, 19 nt, Mycobacterium avium subsp. paratuberculosis
cgcuggcguggcgccggcg

SEQ ID NO: 949168 - RNA, 15 nt, Mycobacterium avium subsp. paratuberculosis
cgcuggcguggcucg

SEQ ID NO: 949169 - RNA, 16 nt, Mycobacterium avium subsp. paratuberculosis
cgcuggcguggcucgg

SEQ ID NO: 949170 - RNA, 21 nt, Mycobacterium avium subsp. paratuberculosis
cgcuggcguggcucggcccgc

SEQ ID NO: 949171 - RNA, 14 nt, Mycobacterium avium subsp. paratuberculosis
cgcuggcgccggcg

SEQ ID NO: 949172 - RNA, 18 nt, Mycobacterium avium subsp. paratuberculosis
cgcuggcgccggcgucca

SEQ ID NO: 949173 - RNA, 12 nt, Mycobacterium avium subsp. paratuberculosis
cgcuggcgccgg

SEQ ID NO: 949174 - RNA, 20 nt, Mycobacterium avium subsp. paratuberculosis
cgcuggcgcaggcgcugggu

SEQ ID NO: 949175 - RNA, 14 nt, Mycobacterium avium subsp. paratuberculosis
cgcuggcgucgauc

SEQ ID NO: 949176 - RNA, 17 nt, Mycobacterium avium subsp. paratuberculosis
cgcuggcgucgaucgcg

SEQ ID NO: 949177 - RNA, 23 nt, Mycobacterium avium subsp. paratuberculosis
cgcuggcguugagcacgcggacc

SEQ ID NO: 949178 - RNA, 17 nt, Mycobacterium avium subsp. paratuberculosis
cgcugggcagccguccc

SEQ ID NO: 949179 - RNA, 16 nt, Mycobacterium avium subsp. paratuberculosis
cgcugggagcgggcca

SEQ ID NO: 949180 - RNA, 17 nt, Mycobacterium avium subsp. paratuberculosis
cgcugggagcgggccac

SEQ ID NO: 949181 - RNA, 21 nt, Mycobacterium avium subsp. paratuberculosis
cgcugggagcgggccacgcag

SEQ ID NO: 949182 - RNA, 16 nt, Mycobacterium avium subsp. paratuberculosis
cgcugguaggcggcgc

SEQ ID NO: 949183 - RNA, 18 nt, Mycobacterium avium subsp. paratuberculosis
cgcugguaggcggcgcag

SEQ ID NO: 949184 - RNA, 22 nt, Mycobacterium avium subsp. paratuberculosis
cgcugguaguacaccgggcugg

SEQ ID NO: 949185 - RNA, 21 nt, Mycobacterium avium subsp. paratuberculosis
cgcuggguguuccccgggcga

SEQ ID NO: 949186 - RNA, 12 nt, Mycobacterium avium subsp. paratuberculosis
cgcuggggugcc

SEQ ID NO: 949187 - RNA, 16 nt, Mycobacterium avium subsp. paratuberculosis
cgcuggggugcucgau

SEQ ID NO: 949188 - RNA, 17 nt, Mycobacterium avium subsp. paratuberculosis
cgcuggggugcucgauc

SEQ ID NO: 949189 - RNA, 20 nt, Mycobacterium avium subsp. paratuberculosis
cgcuggggugcucgaucagc

SEQ ID NO: 949190 - RNA, 18 nt, Mycobacterium avium subsp. paratuberculosis
cgcugggugaacaccccg

SEQ ID NO: 949191 - RNA, 19 nt, Mycobacterium avium subsp. paratuberculosis
cgcugggugaacaccccgc

SEQ ID NO: 949192 - RNA, 23 nt, Mycobacterium avium subsp. paratuberculosis
cgcugggugaacaccccgcggga

SEQ ID NO: 949193 - RNA, 15 nt, Mycobacterium avium subsp. paratuberculosis
cgcuggggcgcaccg

SEQ ID NO: 949194 - RNA, 16 nt, Mycobacterium avium subsp. paratuberculosis
cgcuggggcgcaccgc

SEQ ID NO: 949195 - RNA, 18 nt, Mycobacterium avium subsp. paratuberculosis
cgcuggggcgcaccgccu

SEQ ID NO: 949196 - RNA, 15 nt, Mycobacterium avium subsp. paratuberculosis
cgcugggcguggugc

SEQ ID NO: 949197 - RNA, 20 nt, Mycobacterium avium subsp. paratuberculosis
cgcugggcguggugcggugc

SEQ ID NO: 949198 - RNA, 20 nt, Mycobacterium avium subsp. paratuberculosis
cgcugggcuaacgcuggucg

SEQ ID NO: 949199 - RNA, 21 nt, Mycobacterium avium subsp. paratuberculosis
cgcugggcuaacgcuggucga

SEQ ID NO: 949200 - RNA, 23 nt, Mycobacterium avium subsp. paratuberculosis
cgcugggcucgagugccggcagc

SEQ ID NO: 949201 - RNA, 15 nt, Mycobacterium avium subsp. paratuberculosis
cgcugggcuggccgu

SEQ ID NO: 949202 - RNA, 19 nt, Mycobacterium avium subsp. paratuberculosis
cgcugggcuggccguccgg

SEQ ID NO: 949203 - RNA, 13 nt, Mycobacterium avium subsp. paratuberculosis
cgcugggcgccgg

SEQ ID NO: 949204 - RNA, 13 nt, Mycobacterium avium subsp. paratuberculosis
cgcugggcggcga

SEQ ID NO: 949205 - RNA, 15 nt, Mycobacterium avium subsp. paratuberculosis
cgcugggcggcgaca

SEQ ID NO: 949206 - RNA, 18 nt, Mycobacterium avium subsp. paratuberculosis
cgcugggcggcgacaucg

SEQ ID NO: 949207 - RNA, 21 nt, Mycobacterium avium subsp. paratuberculosis
cgcugggcggcgacaucgccg

SEQ ID NO: 949208 - RNA, 22 nt, Mycobacterium avium subsp. paratuberculosis
cgcugggcggcgcggcggucgg

SEQ ID NO: 949209 - RNA, 15 nt, Mycobacterium avium subsp. paratuberculosis
cgcuggauguccagg

SEQ ID NO: 949210 - RNA, 22 nt, Mycobacterium avium subsp. paratuberculosis
cgcuggauguccaggccgucga

SEQ ID NO: 949211 - RNA, 22 nt, Mycobacterium avium subsp. paratuberculosis
cgcuggauuccaccguggucgg

SEQ ID NO: 949212 - RNA, 20 nt, Mycobacterium avium subsp. paratuberculosis
cgcuggagauguugaucacg

SEQ ID NO: 949213 - RNA, 15 nt, Mycobacterium avium subsp. paratuberculosis
cgcuggccagcguca

SEQ ID NO: 949214 - RNA, 23 nt, Mycobacterium avium subsp. paratuberculosis
cgcuggccagcgucagggcgacu

SEQ ID NO: 949215 - RNA, 17 nt, Mycobacterium avium subsp. paratuberculosis
cgcuggccagcgcgacg

SEQ ID NO: 949216 - RNA, 19 nt, Mycobacterium avium subsp. paratuberculosis
cgcuggccagcgcgacggc

SEQ ID NO: 949217 - RNA, 23 nt, Mycobacterium avium subsp. paratuberculosis
cgcuggccagcgcgacggccucg

SEQ ID NO: 949218 - RNA, 14 nt, Mycobacterium avium subsp. paratuberculosis
cgcuggccgagagc

SEQ ID NO: 949219 - RNA, 15 nt, Mycobacterium avium subsp. paratuberculosis
cgcuggccgagagcc

SEQ ID NO: 949220 - RNA, 18 nt, Mycobacterium avium subsp. paratuberculosis
cgcuggccgaggccucca

SEQ ID NO: 949221 - RNA, 13 nt, Mycobacterium avium subsp. paratuberculosis
cgcuggcccggcg

SEQ ID NO: 949222 - RNA, 23 nt, Mycobacterium avium subsp. paratuberculosis
cgcuggaaaccucuugcggcgca

SEQ ID NO: 949223 - RNA, 22 nt, Mycobacterium avium subsp. paratuberculosis
cgcuggacagccacagcucggg

SEQ ID NO: 949224 - RNA, 15 nt, Mycobacterium avium subsp. paratuberculosis
cgcuggaacgccgag

SEQ ID NO: 949225 - RNA, 17 nt, Mycobacterium avium subsp. paratuberculosis
cgcuggaagucggucug

SEQ ID NO: 949226 - RNA, 16 nt, Mycobacterium avium subsp. paratuberculosis
cgcugcuugacccgcu

SEQ ID NO: 949227 - RNA, 17 nt, Mycobacterium avium subsp. paratuberculosis
cgcugcuugacccgcuc

SEQ ID NO: 949228 - RNA, 17 nt, Mycobacterium avium subsp. paratuberculosis
cgcugcuggucuugccg

SEQ ID NO: 949229 - RNA, 13 nt, Mycobacterium avium subsp. paratuberculosis
cgcugcugcucgg

SEQ ID NO: 949230 - RNA, 13 nt, Mycobacterium avium subsp. paratuberculosis
cgcugcugcugcc

SEQ ID NO: 949231 - RNA, 16 nt, Mycobacterium avium subsp. paratuberculosis
cgcugcgccggcggua

SEQ ID NO: 949232 - RNA, 12 nt, Mycobacterium avium subsp. paratuberculosis
cgcugcgccggg

SEQ ID NO: 949233 - RNA, 13 nt, Mycobacterium avium subsp. paratuberculosis
cgcugcgccgggu

SEQ ID NO: 949234 - RNA, 14 nt, Mycobacterium avium subsp. paratuberculosis
cgcugcgccgggug

SEQ ID NO: 949235 - RNA, 13 nt, Mycobacterium avium subsp. paratuberculosis
cgcugcgccggcg

SEQ ID NO: 949236 - RNA, 14 nt, Mycobacterium avium subsp. paratuberculosis
cgcugcgccggcgc

SEQ ID NO: 949237 - RNA, 15 nt, Mycobacterium avium subsp. paratuberculosis
cgcugcgccggcgcg

SEQ ID NO: 949238 - RNA, 14 nt, Mycobacterium avium subsp. paratuberculosis
cgcugcgcgggucg

SEQ ID NO: 949239 - RNA, 15 nt, Mycobacterium avium subsp. paratuberculosis
cgcugcgcgggucgg

SEQ ID NO: 949240 - RNA, 21 nt, Mycobacterium avium subsp. paratuberculosis
cgcugcgcgggucggcgccgg

SEQ ID NO: 949241 - RNA, 12 nt, Mycobacterium avium subsp. paratuberculosis
cgcugcgcggug

SEQ ID NO: 949242 - RNA, 12 nt, Mycobacterium avium subsp. paratuberculosis
cgcugcgcgcgu

SEQ ID NO: 949243 - RNA, 15 nt, Mycobacterium avium subsp. paratuberculosis
cgcugcgcgacaccu

SEQ ID NO: 949244 - RNA, 18 nt, Mycobacterium avium subsp. paratuberculosis
cgcugcgcgacaccugcu

SEQ ID NO: 949245 - RNA, 21 nt, Mycobacterium avium subsp. paratuberculosis
cgcugcgcgacaccugcucac

SEQ ID NO: 949246 - RNA, 13 nt, Mycobacterium avium subsp. paratuberculosis
cgcugcgcgccga

SEQ ID NO: 949247 - RNA, 15 nt, Mycobacterium avium subsp. paratuberculosis
cgcugcgcgccgauc

SEQ ID NO: 949248 - RNA, 20 nt, Mycobacterium avium subsp. paratuberculosis
cgcugcggcaaugccguugg

SEQ ID NO: 949249 - RNA, 18 nt, Mycobacterium avium subsp. paratuberculosis
cgcugcggcacaccagcg

SEQ ID NO: 949250 - RNA, 24 nt, Mycobacterium avium subsp. paratuberculosis
cgcugcggcacaccagcguucguc

SEQ ID NO: 949251 - RNA, 14 nt, Mycobacterium avium subsp. paratuberculosis
cgcugcggcgcagu

SEQ ID NO: 949252 - RNA, 14 nt, Mycobacterium avium subsp. paratuberculosis
cgcugcggcgccgg

SEQ ID NO: 949253 - RNA, 15 nt, Mycobacterium avium subsp. paratuberculosis
cgcugcggcgccggg

SEQ ID NO: 949254 - RNA, 16 nt, Mycobacterium avium subsp. paratuberculosis
cgcugcggcgccgggc

SEQ ID NO: 949255 - RNA, 16 nt, Mycobacterium avium subsp. paratuberculosis
cgcugcgcgcgcgauc

SEQ ID NO: 949256 - RNA, 14 nt, Mycobacterium avium subsp. paratuberculosis
cgcugcgcucgccg

SEQ ID NO: 949257 - RNA, 18 nt, Mycobacterium avium subsp. paratuberculosis
cgcugcgcuucgagcaga

SEQ ID NO: 949258 - RNA, 19 nt, Mycobacterium avium subsp. paratuberculosis
cgcugcggauaaccgucca

SEQ ID NO: 949259 - RNA, 17 nt, Mycobacterium avium subsp. paratuberculosis
cgcugcucugcgcgcgg

SEQ ID NO: 949260 - RNA, 20 nt, Mycobacterium avium subsp. paratuberculosis
cgcugcucugcgcgcggugc

SEQ ID NO: 949261 - RNA, 18 nt, Mycobacterium avium subsp. paratuberculosis
cgcugcucuuguccgcgu

SEQ ID NO: 949262 - RNA, 21 nt, Mycobacterium avium subsp. paratuberculosis
cgcugcucuuguccgcguugg

SEQ ID NO: 949263 - RNA, 18 nt, Mycobacterium avium subsp. paratuberculosis
cgcugcucgaccucggcg

SEQ ID NO: 949264 - RNA, 20 nt, Mycobacterium avium subsp. paratuberculosis
cgcugcucgaccucggcgac

SEQ ID NO: 949265 - RNA, 21 nt, Mycobacterium avium subsp. paratuberculosis
cgcugcucgaccucggcgacc

SEQ ID NO: 949266 - RNA, 22 nt, Mycobacterium avium subsp. paratuberculosis
cgcugcucgaccucggcgacca

SEQ ID NO: 949267 - RNA, 20 nt, Mycobacterium avium subsp. paratuberculosis
cgcugcucaugagcccucca

SEQ ID NO: 949268 - RNA, 18 nt, Mycobacterium avium subsp. paratuberculosis
cgcugcuccggguccgcg

SEQ ID NO: 949269 - RNA, 21 nt, Mycobacterium avium subsp. paratuberculosis
cgcugcuccggguccgcggug

SEQ ID NO: 949270 - RNA, 16 nt, Mycobacterium avium subsp. paratuberculosis
cgcugcgggccaucga

SEQ ID NO: 949271 - RNA, 12 nt, Mycobacterium avium subsp. paratuberculosis
cgcugcgggcgg

SEQ ID NO: 949272 - RNA, 18 nt, Mycobacterium avium subsp. paratuberculosis
cgcugcgggcgggccgcc

SEQ ID NO: 949273 - RNA, 19 nt, Mycobacterium avium subsp. paratuberculosis
cgcugcgggcgggccgcca

SEQ ID NO: 949274 - RNA, 22 nt, Mycobacterium avium subsp. paratuberculosis
cgcugcgggcgggccgccaggu

SEQ ID NO: 949275 - RNA, 12 nt, Mycobacterium avium subsp. paratuberculosis
cgcugcggaucc

SEQ ID NO: 949276 - RNA, 15 nt, Mycobacterium avium subsp. paratuberculosis
cgcugcggaugucgg

SEQ ID NO: 949277 - RNA, 14 nt, Mycobacterium avium subsp. paratuberculosis
cgcugcggcuggga

SEQ ID NO: 949278 - RNA, 18 nt, Mycobacterium avium subsp. paratuberculosis
cgcggcuucagucccgcg

SEQ ID NO: 949279 - RNA, 15 nt, Mycobacterium avium subsp. paratuberculosis
cgcggcuggugccgc

SEQ ID NO: 949280 - RNA, 17 nt, Mycobacterium avium subsp. paratuberculosis
cgcggcuggugccgccg

SEQ ID NO: 949281 - RNA, 20 nt, Mycobacterium avium subsp. paratuberculosis
cgcggcuggugccgccggcg

SEQ ID NO: 949282 - RNA, 16 nt, Mycobacterium avium subsp. paratuberculosis
cgcggcuugcugcggu

SEQ ID NO: 949283 - RNA, 23 nt, Mycobacterium avium subsp. paratuberculosis
cgcggcuuggccaccaccacgga

SEQ ID NO: 949284 - RNA, 21 nt, Mycobacterium avium subsp. paratuberculosis
cgcggcuucauaugacgccgg

SEQ ID NO: 949285 - RNA, 22 nt, Mycobacterium avium subsp. paratuberculosis
cgcggcuucauaugacgccggc

SEQ ID NO: 949286 - RNA, 23 nt, Mycobacterium avium subsp. paratuberculosis
cgcggcuucauaugacgccggcc

SEQ ID NO: 949287 - RNA, 19 nt, Mycobacterium avium subsp. paratuberculosis
cgcgggaguccacgccgug

SEQ ID NO: 949288 - RNA, 20 nt, Mycobacterium avium subsp. paratuberculosis
cgcgggaguggccggcgucc

SEQ ID NO: 949289 - RNA, 12 nt, Mycobacterium avium subsp. paratuberculosis
cgcgggaucagc

SEQ ID NO: 949290 - RNA, 13 nt, Mycobacterium avium subsp. paratuberculosis
cgcgggaucagcg

SEQ ID NO: 949291 - RNA, 13 nt, Mycobacterium avium subsp. paratuberculosis
cgcgggaucggcc

SEQ ID NO: 949292 - RNA, 15 nt, Mycobacterium avium subsp. paratuberculosis
cgcgggaucggccgg

SEQ ID NO: 949293 - RNA, 16 nt, Mycobacterium avium subsp. paratuberculosis
cgcgggaucggccggc

SEQ ID NO: 949294 - RNA, 15 nt, Mycobacterium avium subsp. paratuberculosis
cgcggcugccggugc

SEQ ID NO: 949295 - RNA, 16 nt, Mycobacterium avium subsp. paratuberculosis
cgcggcugccggugcu

SEQ ID NO: 949296 - RNA, 15 nt, Mycobacterium avium subsp. paratuberculosis
cgcggcugcucgaac

SEQ ID NO: 949297 - RNA, 14 nt, Mycobacterium avium subsp. paratuberculosis
cgcggcuggcccgg

SEQ ID NO: 949298 - RNA, 15 nt, Mycobacterium avium subsp. paratuberculosis
cgcggcuggcccggc

SEQ ID NO: 949299 - RNA, 18 nt, Mycobacterium avium subsp. paratuberculosis
cgcggcuggcccggcgcg

SEQ ID NO: 949300 - RNA, 20 nt, Mycobacterium avium subsp. paratuberculosis
cgcggcuggcccggcgcggc

SEQ ID NO: 949301 - RNA, 21 nt, Mycobacterium avium subsp. paratuberculosis
cgcggcuggcccggcgcggcg

SEQ ID NO: 949302 - RNA, 16 nt, Mycobacterium avium subsp. paratuberculosis
cgcggcuggccgcggc

SEQ ID NO: 949303 - RNA, 20 nt, Mycobacterium avium subsp. paratuberculosis
cgcggcuggccgcggcgauc

SEQ ID NO: 949304 - RNA, 22 nt, Mycobacterium avium subsp. paratuberculosis
cgcggcuggccgcggcgaucgg

SEQ ID NO: 949305 - RNA, 23 nt, Mycobacterium avium subsp. paratuberculosis
cgcggcuggccgcggcgaucggc

SEQ ID NO: 949306 - RNA, 13 nt, Mycobacterium avium subsp. paratuberculosis
cgcggcuggccgu

SEQ ID NO: 949307 - RNA, 15 nt, Mycobacterium avium subsp. paratuberculosis
cgcggcuggccgucg

SEQ ID NO: 949308 - RNA, 16 nt, Mycobacterium avium subsp. paratuberculosis
cgcggcuggccgucgu

SEQ ID NO: 949309 - RNA, 19 nt, Mycobacterium avium subsp. paratuberculosis
cgcggcugaucagccggcg

SEQ ID NO: 949310 - RNA, 13 nt, Mycobacterium avium subsp. paratuberculosis
cgcggcucggucg

SEQ ID NO: 949311 - RNA, 14 nt, Mycobacterium avium subsp. paratuberculosis
cgcggcucgcgacg

SEQ ID NO: 949312 - RNA, 14 nt, Mycobacterium avium subsp. paratuberculosis
cgcggcucgcgcgg

SEQ ID NO: 949313 - RNA, 15 nt, Mycobacterium avium subsp. paratuberculosis
cgcggcucgcgggcg

SEQ ID NO: 949314 - RNA, 18 nt, Mycobacterium avium subsp. paratuberculosis
cgcggcucgcgggcgaug

SEQ ID NO: 949315 - RNA, 22 nt, Mycobacterium avium subsp. paratuberculosis
cgcggcucacagcgcggcggug

SEQ ID NO: 949316 - RNA, 23 nt, Mycobacterium avium subsp. paratuberculosis
cgcggcucacagcgcggcgguga

SEQ ID NO: 949317 - RNA, 15 nt, Mycobacterium avium subsp. paratuberculosis
cgcggcuccggccgc

SEQ ID NO: 949318 - RNA, 19 nt, Mycobacterium avium subsp. paratuberculosis
cgcggcuccggccgcgccg

SEQ ID NO: 949319 - RNA, 22 nt, Mycobacterium avium subsp. paratuberculosis
cgcggcuccggccgcgccggcc

SEQ ID NO: 949320 - RNA, 12 nt, Mycobacterium avium subsp. paratuberculosis
cgcggcgucggg

SEQ ID NO: 949321 - RNA, 13 nt, Mycobacterium avium subsp. paratuberculosis
cgcggcgucggga

SEQ ID NO: 949322 - RNA, 20 nt, Mycobacterium avium subsp. paratuberculosis
cgcggcgucgggauggucga

SEQ ID NO: 949323 - RNA, 14 nt, Mycobacterium avium subsp. paratuberculosis
cgcggcgucgggcg

SEQ ID NO: 949324 - RNA, 13 nt, Mycobacterium avium subsp. paratuberculosis
cgcggcgucgggu

SEQ ID NO: 949325 - RNA, 23 nt, Mycobacterium avium subsp. paratuberculosis
cgcggcgucggguagggcgccgu

SEQ ID NO: 949326 - RNA, 18 nt, Mycobacterium avium subsp. paratuberculosis
cgcggcuaguuggccggc

SEQ ID NO: 949327 - RNA, 20 nt, Mycobacterium avium subsp. paratuberculosis
cgcggcuaguuggccggcuu

SEQ ID NO: 949328 - RNA, 14 nt, Mycobacterium avium subsp. paratuberculosis
cgcggcgucgcggu

SEQ ID NO: 949329 - RNA, 15 nt, Mycobacterium avium subsp. paratuberculosis
cgcggcgucggccgg

SEQ ID NO: 949330 - RNA, 19 nt, Mycobacterium avium subsp. paratuberculosis
cgcggcgucggccgggcug

SEQ ID NO: 949331 - RNA, 14 nt, Mycobacterium avium subsp. paratuberculosis
cgcggcgucggccu

SEQ ID NO: 949332 - RNA, 23 nt, Mycobacterium avium subsp. paratuberculosis
cgcggcguccucgaugacgccgg

SEQ ID NO: 949333 - RNA, 14 nt, Mycobacterium avium subsp. paratuberculosis
cgcggcguagccgc

SEQ ID NO: 949334 - RNA, 15 nt, Mycobacterium avium subsp. paratuberculosis
cgcggcguagccgcc

SEQ ID NO: 949335 - RNA, 18 nt, Mycobacterium avium subsp. paratuberculosis
cgcggcguagccgccggu

SEQ ID NO: 949336 - RNA, 21 nt, Mycobacterium avium subsp. paratuberculosis
cgcggcguagcgccagucgcg

SEQ ID NO: 949337 - RNA, 24 nt, Mycobacterium avium subsp. paratuberculosis
cgcggcguagcgccagucgcggcg

SEQ ID NO: 949338 - RNA, 21 nt, Mycobacterium avium subsp. paratuberculosis
cgcggcguaggugggcagcgc

SEQ ID NO: 949339 - RNA, 22 nt, Mycobacterium avium subsp. paratuberculosis
cgcggcguaggugggcagcgcg

SEQ ID NO: 949340 - RNA, 23 nt, Mycobacterium avium subsp. paratuberculosis
cgcggcguaggugggcagcgcgg

SEQ ID NO: 949341 - RNA, 16 nt, Mycobacterium avium subsp. paratuberculosis
cgcggcguccaccagc

SEQ ID NO: 949342 - RNA, 19 nt, Mycobacterium avium subsp. paratuberculosis
cgcggcguccaccagcacg

SEQ ID NO: 949343 - RNA, 13 nt, Mycobacterium avium subsp. paratuberculosis
cgcggcggugccg

SEQ ID NO: 949344 - RNA, 12 nt, Mycobacterium avium subsp. paratuberculosis
aacagccgaccg

SEQ ID NO: 949345 - RNA, 19 nt, Mycobacterium avium subsp. paratuberculosis
aacagccggcccgagcccu

SEQ ID NO: 949346 - RNA, 16 nt, Mycobacterium avium subsp. paratuberculosis
cgcggcgcagcucgcg

SEQ ID NO: 949347 - RNA, 22 nt, Mycobacterium avium subsp. paratuberculosis
aacagccggcucagggugcgcu

SEQ ID NO: 949348 - RNA, 17 nt, Mycobacterium avium subsp. paratuberculosis
aacagcagcgccgcggc

SEQ ID NO: 949349 - RNA, 14 nt, Mycobacterium avium subsp. paratuberculosis
aacagcagcgcgcc

SEQ ID NO: 949350 - RNA, 17 nt, Mycobacterium avium subsp. paratuberculosis
aacagcagcgcgccgac

SEQ ID NO: 949351 - RNA, 15 nt, Mycobacterium avium subsp. paratuberculosis
cgcggcgcagguccg

SEQ ID NO: 949352 - RNA, 21 nt, Mycobacterium avium subsp. paratuberculosis
cgcggcgcagguccggcagcg

SEQ ID NO: 949353 - RNA, 22 nt, Mycobacterium avium subsp. paratuberculosis
cgcggcgcagguccggcagcgc

SEQ ID NO: 949354 - RNA, 14 nt, Mycobacterium avium subsp. paratuberculosis
cgcggcgcagcgcg

SEQ ID NO: 949355 - RNA, 20 nt, Mycobacterium avium subsp. paratuberculosis
cgcggcgcagggcggccggc

SEQ ID NO: 949356 - RNA, 21 nt, Mycobacterium avium subsp. paratuberculosis
cgcggcgcagggcggccggcc

SEQ ID NO: 949357 - RNA, 15 nt, Mycobacterium avium subsp. paratuberculosis
cgcggcgcacccggg

SEQ ID NO: 949358 - RNA, 14 nt, Mycobacterium avium subsp. paratuberculosis
cgcggcgcaccgag

SEQ ID NO: 949359 - RNA, 20 nt, Mycobacterium avium subsp. paratuberculosis
cgcggcgcaccgcccgcggu

SEQ ID NO: 949360 - RNA, 13 nt, Mycobacterium avium subsp. paratuberculosis
cgcggcgcacggu

SEQ ID NO: 949361 - RNA, 20 nt, Mycobacterium avium subsp. paratuberculosis
cgcggcgcacguggcugacc

SEQ ID NO: 949362 - RNA, 18 nt, Mycobacterium avium subsp. paratuberculosis
cgcggcggugcgcagccg

SEQ ID NO: 949363 - RNA, 16 nt, Mycobacterium avium subsp. paratuberculosis
cgcggcggugcucgcg

SEQ ID NO: 949364 - RNA, 21 nt, Mycobacterium avium subsp. paratuberculosis
cgcggcggugcucgcgccggg

SEQ ID NO: 949365 - RNA, 22 nt, Mycobacterium avium subsp. paratuberculosis
cgcggcggugcucgcgccgggc

SEQ ID NO: 949366 - RNA, 15 nt, Mycobacterium avium subsp. paratuberculosis
cgcggcgguggccug

SEQ ID NO: 949367 - RNA, 23 nt, Mycobacterium avium subsp. paratuberculosis
cgcggcgguggccugcccggcgg

SEQ ID NO: 949368 - RNA, 14 nt, Mycobacterium avium subsp. paratuberculosis
cgcggcggugucgg

SEQ ID NO: 949369 - RNA, 14 nt, Mycobacterium avium subsp. paratuberculosis
cgcggcggcggugc

SEQ ID NO: 949370 - RNA, 20 nt, Mycobacterium avium subsp. paratuberculosis
cgcggcggcguccgcggccg

SEQ ID NO: 949371 - RNA, 15 nt, Mycobacterium avium subsp. paratuberculosis
cgcggcggcgucgac

SEQ ID NO: 949372 - RNA, 20 nt, Mycobacterium avium subsp. paratuberculosis
cgcggcggcgucgaccgccc

SEQ ID NO: 949373 - RNA, 14 nt, Mycobacterium avium subsp. paratuberculosis
cgcggcggcgucgg

SEQ ID NO: 949374 - RNA, 15 nt, Mycobacterium avium subsp. paratuberculosis
cgcggcggcgucggc

SEQ ID NO: 949375 - RNA, 23 nt, Mycobacterium avium subsp. paratuberculosis
cgcggcggugagccgccacagcg

SEQ ID NO: 949376 - RNA, 16 nt, Mycobacterium avium subsp. paratuberculosis
cgcggcggcgacgucg

SEQ ID NO: 949377 - RNA, 18 nt, Mycobacterium avium subsp. paratuberculosis
cgcggcggcgacgucgac

SEQ ID NO: 949378 - RNA, 19 nt, Mycobacterium avium subsp. paratuberculosis
cgcggcggcgccgacgggc

SEQ ID NO: 949379 - RNA, 22 nt, Mycobacterium avium subsp. paratuberculosis
cgcggcggcgccgacgggcccg

SEQ ID NO: 949380 - RNA, 14 nt, Mycobacterium avium subsp. paratuberculosis
cgcggcggcgccgc

SEQ ID NO: 949381 - RNA, 16 nt, Mycobacterium avium subsp. paratuberculosis
cgcggcggcgccgcag

SEQ ID NO: 949382 - RNA, 16 nt, Mycobacterium avium subsp. paratuberculosis
cgcggcggcgccgucg

SEQ ID NO: 949383 - RNA, 20 nt, Mycobacterium avium subsp. paratuberculosis
cgcggcggcgccgucgccga

SEQ ID NO: 949384 - RNA, 14 nt, Mycobacterium avium subsp. paratuberculosis
cgcggcggccucgg

SEQ ID NO: 949385 - RNA, 24 nt, Mycobacterium avium subsp. paratuberculosis
cgcggcggccuggccgucgcggcg

SEQ ID NO: 949386 - RNA, 12 nt, Mycobacterium avium subsp. paratuberculosis
cgcggcgccgga

SEQ ID NO: 949387 - RNA, 20 nt, Mycobacterium avium subsp. paratuberculosis
cgcggcgccggaugggcgca

SEQ ID NO: 949388 - RNA, 18 nt, Mycobacterium avium subsp. paratuberculosis
cgcggcggccaacgcgac

SEQ ID NO: 949389 - RNA, 16 nt, Mycobacterium avium subsp. paratuberculosis
cgcggcggccaccucg

SEQ ID NO: 949390 - RNA, 12 nt, Mycobacterium avium subsp. paratuberculosis
cgcggcggccag

SEQ ID NO: 949391 - RNA, 13 nt, Mycobacterium avium subsp. paratuberculosis
cgcggcggccagc

SEQ ID NO: 949392 - RNA, 15 nt, Mycobacterium avium subsp. paratuberculosis
cgcggcggcccggcg

SEQ ID NO: 949393 - RNA, 16 nt, Mycobacterium avium subsp. paratuberculosis
cgcggcggcccggcgu

SEQ ID NO: 949394 - RNA, 22 nt, Mycobacterium avium subsp. paratuberculosis
cgcggcggcccgucgccaccac

SEQ ID NO: 949395 - RNA, 11 nt, Mycobacterium avium subsp. paratuberculosis
cgcggcggccg

SEQ ID NO: 949396 - RNA, 13 nt, Mycobacterium avium subsp. paratuberculosis
cgcggcggccgac

SEQ ID NO: 949397 - RNA, 21 nt, Mycobacterium avium subsp. paratuberculosis
cgcggcggccgacagcgcguc

SEQ ID NO: 949398 - RNA, 22 nt, Mycobacterium avium subsp. paratuberculosis
cgcggcggccgacagcgcgucg

SEQ ID NO: 949399 - RNA, 15 nt, Mycobacterium avium subsp. paratuberculosis
cgcggcggccgacgc

SEQ ID NO: 949400 - RNA, 17 nt, Mycobacterium avium subsp. paratuberculosis
cgcggcggccgacgcgc

SEQ ID NO: 949401 - RNA, 21 nt, Mycobacterium avium subsp. paratuberculosis
cgcggcggccgacgcgccguc

SEQ ID NO: 949402 - RNA, 14 nt, Mycobacterium avium subsp. paratuberculosis
cgcggcggccggcc

SEQ ID NO: 949403 - RNA, 17 nt, Mycobacterium avium subsp. paratuberculosis
cgcggcggccggccagc

SEQ ID NO: 949404 - RNA, 17 nt, Mycobacterium avium subsp. paratuberculosis
cgcggcggccggcgaug

SEQ ID NO: 949405 - RNA, 16 nt, Mycobacterium avium subsp. paratuberculosis
cgcggcggccggcgcc

SEQ ID NO: 949406 - RNA, 19 nt, Mycobacterium avium subsp. paratuberculosis
cgcggcggccggcgccgac

SEQ ID NO: 949407 - RNA, 12 nt, Mycobacterium avium subsp. paratuberculosis
cgcggcgccggg

SEQ ID NO: 949408 - RNA, 14 nt, Mycobacterium avium subsp. paratuberculosis
cgcggcgccgggcg

SEQ ID NO: 949409 - RNA, 12 nt, Mycobacterium avium subsp. paratuberculosis
cgcggcgccggu

SEQ ID NO: 949410 - RNA, 13 nt, Mycobacterium avium subsp. paratuberculosis
cgcggcgccgguu

SEQ ID NO: 949411 - RNA, 11 nt, Mycobacterium avium subsp. paratuberculosis
cgcggcgccgu

SEQ ID NO: 949412 - RNA, 13 nt, Mycobacterium avium subsp. paratuberculosis
cgcggcgccguag

SEQ ID NO: 949413 - RNA, 14 nt, Mycobacterium avium subsp. paratuberculosis
cgcggcgccgcggc

SEQ ID NO: 949414 - RNA, 19 nt, Mycobacterium avium subsp. paratuberculosis
cgcggcgccgcggcggcac

SEQ ID NO: 949415 - RNA, 13 nt, Mycobacterium avium subsp. paratuberculosis
cgcggcgccgacg

SEQ ID NO: 949416 - RNA, 16 nt, Mycobacterium avium subsp. paratuberculosis
cgcggcgccgacgucc

SEQ ID NO: 949417 - RNA, 22 nt, Mycobacterium avium subsp. paratuberculosis
cgcggccugggugaccgagucg

SEQ ID NO: 949418 - RNA, 14 nt, Mycobacterium avium subsp. paratuberculosis
cgcggccugcgggc

SEQ ID NO: 949419 - RNA, 18 nt, Mycobacterium avium subsp. paratuberculosis
cgcggccugcgggcgccg

SEQ ID NO: 949420 - RNA, 18 nt, Mycobacterium avium subsp. paratuberculosis
cgcggccugcagcaccga

SEQ ID NO: 949421 - RNA, 19 nt, Mycobacterium avium subsp. paratuberculosis
cgcggccugcagcaccgaa

SEQ ID NO: 949422 - RNA, 22 nt, Mycobacterium avium subsp. paratuberculosis
cgcggccugcagcaccgaaccg

SEQ ID NO: 949423 - RNA, 20 nt, Mycobacterium avium subsp. paratuberculosis
cgcggccucucagcgcuguc

SEQ ID NO: 949424 - RNA, 12 nt, Mycobacterium avium subsp. paratuberculosis
cgcggccgcaug

SEQ ID NO: 949425 - RNA, 13 nt, Mycobacterium avium subsp. paratuberculosis
cgcggccucggcg

SEQ ID NO: 949426 - RNA, 16 nt, Mycobacterium avium subsp. paratuberculosis
cgcggccucggcgucg

SEQ ID NO: 949427 - RNA, 20 nt, Mycobacterium avium subsp. paratuberculosis
cgcggccgccucccgcagcg

SEQ ID NO: 949428 - RNA, 24 nt, Mycobacterium avium subsp. paratuberculosis
cgcggccgccuucacgaccggcag

SEQ ID NO: 949429 - RNA, 15 nt, Mycobacterium avium subsp. paratuberculosis
cgcggccgcgacugc

SEQ ID NO: 949430 - RNA, 21 nt, Mycobacterium avium subsp. paratuberculosis
cgcggccgcgacugcagguga

SEQ ID NO: 949431 - RNA, 14 nt, Mycobacterium avium subsp. paratuberculosis
cgcggccgccgcga

SEQ ID NO: 949432 - RNA, 16 nt, Mycobacterium avium subsp. paratuberculosis
cgcggccgccgcgacg

SEQ ID NO: 949433 - RNA, 17 nt, Mycobacterium avium subsp. paratuberculosis
cgcggccgccgcgacgg

SEQ ID NO: 949434 - RNA, 13 nt, Mycobacterium avium subsp. paratuberculosis
cgcggccgcccgg

SEQ ID NO: 949435 - RNA, 14 nt, Mycobacterium avium subsp. paratuberculosis
cgcggccgcccggu

SEQ ID NO: 949436 - RNA, 18 nt, Mycobacterium avium subsp. paratuberculosis
cgcggccgcccgguccgg

SEQ ID NO: 949437 - RNA, 13 nt, Mycobacterium avium subsp. paratuberculosis
cgcggccgcccgu

SEQ ID NO: 949438 - RNA, 11 nt, Mycobacterium avium subsp. paratuberculosis
cgcggccgccg

SEQ ID NO: 949439 - RNA, 17 nt, Mycobacterium avium subsp. paratuberculosis
cgcggccgauucggcgc

SEQ ID NO: 949440 - RNA, 13 nt, Mycobacterium avium subsp. paratuberculosis
cgcggccgagccg

SEQ ID NO: 949441 - RNA, 19 nt, Mycobacterium avium subsp. paratuberculosis
cgcggccgccagcgcaccg

SEQ ID NO: 949442 - RNA, 13 nt, Mycobacterium avium subsp. paratuberculosis
cgcggccgccagg

SEQ ID NO: 949443 - RNA, 14 nt, Mycobacterium avium subsp. paratuberculosis
cgcggccgccaggu

SEQ ID NO: 949444 - RNA, 19 nt, Mycobacterium avium subsp. paratuberculosis
cgcggccgccaucgaucgg

SEQ ID NO: 949445 - RNA, 22 nt, Mycobacterium avium subsp. paratuberculosis
cgcggccgccaucgaucgggcg

SEQ ID NO: 949446 - RNA, 12 nt, Mycobacterium avium subsp. paratuberculosis
cgcggccgccca

SEQ ID NO: 949447 - RNA, 16 nt, Mycobacterium avium subsp. paratuberculosis
cgcggccgcccagccc

SEQ ID NO: 949448 - RNA, 13 nt, Mycobacterium avium subsp. paratuberculosis
cgcggcgagcagc

SEQ ID NO: 949449 - RNA, 15 nt, Mycobacterium avium subsp. paratuberculosis
cgcggcgagcagcgc

SEQ ID NO: 949450 - RNA, 18 nt, Mycobacterium avium subsp. paratuberculosis
cgcggcgauggacgucca

SEQ ID NO: 949451 - RNA, 21 nt, Mycobacterium avium subsp. paratuberculosis
cgcggcgauggacguccagcg

SEQ ID NO: 949452 - RNA, 23 nt, Mycobacterium avium subsp. paratuberculosis
cgcggcgauggacguccagcggc

SEQ ID NO: 949453 - RNA, 16 nt, Mycobacterium avium subsp. paratuberculosis
cgcggcgauggcccgc

SEQ ID NO: 949454 - RNA, 21 nt, Mycobacterium avium subsp. paratuberculosis
cgcggcgauggcccgcugcgc

SEQ ID NO: 949455 - RNA, 17 nt, Mycobacterium avium subsp. paratuberculosis
cgcggcgauggccgaca

SEQ ID NO: 949456 - RNA, 21 nt, Mycobacterium avium subsp. paratuberculosis
cgcggcgauggugggcagccg

SEQ ID NO: 949457 - RNA, 23 nt, Mycobacterium avium subsp. paratuberculosis
cgcggcgauggugggcagccggc

SEQ ID NO: 949458 - RNA, 13 nt, Mycobacterium avium subsp. paratuberculosis
cgcggcgacccgc

SEQ ID NO: 949459 - RNA, 14 nt, Mycobacterium avium subsp. paratuberculosis
cgcggcgacccgcu

SEQ ID NO: 949460 - RNA, 23 nt, Mycobacterium avium subsp. paratuberculosis
cgcggcgacccgcuucgcccggc

SEQ ID NO: 949461 - RNA, 15 nt, Mycobacterium avium subsp. paratuberculosis
cgcggcgaccggggc

SEQ ID NO: 949462 - RNA, 17 nt, Mycobacterium avium subsp. paratuberculosis
cgcggcgaccggggcgg

SEQ ID NO: 949463 - RNA, 18 nt, Mycobacterium avium subsp. paratuberculosis
cgcggcgaccggggcggu

SEQ ID NO: 949464 - RNA, 17 nt, Mycobacterium avium subsp. paratuberculosis
cgcggcgacacccagcg

SEQ ID NO: 949465 - RNA, 18 nt, Mycobacterium avium subsp. paratuberculosis
cgcggcgacacccagcgg

SEQ ID NO: 949466 - RNA, 13 nt, Mycobacterium avium subsp. paratuberculosis
cgcggcgacggcg

SEQ ID NO: 949467 - RNA, 14 nt, Mycobacterium avium subsp. paratuberculosis
cgcggcgacggcga

SEQ ID NO: 949468 - RNA, 13 nt, Mycobacterium avium subsp. paratuberculosis
cgcggcgacggug

SEQ ID NO: 949469 - RNA, 16 nt, Mycobacterium avium subsp. paratuberculosis
cgcggcgacgucgugc

SEQ ID NO: 949470 - RNA, 17 nt, Mycobacterium avium subsp. paratuberculosis
cgcggcgacgucgugca

SEQ ID NO: 949471 - RNA, 22 nt, Mycobacterium avium subsp. paratuberculosis
cgcggcgacgucgugcacgccg

SEQ ID NO: 949472 - RNA, 12 nt, Mycobacterium avium subsp. paratuberculosis
cgcggccuugcg

SEQ ID NO: 949473 - RNA, 16 nt, Mycobacterium avium subsp. paratuberculosis
cgcggccuugcgagcc

SEQ ID NO: 949474 - RNA, 18 nt, Mycobacterium avium subsp. paratuberculosis
cgcggccuugcgagccgg

SEQ ID NO: 949475 - RNA, 17 nt, Mycobacterium avium subsp. paratuberculosis
cgcggccuugcgcaccg

SEQ ID NO: 949476 - RNA, 21 nt, Mycobacterium avium subsp. paratuberculosis
cgcggccuugcgggccggagc

SEQ ID NO: 949477 - RNA, 16 nt, Mycobacterium avium subsp. paratuberculosis
cgcggcgaaaacgccu

SEQ ID NO: 949478 - RNA, 21 nt, Mycobacterium avium subsp. paratuberculosis
cgcggccuucuuggccggagc

SEQ ID NO: 949479 - RNA, 22 nt, Mycobacterium avium subsp. paratuberculosis
cgcggcgaacaccucggcgaug

SEQ ID NO: 949480 - RNA, 14 nt, Mycobacterium avium subsp. paratuberculosis
cgcggcgaaccagc

SEQ ID NO: 949481 - RNA, 19 nt, Mycobacterium avium subsp. paratuberculosis
cgcggcgaaccagcaugcg

SEQ ID NO: 949482 - RNA, 18 nt, Mycobacterium avium subsp. paratuberculosis
cgcggcgaacccgagcac

SEQ ID NO: 949483 - RNA, 19 nt, Mycobacterium avium subsp. paratuberculosis
cgcggcgaacccgagcacc

SEQ ID NO: 949484 - RNA, 22 nt, Mycobacterium avium subsp. paratuberculosis
cgcggcgaacccgagcaccccg

SEQ ID NO: 949485 - RNA, 17 nt, Mycobacterium avium subsp. paratuberculosis
cgcggcgaagcaggcca

SEQ ID NO: 949486 - RNA, 16 nt, Mycobacterium avium subsp. paratuberculosis
cgcggcgaaggcaucc

SEQ ID NO: 949487 - RNA, 14 nt, Mycobacterium avium subsp. paratuberculosis
cgcggcgaaggcca

SEQ ID NO: 949488 - RNA, 20 nt, Mycobacterium avium subsp. paratuberculosis
cgcggcgaauccgagcaucg

SEQ ID NO: 949489 - RNA, 23 nt, Mycobacterium avium subsp. paratuberculosis
cgcggcgacauuggccgcgcgca

SEQ ID NO: 949490 - RNA, 15 nt, Mycobacterium avium subsp. paratuberculosis
cgcggcgaccaccac

SEQ ID NO: 949491 - RNA, 17 nt, Mycobacterium avium subsp. paratuberculosis
cgcggcgaccaccaccg

SEQ ID NO: 949492 - RNA, 18 nt, Mycobacterium avium subsp. paratuberculosis
cgcggcgaccaccucggc

SEQ ID NO: 949493 - RNA, 22 nt, Mycobacterium avium subsp. paratuberculosis
cgcggccgaaaucaacgcgccg

SEQ ID NO: 949494 - RNA, 16 nt, Mycobacterium avium subsp. paratuberculosis
cgcggcccauggggga

SEQ ID NO: 949495 - RNA, 15 nt, Mycobacterium avium subsp. paratuberculosis
cgcggcccagcacca

SEQ ID NO: 949496 - RNA, 16 nt, Mycobacterium avium subsp. paratuberculosis
cgcggcccagcaccac

SEQ ID NO: 949497 - RNA, 18 nt, Mycobacterium avium subsp. paratuberculosis
cgcggcccagcaccaccu

SEQ ID NO: 949498 - RNA, 18 nt, Mycobacterium avium subsp. paratuberculosis
cgcggcccccacgcagcg

SEQ ID NO: 949499 - RNA, 20 nt, Mycobacterium avium subsp. paratuberculosis
cgcggcccccacgcagcggu

SEQ ID NO: 949500 - RNA, 19 nt, Mycobacterium avium subsp. paratuberculosis
cgcggcccccugaucggcc

SEQ ID NO: 949501 - RNA, 20 nt, Mycobacterium avium subsp. paratuberculosis
cgcggcccccugaucggccg

SEQ ID NO: 949502 - RNA, 17 nt, Mycobacterium avium subsp. paratuberculosis
cgcggcccaccgcgucg

SEQ ID NO: 949503 - RNA, 13 nt, Mycobacterium avium subsp. paratuberculosis
cgcggccagcacg

SEQ ID NO: 949504 - RNA, 17 nt, Mycobacterium avium subsp. paratuberculosis
cgcggccagcggcgccg

SEQ ID NO: 949505 - RNA, 18 nt, Mycobacterium avium subsp. paratuberculosis
cgcggccagcggcgccga

SEQ ID NO: 949506 - RNA, 19 nt, Mycobacterium avium subsp. paratuberculosis
cgcggccagcggcgccgaa

SEQ ID NO: 949507 - RNA, 15 nt, Mycobacterium avium subsp. paratuberculosis
cgcggccaggucgag

SEQ ID NO: 949508 - RNA, 14 nt, Mycobacterium avium subsp. paratuberculosis
cgcggccagcgcgc

SEQ ID NO: 949509 - RNA, 17 nt, Mycobacterium avium subsp. paratuberculosis
cgcggccagcgcgcggg

SEQ ID NO: 949510 - RNA, 22 nt, Mycobacterium avium subsp. paratuberculosis
cgcggccagccggucgucgggg

SEQ ID NO: 949511 - RNA, 12 nt, Mycobacterium avium subsp. paratuberculosis
cgcggccagcgc

SEQ ID NO: 949512 - RNA, 13 nt, Mycobacterium avium subsp. paratuberculosis
cgcggccagcgcc

SEQ ID NO: 949513 - RNA, 16 nt, Mycobacterium avium subsp. paratuberculosis
cgcggccagcgccccg

SEQ ID NO: 949514 - RNA, 21 nt, Mycobacterium avium subsp. paratuberculosis
cgcggccagcgccccgccggg

SEQ ID NO: 949515 - RNA, 14 nt, Mycobacterium avium subsp. paratuberculosis
cgcggccagcguga

SEQ ID NO: 949516 - RNA, 16 nt, Mycobacterium avium subsp. paratuberculosis
cgcggccagcgugaac

SEQ ID NO: 949517 - RNA, 19 nt, Mycobacterium avium subsp. paratuberculosis
cgcggccagcuccgggucg

SEQ ID NO: 949518 - RNA, 13 nt, Mycobacterium avium subsp. paratuberculosis
cgcggccagcucg

SEQ ID NO: 949519 - RNA, 14 nt, Mycobacterium avium subsp. paratuberculosis
cgcggccagcucgg

SEQ ID NO: 949520 - RNA, 13 nt, Mycobacterium avium subsp. paratuberculosis
cgcggccagcugc

SEQ ID NO: 949521 - RNA, 20 nt, Mycobacterium avium subsp. paratuberculosis
cgcggccagcugcccgccga

SEQ ID NO: 949522 - RNA, 16 nt, Mycobacterium avium subsp. paratuberculosis
cgcggccagccccggg

SEQ ID NO: 949523 - RNA, 18 nt, Mycobacterium avium subsp. paratuberculosis
cgcggccagccccgggaa

SEQ ID NO: 949524 - RNA, 23 nt, Mycobacterium avium subsp. paratuberculosis
cgcggccagccccgggaaccagc

SEQ ID NO: 949525 - RNA, 11 nt, Mycobacterium avium subsp. paratuberculosis
cgcggccagca

SEQ ID NO: 949526 - RNA, 14 nt, Mycobacterium avium subsp. paratuberculosis
cgcggccagcacgg

SEQ ID NO: 949527 - RNA, 18 nt, Mycobacterium avium subsp. paratuberculosis
cgcggccagcacggucag

SEQ ID NO: 949528 - RNA, 24 nt, Mycobacterium avium subsp. paratuberculosis
cgcggccagcacggucagcggcca

SEQ ID NO: 949529 - RNA, 16 nt, Mycobacterium avium subsp. paratuberculosis
cgcggccacgcucggg

SEQ ID NO: 949530 - RNA, 19 nt, Mycobacterium avium subsp. paratuberculosis
cgcggccacgcucgggccg

SEQ ID NO: 949531 - RNA, 22 nt, Mycobacterium avium subsp. paratuberculosis
cgcggccacgcucgggccggcg

SEQ ID NO: 949532 - RNA, 23 nt, Mycobacterium avium subsp. paratuberculosis
cgcggccacgcucgggccggcgc

SEQ ID NO: 949533 - RNA, 14 nt, Mycobacterium avium subsp. paratuberculosis
cgcggccaccgcgc

SEQ ID NO: 949534 - RNA, 19 nt, Mycobacterium avium subsp. paratuberculosis
cgcggccaccgcgcgcugc

SEQ ID NO: 949535 - RNA, 20 nt, Mycobacterium avium subsp. paratuberculosis
cgcggccaccgcgcgcugcc

SEQ ID NO: 949536 - RNA, 14 nt, Mycobacterium avium subsp. paratuberculosis
cgcggccaccggga

SEQ ID NO: 949537 - RNA, 15 nt, Mycobacterium avium subsp. paratuberculosis
cgcggccaccgggac

SEQ ID NO: 949538 - RNA, 14 nt, Mycobacterium avium subsp. paratuberculosis
cgcggccaccgggu

SEQ ID NO: 949539 - RNA, 18 nt, Mycobacterium avium subsp. paratuberculosis
cgcggccaccuccagccc

SEQ ID NO: 949540 - RNA, 16 nt, Mycobacterium avium subsp. paratuberculosis
cgcggccacgcccugg

SEQ ID NO: 949541 - RNA, 19 nt, Mycobacterium avium subsp. paratuberculosis
cgcggccacgcccuggccg

SEQ ID NO: 949542 - RNA, 21 nt, Mycobacterium avium subsp. paratuberculosis
cgcggccacgcccuggccgcc

SEQ ID NO: 949543 - RNA, 23 nt, Mycobacterium avium subsp. paratuberculosis
cgcggccacgcccuggccgccgg

SEQ ID NO: 949544 - RNA, 14 nt, Mycobacterium avium subsp. paratuberculosis
cgcgcuugacggcc

SEQ ID NO: 949545 - RNA, 15 nt, Mycobacterium avium subsp. paratuberculosis
cgcgcuugacggccg

SEQ ID NO: 949546 - RNA, 18 nt, Mycobacterium avium subsp. paratuberculosis
cgcgcuugacggccgggc

SEQ ID NO: 949547 - RNA, 19 nt, Mycobacterium avium subsp. paratuberculosis
cgcgcuugacggccgggcc

SEQ ID NO: 949548 - RNA, 14 nt, Mycobacterium avium subsp. paratuberculosis
cgcgcuguucggga

SEQ ID NO: 949549 - RNA, 14 nt, Mycobacterium avium subsp. paratuberculosis
cgcgcuugccgcga

SEQ ID NO: 949550 - RNA, 16 nt, Mycobacterium avium subsp. paratuberculosis
cgcgcuugccgcgacc

SEQ ID NO: 949551 - RNA, 18 nt, Mycobacterium avium subsp. paratuberculosis
cgcgcuugcgaccgccgc

SEQ ID NO: 949552 - RNA, 15 nt, Mycobacterium avium subsp. paratuberculosis
cgcgcuugcgaucgc

SEQ ID NO: 949553 - RNA, 18 nt, Mycobacterium avium subsp. paratuberculosis
cgcgcuugcgaucgccgc

SEQ ID NO: 949554 - RNA, 21 nt, Mycobacterium avium subsp. paratuberculosis
cgcgcuugcgaucgccgcgca

SEQ ID NO: 949555 - RNA, 21 nt, Mycobacterium avium subsp. paratuberculosis
cgcgcuugggguucuuggcgu

SEQ ID NO: 949556 - RNA, 17 nt, Mycobacterium avium subsp. paratuberculosis
cgcgcuugguggcgacg

SEQ ID NO: 949557 - RNA, 17 nt, Mycobacterium avium subsp. paratuberculosis
cgcgcuuguacaggucg

SEQ ID NO: 949558 - RNA, 18 nt, Mycobacterium avium subsp. paratuberculosis
cgcgcuuguacaggucga

SEQ ID NO: 949559 - RNA, 17 nt, Mycobacterium avium subsp. paratuberculosis
cgcgcuguccucgucgg

SEQ ID NO: 949560 - RNA, 15 nt, Mycobacterium avium subsp. paratuberculosis
cgcgcugucgacgcg

SEQ ID NO: 949561 - RNA, 15 nt, Mycobacterium avium subsp. paratuberculosis
cgcgcugucgcccuc

SEQ ID NO: 949562 - RNA, 23 nt, Mycobacterium avium subsp. paratuberculosis
cgcgcugucgcccucgaucgcga

SEQ ID NO: 949563 - RNA, 14 nt, Mycobacterium avium subsp. paratuberculosis
cgcgcugugcgcca

SEQ ID NO: 949564 - RNA, 23 nt, Mycobacterium avium subsp. paratuberculosis
cgcgcugugcgccauguccggca

SEQ ID NO: 949565 - RNA, 21 nt, Mycobacterium avium subsp. paratuberculosis
cgcgcuggugcgggccagcac

SEQ ID NO: 949566 - RNA, 22 nt, Mycobacterium avium subsp. paratuberculosis
cgcgcuggugcgggccagcacg

SEQ ID NO: 949567 - RNA, 15 nt, Mycobacterium avium subsp. paratuberculosis
cgcgcuggugcugcc

SEQ ID NO: 949568 - RNA, 19 nt, Mycobacterium avium subsp. paratuberculosis
cgcgcuggugcugccgaac

SEQ ID NO: 949569 - RNA, 12 nt, Mycobacterium avium subsp. paratuberculosis
cgcgccgggcgu

SEQ ID NO: 949570 - RNA, 12 nt, Mycobacterium avium subsp. paratuberculosis
cgcgccgggcga

SEQ ID NO: 949571 - RNA, 24 nt, Mycobacterium avium subsp. paratuberculosis
cgcgccgggcgaagucgccggcca

SEQ ID NO: 949572 - RNA, 15 nt, Mycobacterium avium subsp. paratuberculosis
cgcgccgggcgcccg

SEQ ID NO: 949573 - RNA, 19 nt, Mycobacterium avium subsp. paratuberculosis
cgcgccgggcggaugucgg

SEQ ID NO: 949574 - RNA, 23 nt, Mycobacterium avium subsp. paratuberculosis
cgcgccgggcggaugucggugug

SEQ ID NO: 949575 - RNA, 13 nt, Mycobacterium avium subsp. paratuberculosis
cgcgccgggcggc

SEQ ID NO: 949576 - RNA, 16 nt, Mycobacterium avium subsp. paratuberculosis
cgcgccgggcggccuc

SEQ ID NO: 949577 - RNA, 14 nt, Mycobacterium avium subsp. paratuberculosis
cgcgccgggaucac

SEQ ID NO: 949578 - RNA, 12 nt, Mycobacterium avium subsp. paratuberculosis
cgcgccgggcaa

SEQ ID NO: 949579 - RNA, 16 nt, Mycobacterium avium subsp. paratuberculosis
cgcgccgggcaacagc

SEQ ID NO: 949580 - RNA, 23 nt, Mycobacterium avium subsp. paratuberculosis
cgcgccgggcaacagcgcgccgg

SEQ ID NO: 949581 - RNA, 12 nt, Mycobacterium avium subsp. paratuberculosis
cgcgccgggcac

SEQ ID NO: 949582 - RNA, 15 nt, Mycobacterium avium subsp. paratuberculosis
cgcgccgggcaccac

SEQ ID NO: 949583 - RNA, 16 nt, Mycobacterium avium subsp. paratuberculosis
cgcgccgggcaccacc

SEQ ID NO: 949584 - RNA, 19 nt, Mycobacterium avium subsp. paratuberculosis
cgcgccgggcaccaccacc

SEQ ID NO: 949585 - RNA, 20 nt, Mycobacterium avium subsp. paratuberculosis
cgcgccgggcaccaccaccg

SEQ ID NO: 949586 - RNA, 23 nt, Mycobacterium avium subsp. paratuberculosis
cgcgccgggcaccaccaccgaca

SEQ ID NO: 949587 - RNA, 15 nt, Mycobacterium avium subsp. paratuberculosis
cgcgccgggcagccc

SEQ ID NO: 949588 - RNA, 21 nt, Mycobacterium avium subsp. paratuberculosis
cgcgccgggcagcccgccgcg

SEQ ID NO: 949589 - RNA, 18 nt, Mycobacterium avium subsp. paratuberculosis
cgcgccggcggccgccgc

SEQ ID NO: 949590 - RNA, 13 nt, Mycobacterium avium subsp. paratuberculosis
cgcgccggcggcc

SEQ ID NO: 949591 - RNA, 20 nt, Mycobacterium avium subsp. paratuberculosis
cgcgccggcgugucggcgcc

SEQ ID NO: 949592 - RNA, 21 nt, Mycobacterium avium subsp. paratuberculosis
cgcgccggcgugucggcgcca

SEQ ID NO: 949593 - RNA, 14 nt, Mycobacterium avium subsp. paratuberculosis
cgcgccggcggcgg

SEQ ID NO: 949594 - RNA, 21 nt, Mycobacterium avium subsp. paratuberculosis
cgcgccggcggcggcgguccg

SEQ ID NO: 949595 - RNA, 15 nt, Mycobacterium avium subsp. paratuberculosis
cgcgccggcggucga

SEQ ID NO: 949596 - RNA, 13 nt, Mycobacterium avium subsp. paratuberculosis
cgcgccggcgucg

SEQ ID NO: 949597 - RNA, 16 nt, Mycobacterium avium subsp. paratuberculosis
cgcgccggcgucggug

SEQ ID NO: 949598 - RNA, 14 nt, Mycobacterium avium subsp. paratuberculosis
cgcggacaccaggu

SEQ ID NO: 949599 - RNA, 17 nt, Mycobacterium avium subsp. paratuberculosis
cgcggaauucgcgggug

SEQ ID NO: 949600 - RNA, 20 nt, Mycobacterium avium subsp. paratuberculosis
cgcggaaguggaccgcgugu

SEQ ID NO: 949601 - RNA, 19 nt, Mycobacterium avium subsp. paratuberculosis
cgcggaagccccaggcccg

SEQ ID NO: 949602 - RNA, 21 nt, Mycobacterium avium subsp. paratuberculosis
cgcggaagccccaggcccggu

SEQ ID NO: 949603 - RNA, 16 nt, Mycobacterium avium subsp. paratuberculosis
cgcggacgcggcggac

SEQ ID NO: 949604 - RNA, 18 nt, Mycobacterium avium subsp. paratuberculosis
cgcggacgcggcggacga

SEQ ID NO: 949605 - RNA, 15 nt, Mycobacterium avium subsp. paratuberculosis
cgcggacggccagcc

SEQ ID NO: 949606 - RNA, 13 nt, Mycobacterium avium subsp. paratuberculosis
cgcggacggcgaa

SEQ ID NO: 949607 - RNA, 15 nt, Mycobacterium avium subsp. paratuberculosis
cgcggacacgaacga

SEQ ID NO: 949608 - RNA, 16 nt, Mycobacterium avium subsp. paratuberculosis
cgcggacacgaacgac

SEQ ID NO: 949609 - RNA, 18 nt, Mycobacterium avium subsp. paratuberculosis
cgcggacacgaacgacgc

SEQ ID NO: 949610 - RNA, 15 nt, Mycobacterium avium subsp. paratuberculosis
cgcggacacggccgg

SEQ ID NO: 949611 - RNA, 17 nt, Mycobacterium avium subsp. paratuberculosis
cgcggacacggccggga

SEQ ID NO: 949612 - RNA, 14 nt, Mycobacterium avium subsp. paratuberculosis
cgcggacagcgcgg

SEQ ID NO: 949613 - RNA, 15 nt, Mycobacterium avium subsp. paratuberculosis
cgcggacagcgcggu

SEQ ID NO: 949614 - RNA, 13 nt, Mycobacterium avium subsp. paratuberculosis
cgcggacagcucg

SEQ ID NO: 949615 - RNA, 18 nt, Mycobacterium avium subsp. paratuberculosis
cgcggaccuuggugucgg

SEQ ID NO: 949616 - RNA, 21 nt, Mycobacterium avium subsp. paratuberculosis
cgcggaccuuggugucggcga

SEQ ID NO: 949617 - RNA, 17 nt, Mycobacterium avium subsp. paratuberculosis
cgcggaguaggcgccgc

SEQ ID NO: 949618 - RNA, 20 nt, Mycobacterium avium subsp. paratuberculosis
cgcggaucagcaggaccggg

SEQ ID NO: 949619 - RNA, 24 nt, Mycobacterium avium subsp. paratuberculosis
cgcggaucagcaggaccgggaucg

SEQ ID NO: 949620 - RNA, 15 nt, Mycobacterium avium subsp. paratuberculosis
cgcggauacgcccgg

SEQ ID NO: 949621 - RNA, 16 nt, Mycobacterium avium subsp. paratuberculosis
cgcggauacgcccggc

SEQ ID NO: 949622 - RNA, 19 nt, Mycobacterium avium subsp. paratuberculosis
cgcggauacgcccggccac

SEQ ID NO: 949623 - RNA, 17 nt, Mycobacterium avium subsp. paratuberculosis
cgcggaggaugccggcc

SEQ ID NO: 949624 - RNA, 13 nt, Mycobacterium avium subsp. paratuberculosis
cgcggagcgucgc

SEQ ID NO: 949625 - RNA, 19 nt, Mycobacterium avium subsp. paratuberculosis
cgcggaggaauucgccgac

SEQ ID NO: 949626 - RNA, 20 nt, Mycobacterium avium subsp. paratuberculosis
cgcggaggaauucgccgacg

SEQ ID NO: 949627 - RNA, 22 nt, Mycobacterium avium subsp. paratuberculosis
cgcggacggguugggcgccagc

SEQ ID NO: 949628 - RNA, 23 nt, Mycobacterium avium subsp. paratuberculosis
cgcggacggguugggcgccagca

SEQ ID NO: 949629 - RNA, 14 nt, Mycobacterium avium subsp. paratuberculosis
cgcggacuggccac

SEQ ID NO: 949630 - RNA, 15 nt, Mycobacterium avium subsp. paratuberculosis
cgcggacuggccacc

SEQ ID NO: 949631 - RNA, 17 nt, Mycobacterium avium subsp. paratuberculosis
cgcggacuggccaccgc

SEQ ID NO: 949632 - RNA, 19 nt, Mycobacterium avium subsp. paratuberculosis
cgcggacuggccaccgcga

SEQ ID NO: 949633 - RNA, 22 nt, Mycobacterium avium subsp. paratuberculosis
cgcggacuggccaccgcgaucu

SEQ ID NO: 949634 - RNA, 18 nt, Mycobacterium avium subsp. paratuberculosis
cgcggacuggugggcguc

SEQ ID NO: 949635 - RNA, 19 nt, Mycobacterium avium subsp. paratuberculosis
cgcggacuggugggcgucg

SEQ ID NO: 949636 - RNA, 22 nt, Mycobacterium avium subsp. paratuberculosis
cgcggagaucaccccuggcggg

SEQ ID NO: 949637 - RNA, 16 nt, Mycobacterium avium subsp. paratuberculosis
cgcggagaugcuggug

SEQ ID NO: 949638 - RNA, 23 nt, Mycobacterium avium subsp. paratuberculosis
cgcggagaugcuggugacgccgc

SEQ ID NO: 949639 - RNA, 13 nt, Mycobacterium avium subsp. paratuberculosis
cgcggagccggcc

SEQ ID NO: 949640 - RNA, 14 nt, Mycobacterium avium subsp. paratuberculosis
cgcggagccggccg

SEQ ID NO: 949641 - RNA, 15 nt, Mycobacterium avium subsp. paratuberculosis
cgcggagccggccgc

SEQ ID NO: 949642 - RNA, 14 nt, Mycobacterium avium subsp. paratuberculosis
cgcggagcgcaacg

SEQ ID NO: 949643 - RNA, 12 nt, Mycobacterium avium subsp. paratuberculosis
cgcggagcggcg

SEQ ID NO: 949644 - RNA, 13 nt, Mycobacterium avium subsp. paratuberculosis
cgcggagcggcgg

SEQ ID NO: 949645 - RNA, 16 nt, Mycobacterium avium subsp. paratuberculosis
cgcggagcggcgguca

SEQ ID NO: 949646 - RNA, 17 nt, Mycobacterium avium subsp. paratuberculosis
cgcggagcgggucagcg

SEQ ID NO: 949647 - RNA, 20 nt, Mycobacterium avium subsp. paratuberculosis
cgcggauuucucagcggcgc

SEQ ID NO: 949648 - RNA, 15 nt, Mycobacterium avium subsp. paratuberculosis
cgcggauguccgacc

SEQ ID NO: 949649 - RNA, 17 nt, Mycobacterium avium subsp. paratuberculosis
cgcggauguccgaccgg

SEQ ID NO: 949650 - RNA, 19 nt, Mycobacterium avium subsp. paratuberculosis
cgcggauguccgaccgguu

SEQ ID NO: 949651 - RNA, 15 nt, Mycobacterium avium subsp. paratuberculosis
cgcggauggccucgg

SEQ ID NO: 949652 - RNA, 18 nt, Mycobacterium avium subsp. paratuberculosis
cgcggauggccucggcga

SEQ ID NO: 949653 - RNA, 16 nt, Mycobacterium avium subsp. paratuberculosis
cgcggauguggaggcg

SEQ ID NO: 949654 - RNA, 20 nt, Mycobacterium avium subsp. paratuberculosis
cgcggauuccagcgcgaccg

SEQ ID NO: 949655 - RNA, 17 nt, Mycobacterium avium subsp. paratuberculosis
cgcggauuccagcgcgu

SEQ ID NO: 949656 - RNA, 23 nt, Mycobacterium avium subsp. paratuberculosis
cgcggauuccggcaucggcucgu

SEQ ID NO: 949657 - RNA, 15 nt, Mycobacterium avium subsp. paratuberculosis
cgcggcaaggcgcag

SEQ ID NO: 949658 - RNA, 13 nt, Mycobacterium avium subsp. paratuberculosis
cgcggcaaggcgu

SEQ ID NO: 949659 - RNA, 19 nt, Mycobacterium avium subsp. paratuberculosis
cgcggauggguggcgauca

SEQ ID NO: 949660 - RNA, 18 nt, Mycobacterium avium subsp. paratuberculosis
cgcggaugcgggcgcugc

SEQ ID NO: 949661 - RNA, 17 nt, Mycobacterium avium subsp. paratuberculosis
cgcggaucuucuccgcc

SEQ ID NO: 949662 - RNA, 17 nt, Mycobacterium avium subsp. paratuberculosis
cgcggaugaccaggucg

SEQ ID NO: 949663 - RNA, 23 nt, Mycobacterium avium subsp. paratuberculosis
cgcggaugaccaggucgccggcg

SEQ ID NO: 949664 - RNA, 21 nt, Mycobacterium avium subsp. paratuberculosis
cgcggaugcccaggccggcga

SEQ ID NO: 949665 - RNA, 21 nt, Mycobacterium avium subsp. paratuberculosis
cgcggaugacgggugcucagg

SEQ ID NO: 949666 - RNA, 18 nt, Mycobacterium avium subsp. paratuberculosis
cgcggaugacgugcacca

SEQ ID NO: 949667 - RNA, 22 nt, Mycobacterium avium subsp. paratuberculosis
cgcggaugacgugcaccaccgc

SEQ ID NO: 949668 - RNA, 15 nt, Mycobacterium avium subsp. paratuberculosis
cgcggaucgcguagu

SEQ ID NO: 949669 - RNA, 14 nt, Mycobacterium avium subsp. paratuberculosis
cgcggaucucgcgc

SEQ ID NO: 949670 - RNA, 17 nt, Mycobacterium avium subsp. paratuberculosis
cgcggaucucgcgcagg

SEQ ID NO: 949671 - RNA, 16 nt, Mycobacterium avium subsp. paratuberculosis
cgcggaucucggugag

SEQ ID NO: 949672 - RNA, 17 nt, Mycobacterium avium subsp. paratuberculosis
cgcggaucucggugagc

SEQ ID NO: 949673 - RNA, 15 nt, Mycobacterium avium subsp. paratuberculosis
cgcggaucucgucgg

SEQ ID NO: 949674 - RNA, 19 nt, Mycobacterium avium subsp. paratuberculosis
cgcggaucucgucgggcca

SEQ ID NO: 949675 - RNA, 19 nt, Mycobacterium avium subsp. paratuberculosis
cgcggaucgguggacgcgg

SEQ ID NO: 949676 - RNA, 22 nt, Mycobacterium avium subsp. paratuberculosis
cgcggaucgguggacgcggucg

SEQ ID NO: 949677 - RNA, 13 nt, Mycobacterium avium subsp. paratuberculosis
cgcggaucgucac

SEQ ID NO: 949678 - RNA, 16 nt, Mycobacterium avium subsp. paratuberculosis
cgcggaucgucaccga

SEQ ID NO: 949679 - RNA, 22 nt, Mycobacterium avium subsp. paratuberculosis
cgcggaucgucaccgaccccuc

SEQ ID NO: 949680 - RNA, 19 nt, Mycobacterium avium subsp. paratuberculosis
cgcggaucgaacagggcgg

SEQ ID NO: 949681 - RNA, 16 nt, Mycobacterium avium subsp. paratuberculosis
cgcggaucaugauccg

SEQ ID NO: 949682 - RNA, 17 nt, Mycobacterium avium subsp. paratuberculosis
cgcggaucaugauccgg

SEQ ID NO: 949683 - RNA, 15 nt, Mycobacterium avium subsp. paratuberculosis
cgcggauccgggccg

SEQ ID NO: 949684 - RNA, 18 nt, Mycobacterium avium subsp. paratuberculosis
cgcggauccgggccggcg

SEQ ID NO: 949685 - RNA, 21 nt, Mycobacterium avium subsp. paratuberculosis
cgcggauccgggccggcgucg

SEQ ID NO: 949686 - RNA, 22 nt, Mycobacterium avium subsp. paratuberculosis
cgcggauccgggccggcgucgc

SEQ ID NO: 949687 - RNA, 15 nt, Mycobacterium avium subsp. paratuberculosis
cgcggcagccgggcg

SEQ ID NO: 949688 - RNA, 18 nt, Mycobacterium avium subsp. paratuberculosis
cgcggcagccgggcgauc

SEQ ID NO: 949689 - RNA, 20 nt, Mycobacterium avium subsp. paratuberculosis
cgcggcagccgggcgaucau

SEQ ID NO: 949690 - RNA, 19 nt, Mycobacterium avium subsp. paratuberculosis
cgcggcaggaauuccagcg

SEQ ID NO: 949691 - RNA, 14 nt, Mycobacterium avium subsp. paratuberculosis
cgcggcaggcgacc

SEQ ID NO: 949692 - RNA, 15 nt, Mycobacterium avium subsp. paratuberculosis
cgcggcaggcgcccc

SEQ ID NO: 949693 - RNA, 18 nt, Mycobacterium avium subsp. paratuberculosis
cgcggcaggcgccccagc

SEQ ID NO: 949694 - RNA, 17 nt, Mycobacterium avium subsp. paratuberculosis
cgcggcagggccaggcc

SEQ ID NO: 949695 - RNA, 15 nt, Mycobacterium avium subsp. paratuberculosis
cgcggcaguccgccg

SEQ ID NO: 949696 - RNA, 17 nt, Mycobacterium avium subsp. paratuberculosis
cgcggcaguccgccgga

SEQ ID NO: 949697 - RNA, 20 nt, Mycobacterium avium subsp. paratuberculosis
cgcggcaguccgccggagac

SEQ ID NO: 949698 - RNA, 14 nt, Mycobacterium avium subsp. paratuberculosis
cgcggcacgggccg

SEQ ID NO: 949699 - RNA, 15 nt, Mycobacterium avium subsp. paratuberculosis
cgcggcacgggccgu

SEQ ID NO: 949700 - RNA, 17 nt, Mycobacterium avium subsp. paratuberculosis
cgcggcaccuucaccga

SEQ ID NO: 949701 - RNA, 22 nt, Mycobacterium avium subsp. paratuberculosis
cgcggcaccuucaccgaccagc

SEQ ID NO: 949702 - RNA, 12 nt, Mycobacterium avium subsp. paratuberculosis
cgcggcacgccg

SEQ ID NO: 949703 - RNA, 18 nt, Mycobacterium avium subsp. paratuberculosis
cgcggcacgccgcucguc

SEQ ID NO: 949704 - RNA, 12 nt, Mycobacterium avium subsp. paratuberculosis
cgcggcacgcug

SEQ ID NO: 949705 - RNA, 16 nt, Mycobacterium avium subsp. paratuberculosis
cgcggcacgcugcgcc

SEQ ID NO: 949706 - RNA, 20 nt, Mycobacterium avium subsp. paratuberculosis
cgcggcacgcugcgccagcc

SEQ ID NO: 949707 - RNA, 21 nt, Mycobacterium avium subsp. paratuberculosis
cgcggcaucggcgacggcgac

SEQ ID NO: 949708 - RNA, 13 nt, Mycobacterium avium subsp. paratuberculosis
cgcggcaucguca

SEQ ID NO: 949709 - RNA, 15 nt, Mycobacterium avium subsp. paratuberculosis
cgcggcaucgucacc

SEQ ID NO: 949710 - RNA, 16 nt, Mycobacterium avium subsp. paratuberculosis
cgcggcauggcuggcg

SEQ ID NO: 949711 - RNA, 18 nt, Mycobacterium avium subsp. paratuberculosis
cgcggcauggcuggcggc

SEQ ID NO: 949712 - RNA, 20 nt, Mycobacterium avium subsp. paratuberculosis
cgcggccaacccgggcgcca

SEQ ID NO: 949713 - RNA, 17 nt, Mycobacterium avium subsp. paratuberculosis
cgcggccaacgcccacc

SEQ ID NO: 949714 - RNA, 16 nt, Mycobacterium avium subsp. paratuberculosis
cgcggccaagugcggu

SEQ ID NO: 949715 - RNA, 18 nt, Mycobacterium avium subsp. paratuberculosis
cgcggccaagugcggucg

SEQ ID NO: 949716 - RNA, 19 nt, Mycobacterium avium subsp. paratuberculosis
cgcggccacaccgaucagc

SEQ ID NO: 949717 - RNA, 20 nt, Mycobacterium avium subsp. paratuberculosis
cgcggccacaccgaucagca

SEQ ID NO: 949718 - RNA, 12 nt, Mycobacterium avium subsp. paratuberculosis
cgcggccacacu

SEQ ID NO: 949719 - RNA, 17 nt, Mycobacterium avium subsp. paratuberculosis
cgcggccacacuggcgu

SEQ ID NO: 949720 - RNA, 21 nt, Mycobacterium avium subsp. paratuberculosis
cgcggccacacuggcgugacg

SEQ ID NO: 949721 - RNA, 20 nt, Mycobacterium avium subsp. paratuberculosis
cgcggcaucgugaugcgggu

SEQ ID NO: 949722 - RNA, 14 nt, Mycobacterium avium subsp. paratuberculosis
cgcggcaugccgcc

SEQ ID NO: 949723 - RNA, 17 nt, Mycobacterium avium subsp. paratuberculosis
cgcggccaccaccacgg

SEQ ID NO: 949724 - RNA, 14 nt, Mycobacterium avium subsp. paratuberculosis
cgcggccaccacga

SEQ ID NO: 949725 - RNA, 15 nt, Mycobacterium avium subsp. paratuberculosis
cgcggccaccacgac

SEQ ID NO: 949726 - RNA, 20 nt, Mycobacterium avium subsp. paratuberculosis
cgcggccaccacgacgccgg

SEQ ID NO: 949727 - RNA, 21 nt, Mycobacterium avium subsp. paratuberculosis
cgcggccaccagcgcggccac

SEQ ID NO: 949728 - RNA, 18 nt, Mycobacterium avium subsp. paratuberculosis
cgcggccaccccggugac

SEQ ID NO: 949729 - RNA, 15 nt, Mycobacterium avium subsp. paratuberculosis
cgcgugaccccggcg

SEQ ID NO: 949730 - RNA, 13 nt, Mycobacterium avium subsp. paratuberculosis
cgcgugaccggcg

SEQ ID NO: 949731 - RNA, 16 nt, Mycobacterium avium subsp. paratuberculosis
cgcgugaccggcggug

SEQ ID NO: 949732 - RNA, 12 nt, Mycobacterium avium subsp. paratuberculosis
cgcgucgggcag

SEQ ID NO: 949733 - RNA, 14 nt, Mycobacterium avium subsp. paratuberculosis
cgcgucgggcaggu

SEQ ID NO: 949734 - RNA, 14 nt, Mycobacterium avium subsp. paratuberculosis
cgcgucgggcucgc

SEQ ID NO: 949735 - RNA, 20 nt, Mycobacterium avium subsp. paratuberculosis
cgcgucgggcucgcggucgg

SEQ ID NO: 949736 - RNA, 16 nt, Mycobacterium avium subsp. paratuberculosis
cgcgucgggcucggcc

SEQ ID NO: 949737 - RNA, 15 nt, Mycobacterium avium subsp. paratuberculosis
cgcgugacaagccgg

SEQ ID NO: 949738 - RNA, 18 nt, Mycobacterium avium subsp. paratuberculosis
cgcgugacaagccggcgu

SEQ ID NO: 949739 - RNA, 20 nt, Mycobacterium avium subsp. paratuberculosis
cgcgugacaagccggcgucg

SEQ ID NO: 949740 - RNA, 23 nt, Mycobacterium avium subsp. paratuberculosis
cgcgugacaagccggcgucgaug

SEQ ID NO: 949741 - RNA, 12 nt, Mycobacterium avium subsp. paratuberculosis
cgcgucggccgc

SEQ ID NO: 949742 - RNA, 13 nt, Mycobacterium avium subsp. paratuberculosis
cgcgucggccgca

SEQ ID NO: 949743 - RNA, 13 nt, Mycobacterium avium subsp. paratuberculosis
cgcgucggcggcg

SEQ ID NO: 949744 - RNA, 21 nt, Mycobacterium avium subsp. paratuberculosis
cgcgucggcggcggcggccgc

SEQ ID NO: 949745 - RNA, 15 nt, Mycobacterium avium subsp. paratuberculosis
cgcgucggcggucgc

SEQ ID NO: 949746 - RNA, 17 nt, Mycobacterium avium subsp. paratuberculosis
cgcgucggcggucgcca

SEQ ID NO: 949747 - RNA, 21 nt, Mycobacterium avium subsp. paratuberculosis
cgcgucggcggucgccagcgc

SEQ ID NO: 949748 - RNA, 22 nt, Mycobacterium avium subsp. paratuberculosis
cgcgucggcggucgccagcgcc

SEQ ID NO: 949749 - RNA, 14 nt, Mycobacterium avium subsp. paratuberculosis
cgcgucggcgcugg

SEQ ID NO: 949750 - RNA, 19 nt, Mycobacterium avium subsp. paratuberculosis
cgcgucggcgcuggccagc

SEQ ID NO: 949751 - RNA, 21 nt, Mycobacterium avium subsp. paratuberculosis
cgcgucggcgcuggccagcgc

SEQ ID NO: 949752 - RNA, 14 nt, Mycobacterium avium subsp. paratuberculosis
cgcgucggcgccgg

SEQ ID NO: 949753 - RNA, 15 nt, Mycobacterium avium subsp. paratuberculosis
cgcgucggcgccggc

SEQ ID NO: 949754 - RNA, 16 nt, Mycobacterium avium subsp. paratuberculosis
cgcgucggcgccggcc

SEQ ID NO: 949755 - RNA, 17 nt, Mycobacterium avium subsp. paratuberculosis
cgcgucggcgccggcca

SEQ ID NO: 949756 - RNA, 14 nt, Mycobacterium avium subsp. paratuberculosis
cgcgucggccagcg

SEQ ID NO: 949757 - RNA, 15 nt, Mycobacterium avium subsp. paratuberculosis
cgcgucggccagcgc

SEQ ID NO: 949758 - RNA, 20 nt, Mycobacterium avium subsp. paratuberculosis
cgcgucggcccccagcgagg

SEQ ID NO: 949759 - RNA, 13 nt, Mycobacterium avium subsp. paratuberculosis
cgcgucggccagc

SEQ ID NO: 949760 - RNA, 20 nt, Mycobacterium avium subsp. paratuberculosis
cgcgucggccagcaccacca

SEQ ID NO: 949761 - RNA, 21 nt, Mycobacterium avium subsp. paratuberculosis
cgcgucggagaucaccggcac

SEQ ID NO: 949762 - RNA, 14 nt, Mycobacterium avium subsp. paratuberculosis
cgcgucggaggcca

SEQ ID NO: 949763 - RNA, 21 nt, Mycobacterium avium subsp. paratuberculosis
cgcgucgaugucgucguugug

SEQ ID NO: 949764 - RNA, 15 nt, Mycobacterium avium subsp. paratuberculosis
cgcgucgcacagcgc

SEQ ID NO: 949765 - RNA, 18 nt, Mycobacterium avium subsp. paratuberculosis
cgcgucgcacagcgccgc

SEQ ID NO: 949766 - RNA, 21 nt, Mycobacterium avium subsp. paratuberculosis
cgcgucgcacagcgccgcguu

SEQ ID NO: 949767 - RNA, 15 nt, Mycobacterium avium subsp. paratuberculosis
cgcgucgaucgcguc

SEQ ID NO: 949768 - RNA, 15 nt, Mycobacterium avium subsp. paratuberculosis
cgcgugaugcagcag

SEQ ID NO: 949769 - RNA, 19 nt, Mycobacterium avium subsp. paratuberculosis
cgcgugaugggugggcagc

SEQ ID NO: 949770 - RNA, 22 nt, Mycobacterium avium subsp. paratuberculosis
cgcgugcaacacaugguccugc

SEQ ID NO: 949771 - RNA, 13 nt, Mycobacterium avium subsp. paratuberculosis
cgcgugcacaccg

SEQ ID NO: 949772 - RNA, 14 nt, Mycobacterium avium subsp. paratuberculosis
cgcgugacgcgcgu

SEQ ID NO: 949773 - RNA, 14 nt, Mycobacterium avium subsp. paratuberculosis
cgcgugacggccgc

SEQ ID NO: 949774 - RNA, 19 nt, Mycobacterium avium subsp. paratuberculosis
cgcgugacggccgcggcgc

SEQ ID NO: 949775 - RNA, 20 nt, Mycobacterium avium subsp. paratuberculosis
cgcgugacggccgcggcgcg

SEQ ID NO: 949776 - RNA, 13 nt, Mycobacterium avium subsp. paratuberculosis
cgcgugacggcgg

SEQ ID NO: 949777 - RNA, 14 nt, Mycobacterium avium subsp. paratuberculosis
cgcgugacggcggg

SEQ ID NO: 949778 - RNA, 15 nt, Mycobacterium avium subsp. paratuberculosis
cgcgugcagccgggc

SEQ ID NO: 949779 - RNA, 20 nt, Mycobacterium avium subsp. paratuberculosis
cgcgugcagccgggcggcgc

SEQ ID NO: 949780 - RNA, 21 nt, Mycobacterium avium subsp. paratuberculosis
cgcgugcagccgggcggcgcc

SEQ ID NO: 949781 - RNA, 14 nt, Mycobacterium avium subsp. paratuberculosis
cgcgugcgccgcgg

SEQ ID NO: 949782 - RNA, 21 nt, Mycobacterium avium subsp. paratuberculosis
cgcgugcgagccgagcacgca

SEQ ID NO: 949783 - RNA, 17 nt, Mycobacterium avium subsp. paratuberculosis
cgcguucgggcagcgcc

SEQ ID NO: 949784 - RNA, 14 nt, Mycobacterium avium subsp. paratuberculosis
cgcguucggcgcca

SEQ ID NO: 949785 - RNA, 21 nt, Mycobacterium avium subsp. paratuberculosis
cgcguucggcgccaccccggg

SEQ ID NO: 949786 - RNA, 20 nt, Mycobacterium avium subsp. paratuberculosis
cgcgugcggggugugcaggc

SEQ ID NO: 949787 - RNA, 22 nt, Mycobacterium avium subsp. paratuberculosis
cgcguucgcuuucgcguucgcu

SEQ ID NO: 949788 - RNA, 22 nt, Mycobacterium avium subsp. paratuberculosis
cgcguucggaggcuucgcucau

SEQ ID NO: 949789 - RNA, 14 nt, Mycobacterium avium subsp. paratuberculosis
cgcguucucggcgg

SEQ ID NO: 949790 - RNA, 13 nt, Mycobacterium avium subsp. paratuberculosis
cgcguucugcacc

SEQ ID NO: 949791 - RNA, 15 nt, Mycobacterium avium subsp. paratuberculosis
cgcguucugcaccag

SEQ ID NO: 949792 - RNA, 21 nt, Mycobacterium avium subsp. paratuberculosis
cgcguugcggccguccagcgu

SEQ ID NO: 949793 - RNA, 15 nt, Mycobacterium avium subsp. paratuberculosis
cgcguugcggcgcag

SEQ ID NO: 949794 - RNA, 17 nt, Mycobacterium avium subsp. paratuberculosis
cgcguucuccaccgcgc

SEQ ID NO: 949795 - RNA, 21 nt, Mycobacterium avium subsp. paratuberculosis
cgcguucuccaccgcgcgcgg

SEQ ID NO: 949796 - RNA, 16 nt, Mycobacterium avium subsp. paratuberculosis
cgcguucuccucgaac

SEQ ID NO: 949797 - RNA, 23 nt, Mycobacterium avium subsp. paratuberculosis
cgcguucuccucgaacaccgcac

SEQ ID NO: 949798 - RNA, 17 nt, Mycobacterium avium subsp. paratuberculosis
cgcguucgacccacacc

SEQ ID NO: 949799 - RNA, 23 nt, Mycobacterium avium subsp. paratuberculosis
cgcguucccgggcccgcugcagc

SEQ ID NO: 949800 - RNA, 20 nt, Mycobacterium avium subsp. paratuberculosis
cgcguuccaucagcgcccgc

SEQ ID NO: 949801 - RNA, 21 nt, Mycobacterium avium subsp. paratuberculosis
cgcguucgaccuccacgagcc

SEQ ID NO: 949802 - RNA, 22 nt, Mycobacterium avium subsp. paratuberculosis
cgcguucgaccuccacgagccg

SEQ ID NO: 949803 - RNA, 22 nt, Mycobacterium avium subsp. paratuberculosis
cgcguucagggugcaggcccgg

SEQ ID NO: 949804 - RNA, 17 nt, Mycobacterium avium subsp. paratuberculosis
cgcgugcgucacgcugg

SEQ ID NO: 949805 - RNA, 15 nt, Mycobacterium avium subsp. paratuberculosis
cgcgugcgucaucgc

SEQ ID NO: 949806 - RNA, 20 nt, Mycobacterium avium subsp. paratuberculosis
cgcgugcgucaucgcgcugg

SEQ ID NO: 949807 - RNA, 14 nt, Mycobacterium avium subsp. paratuberculosis
cgcguuggccgcca

SEQ ID NO: 949808 - RNA, 15 nt, Mycobacterium avium subsp. paratuberculosis
cgcguuggccggcug

SEQ ID NO: 949809 - RNA, 14 nt, Mycobacterium avium subsp. paratuberculosis
cgcguuggcgccga

SEQ ID NO: 949810 - RNA, 16 nt, Mycobacterium avium subsp. paratuberculosis
cgcguuggcgccgacg

SEQ ID NO: 949811 - RNA, 19 nt, Mycobacterium avium subsp. paratuberculosis
cgcguuggcgccgacguca

SEQ ID NO: 949812 - RNA, 16 nt, Mycobacterium avium subsp. paratuberculosis
cgcguuguugcucggc

SEQ ID NO: 949813 - RNA, 18 nt, Mycobacterium avium subsp. paratuberculosis
cgcguuguugcucggcgg

SEQ ID NO: 949814 - RNA, 21 nt, Mycobacterium avium subsp. paratuberculosis
cgcguuguugcucggcggccc

SEQ ID NO: 949815 - RNA, 21 nt, Mycobacterium avium subsp. paratuberculosis
cgcguugucgaccaccaggug

SEQ ID NO: 949816 - RNA, 15 nt, Mycobacterium avium subsp. paratuberculosis
cgcguugucggcgac

SEQ ID NO: 949817 - RNA, 15 nt, Mycobacterium avium subsp. paratuberculosis
cgcguugucggcguc

SEQ ID NO: 949818 - RNA, 16 nt, Mycobacterium avium subsp. paratuberculosis
cgcguuggccagguug

SEQ ID NO: 949819 - RNA, 23 nt, Mycobacterium avium subsp. paratuberculosis
cgcguuucccgaguggcgccguc

SEQ ID NO: 949820 - RNA, 21 nt, Mycobacterium avium subsp. paratuberculosis
cgcguuuugaaauccgggcgc

SEQ ID NO: 949821 - RNA, 21 nt, Mycobacterium avium subsp. paratuberculosis
cgcuacgcgagcugcuucguc

SEQ ID NO: 949822 - RNA, 22 nt, Mycobacterium avium subsp. paratuberculosis
cgcuacgccgaggcgcaggagg

SEQ ID NO: 949823 - RNA, 16 nt, Mycobacterium avium subsp. paratuberculosis
cgcuaccucaccacgu

SEQ ID NO: 949824 - RNA, 12 nt, Mycobacterium avium subsp. paratuberculosis
cgcucacccggc

SEQ ID NO: 949825 - RNA, 20 nt, Mycobacterium avium subsp. paratuberculosis
cgcucacccggcccaccggc

SEQ ID NO: 949826 - RNA, 23 nt, Mycobacterium avium subsp. paratuberculosis
cgcucaccgcaucgaaccgccgc

SEQ ID NO: 949827 - RNA, 20 nt, Mycobacterium avium subsp. paratuberculosis
cgcucaccgccgagccgcuc

SEQ ID NO: 949828 - RNA, 14 nt, Mycobacterium avium subsp. paratuberculosis
cgcucaccgcgggg

SEQ ID NO: 949829 - RNA, 16 nt, Mycobacterium avium subsp. paratuberculosis
cgcucaccgucgcggu

SEQ ID NO: 949830 - RNA, 20 nt, Mycobacterium avium subsp. paratuberculosis
cgcucaccugcggcccgucg

SEQ ID NO: 949831 - RNA, 13 nt, Mycobacterium avium subsp. paratuberculosis
cgcucagcgcggc

SEQ ID NO: 949832 - RNA, 16 nt, Mycobacterium avium subsp. paratuberculosis
cgcucagccccagcgg

SEQ ID NO: 949833 - RNA, 20 nt, Mycobacterium avium subsp. paratuberculosis
cgcucagccccagcggagcg

SEQ ID NO: 949834 - RNA, 14 nt, Mycobacterium avium subsp. paratuberculosis
cgcucacgcucggc

SEQ ID NO: 949835 - RNA, 15 nt, Mycobacterium avium subsp. paratuberculosis
cgcucacgcucggcc

SEQ ID NO: 949836 - RNA, 16 nt, Mycobacterium avium subsp. paratuberculosis
cgcuaaagccgaccgc

SEQ ID NO: 949837 - RNA, 14 nt, Mycobacterium avium subsp. paratuberculosis
cgcuaaucgccgcg

SEQ ID NO: 949838 - RNA, 22 nt, Mycobacterium avium subsp. paratuberculosis
cgcuaaggccgcugcccggcgc

SEQ ID NO: 949839 - RNA, 20 nt, Mycobacterium avium subsp. paratuberculosis
cgcuacccggcgaaccggga

SEQ ID NO: 949840 - RNA, 20 nt, Mycobacterium avium subsp. paratuberculosis
cgcuaccgcgcucaccgucg

SEQ ID NO: 949841 - RNA, 18 nt, Mycobacterium avium subsp. paratuberculosis
cgcuccauggcggcgacc

SEQ ID NO: 949842 - RNA, 19 nt, Mycobacterium avium subsp. paratuberculosis
cgcuccauggcggcgacca

SEQ ID NO: 949843 - RNA, 14 nt, Mycobacterium avium subsp. paratuberculosis
cgcuccauguucgg

SEQ ID NO: 949844 - RNA, 14 nt, Mycobacterium avium subsp. paratuberculosis
cgcucagcgcggcg

SEQ ID NO: 949845 - RNA, 15 nt, Mycobacterium avium subsp. paratuberculosis
cgcucaggucggccg

SEQ ID NO: 949846 - RNA, 16 nt, Mycobacterium avium subsp. paratuberculosis
cgcucaggucggccgc

SEQ ID NO: 949847 - RNA, 17 nt, Mycobacterium avium subsp. paratuberculosis
cgcucaggucggccgcg

SEQ ID NO: 949848 - RNA, 20 nt, Mycobacterium avium subsp. paratuberculosis
cgcucaggucggccgcggcc

SEQ ID NO: 949849 - RNA, 14 nt, Mycobacterium avium subsp. paratuberculosis
cgcucagcgggcgg

SEQ ID NO: 949850 - RNA, 15 nt, Mycobacterium avium subsp. paratuberculosis
cgcucagcgggcggc

SEQ ID NO: 949851 - RNA, 21 nt, Mycobacterium avium subsp. paratuberculosis
cgcucagcgggcggccagccg

SEQ ID NO: 949852 - RNA, 17 nt, Mycobacterium avium subsp. paratuberculosis
cgcucagcgcggcgggc

SEQ ID NO: 949853 - RNA, 15 nt, Mycobacterium avium subsp. paratuberculosis
cgcucagcggcagcg

SEQ ID NO: 949854 - RNA, 14 nt, Mycobacterium avium subsp. paratuberculosis
cgcuccgcggcggg

SEQ ID NO: 949855 - RNA, 19 nt, Mycobacterium avium subsp. paratuberculosis
cgcuccgcggcgggcgugc

SEQ ID NO: 949856 - RNA, 15 nt, Mycobacterium avium subsp. paratuberculosis
cgcuccgcgggcagc

SEQ ID NO: 949857 - RNA, 23 nt, Mycobacterium avium subsp. paratuberculosis
cgcuccgcgggcagcgagcacag

SEQ ID NO: 949858 - RNA, 13 nt, Mycobacterium avium subsp. paratuberculosis
cgcuccgcggugc

SEQ ID NO: 949859 - RNA, 15 nt, Mycobacterium avium subsp. paratuberculosis
cgcuccgcggugcug

SEQ ID NO: 949860 - RNA, 18 nt, Mycobacterium avium subsp. paratuberculosis
cgcuccggcccgagcacc

SEQ ID NO: 949861 - RNA, 23 nt, Mycobacterium avium subsp. paratuberculosis
cgcuccggcccgagcaccaccag

SEQ ID NO: 949862 - RNA, 12 nt, Mycobacterium avium subsp. paratuberculosis
cgcuccggcgga

SEQ ID NO: 949863 - RNA, 21 nt, Mycobacterium avium subsp. paratuberculosis
cgcuccggcggacccagcucc

SEQ ID NO: 949864 - RNA, 16 nt, Mycobacterium avium subsp. paratuberculosis
cgcuccggucgcgucg

SEQ ID NO: 949865 - RNA, 18 nt, Mycobacterium avium subsp. paratuberculosis
cgcucccgauggcucgcg

SEQ ID NO: 949866 - RNA, 14 nt, Mycobacterium avium subsp. paratuberculosis
cgcucccgcagcgg

SEQ ID NO: 949867 - RNA, 20 nt, Mycobacterium avium subsp. paratuberculosis
cgcuccccgagcacgucgag

SEQ ID NO: 949868 - RNA, 24 nt, Mycobacterium avium subsp. paratuberculosis
cgcuccccgagcacgucgagcacc

SEQ ID NO: 949869 - RNA, 17 nt, Mycobacterium avium subsp. paratuberculosis
cgcucccauccggaagc

SEQ ID NO: 949870 - RNA, 13 nt, Mycobacterium avium subsp. paratuberculosis
cgcucccgcgcgg

SEQ ID NO: 949871 - RNA, 12 nt, Mycobacterium avium subsp. paratuberculosis
cgcucccggcgc

SEQ ID NO: 949872 - RNA, 14 nt, Mycobacterium avium subsp. paratuberculosis
cgcucccggcgcag

SEQ ID NO: 949873 - RNA, 18 nt, Mycobacterium avium subsp. paratuberculosis
cgcucccgggacagcccg

SEQ ID NO: 949874 - RNA, 13 nt, Mycobacterium avium subsp. paratuberculosis
cgcuccgacgcgg

SEQ ID NO: 949875 - RNA, 15 nt, Mycobacterium avium subsp. paratuberculosis
cgcuccgacgcggug

SEQ ID NO: 949876 - RNA, 16 nt, Mycobacterium avium subsp. paratuberculosis
cgcuccgacgcggugg

SEQ ID NO: 949877 - RNA, 18 nt, Mycobacterium avium subsp. paratuberculosis
cgcgggauugccgagcac

SEQ ID NO: 949878 - RNA, 20 nt, Mycobacterium avium subsp. paratuberculosis
cgcgggauugccgagcaccc

SEQ ID NO: 949879 - RNA, 15 nt, Mycobacterium avium subsp. paratuberculosis
cgcgggaucggugcc

SEQ ID NO: 949880 - RNA, 16 nt, Mycobacterium avium subsp. paratuberculosis
cgcgggaucggugccg

SEQ ID NO: 949881 - RNA, 18 nt, Mycobacterium avium subsp. paratuberculosis
cgcgggaucggugccgac

SEQ ID NO: 949882 - RNA, 20 nt, Mycobacterium avium subsp. paratuberculosis
cgcgggaucggugccgacgg

SEQ ID NO: 949883 - RNA, 22 nt, Mycobacterium avium subsp. paratuberculosis
cgcgggaucggugccgacggug

SEQ ID NO: 949884 - RNA, 12 nt, Mycobacterium avium subsp. paratuberculosis
cgcgggcaucgc

SEQ ID NO: 949885 - RNA, 14 nt, Mycobacterium avium subsp. paratuberculosis
cgcgggcaucgccg

SEQ ID NO: 949886 - RNA, 23 nt, Mycobacterium avium subsp. paratuberculosis
cgcgggcaugaaccaggccgcgc

SEQ ID NO: 949887 - RNA, 12 nt, Mycobacterium avium subsp. paratuberculosis
cgcgggcaccgu

SEQ ID NO: 949888 - RNA, 16 nt, Mycobacterium avium subsp. paratuberculosis
cgcgggcaccgucguc

SEQ ID NO: 949889 - RNA, 17 nt, Mycobacterium avium subsp. paratuberculosis
cgcgggcacggcgaugu

SEQ ID NO: 949890 - RNA, 15 nt, Mycobacterium avium subsp. paratuberculosis
cgcgggcagccggcg

SEQ ID NO: 949891 - RNA, 19 nt, Mycobacterium avium subsp. paratuberculosis
cgcgggcagccggcgcccg

SEQ ID NO: 949892 - RNA, 20 nt, Mycobacterium avium subsp. paratuberculosis
cgcgggcagccggcgcccgc

SEQ ID NO: 949893 - RNA, 22 nt, Mycobacterium avium subsp. paratuberculosis
cgcgggcagccggcgcccgcag

SEQ ID NO: 949894 - RNA, 19 nt, Mycobacterium avium subsp. paratuberculosis
cgcgggcagcgagcacagc

SEQ ID NO: 949895 - RNA, 16 nt, Mycobacterium avium subsp. paratuberculosis
cgcgggcgcccguaga

SEQ ID NO: 949896 - RNA, 15 nt, Mycobacterium avium subsp. paratuberculosis
cgcgggcgcccucca

SEQ ID NO: 949897 - RNA, 12 nt, Mycobacterium avium subsp. paratuberculosis
cgcgggcgccga

SEQ ID NO: 949898 - RNA, 12 nt, Mycobacterium avium subsp. paratuberculosis
cgcgggcgaucu

SEQ ID NO: 949899 - RNA, 19 nt, Mycobacterium avium subsp. paratuberculosis
cgcgggcgaucuccagcgg

SEQ ID NO: 949900 - RNA, 19 nt, Mycobacterium avium subsp. paratuberculosis
cgcgggcgcauaccagcgc

SEQ ID NO: 949901 - RNA, 20 nt, Mycobacterium avium subsp. paratuberculosis
cgcgggcgcauaccagcgcu

SEQ ID NO: 949902 - RNA, 14 nt, Mycobacterium avium subsp. paratuberculosis
cgcgggcgcccagc

SEQ ID NO: 949903 - RNA, 12 nt, Mycobacterium avium subsp. paratuberculosis
cgcgggcgcccg

SEQ ID NO: 949904 - RNA, 16 nt, Mycobacterium avium subsp. paratuberculosis
cgcgggcgauucccgg

SEQ ID NO: 949905 - RNA, 23 nt, Mycobacterium avium subsp. paratuberculosis
cgcgggcgauucccggaugcugc

SEQ ID NO: 949906 - RNA, 20 nt, Mycobacterium avium subsp. paratuberculosis
cgcgggcgauuucgucggcg

SEQ ID NO: 949907 - RNA, 22 nt, Mycobacterium avium subsp. paratuberculosis
cgcgggcgauuucgucggcggu

SEQ ID NO: 949908 - RNA, 14 nt, Mycobacterium avium subsp. paratuberculosis
cgcgggcgacccgc

SEQ ID NO: 949909 - RNA, 17 nt, Mycobacterium avium subsp. paratuberculosis
cgcgggcgacccgcugg

SEQ ID NO: 949910 - RNA, 21 nt, Mycobacterium avium subsp. paratuberculosis
cgcgggcgaccugcgggccca

SEQ ID NO: 949911 - RNA, 18 nt, Mycobacterium avium subsp. paratuberculosis
cgcgggcgaccuggugcu

SEQ ID NO: 949912 - RNA, 21 nt, Mycobacterium avium subsp. paratuberculosis
cgcgggcgagcagcgcccggg

SEQ ID NO: 949913 - RNA, 13 nt, Mycobacterium avium subsp. paratuberculosis
cgcgggcgaugcg

SEQ ID NO: 949914 - RNA, 16 nt, Mycobacterium avium subsp. paratuberculosis
cgcgggcgaugcggcc

SEQ ID NO: 949915 - RNA, 23 nt, Mycobacterium avium subsp. paratuberculosis
cgcgguagaaccaacgcggcgcc

SEQ ID NO: 949916 - RNA, 17 nt, Mycobacterium avium subsp. paratuberculosis
cgcgguagacaccgccg

SEQ ID NO: 949917 - RNA, 18 nt, Mycobacterium avium subsp. paratuberculosis
cgcggucagcgucuggcg

SEQ ID NO: 949918 - RNA, 20 nt, Mycobacterium avium subsp. paratuberculosis
cgcggucagcucgaucgccg

SEQ ID NO: 949919 - RNA, 19 nt, Mycobacterium avium subsp. paratuberculosis
cgcgguaccgaugaccacc

SEQ ID NO: 949920 - RNA, 21 nt, Mycobacterium avium subsp. paratuberculosis
cgcgguaccgaugaccaccgc

SEQ ID NO: 949921 - RNA, 14 nt, Mycobacterium avium subsp. paratuberculosis
cgcgggcgcggcca

SEQ ID NO: 949922 - RNA, 18 nt, Mycobacterium avium subsp. paratuberculosis
cgcgggcgcggccagcgc

SEQ ID NO: 949923 - RNA, 19 nt, Mycobacterium avium subsp. paratuberculosis
cgcgggcggcaggucggcg

SEQ ID NO: 949924 - RNA, 21 nt, Mycobacterium avium subsp. paratuberculosis
cgcggguguuucggucggcgu

SEQ ID NO: 949925 - RNA, 12 nt, Mycobacterium avium subsp. paratuberculosis
cgcgggcgccgu

SEQ ID NO: 949926 - RNA, 21 nt, Mycobacterium avium subsp. paratuberculosis
cgcgggcgccguaggccgcgc

SEQ ID NO: 949927 - RNA, 13 nt, Mycobacterium avium subsp. paratuberculosis
cgcgggcgccguc

SEQ ID NO: 949928 - RNA, 14 nt, Mycobacterium avium subsp. paratuberculosis
cgcgggcgccgucg

SEQ ID NO: 949929 - RNA, 15 nt, Mycobacterium avium subsp. paratuberculosis
cgcgggcgccgucgg

SEQ ID NO: 949930 - RNA, 19 nt, Mycobacterium avium subsp. paratuberculosis
cgcgggcgccgucggggcu

SEQ ID NO: 949931 - RNA, 13 nt, Mycobacterium avium subsp. paratuberculosis
cgcgggcgcgcgc

SEQ ID NO: 949932 - RNA, 17 nt, Mycobacterium avium subsp. paratuberculosis
cgcgguaaagucuucgg

SEQ ID NO: 949933 - RNA, 15 nt, Mycobacterium avium subsp. paratuberculosis
cgcgguaacagagcg

SEQ ID NO: 949934 - RNA, 17 nt, Mycobacterium avium subsp. paratuberculosis
cgcggugcccggaacgg

SEQ ID NO: 949935 - RNA, 19 nt, Mycobacterium avium subsp. paratuberculosis
cgcggugccgaccugggcg

SEQ ID NO: 949936 - RNA, 23 nt, Mycobacterium avium subsp. paratuberculosis
cgcggugccgaccugggcggcca

SEQ ID NO: 949937 - RNA, 13 nt, Mycobacterium avium subsp. paratuberculosis
cgcggugcccagc

SEQ ID NO: 949938 - RNA, 18 nt, Mycobacterium avium subsp. paratuberculosis
cgcggugcccagccaggc

SEQ ID NO: 949939 - RNA, 20 nt, Mycobacterium avium subsp. paratuberculosis
cgcggugcccagccaggccg

SEQ ID NO: 949940 - RNA, 21 nt, Mycobacterium avium subsp. paratuberculosis
cgcggugcccagccaggccgc

SEQ ID NO: 949941 - RNA, 15 nt, Mycobacterium avium subsp. paratuberculosis
cgcggugcccagccg

SEQ ID NO: 949942 - RNA, 18 nt, Mycobacterium avium subsp. paratuberculosis
cgcggugcccagccgcag

SEQ ID NO: 949943 - RNA, 20 nt, Mycobacterium avium subsp. paratuberculosis
cgcggugcacggucagcucg

SEQ ID NO: 949944 - RNA, 14 nt, Mycobacterium avium subsp. paratuberculosis
cgcggugcagucgg

SEQ ID NO: 949945 - RNA, 21 nt, Mycobacterium avium subsp. paratuberculosis
cgcggugcagucggucgguca

SEQ ID NO: 949946 - RNA, 16 nt, Mycobacterium avium subsp. paratuberculosis
cgcggucuuuggcgua

SEQ ID NO: 949947 - RNA, 15 nt, Mycobacterium avium subsp. paratuberculosis
cgcggugaagucggu

SEQ ID NO: 949948 - RNA, 19 nt, Mycobacterium avium subsp. paratuberculosis
cgcggugaaguugccgccg

SEQ ID NO: 949949 - RNA, 20 nt, Mycobacterium avium subsp. paratuberculosis
cgcggugaguucaucgacgu

SEQ ID NO: 949950 - RNA, 21 nt, Mycobacterium avium subsp. paratuberculosis
cgcggugaguucaucgacguc

SEQ ID NO: 949951 - RNA, 22 nt, Mycobacterium avium subsp. paratuberculosis
cgcggugaucaggcccucgucg

SEQ ID NO: 949952 - RNA, 23 nt, Mycobacterium avium subsp. paratuberculosis
cgcggugaucaggcccucgucgg

SEQ ID NO: 949953 - RNA, 16 nt, Mycobacterium avium subsp. paratuberculosis
cgcggucugcggugcg

SEQ ID NO: 949954 - RNA, 20 nt, Mycobacterium avium subsp. paratuberculosis
cgcggucugcggugcgccca

SEQ ID NO: 949955 - RNA, 21 nt, Mycobacterium avium subsp. paratuberculosis
cgcggucucgaucugcaccag

SEQ ID NO: 949956 - RNA, 16 nt, Mycobacterium avium subsp. paratuberculosis
cgcggucuucgaacau

SEQ ID NO: 949957 - RNA, 14 nt, Mycobacterium avium subsp. paratuberculosis
cgcggugacgcgcc

SEQ ID NO: 949958 - RNA, 15 nt, Mycobacterium avium subsp. paratuberculosis
cgcggugacgcgccg

SEQ ID NO: 949959 - RNA, 16 nt, Mycobacterium avium subsp. paratuberculosis
cgcggugacgcgccgg

SEQ ID NO: 949960 - RNA, 17 nt, Mycobacterium avium subsp. paratuberculosis
cgcggugacgcgccggc

SEQ ID NO: 949961 - RNA, 20 nt, Mycobacterium avium subsp. paratuberculosis
cgcggugacgcgccggccca

SEQ ID NO: 949962 - RNA, 19 nt, Mycobacterium avium subsp. paratuberculosis
cgcggugagcaccggaucg

SEQ ID NO: 949963 - RNA, 23 nt, Mycobacterium avium subsp. paratuberculosis
cgcggugagcagcaugccgagca

SEQ ID NO: 949964 - RNA, 16 nt, Mycobacterium avium subsp. paratuberculosis
cgcggugagcgcgccg

SEQ ID NO: 949965 - RNA, 17 nt, Mycobacterium avium subsp. paratuberculosis
cgcggugagcggccgca

SEQ ID NO: 949966 - RNA, 16 nt, Mycobacterium avium subsp. paratuberculosis
cgcggugagcgugccg

SEQ ID NO: 949967 - RNA, 23 nt, Mycobacterium avium subsp. paratuberculosis
cgcggugagcgugccgaucgaga

SEQ ID NO: 949968 - RNA, 13 nt, Mycobacterium avium subsp. paratuberculosis
cgcggugaccgcc

SEQ ID NO: 949969 - RNA, 17 nt, Mycobacterium avium subsp. paratuberculosis
cgcggugaccgcccgcu

SEQ ID NO: 949970 - RNA, 17 nt, Mycobacterium avium subsp. paratuberculosis
cgcggugaccgccgcca

SEQ ID NO: 949971 - RNA, 18 nt, Mycobacterium avium subsp. paratuberculosis
cgcggugaccgccgccau

SEQ ID NO: 949972 - RNA, 16 nt, Mycobacterium avium subsp. paratuberculosis
cgcggugaccgcgccg

SEQ ID NO: 949973 - RNA, 19 nt, Mycobacterium avium subsp. paratuberculosis
cgcggugaccgcgccgcgg

SEQ ID NO: 949974 - RNA, 20 nt, Mycobacterium avium subsp. paratuberculosis
cgcggugaccgcggccucgu

SEQ ID NO: 949975 - RNA, 12 nt, Mycobacterium avium subsp. paratuberculosis
cgcggucggugg

SEQ ID NO: 949976 - RNA, 13 nt, Mycobacterium avium subsp. paratuberculosis
cgcggucgguggc

SEQ ID NO: 949977 - RNA, 16 nt, Mycobacterium avium subsp. paratuberculosis
cgcggucgguggcggu

SEQ ID NO: 949978 - RNA, 18 nt, Mycobacterium avium subsp. paratuberculosis
cgcggucgguggcggugc

SEQ ID NO: 949979 - RNA, 17 nt, Mycobacterium avium subsp. paratuberculosis
cgcggucgucgcccguc

SEQ ID NO: 949980 - RNA, 22 nt, Mycobacterium avium subsp. paratuberculosis
cgcggucgucgcccgucucggc

SEQ ID NO: 949981 - RNA, 23 nt, Mycobacterium avium subsp. paratuberculosis
cgcggucgucgcccgucucggcg

SEQ ID NO: 949982 - RNA, 16 nt, Mycobacterium avium subsp. paratuberculosis
cgcggucgucgucguc

SEQ ID NO: 949983 - RNA, 18 nt, Mycobacterium avium subsp. paratuberculosis
cgcggucgucgucgucgg

SEQ ID NO: 949984 - RNA, 23 nt, Mycobacterium avium subsp. paratuberculosis
cgcggucgucgucgucggugaug

SEQ ID NO: 949985 - RNA, 21 nt, Mycobacterium avium subsp. paratuberculosis
cgcggucgucuucuuggccgc

SEQ ID NO: 949986 - RNA, 18 nt, Mycobacterium avium subsp. paratuberculosis
cgcggucgacggaagccg

SEQ ID NO: 949987 - RNA, 15 nt, Mycobacterium avium subsp. paratuberculosis
cgcggucgaacaacg

SEQ ID NO: 949988 - RNA, 14 nt, Mycobacterium avium subsp. paratuberculosis
cgcggucccaggug

SEQ ID NO: 949989 - RNA, 20 nt, Mycobacterium avium subsp. paratuberculosis
cgcggucccaggugcugggc

SEQ ID NO: 949990 - RNA, 18 nt, Mycobacterium avium subsp. paratuberculosis
cgcgguccaucuccagcu

SEQ ID NO: 949991 - RNA, 23 nt, Mycobacterium avium subsp. paratuberculosis
cgcgguccaucuccagcuccgcg

SEQ ID NO: 949992 - RNA, 16 nt, Mycobacterium avium subsp. paratuberculosis
cgcgguccacggucag

SEQ ID NO: 949993 - RNA, 21 nt, Mycobacterium avium subsp. paratuberculosis
cgcgguccacggucagcgcgu

SEQ ID NO: 949994 - RNA, 20 nt, Mycobacterium avium subsp. paratuberculosis
cgcgguccacuuccgcgcag

SEQ ID NO: 949995 - RNA, 12 nt, Mycobacterium avium subsp. paratuberculosis
cgcgguccacgc

SEQ ID NO: 949996 - RNA, 14 nt, Mycobacterium avium subsp. paratuberculosis
cgcggucaucguca

SEQ ID NO: 949997 - RNA, 18 nt, Mycobacterium avium subsp. paratuberculosis
cgcggucaugcgcgggca

SEQ ID NO: 949998 - RNA, 21 nt, Mycobacterium avium subsp. paratuberculosis
cgcgguagaucgacagggcgu

SEQ ID NO: 949999 - RNA, 17 nt, Mycobacterium avium subsp. paratuberculosis
cgcggucaucgagccgg

SEQ ID NO: 950000 - RNA, 20 nt, Mycobacterium avium subsp. paratuberculosis
cgcggucaucgagccgguac

SEQ ID NO: 950001 - RNA, 17 nt, Mycobacterium avium subsp. paratuberculosis
cgcgucauggccgucgg

SEQ ID NO: 950002 - RNA, 21 nt, Mycobacterium avium subsp. paratuberculosis
cgcgucauggccgucgggucg

SEQ ID NO: 950003 - RNA, 14 nt, Mycobacterium avium subsp. paratuberculosis
cgcguccacgaccc

SEQ ID NO: 950004 - RNA, 17 nt, Mycobacterium avium subsp. paratuberculosis
cgcguccacgaccccgg

SEQ ID NO: 950005 - RNA, 13 nt, Mycobacterium avium subsp. paratuberculosis
cgcguccagcagc

SEQ ID NO: 950006 - RNA, 23 nt, Mycobacterium avium subsp. paratuberculosis
cgcguccagcaugcccacgccgu

SEQ ID NO: 950007 - RNA, 15 nt, Mycobacterium avium subsp. paratuberculosis
cgcgucagccgucgu

SEQ ID NO: 950008 - RNA, 18 nt, Mycobacterium avium subsp. paratuberculosis
cgcgucagccgucgucgu

SEQ ID NO: 950009 - RNA, 17 nt, Mycobacterium avium subsp. paratuberculosis
cgcguagggcagggucg

SEQ ID NO: 950010 - RNA, 19 nt, Mycobacterium avium subsp. paratuberculosis
cgcguagcucagugguaga

SEQ ID NO: 950011 - RNA, 15 nt, Mycobacterium avium subsp. paratuberculosis
cgcguagcucgccgc

SEQ ID NO: 950012 - RNA, 16 nt, Mycobacterium avium subsp. paratuberculosis
cgcguaggugcggucg

SEQ ID NO: 950013 - RNA, 18 nt, Mycobacterium avium subsp. paratuberculosis
cgcgucacgcuggcguga

SEQ ID NO: 950014 - RNA, 16 nt, Mycobacterium avium subsp. paratuberculosis
cgcgucacgucggccu

SEQ ID NO: 950015 - RNA, 22 nt, Mycobacterium avium subsp. paratuberculosis
cgcguacgccgccuugacgccg

SEQ ID NO: 950016 - RNA, 13 nt, Mycobacterium avium subsp. paratuberculosis
cgcguagcgccgc

SEQ ID NO: 950017 - RNA, 20 nt, Mycobacterium avium subsp. paratuberculosis
cgcguacgggaugaucagca

SEQ ID NO: 950018 - RNA, 21 nt, Mycobacterium avium subsp. paratuberculosis
cgcguagaucaucuggcuggu

SEQ ID NO: 950019 - RNA, 13 nt, Mycobacterium avium subsp. paratuberculosis
cgcgguggucagc

SEQ ID NO: 950020 - RNA, 22 nt, Mycobacterium avium subsp. paratuberculosis
cgcgguggucagcaccggcgug

SEQ ID NO: 950021 - RNA, 18 nt, Mycobacterium avium subsp. paratuberculosis
cgcgguggucagcggcgc

SEQ ID NO: 950022 - RNA, 20 nt, Mycobacterium avium subsp. paratuberculosis
cgcgguggucagcggcgcca

SEQ ID NO: 950023 - RNA, 18 nt, Mycobacterium avium subsp. paratuberculosis
cgcggugggcgcgggccg

SEQ ID NO: 950024 - RNA, 19 nt, Mycobacterium avium subsp. paratuberculosis
cgcggugggcgcgggccgc

SEQ ID NO: 950025 - RNA, 20 nt, Mycobacterium avium subsp. paratuberculosis
cgcggugggcgcgggccgcg

SEQ ID NO: 950026 - RNA, 21 nt, Mycobacterium avium subsp. paratuberculosis
cgcggugggcgcgggccgcgu

SEQ ID NO: 950027 - RNA, 17 nt, Mycobacterium avium subsp. paratuberculosis
cgcggugggcggcggga

SEQ ID NO: 950028 - RNA, 14 nt, Mycobacterium avium subsp. paratuberculosis
cgcggugggcucgg

SEQ ID NO: 950029 - RNA, 19 nt, Mycobacterium avium subsp. paratuberculosis
cgcggugggcucggcgccg

SEQ ID NO: 950030 - RNA, 21 nt, Mycobacterium avium subsp. paratuberculosis
cgcggugggcucggcgccgac

SEQ ID NO: 950031 - RNA, 23 nt, Mycobacterium avium subsp. paratuberculosis
cgcgguggguccgccgggcgcga

SEQ ID NO: 950032 - RNA, 13 nt, Mycobacterium avium subsp. paratuberculosis
cgcggugccgcag

SEQ ID NO: 950033 - RNA, 13 nt, Mycobacterium avium subsp. paratuberculosis
cgcgguggcgccg

SEQ ID NO: 950034 - RNA, 12 nt, Mycobacterium avium subsp. paratuberculosis
cgcgguggcggu

SEQ ID NO: 950035 - RNA, 22 nt, Mycobacterium avium subsp. paratuberculosis
cgcgguggcgugcagcgcggcg

SEQ ID NO: 950036 - RNA, 23 nt, Mycobacterium avium subsp. paratuberculosis
cgcgguggcgugcagcgcggcga

SEQ ID NO: 950037 - RNA, 13 nt, Mycobacterium avium subsp. paratuberculosis
cgcggugucggcg

SEQ ID NO: 950038 - RNA, 18 nt, Mycobacterium avium subsp. paratuberculosis
cgcgguguagucgcugac

SEQ ID NO: 950039 - RNA, 19 nt, Mycobacterium avium subsp. paratuberculosis
cgcggugguguugcggugg

SEQ ID NO: 950040 - RNA, 19 nt, Mycobacterium avium subsp. paratuberculosis
cgcgguguacagcgcgccg

SEQ ID NO: 950041 - RNA, 20 nt, Mycobacterium avium subsp. paratuberculosis
cgcgguguacagcgcgccgc

SEQ ID NO: 950042 - RNA, 22 nt, Mycobacterium avium subsp. paratuberculosis
cgcgguguacagcgcgccgcgg

SEQ ID NO: 950043 - RNA, 17 nt, Mycobacterium avium subsp. paratuberculosis
cgcgguggucagcaccg

SEQ ID NO: 950044 - RNA, 17 nt, Mycobacterium avium subsp. paratuberculosis
cgcgucccgggccuugg

SEQ ID NO: 950045 - RNA, 16 nt, Mycobacterium avium subsp. paratuberculosis
cgcgucccuggcgaug

SEQ ID NO: 950046 - RNA, 17 nt, Mycobacterium avium subsp. paratuberculosis
cgcgucccuggcgauga

SEQ ID NO: 950047 - RNA, 19 nt, Mycobacterium avium subsp. paratuberculosis
cgcgucccuggcgaugauc

SEQ ID NO: 950048 - RNA, 21 nt, Mycobacterium avium subsp. paratuberculosis
cgcguccauggucgagccgca

SEQ ID NO: 950049 - RNA, 14 nt, Mycobacterium avium subsp. paratuberculosis
cgcgucccacaucu

SEQ ID NO: 950050 - RNA, 15 nt, Mycobacterium avium subsp. paratuberculosis
cgcguccccgcgccg

SEQ ID NO: 950051 - RNA, 16 nt, Mycobacterium avium subsp. paratuberculosis
cgcguccccgcgccgg

SEQ ID NO: 950052 - RNA, 18 nt, Mycobacterium avium subsp. paratuberculosis
cgcguccccgcgccgggc

SEQ ID NO: 950053 - RNA, 18 nt, Mycobacterium avium subsp. paratuberculosis
cgcguccaggugcgccgc

SEQ ID NO: 950054 - RNA, 22 nt, Mycobacterium avium subsp. paratuberculosis
cgcguccaggugcgccgccgcg

SEQ ID NO: 950055 - RNA, 14 nt, Mycobacterium avium subsp. paratuberculosis
cgcguccguagugc

SEQ ID NO: 950056 - RNA, 20 nt, Mycobacterium avium subsp. paratuberculosis
cgcguccguagugcucggcg

SEQ ID NO: 950057 - RNA, 22 nt, Mycobacterium avium subsp. paratuberculosis
cgcguccguagugcucggcguc

SEQ ID NO: 950058 - RNA, 23 nt, Mycobacterium avium subsp. paratuberculosis
cgcguccguagugcucggcgucc

SEQ ID NO: 950059 - RNA, 23 nt, Mycobacterium avium subsp. paratuberculosis
cgcguccggaggugccggccggu

SEQ ID NO: 950060 - RNA, 14 nt, Mycobacterium avium subsp. paratuberculosis
cgcguccggggugc

SEQ ID NO: 950061 - RNA, 14 nt, Mycobacterium avium subsp. paratuberculosis
cgcguccgcgggcg

SEQ ID NO: 950062 - RNA, 21 nt, Mycobacterium avium subsp. paratuberculosis
cgcguccgcgguuucaccgug

SEQ ID NO: 950063 - RNA, 18 nt, Mycobacterium avium subsp. paratuberculosis
cgcguccgcgucgucgag

SEQ ID NO: 950064 - RNA, 15 nt, Mycobacterium avium subsp. paratuberculosis
cgcguccgcgaucgu

SEQ ID NO: 950065 - RNA, 16 nt, Mycobacterium avium subsp. paratuberculosis
cgcguccgcgaucguc

SEQ ID NO: 950066 - RNA, 20 nt, Mycobacterium avium subsp. paratuberculosis
cgcguccgcgaucgucucgu

SEQ ID NO: 950067 - RNA, 13 nt, Mycobacterium avium subsp. paratuberculosis
cgcguccgacggc

SEQ ID NO: 950068 - RNA, 16 nt, Mycobacterium avium subsp. paratuberculosis
cgcguccgacggcugg

SEQ ID NO: 950069 - RNA, 14 nt, Mycobacterium avium subsp. paratuberculosis
cgcguccgagcagc

SEQ ID NO: 950070 - RNA, 16 nt, Mycobacterium avium subsp. paratuberculosis
cgcgucgagcagcacc

SEQ ID NO: 950071 - RNA, 18 nt, Mycobacterium avium subsp. paratuberculosis
cgcgucgagcagcaccac

SEQ ID NO: 950072 - RNA, 23 nt, Mycobacterium avium subsp. paratuberculosis
cgcgucgagcagcaccacccgca

SEQ ID NO: 950073 - RNA, 13 nt, Mycobacterium avium subsp. paratuberculosis
cgcgucgaggucg

SEQ ID NO: 950074 - RNA, 17 nt, Mycobacterium avium subsp. paratuberculosis
cgcgucgaggucgcgca

SEQ ID NO: 950075 - RNA, 14 nt, Mycobacterium avium subsp. paratuberculosis
cgcgucgacgucgg

SEQ ID NO: 950076 - RNA, 17 nt, Mycobacterium avium subsp. paratuberculosis
cgcgucgacgucgggca

SEQ ID NO: 950077 - RNA, 18 nt, Mycobacterium avium subsp. paratuberculosis
cgcgucgacguucgccgc

SEQ ID NO: 950078 - RNA, 20 nt, Mycobacterium avium subsp. paratuberculosis
cgcgucgacguucgccgcca

SEQ ID NO: 950079 - RNA, 16 nt, Mycobacterium avium subsp. paratuberculosis
cgcgucgagcaccugg

SEQ ID NO: 950080 - RNA, 17 nt, Mycobacterium avium subsp. paratuberculosis
cgcgucgagcaccugga

SEQ ID NO: 950081 - RNA, 14 nt, Mycobacterium avium subsp. paratuberculosis
cgcgucgagcagca

SEQ ID NO: 950082 - RNA, 14 nt, Mycobacterium avium subsp. paratuberculosis
cgcgucgaccagcc

SEQ ID NO: 950083 - RNA, 15 nt, Mycobacterium avium subsp. paratuberculosis
cgcgucgaccagccg

SEQ ID NO: 950084 - RNA, 16 nt, Mycobacterium avium subsp. paratuberculosis
cgcgucgaccagccgg

SEQ ID NO: 950085 - RNA, 15 nt, Mycobacterium avium subsp. paratuberculosis
cgcgucgaaugcgcu

SEQ ID NO: 950086 - RNA, 17 nt, Mycobacterium avium subsp. paratuberculosis
cgcgucgaccgccgcga

SEQ ID NO: 950087 - RNA, 13 nt, Mycobacterium avium subsp. paratuberculosis
cgcgucgacgaug

SEQ ID NO: 950088 - RNA, 20 nt, Mycobacterium avium subsp. paratuberculosis
cgcgucgacgauggcgucca

SEQ ID NO: 950089 - RNA, 14 nt, Mycobacterium avium subsp. paratuberculosis
cgcgucgacgccgc

SEQ ID NO: 950090 - RNA, 17 nt, Mycobacterium avium subsp. paratuberculosis
cgcgucgacgccgcugc

SEQ ID NO: 950091 - RNA, 12 nt, Mycobacterium avium subsp. paratuberculosis
cgcgucgacgcg

SEQ ID NO: 950092 - RNA, 13 nt, Mycobacterium avium subsp. paratuberculosis
cgcgucgacgcgg

SEQ ID NO: 950093 - RNA, 15 nt, Mycobacterium avium subsp. paratuberculosis
cgcgucgacgcgguc

SEQ ID NO: 950094 - RNA, 18 nt, Mycobacterium avium subsp. paratuberculosis
cgcgucgacggcaagcag

SEQ ID NO: 950095 - RNA, 17 nt, Mycobacterium avium subsp. paratuberculosis
cgcgucgacggcgccgg

SEQ ID NO: 950096 - RNA, 16 nt, Mycobacterium avium subsp. paratuberculosis
cgcgucgacaccccgc

SEQ ID NO: 950097 - RNA, 20 nt, Mycobacterium avium subsp. paratuberculosis
cgcgucgacaccccgcucgg

SEQ ID NO: 950098 - RNA, 22 nt, Mycobacterium avium subsp. paratuberculosis
cgcgucgacaccccgcucggcc

SEQ ID NO: 950099 - RNA, 23 nt, Mycobacterium avium subsp. paratuberculosis
cgcgucgacaccccgcucggcca

SEQ ID NO: 950100 - RNA, 20 nt, Mycobacterium avium subsp. paratuberculosis
cgcguccuucuccgccgggc

SEQ ID NO: 950101 - RNA, 15 nt, Mycobacterium avium subsp. paratuberculosis
cgcgucgaacacccu

SEQ ID NO: 950102 - RNA, 15 nt, Mycobacterium avium subsp. paratuberculosis
cgcgucgaacagccg

SEQ ID NO: 950103 - RNA, 20 nt, Mycobacterium avium subsp. paratuberculosis
cgcgucgaacagccgggccg

SEQ ID NO: 950104 - RNA, 21 nt, Mycobacterium avium subsp. paratuberculosis
cgcgucgaacagccgggccgc

SEQ ID NO: 950105 - RNA, 17 nt, Mycobacterium avium subsp. paratuberculosis
cgcguccucgccguacg

SEQ ID NO: 950106 - RNA, 22 nt, Mycobacterium avium subsp. paratuberculosis
cgcguccucgccguacgcgccg

SEQ ID NO: 950107 - RNA, 16 nt, Mycobacterium avium subsp. paratuberculosis
cgcguccucgucgaug

SEQ ID NO: 950108 - RNA, 20 nt, Mycobacterium avium subsp. paratuberculosis
cgcguccugcagcgccgucc

SEQ ID NO: 950109 - RNA, 14 nt, Mycobacterium avium subsp. paratuberculosis
cgcguccugcaggc

SEQ ID NO: 950110 - RNA, 16 nt, Mycobacterium avium subsp. paratuberculosis
cgcguccugcaggcag

SEQ ID NO: 950111 - RNA, 19 nt, Mycobacterium avium subsp. paratuberculosis
cgcguccugcaggcaggcc

SEQ ID NO: 950112 - RNA, 20 nt, Mycobacterium avium subsp. paratuberculosis
cgcguccugcaggcaggccg

SEQ ID NO: 950113 - RNA, 21 nt, Mycobacterium avium subsp. paratuberculosis
cgcgauucgguaccagggcag

SEQ ID NO: 950114 - RNA, 18 nt, Mycobacterium avium subsp. paratuberculosis
cgcgauucucgcugcggc

SEQ ID NO: 950115 - RNA, 20 nt, Mycobacterium avium subsp. paratuberculosis
cgcgauuuccgguugcggca

SEQ ID NO: 950116 - RNA, 21 nt, Mycobacterium avium subsp. paratuberculosis
cgcgauuuccgguugcggcag

SEQ ID NO: 950117 - RNA, 23 nt, Mycobacterium avium subsp. paratuberculosis
cgcgauuuccgguugcggcagca

SEQ ID NO: 950118 - RNA, 16 nt, Mycobacterium avium subsp. paratuberculosis
cgcgcaaacugacagg

SEQ ID NO: 950119 - RNA, 23 nt, Mycobacterium avium subsp. paratuberculosis
cgcgcaaacugacaggcggucgu

SEQ ID NO: 950120 - RNA, 14 nt, Mycobacterium avium subsp. paratuberculosis
cgcgaugucgacgg

SEQ ID NO: 950121 - RNA, 15 nt, Mycobacterium avium subsp. paratuberculosis
cgcgaugucgacgga

SEQ ID NO: 950122 - RNA, 16 nt, Mycobacterium avium subsp. paratuberculosis
cgcgauguccgacagc

SEQ ID NO: 950123 - RNA, 21 nt, Mycobacterium avium subsp. paratuberculosis
cgcgauguccgacagcccgcc

SEQ ID NO: 950124 - RNA, 13 nt, Mycobacterium avium subsp. paratuberculosis
cgcgauguagcgg

SEQ ID NO: 950125 - RNA, 22 nt, Mycobacterium avium subsp. paratuberculosis
cgcgauguagcggacgggccgc

SEQ ID NO: 950126 - RNA, 18 nt, Mycobacterium avium subsp. paratuberculosis
cgcgauguaggugcgcga

SEQ ID NO: 950127 - RNA, 20 nt, Mycobacterium avium subsp. paratuberculosis
cgcgcaacagcgucucgacg

SEQ ID NO: 950128 - RNA, 23 nt, Mycobacterium avium subsp. paratuberculosis
cgcgcacccgcacgugcgcgccg

SEQ ID NO: 950129 - RNA, 15 nt, Mycobacterium avium subsp. paratuberculosis
cgcgcacccgggacc

SEQ ID NO: 950130 - RNA, 22 nt, Mycobacterium avium subsp. paratuberculosis
cgcgcacccguaacacgaucac

SEQ ID NO: 950131 - RNA, 13 nt, Mycobacterium avium subsp. paratuberculosis
cgcgcaacgacga

SEQ ID NO: 950132 - RNA, 21 nt, Mycobacterium avium subsp. paratuberculosis
cgcgcaacgauucacccagcg

SEQ ID NO: 950133 - RNA, 16 nt, Mycobacterium avium subsp. paratuberculosis
cgcgcaccuggucggu

SEQ ID NO: 950134 - RNA, 20 nt, Mycobacterium avium subsp. paratuberculosis
cgcgcaccuggucggucagc

SEQ ID NO: 950135 - RNA, 13 nt, Mycobacterium avium subsp. paratuberculosis
cgcgcaccggcgc

SEQ ID NO: 950136 - RNA, 15 nt, Mycobacterium avium subsp. paratuberculosis
cgcgcaccggcgcug

SEQ ID NO: 950137 - RNA, 21 nt, Mycobacterium avium subsp. paratuberculosis
cgcgcaccgggaccagcgcgg

SEQ ID NO: 950138 - RNA, 22 nt, Mycobacterium avium subsp. paratuberculosis
cgcgcaccgggaccagcgcggu

SEQ ID NO: 950139 - RNA, 22 nt, Mycobacterium avium subsp. paratuberculosis
cgcgcaccgguuugucggcgcc

SEQ ID NO: 950140 - RNA, 12 nt, Mycobacterium avium subsp. paratuberculosis
cgcgcaccgcga

SEQ ID NO: 950141 - RNA, 12 nt, Mycobacterium avium subsp. paratuberculosis
cgcgcaccgcgc

SEQ ID NO: 950142 - RNA, 19 nt, Mycobacterium avium subsp. paratuberculosis
cgcgcaccgcgcguucgag

SEQ ID NO: 950143 - RNA, 12 nt, Mycobacterium avium subsp. paratuberculosis
cgcgcaccgcgg

SEQ ID NO: 950144 - RNA, 14 nt, Mycobacterium avium subsp. paratuberculosis
cgcgcaccgccacc

SEQ ID NO: 950145 - RNA, 13 nt, Mycobacterium avium subsp. paratuberculosis
cgcgcaccgcccc

SEQ ID NO: 950146 - RNA, 13 nt, Mycobacterium avium subsp. paratuberculosis
cgcgcaccgcggc

SEQ ID NO: 950147 - RNA, 15 nt, Mycobacterium avium subsp. paratuberculosis
cgcgcaccgcggcgg

SEQ ID NO: 950148 - RNA, 14 nt, Mycobacterium avium subsp. paratuberculosis
cgcgcaccgcgggc

SEQ ID NO: 950149 - RNA, 16 nt, Mycobacterium avium subsp. paratuberculosis
cgcgcaccgcgggcag

SEQ ID NO: 950150 - RNA, 17 nt, Mycobacterium avium subsp. paratuberculosis
cgcgcaccgcgggcucg

SEQ ID NO: 950151 - RNA, 18 nt, Mycobacterium avium subsp. paratuberculosis
cgcgaucuccgucaccgu

SEQ ID NO: 950152 - RNA, 21 nt, Mycobacterium avium subsp. paratuberculosis
cgcgaucgguguccagccgca

SEQ ID NO: 950153 - RNA, 14 nt, Mycobacterium avium subsp. paratuberculosis
cgcgaucgucgacc

SEQ ID NO: 950154 - RNA, 15 nt, Mycobacterium avium subsp. paratuberculosis
cgcgaucgucgacca

SEQ ID NO: 950155 - RNA, 17 nt, Mycobacterium avium subsp. paratuberculosis
cgcgaucugcucggugu

SEQ ID NO: 950156 - RNA, 15 nt, Mycobacterium avium subsp. paratuberculosis
cgcgaugguggcguc

SEQ ID NO: 950157 - RNA, 17 nt, Mycobacterium avium subsp. paratuberculosis
cgcgaucaggcugccgc

SEQ ID NO: 950158 - RNA, 18 nt, Mycobacterium avium subsp. paratuberculosis
cgcgaucaggcugccgcu

SEQ ID NO: 950159 - RNA, 19 nt, Mycobacterium avium subsp. paratuberculosis
cgcgaucagggccgcggcc

SEQ ID NO: 950160 - RNA, 17 nt, Mycobacterium avium subsp. paratuberculosis
cgcgaucagguccggaa

SEQ ID NO: 950161 - RNA, 15 nt, Mycobacterium avium subsp. paratuberculosis
cgcgauccagcgcug

SEQ ID NO: 950162 - RNA, 23 nt, Mycobacterium avium subsp. paratuberculosis
cgcgauccagcgcuggccggcca

SEQ ID NO: 950163 - RNA, 13 nt, Mycobacterium avium subsp. paratuberculosis
cgcgaucgcgguc

SEQ ID NO: 950164 - RNA, 15 nt, Mycobacterium avium subsp. paratuberculosis
cgcgaucgcggucca

SEQ ID NO: 950165 - RNA, 17 nt, Mycobacterium avium subsp. paratuberculosis
cgcgaucggauggugcc

SEQ ID NO: 950166 - RNA, 18 nt, Mycobacterium avium subsp. paratuberculosis
cgcgaucggcaggucguc

SEQ ID NO: 950167 - RNA, 20 nt, Mycobacterium avium subsp. paratuberculosis
cgcgaucggcaggucgucga

SEQ ID NO: 950168 - RNA, 23 nt, Mycobacterium avium subsp. paratuberculosis
cgcgaucggcaggucgucgacgu

SEQ ID NO: 950169 - RNA, 17 nt, Mycobacterium avium subsp. paratuberculosis
cgcgaucggcgagccgg

SEQ ID NO: 950170 - RNA, 21 nt, Mycobacterium avium subsp. paratuberculosis
cgcgaucggcgagccgggacc

SEQ ID NO: 950171 - RNA, 14 nt, Mycobacterium avium subsp. paratuberculosis
cgcgaucggcgcca

SEQ ID NO: 950172 - RNA, 17 nt, Mycobacterium avium subsp. paratuberculosis
cgcgaucggcgccacga

SEQ ID NO: 950173 - RNA, 22 nt, Mycobacterium avium subsp. paratuberculosis
cgcgaucggcgccacgaccagc

SEQ ID NO: 950174 - RNA, 23 nt, Mycobacterium avium subsp. paratuberculosis
cgcgaucagcucguggcgggccc

SEQ ID NO: 950175 - RNA, 15 nt, Mycobacterium avium subsp. paratuberculosis
cgcgaucaggccggc

SEQ ID NO: 950176 - RNA, 17 nt, Mycobacterium avium subsp. paratuberculosis
cgcgaucaggccggcca

SEQ ID NO: 950177 - RNA, 21 nt, Mycobacterium avium subsp. paratuberculosis
cgcgaucaggccggccaccag

SEQ ID NO: 950178 - RNA, 13 nt, Mycobacterium avium subsp. paratuberculosis
cgcgaucagcgcc

SEQ ID NO: 950179 - RNA, 14 nt, Mycobacterium avium subsp. paratuberculosis
cgcgaucagcgccg

SEQ ID NO: 950180 - RNA, 16 nt, Mycobacterium avium subsp. paratuberculosis
cgcgaucagcgccguc

SEQ ID NO: 950181 - RNA, 15 nt, Mycobacterium avium subsp. paratuberculosis
cgcgaucaccgcggc

SEQ ID NO: 950182 - RNA, 17 nt, Mycobacterium avium subsp. paratuberculosis
cgcgaucaccgcggcca

SEQ ID NO: 950183 - RNA, 20 nt, Mycobacterium avium subsp. paratuberculosis
cgcgaucacguucucggcga

SEQ ID NO: 950184 - RNA, 21 nt, Mycobacterium avium subsp. paratuberculosis
cgcgaucacguucucggcgaa

SEQ ID NO: 950185 - RNA, 19 nt, Mycobacterium avium subsp. paratuberculosis
cgcgaucagccccagggug

SEQ ID NO: 950186 - RNA, 21 nt, Mycobacterium avium subsp. paratuberculosis
cgcgaucagccccagggugcg

SEQ ID NO: 950187 - RNA, 22 nt, Mycobacterium avium subsp. paratuberculosis
cgcgaucaacaccgguccggcc

SEQ ID NO: 950188 - RNA, 16 nt, Mycobacterium avium subsp. paratuberculosis
cgcgaucaacgggucg

SEQ ID NO: 950189 - RNA, 16 nt, Mycobacterium avium subsp. paratuberculosis
cgcgaucacaccacca

SEQ ID NO: 950190 - RNA, 22 nt, Mycobacterium avium subsp. paratuberculosis
cgcgaucaccaccccggugccg

SEQ ID NO: 950191 - RNA, 23 nt, Mycobacterium avium subsp. paratuberculosis
cgcgaggucgacggagucgucgg

SEQ ID NO: 950192 - RNA, 20 nt, Mycobacterium avium subsp. paratuberculosis
cgcgaguaggcgaagagcgg

SEQ ID NO: 950193 - RNA, 16 nt, Mycobacterium avium subsp. paratuberculosis
cgcgagucaccggcuc

SEQ ID NO: 950194 - RNA, 17 nt, Mycobacterium avium subsp. paratuberculosis
cgcgagucaccggcucg

SEQ ID NO: 950195 - RNA, 15 nt, Mycobacterium avium subsp. paratuberculosis
cgcgagucgagcacc

SEQ ID NO: 950196 - RNA, 17 nt, Mycobacterium avium subsp. paratuberculosis
cgcgagucgagcaccgc

SEQ ID NO: 950197 - RNA, 19 nt, Mycobacterium avium subsp. paratuberculosis
cgcgagucgagcaccgcga

SEQ ID NO: 950198 - RNA, 20 nt, Mycobacterium avium subsp. paratuberculosis
cgcgagucgagcaccgcgac

SEQ ID NO: 950199 - RNA, 21 nt, Mycobacterium avium subsp. paratuberculosis
cgcgagucgagcaccgcgacc

SEQ ID NO: 950200 - RNA, 22 nt, Mycobacterium avium subsp. paratuberculosis
cgcgagucgagcaccgcgacca

SEQ ID NO: 950201 - RNA, 15 nt, Mycobacterium avium subsp. paratuberculosis
cgcgacgaccgccug

SEQ ID NO: 950202 - RNA, 19 nt, Mycobacterium avium subsp. paratuberculosis
cgcgaccugcuuggcggcc

SEQ ID NO: 950203 - RNA, 20 nt, Mycobacterium avium subsp. paratuberculosis
cgcgaccugcuuggcggccu

SEQ ID NO: 950204 - RNA, 22 nt, Mycobacterium avium subsp. paratuberculosis
cgcgaccuguuugaacaccucg

SEQ ID NO: 950205 - RNA, 12 nt, Mycobacterium avium subsp. paratuberculosis
cgcgacgaucac

SEQ ID NO: 950206 - RNA, 19 nt, Mycobacterium avium subsp. paratuberculosis
cgcgacgaucagcagccgg

SEQ ID NO: 950207 - RNA, 22 nt, Mycobacterium avium subsp. paratuberculosis
cgcgacgaucagcagccgggcc

SEQ ID NO: 950208 - RNA, 12 nt, Mycobacterium avium subsp. paratuberculosis
cgcgacgaucgc

SEQ ID NO: 950209 - RNA, 17 nt, Mycobacterium avium subsp. paratuberculosis
cgcgacgaucgcgacgg

SEQ ID NO: 950210 - RNA, 18 nt, Mycobacterium avium subsp. paratuberculosis
cgcgacgaucgcgacggc

SEQ ID NO: 950211 - RNA, 12 nt, Mycobacterium avium subsp. paratuberculosis
cgcgacgagcgg

SEQ ID NO: 950212 - RNA, 13 nt, Mycobacterium avium subsp. paratuberculosis
cgcgacgaugccg

SEQ ID NO: 950213 - RNA, 17 nt, Mycobacterium avium subsp. paratuberculosis
cgcgacgaugccggcgu

SEQ ID NO: 950214 - RNA, 19 nt, Mycobacterium avium subsp. paratuberculosis
cgcgacgaugccggcgucg

SEQ ID NO: 950215 - RNA, 17 nt, Mycobacterium avium subsp. paratuberculosis
cgcgacgaugucgaccc

SEQ ID NO: 950216 - RNA, 13 nt, Mycobacterium avium subsp. paratuberculosis
cgcgacgcacgcc

SEQ ID NO: 950217 - RNA, 14 nt, Mycobacterium avium subsp. paratuberculosis
cgcgacgcacgccg

SEQ ID NO: 950218 - RNA, 15 nt, Mycobacterium avium subsp. paratuberculosis
cgcgacgcacgccgg

SEQ ID NO: 950219 - RNA, 16 nt, Mycobacterium avium subsp. paratuberculosis
cgcgacgcacgccggc

SEQ ID NO: 950220 - RNA, 13 nt, Mycobacterium avium subsp. paratuberculosis
cgcgacgccagca

SEQ ID NO: 950221 - RNA, 14 nt, Mycobacterium avium subsp. paratuberculosis
cgcgacgccagcac

SEQ ID NO: 950222 - RNA, 15 nt, Mycobacterium avium subsp. paratuberculosis
cgcgacgccagcacc

SEQ ID NO: 950223 - RNA, 22 nt, Mycobacterium avium subsp. paratuberculosis
cgcgacgccagcaccuucgggc

SEQ ID NO: 950224 - RNA, 15 nt, Mycobacterium avium subsp. paratuberculosis
cgcgaccucgguggu

SEQ ID NO: 950225 - RNA, 16 nt, Mycobacterium avium subsp. paratuberculosis
cgcgaccucgguggug

SEQ ID NO: 950226 - RNA, 14 nt, Mycobacterium avium subsp. paratuberculosis
cgcgacgaacagca

SEQ ID NO: 950227 - RNA, 16 nt, Mycobacterium avium subsp. paratuberculosis
cgcgacgaacagcacc

SEQ ID NO: 950228 - RNA, 18 nt, Mycobacterium avium subsp. paratuberculosis
cgcgacgaacagcaccgc

SEQ ID NO: 950229 - RNA, 20 nt, Mycobacterium avium subsp. paratuberculosis
cgcgacgaacagcaccgcca

SEQ ID NO: 950230 - RNA, 18 nt, Mycobacterium avium subsp. paratuberculosis
cgcgacgaagccggugcc

SEQ ID NO: 950231 - RNA, 14 nt, Mycobacterium avium subsp. paratuberculosis
cgcgacgaagcggu

SEQ ID NO: 950232 - RNA, 21 nt, Mycobacterium avium subsp. paratuberculosis
cgcgacgaagcggucgcggaa

SEQ ID NO: 950233 - RNA, 16 nt, Mycobacterium avium subsp. paratuberculosis
cgcgacgaauccggug

SEQ ID NO: 950234 - RNA, 18 nt, Mycobacterium avium subsp. paratuberculosis
cgcgacgaauccggugac

SEQ ID NO: 950235 - RNA, 22 nt, Mycobacterium avium subsp. paratuberculosis
cgcgacgaauugcagauccaga

SEQ ID NO: 950236 - RNA, 13 nt, Mycobacterium avium subsp. paratuberculosis
cgcgacgacacca

SEQ ID NO: 950237 - RNA, 23 nt, Mycobacterium avium subsp. paratuberculosis
cgcgacgacaccaccgugcuggc

SEQ ID NO: 950238 - RNA, 19 nt, Mycobacterium avium subsp. paratuberculosis
cgcgaccgucgggacggcc

SEQ ID NO: 950239 - RNA, 13 nt, Mycobacterium avium subsp. paratuberculosis
cgcgaccgcgucg

SEQ ID NO: 950240 - RNA, 15 nt, Mycobacterium avium subsp. paratuberculosis
cgcgaccgcgucgac

SEQ ID NO: 950241 - RNA, 14 nt, Mycobacterium avium subsp. paratuberculosis
cgcgaccgcgcggc

SEQ ID NO: 950242 - RNA, 14 nt, Mycobacterium avium subsp. paratuberculosis
cgcgaccgccucgu

SEQ ID NO: 950243 - RNA, 15 nt, Mycobacterium avium subsp. paratuberculosis
cgcgaccgccucguc

SEQ ID NO: 950244 - RNA, 22 nt, Mycobacterium avium subsp. paratuberculosis
cgcgaccgcgaucagggccgcg

SEQ ID NO: 950245 - RNA, 14 nt, Mycobacterium avium subsp. paratuberculosis
cgcgaccgcgaugc

SEQ ID NO: 950246 - RNA, 23 nt, Mycobacterium avium subsp. paratuberculosis
cgcgacgcggcucgcgcgguguu

SEQ ID NO: 950247 - RNA, 14 nt, Mycobacterium avium subsp. paratuberculosis
cgcgacgcgcgguc

SEQ ID NO: 950248 - RNA, 15 nt, Mycobacterium avium subsp. paratuberculosis
cgcgacgcgcggucg

SEQ ID NO: 950249 - RNA, 15 nt, Mycobacterium avium subsp. paratuberculosis
cgcgacgcgcucggc

SEQ ID NO: 950250 - RNA, 21 nt, Mycobacterium avium subsp. paratuberculosis
cgcgacgcgcucggcgaccgc

SEQ ID NO: 950251 - RNA, 23 nt, Mycobacterium avium subsp. paratuberculosis
cgcgacgccguagaucacgccgg

SEQ ID NO: 950252 - RNA, 19 nt, Mycobacterium avium subsp. paratuberculosis
cgcgacgccgucaucccca

SEQ ID NO: 950253 - RNA, 15 nt, Mycobacterium avium subsp. paratuberculosis
cgcgacgccgacgcc

SEQ ID NO: 950254 - RNA, 16 nt, Mycobacterium avium subsp. paratuberculosis
cgcgacgccgacgccc

SEQ ID NO: 950255 - RNA, 17 nt, Mycobacterium avium subsp. paratuberculosis
cgcgacgccgacgccca

SEQ ID NO: 950256 - RNA, 20 nt, Mycobacterium avium subsp. paratuberculosis
cgcgacgccgacgcccagcg

SEQ ID NO: 950257 - RNA, 17 nt, Mycobacterium avium subsp. paratuberculosis
cgcgacgagcgggccga

SEQ ID NO: 950258 - RNA, 15 nt, Mycobacterium avium subsp. paratuberculosis
cgcgacgccgccgcc

SEQ ID NO: 950259 - RNA, 16 nt, Mycobacterium avium subsp. paratuberculosis
cgcgacgccgccgccg

SEQ ID NO: 950260 - RNA, 18 nt, Mycobacterium avium subsp. paratuberculosis
cgcgacgcugagcgccag

SEQ ID NO: 950261 - RNA, 21 nt, Mycobacterium avium subsp. paratuberculosis
cgcgacgcugagcgccaggcc

SEQ ID NO: 950262 - RNA, 20 nt, Mycobacterium avium subsp. paratuberculosis
cgcgacgcugauggcgagga

SEQ ID NO: 950263 - RNA, 17 nt, Mycobacterium avium subsp. paratuberculosis
cgcgacgggcaugccgu

SEQ ID NO: 950264 - RNA, 18 nt, Mycobacterium avium subsp. paratuberculosis
cgcgacgggcaugccguc

SEQ ID NO: 950265 - RNA, 19 nt, Mycobacterium avium subsp. paratuberculosis
cgcgacgggcaugccgucg

SEQ ID NO: 950266 - RNA, 21 nt, Mycobacterium avium subsp. paratuberculosis
cgcgacgggcaugccgucggc

SEQ ID NO: 950267 - RNA, 22 nt, Mycobacterium avium subsp. paratuberculosis
cgcgacgggcaugccgucggcg

SEQ ID NO: 950268 - RNA, 13 nt, Mycobacterium avium subsp. paratuberculosis
cgcgacgggcguc

SEQ ID NO: 950269 - RNA, 14 nt, Mycobacterium avium subsp. paratuberculosis
cgcgacgggcgucc

SEQ ID NO: 950270 - RNA, 14 nt, Mycobacterium avium subsp. paratuberculosis
cgcgacgggcucgg

SEQ ID NO: 950271 - RNA, 15 nt, Mycobacterium avium subsp. paratuberculosis
cgcgacgggcucggc

SEQ ID NO: 950272 - RNA, 16 nt, Mycobacterium avium subsp. paratuberculosis
cgcgacgggcucggcg

SEQ ID NO: 950273 - RNA, 17 nt, Mycobacterium avium subsp. paratuberculosis
cgcgacgggcucggcgu

SEQ ID NO: 950274 - RNA, 13 nt, Mycobacterium avium subsp. paratuberculosis
cgcgacgggcugc

SEQ ID NO: 950275 - RNA, 16 nt, Mycobacterium avium subsp. paratuberculosis
cgcgacgggcugcugc

SEQ ID NO: 950276 - RNA, 18 nt, Mycobacterium avium subsp. paratuberculosis
cgcgacgggcugcugcac

SEQ ID NO: 950277 - RNA, 20 nt, Mycobacterium avium subsp. paratuberculosis
cgcgacgggcugcugcacgu

SEQ ID NO: 950278 - RNA, 20 nt, Mycobacterium avium subsp. paratuberculosis
cgcgacgggcugucccggcc

SEQ ID NO: 950279 - RNA, 22 nt, Mycobacterium avium subsp. paratuberculosis
cgcgacgggcugucccggccgc

SEQ ID NO: 950280 - RNA, 23 nt, Mycobacterium avium subsp. paratuberculosis
cgcgacgggcugucccggccgcg

SEQ ID NO: 950281 - RNA, 15 nt, Mycobacterium avium subsp. paratuberculosis
cgcgacgguggaccc

SEQ ID NO: 950282 - RNA, 16 nt, Mycobacterium avium subsp. paratuberculosis
cgcgacgguggcggcg

SEQ ID NO: 950283 - RNA, 17 nt, Mycobacterium avium subsp. paratuberculosis
cgcgacgguggcggcga

SEQ ID NO: 950284 - RNA, 21 nt, Mycobacterium avium subsp. paratuberculosis
cgcgacgguggcggcgauguc

SEQ ID NO: 950285 - RNA, 21 nt, Mycobacterium avium subsp. paratuberculosis
cgcgacgguguaggacgccgu

SEQ ID NO: 950286 - RNA, 23 nt, Mycobacterium avium subsp. paratuberculosis
cgcgacgguguaggacgccgugc

SEQ ID NO: 950287 - RNA, 20 nt, Mycobacterium avium subsp. paratuberculosis
cgcgacgguuuccggcuuca

SEQ ID NO: 950288 - RNA, 13 nt, Mycobacterium avium subsp. paratuberculosis
cgcgacggucacg

SEQ ID NO: 950289 - RNA, 22 nt, Mycobacterium avium subsp. paratuberculosis
cgcgacggucacgcuggcguga

SEQ ID NO: 950290 - RNA, 15 nt, Mycobacterium avium subsp. paratuberculosis
cgcgacguagccggu

SEQ ID NO: 950291 - RNA, 14 nt, Mycobacterium avium subsp. paratuberculosis
cgcgacguccaucg

SEQ ID NO: 950292 - RNA, 15 nt, Mycobacterium avium subsp. paratuberculosis
cgcgagcgcagcgcc

SEQ ID NO: 950293 - RNA, 12 nt, Mycobacterium avium subsp. paratuberculosis
cgcgagcccggc

SEQ ID NO: 950294 - RNA, 22 nt, Mycobacterium avium subsp. paratuberculosis
cgcgagccgcccaggcgggcca

SEQ ID NO: 950295 - RNA, 13 nt, Mycobacterium avium subsp. paratuberculosis
cgcgagcccggcg

SEQ ID NO: 950296 - RNA, 14 nt, Mycobacterium avium subsp. paratuberculosis
cgcgagcccggcga

SEQ ID NO: 950297 - RNA, 16 nt, Mycobacterium avium subsp. paratuberculosis
cgcgagcccggcgacg

SEQ ID NO: 950298 - RNA, 14 nt, Mycobacterium avium subsp. paratuberculosis
cgcgagccgaaacg

SEQ ID NO: 950299 - RNA, 22 nt, Mycobacterium avium subsp. paratuberculosis
cgcgagccgaaacggugcccgc

SEQ ID NO: 950300 - RNA, 16 nt, Mycobacterium avium subsp. paratuberculosis
cgcgagccgagccggu

SEQ ID NO: 950301 - RNA, 17 nt, Mycobacterium avium subsp. paratuberculosis
cgcgagccgagccgguc

SEQ ID NO: 950302 - RNA, 13 nt, Mycobacterium avium subsp. paratuberculosis
cgcgagccgccca

SEQ ID NO: 950303 - RNA, 20 nt, Mycobacterium avium subsp. paratuberculosis
cgcgaggaggggucggugcg

SEQ ID NO: 950304 - RNA, 20 nt, Mycobacterium avium subsp. paratuberculosis
cgcgaggcggguaggcgucg

SEQ ID NO: 950305 - RNA, 12 nt, Mycobacterium avium subsp. paratuberculosis
cgcgaggcgcgg

SEQ ID NO: 950306 - RNA, 16 nt, Mycobacterium avium subsp. paratuberculosis
cgcgaggcgcggggcg

SEQ ID NO: 950307 - RNA, 18 nt, Mycobacterium avium subsp. paratuberculosis
cgcgaggcgcggggcgcg

SEQ ID NO: 950308 - RNA, 23 nt, Mycobacterium avium subsp. paratuberculosis
cgcgaggcgcggggcgcgaggcg

SEQ ID NO: 950309 - RNA, 22 nt, Mycobacterium avium subsp. paratuberculosis
cgcgagcugcuucgucgccggg

SEQ ID NO: 950310 - RNA, 15 nt, Mycobacterium avium subsp. paratuberculosis
cgcgagcgucacgcu

SEQ ID NO: 950311 - RNA, 18 nt, Mycobacterium avium subsp. paratuberculosis
cgcgagcgucacgcuggc

SEQ ID NO: 950312 - RNA, 23 nt, Mycobacterium avium subsp. paratuberculosis
cgcgagcugccccuucgcgacac

SEQ ID NO: 950313 - RNA, 18 nt, Mycobacterium avium subsp. paratuberculosis
cgcgaggaaucgcggcag

SEQ ID NO: 950314 - RNA, 22 nt, Mycobacterium avium subsp. paratuberculosis
cgcgaggaaucgcggcaggcga

SEQ ID NO: 950315 - RNA, 18 nt, Mycobacterium avium subsp. paratuberculosis
cgcgaggacgauggacga

SEQ ID NO: 950316 - RNA, 12 nt, Mycobacterium avium subsp. paratuberculosis
cgcgagcgcgcg

SEQ ID NO: 950317 - RNA, 13 nt, Mycobacterium avium subsp. paratuberculosis
cgcgagcgcgcgg

SEQ ID NO: 950318 - RNA, 13 nt, Mycobacterium avium subsp. paratuberculosis
cgcgagcgcuacc

SEQ ID NO: 950319 - RNA, 17 nt, Mycobacterium avium subsp. paratuberculosis
cgcgagcgcuaccgcgc

SEQ ID NO: 950320 - RNA, 18 nt, Mycobacterium avium subsp. paratuberculosis
cgcgagcggacgggccua

SEQ ID NO: 950321 - RNA, 17 nt, Mycobacterium avium subsp. paratuberculosis
cgcgcccgccggcccag

SEQ ID NO: 950322 - RNA, 18 nt, Mycobacterium avium subsp. paratuberculosis
cgcgcccgccggcccagc

SEQ ID NO: 950323 - RNA, 21 nt, Mycobacterium avium subsp. paratuberculosis
cgcgcccgccggcccagcucc

SEQ ID NO: 950324 - RNA, 20 nt, Mycobacterium avium subsp. paratuberculosis
cgcgcccuagucgacgccga

SEQ ID NO: 950325 - RNA, 23 nt, Mycobacterium avium subsp. paratuberculosis
cgcgcccucgauaauggcggccg

SEQ ID NO: 950326 - RNA, 15 nt, Mycobacterium avium subsp. paratuberculosis
cgcgccgaacaacgg

SEQ ID NO: 950327 - RNA, 18 nt, Mycobacterium avium subsp. paratuberculosis
cgcgccgaacaccacgcc

SEQ ID NO: 950328 - RNA, 20 nt, Mycobacterium avium subsp. paratuberculosis
cgcgcccugcugggagcggc

SEQ ID NO: 950329 - RNA, 21 nt, Mycobacterium avium subsp. paratuberculosis
cgcgcccuucuucgcgggugc

SEQ ID NO: 950330 - RNA, 19 nt, Mycobacterium avium subsp. paratuberculosis
cgcgccgaagauggccagc

SEQ ID NO: 950331 - RNA, 20 nt, Mycobacterium avium subsp. paratuberculosis
cgcgccgaagauggccagcg

SEQ ID NO: 950332 - RNA, 21 nt, Mycobacterium avium subsp. paratuberculosis
cgcgccgaagauggccagcgc

SEQ ID NO: 950333 - RNA, 24 nt, Mycobacterium avium subsp. paratuberculosis
cgcgccgaagauggccagcgcggc

SEQ ID NO: 950334 - RNA, 20 nt, Mycobacterium avium subsp. paratuberculosis
cgcgccgaacgcaccaccgc

SEQ ID NO: 950335 - RNA, 11 nt, Mycobacterium avium subsp. paratuberculosis
cgcgccgacca

SEQ ID NO: 950336 - RNA, 14 nt, Mycobacterium avium subsp. paratuberculosis
cgcgccgacagaug

SEQ ID NO: 950337 - RNA, 22 nt, Mycobacterium avium subsp. paratuberculosis
cgcgccgacagaugcggcacca

SEQ ID NO: 950338 - RNA, 22 nt, Mycobacterium avium subsp. paratuberculosis
cgcgccgaucacgaacaggucc

SEQ ID NO: 950339 - RNA, 20 nt, Mycobacterium avium subsp. paratuberculosis
cgcgccgauccggcuccaca

SEQ ID NO: 950340 - RNA, 16 nt, Mycobacterium avium subsp. paratuberculosis
cgcgccgaucgagacg

SEQ ID NO: 950341 - RNA, 20 nt, Mycobacterium avium subsp. paratuberculosis
cgcgccgaucgagacgaugc

SEQ ID NO: 950342 - RNA, 14 nt, Mycobacterium avium subsp. paratuberculosis
cgcgccgaccacgg

SEQ ID NO: 950343 - RNA, 19 nt, Mycobacterium avium subsp. paratuberculosis
cgcgccgaccacggcccca

SEQ ID NO: 950344 - RNA, 20 nt, Mycobacterium avium subsp. paratuberculosis
cgcgccgaccacggccccag

SEQ ID NO: 950345 - RNA, 13 nt, Mycobacterium avium subsp. paratuberculosis
cgcgccccggccc

SEQ ID NO: 950346 - RNA, 16 nt, Mycobacterium avium subsp. paratuberculosis
cgcgccccggcccggc

SEQ ID NO: 950347 - RNA, 17 nt, Mycobacterium avium subsp. paratuberculosis
cgcgccccggcccggcg

SEQ ID NO: 950348 - RNA, 18 nt, Mycobacterium avium subsp. paratuberculosis
cgcgccccggcccggcga

SEQ ID NO: 950349 - RNA, 13 nt, Mycobacterium avium subsp. paratuberculosis
cgcgccccggcgc

SEQ ID NO: 950350 - RNA, 22 nt, Mycobacterium avium subsp. paratuberculosis
cgcgccccggcgcagcgccgcg

SEQ ID NO: 950351 - RNA, 16 nt, Mycobacterium avium subsp. paratuberculosis
cgcgccccggcgcgcc

SEQ ID NO: 950352 - RNA, 18 nt, Mycobacterium avium subsp. paratuberculosis
cgcgccccggcgcgccug

SEQ ID NO: 950353 - RNA, 16 nt, Mycobacterium avium subsp. paratuberculosis
cgcgccccggcggcca

SEQ ID NO: 950354 - RNA, 17 nt, Mycobacterium avium subsp. paratuberculosis
cgcgccccggcggccac

SEQ ID NO: 950355 - RNA, 19 nt, Mycobacterium avium subsp. paratuberculosis
cgcgccccggucccgccgg

SEQ ID NO: 950356 - RNA, 13 nt, Mycobacterium avium subsp. paratuberculosis
cgcgcccacccga

SEQ ID NO: 950357 - RNA, 21 nt, Mycobacterium avium subsp. paratuberculosis
cgcgcccacccgaugaccggc

SEQ ID NO: 950358 - RNA, 13 nt, Mycobacterium avium subsp. paratuberculosis
cgcgcccacccgc

SEQ ID NO: 950359 - RNA, 14 nt, Mycobacterium avium subsp. paratuberculosis
cgcgcccacccgcg

SEQ ID NO: 950360 - RNA, 20 nt, Mycobacterium avium subsp. paratuberculosis
cgcgcccacccgcgcacgcu

SEQ ID NO: 950361 - RNA, 16 nt, Mycobacterium avium subsp. paratuberculosis
cgcgcccacccgcgcc

SEQ ID NO: 950362 - RNA, 18 nt, Mycobacterium avium subsp. paratuberculosis
cgcgcccacccgcgccgg

SEQ ID NO: 950363 - RNA, 15 nt, Mycobacterium avium subsp. paratuberculosis
cgcgccccgccggga

SEQ ID NO: 950364 - RNA, 16 nt, Mycobacterium avium subsp. paratuberculosis
cgcgccccgccgggau

SEQ ID NO: 950365 - RNA, 13 nt, Mycobacterium avium subsp. paratuberculosis
cgcgcccgacgau

SEQ ID NO: 950366 - RNA, 14 nt, Mycobacterium avium subsp. paratuberculosis
cgcgcccgauggag

SEQ ID NO: 950367 - RNA, 23 nt, Mycobacterium avium subsp. paratuberculosis
cgcgcccgagcauuucgcgcacg

SEQ ID NO: 950368 - RNA, 20 nt, Mycobacterium avium subsp. paratuberculosis
cgcgccgccuucuugcgcgg

SEQ ID NO: 950369 - RNA, 14 nt, Mycobacterium avium subsp. paratuberculosis
cgcgccgcgacguc

SEQ ID NO: 950370 - RNA, 16 nt, Mycobacterium avium subsp. paratuberculosis
cgcgccgcgacgucgg

SEQ ID NO: 950371 - RNA, 20 nt, Mycobacterium avium subsp. paratuberculosis
cgcgccgccacaccucggcg

SEQ ID NO: 950372 - RNA, 13 nt, Mycobacterium avium subsp. paratuberculosis
cgcgccgccggug

SEQ ID NO: 950373 - RNA, 14 nt, Mycobacterium avium subsp. paratuberculosis
cgcgccgccgguga

SEQ ID NO: 950374 - RNA, 13 nt, Mycobacterium avium subsp. paratuberculosis
cgcgccgcgcugg

SEQ ID NO: 950375 - RNA, 20 nt, Mycobacterium avium subsp. paratuberculosis
cgcgccgcgcuggccgaucc

SEQ ID NO: 950376 - RNA, 13 nt, Mycobacterium avium subsp. paratuberculosis
cgcgccgcgaucu

SEQ ID NO: 950377 - RNA, 16 nt, Mycobacterium avium subsp. paratuberculosis
cgcgccgcgaucucgg

SEQ ID NO: 950378 - RNA, 13 nt, Mycobacterium avium subsp. paratuberculosis
cgcgccgcgcauu

SEQ ID NO: 950379 - RNA, 12 nt, Mycobacterium avium subsp. paratuberculosis
cgcgccgcagga

SEQ ID NO: 950380 - RNA, 12 nt, Mycobacterium avium subsp. paratuberculosis
cgcgccgcauga

SEQ ID NO: 950381 - RNA, 13 nt, Mycobacterium avium subsp. paratuberculosis
cgcgccgcaugau

SEQ ID NO: 950382 - RNA, 20 nt, Mycobacterium avium subsp. paratuberculosis
cgcgccgcaugaugcggcca

SEQ ID NO: 950383 - RNA, 22 nt, Mycobacterium avium subsp. paratuberculosis
cgcgccgcaugaugcggccaug

SEQ ID NO: 950384 - RNA, 14 nt, Mycobacterium avium subsp. paratuberculosis
cgcgccgcacugca

SEQ ID NO: 950385 - RNA, 19 nt, Mycobacterium avium subsp. paratuberculosis
cgcgccgcacugcacggcc

SEQ ID NO: 950386 - RNA, 22 nt, Mycobacterium avium subsp. paratuberculosis
cgcgccgcacagccggcggcgg

SEQ ID NO: 950387 - RNA, 19 nt, Mycobacterium avium subsp. paratuberculosis
cgcgccgauguggccggcg

SEQ ID NO: 950388 - RNA, 20 nt, Mycobacterium avium subsp. paratuberculosis
cgcgccgauguggccggcga

SEQ ID NO: 950389 - RNA, 18 nt, Mycobacterium avium subsp. paratuberculosis
cgcgccgaucugaccgag

SEQ ID NO: 950390 - RNA, 20 nt, Mycobacterium avium subsp. paratuberculosis
cgcgccgaucugaccgagca

SEQ ID NO: 950391 - RNA, 21 nt, Mycobacterium avium subsp. paratuberculosis
cgcgccgaugcauuggugcac

SEQ ID NO: 950392 - RNA, 12 nt, Mycobacterium avium subsp. paratuberculosis
cgcgccggcggc

SEQ ID NO: 950393 - RNA, 12 nt, Mycobacterium avium subsp. paratuberculosis
cgcgccggcgca

SEQ ID NO: 950394 - RNA, 13 nt, Mycobacterium avium subsp. paratuberculosis
cgcgccggcgcaa

SEQ ID NO: 950395 - RNA, 20 nt, Mycobacterium avium subsp. paratuberculosis
cgcgccggcgcacaucgugg

SEQ ID NO: 950396 - RNA, 13 nt, Mycobacterium avium subsp. paratuberculosis
cgcgccggcgcag

SEQ ID NO: 950397 - RNA, 17 nt, Mycobacterium avium subsp. paratuberculosis
cgcgccggcgcagcggc

SEQ ID NO: 950398 - RNA, 18 nt, Mycobacterium avium subsp. paratuberculosis
cgcgccggcgcagcggcc

SEQ ID NO: 950399 - RNA, 12 nt, Mycobacterium avium subsp. paratuberculosis
cgcgccggcgcg

SEQ ID NO: 950400 - RNA, 14 nt, Mycobacterium avium subsp. paratuberculosis
cgcgccggcgcgca

SEQ ID NO: 950401 - RNA, 15 nt, Mycobacterium avium subsp. paratuberculosis
cgcgccggcgcgcag

SEQ ID NO: 950402 - RNA, 13 nt, Mycobacterium avium subsp. paratuberculosis
cgcgccggcgcgg

SEQ ID NO: 950403 - RNA, 19 nt, Mycobacterium avium subsp. paratuberculosis
cgcgccggccuuggcccgc

SEQ ID NO: 950404 - RNA, 20 nt, Mycobacterium avium subsp. paratuberculosis
cgcgccggcgauaggcggcc

SEQ ID NO: 950405 - RNA, 21 nt, Mycobacterium avium subsp. paratuberculosis
cgcgccggcgauaggcggcca

SEQ ID NO: 950406 - RNA, 14 nt, Mycobacterium avium subsp. paratuberculosis
cgcgccggccgccg

SEQ ID NO: 950407 - RNA, 16 nt, Mycobacterium avium subsp. paratuberculosis
cgcgccggccgccgcg

SEQ ID NO: 950408 - RNA, 12 nt, Mycobacterium avium subsp. paratuberculosis
cgcgccggccgg

SEQ ID NO: 950409 - RNA, 18 nt, Mycobacterium avium subsp. paratuberculosis
cgcgccggccggacagau

SEQ ID NO: 950410 - RNA, 15 nt, Mycobacterium avium subsp. paratuberculosis
cgcgccggccggagc

SEQ ID NO: 950411 - RNA, 17 nt, Mycobacterium avium subsp. paratuberculosis
cgcgccggccggagcgg

SEQ ID NO: 950412 - RNA, 13 nt, Mycobacterium avium subsp. paratuberculosis
cgcgccggccggc

SEQ ID NO: 950413 - RNA, 14 nt, Mycobacterium avium subsp. paratuberculosis
cgcgccggccggca

SEQ ID NO: 950414 - RNA, 15 nt, Mycobacterium avium subsp. paratuberculosis
cgcgccggccggcac

SEQ ID NO: 950415 - RNA, 13 nt, Mycobacterium avium subsp. paratuberculosis
cgcgccgcgccgc

SEQ ID NO: 950416 - RNA, 15 nt, Mycobacterium avium subsp. paratuberculosis
cgcgccgcgccgccu

SEQ ID NO: 950417 - RNA, 21 nt, Mycobacterium avium subsp. paratuberculosis
cgcgccgcgucgcgccgccgc

SEQ ID NO: 950418 - RNA, 13 nt, Mycobacterium avium subsp. paratuberculosis
cgcgccgcgggug

SEQ ID NO: 950419 - RNA, 14 nt, Mycobacterium avium subsp. paratuberculosis
cgcgccgcggguga

SEQ ID NO: 950420 - RNA, 17 nt, Mycobacterium avium subsp. paratuberculosis
cgcgccgcgggugacga

SEQ ID NO: 950421 - RNA, 13 nt, Mycobacterium avium subsp. paratuberculosis
cgcgccgcggcca

SEQ ID NO: 950422 - RNA, 17 nt, Mycobacterium avium subsp. paratuberculosis
cgcgccgcggccagcgc

SEQ ID NO: 950423 - RNA, 18 nt, Mycobacterium avium subsp. paratuberculosis
cgcgccgcggccagcgcc

SEQ ID NO: 950424 - RNA, 12 nt, Mycobacterium avium subsp. paratuberculosis
cgcgccagccgc

SEQ ID NO: 950425 - RNA, 15 nt, Mycobacterium avium subsp. paratuberculosis
cgcgccagccgccgc

SEQ ID NO: 950426 - RNA, 19 nt, Mycobacterium avium subsp. paratuberculosis
cgcgccagccgccgccgac

SEQ ID NO: 950427 - RNA, 18 nt, Mycobacterium avium subsp. paratuberculosis
cgcgccacguaucgcgcc

SEQ ID NO: 950428 - RNA, 22 nt, Mycobacterium avium subsp. paratuberculosis
cgcgccacgccccggcgccguc

SEQ ID NO: 950429 - RNA, 23 nt, Mycobacterium avium subsp. paratuberculosis
cgcgccacgccccggcgccgucg

SEQ ID NO: 950430 - RNA, 13 nt, Mycobacterium avium subsp. paratuberculosis
cgcgccacgccgc

SEQ ID NO: 950431 - RNA, 19 nt, Mycobacterium avium subsp. paratuberculosis
cgcgccacgcgcagggcga

SEQ ID NO: 950432 - RNA, 12 nt, Mycobacterium avium subsp. paratuberculosis
cgcgccagacgu

SEQ ID NO: 950433 - RNA, 13 nt, Mycobacterium avium subsp. paratuberculosis
cgcgccagacguc

SEQ ID NO: 950434 - RNA, 18 nt, Mycobacterium avium subsp. paratuberculosis
cgcgccagacguccagcg

SEQ ID NO: 950435 - RNA, 19 nt, Mycobacterium avium subsp. paratuberculosis
cgcgccagacguccagcgc

SEQ ID NO: 950436 - RNA, 22 nt, Mycobacterium avium subsp. paratuberculosis
cgcgccagacguccagcgccgc

SEQ ID NO: 950437 - RNA, 23 nt, Mycobacterium avium subsp. paratuberculosis
cgcgccagacguccagcgccgcc

SEQ ID NO: 950438 - RNA, 13 nt, Mycobacterium avium subsp. paratuberculosis
cgcgccagcaccu

SEQ ID NO: 950439 - RNA, 16 nt, Mycobacterium avium subsp. paratuberculosis
cgcgccagcagcgcgc

SEQ ID NO: 950440 - RNA, 19 nt, Mycobacterium avium subsp. paratuberculosis
cgcgccagcagcgcgccgc

SEQ ID NO: 950441 - RNA, 20 nt, Mycobacterium avium subsp. paratuberculosis
cgcgccagcagcgcgccgcg

SEQ ID NO: 950442 - RNA, 23 nt, Mycobacterium avium subsp. paratuberculosis
cgcgcaucagcaccuccggcagc

SEQ ID NO: 950443 - RNA, 16 nt, Mycobacterium avium subsp. paratuberculosis
cgcgcaucaucgccca

SEQ ID NO: 950444 - RNA, 18 nt, Mycobacterium avium subsp. paratuberculosis
cgcgcaucaucgcccagc

SEQ ID NO: 950445 - RNA, 20 nt, Mycobacterium avium subsp. paratuberculosis
cgcgcaucaucgcccagcgc

SEQ ID NO: 950446 - RNA, 21 nt, Mycobacterium avium subsp. paratuberculosis
cgcgcaucaucgcccagcgca

SEQ ID NO: 950447 - RNA, 22 nt, Mycobacterium avium subsp. paratuberculosis
cgcgcaucaugcguuugccguc

SEQ ID NO: 950448 - RNA, 23 nt, Mycobacterium avium subsp. paratuberculosis
cgcgcaucaugcguuugccgucg

SEQ ID NO: 950449 - RNA, 18 nt, Mycobacterium avium subsp. paratuberculosis
cgcgcaucccgaucgacg

SEQ ID NO: 950450 - RNA, 17 nt, Mycobacterium avium subsp. paratuberculosis
cgcgcaucccgucgacc

SEQ ID NO: 950451 - RNA, 14 nt, Mycobacterium avium subsp. paratuberculosis
cgcgcauccgcacc

SEQ ID NO: 950452 - RNA, 17 nt, Mycobacterium avium subsp. paratuberculosis
cgcgcauccgcaccgag

SEQ ID NO: 950453 - RNA, 18 nt, Mycobacterium avium subsp. paratuberculosis
cgcgcauccgcaccgaga

SEQ ID NO: 950454 - RNA, 13 nt, Mycobacterium avium subsp. paratuberculosis
cgcgcaucgccgu

SEQ ID NO: 950455 - RNA, 15 nt, Mycobacterium avium subsp. paratuberculosis
cgcgcaucgccgucc

SEQ ID NO: 950456 - RNA, 16 nt, Mycobacterium avium subsp. paratuberculosis
cgcgcaucgccucggc

SEQ ID NO: 950457 - RNA, 19 nt, Mycobacterium avium subsp. paratuberculosis
cgcgcaucgccucggcggc

SEQ ID NO: 950458 - RNA, 13 nt, Mycobacterium avium subsp. paratuberculosis
cgcgcaucacccg

SEQ ID NO: 950459 - RNA, 19 nt, Mycobacterium avium subsp. paratuberculosis
cgcgcaucaccgaggucac

SEQ ID NO: 950460 - RNA, 14 nt, Mycobacterium avium subsp. paratuberculosis
cgcgcaggcgcuga

SEQ ID NO: 950461 - RNA, 15 nt, Mycobacterium avium subsp. paratuberculosis
cgcgcaguugcgcgg

SEQ ID NO: 950462 - RNA, 18 nt, Mycobacterium avium subsp. paratuberculosis
cgcgcaguugcgcggcgg

SEQ ID NO: 950463 - RNA, 19 nt, Mycobacterium avium subsp. paratuberculosis
cgcgcaggccgccgacgac

SEQ ID NO: 950464 - RNA, 15 nt, Mycobacterium avium subsp. paratuberculosis
cgcgcaggcgcacca

SEQ ID NO: 950465 - RNA, 19 nt, Mycobacterium avium subsp. paratuberculosis
cgcgcaggcgcaccaccag

SEQ ID NO: 950466 - RNA, 18 nt, Mycobacterium avium subsp. paratuberculosis
cgcgcaggccguccagca

SEQ ID NO: 950467 - RNA, 16 nt, Mycobacterium avium subsp. paratuberculosis
cgcgcaggcggcgacg

SEQ ID NO: 950468 - RNA, 16 nt, Mycobacterium avium subsp. paratuberculosis
cgcgcagucggcgucg

SEQ ID NO: 950469 - RNA, 14 nt, Mycobacterium avium subsp. paratuberculosis
cgcgcagaucgucg

SEQ ID NO: 950470 - RNA, 15 nt, Mycobacterium avium subsp. paratuberculosis
cgcgcagaucgucga

SEQ ID NO: 950471 - RNA, 18 nt, Mycobacterium avium subsp. paratuberculosis
cgcgcagaucgucgaacu

SEQ ID NO: 950472 - RNA, 18 nt, Mycobacterium avium subsp. paratuberculosis
cgcgcagaucgucgaccu

SEQ ID NO: 950473 - RNA, 15 nt, Mycobacterium avium subsp. paratuberculosis
cgcgcagaucgaugg

SEQ ID NO: 950474 - RNA, 17 nt, Mycobacterium avium subsp. paratuberculosis
cgcgcagaucgccagca

SEQ ID NO: 950475 - RNA, 23 nt, Mycobacterium avium subsp. paratuberculosis
cgcgcagaucgccagcaccggcg

SEQ ID NO: 950476 - RNA, 19 nt, Mycobacterium avium subsp. paratuberculosis
cgcgcaccuucccggccgc

SEQ ID NO: 950477 - RNA, 21 nt, Mycobacterium avium subsp. paratuberculosis
cgcgcaccuucccggccgcca

SEQ ID NO: 950478 - RNA, 21 nt, Mycobacterium avium subsp. paratuberculosis
cgcgcagaaccgcaccccguc

SEQ ID NO: 950479 - RNA, 17 nt, Mycobacterium avium subsp. paratuberculosis
cgcgcagcaccuccugg

SEQ ID NO: 950480 - RNA, 14 nt, Mycobacterium avium subsp. paratuberculosis
cgcgcagcacggaa

SEQ ID NO: 950481 - RNA, 13 nt, Mycobacterium avium subsp. paratuberculosis
cgcgcagcaccgu

SEQ ID NO: 950482 - RNA, 15 nt, Mycobacterium avium subsp. paratuberculosis
cgcgcagcaccguca

SEQ ID NO: 950483 - RNA, 14 nt, Mycobacterium avium subsp. paratuberculosis
cgcgcagcaccgcg

SEQ ID NO: 950484 - RNA, 13 nt, Mycobacterium avium subsp. paratuberculosis
cgcgcagcaccgc

SEQ ID NO: 950485 - RNA, 16 nt, Mycobacterium avium subsp. paratuberculosis
cgcgcagcaccagcuc

SEQ ID NO: 950486 - RNA, 14 nt, Mycobacterium avium subsp. paratuberculosis
cgcgcagcaccgau

SEQ ID NO: 950487 - RNA, 20 nt, Mycobacterium avium subsp. paratuberculosis
cgcgcagcaauugacgccga

SEQ ID NO: 950488 - RNA, 21 nt, Mycobacterium avium subsp. paratuberculosis
cgcgcagcaauugacgccgac

SEQ ID NO: 950489 - RNA, 22 nt, Mycobacterium avium subsp. paratuberculosis
cgcgcagcaauugacgccgaca

SEQ ID NO: 950490 - RNA, 14 nt, Mycobacterium avium subsp. paratuberculosis
cgcgcaggccgccg

SEQ ID NO: 950491 - RNA, 14 nt, Mycobacterium avium subsp. paratuberculosis
cgcgcaggccccgg

SEQ ID NO: 950492 - RNA, 17 nt, Mycobacterium avium subsp. paratuberculosis
cgcgcaggccccggcgc

SEQ ID NO: 950493 - RNA, 18 nt, Mycobacterium avium subsp. paratuberculosis
cgcgcaggaacagcgacc

SEQ ID NO: 950494 - RNA, 19 nt, Mycobacterium avium subsp. paratuberculosis
cgcgcaggaacagcgaccc

SEQ ID NO: 950495 - RNA, 16 nt, Mycobacterium avium subsp. paratuberculosis
cgcgcaggaacgucuc

SEQ ID NO: 950496 - RNA, 13 nt, Mycobacterium avium subsp. paratuberculosis
cgcgcagcugcgc

SEQ ID NO: 950497 - RNA, 14 nt, Mycobacterium avium subsp. paratuberculosis
cgcgcagcugcgcc

SEQ ID NO: 950498 - RNA, 21 nt, Mycobacterium avium subsp. paratuberculosis
cgcgcagcugcgccgcgucga

SEQ ID NO: 950499 - RNA, 14 nt, Mycobacterium avium subsp. paratuberculosis
cgcgcagcucgggg

SEQ ID NO: 950500 - RNA, 18 nt, Mycobacterium avium subsp. paratuberculosis
cgcgcagcucggggucgg

SEQ ID NO: 950501 - RNA, 15 nt, Mycobacterium avium subsp. paratuberculosis
cgcgcagcgugucgg

SEQ ID NO: 950502 - RNA, 21 nt, Mycobacterium avium subsp. paratuberculosis
cgcgcagcgugucggggucgg

SEQ ID NO: 950503 - RNA, 18 nt, Mycobacterium avium subsp. paratuberculosis
cgcgcagcgugugcaccu

SEQ ID NO: 950504 - RNA, 20 nt, Mycobacterium avium subsp. paratuberculosis
cgcgcagcgugugcaccuga

SEQ ID NO: 950505 - RNA, 16 nt, Mycobacterium avium subsp. paratuberculosis
cgcgcagcucgacgac

SEQ ID NO: 950506 - RNA, 17 nt, Mycobacterium avium subsp. paratuberculosis
cgcgcagcucgacgacc

SEQ ID NO: 950507 - RNA, 13 nt, Mycobacterium avium subsp. paratuberculosis
cgcgcagcucgcg

SEQ ID NO: 950508 - RNA, 19 nt, Mycobacterium avium subsp. paratuberculosis
cgcgcagccagucgccggc

SEQ ID NO: 950509 - RNA, 21 nt, Mycobacterium avium subsp. paratuberculosis
cgcgcagccagucgccggcca

SEQ ID NO: 950510 - RNA, 13 nt, Mycobacterium avium subsp. paratuberculosis
cgcgcagccagac

SEQ ID NO: 950511 - RNA, 14 nt, Mycobacterium avium subsp. paratuberculosis
cgcgcagccagacc

SEQ ID NO: 950512 - RNA, 18 nt, Mycobacterium avium subsp. paratuberculosis
cgcgcagccagaccucgc

SEQ ID NO: 950513 - RNA, 12 nt, Mycobacterium avium subsp. paratuberculosis
cgcgcagccagg

SEQ ID NO: 950514 - RNA, 14 nt, Mycobacterium avium subsp. paratuberculosis
cgcgcagccaggac

SEQ ID NO: 950515 - RNA, 15 nt, Mycobacterium avium subsp. paratuberculosis
cgcgcagccaccgcc

SEQ ID NO: 950516 - RNA, 17 nt, Mycobacterium avium subsp. paratuberculosis
cgcgcagccaccgcccg

SEQ ID NO: 950517 - RNA, 15 nt, Mycobacterium avium subsp. paratuberculosis
cgcgcagccacgagc

SEQ ID NO: 950518 - RNA, 20 nt, Mycobacterium avium subsp. paratuberculosis
cgcgcagccacgagcccagc

SEQ ID NO: 950519 - RNA, 22 nt, Mycobacterium avium subsp. paratuberculosis
cgcgcagccacgagcccagccg

SEQ ID NO: 950520 - RNA, 13 nt, Mycobacterium avium subsp. paratuberculosis
cgcgcagccaaug

SEQ ID NO: 950521 - RNA, 15 nt, Mycobacterium avium subsp. paratuberculosis
cgcgcagcagcggga

SEQ ID NO: 950522 - RNA, 23 nt, Mycobacterium avium subsp. paratuberculosis
cgcgcagcagcgggaucagcucc

SEQ ID NO: 950523 - RNA, 14 nt, Mycobacterium avium subsp. paratuberculosis
cgcgcagcaggcgc

SEQ ID NO: 950524 - RNA, 17 nt, Mycobacterium avium subsp. paratuberculosis
cgcgcagcaggcgccgg

SEQ ID NO: 950525 - RNA, 15 nt, Mycobacterium avium subsp. paratuberculosis
cgcgcagcauccgca

SEQ ID NO: 950526 - RNA, 17 nt, Mycobacterium avium subsp. paratuberculosis
cgcgcagcauccgcacc

SEQ ID NO: 950527 - RNA, 22 nt, Mycobacterium avium subsp. paratuberculosis
cgcgcagcaucucuugaugcag

SEQ ID NO: 950528 - RNA, 17 nt, Mycobacterium avium subsp. paratuberculosis
cgcgcagcauggcccac

SEQ ID NO: 950529 - RNA, 18 nt, Mycobacterium avium subsp. paratuberculosis
cgcgcagcauggcccaca

SEQ ID NO: 950530 - RNA, 22 nt, Mycobacterium avium subsp. paratuberculosis
cgccugcuucuggaugcggucg

SEQ ID NO: 950531 - RNA, 22 nt, Mycobacterium avium subsp. paratuberculosis
cgccugcuugagguugacgugc

SEQ ID NO: 950532 - RNA, 14 nt, Mycobacterium avium subsp. paratuberculosis
cgccuggacgacgu

SEQ ID NO: 950533 - RNA, 19 nt, Mycobacterium avium subsp. paratuberculosis
cgccuggacgacgucgaug

SEQ ID NO: 950534 - RNA, 22 nt, Mycobacterium avium subsp. paratuberculosis
cgccuggccaccucgacggcgu

SEQ ID NO: 950535 - RNA, 13 nt, Mycobacterium avium subsp. paratuberculosis
cgccugccgccuu

SEQ ID NO: 950536 - RNA, 23 nt, Mycobacterium avium subsp. paratuberculosis
cgccugggucucgggaucgccga

SEQ ID NO: 950537 - RNA, 17 nt, Mycobacterium avium subsp. paratuberculosis
cgccuggcggaaggccg

SEQ ID NO: 950538 - RNA, 19 nt, Mycobacterium avium subsp. paratuberculosis
cgccuggcggaaggccgcg

SEQ ID NO: 950539 - RNA, 18 nt, Mycobacterium avium subsp. paratuberculosis
cgccuggucaaggugcug

SEQ ID NO: 950540 - RNA, 21 nt, Mycobacterium avium subsp. paratuberculosis
cgccugucaguuugcgcgacg

SEQ ID NO: 950541 - RNA, 20 nt, Mycobacterium avium subsp. paratuberculosis
cgccugguccucccgggugg

SEQ ID NO: 950542 - RNA, 23 nt, Mycobacterium avium subsp. paratuberculosis
cgccugggcguacagcggcgcca

SEQ ID NO: 950543 - RNA, 15 nt, Mycobacterium avium subsp. paratuberculosis
cgccugugcgacggc

SEQ ID NO: 950544 - RNA, 16 nt, Mycobacterium avium subsp. paratuberculosis
cgccugugcgacggcg

SEQ ID NO: 950545 - RNA, 18 nt, Mycobacterium avium subsp. paratuberculosis
cgccugugcgacggcguc

SEQ ID NO: 950546 - RNA, 19 nt, Mycobacterium avium subsp. paratuberculosis
cgccugugcgacggcgucg

SEQ ID NO: 950547 - RNA, 20 nt, Mycobacterium avium subsp. paratuberculosis
cgccugugcgacggcgucgg

SEQ ID NO: 950548 - RNA, 20 nt, Mycobacterium avium subsp. paratuberculosis
cgccucgugcaugugcucgg

SEQ ID NO: 950549 - RNA, 16 nt, Mycobacterium avium subsp. paratuberculosis
cgccugauacgacguc

SEQ ID NO: 950550 - RNA, 18 nt, Mycobacterium avium subsp. paratuberculosis
cgccugauacgacguccg

SEQ ID NO: 950551 - RNA, 21 nt, Mycobacterium avium subsp. paratuberculosis
cgccucgucgaccgcggccug

SEQ ID NO: 950552 - RNA, 21 nt, Mycobacterium avium subsp. paratuberculosis
cgccucggugcggaacaccgc

SEQ ID NO: 950553 - RNA, 23 nt, Mycobacterium avium subsp. paratuberculosis
cgccucggugcggaacaccgccu

SEQ ID NO: 950554 - RNA, 16 nt, Mycobacterium avium subsp. paratuberculosis
cgccucgguugaucag

SEQ ID NO: 950555 - RNA, 20 nt, Mycobacterium avium subsp. paratuberculosis
cgccucgucgagcagcgccc

SEQ ID NO: 950556 - RNA, 16 nt, Mycobacterium avium subsp. paratuberculosis
cgccucgucgagccgg

SEQ ID NO: 950557 - RNA, 20 nt, Mycobacterium avium subsp. paratuberculosis
cgccucggggaucgccaggc

SEQ ID NO: 950558 - RNA, 22 nt, Mycobacterium avium subsp. paratuberculosis
cgccucggucgcgugaccggcg

SEQ ID NO: 950559 - RNA, 17 nt, Mycobacterium avium subsp. paratuberculosis
cgccucggucugggcga

SEQ ID NO: 950560 - RNA, 15 nt, Mycobacterium avium subsp. paratuberculosis
cgccucgggccggca

SEQ ID NO: 950561 - RNA, 16 nt, Mycobacterium avium subsp. paratuberculosis
cgccucgggccggcag

SEQ ID NO: 950562 - RNA, 23 nt, Mycobacterium avium subsp. paratuberculosis
cgccucgggccggcagccggcca

SEQ ID NO: 950563 - RNA, 17 nt, Mycobacterium avium subsp. paratuberculosis
cgccugcgagcacaccc

SEQ ID NO: 950564 - RNA, 23 nt, Mycobacterium avium subsp. paratuberculosis
cgccugccuggccacguggucgc

SEQ ID NO: 950565 - RNA, 13 nt, Mycobacterium avium subsp. paratuberculosis
cgccugccggcgc

SEQ ID NO: 950566 - RNA, 16 nt, Mycobacterium avium subsp. paratuberculosis
cgccugccggcgccgg

SEQ ID NO: 950567 - RNA, 15 nt, Mycobacterium avium subsp. paratuberculosis
cgccugcacggugcc

SEQ ID NO: 950568 - RNA, 15 nt, Mycobacterium avium subsp. paratuberculosis
cgccugcccgggcgc

SEQ ID NO: 950569 - RNA, 16 nt, Mycobacterium avium subsp. paratuberculosis
cgccugcccgggcgcc

SEQ ID NO: 950570 - RNA, 17 nt, Mycobacterium avium subsp. paratuberculosis
cgccugcccgggcgccg

SEQ ID NO: 950571 - RNA, 18 nt, Mycobacterium avium subsp. paratuberculosis
cgccugcaccggcgacgg

SEQ ID NO: 950572 - RNA, 23 nt, Mycobacterium avium subsp. paratuberculosis
cgccugcaccggcgacggcgguu

SEQ ID NO: 950573 - RNA, 20 nt, Mycobacterium avium subsp. paratuberculosis
cgccugcaccuugcccgucg

SEQ ID NO: 950574 - RNA, 11 nt, Mycobacterium avium subsp. paratuberculosis
cgccucggcgu

SEQ ID NO: 950575 - RNA, 22 nt, Mycobacterium avium subsp. paratuberculosis
cgccucggcggccgcccgggcg

SEQ ID NO: 950576 - RNA, 16 nt, Mycobacterium avium subsp. paratuberculosis
cgccucggcgucaccg

SEQ ID NO: 950577 - RNA, 18 nt, Mycobacterium avium subsp. paratuberculosis
cgccucggcgucaccgcg

SEQ ID NO: 950578 - RNA, 16 nt, Mycobacterium avium subsp. paratuberculosis
cgccucggcgucccgg

SEQ ID NO: 950579 - RNA, 15 nt, Mycobacterium avium subsp. paratuberculosis
cgccucgacggugac

SEQ ID NO: 950580 - RNA, 14 nt, Mycobacterium avium subsp. paratuberculosis
cgccucgagcaacg

SEQ ID NO: 950581 - RNA, 17 nt, Mycobacterium avium subsp. paratuberculosis
cgccucgaacaucggca

SEQ ID NO: 950582 - RNA, 19 nt, Mycobacterium avium subsp. paratuberculosis
cgccucgaacaucggcacg

SEQ ID NO: 950583 - RNA, 19 nt, Mycobacterium avium subsp. paratuberculosis
cgccucgaaggcgccgaug

SEQ ID NO: 950584 - RNA, 20 nt, Mycobacterium avium subsp. paratuberculosis
cgccucgaaggcgccgaugg

SEQ ID NO: 950585 - RNA, 16 nt, Mycobacterium avium subsp. paratuberculosis
cgccuccugcuggcgc

SEQ ID NO: 950586 - RNA, 18 nt, Mycobacterium avium subsp. paratuberculosis
cgccuccugcuggcgcug

SEQ ID NO: 950587 - RNA, 15 nt, Mycobacterium avium subsp. paratuberculosis
cgccucgaccagcac

SEQ ID NO: 950588 - RNA, 16 nt, Mycobacterium avium subsp. paratuberculosis
cgccucgaccagcacc

SEQ ID NO: 950589 - RNA, 17 nt, Mycobacterium avium subsp. paratuberculosis
cgccucgaccagcaccg

SEQ ID NO: 950590 - RNA, 20 nt, Mycobacterium avium subsp. paratuberculosis
cgccuccgacagccgcaccg

SEQ ID NO: 950591 - RNA, 22 nt, Mycobacterium avium subsp. paratuberculosis
cgccuccgacagccgcaccggc

SEQ ID NO: 950592 - RNA, 14 nt, Mycobacterium avium subsp. paratuberculosis
cgccuccgaccagc

SEQ ID NO: 950593 - RNA, 15 nt, Mycobacterium avium subsp. paratuberculosis
cgccuccgaccagcc

SEQ ID NO: 950594 - RNA, 18 nt, Mycobacterium avium subsp. paratuberculosis
cgccuccgaccagccggu

SEQ ID NO: 950595 - RNA, 22 nt, Mycobacterium avium subsp. paratuberculosis
cgccuccgagauggacagcacc

SEQ ID NO: 950596 - RNA, 19 nt, Mycobacterium avium subsp. paratuberculosis
cgccuccgcccgggugcag

SEQ ID NO: 950597 - RNA, 17 nt, Mycobacterium avium subsp. paratuberculosis
cgccucccggaccacca

SEQ ID NO: 950598 - RNA, 22 nt, Mycobacterium avium subsp. paratuberculosis
cgccuccggcaguacgcgccgg

SEQ ID NO: 950599 - RNA, 13 nt, Mycobacterium avium subsp. paratuberculosis
cgccuccgggaag

SEQ ID NO: 950600 - RNA, 21 nt, Mycobacterium avium subsp. paratuberculosis
cgccuccgggaaggcggccgc

SEQ ID NO: 950601 - RNA, 16 nt, Mycobacterium avium subsp. paratuberculosis
cgccuccgucagcgcc

SEQ ID NO: 950602 - RNA, 20 nt, Mycobacterium avium subsp. paratuberculosis
cgccuccgucagcgccgccc

SEQ ID NO: 950603 - RNA, 19 nt, Mycobacterium avium subsp. paratuberculosis
cgccuccucgaugucggug

SEQ ID NO: 950604 - RNA, 20 nt, Mycobacterium avium subsp. paratuberculosis
cgccucccgcagcgccagcg

SEQ ID NO: 950605 - RNA, 22 nt, Mycobacterium avium subsp. paratuberculosis
cgccucccgcagcgccagcgcg

SEQ ID NO: 950606 - RNA, 14 nt, Mycobacterium avium subsp. paratuberculosis
cgccucccccaccc

SEQ ID NO: 950607 - RNA, 18 nt, Mycobacterium avium subsp. paratuberculosis
cgccuccauucgggccag

SEQ ID NO: 950608 - RNA, 22 nt, Mycobacterium avium subsp. paratuberculosis
cgccuccauucgggccagcgcc

SEQ ID NO: 950609 - RNA, 15 nt, Mycobacterium avium subsp. paratuberculosis
cgccgucgcgaucgc

SEQ ID NO: 950610 - RNA, 20 nt, Mycobacterium avium subsp. paratuberculosis
cgccgucgcgaucgcggucc

SEQ ID NO: 950611 - RNA, 21 nt, Mycobacterium avium subsp. paratuberculosis
cgccgucgcgaucgcggucca

SEQ ID NO: 950612 - RNA, 22 nt, Mycobacterium avium subsp. paratuberculosis
cgccgucgcgaucgcgguccag

SEQ ID NO: 950613 - RNA, 18 nt, Mycobacterium avium subsp. paratuberculosis
cgccgucgccgccgugau

SEQ ID NO: 950614 - RNA, 13 nt, Mycobacterium avium subsp. paratuberculosis
cgccuccagcagg

SEQ ID NO: 950615 - RNA, 17 nt, Mycobacterium avium subsp. paratuberculosis
cgccgucgccgaucacc

SEQ ID NO: 950616 - RNA, 15 nt, Mycobacterium avium subsp. paratuberculosis
cgccgucgccgcacg

SEQ ID NO: 950617 - RNA, 17 nt, Mycobacterium avium subsp. paratuberculosis
cgccgucgccgcacgcc

SEQ ID NO: 950618 - RNA, 12 nt, Mycobacterium avium subsp. paratuberculosis
cgccgucgccgg

SEQ ID NO: 950619 - RNA, 14 nt, Mycobacterium avium subsp. paratuberculosis
cgccgucgccggac

SEQ ID NO: 950620 - RNA, 21 nt, Mycobacterium avium subsp. paratuberculosis
cgccgucgccggacucgaucg

SEQ ID NO: 950621 - RNA, 13 nt, Mycobacterium avium subsp. paratuberculosis
cgccgucgccgac

SEQ ID NO: 950622 - RNA, 13 nt, Mycobacterium avium subsp. paratuberculosis
cgccgucgccacc

SEQ ID NO: 950623 - RNA, 15 nt, Mycobacterium avium subsp. paratuberculosis
cgccgucgccaccga

SEQ ID NO: 950624 - RNA, 17 nt, Mycobacterium avium subsp. paratuberculosis
cgccgucgccaccaccg

SEQ ID NO: 950625 - RNA, 14 nt, Mycobacterium avium subsp. paratuberculosis
cgccgucgccaccg

SEQ ID NO: 950626 - RNA, 22 nt, Mycobacterium avium subsp. paratuberculosis
cgccuuggugccguugaccacg

SEQ ID NO: 950627 - RNA, 13 nt, Mycobacterium avium subsp. paratuberculosis
cgccuugucggcg

SEQ ID NO: 950628 - RNA, 18 nt, Mycobacterium avium subsp. paratuberculosis
cgccuuggcgcgcucggu

SEQ ID NO: 950629 - RNA, 15 nt, Mycobacterium avium subsp. paratuberculosis
cgccuuggccacguc

SEQ ID NO: 950630 - RNA, 13 nt, Mycobacterium avium subsp. paratuberculosis
cgccuugggccgg

SEQ ID NO: 950631 - RNA, 23 nt, Mycobacterium avium subsp. paratuberculosis
cgccuugguagaugcguuccagg

SEQ ID NO: 950632 - RNA, 13 nt, Mycobacterium avium subsp. paratuberculosis
cgccuugcacacg

SEQ ID NO: 950633 - RNA, 16 nt, Mycobacterium avium subsp. paratuberculosis
cgccuugccgacgacg

SEQ ID NO: 950634 - RNA, 20 nt, Mycobacterium avium subsp. paratuberculosis
cgccuucuccgggucgcggg

SEQ ID NO: 950635 - RNA, 15 nt, Mycobacterium avium subsp. paratuberculosis
cgccuucgacggccg

SEQ ID NO: 950636 - RNA, 18 nt, Mycobacterium avium subsp. paratuberculosis
cgccuucuugcgcggcgc

SEQ ID NO: 950637 - RNA, 18 nt, Mycobacterium avium subsp. paratuberculosis
cgccuucuugcugcccgc

SEQ ID NO: 950638 - RNA, 22 nt, Mycobacterium avium subsp. paratuberculosis
cgccuucuugcugcccgcggcc

SEQ ID NO: 950639 - RNA, 17 nt, Mycobacterium avium subsp. paratuberculosis
cgccuugaaccggcugg

SEQ ID NO: 950640 - RNA, 13 nt, Mycobacterium avium subsp. paratuberculosis
cgccuugacgccg

SEQ ID NO: 950641 - RNA, 17 nt, Mycobacterium avium subsp. paratuberculosis
cgccuucuuggcggcgg

SEQ ID NO: 950642 - RNA, 22 nt, Mycobacterium avium subsp. paratuberculosis
cgccuugaccgcguuggcgccg

SEQ ID NO: 950643 - RNA, 23 nt, Mycobacterium avium subsp. paratuberculosis
cgccuucacgaccggcagcaccg

SEQ ID NO: 950644 - RNA, 19 nt, Mycobacterium avium subsp. paratuberculosis
cgccuuccgccacgcccag

SEQ ID NO: 950645 - RNA, 13 nt, Mycobacterium avium subsp. paratuberculosis
cgccuuccgggaa

SEQ ID NO: 950646 - RNA, 18 nt, Mycobacterium avium subsp. paratuberculosis
cgccuucgaugcccucca

SEQ ID NO: 950647 - RNA, 23 nt, Mycobacterium avium subsp. paratuberculosis
cgccuucgaugcccuccagcacc

SEQ ID NO: 950648 - RNA, 13 nt, Mycobacterium avium subsp. paratuberculosis
cgcgaacagcgcc

SEQ ID NO: 950649 - RNA, 16 nt, Mycobacterium avium subsp. paratuberculosis
cgcgaacagcgccgac

SEQ ID NO: 950650 - RNA, 15 nt, Mycobacterium avium subsp. paratuberculosis
cgcgaacagcgcggc

SEQ ID NO: 950651 - RNA, 17 nt, Mycobacterium avium subsp. paratuberculosis
cgcgaacagcgcggcca

SEQ ID NO: 950652 - RNA, 19 nt, Mycobacterium avium subsp. paratuberculosis
cgcgaacagcgcggccacc

SEQ ID NO: 950653 - RNA, 20 nt, Mycobacterium avium subsp. paratuberculosis
cgcgaacagcgcggccacca

SEQ ID NO: 950654 - RNA, 22 nt, Mycobacterium avium subsp. paratuberculosis
cgcgaacagcgcggccaccacg

SEQ ID NO: 950655 - RNA, 14 nt, Mycobacterium avium subsp. paratuberculosis
cgcgaacagguccu

SEQ ID NO: 950656 - RNA, 23 nt, Mycobacterium avium subsp. paratuberculosis
cgcgaacagguccuugcccagca

SEQ ID NO: 950657 - RNA, 13 nt, Mycobacterium avium subsp. paratuberculosis
cgcgaacagccga

SEQ ID NO: 950658 - RNA, 16 nt, Mycobacterium avium subsp. paratuberculosis
cgcgaacagccgaccg

SEQ ID NO: 950659 - RNA, 13 nt, Mycobacterium avium subsp. paratuberculosis
cgcgaacacgcga

SEQ ID NO: 950660 - RNA, 13 nt, Mycobacterium avium subsp. paratuberculosis
cgcgaacaucgcc

SEQ ID NO: 950661 - RNA, 14 nt, Mycobacterium avium subsp. paratuberculosis
cgcgaacaucgcca

SEQ ID NO: 950662 - RNA, 17 nt, Mycobacterium avium subsp. paratuberculosis
cgcgaacaucgccagca

SEQ ID NO: 950663 - RNA, 19 nt, Mycobacterium avium subsp. paratuberculosis
cgcgaacaucgccagcaac

SEQ ID NO: 950664 - RNA, 19 nt, Mycobacterium avium subsp. paratuberculosis
cgcgaaccgggccaggaug

SEQ ID NO: 950665 - RNA, 14 nt, Mycobacterium avium subsp. paratuberculosis
cgcgaacgacgacc

SEQ ID NO: 950666 - RNA, 18 nt, Mycobacterium avium subsp. paratuberculosis
cgcgaacgccucguuggc

SEQ ID NO: 950667 - RNA, 17 nt, Mycobacterium avium subsp. paratuberculosis
cgcgaacgcgccccgcc

SEQ ID NO: 950668 - RNA, 14 nt, Mycobacterium avium subsp. paratuberculosis
cgcgaacgggucgg

SEQ ID NO: 950669 - RNA, 18 nt, Mycobacterium avium subsp. paratuberculosis
cgcgaacgucucgcggga

SEQ ID NO: 950670 - RNA, 22 nt, Mycobacterium avium subsp. paratuberculosis
cgcgaacgggugaccggcggcc

SEQ ID NO: 950671 - RNA, 15 nt, Mycobacterium avium subsp. paratuberculosis
cgcgaacgggugcgg

SEQ ID NO: 950672 - RNA, 22 nt, Mycobacterium avium subsp. paratuberculosis
cgcgaacgggugcggcgcucgg

SEQ ID NO: 950673 - RNA, 23 nt, Mycobacterium avium subsp. paratuberculosis
cgcgaacgggugcggcgcucggu

SEQ ID NO: 950674 - RNA, 15 nt, Mycobacterium avium subsp. paratuberculosis
cgcgaacggcccgcc

SEQ ID NO: 950675 - RNA, 19 nt, Mycobacterium avium subsp. paratuberculosis
cgcgaacggcccgccgccg

SEQ ID NO: 950676 - RNA, 13 nt, Mycobacterium avium subsp. paratuberculosis
cgcgaacgcgccg

SEQ ID NO: 950677 - RNA, 19 nt, Mycobacterium avium subsp. paratuberculosis
cgcgaacgcgccggugacc

SEQ ID NO: 950678 - RNA, 19 nt, Mycobacterium avium subsp. paratuberculosis
cgcgaaaaaacggcggcgg

SEQ ID NO: 950679 - RNA, 21 nt, Mycobacterium avium subsp. paratuberculosis
cgcgaaaaaacggcggcggaa

SEQ ID NO: 950680 - RNA, 14 nt, Mycobacterium avium subsp. paratuberculosis
cgcgaaaacagcga

SEQ ID NO: 950681 - RNA, 17 nt, Mycobacterium avium subsp. paratuberculosis
cgcgaaaaccagcaccg

SEQ ID NO: 950682 - RNA, 18 nt, Mycobacterium avium subsp. paratuberculosis
cgcgaaaaccagcaccgg

SEQ ID NO: 950683 - RNA, 21 nt, Mycobacterium avium subsp. paratuberculosis
cgcgaaaaccagcaccggcac

SEQ ID NO: 950684 - RNA, 21 nt, Mycobacterium avium subsp. paratuberculosis
cgcgaaaauaccgccggccgc

SEQ ID NO: 950685 - RNA, 16 nt, Mycobacterium avium subsp. paratuberculosis
cgcgaaaaucgguggu

SEQ ID NO: 950686 - RNA, 19 nt, Mycobacterium avium subsp. paratuberculosis
cgccuuguuggcccacagc

SEQ ID NO: 950687 - RNA, 20 nt, Mycobacterium avium subsp. paratuberculosis
cgccuuguuggcccacagcu

SEQ ID NO: 950688 - RNA, 16 nt, Mycobacterium avium subsp. paratuberculosis
cgccuuuugcacccgc

SEQ ID NO: 950689 - RNA, 14 nt, Mycobacterium avium subsp. paratuberculosis
cgcgaaagcacccg

SEQ ID NO: 950690 - RNA, 22 nt, Mycobacterium avium subsp. paratuberculosis
cgcgaaagcagcaacggcggcg

SEQ ID NO: 950691 - RNA, 23 nt, Mycobacterium avium subsp. paratuberculosis
cgcgaaagcagcaacggcggcgg

SEQ ID NO: 950692 - RNA, 23 nt, Mycobacterium avium subsp. paratuberculosis
cgcgaaagcagcguucggucagc

SEQ ID NO: 950693 - RNA, 17 nt, Mycobacterium avium subsp. paratuberculosis
cgcgaacaaucgcugcg

SEQ ID NO: 950694 - RNA, 20 nt, Mycobacterium avium subsp. paratuberculosis
cgcgaacaaucgcugcgagc

SEQ ID NO: 950695 - RNA, 21 nt, Mycobacterium avium subsp. paratuberculosis
cgcgaaagugcaacugccgac

SEQ ID NO: 950696 - RNA, 18 nt, Mycobacterium avium subsp. paratuberculosis
cgcgaaagugcuacugcc

SEQ ID NO: 950697 - RNA, 24 nt, Mycobacterium avium subsp. paratuberculosis
cgcgaaagugcuacugccgacgca

SEQ ID NO: 950698 - RNA, 21 nt, Mycobacterium avium subsp. paratuberculosis
cgcgaaauacgacgagccgac

SEQ ID NO: 950699 - RNA, 15 nt, Mycobacterium avium subsp. paratuberculosis
cgcgaaagcgucggc

SEQ ID NO: 950700 - RNA, 22 nt, Mycobacterium avium subsp. paratuberculosis
cgcgaaagcgucggcuagcggc

SEQ ID NO: 950701 - RNA, 17 nt, Mycobacterium avium subsp. paratuberculosis
cgcgaaaggcccaccgc

SEQ ID NO: 950702 - RNA, 15 nt, Mycobacterium avium subsp. paratuberculosis
cgcgaaugucgacca

SEQ ID NO: 950703 - RNA, 17 nt, Mycobacterium avium subsp. paratuberculosis
cgcgaaucccggccucg

SEQ ID NO: 950704 - RNA, 24 nt, Mycobacterium avium subsp. paratuberculosis
cgcgaaucgauaacgcgcgcgccg

SEQ ID NO: 950705 - RNA, 17 nt, Mycobacterium avium subsp. paratuberculosis
cgcgacacgucgacacg

SEQ ID NO: 950706 - RNA, 20 nt, Mycobacterium avium subsp. paratuberculosis
cgcgacacugcaacuacgca

SEQ ID NO: 950707 - RNA, 15 nt, Mycobacterium avium subsp. paratuberculosis
cgcgacagccgggaa

SEQ ID NO: 950708 - RNA, 17 nt, Mycobacterium avium subsp. paratuberculosis
cgcgacaaggucgaccg

SEQ ID NO: 950709 - RNA, 18 nt, Mycobacterium avium subsp. paratuberculosis
cgcgacaaggucgaccgc

SEQ ID NO: 950710 - RNA, 20 nt, Mycobacterium avium subsp. paratuberculosis
cgcgacaaggucgaccgcgc

SEQ ID NO: 950711 - RNA, 21 nt, Mycobacterium avium subsp. paratuberculosis
cgcgacaaggucgaccgcgca

SEQ ID NO: 950712 - RNA, 17 nt, Mycobacterium avium subsp. paratuberculosis
cgcgacacccgcgacga

SEQ ID NO: 950713 - RNA, 18 nt, Mycobacterium avium subsp. paratuberculosis
cgcgacacccgcgacgac

SEQ ID NO: 950714 - RNA, 14 nt, Mycobacterium avium subsp. paratuberculosis
cgcgacaccgcggc

SEQ ID NO: 950715 - RNA, 17 nt, Mycobacterium avium subsp. paratuberculosis
cgcgacaccgcggcgac

SEQ ID NO: 950716 - RNA, 20 nt, Mycobacterium avium subsp. paratuberculosis
cgcgacaccgcggcgacguc

SEQ ID NO: 950717 - RNA, 21 nt, Mycobacterium avium subsp. paratuberculosis
cgcgacaccugcucaccgagc

SEQ ID NO: 950718 - RNA, 21 nt, Mycobacterium avium subsp. paratuberculosis
cgcgaagcguaugccgguggc

SEQ ID NO: 950719 - RNA, 22 nt, Mycobacterium avium subsp. paratuberculosis
cgcgaagcguaugccgguggcg

SEQ ID NO: 950720 - RNA, 19 nt, Mycobacterium avium subsp. paratuberculosis
cgcgaacuucaggcccuca

SEQ ID NO: 950721 - RNA, 20 nt, Mycobacterium avium subsp. paratuberculosis
cgcgaagucccacugcccgu

SEQ ID NO: 950722 - RNA, 14 nt, Mycobacterium avium subsp. paratuberculosis
cgcgaaguccgacg

SEQ ID NO: 950723 - RNA, 17 nt, Mycobacterium avium subsp. paratuberculosis
cgcgaagucgagcaggu

SEQ ID NO: 950724 - RNA, 14 nt, Mycobacterium avium subsp. paratuberculosis
cgcgaagucgccgc

SEQ ID NO: 950725 - RNA, 18 nt, Mycobacterium avium subsp. paratuberculosis
cgcgaagucgccgcccgg

SEQ ID NO: 950726 - RNA, 15 nt, Mycobacterium avium subsp. paratuberculosis
cgcgaaggcggcguc

SEQ ID NO: 950727 - RNA, 16 nt, Mycobacterium avium subsp. paratuberculosis
cgcgaaggcggcgucg

SEQ ID NO: 950728 - RNA, 17 nt, Mycobacterium avium subsp. paratuberculosis
cgcgaagguggcgccgg

SEQ ID NO: 950729 - RNA, 17 nt, Mycobacterium avium subsp. paratuberculosis
cgcgaacucaggcgcgc

SEQ ID NO: 950730 - RNA, 15 nt, Mycobacterium avium subsp. paratuberculosis
cgcgaacucgucgau

SEQ ID NO: 950731 - RNA, 16 nt, Mycobacterium avium subsp. paratuberculosis
cgcgaagaacgacgcc

SEQ ID NO: 950732 - RNA, 19 nt, Mycobacterium avium subsp. paratuberculosis
cgcgaagaacgacgccacc

SEQ ID NO: 950733 - RNA, 20 nt, Mycobacterium avium subsp. paratuberculosis
cgcgaagcccucgaagcaga

SEQ ID NO: 950734 - RNA, 15 nt, Mycobacterium avium subsp. paratuberculosis
cgcgacagccgcccg

SEQ ID NO: 950735 - RNA, 18 nt, Mycobacterium avium subsp. paratuberculosis
cgcgacagccgcccggcg

SEQ ID NO: 950736 - RNA, 16 nt, Mycobacterium avium subsp. paratuberculosis
cgcgacacgccgcgca

SEQ ID NO: 950737 - RNA, 16 nt, Mycobacterium avium subsp. paratuberculosis
cgcgacaucaccgcgg

SEQ ID NO: 950738 - RNA, 17 nt, Mycobacterium avium subsp. paratuberculosis
cgcgacaucaccgcggg

SEQ ID NO: 950739 - RNA, 22 nt, Mycobacterium avium subsp. paratuberculosis
cgcgacaucaccgcgggcgcgc

SEQ ID NO: 950740 - RNA, 15 nt, Mycobacterium avium subsp. paratuberculosis
cgcgacaucgccggc

SEQ ID NO: 950741 - RNA, 17 nt, Mycobacterium avium subsp. paratuberculosis
cgcgacaucgccggcga

SEQ ID NO: 950742 - RNA, 18 nt, Mycobacterium avium subsp. paratuberculosis
cgcgacaucgccggcgac

SEQ ID NO: 950743 - RNA, 13 nt, Mycobacterium avium subsp. paratuberculosis
cgcgacaucggcg

SEQ ID NO: 950744 - RNA, 14 nt, Mycobacterium avium subsp. paratuberculosis
cgcgacaucggcgc

SEQ ID NO: 950745 - RNA, 16 nt, Mycobacterium avium subsp. paratuberculosis
cgcgacaucggcgccg

SEQ ID NO: 950746 - RNA, 17 nt, Mycobacterium avium subsp. paratuberculosis
cgcgacaucggcgccga

SEQ ID NO: 950747 - RNA, 18 nt, Mycobacterium avium subsp. paratuberculosis
cgcgacaucggcgccgac

SEQ ID NO: 950748 - RNA, 16 nt, Mycobacterium avium subsp. paratuberculosis
cgcgacaucggugacc

SEQ ID NO: 950749 - RNA, 19 nt, Mycobacterium avium subsp. paratuberculosis
cgcgacaucggugaccguc

SEQ ID NO: 950750 - RNA, 19 nt, Mycobacterium avium subsp. paratuberculosis
cgcgaccacagcgccucgu

SEQ ID NO: 950751 - RNA, 20 nt, Mycobacterium avium subsp. paratuberculosis
cgcgaccacagcgccucguc

SEQ ID NO: 950752 - RNA, 19 nt, Mycobacterium avium subsp. paratuberculosis
cgcgaccaaacgcagcguc

SEQ ID NO: 950753 - RNA, 22 nt, Mycobacterium avium subsp. paratuberculosis
cgcgaccaaacgcagcgucuuc

SEQ ID NO: 950754 - RNA, 17 nt, Mycobacterium avium subsp. paratuberculosis
cgcgaccaccggccgac

SEQ ID NO: 950755 - RNA, 15 nt, Mycobacterium avium subsp. paratuberculosis
cgcgaccacauaccg

SEQ ID NO: 950756 - RNA, 14 nt, Mycobacterium avium subsp. paratuberculosis
cgcgaccacgccgc

SEQ ID NO: 950757 - RNA, 15 nt, Mycobacterium avium subsp. paratuberculosis
cgcgaccacgccgcg

SEQ ID NO: 950758 - RNA, 19 nt, Mycobacterium avium subsp. paratuberculosis
cgcgaccacgccgcggucg

SEQ ID NO: 950759 - RNA, 20 nt, Mycobacterium avium subsp. paratuberculosis
cgcgaccacgccgcggucgc

SEQ ID NO: 950760 - RNA, 16 nt, Mycobacterium avium subsp. paratuberculosis
cgcgaccccuacgggc

SEQ ID NO: 950761 - RNA, 22 nt, Mycobacterium avium subsp. paratuberculosis
cgcgaccccuacgggcgcaccg

SEQ ID NO: 950762 - RNA, 21 nt, Mycobacterium avium subsp. paratuberculosis
cgcgaccccuccaacggccgc

SEQ ID NO: 950763 - RNA, 22 nt, Mycobacterium avium subsp. paratuberculosis
cgcgaccccuccaacggccgca

SEQ ID NO: 950764 - RNA, 22 nt, Mycobacterium avium subsp. paratuberculosis
cgcgacccgaacuucagcgcgu

SEQ ID NO: 950765 - RNA, 12 nt, Mycobacterium avium subsp. paratuberculosis
cgcgacccgcuc

SEQ ID NO: 950766 - RNA, 13 nt, Mycobacterium avium subsp. paratuberculosis
cgcgacccggccg

SEQ ID NO: 950767 - RNA, 14 nt, Mycobacterium avium subsp. paratuberculosis
cgcgacccggccga

SEQ ID NO: 950768 - RNA, 15 nt, Mycobacterium avium subsp. paratuberculosis
cgcgacccggccgag

SEQ ID NO: 950769 - RNA, 16 nt, Mycobacterium avium subsp. paratuberculosis
cgcgacccggccgagc

SEQ ID NO: 950770 - RNA, 15 nt, Mycobacterium avium subsp. paratuberculosis
cgcgacccgggccgc

SEQ ID NO: 950771 - RNA, 17 nt, Mycobacterium avium subsp. paratuberculosis
cgcgacccgggccgcca

SEQ ID NO: 950772 - RNA, 18 nt, Mycobacterium avium subsp. paratuberculosis
cgcgacccgguccaccug

SEQ ID NO: 950773 - RNA, 13 nt, Mycobacterium avium subsp. paratuberculosis
cgcgaccgccucg

SEQ ID NO: 950774 - RNA, 20 nt, Mycobacterium avium subsp. paratuberculosis
cgcgaccccggaccgcggaa

SEQ ID NO: 950775 - RNA, 14 nt, Mycobacterium avium subsp. paratuberculosis
cgcgaccgcagcag

SEQ ID NO: 950776 - RNA, 13 nt, Mycobacterium avium subsp. paratuberculosis
cgcgacccaggcc

SEQ ID NO: 950777 - RNA, 15 nt, Mycobacterium avium subsp. paratuberculosis
cgcgacccaggccgc

SEQ ID NO: 950778 - RNA, 17 nt, Mycobacterium avium subsp. paratuberculosis
cgcgacccaggccgccg

SEQ ID NO: 950779 - RNA, 19 nt, Mycobacterium avium subsp. paratuberculosis
cgcgacccaggccgccgcc

SEQ ID NO: 950780 - RNA, 15 nt, Mycobacterium avium subsp. paratuberculosis
cgcgaccaucagccc

SEQ ID NO: 950781 - RNA, 16 nt, Mycobacterium avium subsp. paratuberculosis
cgcgaccaucagcccg

SEQ ID NO: 950782 - RNA, 22 nt, Mycobacterium avium subsp. paratuberculosis
cgcgaccaucagcccggugacg

SEQ ID NO: 950783 - RNA, 16 nt, Mycobacterium avium subsp. paratuberculosis
cgcgaccaggcccagc

SEQ ID NO: 950784 - RNA, 17 nt, Mycobacterium avium subsp. paratuberculosis
cgcgaccaggcccagcg

SEQ ID NO: 950785 - RNA, 22 nt, Mycobacterium avium subsp. paratuberculosis
cgcgaccaggcccagcggaucg

SEQ ID NO: 950786 - RNA, 15 nt, Mycobacterium avium subsp. paratuberculosis
cgcgaccagcucggg

SEQ ID NO: 950787 - RNA, 13 nt, Mycobacterium avium subsp. paratuberculosis
cgcgaccagcccg

SEQ ID NO: 950788 - RNA, 19 nt, Mycobacterium avium subsp. paratuberculosis
cgcgaccagcccggccgcc

SEQ ID NO: 950789 - RNA, 15 nt, Mycobacterium avium subsp. paratuberculosis
cgcgaccagcggcag

SEQ ID NO: 950790 - RNA, 17 nt, Mycobacterium avium subsp. paratuberculosis
cgcgaccagcggcagca

SEQ ID NO: 950791 - RNA, 23 nt, Mycobacterium avium subsp. paratuberculosis
cgcgaccagcggcagcagcacca

SEQ ID NO: 950792 - RNA, 13 nt, Mycobacterium avium subsp. paratuberculosis
aacacgaacccgg

SEQ ID NO: 950793 - RNA, 20 nt, Mycobacterium avium subsp. paratuberculosis
aacacgagcagacccgccgc

SEQ ID NO: 950794 - RNA, 23 nt, Mycobacterium avium subsp. paratuberculosis
aacacgagcagacccgccgcggc

SEQ ID NO: 950795 - RNA, 15 nt, Mycobacterium avium subsp. paratuberculosis
aacaccuuucggccg

SEQ ID NO: 950796 - RNA, 19 nt, Mycobacterium avium subsp. paratuberculosis
aacaccuuucggccgcgga

SEQ ID NO: 950797 - RNA, 15 nt, Mycobacterium avium subsp. paratuberculosis
aacaccucggcgaug

SEQ ID NO: 950798 - RNA, 15 nt, Mycobacterium avium subsp. paratuberculosis
aacaccugcggcggc

SEQ ID NO: 950799 - RNA, 17 nt, Mycobacterium avium subsp. paratuberculosis
aacacgcccagcgccgc

SEQ ID NO: 950800 - RNA, 17 nt, Mycobacterium avium subsp. paratuberculosis
aacacgccccggcgggu

SEQ ID NO: 950801 - RNA, 13 nt, Mycobacterium avium subsp. paratuberculosis
cgccgggccgccg

SEQ ID NO: 950802 - RNA, 14 nt, Mycobacterium avium subsp. paratuberculosis
cgccgggccgccga

SEQ ID NO: 950803 - RNA, 16 nt, Mycobacterium avium subsp. paratuberculosis
cgccgggccgccgaug

SEQ ID NO: 950804 - RNA, 19 nt, Mycobacterium avium subsp. paratuberculosis
cgccgggccgccgaugcgc

SEQ ID NO: 950805 - RNA, 23 nt, Mycobacterium avium subsp. paratuberculosis
cgccgggccgccgaugcgcccgc

SEQ ID NO: 950806 - RNA, 17 nt, Mycobacterium avium subsp. paratuberculosis
cgccgggccgccgcggc

SEQ ID NO: 950807 - RNA, 19 nt, Mycobacterium avium subsp. paratuberculosis
cgccgggcgccacgcuggc

SEQ ID NO: 950808 - RNA, 18 nt, Mycobacterium avium subsp. paratuberculosis
cgccgggcgcccgagccg

SEQ ID NO: 950809 - RNA, 16 nt, Mycobacterium avium subsp. paratuberculosis
cgccgggcgcccgcgg

SEQ ID NO: 950810 - RNA, 20 nt, Mycobacterium avium subsp. paratuberculosis
cgccgggcgaagucgccggc

SEQ ID NO: 950811 - RNA, 21 nt, Mycobacterium avium subsp. paratuberculosis
cgccgggcgaagucgccggcc

SEQ ID NO: 950812 - RNA, 22 nt, Mycobacterium avium subsp. paratuberculosis
cgccgggcgaagucgccggcca

SEQ ID NO: 950813 - RNA, 12 nt, Mycobacterium avium subsp. paratuberculosis
aacacgccggcg

SEQ ID NO: 950814 - RNA, 16 nt, Mycobacterium avium subsp. paratuberculosis
cgccggcggcggcggu

SEQ ID NO: 950815 - RNA, 15 nt, Mycobacterium avium subsp. paratuberculosis
cgccggcggcguccc

SEQ ID NO: 950816 - RNA, 17 nt, Mycobacterium avium subsp. paratuberculosis
cgccgggccuguccagc

SEQ ID NO: 950817 - RNA, 14 nt, Mycobacterium avium subsp. paratuberculosis
cgccgggccggauc

SEQ ID NO: 950818 - RNA, 17 nt, Mycobacterium avium subsp. paratuberculosis
cgccgggccggaucgcg

SEQ ID NO: 950819 - RNA, 15 nt, Mycobacterium avium subsp. paratuberculosis
cgccgggccggccgg

SEQ ID NO: 950820 - RNA, 16 nt, Mycobacterium avium subsp. paratuberculosis
cgccgggccggccggu

SEQ ID NO: 950821 - RNA, 15 nt, Mycobacterium avium subsp. paratuberculosis
cgccgggccggcggc

SEQ ID NO: 950822 - RNA, 16 nt, Mycobacterium avium subsp. paratuberculosis
cgccgggccggcggcc

SEQ ID NO: 950823 - RNA, 17 nt, Mycobacterium avium subsp. paratuberculosis
cgccgggccggcggcca

SEQ ID NO: 950824 - RNA, 22 nt, Mycobacterium avium subsp. paratuberculosis
cgccgggcgggccgcagcacca

SEQ ID NO: 950825 - RNA, 20 nt, Mycobacterium avium subsp. paratuberculosis
cgccgggcggggugguggac

SEQ ID NO: 950826 - RNA, 13 nt, Mycobacterium avium subsp. paratuberculosis
cgccgggcgucgc

SEQ ID NO: 950827 - RNA, 14 nt, Mycobacterium avium subsp. paratuberculosis
cgccgggcgucgcg

SEQ ID NO: 950828 - RNA, 18 nt, Mycobacterium avium subsp. paratuberculosis
cgccgggcguugcccgcc

SEQ ID NO: 950829 - RNA, 13 nt, Mycobacterium avium subsp. paratuberculosis
cgccgggcgucac

SEQ ID NO: 950830 - RNA, 17 nt, Mycobacterium avium subsp. paratuberculosis
cgccgggcgucacgcca

SEQ ID NO: 950831 - RNA, 17 nt, Mycobacterium avium subsp. paratuberculosis
cgccgggcgucacucug

SEQ ID NO: 950832 - RNA, 19 nt, Mycobacterium avium subsp. paratuberculosis
cgccgggcgucacucuggc

SEQ ID NO: 950833 - RNA, 14 nt, Mycobacterium avium subsp. paratuberculosis
cgccgggcggaugu

SEQ ID NO: 950834 - RNA, 18 nt, Mycobacterium avium subsp. paratuberculosis
cgccgggcggcagcacgu

SEQ ID NO: 950835 - RNA, 21 nt, Mycobacterium avium subsp. paratuberculosis
cgccgggcggcagcacgucgu

SEQ ID NO: 950836 - RNA, 14 nt, Mycobacterium avium subsp. paratuberculosis
cgccgggcggcccg

SEQ ID NO: 950837 - RNA, 16 nt, Mycobacterium avium subsp. paratuberculosis
cgccgggcggcccgcc

SEQ ID NO: 950838 - RNA, 21 nt, Mycobacterium avium subsp. paratuberculosis
cgccgggcggcccgccucggc

SEQ ID NO: 950839 - RNA, 13 nt, Mycobacterium avium subsp. paratuberculosis
cgccgggcggccu

SEQ ID NO: 950840 - RNA, 14 nt, Mycobacterium avium subsp. paratuberculosis
cgccgggcggccuc

SEQ ID NO: 950841 - RNA, 15 nt, Mycobacterium avium subsp. paratuberculosis
cgccgggcggccucg

SEQ ID NO: 950842 - RNA, 21 nt, Mycobacterium avium subsp. paratuberculosis
cgccgggcugaccgucgacca

SEQ ID NO: 950843 - RNA, 23 nt, Mycobacterium avium subsp. paratuberculosis
cgccgggcugaccgucgaccaac

SEQ ID NO: 950844 - RNA, 18 nt, Mycobacterium avium subsp. paratuberculosis
cgccgggcuggccgucgg

SEQ ID NO: 950845 - RNA, 19 nt, Mycobacterium avium subsp. paratuberculosis
cgccgggcuggccgucggc

SEQ ID NO: 950846 - RNA, 21 nt, Mycobacterium avium subsp. paratuberculosis
cgccgggcuggccgucggcga

SEQ ID NO: 950847 - RNA, 13 nt, Mycobacterium avium subsp. paratuberculosis
cgccgggcugggu

SEQ ID NO: 950848 - RNA, 17 nt, Mycobacterium avium subsp. paratuberculosis
cgccgggcuggccgucg

SEQ ID NO: 950849 - RNA, 21 nt, Mycobacterium avium subsp. paratuberculosis
cgccggggaagaucucggcca

SEQ ID NO: 950850 - RNA, 22 nt, Mycobacterium avium subsp. paratuberculosis
cgccggggaagaucucggccag

SEQ ID NO: 950851 - RNA, 23 nt, Mycobacterium avium subsp. paratuberculosis
cgccggggaagaucucggccagg

SEQ ID NO: 950852 - RNA, 20 nt, Mycobacterium avium subsp. paratuberculosis
cgccgggcuuccccaaccug

SEQ ID NO: 950853 - RNA, 18 nt, Mycobacterium avium subsp. paratuberculosis
cgccggggacccgcaccg

SEQ ID NO: 950854 - RNA, 20 nt, Mycobacterium avium subsp. paratuberculosis
cgccggggacccgcaccgga

SEQ ID NO: 950855 - RNA, 17 nt, Mycobacterium avium subsp. paratuberculosis
cgccggggacgacggcg

SEQ ID NO: 950856 - RNA, 18 nt, Mycobacterium avium subsp. paratuberculosis
cgccggggacgacggcgg

SEQ ID NO: 950857 - RNA, 23 nt, Mycobacterium avium subsp. paratuberculosis
cgccggggacgacggcggggaug

SEQ ID NO: 950858 - RNA, 13 nt, Mycobacterium avium subsp. paratuberculosis
cgccgguaccgcc

SEQ ID NO: 950859 - RNA, 20 nt, Mycobacterium avium subsp. paratuberculosis
cgccgguaccgccggccagg

SEQ ID NO: 950860 - RNA, 22 nt, Mycobacterium avium subsp. paratuberculosis
cgccgguaccgccggccaggcg

SEQ ID NO: 950861 - RNA, 15 nt, Mycobacterium avium subsp. paratuberculosis
cgccgguagccgcuc

SEQ ID NO: 950862 - RNA, 22 nt, Mycobacterium avium subsp. paratuberculosis
cgccgguagccgcucgcccagc

SEQ ID NO: 950863 - RNA, 23 nt, Mycobacterium avium subsp. paratuberculosis
cgccgguagccgcucgcccagcg

SEQ ID NO: 950864 - RNA, 18 nt, Mycobacterium avium subsp. paratuberculosis
cgccgguaggccgcgccg

SEQ ID NO: 950865 - RNA, 17 nt, Mycobacterium avium subsp. paratuberculosis
cgccgguaggcgcgggu

SEQ ID NO: 950866 - RNA, 18 nt, Mycobacterium avium subsp. paratuberculosis
cgccgguaggcgcgggug

SEQ ID NO: 950867 - RNA, 19 nt, Mycobacterium avium subsp. paratuberculosis
cgccgguaggcgcggguga

SEQ ID NO: 950868 - RNA, 15 nt, Mycobacterium avium subsp. paratuberculosis
cgccgguaggcggcc

SEQ ID NO: 950869 - RNA, 16 nt, Mycobacterium avium subsp. paratuberculosis
cgccgguaggcggcca

SEQ ID NO: 950870 - RNA, 18 nt, Mycobacterium avium subsp. paratuberculosis
cgccggguuuguccggcc

SEQ ID NO: 950871 - RNA, 18 nt, Mycobacterium avium subsp. paratuberculosis
cgccggguugggcggcgg

SEQ ID NO: 950872 - RNA, 19 nt, Mycobacterium avium subsp. paratuberculosis
cgccggguugggcggcggc

SEQ ID NO: 950873 - RNA, 21 nt, Mycobacterium avium subsp. paratuberculosis
cgccggguugggcggcggcca

SEQ ID NO: 950874 - RNA, 16 nt, Mycobacterium avium subsp. paratuberculosis
cgccgggucuuccacg

SEQ ID NO: 950875 - RNA, 20 nt, Mycobacterium avium subsp. paratuberculosis
cgccgggucuuccacgccgg

SEQ ID NO: 950876 - RNA, 21 nt, Mycobacterium avium subsp. paratuberculosis
cgccgggucuuccacgccggu

SEQ ID NO: 950877 - RNA, 22 nt, Mycobacterium avium subsp. paratuberculosis
cgccggguggccgccacguccg

SEQ ID NO: 950878 - RNA, 19 nt, Mycobacterium avium subsp. paratuberculosis
cgccggguggccggggcca

SEQ ID NO: 950879 - RNA, 15 nt, Mycobacterium avium subsp. paratuberculosis
cgccgggucgcggua

SEQ ID NO: 950880 - RNA, 20 nt, Mycobacterium avium subsp. paratuberculosis
cgccgggucgcgguagaugu

SEQ ID NO: 950881 - RNA, 21 nt, Mycobacterium avium subsp. paratuberculosis
cgccgggucgcggugggcucg

SEQ ID NO: 950882 - RNA, 23 nt, Mycobacterium avium subsp. paratuberculosis
cgccgggucgcggugggcucggc

SEQ ID NO: 950883 - RNA, 14 nt, Mycobacterium avium subsp. paratuberculosis
cgccgggucgcacg

SEQ ID NO: 950884 - RNA, 17 nt, Mycobacterium avium subsp. paratuberculosis
cgccgggucgcacgccg

SEQ ID NO: 950885 - RNA, 18 nt, Mycobacterium avium subsp. paratuberculosis
cgccgggucgcacgccgg

SEQ ID NO: 950886 - RNA, 19 nt, Mycobacterium avium subsp. paratuberculosis
cgccgggucgcacgccggu

SEQ ID NO: 950887 - RNA, 22 nt, Mycobacterium avium subsp. paratuberculosis
cgccggguccuugcgccccggc

SEQ ID NO: 950888 - RNA, 14 nt, Mycobacterium avium subsp. paratuberculosis
cgccgggucgacgc

SEQ ID NO: 950889 - RNA, 15 nt, Mycobacterium avium subsp. paratuberculosis
cgccgggucgacgcc

SEQ ID NO: 950890 - RNA, 17 nt, Mycobacterium avium subsp. paratuberculosis
cgccgggucgacgccga

SEQ ID NO: 950891 - RNA, 18 nt, Mycobacterium avium subsp. paratuberculosis
cgccgggucgacgccgag

SEQ ID NO: 950892 - RNA, 16 nt, Mycobacterium avium subsp. paratuberculosis
cgccgggguagaggcc

SEQ ID NO: 950893 - RNA, 20 nt, Mycobacterium avium subsp. paratuberculosis
cgccgggguagaggccgcgg

SEQ ID NO: 950894 - RNA, 19 nt, Mycobacterium avium subsp. paratuberculosis
cgccggguaguucaccccg

SEQ ID NO: 950895 - RNA, 14 nt, Mycobacterium avium subsp. paratuberculosis
cgccgggucaccgg

SEQ ID NO: 950896 - RNA, 16 nt, Mycobacterium avium subsp. paratuberculosis
cgccggguccacgaac

SEQ ID NO: 950897 - RNA, 15 nt, Mycobacterium avium subsp. paratuberculosis
cgccggguccagccg

SEQ ID NO: 950898 - RNA, 17 nt, Mycobacterium avium subsp. paratuberculosis
cgccggguccagccgcg

SEQ ID NO: 950899 - RNA, 19 nt, Mycobacterium avium subsp. paratuberculosis
cgccggguccagccgcggu

SEQ ID NO: 950900 - RNA, 12 nt, Mycobacterium avium subsp. paratuberculosis
cgccggguccca

SEQ ID NO: 950901 - RNA, 18 nt, Mycobacterium avium subsp. paratuberculosis
cgccgggucccagugcca

SEQ ID NO: 950902 - RNA, 14 nt, Mycobacterium avium subsp. paratuberculosis
cgccgggguccgca

SEQ ID NO: 950903 - RNA, 16 nt, Mycobacterium avium subsp. paratuberculosis
cgccgggguccgcaac

SEQ ID NO: 950904 - RNA, 22 nt, Mycobacterium avium subsp. paratuberculosis
cgccgggguccgcaacgccggc

SEQ ID NO: 950905 - RNA, 18 nt, Mycobacterium avium subsp. paratuberculosis
cgccgggguccucucggc

SEQ ID NO: 950906 - RNA, 14 nt, Mycobacterium avium subsp. paratuberculosis
cgccggggucgaca

SEQ ID NO: 950907 - RNA, 14 nt, Mycobacterium avium subsp. paratuberculosis
cgccggggucgcgc

SEQ ID NO: 950908 - RNA, 17 nt, Mycobacterium avium subsp. paratuberculosis
cgccggggucgcgcgcg

SEQ ID NO: 950909 - RNA, 17 nt, Mycobacterium avium subsp. paratuberculosis
cgccggggugcaccgug

SEQ ID NO: 950910 - RNA, 18 nt, Mycobacterium avium subsp. paratuberculosis
cgccggggugcaccgugg

SEQ ID NO: 950911 - RNA, 21 nt, Mycobacterium avium subsp. paratuberculosis
cgccggggugcaccgugguga

SEQ ID NO: 950912 - RNA, 23 nt, Mycobacterium avium subsp. paratuberculosis
cgccggggugcaccguggugacc

SEQ ID NO: 950913 - RNA, 15 nt, Mycobacterium avium subsp. paratuberculosis
cgccggggugggcca

SEQ ID NO: 950914 - RNA, 19 nt, Mycobacterium avium subsp. paratuberculosis
cgccggggugggccaucgg

SEQ ID NO: 950915 - RNA, 20 nt, Mycobacterium avium subsp. paratuberculosis
cgccggggugggccaucggc

SEQ ID NO: 950916 - RNA, 21 nt, Mycobacterium avium subsp. paratuberculosis
cgccggggugggccaucggca

SEQ ID NO: 950917 - RNA, 16 nt, Mycobacterium avium subsp. paratuberculosis
cgccgggguguccagc

SEQ ID NO: 950918 - RNA, 20 nt, Mycobacterium avium subsp. paratuberculosis
cgccgggguguccagcgggu

SEQ ID NO: 950919 - RNA, 16 nt, Mycobacterium avium subsp. paratuberculosis
cgccggggugugcagc

SEQ ID NO: 950920 - RNA, 20 nt, Mycobacterium avium subsp. paratuberculosis
cgccggggugugcagcggga

SEQ ID NO: 950921 - RNA, 20 nt, Mycobacterium avium subsp. paratuberculosis
cgccggggcucauacggcgg

SEQ ID NO: 950922 - RNA, 21 nt, Mycobacterium avium subsp. paratuberculosis
cgccggggcucauacggcggc

SEQ ID NO: 950923 - RNA, 20 nt, Mycobacterium avium subsp. paratuberculosis
cgccgggggagucggggugc

SEQ ID NO: 950924 - RNA, 23 nt, Mycobacterium avium subsp. paratuberculosis
cgccggggccuucuuggcggcgg

SEQ ID NO: 950925 - RNA, 22 nt, Mycobacterium avium subsp. paratuberculosis
cgccggggcgggcagcaccagc

SEQ ID NO: 950926 - RNA, 23 nt, Mycobacterium avium subsp. paratuberculosis
cgccggggcgggcagcaccagcg

SEQ ID NO: 950927 - RNA, 15 nt, Mycobacterium avium subsp. paratuberculosis
cgccggggcgggcgg

SEQ ID NO: 950928 - RNA, 17 nt, Mycobacterium avium subsp. paratuberculosis
cgccggggcgggcggcg

SEQ ID NO: 950929 - RNA, 19 nt, Mycobacterium avium subsp. paratuberculosis
cgccggggcgggcggcggc

SEQ ID NO: 950930 - RNA, 21 nt, Mycobacterium avium subsp. paratuberculosis
cgccggggcgggcggcggcug

SEQ ID NO: 950931 - RNA, 13 nt, Mycobacterium avium subsp. paratuberculosis
cgccggggcgucg

SEQ ID NO: 950932 - RNA, 14 nt, Mycobacterium avium subsp. paratuberculosis
cgccggggcgucgg

SEQ ID NO: 950933 - RNA, 23 nt, Mycobacterium avium subsp. paratuberculosis
cgccggggcgcugagcagguccu

SEQ ID NO: 950934 - RNA, 23 nt, Mycobacterium avium subsp. paratuberculosis
cgccggggcggauccccgcgcug

SEQ ID NO: 950935 - RNA, 13 nt, Mycobacterium avium subsp. paratuberculosis
cgccggggcgccg

SEQ ID NO: 950936 - RNA, 14 nt, Mycobacterium avium subsp. paratuberculosis
cgccggggcgccgc

SEQ ID NO: 950937 - RNA, 19 nt, Mycobacterium avium subsp. paratuberculosis
cgccggggcgccgccgaac

SEQ ID NO: 950938 - RNA, 15 nt, Mycobacterium avium subsp. paratuberculosis
cgccggggcaccauu

SEQ ID NO: 950939 - RNA, 13 nt, Mycobacterium avium subsp. paratuberculosis
cgccggggcccca

SEQ ID NO: 950940 - RNA, 13 nt, Mycobacterium avium subsp. paratuberculosis
cgccggggcccuc

SEQ ID NO: 950941 - RNA, 14 nt, Mycobacterium avium subsp. paratuberculosis
cgccggggccgcgg

SEQ ID NO: 950942 - RNA, 16 nt, Mycobacterium avium subsp. paratuberculosis
cgccggggccgcggcu

SEQ ID NO: 950943 - RNA, 19 nt, Mycobacterium avium subsp. paratuberculosis
cgccggggccgcggcucgc

SEQ ID NO: 950944 - RNA, 20 nt, Mycobacterium avium subsp. paratuberculosis
cgccggggccgcggcucgcg

SEQ ID NO: 950945 - RNA, 16 nt, Mycobacterium avium subsp. paratuberculosis
cgccguagcgccggca

SEQ ID NO: 950946 - RNA, 14 nt, Mycobacterium avium subsp. paratuberculosis
cgccgucaucggcg

SEQ ID NO: 950947 - RNA, 15 nt, Mycobacterium avium subsp. paratuberculosis
cgccgucaucggcgg

SEQ ID NO: 950948 - RNA, 16 nt, Mycobacterium avium subsp. paratuberculosis
cgccgucaucggcgga

SEQ ID NO: 950949 - RNA, 17 nt, Mycobacterium avium subsp. paratuberculosis
cgccgucaucggcggaa

SEQ ID NO: 950950 - RNA, 19 nt, Mycobacterium avium subsp. paratuberculosis
cgccgucaucggcggaagc

SEQ ID NO: 950951 - RNA, 16 nt, Mycobacterium avium subsp. paratuberculosis
cgccguauucgccgac

SEQ ID NO: 950952 - RNA, 17 nt, Mycobacterium avium subsp. paratuberculosis
cgccguauucgccgacg

SEQ ID NO: 950953 - RNA, 23 nt, Mycobacterium avium subsp. paratuberculosis
cgccguauucgccgacggucugc

SEQ ID NO: 950954 - RNA, 17 nt, Mycobacterium avium subsp. paratuberculosis
cgccguauuggcaggcg

SEQ ID NO: 950955 - RNA, 18 nt, Mycobacterium avium subsp. paratuberculosis
cgccguauuggcaggcga

SEQ ID NO: 950956 - RNA, 20 nt, Mycobacterium avium subsp. paratuberculosis
cgccgucauccccaucucga

SEQ ID NO: 950957 - RNA, 23 nt, Mycobacterium avium subsp. paratuberculosis
cgccgucgaggaauccgguccac

SEQ ID NO: 950958 - RNA, 14 nt, Mycobacterium avium subsp. paratuberculosis
cgccgucgaggggg

SEQ ID NO: 950959 - RNA, 15 nt, Mycobacterium avium subsp. paratuberculosis
cgccgucgaguccgu

SEQ ID NO: 950960 - RNA, 14 nt, Mycobacterium avium subsp. paratuberculosis
cgccgucgaugacg

SEQ ID NO: 950961 - RNA, 21 nt, Mycobacterium avium subsp. paratuberculosis
cgccgucgaugcggaucucgg

SEQ ID NO: 950962 - RNA, 14 nt, Mycobacterium avium subsp. paratuberculosis
cgccgucgauggcg

SEQ ID NO: 950963 - RNA, 21 nt, Mycobacterium avium subsp. paratuberculosis
cgccgucgauggcgcggccca

SEQ ID NO: 950964 - RNA, 16 nt, Mycobacterium avium subsp. paratuberculosis
cgccgucccaccggcg

SEQ ID NO: 950965 - RNA, 17 nt, Mycobacterium avium subsp. paratuberculosis
cgccgucccaccggcga

SEQ ID NO: 950966 - RNA, 19 nt, Mycobacterium avium subsp. paratuberculosis
cgccgucccaccggcgaug

SEQ ID NO: 950967 - RNA, 15 nt, Mycobacterium avium subsp. paratuberculosis
cgccguccagcguca

SEQ ID NO: 950968 - RNA, 14 nt, Mycobacterium avium subsp. paratuberculosis
cgccguccagcucg

SEQ ID NO: 950969 - RNA, 22 nt, Mycobacterium avium subsp. paratuberculosis
cgccguccacgggucgccgugg

SEQ ID NO: 950970 - RNA, 23 nt, Mycobacterium avium subsp. paratuberculosis
cgccguccacgggucgccguggc

SEQ ID NO: 950971 - RNA, 15 nt, Mycobacterium avium subsp. paratuberculosis
cgccguacccgaagc

SEQ ID NO: 950972 - RNA, 23 nt, Mycobacterium avium subsp. paratuberculosis
cgccguacaccgugcccgagccg

SEQ ID NO: 950973 - RNA, 13 nt, Mycobacterium avium subsp. paratuberculosis
cgccguacagcug

SEQ ID NO: 950974 - RNA, 21 nt, Mycobacterium avium subsp. paratuberculosis
cgccguacagcugguccggcc

SEQ ID NO: 950975 - RNA, 22 nt, Mycobacterium avium subsp. paratuberculosis
cgccguacagcugguccggccg

SEQ ID NO: 950976 - RNA, 23 nt, Mycobacterium avium subsp. paratuberculosis
cgccguacagcugguccggccgg

SEQ ID NO: 950977 - RNA, 14 nt, Mycobacterium avium subsp. paratuberculosis
cgccguagccggcg

SEQ ID NO: 950978 - RNA, 18 nt, Mycobacterium avium subsp. paratuberculosis
cgccguagccggcggugg

SEQ ID NO: 950979 - RNA, 15 nt, Mycobacterium avium subsp. paratuberculosis
cgccguaggccgcgc

SEQ ID NO: 950980 - RNA, 17 nt, Mycobacterium avium subsp. paratuberculosis
cgccguaggccgcgcug

SEQ ID NO: 950981 - RNA, 18 nt, Mycobacterium avium subsp. paratuberculosis
cgccguaggccgcgcuga

SEQ ID NO: 950982 - RNA, 15 nt, Mycobacterium avium subsp. paratuberculosis
cgccguagcggccca

SEQ ID NO: 950983 - RNA, 23 nt, Mycobacterium avium subsp. paratuberculosis
cgccguacaucauggcgaacgcc

SEQ ID NO: 950984 - RNA, 16 nt, Mycobacterium avium subsp. paratuberculosis
cgccguacgcgccggc

SEQ ID NO: 950985 - RNA, 17 nt, Mycobacterium avium subsp. paratuberculosis
cgccguacgcgccggcc

SEQ ID NO: 950986 - RNA, 20 nt, Mycobacterium avium subsp. paratuberculosis
cgccguacgcgccggccagc

SEQ ID NO: 950987 - RNA, 20 nt, Mycobacterium avium subsp. paratuberculosis
cgccguagaauccgccguug

SEQ ID NO: 950988 - RNA, 17 nt, Mycobacterium avium subsp. paratuberculosis
cgccguagaucacgccg

SEQ ID NO: 950989 - RNA, 19 nt, Mycobacterium avium subsp. paratuberculosis
cgccguagaucacgccggu

SEQ ID NO: 950990 - RNA, 21 nt, Mycobacterium avium subsp. paratuberculosis
cgccguagaucacgccgguga

SEQ ID NO: 950991 - RNA, 22 nt, Mycobacterium avium subsp. paratuberculosis
cgccguagaucacgccggugag

SEQ ID NO: 950992 - RNA, 14 nt, Mycobacterium avium subsp. paratuberculosis
cgccggugagcacg

SEQ ID NO: 950993 - RNA, 20 nt, Mycobacterium avium subsp. paratuberculosis
cgccggugagcacgaccgcc

SEQ ID NO: 950994 - RNA, 16 nt, Mycobacterium avium subsp. paratuberculosis
cgccggugagcacggu

SEQ ID NO: 950995 - RNA, 13 nt, Mycobacterium avium subsp. paratuberculosis
cgccggugcccac

SEQ ID NO: 950996 - RNA, 17 nt, Mycobacterium avium subsp. paratuberculosis
cgccggugcccacgccg

SEQ ID NO: 950997 - RNA, 17 nt, Mycobacterium avium subsp. paratuberculosis
cgccggugccgacgaug

SEQ ID NO: 950998 - RNA, 21 nt, Mycobacterium avium subsp. paratuberculosis
cgccggugccgcagccguccc

SEQ ID NO: 950999 - RNA, 22 nt, Mycobacterium avium subsp. paratuberculosis
cgccgguuuccaggacgaugcg

SEQ ID NO: 951000 - RNA, 23 nt, Mycobacterium avium subsp. paratuberculosis
cgccgguuuccaggacgaugcgc

SEQ ID NO: 951001 - RNA, 19 nt, Mycobacterium avium subsp. paratuberculosis
cgccgguuucgucggucug

SEQ ID NO: 951002 - RNA, 15 nt, Mycobacterium avium subsp. paratuberculosis
cgccggugagguggc

SEQ ID NO: 951003 - RNA, 23 nt, Mycobacterium avium subsp. paratuberculosis
cgccggucgcccccucggccggu

SEQ ID NO: 951004 - RNA, 13 nt, Mycobacterium avium subsp. paratuberculosis
cgccggucgacgc

SEQ ID NO: 951005 - RNA, 20 nt, Mycobacterium avium subsp. paratuberculosis
cgccggucgacgcggggcgg

SEQ ID NO: 951006 - RNA, 14 nt, Mycobacterium avium subsp. paratuberculosis
cgccgguccggccc

SEQ ID NO: 951007 - RNA, 18 nt, Mycobacterium avium subsp. paratuberculosis
cgccgguccggcccuggu

SEQ ID NO: 951008 - RNA, 20 nt, Mycobacterium avium subsp. paratuberculosis
cgccgguccggcccuggucg

SEQ ID NO: 951009 - RNA, 14 nt, Mycobacterium avium subsp. paratuberculosis
cgccggucccgcgg

SEQ ID NO: 951010 - RNA, 15 nt, Mycobacterium avium subsp. paratuberculosis
cgccggucccgcggc

SEQ ID NO: 951011 - RNA, 16 nt, Mycobacterium avium subsp. paratuberculosis
cgccggucccgcggcg

SEQ ID NO: 951012 - RNA, 23 nt, Mycobacterium avium subsp. paratuberculosis
cgccggucagaccccguaccagc

SEQ ID NO: 951013 - RNA, 14 nt, Mycobacterium avium subsp. paratuberculosis
cgccggucagcacc

SEQ ID NO: 951014 - RNA, 15 nt, Mycobacterium avium subsp. paratuberculosis
cgccggucagcacca

SEQ ID NO: 951015 - RNA, 21 nt, Mycobacterium avium subsp. paratuberculosis
cgccggucagcaccauggcgu

SEQ ID NO: 951016 - RNA, 19 nt, Mycobacterium avium subsp. paratuberculosis
cgccggucagcacgucggu

SEQ ID NO: 951017 - RNA, 13 nt, Mycobacterium avium subsp. paratuberculosis
cgccggucacggc

SEQ ID NO: 951018 - RNA, 15 nt, Mycobacterium avium subsp. paratuberculosis
cgccggucacggcgu

SEQ ID NO: 951019 - RNA, 16 nt, Mycobacterium avium subsp. paratuberculosis
cgccggucacggcguc

SEQ ID NO: 951020 - RNA, 17 nt, Mycobacterium avium subsp. paratuberculosis
cgccggucacggcgucg

SEQ ID NO: 951021 - RNA, 19 nt, Mycobacterium avium subsp. paratuberculosis
cgccggucacggcgucggc

SEQ ID NO: 951022 - RNA, 20 nt, Mycobacterium avium subsp. paratuberculosis
cgccggucacggcgucggcg

SEQ ID NO: 951023 - RNA, 23 nt, Mycobacterium avium subsp. paratuberculosis
cgccgguaggcggccagcgcccg

SEQ ID NO: 951024 - RNA, 20 nt, Mycobacterium avium subsp. paratuberculosis
cgccggguugcaggcgccca

SEQ ID NO: 951025 - RNA, 19 nt, Mycobacterium avium subsp. paratuberculosis
cgccgguagcgacacggaa

SEQ ID NO: 951026 - RNA, 18 nt, Mycobacterium avium subsp. paratuberculosis
cgccgguaggcggccagc

SEQ ID NO: 951027 - RNA, 20 nt, Mycobacterium avium subsp. paratuberculosis
aacaccgugguggacaacuc

SEQ ID NO: 951028 - RNA, 16 nt, Mycobacterium avium subsp. paratuberculosis
aacaccggcagcgcca

SEQ ID NO: 951029 - RNA, 22 nt, Mycobacterium avium subsp. paratuberculosis
aacaccgccuugcccggcucgg

SEQ ID NO: 951030 - RNA, 16 nt, Mycobacterium avium subsp. paratuberculosis
cgccggcgcuggcgcg

SEQ ID NO: 951031 - RNA, 16 nt, Mycobacterium avium subsp. paratuberculosis
cgccggcgcggccagc

SEQ ID NO: 951032 - RNA, 20 nt, Mycobacterium avium subsp. paratuberculosis
cgccggcgcuuugccguccc

SEQ ID NO: 951033 - RNA, 13 nt, Mycobacterium avium subsp. paratuberculosis
cgccggcgcgucc

SEQ ID NO: 951034 - RNA, 14 nt, Mycobacterium avium subsp. paratuberculosis
cgccggcgcguccg

SEQ ID NO: 951035 - RNA, 16 nt, Mycobacterium avium subsp. paratuberculosis
cgccggcgcgcugaag

SEQ ID NO: 951036 - RNA, 13 nt, Mycobacterium avium subsp. paratuberculosis
cgccggcgcggaa

SEQ ID NO: 951037 - RNA, 15 nt, Mycobacterium avium subsp. paratuberculosis
cgccggcgcggaaca

SEQ ID NO: 951038 - RNA, 15 nt, Mycobacterium avium subsp. paratuberculosis
cgccggcgcggacgg

SEQ ID NO: 951039 - RNA, 19 nt, Mycobacterium avium subsp. paratuberculosis
cgccggcgcggacggaucg

SEQ ID NO: 951040 - RNA, 14 nt, Mycobacterium avium subsp. paratuberculosis
cgccggcgcgggca

SEQ ID NO: 951041 - RNA, 23 nt, Mycobacterium avium subsp. paratuberculosis
cgccggcgcgggcaugaaccagg

SEQ ID NO: 951042 - RNA, 19 nt, Mycobacterium avium subsp. paratuberculosis
cgccggcgcgggccgcagc

SEQ ID NO: 951043 - RNA, 20 nt, Mycobacterium avium subsp. paratuberculosis
cgccggcgcgggccgcagcg

SEQ ID NO: 951044 - RNA, 23 nt, Mycobacterium avium subsp. paratuberculosis
cgccggcgcgggccgcagcgcgc

SEQ ID NO: 951045 - RNA, 12 nt, Mycobacterium avium subsp. paratuberculosis
cgccggcgcggu

SEQ ID NO: 951046 - RNA, 15 nt, Mycobacterium avium subsp. paratuberculosis
cgccggcgcgcgagc

SEQ ID NO: 951047 - RNA, 16 nt, Mycobacterium avium subsp. paratuberculosis
cgccggcgcgcgagcg

SEQ ID NO: 951048 - RNA, 18 nt, Mycobacterium avium subsp. paratuberculosis
cgccggcgcgcgagcguc

SEQ ID NO: 951049 - RNA, 19 nt, Mycobacterium avium subsp. paratuberculosis
cgccggcgcgcgagcguca

SEQ ID NO: 951050 - RNA, 13 nt, Mycobacterium avium subsp. paratuberculosis
cgccggcgcgcag

SEQ ID NO: 951051 - RNA, 16 nt, Mycobacterium avium subsp. paratuberculosis
cgccggcgcgcagcca

SEQ ID NO: 951052 - RNA, 15 nt, Mycobacterium avium subsp. paratuberculosis
cgccggcgccgggcg

SEQ ID NO: 951053 - RNA, 16 nt, Mycobacterium avium subsp. paratuberculosis
cgccggcgccgggcgg

SEQ ID NO: 951054 - RNA, 13 nt, Mycobacterium avium subsp. paratuberculosis
cgccggcgccguc

SEQ ID NO: 951055 - RNA, 17 nt, Mycobacterium avium subsp. paratuberculosis
cgccggcgcgcaacagc

SEQ ID NO: 951056 - RNA, 15 nt, Mycobacterium avium subsp. paratuberculosis
cgccggcgcgcaccc

SEQ ID NO: 951057 - RNA, 18 nt, Mycobacterium avium subsp. paratuberculosis
cgccggcgcgcaccccgg

SEQ ID NO: 951058 - RNA, 14 nt, Mycobacterium avium subsp. paratuberculosis
cgccggcgaucucg

SEQ ID NO: 951059 - RNA, 22 nt, Mycobacterium avium subsp. paratuberculosis
cgccggcgaucucgucgcgcag

SEQ ID NO: 951060 - RNA, 23 nt, Mycobacterium avium subsp. paratuberculosis
cgccggcgaucucgucgcgcagc

SEQ ID NO: 951061 - RNA, 12 nt, Mycobacterium avium subsp. paratuberculosis
cgccggcgauga

SEQ ID NO: 951062 - RNA, 13 nt, Mycobacterium avium subsp. paratuberculosis
cgccggcgaggcg

SEQ ID NO: 951063 - RNA, 17 nt, Mycobacterium avium subsp. paratuberculosis
cgccggcgaggcggucg

SEQ ID NO: 951064 - RNA, 14 nt, Mycobacterium avium subsp. paratuberculosis
cgccggcgaucgac

SEQ ID NO: 951065 - RNA, 15 nt, Mycobacterium avium subsp. paratuberculosis
cgccggcgaucgacg

SEQ ID NO: 951066 - RNA, 14 nt, Mycobacterium avium subsp. paratuberculosis
cgccggcgacggcc

SEQ ID NO: 951067 - RNA, 16 nt, Mycobacterium avium subsp. paratuberculosis
cgccggcgacggccag

SEQ ID NO: 951068 - RNA, 17 nt, Mycobacterium avium subsp. paratuberculosis
cgccggcgacggccagc

SEQ ID NO: 951069 - RNA, 18 nt, Mycobacterium avium subsp. paratuberculosis
cgccggcgacggccagcg

SEQ ID NO: 951070 - RNA, 20 nt, Mycobacterium avium subsp. paratuberculosis
cgccggcgaccgccuugucg

SEQ ID NO: 951071 - RNA, 17 nt, Mycobacterium avium subsp. paratuberculosis
cgccggcgaagcucgac

SEQ ID NO: 951072 - RNA, 20 nt, Mycobacterium avium subsp. paratuberculosis
cgccggccuuggcccgcgcc

SEQ ID NO: 951073 - RNA, 17 nt, Mycobacterium avium subsp. paratuberculosis
cgccggcgaacgacguc

SEQ ID NO: 951074 - RNA, 19 nt, Mycobacterium avium subsp. paratuberculosis
cgccggcgaacgacgucga

SEQ ID NO: 951075 - RNA, 20 nt, Mycobacterium avium subsp. paratuberculosis
cgccggcgaacgacgucgag

SEQ ID NO: 951076 - RNA, 13 nt, Mycobacterium avium subsp. paratuberculosis
cgccggccucucg

SEQ ID NO: 951077 - RNA, 16 nt, Mycobacterium avium subsp. paratuberculosis
cgccggccugcccgcc

SEQ ID NO: 951078 - RNA, 17 nt, Mycobacterium avium subsp. paratuberculosis
cgccggccugcccgccg

SEQ ID NO: 951079 - RNA, 23 nt, Mycobacterium avium subsp. paratuberculosis
cgccggccugcccgccgcggccg

SEQ ID NO: 951080 - RNA, 20 nt, Mycobacterium avium subsp. paratuberculosis
cgccggccguucgccggcca

SEQ ID NO: 951081 - RNA, 21 nt, Mycobacterium avium subsp. paratuberculosis
cgccggccguucgccggccag

SEQ ID NO: 951082 - RNA, 22 nt, Mycobacterium avium subsp. paratuberculosis
cgccggccguucgccggccagc

SEQ ID NO: 951083 - RNA, 12 nt, Mycobacterium avium subsp. paratuberculosis
cgccggccucca

SEQ ID NO: 951084 - RNA, 17 nt, Mycobacterium avium subsp. paratuberculosis
cgccggccuccagcugu

SEQ ID NO: 951085 - RNA, 20 nt, Mycobacterium avium subsp. paratuberculosis
cgccggccgucacgcuggcg

SEQ ID NO: 951086 - RNA, 22 nt, Mycobacterium avium subsp. paratuberculosis
cgccggccgguccucugcgacc

SEQ ID NO: 951087 - RNA, 13 nt, Mycobacterium avium subsp. paratuberculosis
cgccggccgggcg

SEQ ID NO: 951088 - RNA, 13 nt, Mycobacterium avium subsp. paratuberculosis
cgccggccgggcu

SEQ ID NO: 951089 - RNA, 20 nt, Mycobacterium avium subsp. paratuberculosis
cgccggcccgauaggccgac

SEQ ID NO: 951090 - RNA, 15 nt, Mycobacterium avium subsp. paratuberculosis
cgccggcccgcggcg

SEQ ID NO: 951091 - RNA, 16 nt, Mycobacterium avium subsp. paratuberculosis
cgccggcccgcggcgg

SEQ ID NO: 951092 - RNA, 12 nt, Mycobacterium avium subsp. paratuberculosis
cgccggcccggc

SEQ ID NO: 951093 - RNA, 13 nt, Mycobacterium avium subsp. paratuberculosis
cgccggccccggc

SEQ ID NO: 951094 - RNA, 16 nt, Mycobacterium avium subsp. paratuberculosis
cgccggccccggcgac

SEQ ID NO: 951095 - RNA, 17 nt, Mycobacterium avium subsp. paratuberculosis
cgccggccccggcgacg

SEQ ID NO: 951096 - RNA, 15 nt, Mycobacterium avium subsp. paratuberculosis
cgccggcccagcucc

SEQ ID NO: 951097 - RNA, 19 nt, Mycobacterium avium subsp. paratuberculosis
cgccggcccagcuccacgc

SEQ ID NO: 951098 - RNA, 20 nt, Mycobacterium avium subsp. paratuberculosis
cgccggcccagcuccacgcg

SEQ ID NO: 951099 - RNA, 21 nt, Mycobacterium avium subsp. paratuberculosis
cgccggcccagcuccacgcgu

SEQ ID NO: 951100 - RNA, 15 nt, Mycobacterium avium subsp. paratuberculosis
cgccggcccagacgg

SEQ ID NO: 951101 - RNA, 22 nt, Mycobacterium avium subsp. paratuberculosis
cgccggcagauugguucggccg

SEQ ID NO: 951102 - RNA, 14 nt, Mycobacterium avium subsp. paratuberculosis
cgccggcagcaacc

SEQ ID NO: 951103 - RNA, 13 nt, Mycobacterium avium subsp. paratuberculosis
cgccggcaguccg

SEQ ID NO: 951104 - RNA, 20 nt, Mycobacterium avium subsp. paratuberculosis
cgccggcaguccggacacgg

SEQ ID NO: 951105 - RNA, 21 nt, Mycobacterium avium subsp. paratuberculosis
cgccggcaguccggacacggc

SEQ ID NO: 951106 - RNA, 16 nt, Mycobacterium avium subsp. paratuberculosis
cgccggcacucgucgu

SEQ ID NO: 951107 - RNA, 22 nt, Mycobacterium avium subsp. paratuberculosis
cgccggcacucgucguggcggu

SEQ ID NO: 951108 - RNA, 16 nt, Mycobacterium avium subsp. paratuberculosis
cgccggcacugcugcc

SEQ ID NO: 951109 - RNA, 19 nt, Mycobacterium avium subsp. paratuberculosis
cgccggcacugcugcccgc

SEQ ID NO: 951110 - RNA, 14 nt, Mycobacterium avium subsp. paratuberculosis
cgccggcagcggcc

SEQ ID NO: 951111 - RNA, 17 nt, Mycobacterium avium subsp. paratuberculosis
cgccggcagcggccgca

SEQ ID NO: 951112 - RNA, 20 nt, Mycobacterium avium subsp. paratuberculosis
cgccggcagcggccgcaauc

SEQ ID NO: 951113 - RNA, 16 nt, Mycobacterium avium subsp. paratuberculosis
cgccggcagcggcugc

SEQ ID NO: 951114 - RNA, 13 nt, Mycobacterium avium subsp. paratuberculosis
cgccggaugcugc

SEQ ID NO: 951115 - RNA, 13 nt, Mycobacterium avium subsp. paratuberculosis
cgccggaugggcg

SEQ ID NO: 951116 - RNA, 22 nt, Mycobacterium avium subsp. paratuberculosis
cgccggaugggcgcacgaucgg

SEQ ID NO: 951117 - RNA, 16 nt, Mycobacterium avium subsp. paratuberculosis
cgccggaugccagcag

SEQ ID NO: 951118 - RNA, 17 nt, Mycobacterium avium subsp. paratuberculosis
cgccggaugccagcagg

SEQ ID NO: 951119 - RNA, 15 nt, Mycobacterium avium subsp. paratuberculosis
cgccggcaccguccg

SEQ ID NO: 951120 - RNA, 21 nt, Mycobacterium avium subsp. paratuberculosis
cgccggaaggucuuucgucgc

SEQ ID NO: 951121 - RNA, 15 nt, Mycobacterium avium subsp. paratuberculosis
cgccggacaccaccg

SEQ ID NO: 951122 - RNA, 17 nt, Mycobacterium avium subsp. paratuberculosis
cgccggacaccaccgcg

SEQ ID NO: 951123 - RNA, 20 nt, Mycobacterium avium subsp. paratuberculosis
cgccggacaccaccgcggug

SEQ ID NO: 951124 - RNA, 21 nt, Mycobacterium avium subsp. paratuberculosis
cgccggacaccaccgcggugg

SEQ ID NO: 951125 - RNA, 14 nt, Mycobacterium avium subsp. paratuberculosis
cgccggacagccgg

SEQ ID NO: 951126 - RNA, 19 nt, Mycobacterium avium subsp. paratuberculosis
cgccggacagccggggcag

SEQ ID NO: 951127 - RNA, 23 nt, Mycobacterium avium subsp. paratuberculosis
cgccggacagccggggcagcugc

SEQ ID NO: 951128 - RNA, 12 nt, Mycobacterium avium subsp. paratuberculosis
cgccggacagcg

SEQ ID NO: 951129 - RNA, 22 nt, Mycobacterium avium subsp. paratuberculosis
cgccggaggggcgacgggccga

SEQ ID NO: 951130 - RNA, 17 nt, Mycobacterium avium subsp. paratuberculosis
cgccggacagcgggccg

SEQ ID NO: 951131 - RNA, 21 nt, Mycobacterium avium subsp. paratuberculosis
cgccggacagcgggccgaccc

SEQ ID NO: 951132 - RNA, 14 nt, Mycobacterium avium subsp. paratuberculosis
cgccggacagcugg

SEQ ID NO: 951133 - RNA, 16 nt, Mycobacterium avium subsp. paratuberculosis
cgccggacagcuggcg

SEQ ID NO: 951134 - RNA, 20 nt, Mycobacterium avium subsp. paratuberculosis
cgccggacagcuggcggucg

SEQ ID NO: 951135 - RNA, 16 nt, Mycobacterium avium subsp. paratuberculosis
cgccggaucgccgagg

SEQ ID NO: 951136 - RNA, 13 nt, Mycobacterium avium subsp. paratuberculosis
cgccggaucggca

SEQ ID NO: 951137 - RNA, 16 nt, Mycobacterium avium subsp. paratuberculosis
cgccggaucggcagcg

SEQ ID NO: 951138 - RNA, 20 nt, Mycobacterium avium subsp. paratuberculosis
cgccggaucggcagcgcguu

SEQ ID NO: 951139 - RNA, 20 nt, Mycobacterium avium subsp. paratuberculosis
cgccggaguugccgauggcg

SEQ ID NO: 951140 - RNA, 15 nt, Mycobacterium avium subsp. paratuberculosis
cgccggaucaugucg

SEQ ID NO: 951141 - RNA, 14 nt, Mycobacterium avium subsp. paratuberculosis
cgccggaucgagca

SEQ ID NO: 951142 - RNA, 16 nt, Mycobacterium avium subsp. paratuberculosis
cgccggaucgagcacc

SEQ ID NO: 951143 - RNA, 14 nt, Mycobacterium avium subsp. paratuberculosis
cgccgcuggauccc

SEQ ID NO: 951144 - RNA, 12 nt, Mycobacterium avium subsp. paratuberculosis
cgccggaacggg

SEQ ID NO: 951145 - RNA, 22 nt, Mycobacterium avium subsp. paratuberculosis
cgccggaacgggaagaucgucg

SEQ ID NO: 951146 - RNA, 15 nt, Mycobacterium avium subsp. paratuberculosis
cgccggaacucggcc

SEQ ID NO: 951147 - RNA, 22 nt, Mycobacterium avium subsp. paratuberculosis
cgccgcugcgcgcgcgaucggu

SEQ ID NO: 951148 - RNA, 24 nt, Mycobacterium avium subsp. paratuberculosis
cgccgcugcgcgcgcgaucggugu

SEQ ID NO: 951149 - RNA, 17 nt, Mycobacterium avium subsp. paratuberculosis
cgccgcugcgggccauc

SEQ ID NO: 951150 - RNA, 19 nt, Mycobacterium avium subsp. paratuberculosis
cgccgcugcgggccaucga

SEQ ID NO: 951151 - RNA, 23 nt, Mycobacterium avium subsp. paratuberculosis
cgccgcugcgggccaucgacucc

SEQ ID NO: 951152 - RNA, 13 nt, Mycobacterium avium subsp. paratuberculosis
cgccgcugccggg

SEQ ID NO: 951153 - RNA, 17 nt, Mycobacterium avium subsp. paratuberculosis
cgccgcugccggggugc

SEQ ID NO: 951154 - RNA, 19 nt, Mycobacterium avium subsp. paratuberculosis
cgccgcugccggggugcag

SEQ ID NO: 951155 - RNA, 21 nt, Mycobacterium avium subsp. paratuberculosis
cgccgcugccggggugcagca

SEQ ID NO: 951156 - RNA, 19 nt, Mycobacterium avium subsp. paratuberculosis
cgccgcugacgcggcgggc

SEQ ID NO: 951157 - RNA, 16 nt, Mycobacterium avium subsp. paratuberculosis
cgccgcugcagcugcu

SEQ ID NO: 951158 - RNA, 12 nt, Mycobacterium avium subsp. paratuberculosis
cgccgcucgucg

SEQ ID NO: 951159 - RNA, 13 nt, Mycobacterium avium subsp. paratuberculosis
cgccgcucgucgg

SEQ ID NO: 951160 - RNA, 16 nt, Mycobacterium avium subsp. paratuberculosis
cgccgcucgucggcca

SEQ ID NO: 951161 - RNA, 18 nt, Mycobacterium avium subsp. paratuberculosis
cgccgcucgucggccagc

SEQ ID NO: 951162 - RNA, 20 nt, Mycobacterium avium subsp. paratuberculosis
cgccgcucgucggccagcga

SEQ ID NO: 951163 - RNA, 15 nt, Mycobacterium avium subsp. paratuberculosis
cgccgcucgucgggc

SEQ ID NO: 951164 - RNA, 23 nt, Mycobacterium avium subsp. paratuberculosis
cgccgcucgucgggcacaucccg

SEQ ID NO: 951165 - RNA, 15 nt, Mycobacterium avium subsp. paratuberculosis
cgccgcugacugcga

SEQ ID NO: 951166 - RNA, 19 nt, Mycobacterium avium subsp. paratuberculosis
cgccgcugacugcgaucgc

SEQ ID NO: 951167 - RNA, 20 nt, Mycobacterium avium subsp. paratuberculosis
cgccgcugacugcgaucgcc

SEQ ID NO: 951168 - RNA, 21 nt, Mycobacterium avium subsp. paratuberculosis
cgccgcugacugcgaucgccg

SEQ ID NO: 951169 - RNA, 23 nt, Mycobacterium avium subsp. paratuberculosis
cgccgcugacugcgaucgccgac

SEQ ID NO: 951170 - RNA, 14 nt, Mycobacterium avium subsp. paratuberculosis
cgccgcucgacccc

SEQ ID NO: 951171 - RNA, 23 nt, Mycobacterium avium subsp. paratuberculosis
cgccgcucggaguucgcccgcag

SEQ ID NO: 951172 - RNA, 11 nt, Mycobacterium avium subsp. paratuberculosis
cgccgcucggc

SEQ ID NO: 951173 - RNA, 12 nt, Mycobacterium avium subsp. paratuberculosis
cgccgcucggcc

SEQ ID NO: 951174 - RNA, 16 nt, Mycobacterium avium subsp. paratuberculosis
cgccgcucggccagca

SEQ ID NO: 951175 - RNA, 17 nt, Mycobacterium avium subsp. paratuberculosis
cgccgcucggccagcag

SEQ ID NO: 951176 - RNA, 16 nt, Mycobacterium avium subsp. paratuberculosis
cgccgcucggccagcg

SEQ ID NO: 951177 - RNA, 13 nt, Mycobacterium avium subsp. paratuberculosis
cgccgcucggccg

SEQ ID NO: 951178 - RNA, 13 nt, Mycobacterium avium subsp. paratuberculosis
cgccgcucaccgc

SEQ ID NO: 951179 - RNA, 14 nt, Mycobacterium avium subsp. paratuberculosis
cgccgcucaccgcc

SEQ ID NO: 951180 - RNA, 15 nt, Mycobacterium avium subsp. paratuberculosis
cgccgcucaccgccg

SEQ ID NO: 951181 - RNA, 16 nt, Mycobacterium avium subsp. paratuberculosis
cgccgcucaccgccga

SEQ ID NO: 951182 - RNA, 18 nt, Mycobacterium avium subsp. paratuberculosis
cgccgcucaccgccgagc

SEQ ID NO: 951183 - RNA, 19 nt, Mycobacterium avium subsp. paratuberculosis
cgccgcucaccgccgagcc

SEQ ID NO: 951184 - RNA, 20 nt, Mycobacterium avium subsp. paratuberculosis
cgccgcucaccgccgagccg

SEQ ID NO: 951185 - RNA, 18 nt, Mycobacterium avium subsp. paratuberculosis
cgccgcucagcgauugcg

SEQ ID NO: 951186 - RNA, 22 nt, Mycobacterium avium subsp. paratuberculosis
cgccgcuagguuuggccagcac

SEQ ID NO: 951187 - RNA, 16 nt, Mycobacterium avium subsp. paratuberculosis
cgccgcuagucgccca

SEQ ID NO: 951188 - RNA, 19 nt, Mycobacterium avium subsp. paratuberculosis
cgccgcuagucgcccagca

SEQ ID NO: 951189 - RNA, 12 nt, Mycobacterium avium subsp. paratuberculosis
cgccgcggccac

SEQ ID NO: 951190 - RNA, 13 nt, Mycobacterium avium subsp. paratuberculosis
cgccgcggccacc

SEQ ID NO: 951191 - RNA, 18 nt, Mycobacterium avium subsp. paratuberculosis
cgccgcggagcggcgguc

SEQ ID NO: 951192 - RNA, 12 nt, Mycobacterium avium subsp. paratuberculosis
cgccgcggaucg

SEQ ID NO: 951193 - RNA, 14 nt, Mycobacterium avium subsp. paratuberculosis
cgccgcggaucggu

SEQ ID NO: 951194 - RNA, 15 nt, Mycobacterium avium subsp. paratuberculosis
cgccgcggcaccuuc

SEQ ID NO: 951195 - RNA, 22 nt, Mycobacterium avium subsp. paratuberculosis
cgccgcggcaccuucaccgacc

SEQ ID NO: 951196 - RNA, 18 nt, Mycobacterium avium subsp. paratuberculosis
cgccgcggaucuucuccg

SEQ ID NO: 951197 - RNA, 21 nt, Mycobacterium avium subsp. paratuberculosis
cgccgcggaucuucuccgcca

SEQ ID NO: 951198 - RNA, 20 nt, Mycobacterium avium subsp. paratuberculosis
cgccgcggauguggaggcga

SEQ ID NO: 951199 - RNA, 23 nt, Mycobacterium avium subsp. paratuberculosis
cgccgcggacauucugcacgacg

SEQ ID NO: 951200 - RNA, 20 nt, Mycobacterium avium subsp. paratuberculosis
cgccgcggaccccagcguga

SEQ ID NO: 951201 - RNA, 14 nt, Mycobacterium avium subsp. paratuberculosis
cgccgcgcuugacg

SEQ ID NO: 951202 - RNA, 17 nt, Mycobacterium avium subsp. paratuberculosis
cgccgcgcuugcgaccg

SEQ ID NO: 951203 - RNA, 18 nt, Mycobacterium avium subsp. paratuberculosis
cgccgcgcuugcgaccgc

SEQ ID NO: 951204 - RNA, 19 nt, Mycobacterium avium subsp. paratuberculosis
cgccgcgcuugcgaucgcc

SEQ ID NO: 951205 - RNA, 24 nt, Mycobacterium avium subsp. paratuberculosis
cgccgcgcuugcgaucgccgcgca

SEQ ID NO: 951206 - RNA, 14 nt, Mycobacterium avium subsp. paratuberculosis
cgccgcgcuggccg

SEQ ID NO: 951207 - RNA, 15 nt, Mycobacterium avium subsp. paratuberculosis
cgccgcgcuggccga

SEQ ID NO: 951208 - RNA, 20 nt, Mycobacterium avium subsp. paratuberculosis
cgccgcgcuggccgaucccg

SEQ ID NO: 951209 - RNA, 16 nt, Mycobacterium avium subsp. paratuberculosis
cgccgcggaagcccca

SEQ ID NO: 951210 - RNA, 15 nt, Mycobacterium avium subsp. paratuberculosis
cgccgcauuggugcc

SEQ ID NO: 951211 - RNA, 22 nt, Mycobacterium avium subsp. paratuberculosis
cgccgcauuggugccggccucg

SEQ ID NO: 951212 - RNA, 19 nt, Mycobacterium avium subsp. paratuberculosis
cgccgcauuggcaccgucg

SEQ ID NO: 951213 - RNA, 23 nt, Mycobacterium avium subsp. paratuberculosis
cgccgcauuggcaccgucgaccu

SEQ ID NO: 951214 - RNA, 21 nt, Mycobacterium avium subsp. paratuberculosis
cgccgccaacgcgaacgggua

SEQ ID NO: 951215 - RNA, 17 nt, Mycobacterium avium subsp. paratuberculosis
cgccgccaaccaggucg

SEQ ID NO: 951216 - RNA, 21 nt, Mycobacterium avium subsp. paratuberculosis
cgccgccaaccaggucgcggc

SEQ ID NO: 951217 - RNA, 16 nt, Mycobacterium avium subsp. paratuberculosis
cgccgccacaccucgg

SEQ ID NO: 951218 - RNA, 14 nt, Mycobacterium avium subsp. paratuberculosis
cgccgccacgcggc

SEQ ID NO: 951219 - RNA, 21 nt, Mycobacterium avium subsp. paratuberculosis
cgccgccacgcggcgcgcauc

SEQ ID NO: 951220 - RNA, 12 nt, Mycobacterium avium subsp. paratuberculosis
cgccgccacggc

SEQ ID NO: 951221 - RNA, 12 nt, Mycobacterium avium subsp. paratuberculosis
cgccgccaccgg

SEQ ID NO: 951222 - RNA, 18 nt, Mycobacterium avium subsp. paratuberculosis
cgccgccaccggccgguc

SEQ ID NO: 951223 - RNA, 22 nt, Mycobacterium avium subsp. paratuberculosis
cgccgccaccgucgccggcuga

SEQ ID NO: 951224 - RNA, 24 nt, Mycobacterium avium subsp. paratuberculosis
cgccgccagcaaccccgcggugca

SEQ ID NO: 951225 - RNA, 13 nt, Mycobacterium avium subsp. paratuberculosis
cgccgccagcacc

SEQ ID NO: 951226 - RNA, 14 nt, Mycobacterium avium subsp. paratuberculosis
cgccgccagcacca

SEQ ID NO: 951227 - RNA, 19 nt, Mycobacterium avium subsp. paratuberculosis
cgccgccagcacgugaugc

SEQ ID NO: 951228 - RNA, 23 nt, Mycobacterium avium subsp. paratuberculosis
cgccgccagcacgugaugcagcu

SEQ ID NO: 951229 - RNA, 15 nt, Mycobacterium avium subsp. paratuberculosis
cgccgccagcaccac

SEQ ID NO: 951230 - RNA, 16 nt, Mycobacterium avium subsp. paratuberculosis
cgccgccagcaccacc

SEQ ID NO: 951231 - RNA, 14 nt, Mycobacterium avium subsp. paratuberculosis
cgccgccagcagca

SEQ ID NO: 951232 - RNA, 19 nt, Mycobacterium avium subsp. paratuberculosis
cgccgccagcagcagcgcc

SEQ ID NO: 951233 - RNA, 21 nt, Mycobacterium avium subsp. paratuberculosis
cgccgccagcagcagcgccgc

SEQ ID NO: 951234 - RNA, 21 nt, Mycobacterium avium subsp. paratuberculosis
cgccgccagccagccggugcg

SEQ ID NO: 951235 - RNA, 12 nt, Mycobacterium avium subsp. paratuberculosis
cgccgccagccg

SEQ ID NO: 951236 - RNA, 15 nt, Mycobacterium avium subsp. paratuberculosis
cgccgccagccgcag

SEQ ID NO: 951237 - RNA, 17 nt, Mycobacterium avium subsp. paratuberculosis
cgccgccagccgcagca

SEQ ID NO: 951238 - RNA, 17 nt, Mycobacterium avium subsp. paratuberculosis
cgccgccagggcgcggc

SEQ ID NO: 951239 - RNA, 18 nt, Mycobacterium avium subsp. paratuberculosis
cgccgccagggcgcggcg

SEQ ID NO: 951240 - RNA, 23 nt, Mycobacterium avium subsp. paratuberculosis
cgccgccagggcgcggcgcaccg

SEQ ID NO: 951241 - RNA, 14 nt, Mycobacterium avium subsp. paratuberculosis
cgccgccagcgcgg

SEQ ID NO: 951242 - RNA, 15 nt, Mycobacterium avium subsp. paratuberculosis
cgccgccagcgccac

SEQ ID NO: 951243 - RNA, 16 nt, Mycobacterium avium subsp. paratuberculosis
cgccgcccgcaccugc

SEQ ID NO: 951244 - RNA, 16 nt, Mycobacterium avium subsp. paratuberculosis
cgccgcccgcgcggcg

SEQ ID NO: 951245 - RNA, 17 nt, Mycobacterium avium subsp. paratuberculosis
cgccgcccggagguucg

SEQ ID NO: 951246 - RNA, 13 nt, Mycobacterium avium subsp. paratuberculosis
cgccgcccggcga

SEQ ID NO: 951247 - RNA, 14 nt, Mycobacterium avium subsp. paratuberculosis
cgccgcccggcgau

SEQ ID NO: 951248 - RNA, 15 nt, Mycobacterium avium subsp. paratuberculosis
cgccgcccggcgaua

SEQ ID NO: 951249 - RNA, 15 nt, Mycobacterium avium subsp. paratuberculosis
cgccgcccggcgauc

SEQ ID NO: 951250 - RNA, 13 nt, Mycobacterium avium subsp. paratuberculosis
cgccgcccgggcc

SEQ ID NO: 951251 - RNA, 15 nt, Mycobacterium avium subsp. paratuberculosis
cgccgcccgggcccg

SEQ ID NO: 951252 - RNA, 15 nt, Mycobacterium avium subsp. paratuberculosis
cgccgcccgggccgc

SEQ ID NO: 951253 - RNA, 17 nt, Mycobacterium avium subsp. paratuberculosis
cgccgcccgggccgcgc

SEQ ID NO: 951254 - RNA, 18 nt, Mycobacterium avium subsp. paratuberculosis
cgccgcccgggccgcgcc

SEQ ID NO: 951255 - RNA, 14 nt, Mycobacterium avium subsp. paratuberculosis
cgccgcccgggcgg

SEQ ID NO: 951256 - RNA, 15 nt, Mycobacterium avium subsp. paratuberculosis
cgccgcccgcccgag

SEQ ID NO: 951257 - RNA, 16 nt, Mycobacterium avium subsp. paratuberculosis
cgccgcccgcaguucg

SEQ ID NO: 951258 - RNA, 13 nt, Mycobacterium avium subsp. paratuberculosis
cgccgccccgucg

SEQ ID NO: 951259 - RNA, 15 nt, Mycobacterium avium subsp. paratuberculosis
cgccgccccgucggu

SEQ ID NO: 951260 - RNA, 18 nt, Mycobacterium avium subsp. paratuberculosis
cgccgccccgucggucgg

SEQ ID NO: 951261 - RNA, 22 nt, Mycobacterium avium subsp. paratuberculosis
cgccgcccccgcccacagcggu

SEQ ID NO: 951262 - RNA, 19 nt, Mycobacterium avium subsp. paratuberculosis
cgccgcccacgccgugcag

SEQ ID NO: 951263 - RNA, 17 nt, Mycobacterium avium subsp. paratuberculosis
cgccgcccaucggcagc

SEQ ID NO: 951264 - RNA, 15 nt, Mycobacterium avium subsp. paratuberculosis
cgccgcccccgccgc

SEQ ID NO: 951265 - RNA, 19 nt, Mycobacterium avium subsp. paratuberculosis
cgccgcccccgccgcgagc

SEQ ID NO: 951266 - RNA, 20 nt, Mycobacterium avium subsp. paratuberculosis
cgccgcccccgccgcgagca

SEQ ID NO: 951267 - RNA, 21 nt, Mycobacterium avium subsp. paratuberculosis
cgccgcccccgccgcgagcag

SEQ ID NO: 951268 - RNA, 14 nt, Mycobacterium avium subsp. paratuberculosis
cgccgcccccgcgg

SEQ ID NO: 951269 - RNA, 15 nt, Mycobacterium avium subsp. paratuberculosis
cgccgcccccgcggc

SEQ ID NO: 951270 - RNA, 16 nt, Mycobacterium avium subsp. paratuberculosis
cgccgcccccgcggcg

SEQ ID NO: 951271 - RNA, 14 nt, Mycobacterium avium subsp. paratuberculosis
cgccgcccagcggc

SEQ ID NO: 951272 - RNA, 15 nt, Mycobacterium avium subsp. paratuberculosis
cgccgcccagcggcc

SEQ ID NO: 951273 - RNA, 20 nt, Mycobacterium avium subsp. paratuberculosis
cgccgcccagcggccccggc

SEQ ID NO: 951274 - RNA, 23 nt, Mycobacterium avium subsp. paratuberculosis
cgccgcccagcggccccggcucg

SEQ ID NO: 951275 - RNA, 12 nt, Mycobacterium avium subsp. paratuberculosis
cgccgcccaggc

SEQ ID NO: 951276 - RNA, 18 nt, Mycobacterium avium subsp. paratuberculosis
cgccgcccaggccccggc

SEQ ID NO: 951277 - RNA, 21 nt, Mycobacterium avium subsp. paratuberculosis
cgccgcccaggccccggccga

SEQ ID NO: 951278 - RNA, 14 nt, Mycobacterium avium subsp. paratuberculosis
cgccgcccaggccg

SEQ ID NO: 951279 - RNA, 17 nt, Mycobacterium avium subsp. paratuberculosis
cgccgcccaggccgagc

SEQ ID NO: 951280 - RNA, 20 nt, Mycobacterium avium subsp. paratuberculosis
cgccgcccaggccgagcgca

SEQ ID NO: 951281 - RNA, 16 nt, Mycobacterium avium subsp. paratuberculosis
cgccgcccacuggucg

SEQ ID NO: 951282 - RNA, 14 nt, Mycobacterium avium subsp. paratuberculosis
cgccgcccacgccg

SEQ ID NO: 951283 - RNA, 17 nt, Mycobacterium avium subsp. paratuberculosis
cgccgcccacgccgccc

SEQ ID NO: 951284 - RNA, 20 nt, Mycobacterium avium subsp. paratuberculosis
cgccgcccacgccgcccagg

SEQ ID NO: 951285 - RNA, 13 nt, Mycobacterium avium subsp. paratuberculosis
cgccgcccaccag

SEQ ID NO: 951286 - RNA, 18 nt, Mycobacterium avium subsp. paratuberculosis
cgccgcccaccagcacac

SEQ ID NO: 951287 - RNA, 20 nt, Mycobacterium avium subsp. paratuberculosis
cgccgcccaccagcacaccg

SEQ ID NO: 951288 - RNA, 13 nt, Mycobacterium avium subsp. paratuberculosis
cgccgcccacgcc

SEQ ID NO: 951289 - RNA, 19 nt, Mycobacterium avium subsp. paratuberculosis
cgccgcccacaccgacacc

SEQ ID NO: 951290 - RNA, 24 nt, Mycobacterium avium subsp. paratuberculosis
cgccgcccacaccgacaccggccg

SEQ ID NO: 951291 - RNA, 23 nt, Mycobacterium avium subsp. paratuberculosis
cgccgccauccguucggcucugc

SEQ ID NO: 951292 - RNA, 14 nt, Mycobacterium avium subsp. paratuberculosis
cgccgccaucgccg

SEQ ID NO: 951293 - RNA, 16 nt, Mycobacterium avium subsp. paratuberculosis
cgccgccaucgccgcc

SEQ ID NO: 951294 - RNA, 17 nt, Mycobacterium avium subsp. paratuberculosis
cgccgccaucgccucgu

SEQ ID NO: 951295 - RNA, 20 nt, Mycobacterium avium subsp. paratuberculosis
cgccgccauccgcgccgaac

SEQ ID NO: 951296 - RNA, 23 nt, Mycobacterium avium subsp. paratuberculosis
cgccgccauccgcgccgaacgca

SEQ ID NO: 951297 - RNA, 22 nt, Mycobacterium avium subsp. paratuberculosis
cgccgcccugcgggaacagcgg

SEQ ID NO: 951298 - RNA, 13 nt, Mycobacterium avium subsp. paratuberculosis
cgccgccgccagc

SEQ ID NO: 951299 - RNA, 14 nt, Mycobacterium avium subsp. paratuberculosis
cgccgccgccagca

SEQ ID NO: 951300 - RNA, 15 nt, Mycobacterium avium subsp. paratuberculosis
cgccgccgccagcca

SEQ ID NO: 951301 - RNA, 15 nt, Mycobacterium avium subsp. paratuberculosis
cgccgccugagcccg

SEQ ID NO: 951302 - RNA, 15 nt, Mycobacterium avium subsp. paratuberculosis
cgccgccggcggcgu

SEQ ID NO: 951303 - RNA, 14 nt, Mycobacterium avium subsp. paratuberculosis
cgccgccgggaaca

SEQ ID NO: 951304 - RNA, 14 nt, Mycobacterium avium subsp. paratuberculosis
cgccgccggcgcug

SEQ ID NO: 951305 - RNA, 17 nt, Mycobacterium avium subsp. paratuberculosis
cgccgccggcgcuggcg

SEQ ID NO: 951306 - RNA, 13 nt, Mycobacterium avium subsp. paratuberculosis
cgccgccggcguc

SEQ ID NO: 951307 - RNA, 16 nt, Mycobacterium avium subsp. paratuberculosis
cgccgccggcgucgac

SEQ ID NO: 951308 - RNA, 15 nt, Mycobacterium avium subsp. paratuberculosis
cgccgccggcgucgc

SEQ ID NO: 951309 - RNA, 17 nt, Mycobacterium avium subsp. paratuberculosis
cgccgccggcgucgccg

SEQ ID NO: 951310 - RNA, 21 nt, Mycobacterium avium subsp. paratuberculosis
cgccgccgcaauacaccgcga

SEQ ID NO: 951311 - RNA, 15 nt, Mycobacterium avium subsp. paratuberculosis
cgccgccgcaccggc

SEQ ID NO: 951312 - RNA, 15 nt, Mycobacterium avium subsp. paratuberculosis
cgccgccgagccgcg

SEQ ID NO: 951313 - RNA, 18 nt, Mycobacterium avium subsp. paratuberculosis
cgccgccgagccgcgggu

SEQ ID NO: 951314 - RNA, 23 nt, Mycobacterium avium subsp. paratuberculosis
cgccgccgagcucggccaccagc

SEQ ID NO: 951315 - RNA, 14 nt, Mycobacterium avium subsp. paratuberculosis
cgccgccgacgaag

SEQ ID NO: 951316 - RNA, 15 nt, Mycobacterium avium subsp. paratuberculosis
cgccgccgacgaaga

SEQ ID NO: 951317 - RNA, 12 nt, Mycobacterium avium subsp. paratuberculosis
cgccgccgacag

SEQ ID NO: 951318 - RNA, 13 nt, Mycobacterium avium subsp. paratuberculosis
cgccgccgacagc

SEQ ID NO: 951319 - RNA, 16 nt, Mycobacterium avium subsp. paratuberculosis
cgccgccgacagcacc

SEQ ID NO: 951320 - RNA, 17 nt, Mycobacterium avium subsp. paratuberculosis
cgccgccgaccacgccg

SEQ ID NO: 951321 - RNA, 14 nt, Mycobacterium avium subsp. paratuberculosis
cgccgccgaccgcc

SEQ ID NO: 951322 - RNA, 21 nt, Mycobacterium avium subsp. paratuberculosis
cgccgccgaacagccggguga

SEQ ID NO: 951323 - RNA, 20 nt, Mycobacterium avium subsp. paratuberculosis
cgccgccgaaccccagcucc

SEQ ID NO: 951324 - RNA, 14 nt, Mycobacterium avium subsp. paratuberculosis
cgccgcccucgccc

SEQ ID NO: 951325 - RNA, 17 nt, Mycobacterium avium subsp. paratuberculosis
cgccgcccucgcccucg

SEQ ID NO: 951326 - RNA, 21 nt, Mycobacterium avium subsp. paratuberculosis
cgccgcccucggugacgaacu

SEQ ID NO: 951327 - RNA, 21 nt, Mycobacterium avium subsp. paratuberculosis
cgccgcccucucacggcggua

SEQ ID NO: 951328 - RNA, 14 nt, Mycobacterium avium subsp. paratuberculosis
cgccgcccguccag

SEQ ID NO: 951329 - RNA, 15 nt, Mycobacterium avium subsp. paratuberculosis
cgccgcccguccagc

SEQ ID NO: 951330 - RNA, 16 nt, Mycobacterium avium subsp. paratuberculosis
cgccgcccguccagcg

SEQ ID NO: 951331 - RNA, 18 nt, Mycobacterium avium subsp. paratuberculosis
cgccgcccguccagcgca

SEQ ID NO: 951332 - RNA, 14 nt, Mycobacterium avium subsp. paratuberculosis
cgccgcgcgcggcc

SEQ ID NO: 951333 - RNA, 13 nt, Mycobacterium avium subsp. paratuberculosis
cgccgcgcgcggc

SEQ ID NO: 951334 - RNA, 15 nt, Mycobacterium avium subsp. paratuberculosis
cgccgcgcgccagcg

SEQ ID NO: 951335 - RNA, 15 nt, Mycobacterium avium subsp. paratuberculosis
cgccgcgcgcgcggc

SEQ ID NO: 951336 - RNA, 19 nt, Mycobacterium avium subsp. paratuberculosis
cgccgcgcgcgcggccucc

SEQ ID NO: 951337 - RNA, 13 nt, Mycobacterium avium subsp. paratuberculosis
cgccgcgccgggc

SEQ ID NO: 951338 - RNA, 13 nt, Mycobacterium avium subsp. paratuberculosis
cgccgcgccggca

SEQ ID NO: 951339 - RNA, 13 nt, Mycobacterium avium subsp. paratuberculosis
cgccgcgaucagg

SEQ ID NO: 951340 - RNA, 15 nt, Mycobacterium avium subsp. paratuberculosis
cgccgcgccgccggu

SEQ ID NO: 951341 - RNA, 16 nt, Mycobacterium avium subsp. paratuberculosis
cgccgcgccgccggug

SEQ ID NO: 951342 - RNA, 12 nt, Mycobacterium avium subsp. paratuberculosis
cgccgcgauccg

SEQ ID NO: 951343 - RNA, 16 nt, Mycobacterium avium subsp. paratuberculosis
cgccgcgauccgggca

SEQ ID NO: 951344 - RNA, 17 nt, Mycobacterium avium subsp. paratuberculosis
cgccgcgauccgggcau

SEQ ID NO: 951345 - RNA, 13 nt, Mycobacterium avium subsp. paratuberculosis
cgccgcgaucucg

SEQ ID NO: 951346 - RNA, 22 nt, Mycobacterium avium subsp. paratuberculosis
cgccgcgaucucggcggacucg

SEQ ID NO: 951347 - RNA, 18 nt, Mycobacterium avium subsp. paratuberculosis
cgccgcgaucuugccgcc

SEQ ID NO: 951348 - RNA, 13 nt, Mycobacterium avium subsp. paratuberculosis
cgccgcgagccgc

SEQ ID NO: 951349 - RNA, 15 nt, Mycobacterium avium subsp. paratuberculosis
cgccgcgagccgccc

SEQ ID NO: 951350 - RNA, 13 nt, Mycobacterium avium subsp. paratuberculosis
cgccgcgacgaug

SEQ ID NO: 951351 - RNA, 22 nt, Mycobacterium avium subsp. paratuberculosis
cgccgcgacgaugccggcgucg

SEQ ID NO: 951352 - RNA, 16 nt, Mycobacterium avium subsp. paratuberculosis
cgccgcgagcgcagca

SEQ ID NO: 951353 - RNA, 16 nt, Mycobacterium avium subsp. paratuberculosis
cgccgcgaccgucagc

SEQ ID NO: 951354 - RNA, 13 nt, Mycobacterium avium subsp. paratuberculosis
cgccgcgacgucg

SEQ ID NO: 951355 - RNA, 14 nt, Mycobacterium avium subsp. paratuberculosis
cgccgcgacgucgg

SEQ ID NO: 951356 - RNA, 15 nt, Mycobacterium avium subsp. paratuberculosis
cgccgcgacgucggu

SEQ ID NO: 951357 - RNA, 12 nt, Mycobacterium avium subsp. paratuberculosis
cgccgcgacacc

SEQ ID NO: 951358 - RNA, 17 nt, Mycobacterium avium subsp. paratuberculosis
cgccgcgacacccgcga

SEQ ID NO: 951359 - RNA, 21 nt, Mycobacterium avium subsp. paratuberculosis
cgccgcgacacccgcgacgac

SEQ ID NO: 951360 - RNA, 12 nt, Mycobacterium avium subsp. paratuberculosis
cgccgcgacccc

SEQ ID NO: 951361 - RNA, 13 nt, Mycobacterium avium subsp. paratuberculosis
cgccgcgacccgg

SEQ ID NO: 951362 - RNA, 14 nt, Mycobacterium avium subsp. paratuberculosis
cgccgcgacccggu

SEQ ID NO: 951363 - RNA, 13 nt, Mycobacterium avium subsp. paratuberculosis
cgccgcgaccgcg

SEQ ID NO: 951364 - RNA, 18 nt, Mycobacterium avium subsp. paratuberculosis
cgccgcgaccgcgaucag

SEQ ID NO: 951365 - RNA, 22 nt, Mycobacterium avium subsp. paratuberculosis
cgccgcgaccgcgaucagggcc

SEQ ID NO: 951366 - RNA, 21 nt, Mycobacterium avium subsp. paratuberculosis
cgccgccuugacgccgggcac

SEQ ID NO: 951367 - RNA, 16 nt, Mycobacterium avium subsp. paratuberculosis
cgccgcgaacgacgac

SEQ ID NO: 951368 - RNA, 16 nt, Mycobacterium avium subsp. paratuberculosis
cgccgcgaacgggucg

SEQ ID NO: 951369 - RNA, 17 nt, Mycobacterium avium subsp. paratuberculosis
cgccgcgaacgggucgg

SEQ ID NO: 951370 - RNA, 21 nt, Mycobacterium avium subsp. paratuberculosis
cgccgcgaacucaggcgcgca

SEQ ID NO: 951371 - RNA, 23 nt, Mycobacterium avium subsp. paratuberculosis
cgccgcgaacucaggcgcgcacg

SEQ ID NO: 951372 - RNA, 20 nt, Mycobacterium avium subsp. paratuberculosis
cgccgccuucuugcgcggcg

SEQ ID NO: 951373 - RNA, 23 nt, Mycobacterium avium subsp. paratuberculosis
cgccgccuucuugcgcggcgcga

SEQ ID NO: 951374 - RNA, 23 nt, Mycobacterium avium subsp. paratuberculosis
cgcccagacgcgggcgcccagca

SEQ ID NO: 951375 - RNA, 17 nt, Mycobacterium avium subsp. paratuberculosis
cgcccagaugccgccgc

SEQ ID NO: 951376 - RNA, 19 nt, Mycobacterium avium subsp. paratuberculosis
cgcccagaugccgccgcca

SEQ ID NO: 951377 - RNA, 16 nt, Mycobacterium avium subsp. paratuberculosis
cgcccagauagaucgc

SEQ ID NO: 951378 - RNA, 18 nt, Mycobacterium avium subsp. paratuberculosis
cgcccagaucgacgccga

SEQ ID NO: 951379 - RNA, 16 nt, Mycobacterium avium subsp. paratuberculosis
cgcccagaucgccgac

SEQ ID NO: 951380 - RNA, 12 nt, Mycobacterium avium subsp. paratuberculosis
cgcccagcaccg

SEQ ID NO: 951381 - RNA, 20 nt, Mycobacterium avium subsp. paratuberculosis
cgcccagcaaacccagcacc

SEQ ID NO: 951382 - RNA, 24 nt, Mycobacterium avium subsp. paratuberculosis
cgcccagcaaacccagcaccaaca

SEQ ID NO: 951383 - RNA, 13 nt, Mycobacterium avium subsp. paratuberculosis
cgcccagcaccga

SEQ ID NO: 951384 - RNA, 14 nt, Mycobacterium avium subsp. paratuberculosis
cgcccagcaccgag

SEQ ID NO: 951385 - RNA, 15 nt, Mycobacterium avium subsp. paratuberculosis
cgcccagcaccgcga

SEQ ID NO: 951386 - RNA, 14 nt, Mycobacterium avium subsp. paratuberculosis
cgcccagcaccguc

SEQ ID NO: 951387 - RNA, 20 nt, Mycobacterium avium subsp. paratuberculosis
cgcccagaacugggccgccg

SEQ ID NO: 951388 - RNA, 20 nt, Mycobacterium avium subsp. paratuberculosis
cgcccacguucagcgacuug

SEQ ID NO: 951389 - RNA, 13 nt, Mycobacterium avium subsp. paratuberculosis
cgcccacggccac

SEQ ID NO: 951390 - RNA, 18 nt, Mycobacterium avium subsp. paratuberculosis
cgcccagaacgacgcgcu

SEQ ID NO: 951391 - RNA, 20 nt, Mycobacterium avium subsp. paratuberculosis
cgcccacugguaaccgcccg

SEQ ID NO: 951392 - RNA, 21 nt, Mycobacterium avium subsp. paratuberculosis
cgcccacugguaaccgcccga

SEQ ID NO: 951393 - RNA, 17 nt, Mycobacterium avium subsp. paratuberculosis
cgcccacuggucguugc

SEQ ID NO: 951394 - RNA, 14 nt, Mycobacterium avium subsp. paratuberculosis
cgcccacgggucgc

SEQ ID NO: 951395 - RNA, 19 nt, Mycobacterium avium subsp. paratuberculosis
cgcccacgggucgccgauc

SEQ ID NO: 951396 - RNA, 23 nt, Mycobacterium avium subsp. paratuberculosis
cgcccacgggucgccgaucucgg

SEQ ID NO: 951397 - RNA, 23 nt, Mycobacterium avium subsp. paratuberculosis
cgcccacguaggggcccggguug

SEQ ID NO: 951398 - RNA, 18 nt, Mycobacterium avium subsp. paratuberculosis
cgccgagaaugccguaga

SEQ ID NO: 951399 - RNA, 21 nt, Mycobacterium avium subsp. paratuberculosis
cgccgagacacauucgcgugu

SEQ ID NO: 951400 - RNA, 22 nt, Mycobacterium avium subsp. paratuberculosis
cgccgagacacauucgcgugug

SEQ ID NO: 951401 - RNA, 16 nt, Mycobacterium avium subsp. paratuberculosis
cgccgagaccagccag

SEQ ID NO: 951402 - RNA, 14 nt, Mycobacterium avium subsp. paratuberculosis
cgccgagaacaggc

SEQ ID NO: 951403 - RNA, 17 nt, Mycobacterium avium subsp. paratuberculosis
cgccgagaacaggccga

SEQ ID NO: 951404 - RNA, 20 nt, Mycobacterium avium subsp. paratuberculosis
cgccgagaacaggccgagcg

SEQ ID NO: 951405 - RNA, 14 nt, Mycobacterium avium subsp. paratuberculosis
cgccgagacgaucc

SEQ ID NO: 951406 - RNA, 16 nt, Mycobacterium avium subsp. paratuberculosis
cgccgagacgaucccg

SEQ ID NO: 951407 - RNA, 13 nt, Mycobacterium avium subsp. paratuberculosis
cgccgagacggcg

SEQ ID NO: 951408 - RNA, 14 nt, Mycobacterium avium subsp. paratuberculosis
cgccgagacggcgu

SEQ ID NO: 951409 - RNA, 22 nt, Mycobacterium avium subsp. paratuberculosis
cgccgagacgugguggugcgga

SEQ ID NO: 951410 - RNA, 14 nt, Mycobacterium avium subsp. paratuberculosis
cgccgagagcgcgu

SEQ ID NO: 951411 - RNA, 18 nt, Mycobacterium avium subsp. paratuberculosis
cgccgagagcgcgucgac

SEQ ID NO: 951412 - RNA, 22 nt, Mycobacterium avium subsp. paratuberculosis
cgccgagagcucuugcgcccca

SEQ ID NO: 951413 - RNA, 18 nt, Mycobacterium avium subsp. paratuberculosis
cgccgacuccccgcccgg

SEQ ID NO: 951414 - RNA, 19 nt, Mycobacterium avium subsp. paratuberculosis
cgccgacuccccgcccggc

SEQ ID NO: 951415 - RNA, 22 nt, Mycobacterium avium subsp. paratuberculosis
cgccgacucgcaggugccggug

SEQ ID NO: 951416 - RNA, 14 nt, Mycobacterium avium subsp. paratuberculosis
cgcccagcagcccg

SEQ ID NO: 951417 - RNA, 19 nt, Mycobacterium avium subsp. paratuberculosis
cgcccagcagcccggccag

SEQ ID NO: 951418 - RNA, 22 nt, Mycobacterium avium subsp. paratuberculosis
cgcccagcagcccggccagccg

SEQ ID NO: 951419 - RNA, 20 nt, Mycobacterium avium subsp. paratuberculosis
cgcccagcagccgcgccgac

SEQ ID NO: 951420 - RNA, 21 nt, Mycobacterium avium subsp. paratuberculosis
cgcccagcagccgcgccgacg

SEQ ID NO: 951421 - RNA, 23 nt, Mycobacterium avium subsp. paratuberculosis
cgcccagcagccgcgccgacgcc

SEQ ID NO: 951422 - RNA, 15 nt, Mycobacterium avium subsp. paratuberculosis
cgcccagcagcgggc

SEQ ID NO: 951423 - RNA, 23 nt, Mycobacterium avium subsp. paratuberculosis
cgcccagcagcgggcccgggcug

SEQ ID NO: 951424 - RNA, 13 nt, Mycobacterium avium subsp. paratuberculosis
cgccgacuagcgc

SEQ ID NO: 951425 - RNA, 17 nt, Mycobacterium avium subsp. paratuberculosis
cgccgacuagcgcggcg

SEQ ID NO: 951426 - RNA, 18 nt, Mycobacterium avium subsp. paratuberculosis
cgccgacuagcgcggcgg

SEQ ID NO: 951427 - RNA, 19 nt, Mycobacterium avium subsp. paratuberculosis
cgccgacuagcgcggcggc

SEQ ID NO: 951428 - RNA, 23 nt, Mycobacterium avium subsp. paratuberculosis
cgccgacuagcgcggcggccucg

SEQ ID NO: 951429 - RNA, 17 nt, Mycobacterium avium subsp. paratuberculosis
cgccgagcaacagcccg

SEQ ID NO: 951430 - RNA, 21 nt, Mycobacterium avium subsp. paratuberculosis
cgccgagcaacagcccgaccg

SEQ ID NO: 951431 - RNA, 23 nt, Mycobacterium avium subsp. paratuberculosis
cgccgagauccaccgcgcggcca

SEQ ID NO: 951432 - RNA, 16 nt, Mycobacterium avium subsp. paratuberculosis
cgccgagaucgcggug

SEQ ID NO: 951433 - RNA, 19 nt, Mycobacterium avium subsp. paratuberculosis
cgccgagaucgcgguggcg

SEQ ID NO: 951434 - RNA, 19 nt, Mycobacterium avium subsp. paratuberculosis
cgccgagauuggacgacac

SEQ ID NO: 951435 - RNA, 22 nt, Mycobacterium avium subsp. paratuberculosis
cgccgagauuggacgacaccac

SEQ ID NO: 951436 - RNA, 14 nt, Mycobacterium avium subsp. paratuberculosis
cgccgagcagaucg

SEQ ID NO: 951437 - RNA, 13 nt, Mycobacterium avium subsp. paratuberculosis
cgccgagcagcac

SEQ ID NO: 951438 - RNA, 16 nt, Mycobacterium avium subsp. paratuberculosis
cgccgagcagcaccgg

SEQ ID NO: 951439 - RNA, 17 nt, Mycobacterium avium subsp. paratuberculosis
cgccgagcagcaccggc

SEQ ID NO: 951440 - RNA, 20 nt, Mycobacterium avium subsp. paratuberculosis
cgccgagcagcaccggcaug

SEQ ID NO: 951441 - RNA, 14 nt, Mycobacterium avium subsp. paratuberculosis
cgccgagcacaccg

SEQ ID NO: 951442 - RNA, 16 nt, Mycobacterium avium subsp. paratuberculosis
cgccgagcacgaacgc

SEQ ID NO: 951443 - RNA, 22 nt, Mycobacterium avium subsp. paratuberculosis
cgccgagcacgaacgcggccgc

SEQ ID NO: 951444 - RNA, 15 nt, Mycobacterium avium subsp. paratuberculosis
cgccgagcacggcuc

SEQ ID NO: 951445 - RNA, 16 nt, Mycobacterium avium subsp. paratuberculosis
cgccgagcacggcucg

SEQ ID NO: 951446 - RNA, 20 nt, Mycobacterium avium subsp. paratuberculosis
cgccgagcacggcucgucca

SEQ ID NO: 951447 - RNA, 15 nt, Mycobacterium avium subsp. paratuberculosis
cgccgagggccagca

SEQ ID NO: 951448 - RNA, 16 nt, Mycobacterium avium subsp. paratuberculosis
cgccgagggccagcag

SEQ ID NO: 951449 - RNA, 18 nt, Mycobacterium avium subsp. paratuberculosis
cgccgagggccagcagcc

SEQ ID NO: 951450 - RNA, 22 nt, Mycobacterium avium subsp. paratuberculosis
cgccgagggccagcagccagcu

SEQ ID NO: 951451 - RNA, 16 nt, Mycobacterium avium subsp. paratuberculosis
cgccgagggcccgggc

SEQ ID NO: 951452 - RNA, 19 nt, Mycobacterium avium subsp. paratuberculosis
cgccgaggcgcucggcccg

SEQ ID NO: 951453 - RNA, 21 nt, Mycobacterium avium subsp. paratuberculosis
cgccgaggcgcucggcccgcu

SEQ ID NO: 951454 - RNA, 15 nt, Mycobacterium avium subsp. paratuberculosis
cgccgaggcgugccg

SEQ ID NO: 951455 - RNA, 23 nt, Mycobacterium avium subsp. paratuberculosis
cgccgaggcgugccgcugggagc

SEQ ID NO: 951456 - RNA, 13 nt, Mycobacterium avium subsp. paratuberculosis
cgccgagcagccg

SEQ ID NO: 951457 - RNA, 16 nt, Mycobacterium avium subsp. paratuberculosis
cgccgagcagccgguc

SEQ ID NO: 951458 - RNA, 23 nt, Mycobacterium avium subsp. paratuberculosis
cgccgacugugcgaugucggugc

SEQ ID NO: 951459 - RNA, 14 nt, Mycobacterium avium subsp. paratuberculosis
cgccgaggcgaugc

SEQ ID NO: 951460 - RNA, 15 nt, Mycobacterium avium subsp. paratuberculosis
cgccgaggcgaugcc

SEQ ID NO: 951461 - RNA, 17 nt, Mycobacterium avium subsp. paratuberculosis
cgccgaggcgaugccgu

SEQ ID NO: 951462 - RNA, 15 nt, Mycobacterium avium subsp. paratuberculosis
cgccgaggcgcagga

SEQ ID NO: 951463 - RNA, 21 nt, Mycobacterium avium subsp. paratuberculosis
cgccgagguagccgcgcacca

SEQ ID NO: 951464 - RNA, 16 nt, Mycobacterium avium subsp. paratuberculosis
cgccgaggucaccgcg

SEQ ID NO: 951465 - RNA, 17 nt, Mycobacterium avium subsp. paratuberculosis
cgccgagggcgacgaug

SEQ ID NO: 951466 - RNA, 14 nt, Mycobacterium avium subsp. paratuberculosis
cgccgagggcggcg

SEQ ID NO: 951467 - RNA, 16 nt, Mycobacterium avium subsp. paratuberculosis
cgccgagggcggcggc

SEQ ID NO: 951468 - RNA, 18 nt, Mycobacterium avium subsp. paratuberculosis
cgccgagggugccggcca

SEQ ID NO: 951469 - RNA, 20 nt, Mycobacterium avium subsp. paratuberculosis
cgccgagggugccggccacc

SEQ ID NO: 951470 - RNA, 20 nt, Mycobacterium avium subsp. paratuberculosis
cgccgaucaacaggcccagc

SEQ ID NO: 951471 - RNA, 21 nt, Mycobacterium avium subsp. paratuberculosis
cgccgaucaacaggcccagca

SEQ ID NO: 951472 - RNA, 23 nt, Mycobacterium avium subsp. paratuberculosis
cgccgaucaacaggcccagcagc

SEQ ID NO: 951473 - RNA, 14 nt, Mycobacterium avium subsp. paratuberculosis
cgccgcacgcgacc

SEQ ID NO: 951474 - RNA, 15 nt, Mycobacterium avium subsp. paratuberculosis
cgccgcacgcgaccg

SEQ ID NO: 951475 - RNA, 16 nt, Mycobacterium avium subsp. paratuberculosis
cgccgcaccgucgugc

SEQ ID NO: 951476 - RNA, 15 nt, Mycobacterium avium subsp. paratuberculosis
cgccgcaccucgccg

SEQ ID NO: 951477 - RNA, 17 nt, Mycobacterium avium subsp. paratuberculosis
cgccgcaccucgccggc

SEQ ID NO: 951478 - RNA, 20 nt, Mycobacterium avium subsp. paratuberculosis
cgccgcaccucgccggccgc

SEQ ID NO: 951479 - RNA, 21 nt, Mycobacterium avium subsp. paratuberculosis
cgccgcacgaauugccggugg

SEQ ID NO: 951480 - RNA, 13 nt, Mycobacterium avium subsp. paratuberculosis
cgccgcacgccca

SEQ ID NO: 951481 - RNA, 23 nt, Mycobacterium avium subsp. paratuberculosis
cgccgcacugcacggccucgguc

SEQ ID NO: 951482 - RNA, 16 nt, Mycobacterium avium subsp. paratuberculosis
cgccgcagcccaggcc

SEQ ID NO: 951483 - RNA, 20 nt, Mycobacterium avium subsp. paratuberculosis
cgccgcagcccaggcccagc

SEQ ID NO: 951484 - RNA, 21 nt, Mycobacterium avium subsp. paratuberculosis
cgccgcagcccaggcccagca

SEQ ID NO: 951485 - RNA, 15 nt, Mycobacterium avium subsp. paratuberculosis
cgccgcagcccgcca

SEQ ID NO: 951486 - RNA, 12 nt, Mycobacterium avium subsp. paratuberculosis
cgccgcagcacg

SEQ ID NO: 951487 - RNA, 14 nt, Mycobacterium avium subsp. paratuberculosis
cgccgcagcacgcu

SEQ ID NO: 951488 - RNA, 18 nt, Mycobacterium avium subsp. paratuberculosis
cgccgcagcacgcugaag

SEQ ID NO: 951489 - RNA, 13 nt, Mycobacterium avium subsp. paratuberculosis
cgccgcagcaggu

SEQ ID NO: 951490 - RNA, 18 nt, Mycobacterium avium subsp. paratuberculosis
cgccgcagcgcagcgucg

SEQ ID NO: 951491 - RNA, 19 nt, Mycobacterium avium subsp. paratuberculosis
cgccgcagcgcagcgucgg

SEQ ID NO: 951492 - RNA, 20 nt, Mycobacterium avium subsp. paratuberculosis
cgccgcagcgcagcgucggc

SEQ ID NO: 951493 - RNA, 20 nt, Mycobacterium avium subsp. paratuberculosis
cgccgcagcgcgcgcucggu

SEQ ID NO: 951494 - RNA, 13 nt, Mycobacterium avium subsp. paratuberculosis
cgccgcagcggcg

SEQ ID NO: 951495 - RNA, 16 nt, Mycobacterium avium subsp. paratuberculosis
cgccgcagcggcgccg

SEQ ID NO: 951496 - RNA, 17 nt, Mycobacterium avium subsp. paratuberculosis
cgccgcagcggcgccgc

SEQ ID NO: 951497 - RNA, 20 nt, Mycobacterium avium subsp. paratuberculosis
cgccgcagcggcgccgcagc

SEQ ID NO: 951498 - RNA, 18 nt, Mycobacterium avium subsp. paratuberculosis
cgccgcagcggcgccggg

SEQ ID NO: 951499 - RNA, 22 nt, Mycobacterium avium subsp. paratuberculosis
cgccgcagcggcgccgggaucg

SEQ ID NO: 951500 - RNA, 12 nt, Mycobacterium avium subsp. paratuberculosis
cgccgcagcggu

SEQ ID NO: 951501 - RNA, 22 nt, Mycobacterium avium subsp. paratuberculosis
cgccgcauacaccuugucggcg

SEQ ID NO: 951502 - RNA, 23 nt, Mycobacterium avium subsp. paratuberculosis
cgccgcauacaccuugucggcga

SEQ ID NO: 951503 - RNA, 22 nt, Mycobacterium avium subsp. paratuberculosis
cgccgcauaccgcccgcgcugg

SEQ ID NO: 951504 - RNA, 12 nt, Mycobacterium avium subsp. paratuberculosis
cgccgcagcucg

SEQ ID NO: 951505 - RNA, 20 nt, Mycobacterium avium subsp. paratuberculosis
cgccgcaggagaucggcgcg

SEQ ID NO: 951506 - RNA, 21 nt, Mycobacterium avium subsp. paratuberculosis
cgccgcaugcccuugucgcug

SEQ ID NO: 951507 - RNA, 16 nt, Mycobacterium avium subsp. paratuberculosis
cgccgcaugaugcggc

SEQ ID NO: 951508 - RNA, 19 nt, Mycobacterium avium subsp. paratuberculosis
cgccgcaugaugcggccau

SEQ ID NO: 951509 - RNA, 20 nt, Mycobacterium avium subsp. paratuberculosis
cgccgcaugaugcggccaug

SEQ ID NO: 951510 - RNA, 15 nt, Mycobacterium avium subsp. paratuberculosis
cgccgcauuccucgg

SEQ ID NO: 951511 - RNA, 16 nt, Mycobacterium avium subsp. paratuberculosis
cgccgcauuccucggc

SEQ ID NO: 951512 - RNA, 19 nt, Mycobacterium avium subsp. paratuberculosis
cgccgcauuccucggccag

SEQ ID NO: 951513 - RNA, 20 nt, Mycobacterium avium subsp. paratuberculosis
cgccgcauuccucggccagc

SEQ ID NO: 951514 - RNA, 16 nt, Mycobacterium avium subsp. paratuberculosis
cgccgauuccggccgg

SEQ ID NO: 951515 - RNA, 17 nt, Mycobacterium avium subsp. paratuberculosis
cgccgauuccggccggc

SEQ ID NO: 951516 - RNA, 18 nt, Mycobacterium avium subsp. paratuberculosis
cgccgauuccgucggugg

SEQ ID NO: 951517 - RNA, 19 nt, Mycobacterium avium subsp. paratuberculosis
cgccgauuccgucgguggc

SEQ ID NO: 951518 - RNA, 16 nt, Mycobacterium avium subsp. paratuberculosis
cgccgauuucgguguc

SEQ ID NO: 951519 - RNA, 15 nt, Mycobacterium avium subsp. paratuberculosis
cgccgauccgcagcc

SEQ ID NO: 951520 - RNA, 16 nt, Mycobacterium avium subsp. paratuberculosis
cgccgauccgcagccg

SEQ ID NO: 951521 - RNA, 18 nt, Mycobacterium avium subsp. paratuberculosis
cgccgauccgcagccgcu

SEQ ID NO: 951522 - RNA, 19 nt, Mycobacterium avium subsp. paratuberculosis
cgccgauccgcagccgcug

SEQ ID NO: 951523 - RNA, 13 nt, Mycobacterium avium subsp. paratuberculosis
cgccgauccgcug

SEQ ID NO: 951524 - RNA, 17 nt, Mycobacterium avium subsp. paratuberculosis
cgccgauccgcugcgga

SEQ ID NO: 951525 - RNA, 20 nt, Mycobacterium avium subsp. paratuberculosis
cgccgauguuuugggugcuu

SEQ ID NO: 951526 - RNA, 22 nt, Mycobacterium avium subsp. paratuberculosis
cgccgauucaaccccgcgcgcg

SEQ ID NO: 951527 - RNA, 23 nt, Mycobacterium avium subsp. paratuberculosis
cgccgauucaaccccgcgcgcgg

SEQ ID NO: 951528 - RNA, 14 nt, Mycobacterium avium subsp. paratuberculosis
cgccgauccagccg

SEQ ID NO: 951529 - RNA, 15 nt, Mycobacterium avium subsp. paratuberculosis
cgccgauccagccgu

SEQ ID NO: 951530 - RNA, 17 nt, Mycobacterium avium subsp. paratuberculosis
cgccgauccagccgucg

SEQ ID NO: 951531 - RNA, 14 nt, Mycobacterium avium subsp. paratuberculosis
cgccgaucaccgcg

SEQ ID NO: 951532 - RNA, 16 nt, Mycobacterium avium subsp. paratuberculosis
cgccgaucaccgcguu

SEQ ID NO: 951533 - RNA, 12 nt, Mycobacterium avium subsp. paratuberculosis
cgccgaucacga

SEQ ID NO: 951534 - RNA, 17 nt, Mycobacterium avium subsp. paratuberculosis
cgccgaucacgaacagg

SEQ ID NO: 951535 - RNA, 14 nt, Mycobacterium avium subsp. paratuberculosis
cgccgaucacgccg

SEQ ID NO: 951536 - RNA, 16 nt, Mycobacterium avium subsp. paratuberculosis
cgccgaucacgccggu

SEQ ID NO: 951537 - RNA, 16 nt, Mycobacterium avium subsp. paratuberculosis
cgccgcaauacaccgc

SEQ ID NO: 951538 - RNA, 18 nt, Mycobacterium avium subsp. paratuberculosis
cgccgcaauacaccgcga

SEQ ID NO: 951539 - RNA, 21 nt, Mycobacterium avium subsp. paratuberculosis
cgccgcaauacaccgcgaacu

SEQ ID NO: 951540 - RNA, 23 nt, Mycobacterium avium subsp. paratuberculosis
cgccgcaacagguuucgcucguc

SEQ ID NO: 951541 - RNA, 14 nt, Mycobacterium avium subsp. paratuberculosis
cgccgcaacagccg

SEQ ID NO: 951542 - RNA, 21 nt, Mycobacterium avium subsp. paratuberculosis
cgccgcaacagccggcccgag

SEQ ID NO: 951543 - RNA, 23 nt, Mycobacterium avium subsp. paratuberculosis
cgccgcaaccgucaguucguaga

SEQ ID NO: 951544 - RNA, 22 nt, Mycobacterium avium subsp. paratuberculosis
cgccgcaaccuucuuggccgga

SEQ ID NO: 951545 - RNA, 23 nt, Mycobacterium avium subsp. paratuberculosis
cgccgcaaccuucuuggccggag

SEQ ID NO: 951546 - RNA, 13 nt, Mycobacterium avium subsp. paratuberculosis
cgccgcaacggcg

SEQ ID NO: 951547 - RNA, 14 nt, Mycobacterium avium subsp. paratuberculosis
cgccgcaacggcgc

SEQ ID NO: 951548 - RNA, 20 nt, Mycobacterium avium subsp. paratuberculosis
cgccgcaacggcucccaggc

SEQ ID NO: 951549 - RNA, 19 nt, Mycobacterium avium subsp. paratuberculosis
cgccgcaacuugcccgacg

SEQ ID NO: 951550 - RNA, 22 nt, Mycobacterium avium subsp. paratuberculosis
cgccgcaccaguuccugcaugc

SEQ ID NO: 951551 - RNA, 17 nt, Mycobacterium avium subsp. paratuberculosis
cgccgcacccagcgggc

SEQ ID NO: 951552 - RNA, 14 nt, Mycobacterium avium subsp. paratuberculosis
cgccgcaccggccg

SEQ ID NO: 951553 - RNA, 15 nt, Mycobacterium avium subsp. paratuberculosis
cgccgcaccggccgg

SEQ ID NO: 951554 - RNA, 16 nt, Mycobacterium avium subsp. paratuberculosis
cgccgcacagccggcg

SEQ ID NO: 951555 - RNA, 18 nt, Mycobacterium avium subsp. paratuberculosis
cgccgcacagccggcggc

SEQ ID NO: 951556 - RNA, 20 nt, Mycobacterium avium subsp. paratuberculosis
cgccgcacagccggcggcgg

SEQ ID NO: 951557 - RNA, 21 nt, Mycobacterium avium subsp. paratuberculosis
cgccgcacagccggcggcggc

SEQ ID NO: 951558 - RNA, 20 nt, Mycobacterium avium subsp. paratuberculosis
ccgggcgguacgcgccgcgc

SEQ ID NO: 951559 - RNA, 12 nt, Mycobacterium avium subsp. paratuberculosis
ccgggcggcguc

SEQ ID NO: 951560 - RNA, 13 nt, Mycobacterium avium subsp. paratuberculosis
ccgggcggccgga

SEQ ID NO: 951561 - RNA, 17 nt, Mycobacterium avium subsp. paratuberculosis
ccgggcggccggagccg

SEQ ID NO: 951562 - RNA, 13 nt, Mycobacterium avium subsp. paratuberculosis
ccgggcggccgug

SEQ ID NO: 951563 - RNA, 17 nt, Mycobacterium avium subsp. paratuberculosis
ccgggcggccguggucg

SEQ ID NO: 951564 - RNA, 12 nt, Mycobacterium avium subsp. paratuberculosis
ccgggcggccuc

SEQ ID NO: 951565 - RNA, 16 nt, Mycobacterium avium subsp. paratuberculosis
ccgggcggccucggcg

SEQ ID NO: 951566 - RNA, 16 nt, Mycobacterium avium subsp. paratuberculosis
ccgggcggcgacgucg

SEQ ID NO: 951567 - RNA, 17 nt, Mycobacterium avium subsp. paratuberculosis
ccgggcggcgccgaacc

SEQ ID NO: 951568 - RNA, 12 nt, Mycobacterium avium subsp. paratuberculosis
ccgggcggucgc

SEQ ID NO: 951569 - RNA, 15 nt, Mycobacterium avium subsp. paratuberculosis
ccgggcggucgcguc

SEQ ID NO: 951570 - RNA, 19 nt, Mycobacterium avium subsp. paratuberculosis
ccgggcggucgcgucgucg

SEQ ID NO: 951571 - RNA, 21 nt, Mycobacterium avium subsp. paratuberculosis
ccgggcggucgcgucgucggc

SEQ ID NO: 951572 - RNA, 22 nt, Mycobacterium avium subsp. paratuberculosis
ccgggcggucgcgucgucggcg

SEQ ID NO: 951573 - RNA, 21 nt, Mycobacterium avium subsp. paratuberculosis
ccgggcgggcaccccaucggc

SEQ ID NO: 951574 - RNA, 15 nt, Mycobacterium avium subsp. paratuberculosis
ccgggcgggccgcag

SEQ ID NO: 951575 - RNA, 16 nt, Mycobacterium avium subsp. paratuberculosis
ccgggcgggccgcagc

SEQ ID NO: 951576 - RNA, 18 nt, Mycobacterium avium subsp. paratuberculosis
ccgggcgggcgcaggugg

SEQ ID NO: 951577 - RNA, 22 nt, Mycobacterium avium subsp. paratuberculosis
ccgggcgggcgcaggugggcgg

SEQ ID NO: 951578 - RNA, 17 nt, Mycobacterium avium subsp. paratuberculosis
ccggggguccagggugc

SEQ ID NO: 951579 - RNA, 13 nt, Mycobacterium avium subsp. paratuberculosis
ccgggggcggcgg

SEQ ID NO: 951580 - RNA, 18 nt, Mycobacterium avium subsp. paratuberculosis
ccgggggcggcggcgcgu

SEQ ID NO: 951581 - RNA, 15 nt, Mycobacterium avium subsp. paratuberculosis
ccgggggcggugcag

SEQ ID NO: 951582 - RNA, 21 nt, Mycobacterium avium subsp. paratuberculosis
ccgggggcggugcagccgggu

SEQ ID NO: 951583 - RNA, 15 nt, Mycobacterium avium subsp. paratuberculosis
ccggggggaggucgc

SEQ ID NO: 951584 - RNA, 16 nt, Mycobacterium avium subsp. paratuberculosis
ccgggguagaggccgc

SEQ ID NO: 951585 - RNA, 15 nt, Mycobacterium avium subsp. paratuberculosis
ccggggucaccuugg

SEQ ID NO: 951586 - RNA, 20 nt, Mycobacterium avium subsp. paratuberculosis
ccggggucaccuuggccgga

SEQ ID NO: 951587 - RNA, 23 nt, Mycobacterium avium subsp. paratuberculosis
ccggggguggcggucccggcgga

SEQ ID NO: 951588 - RNA, 17 nt, Mycobacterium avium subsp. paratuberculosis
ccggggguuucgugugc

SEQ ID NO: 951589 - RNA, 13 nt, Mycobacterium avium subsp. paratuberculosis
ccgggguccaccg

SEQ ID NO: 951590 - RNA, 18 nt, Mycobacterium avium subsp. paratuberculosis
ccgggguccaccggccga

SEQ ID NO: 951591 - RNA, 17 nt, Mycobacterium avium subsp. paratuberculosis
ccggggugaugccggcg

SEQ ID NO: 951592 - RNA, 22 nt, Mycobacterium avium subsp. paratuberculosis
ccggggugcaccguggugaccc

SEQ ID NO: 951593 - RNA, 21 nt, Mycobacterium avium subsp. paratuberculosis
ccgggguccgcaacgccggcg

SEQ ID NO: 951594 - RNA, 22 nt, Mycobacterium avium subsp. paratuberculosis
ccgggguccgcaacgccggcgu

SEQ ID NO: 951595 - RNA, 22 nt, Mycobacterium avium subsp. paratuberculosis
ccgggucaggaacaccgagccg

SEQ ID NO: 951596 - RNA, 24 nt, Mycobacterium avium subsp. paratuberculosis
ccgggucaggaacaccgagccggc

SEQ ID NO: 951597 - RNA, 13 nt, Mycobacterium avium subsp. paratuberculosis
ccgggucacgugc

SEQ ID NO: 951598 - RNA, 14 nt, Mycobacterium avium subsp. paratuberculosis
ccgggucaggucga

SEQ ID NO: 951599 - RNA, 17 nt, Mycobacterium avium subsp. paratuberculosis
ccgggucaguucgcggc

SEQ ID NO: 951600 - RNA, 16 nt, Mycobacterium avium subsp. paratuberculosis
ccgggucauccccgug

SEQ ID NO: 951601 - RNA, 14 nt, Mycobacterium avium subsp. paratuberculosis
ccggggugcuggcg

SEQ ID NO: 951602 - RNA, 21 nt, Mycobacterium avium subsp. paratuberculosis
ccggggugggcacgucggcca

SEQ ID NO: 951603 - RNA, 21 nt, Mycobacterium avium subsp. paratuberculosis
ccgggguggugugcaaggcga

SEQ ID NO: 951604 - RNA, 21 nt, Mycobacterium avium subsp. paratuberculosis
ccgggguguagcggauggcga

SEQ ID NO: 951605 - RNA, 16 nt, Mycobacterium avium subsp. paratuberculosis
ccgggguguaggcguc

SEQ ID NO: 951606 - RNA, 13 nt, Mycobacterium avium subsp. paratuberculosis
ccgggucagcacc

SEQ ID NO: 951607 - RNA, 14 nt, Mycobacterium avium subsp. paratuberculosis
ccgggucagcacca

SEQ ID NO: 951608 - RNA, 15 nt, Mycobacterium avium subsp. paratuberculosis
ccgggucagcaccac

SEQ ID NO: 951609 - RNA, 23 nt, Mycobacterium avium subsp. paratuberculosis
ccgggucagcaccaccaacagca

SEQ ID NO: 951610 - RNA, 14 nt, Mycobacterium avium subsp. paratuberculosis
ccgggucgacgccg

SEQ ID NO: 951611 - RNA, 22 nt, Mycobacterium avium subsp. paratuberculosis
ccgggucgcggugggcucggcg

SEQ ID NO: 951612 - RNA, 21 nt, Mycobacterium avium subsp. paratuberculosis
ccgggucggcucggcucggcc

SEQ ID NO: 951613 - RNA, 14 nt, Mycobacterium avium subsp. paratuberculosis
ccgggucguagccg

SEQ ID NO: 951614 - RNA, 17 nt, Mycobacterium avium subsp. paratuberculosis
ccgggucguccgcgacg

SEQ ID NO: 951615 - RNA, 23 nt, Mycobacterium avium subsp. paratuberculosis
ccgggucguccgcgacgcugagc

SEQ ID NO: 951616 - RNA, 12 nt, Mycobacterium avium subsp. paratuberculosis
ccgggucgucgc

SEQ ID NO: 951617 - RNA, 17 nt, Mycobacterium avium subsp. paratuberculosis
ccgggucgucggugccg

SEQ ID NO: 951618 - RNA, 14 nt, Mycobacterium avium subsp. paratuberculosis
ccgggugaacgagg

SEQ ID NO: 951619 - RNA, 22 nt, Mycobacterium avium subsp. paratuberculosis
ccgggugaacgaggccgcgccg

SEQ ID NO: 951620 - RNA, 21 nt, Mycobacterium avium subsp. paratuberculosis
ccgggugacaacggugguggc

SEQ ID NO: 951621 - RNA, 13 nt, Mycobacterium avium subsp. paratuberculosis
ccgggugaccggc

SEQ ID NO: 951622 - RNA, 19 nt, Mycobacterium avium subsp. paratuberculosis
ccgggugaccggcgcgcag

SEQ ID NO: 951623 - RNA, 20 nt, Mycobacterium avium subsp. paratuberculosis
ccgggugaccggcgcgcagc

SEQ ID NO: 951624 - RNA, 21 nt, Mycobacterium avium subsp. paratuberculosis
ccgggugaccggcgcgcagca

SEQ ID NO: 951625 - RNA, 12 nt, Mycobacterium avium subsp. paratuberculosis
ccggguccggcu

SEQ ID NO: 951626 - RNA, 20 nt, Mycobacterium avium subsp. paratuberculosis
ccggguccuugcgccccggc

SEQ ID NO: 951627 - RNA, 21 nt, Mycobacterium avium subsp. paratuberculosis
ccggguccuugcgccccggcg

SEQ ID NO: 951628 - RNA, 14 nt, Mycobacterium avium subsp. paratuberculosis
ccgggucgaacggc

SEQ ID NO: 951629 - RNA, 13 nt, Mycobacterium avium subsp. paratuberculosis
ccgggucgaccgc

SEQ ID NO: 951630 - RNA, 18 nt, Mycobacterium avium subsp. paratuberculosis
ccgggucgaccgccucgg

SEQ ID NO: 951631 - RNA, 14 nt, Mycobacterium avium subsp. paratuberculosis
ccgggucgaccgcg

SEQ ID NO: 951632 - RNA, 14 nt, Mycobacterium avium subsp. paratuberculosis
ccgggucgagcggc

SEQ ID NO: 951633 - RNA, 15 nt, Mycobacterium avium subsp. paratuberculosis
ccgggucgcacgccg

SEQ ID NO: 951634 - RNA, 16 nt, Mycobacterium avium subsp. paratuberculosis
ccgggucgcagcggca

SEQ ID NO: 951635 - RNA, 20 nt, Mycobacterium avium subsp. paratuberculosis
ccgggucgcaggcagcagca

SEQ ID NO: 951636 - RNA, 13 nt, Mycobacterium avium subsp. paratuberculosis
ccgggucgccgau

SEQ ID NO: 951637 - RNA, 12 nt, Mycobacterium avium subsp. paratuberculosis
ccgggucgccgu

SEQ ID NO: 951638 - RNA, 14 nt, Mycobacterium avium subsp. paratuberculosis
ccgggugucgacgc

SEQ ID NO: 951639 - RNA, 15 nt, Mycobacterium avium subsp. paratuberculosis
ccgggugucgacgcc

SEQ ID NO: 951640 - RNA, 19 nt, Mycobacterium avium subsp. paratuberculosis
ccgggugucgacgccgggc

SEQ ID NO: 951641 - RNA, 17 nt, Mycobacterium avium subsp. paratuberculosis
ccgggugugggcgccgu

SEQ ID NO: 951642 - RNA, 19 nt, Mycobacterium avium subsp. paratuberculosis
ccgggugugggcgccguca

SEQ ID NO: 951643 - RNA, 16 nt, Mycobacterium avium subsp. paratuberculosis
ccgggugggcagcccc

SEQ ID NO: 951644 - RNA, 19 nt, Mycobacterium avium subsp. paratuberculosis
ccgggugggcagccccagc

SEQ ID NO: 951645 - RNA, 17 nt, Mycobacterium avium subsp. paratuberculosis
ccgggugggcagcgcga

SEQ ID NO: 951646 - RNA, 18 nt, Mycobacterium avium subsp. paratuberculosis
ccgggugggcagcgcgau

SEQ ID NO: 951647 - RNA, 19 nt, Mycobacterium avium subsp. paratuberculosis
ccgggugggcagcgcgauc

SEQ ID NO: 951648 - RNA, 23 nt, Mycobacterium avium subsp. paratuberculosis
ccgggugggcagcgcgauccgcg

SEQ ID NO: 951649 - RNA, 12 nt, Mycobacterium avium subsp. paratuberculosis
ccggguggccgg

SEQ ID NO: 951650 - RNA, 17 nt, Mycobacterium avium subsp. paratuberculosis
ccggguggccagcacca

SEQ ID NO: 951651 - RNA, 20 nt, Mycobacterium avium subsp. paratuberculosis
ccggguggccagcaccagcc

SEQ ID NO: 951652 - RNA, 15 nt, Mycobacterium avium subsp. paratuberculosis
ccggguggcccgcac

SEQ ID NO: 951653 - RNA, 24 nt, Mycobacterium avium subsp. paratuberculosis
ccggguggcccgcacguagacggu

SEQ ID NO: 951654 - RNA, 18 nt, Mycobacterium avium subsp. paratuberculosis
ccgggugcgcgucgcggu

SEQ ID NO: 951655 - RNA, 14 nt, Mycobacterium avium subsp. paratuberculosis
ccgggugcgggcca

SEQ ID NO: 951656 - RNA, 21 nt, Mycobacterium avium subsp. paratuberculosis
ccggguggaacuggacgccgu

SEQ ID NO: 951657 - RNA, 23 nt, Mycobacterium avium subsp. paratuberculosis
ccggguggaacuggacgccgugg

SEQ ID NO: 951658 - RNA, 15 nt, Mycobacterium avium subsp. paratuberculosis
ccggguggacaccgc

SEQ ID NO: 951659 - RNA, 17 nt, Mycobacterium avium subsp. paratuberculosis
ccggguggacaccgcga

SEQ ID NO: 951660 - RNA, 16 nt, Mycobacterium avium subsp. paratuberculosis
ccggguggacgcccgc

SEQ ID NO: 951661 - RNA, 18 nt, Mycobacterium avium subsp. paratuberculosis
ccgggugcguccagaccg

SEQ ID NO: 951662 - RNA, 19 nt, Mycobacterium avium subsp. paratuberculosis
ccgggugcguccagaccgg

SEQ ID NO: 951663 - RNA, 22 nt, Mycobacterium avium subsp. paratuberculosis
ccgggugcguccagaccggccg

SEQ ID NO: 951664 - RNA, 19 nt, Mycobacterium avium subsp. paratuberculosis
ccgggugcugaacgccugc

SEQ ID NO: 951665 - RNA, 21 nt, Mycobacterium avium subsp. paratuberculosis
ccgggugcugaacgccugccg

SEQ ID NO: 951666 - RNA, 16 nt, Mycobacterium avium subsp. paratuberculosis
ccgggugcugcggcuc

SEQ ID NO: 951667 - RNA, 19 nt, Mycobacterium avium subsp. paratuberculosis
ccgggucugccacgcccac

SEQ ID NO: 951668 - RNA, 20 nt, Mycobacterium avium subsp. paratuberculosis
ccgggugaucaacgcggaca

SEQ ID NO: 951669 - RNA, 18 nt, Mycobacterium avium subsp. paratuberculosis
ccgggugaugucgccgac

SEQ ID NO: 951670 - RNA, 19 nt, Mycobacterium avium subsp. paratuberculosis
ccgggugaugucgccgacc

SEQ ID NO: 951671 - RNA, 17 nt, Mycobacterium avium subsp. paratuberculosis
ccgggugcaggcccagc

SEQ ID NO: 951672 - RNA, 20 nt, Mycobacterium avium subsp. paratuberculosis
ccgggugcaggcccagcugc

SEQ ID NO: 951673 - RNA, 19 nt, Mycobacterium avium subsp. paratuberculosis
ccgggugcccggcugggcg

SEQ ID NO: 951674 - RNA, 22 nt, Mycobacterium avium subsp. paratuberculosis
ccggguguugcggcagggccac

SEQ ID NO: 951675 - RNA, 23 nt, Mycobacterium avium subsp. paratuberculosis
ccggguguuggagccguccgggu

SEQ ID NO: 951676 - RNA, 20 nt, Mycobacterium avium subsp. paratuberculosis
ccgggugggugcucaccccg

SEQ ID NO: 951677 - RNA, 21 nt, Mycobacterium avium subsp. paratuberculosis
ccgggugggugcucaccccgg

SEQ ID NO: 951678 - RNA, 19 nt, Mycobacterium avium subsp. paratuberculosis
ccggguugagcaggucagc

SEQ ID NO: 951679 - RNA, 22 nt, Mycobacterium avium subsp. paratuberculosis
ccggguuggcauccaggaucgc

SEQ ID NO: 951680 - RNA, 18 nt, Mycobacterium avium subsp. paratuberculosis
ccggguugcacaggucga

SEQ ID NO: 951681 - RNA, 18 nt, Mycobacterium avium subsp. paratuberculosis
ccggguuuguccggccag

SEQ ID NO: 951682 - RNA, 21 nt, Mycobacterium avium subsp. paratuberculosis
ccggguuuucgggccggucag

SEQ ID NO: 951683 - RNA, 14 nt, Mycobacterium avium subsp. paratuberculosis
ccggguuggcgcgc

SEQ ID NO: 951684 - RNA, 16 nt, Mycobacterium avium subsp. paratuberculosis
ccggguugggcgccug

SEQ ID NO: 951685 - RNA, 22 nt, Mycobacterium avium subsp. paratuberculosis
ccggguugggcgccugcgguga

SEQ ID NO: 951686 - RNA, 23 nt, Mycobacterium avium subsp. paratuberculosis
ccgguacagcgacuccagcgcga

SEQ ID NO: 951687 - RNA, 12 nt, Mycobacterium avium subsp. paratuberculosis
ccgguacagcgc

SEQ ID NO: 951688 - RNA, 18 nt, Mycobacterium avium subsp. paratuberculosis
ccgguacaggucgcugcc

SEQ ID NO: 951689 - RNA, 22 nt, Mycobacterium avium subsp. paratuberculosis
ccgguacaggucgcugcccggc

SEQ ID NO: 951690 - RNA, 15 nt, Mycobacterium avium subsp. paratuberculosis
ccgguacaucgacgc

SEQ ID NO: 951691 - RNA, 18 nt, Mycobacterium avium subsp. paratuberculosis
ccgguacaucgacgcgac

SEQ ID NO: 951692 - RNA, 22 nt, Mycobacterium avium subsp. paratuberculosis
ccgguacaucgacgcgaccggc

SEQ ID NO: 951693 - RNA, 23 nt, Mycobacterium avium subsp. paratuberculosis
ccgguacaucgacgcgaccggcc

SEQ ID NO: 951694 - RNA, 18 nt, Mycobacterium avium subsp. paratuberculosis
ccgguaccacgccgucga

SEQ ID NO: 951695 - RNA, 22 nt, Mycobacterium avium subsp. paratuberculosis
ccgguaccgccggccaggcgac

SEQ ID NO: 951696 - RNA, 15 nt, Mycobacterium avium subsp. paratuberculosis
ccgguagaucgccgg

SEQ ID NO: 951697 - RNA, 18 nt, Mycobacterium avium subsp. paratuberculosis
ccgguagaucgccggauc

SEQ ID NO: 951698 - RNA, 17 nt, Mycobacterium avium subsp. paratuberculosis
ccgguagccagcaccgc

SEQ ID NO: 951699 - RNA, 13 nt, Mycobacterium avium subsp. paratuberculosis
ccgguacggaucg

SEQ ID NO: 951700 - RNA, 19 nt, Mycobacterium avium subsp. paratuberculosis
ccgguacggaucgccggac

SEQ ID NO: 951701 - RNA, 16 nt, Mycobacterium avium subsp. paratuberculosis
ccgguacggccgacgc

SEQ ID NO: 951702 - RNA, 22 nt, Mycobacterium avium subsp. paratuberculosis
ccgguacggcucaacggccggc

SEQ ID NO: 951703 - RNA, 14 nt, Mycobacterium avium subsp. paratuberculosis
ccgguacggcucgu

SEQ ID NO: 951704 - RNA, 18 nt, Mycobacterium avium subsp. paratuberculosis
ccgguagaucagcgccug

SEQ ID NO: 951705 - RNA, 20 nt, Mycobacterium avium subsp. paratuberculosis
ccgguagaucagcgccuggu

SEQ ID NO: 951706 - RNA, 13 nt, Mycobacterium avium subsp. paratuberculosis
ccgguaucgagca

SEQ ID NO: 951707 - RNA, 18 nt, Mycobacterium avium subsp. paratuberculosis
ccgguaucgggucaccgu

SEQ ID NO: 951708 - RNA, 20 nt, Mycobacterium avium subsp. paratuberculosis
ccggucaccaucagcaccgc

SEQ ID NO: 951709 - RNA, 16 nt, Mycobacterium avium subsp. paratuberculosis
ccggucacccaggccg

SEQ ID NO: 951710 - RNA, 13 nt, Mycobacterium avium subsp. paratuberculosis
ccggucaccccgg

SEQ ID NO: 951711 - RNA, 18 nt, Mycobacterium avium subsp. paratuberculosis
ccggucaccccggccauc

SEQ ID NO: 951712 - RNA, 16 nt, Mycobacterium avium subsp. paratuberculosis
ccggucacccgugggc

SEQ ID NO: 951713 - RNA, 16 nt, Mycobacterium avium subsp. paratuberculosis
ccgguauuggccacgc

SEQ ID NO: 951714 - RNA, 18 nt, Mycobacterium avium subsp. paratuberculosis
ccgguauuggccacgcug

SEQ ID NO: 951715 - RNA, 12 nt, Mycobacterium avium subsp. paratuberculosis
ccggucaacgcc

SEQ ID NO: 951716 - RNA, 17 nt, Mycobacterium avium subsp. paratuberculosis
ccggucaacgccgcgcg

SEQ ID NO: 951717 - RNA, 18 nt, Mycobacterium avium subsp. paratuberculosis
ccggucaacgccgcgcgc

SEQ ID NO: 951718 - RNA, 22 nt, Mycobacterium avium subsp. paratuberculosis
ccggucaagcgcuuucgccgaa

SEQ ID NO: 951719 - RNA, 13 nt, Mycobacterium avium subsp. paratuberculosis
ccgguaggccgcc

SEQ ID NO: 951720 - RNA, 14 nt, Mycobacterium avium subsp. paratuberculosis
ccgguaggccgccg

SEQ ID NO: 951721 - RNA, 22 nt, Mycobacterium avium subsp. paratuberculosis
ccgguaggccgccgcgaccguc

SEQ ID NO: 951722 - RNA, 16 nt, Mycobacterium avium subsp. paratuberculosis
ccgguaggccgcgccg

SEQ ID NO: 951723 - RNA, 13 nt, Mycobacterium avium subsp. paratuberculosis
ccgguaggccggc

SEQ ID NO: 951724 - RNA, 16 nt, Mycobacterium avium subsp. paratuberculosis
ccgguaggccggccgc

SEQ ID NO: 951725 - RNA, 17 nt, Mycobacterium avium subsp. paratuberculosis
ccgguaggccggccgca

SEQ ID NO: 951726 - RNA, 14 nt, Mycobacterium avium subsp. paratuberculosis
ccgguaggcgcacc

SEQ ID NO: 951727 - RNA, 18 nt, Mycobacterium avium subsp. paratuberculosis
ccgguaggcgcaccgccg

SEQ ID NO: 951728 - RNA, 19 nt, Mycobacterium avium subsp. paratuberculosis
ccgguaggcgcaccgccgg

SEQ ID NO: 951729 - RNA, 20 nt, Mycobacterium avium subsp. paratuberculosis
ccgguaggcgcaccgccggg

SEQ ID NO: 951730 - RNA, 17 nt, Mycobacterium avium subsp. paratuberculosis
ccgguagggccggucac

SEQ ID NO: 951731 - RNA, 20 nt, Mycobacterium avium subsp. paratuberculosis
ccgguagggccggucaccgg

SEQ ID NO: 951732 - RNA, 21 nt, Mycobacterium avium subsp. paratuberculosis
ccgguagggccggucaccggu

SEQ ID NO: 951733 - RNA, 22 nt, Mycobacterium avium subsp. paratuberculosis
ccgguaggcggccagcgcccgc

SEQ ID NO: 951734 - RNA, 20 nt, Mycobacterium avium subsp. paratuberculosis
ccgguaggugaucgccucga

SEQ ID NO: 951735 - RNA, 22 nt, Mycobacterium avium subsp. paratuberculosis
ccgguaggugaucgccucgacc

SEQ ID NO: 951736 - RNA, 21 nt, Mycobacterium avium subsp. paratuberculosis
ccggucaggcauuccaccgcg

SEQ ID NO: 951737 - RNA, 22 nt, Mycobacterium avium subsp. paratuberculosis
ccggucaggcauuccaccgcgc

SEQ ID NO: 951738 - RNA, 20 nt, Mycobacterium avium subsp. paratuberculosis
ccggucaggaacccggcccg

SEQ ID NO: 951739 - RNA, 19 nt, Mycobacterium avium subsp. paratuberculosis
ccggucagcccccaccgcg

SEQ ID NO: 951740 - RNA, 22 nt, Mycobacterium avium subsp. paratuberculosis
ccggucagcccccaccgcgccg

SEQ ID NO: 951741 - RNA, 16 nt, Mycobacterium avium subsp. paratuberculosis
ccggucagcgccagca

SEQ ID NO: 951742 - RNA, 23 nt, Mycobacterium avium subsp. paratuberculosis
ccggucagcgcgacaucgccggc

SEQ ID NO: 951743 - RNA, 21 nt, Mycobacterium avium subsp. paratuberculosis
ccggucagcgcuccuggccgg

SEQ ID NO: 951744 - RNA, 12 nt, Mycobacterium avium subsp. paratuberculosis
ccggucagcggc

SEQ ID NO: 951745 - RNA, 14 nt, Mycobacterium avium subsp. paratuberculosis
ccggucagcgucca

SEQ ID NO: 951746 - RNA, 13 nt, Mycobacterium avium subsp. paratuberculosis
ccggucagcgugg

SEQ ID NO: 951747 - RNA, 20 nt, Mycobacterium avium subsp. paratuberculosis
ccggucagcguggcgucggc

SEQ ID NO: 951748 - RNA, 12 nt, Mycobacterium avium subsp. paratuberculosis
ccggucagcucg

SEQ ID NO: 951749 - RNA, 17 nt, Mycobacterium avium subsp. paratuberculosis
ccggucagcucgccguc

SEQ ID NO: 951750 - RNA, 12 nt, Mycobacterium avium subsp. paratuberculosis
ccggucagcugg

SEQ ID NO: 951751 - RNA, 15 nt, Mycobacterium avium subsp. paratuberculosis
ccggucagcuggugc

SEQ ID NO: 951752 - RNA, 19 nt, Mycobacterium avium subsp. paratuberculosis
ccggucagcuggugcagau

SEQ ID NO: 951753 - RNA, 18 nt, Mycobacterium avium subsp. paratuberculosis
ccggucagaccccguacc

SEQ ID NO: 951754 - RNA, 18 nt, Mycobacterium avium subsp. paratuberculosis
ccggucagaccuucgcga

SEQ ID NO: 951755 - RNA, 16 nt, Mycobacterium avium subsp. paratuberculosis
ccggucacgcccgggg

SEQ ID NO: 951756 - RNA, 13 nt, Mycobacterium avium subsp. paratuberculosis
ccggucagcaccg

SEQ ID NO: 951757 - RNA, 15 nt, Mycobacterium avium subsp. paratuberculosis
ccggucagcaccgcg

SEQ ID NO: 951758 - RNA, 16 nt, Mycobacterium avium subsp. paratuberculosis
ccggucagcaccgcgc

SEQ ID NO: 951759 - RNA, 17 nt, Mycobacterium avium subsp. paratuberculosis
ccggucagcaccgcgcg

SEQ ID NO: 951760 - RNA, 18 nt, Mycobacterium avium subsp. paratuberculosis
ccggucagcaccgcgcgg

SEQ ID NO: 951761 - RNA, 21 nt, Mycobacterium avium subsp. paratuberculosis
ccggucagcaccgcgcggcgg

SEQ ID NO: 951762 - RNA, 22 nt, Mycobacterium avium subsp. paratuberculosis
ccggucagcacgucggucagcg

SEQ ID NO: 951763 - RNA, 15 nt, Mycobacterium avium subsp. paratuberculosis
ccggucacggcgucg

SEQ ID NO: 951764 - RNA, 17 nt, Mycobacterium avium subsp. paratuberculosis
ccggucacggcgucggc

SEQ ID NO: 951765 - RNA, 14 nt, Mycobacterium avium subsp. paratuberculosis
ccggucacguagcu

SEQ ID NO: 951766 - RNA, 15 nt, Mycobacterium avium subsp. paratuberculosis
ccggucaccggucgc

SEQ ID NO: 951767 - RNA, 14 nt, Mycobacterium avium subsp. paratuberculosis
ccgggcccgcccgc

SEQ ID NO: 951768 - RNA, 20 nt, Mycobacterium avium subsp. paratuberculosis
ccgggcccgcccgcagcggc

SEQ ID NO: 951769 - RNA, 19 nt, Mycobacterium avium subsp. paratuberculosis
ccgggcccgcucaccugcg

SEQ ID NO: 951770 - RNA, 15 nt, Mycobacterium avium subsp. paratuberculosis
ccgggcccgcugcag

SEQ ID NO: 951771 - RNA, 13 nt, Mycobacterium avium subsp. paratuberculosis
ccgggcccggcgc

SEQ ID NO: 951772 - RNA, 14 nt, Mycobacterium avium subsp. paratuberculosis
ccgggcccggcgcc

SEQ ID NO: 951773 - RNA, 15 nt, Mycobacterium avium subsp. paratuberculosis
ccgggcccggcgcca

SEQ ID NO: 951774 - RNA, 16 nt, Mycobacterium avium subsp. paratuberculosis
ccgggcccggcgccaa

SEQ ID NO: 951775 - RNA, 17 nt, Mycobacterium avium subsp. paratuberculosis
ccgggccagcugcucgu

SEQ ID NO: 951776 - RNA, 14 nt, Mycobacterium avium subsp. paratuberculosis
ccgggccaggaccg

SEQ ID NO: 951777 - RNA, 12 nt, Mycobacterium avium subsp. paratuberculosis
ccgggcccacca

SEQ ID NO: 951778 - RNA, 13 nt, Mycobacterium avium subsp. paratuberculosis
ccgggccagcccg

SEQ ID NO: 951779 - RNA, 12 nt, Mycobacterium avium subsp. paratuberculosis
ccgggccagccg

SEQ ID NO: 951780 - RNA, 13 nt, Mycobacterium avium subsp. paratuberculosis
ccgggccagccgg

SEQ ID NO: 951781 - RNA, 13 nt, Mycobacterium avium subsp. paratuberculosis
ccgggccaggucc

SEQ ID NO: 951782 - RNA, 14 nt, Mycobacterium avium subsp. paratuberculosis
ccgggccagguccc

SEQ ID NO: 951783 - RNA, 18 nt, Mycobacterium avium subsp. paratuberculosis
ccgggccaggucccaggc

SEQ ID NO: 951784 - RNA, 14 nt, Mycobacterium avium subsp. paratuberculosis
ccgggccaggucgg

SEQ ID NO: 951785 - RNA, 19 nt, Mycobacterium avium subsp. paratuberculosis
ccgggccaggugugcccgc

SEQ ID NO: 951786 - RNA, 18 nt, Mycobacterium avium subsp. paratuberculosis
ccgggccagguucgcgcc

SEQ ID NO: 951787 - RNA, 13 nt, Mycobacterium avium subsp. paratuberculosis
ccgggccgagcgc

SEQ ID NO: 951788 - RNA, 15 nt, Mycobacterium avium subsp. paratuberculosis
ccgggcccggucguc

SEQ ID NO: 951789 - RNA, 18 nt, Mycobacterium avium subsp. paratuberculosis
ccgggcccggucgucgcc

SEQ ID NO: 951790 - RNA, 21 nt, Mycobacterium avium subsp. paratuberculosis
ccgggcccggucgucgccgga

SEQ ID NO: 951791 - RNA, 17 nt, Mycobacterium avium subsp. paratuberculosis
ccgggccgagcgcgccg

SEQ ID NO: 951792 - RNA, 15 nt, Mycobacterium avium subsp. paratuberculosis
ccgggccgaaggcgg

SEQ ID NO: 951793 - RNA, 20 nt, Mycobacterium avium subsp. paratuberculosis
ccgggccgaaggcggcgccg

SEQ ID NO: 951794 - RNA, 21 nt, Mycobacterium avium subsp. paratuberculosis
ccgggccgcagcucgcccagc

SEQ ID NO: 951795 - RNA, 16 nt, Mycobacterium avium subsp. paratuberculosis
ccgggccgcagggugg

SEQ ID NO: 951796 - RNA, 21 nt, Mycobacterium avium subsp. paratuberculosis
ccgggccgcauccagcgccgc

SEQ ID NO: 951797 - RNA, 15 nt, Mycobacterium avium subsp. paratuberculosis
ccgggccgccacggc

SEQ ID NO: 951798 - RNA, 17 nt, Mycobacterium avium subsp. paratuberculosis
ccgggccgccacggcgc

SEQ ID NO: 951799 - RNA, 14 nt, Mycobacterium avium subsp. paratuberculosis
ccgggccgcccgcg

SEQ ID NO: 951800 - RNA, 18 nt, Mycobacterium avium subsp. paratuberculosis
ccgggccgcccgcgcgug

SEQ ID NO: 951801 - RNA, 21 nt, Mycobacterium avium subsp. paratuberculosis
ccgggccgcccgcgcgugguc

SEQ ID NO: 951802 - RNA, 23 nt, Mycobacterium avium subsp. paratuberculosis
ccgggccgcccgcgcgugguccc

SEQ ID NO: 951803 - RNA, 17 nt, Mycobacterium avium subsp. paratuberculosis
ccgggccgccgaugcgc

SEQ ID NO: 951804 - RNA, 13 nt, Mycobacterium avium subsp. paratuberculosis
ccgggccgccgcg

SEQ ID NO: 951805 - RNA, 14 nt, Mycobacterium avium subsp. paratuberculosis
ccgggccgccgcgg

SEQ ID NO: 951806 - RNA, 14 nt, Mycobacterium avium subsp. paratuberculosis
ccgggcgcccgcgg

SEQ ID NO: 951807 - RNA, 22 nt, Mycobacterium avium subsp. paratuberculosis
ccgggcggcaccgcugccggcc

SEQ ID NO: 951808 - RNA, 12 nt, Mycobacterium avium subsp. paratuberculosis
ccgggcggcagc

SEQ ID NO: 951809 - RNA, 19 nt, Mycobacterium avium subsp. paratuberculosis
ccgggcggcagcacgucgu

SEQ ID NO: 951810 - RNA, 17 nt, Mycobacterium avium subsp. paratuberculosis
ccgggcggacggcaccg

SEQ ID NO: 951811 - RNA, 19 nt, Mycobacterium avium subsp. paratuberculosis
ccgggcggacggcaccgac

SEQ ID NO: 951812 - RNA, 22 nt, Mycobacterium avium subsp. paratuberculosis
ccgggcggacggcaccgacgga

SEQ ID NO: 951813 - RNA, 21 nt, Mycobacterium avium subsp. paratuberculosis
ccgggcgcugcgcgguggcgc

SEQ ID NO: 951814 - RNA, 14 nt, Mycobacterium avium subsp. paratuberculosis
ccgggcgcuggccg

SEQ ID NO: 951815 - RNA, 19 nt, Mycobacterium avium subsp. paratuberculosis
ccgggcgcuggccguggcc

SEQ ID NO: 951816 - RNA, 16 nt, Mycobacterium avium subsp. paratuberculosis
ccgggcgcuggcgaug

SEQ ID NO: 951817 - RNA, 15 nt, Mycobacterium avium subsp. paratuberculosis
ccgggcggccagccg

SEQ ID NO: 951818 - RNA, 16 nt, Mycobacterium avium subsp. paratuberculosis
ccgggcggccagccgc

SEQ ID NO: 951819 - RNA, 19 nt, Mycobacterium avium subsp. paratuberculosis
ccgggcggccagccgcgcg

SEQ ID NO: 951820 - RNA, 21 nt, Mycobacterium avium subsp. paratuberculosis
ccgggcggccagccgcgcggc

SEQ ID NO: 951821 - RNA, 22 nt, Mycobacterium avium subsp. paratuberculosis
ccgggcggccagccgcgcggcg

SEQ ID NO: 951822 - RNA, 14 nt, Mycobacterium avium subsp. paratuberculosis
ccgggcggccagcg

SEQ ID NO: 951823 - RNA, 17 nt, Mycobacterium avium subsp. paratuberculosis
ccgggcggccagcgugg

SEQ ID NO: 951824 - RNA, 20 nt, Mycobacterium avium subsp. paratuberculosis
ccgggcggccagcguggcgc

SEQ ID NO: 951825 - RNA, 22 nt, Mycobacterium avium subsp. paratuberculosis
ccgggcaugccguucagcgcgg

SEQ ID NO: 951826 - RNA, 21 nt, Mycobacterium avium subsp. paratuberculosis
ccgggcggcaucgcgcgcggc

SEQ ID NO: 951827 - RNA, 15 nt, Mycobacterium avium subsp. paratuberculosis
ccgggcggcccgcau

SEQ ID NO: 951828 - RNA, 22 nt, Mycobacterium avium subsp. paratuberculosis
ccgggcggcccgccucggcggc

SEQ ID NO: 951829 - RNA, 16 nt, Mycobacterium avium subsp. paratuberculosis
ccgggcgcugagcacg

SEQ ID NO: 951830 - RNA, 19 nt, Mycobacterium avium subsp. paratuberculosis
ccgggcgcgugcacaccgg

SEQ ID NO: 951831 - RNA, 20 nt, Mycobacterium avium subsp. paratuberculosis
ccgggcgcgugcacaccggc

SEQ ID NO: 951832 - RNA, 22 nt, Mycobacterium avium subsp. paratuberculosis
ccgggcgcgggcgccgucgggg

SEQ ID NO: 951833 - RNA, 19 nt, Mycobacterium avium subsp. paratuberculosis
ccgggcgcgacggucacgc

SEQ ID NO: 951834 - RNA, 21 nt, Mycobacterium avium subsp. paratuberculosis
ccgggcgcgcagaucgucgac

SEQ ID NO: 951835 - RNA, 12 nt, Mycobacterium avium subsp. paratuberculosis
ccgggcgcgccc

SEQ ID NO: 951836 - RNA, 13 nt, Mycobacterium avium subsp. paratuberculosis
ccgggcgcgccca

SEQ ID NO: 951837 - RNA, 14 nt, Mycobacterium avium subsp. paratuberculosis
ccgggcgcgcccac

SEQ ID NO: 951838 - RNA, 16 nt, Mycobacterium avium subsp. paratuberculosis
ccgggcgcgcccaccc

SEQ ID NO: 951839 - RNA, 22 nt, Mycobacterium avium subsp. paratuberculosis
ccgggcgcgcccacccgcgccg

SEQ ID NO: 951840 - RNA, 24 nt, Mycobacterium avium subsp. paratuberculosis
ccgggcgcgcccacccgcgccggc

SEQ ID NO: 951841 - RNA, 12 nt, Mycobacterium avium subsp. paratuberculosis
ccgggcgccggu

SEQ ID NO: 951842 - RNA, 11 nt, Mycobacterium avium subsp. paratuberculosis
ccgggcgccgg

SEQ ID NO: 951843 - RNA, 12 nt, Mycobacterium avium subsp. paratuberculosis
ccgggcgccggc

SEQ ID NO: 951844 - RNA, 14 nt, Mycobacterium avium subsp. paratuberculosis
ccgggcgccggccg

SEQ ID NO: 951845 - RNA, 16 nt, Mycobacterium avium subsp. paratuberculosis
ccgggcgccggccggc

SEQ ID NO: 951846 - RNA, 18 nt, Mycobacterium avium subsp. paratuberculosis
ccgggcgccggccggcgc

SEQ ID NO: 951847 - RNA, 22 nt, Mycobacterium avium subsp. paratuberculosis
ccgggcgccggccggcgcgugc

SEQ ID NO: 951848 - RNA, 15 nt, Mycobacterium avium subsp. paratuberculosis
ccgggcgccggcgau

SEQ ID NO: 951849 - RNA, 19 nt, Mycobacterium avium subsp. paratuberculosis
ccgggccacgccgacuagc

SEQ ID NO: 951850 - RNA, 15 nt, Mycobacterium avium subsp. paratuberculosis
ccgggcaugcccgua

SEQ ID NO: 951851 - RNA, 21 nt, Mycobacterium avium subsp. paratuberculosis
ccgggccaacgguucggccgc

SEQ ID NO: 951852 - RNA, 23 nt, Mycobacterium avium subsp. paratuberculosis
ccgggccaacgguucggccgcuc

SEQ ID NO: 951853 - RNA, 22 nt, Mycobacterium avium subsp. paratuberculosis
ccgggccaauuacgcugcggcg

SEQ ID NO: 951854 - RNA, 14 nt, Mycobacterium avium subsp. paratuberculosis
ccgggccacacccg

SEQ ID NO: 951855 - RNA, 24 nt, Mycobacterium avium subsp. paratuberculosis
ccgggccacacccgucgacucggc

SEQ ID NO: 951856 - RNA, 13 nt, Mycobacterium avium subsp. paratuberculosis
ccgggccaccacc

SEQ ID NO: 951857 - RNA, 14 nt, Mycobacterium avium subsp. paratuberculosis
ccgggccaccacca

SEQ ID NO: 951858 - RNA, 15 nt, Mycobacterium avium subsp. paratuberculosis
ccgggccaccaccac

SEQ ID NO: 951859 - RNA, 17 nt, Mycobacterium avium subsp. paratuberculosis
ccgggccaccaccacgg

SEQ ID NO: 951860 - RNA, 21 nt, Mycobacterium avium subsp. paratuberculosis
ccgggccaccaccacggccgc

SEQ ID NO: 951861 - RNA, 18 nt, Mycobacterium avium subsp. paratuberculosis
ccgggccacccgcgaucg

SEQ ID NO: 951862 - RNA, 19 nt, Mycobacterium avium subsp. paratuberculosis
ccgggccacccgcgaucgg

SEQ ID NO: 951863 - RNA, 14 nt, Mycobacterium avium subsp. paratuberculosis
ccgggcauggucac

SEQ ID NO: 951864 - RNA, 15 nt, Mycobacterium avium subsp. paratuberculosis
ccgggcaccgcgccc

SEQ ID NO: 951865 - RNA, 17 nt, Mycobacterium avium subsp. paratuberculosis
ccgggcaccgcgcccgc

SEQ ID NO: 951866 - RNA, 18 nt, Mycobacterium avium subsp. paratuberculosis
ccgggcaccgcgcccgcc

SEQ ID NO: 951867 - RNA, 14 nt, Mycobacterium avium subsp. paratuberculosis
ccgggcaccccggu

SEQ ID NO: 951868 - RNA, 17 nt, Mycobacterium avium subsp. paratuberculosis
ccgggcaccccggucac

SEQ ID NO: 951869 - RNA, 14 nt, Mycobacterium avium subsp. paratuberculosis
ccgggcacccgacg

SEQ ID NO: 951870 - RNA, 13 nt, Mycobacterium avium subsp. paratuberculosis
ccgggcacccggc

SEQ ID NO: 951871 - RNA, 15 nt, Mycobacterium avium subsp. paratuberculosis
ccgggcacccggcgc

SEQ ID NO: 951872 - RNA, 21 nt, Mycobacterium avium subsp. paratuberculosis
ccgggcacccggcgcggccgc

SEQ ID NO: 951873 - RNA, 22 nt, Mycobacterium avium subsp. paratuberculosis
ccgggcacgaauucgguggcga

SEQ ID NO: 951874 - RNA, 14 nt, Mycobacterium avium subsp. paratuberculosis
ccgggcacgacggu

SEQ ID NO: 951875 - RNA, 14 nt, Mycobacterium avium subsp. paratuberculosis
ccgggcacgcagcg

SEQ ID NO: 951876 - RNA, 16 nt, Mycobacterium avium subsp. paratuberculosis
ccgggcacgcagcggc

SEQ ID NO: 951877 - RNA, 18 nt, Mycobacterium avium subsp. paratuberculosis
ccgggcacgcagcggcgu

SEQ ID NO: 951878 - RNA, 19 nt, Mycobacterium avium subsp. paratuberculosis
ccgggcacgcagcggcguc

SEQ ID NO: 951879 - RNA, 16 nt, Mycobacterium avium subsp. paratuberculosis
ccgggcaccucggcgu

SEQ ID NO: 951880 - RNA, 17 nt, Mycobacterium avium subsp. paratuberculosis
ccgggcaccucggcguc

SEQ ID NO: 951881 - RNA, 20 nt, Mycobacterium avium subsp. paratuberculosis
ccgggcaccucggcgucggc

SEQ ID NO: 951882 - RNA, 16 nt, Mycobacterium avium subsp. paratuberculosis
ccgggcaccaccaccg

SEQ ID NO: 951883 - RNA, 20 nt, Mycobacterium avium subsp. paratuberculosis
ccgggcaccaccaccgacac

SEQ ID NO: 951884 - RNA, 22 nt, Mycobacterium avium subsp. paratuberculosis
ccgggacaucgucgcgcccagg

SEQ ID NO: 951885 - RNA, 18 nt, Mycobacterium avium subsp. paratuberculosis
ccgggaccagcgcggugc

SEQ ID NO: 951886 - RNA, 17 nt, Mycobacterium avium subsp. paratuberculosis
ccgggacgacggcgccg

SEQ ID NO: 951887 - RNA, 23 nt, Mycobacterium avium subsp. paratuberculosis
ccgggacgacggcgccgcccggg

SEQ ID NO: 951888 - RNA, 12 nt, Mycobacterium avium subsp. paratuberculosis
ccgggacgcggu

SEQ ID NO: 951889 - RNA, 18 nt, Mycobacterium avium subsp. paratuberculosis
ccgggacgggcauccggc

SEQ ID NO: 951890 - RNA, 17 nt, Mycobacterium avium subsp. paratuberculosis
ccgggacgggggugccg

SEQ ID NO: 951891 - RNA, 22 nt, Mycobacterium avium subsp. paratuberculosis
ccgggacgggggugccgaccgc

SEQ ID NO: 951892 - RNA, 23 nt, Mycobacterium avium subsp. paratuberculosis
ccgggacgggggugccgaccgcg

SEQ ID NO: 951893 - RNA, 18 nt, Mycobacterium avium subsp. paratuberculosis
ccgggacggguugcaggc

SEQ ID NO: 951894 - RNA, 13 nt, Mycobacterium avium subsp. paratuberculosis
ccgggaccgucgg

SEQ ID NO: 951895 - RNA, 20 nt, Mycobacterium avium subsp. paratuberculosis
ccgggaccugggucugcggc

SEQ ID NO: 951896 - RNA, 22 nt, Mycobacterium avium subsp. paratuberculosis
ccgggaccugggucugcggccg

SEQ ID NO: 951897 - RNA, 12 nt, Mycobacterium avium subsp. paratuberculosis
ccgggaccggcg

SEQ ID NO: 951898 - RNA, 14 nt, Mycobacterium avium subsp. paratuberculosis
ccgggaccggcguc

SEQ ID NO: 951899 - RNA, 19 nt, Mycobacterium avium subsp. paratuberculosis
ccgggacgucagcccgcgu

SEQ ID NO: 951900 - RNA, 13 nt, Mycobacterium avium subsp. paratuberculosis
ccgggcaccagcg

SEQ ID NO: 951901 - RNA, 15 nt, Mycobacterium avium subsp. paratuberculosis
ccgggcaccagcgac

SEQ ID NO: 951902 - RNA, 18 nt, Mycobacterium avium subsp. paratuberculosis
ccgggcaccagcgacagc

SEQ ID NO: 951903 - RNA, 14 nt, Mycobacterium avium subsp. paratuberculosis
ccgggcaccagcgc

SEQ ID NO: 951904 - RNA, 15 nt, Mycobacterium avium subsp. paratuberculosis
ccgggcaccagcgcg

SEQ ID NO: 951905 - RNA, 20 nt, Mycobacterium avium subsp. paratuberculosis
ccgggcaccagcgcgacggu

SEQ ID NO: 951906 - RNA, 14 nt, Mycobacterium avium subsp. paratuberculosis
ccgggaacgacggu

SEQ ID NO: 951907 - RNA, 22 nt, Mycobacterium avium subsp. paratuberculosis
ccgggaacgacggugcgcccgu

SEQ ID NO: 951908 - RNA, 16 nt, Mycobacterium avium subsp. paratuberculosis
ccgggaagccgcagca

SEQ ID NO: 951909 - RNA, 21 nt, Mycobacterium avium subsp. paratuberculosis
ccgggaagccgcagcaggugc

SEQ ID NO: 951910 - RNA, 18 nt, Mycobacterium avium subsp. paratuberculosis
ccgggaaggcggccgcga

SEQ ID NO: 951911 - RNA, 23 nt, Mycobacterium avium subsp. paratuberculosis
ccgggaaggugguccuggcggug

SEQ ID NO: 951912 - RNA, 21 nt, Mycobacterium avium subsp. paratuberculosis
ccgggaaggugucggccggga

SEQ ID NO: 951913 - RNA, 21 nt, Mycobacterium avium subsp. paratuberculosis
ccgggaaguagggcagcccga

SEQ ID NO: 951914 - RNA, 18 nt, Mycobacterium avium subsp. paratuberculosis
ccgggaagucgucguuga

SEQ ID NO: 951915 - RNA, 16 nt, Mycobacterium avium subsp. paratuberculosis
ccgggaaugucgcgca

SEQ ID NO: 951916 - RNA, 15 nt, Mycobacterium avium subsp. paratuberculosis
ccgggacaccgcugg

SEQ ID NO: 951917 - RNA, 14 nt, Mycobacterium avium subsp. paratuberculosis
ccgggacagcccga

SEQ ID NO: 951918 - RNA, 12 nt, Mycobacterium avium subsp. paratuberculosis
ccgggacagccg

SEQ ID NO: 951919 - RNA, 19 nt, Mycobacterium avium subsp. paratuberculosis
ccgggacagccgcgccgac

SEQ ID NO: 951920 - RNA, 16 nt, Mycobacterium avium subsp. paratuberculosis
ccggcuuuccgacggc

SEQ ID NO: 951921 - RNA, 22 nt, Mycobacterium avium subsp. paratuberculosis
ccggcuuucgaagagccggcgu

SEQ ID NO: 951922 - RNA, 17 nt, Mycobacterium avium subsp. paratuberculosis
ccgggaaaugcugcacc

SEQ ID NO: 951923 - RNA, 18 nt, Mycobacterium avium subsp. paratuberculosis
ccgggaaacccucgacgc

SEQ ID NO: 951924 - RNA, 20 nt, Mycobacterium avium subsp. paratuberculosis
ccgggaaacccucgacgccg

SEQ ID NO: 951925 - RNA, 21 nt, Mycobacterium avium subsp. paratuberculosis
ccgggaaagcgggugaccgac

SEQ ID NO: 951926 - RNA, 21 nt, Mycobacterium avium subsp. paratuberculosis
ccgggaaccagcccaggucgg

SEQ ID NO: 951927 - RNA, 12 nt, Mycobacterium avium subsp. paratuberculosis
ccgggaacgcgg

SEQ ID NO: 951928 - RNA, 15 nt, Mycobacterium avium subsp. paratuberculosis
ccgggaacgcggcga

SEQ ID NO: 951929 - RNA, 12 nt, Mycobacterium avium subsp. paratuberculosis
ccggcuggccgg

SEQ ID NO: 951930 - RNA, 15 nt, Mycobacterium avium subsp. paratuberculosis
ccggcuucucggcgu

SEQ ID NO: 951931 - RNA, 23 nt, Mycobacterium avium subsp. paratuberculosis
ccggcuucucggcgugcccgccg

SEQ ID NO: 951932 - RNA, 22 nt, Mycobacterium avium subsp. paratuberculosis
ccggcuugccccggucccgggg

SEQ ID NO: 951933 - RNA, 16 nt, Mycobacterium avium subsp. paratuberculosis
ccggcugcgcagcgca

SEQ ID NO: 951934 - RNA, 19 nt, Mycobacterium avium subsp. paratuberculosis
ccggcugcgcagcgcagca

SEQ ID NO: 951935 - RNA, 17 nt, Mycobacterium avium subsp. paratuberculosis
ccggcugaaccugcugg

SEQ ID NO: 951936 - RNA, 20 nt, Mycobacterium avium subsp. paratuberculosis
ccggcugaaccugcugggcg

SEQ ID NO: 951937 - RNA, 16 nt, Mycobacterium avium subsp. paratuberculosis
ccggcugaacgccagc

SEQ ID NO: 951938 - RNA, 18 nt, Mycobacterium avium subsp. paratuberculosis
ccggcucguagcuggugc

SEQ ID NO: 951939 - RNA, 23 nt, Mycobacterium avium subsp. paratuberculosis
ccggcucguagcuggugcgcagc

SEQ ID NO: 951940 - RNA, 15 nt, Mycobacterium avium subsp. paratuberculosis
ccggcugcgccgcgc

SEQ ID NO: 951941 - RNA, 16 nt, Mycobacterium avium subsp. paratuberculosis
ccggcugcugcacgac

SEQ ID NO: 951942 - RNA, 23 nt, Mycobacterium avium subsp. paratuberculosis
ccggcugcugcacgacgaccgcg

SEQ ID NO: 951943 - RNA, 18 nt, Mycobacterium avium subsp. paratuberculosis
ccggcuggucggccuggc

SEQ ID NO: 951944 - RNA, 21 nt, Mycobacterium avium subsp. paratuberculosis
ccggcuggucggcggguaugu

SEQ ID NO: 951945 - RNA, 19 nt, Mycobacterium avium subsp. paratuberculosis
ccggcuugccgaucgccgc

SEQ ID NO: 951946 - RNA, 20 nt, Mycobacterium avium subsp. paratuberculosis
ccggcuugccgaucgccgcg

SEQ ID NO: 951947 - RNA, 13 nt, Mycobacterium avium subsp. paratuberculosis
ccggcuggcgggc

SEQ ID NO: 951948 - RNA, 19 nt, Mycobacterium avium subsp. paratuberculosis
ccggcuggcgggcgaucgc

SEQ ID NO: 951949 - RNA, 21 nt, Mycobacterium avium subsp. paratuberculosis
ccggcuggcgggcgaucgccu

SEQ ID NO: 951950 - RNA, 17 nt, Mycobacterium avium subsp. paratuberculosis
ccggcugggcgcgcaac

SEQ ID NO: 951951 - RNA, 12 nt, Mycobacterium avium subsp. paratuberculosis
ccggcuggccga

SEQ ID NO: 951952 - RNA, 16 nt, Mycobacterium avium subsp. paratuberculosis
ccggcuggccgagcgg

SEQ ID NO: 951953 - RNA, 13 nt, Mycobacterium avium subsp. paratuberculosis
ccggcuggccgca

SEQ ID NO: 951954 - RNA, 20 nt, Mycobacterium avium subsp. paratuberculosis
ccggcuggccgcacaccugc

SEQ ID NO: 951955 - RNA, 21 nt, Mycobacterium avium subsp. paratuberculosis
ccggcgaugaucaggccggac

SEQ ID NO: 951956 - RNA, 16 nt, Mycobacterium avium subsp. paratuberculosis
ccggcgauggcgcggc

SEQ ID NO: 951957 - RNA, 18 nt, Mycobacterium avium subsp. paratuberculosis
ccggcgauggcgcggccg

SEQ ID NO: 951958 - RNA, 20 nt, Mycobacterium avium subsp. paratuberculosis
ccggcgauggcgcggccggc

SEQ ID NO: 951959 - RNA, 21 nt, Mycobacterium avium subsp. paratuberculosis
ccggcgauggcgcggccggcc

SEQ ID NO: 951960 - RNA, 18 nt, Mycobacterium avium subsp. paratuberculosis
ccggcgaugguggcgcug

SEQ ID NO: 951961 - RNA, 20 nt, Mycobacterium avium subsp. paratuberculosis
ccggcgaugucgggcaccug

SEQ ID NO: 951962 - RNA, 19 nt, Mycobacterium avium subsp. paratuberculosis
ccggcuaauucgggccgcc

SEQ ID NO: 951963 - RNA, 20 nt, Mycobacterium avium subsp. paratuberculosis
ccggcuaauucgggccgccg

SEQ ID NO: 951964 - RNA, 23 nt, Mycobacterium avium subsp. paratuberculosis
ccggcuaauucgggccgccgcgc

SEQ ID NO: 951965 - RNA, 13 nt, Mycobacterium avium subsp. paratuberculosis
ccggcuaccgcgc

SEQ ID NO: 951966 - RNA, 13 nt, Mycobacterium avium subsp. paratuberculosis
ccggcuaccggcg

SEQ ID NO: 951967 - RNA, 15 nt, Mycobacterium avium subsp. paratuberculosis
ccggcuaccggcgcu

SEQ ID NO: 951968 - RNA, 16 nt, Mycobacterium avium subsp. paratuberculosis
ccggcuaccggcgcug

SEQ ID NO: 951969 - RNA, 22 nt, Mycobacterium avium subsp. paratuberculosis
ccggcgaugcagaucaccacgg

SEQ ID NO: 951970 - RNA, 20 nt, Mycobacterium avium subsp. paratuberculosis
ccggcgaugccagcgcaccg

SEQ ID NO: 951971 - RNA, 21 nt, Mycobacterium avium subsp. paratuberculosis
ccggcgaugccagcgcaccgg

SEQ ID NO: 951972 - RNA, 17 nt, Mycobacterium avium subsp. paratuberculosis
ccggcgaugcccgugau

SEQ ID NO: 951973 - RNA, 22 nt, Mycobacterium avium subsp. paratuberculosis
ccggcgaugcccgugaucgcca

SEQ ID NO: 951974 - RNA, 15 nt, Mycobacterium avium subsp. paratuberculosis
ccggcgaugccgagc

SEQ ID NO: 951975 - RNA, 18 nt, Mycobacterium avium subsp. paratuberculosis
ccggcgaugcgcacgucg

SEQ ID NO: 951976 - RNA, 19 nt, Mycobacterium avium subsp. paratuberculosis
ccggcgaugcgcacgucgg

SEQ ID NO: 951977 - RNA, 21 nt, Mycobacterium avium subsp. paratuberculosis
ccggcgaugcgcacgucggcc

SEQ ID NO: 951978 - RNA, 23 nt, Mycobacterium avium subsp. paratuberculosis
ccggcgaugcgcacgucggccgc

SEQ ID NO: 951979 - RNA, 13 nt, Mycobacterium avium subsp. paratuberculosis
ccggcgaugaccg

SEQ ID NO: 951980 - RNA, 18 nt, Mycobacterium avium subsp. paratuberculosis
ccggcgaucucgucgcgc

SEQ ID NO: 951981 - RNA, 21 nt, Mycobacterium avium subsp. paratuberculosis
ccggcgaucucgucgcgcagc

SEQ ID NO: 951982 - RNA, 23 nt, Mycobacterium avium subsp. paratuberculosis
ccggcgaucucgucgcgcagcug

SEQ ID NO: 951983 - RNA, 18 nt, Mycobacterium avium subsp. paratuberculosis
ccggcgaugaacacgccg

SEQ ID NO: 951984 - RNA, 19 nt, Mycobacterium avium subsp. paratuberculosis
ccggcgaugaacacgccga

SEQ ID NO: 951985 - RNA, 17 nt, Mycobacterium avium subsp. paratuberculosis
ccggcgauccgcgcggc

SEQ ID NO: 951986 - RNA, 19 nt, Mycobacterium avium subsp. paratuberculosis
ccggcgauccgcgcggcga

SEQ ID NO: 951987 - RNA, 15 nt, Mycobacterium avium subsp. paratuberculosis
ccggcgaucgacguc

SEQ ID NO: 951988 - RNA, 22 nt, Mycobacterium avium subsp. paratuberculosis
ccggcgaucgacgucaccaccg

SEQ ID NO: 951989 - RNA, 16 nt, Mycobacterium avium subsp. paratuberculosis
ccggcgaucgucaggu

SEQ ID NO: 951990 - RNA, 15 nt, Mycobacterium avium subsp. paratuberculosis
ccggcgaucgucgcc

SEQ ID NO: 951991 - RNA, 19 nt, Mycobacterium avium subsp. paratuberculosis
ccggcgaucgucgccguca

SEQ ID NO: 951992 - RNA, 12 nt, Mycobacterium avium subsp. paratuberculosis
ccggcucgggaa

SEQ ID NO: 951993 - RNA, 16 nt, Mycobacterium avium subsp. paratuberculosis
ccggcucgggaacggu

SEQ ID NO: 951994 - RNA, 22 nt, Mycobacterium avium subsp. paratuberculosis
ccggcucgggaacggucagccg

SEQ ID NO: 951995 - RNA, 17 nt, Mycobacterium avium subsp. paratuberculosis
ccggcucgguaugcggc

SEQ ID NO: 951996 - RNA, 21 nt, Mycobacterium avium subsp. paratuberculosis
ccggcucgguaugcggcgacg

SEQ ID NO: 951997 - RNA, 22 nt, Mycobacterium avium subsp. paratuberculosis
ccggcucgguaugcggcgacga

SEQ ID NO: 951998 - RNA, 13 nt, Mycobacterium avium subsp. paratuberculosis
ccggcucggugcc

SEQ ID NO: 951999 - RNA, 15 nt, Mycobacterium avium subsp. paratuberculosis
ccggcucggugcgcc

SEQ ID NO: 952000 - RNA, 16 nt, Mycobacterium avium subsp. paratuberculosis
ccggcucuuggcgacc

SEQ ID NO: 952001 - RNA, 18 nt, Mycobacterium avium subsp. paratuberculosis
ccggcucuuggcgaccuc

SEQ ID NO: 952002 - RNA, 17 nt, Mycobacterium avium subsp. paratuberculosis
ccggcucgcugaucugc

SEQ ID NO: 952003 - RNA, 20 nt, Mycobacterium avium subsp. paratuberculosis
ccggcucgcugaucugcggc

SEQ ID NO: 952004 - RNA, 14 nt, Mycobacterium avium subsp. paratuberculosis
ccggcucgccggcg

SEQ ID NO: 952005 - RNA, 13 nt, Mycobacterium avium subsp. paratuberculosis
ccggcucgccggg

SEQ ID NO: 952006 - RNA, 15 nt, Mycobacterium avium subsp. paratuberculosis
ccggcucgccgggcu

SEQ ID NO: 952007 - RNA, 12 nt, Mycobacterium avium subsp. paratuberculosis
ccggcucgccgu

SEQ ID NO: 952008 - RNA, 15 nt, Mycobacterium avium subsp. paratuberculosis
ccggcucgccguugc

SEQ ID NO: 952009 - RNA, 13 nt, Mycobacterium avium subsp. paratuberculosis
ccggcucgcgggg

SEQ ID NO: 952010 - RNA, 13 nt, Mycobacterium avium subsp. paratuberculosis
ccggcucagcccg

SEQ ID NO: 952011 - RNA, 22 nt, Mycobacterium avium subsp. paratuberculosis
ccggcucagcccgauucagccg

SEQ ID NO: 952012 - RNA, 23 nt, Mycobacterium avium subsp. paratuberculosis
ccggcucagcccggcgcucaccg

SEQ ID NO: 952013 - RNA, 20 nt, Mycobacterium avium subsp. paratuberculosis
ccggcuauucgggccugacc

SEQ ID NO: 952014 - RNA, 22 nt, Mycobacterium avium subsp. paratuberculosis
ccggcucaaaccguugaccacc

SEQ ID NO: 952015 - RNA, 23 nt, Mycobacterium avium subsp. paratuberculosis
ccggcucaaugccuuugccgugg

SEQ ID NO: 952016 - RNA, 20 nt, Mycobacterium avium subsp. paratuberculosis
ccggcuacucggacgccggc

SEQ ID NO: 952017 - RNA, 22 nt, Mycobacterium avium subsp. paratuberculosis
ccggcuacucggacgccggcag

SEQ ID NO: 952018 - RNA, 20 nt, Mycobacterium avium subsp. paratuberculosis
ccggcuagacgcgcagcacg

SEQ ID NO: 952019 - RNA, 18 nt, Mycobacterium avium subsp. paratuberculosis
ccgugaggcccggcgugg

SEQ ID NO: 952020 - RNA, 16 nt, Mycobacterium avium subsp. paratuberculosis
ccgucuuggucucgcc

SEQ ID NO: 952021 - RNA, 19 nt, Mycobacterium avium subsp. paratuberculosis
ccgucuuggucucgccgau

SEQ ID NO: 952022 - RNA, 20 nt, Mycobacterium avium subsp. paratuberculosis
ccgucuuggucucgccgauc

SEQ ID NO: 952023 - RNA, 13 nt, Mycobacterium avium subsp. paratuberculosis
ccgucuuccgggc

SEQ ID NO: 952024 - RNA, 15 nt, Mycobacterium avium subsp. paratuberculosis
ccgucuucggggccg

SEQ ID NO: 952025 - RNA, 16 nt, Mycobacterium avium subsp. paratuberculosis
ccgucuucggggccgc

SEQ ID NO: 952026 - RNA, 20 nt, Mycobacterium avium subsp. paratuberculosis
ccgucuucggggccgccguc

SEQ ID NO: 952027 - RNA, 14 nt, Mycobacterium avium subsp. paratuberculosis
ccgucuucgaccgc

SEQ ID NO: 952028 - RNA, 17 nt, Mycobacterium avium subsp. paratuberculosis
ccgucuccucgaccagc

SEQ ID NO: 952029 - RNA, 21 nt, Mycobacterium avium subsp. paratuberculosis
ccgugaucucgugccgcaccc

SEQ ID NO: 952030 - RNA, 16 nt, Mycobacterium avium subsp. paratuberculosis
ccgugcaccgucgccg

SEQ ID NO: 952031 - RNA, 16 nt, Mycobacterium avium subsp. paratuberculosis
ccgugcacgaucgcgg

SEQ ID NO: 952032 - RNA, 14 nt, Mycobacterium avium subsp. paratuberculosis
ccgugcacgccguc

SEQ ID NO: 952033 - RNA, 16 nt, Mycobacterium avium subsp. paratuberculosis
ccgugcacgccgucgu

SEQ ID NO: 952034 - RNA, 13 nt, Mycobacterium avium subsp. paratuberculosis
ccgugaugccggg

SEQ ID NO: 952035 - RNA, 15 nt, Mycobacterium avium subsp. paratuberculosis
ccgugaugccgggca

SEQ ID NO: 952036 - RNA, 14 nt, Mycobacterium avium subsp. paratuberculosis
ccgugaugcgccgg

SEQ ID NO: 952037 - RNA, 16 nt, Mycobacterium avium subsp. paratuberculosis
ccgugaugcgccggcg

SEQ ID NO: 952038 - RNA, 19 nt, Mycobacterium avium subsp. paratuberculosis
ccgugaguucgcugaccgc

SEQ ID NO: 952039 - RNA, 16 nt, Mycobacterium avium subsp. paratuberculosis
ccgugaucgccacggc

SEQ ID NO: 952040 - RNA, 17 nt, Mycobacterium avium subsp. paratuberculosis
ccgugaucggccagcca

SEQ ID NO: 952041 - RNA, 12 nt, Mycobacterium avium subsp. paratuberculosis
ccgugcagcgcc

SEQ ID NO: 952042 - RNA, 21 nt, Mycobacterium avium subsp. paratuberculosis
ccgugcagcaccucgaagccg

SEQ ID NO: 952043 - RNA, 15 nt, Mycobacterium avium subsp. paratuberculosis
ccgugccggaccgcg

SEQ ID NO: 952044 - RNA, 23 nt, Mycobacterium avium subsp. paratuberculosis
ccgugccgguggaacaguucggu

SEQ ID NO: 952045 - RNA, 18 nt, Mycobacterium avium subsp. paratuberculosis
ccgugcagaacagcacga

SEQ ID NO: 952046 - RNA, 19 nt, Mycobacterium avium subsp. paratuberculosis
ccgugccgucggcgucgac

SEQ ID NO: 952047 - RNA, 22 nt, Mycobacterium avium subsp. paratuberculosis
ccgugccucgccacugggcguc

SEQ ID NO: 952048 - RNA, 17 nt, Mycobacterium avium subsp. paratuberculosis
ccgugcgccgcccacac

SEQ ID NO: 952049 - RNA, 21 nt, Mycobacterium avium subsp. paratuberculosis
ccgugcgccgcccacaccgac

SEQ ID NO: 952050 - RNA, 15 nt, Mycobacterium avium subsp. paratuberculosis
ccgugcgacggcucu

SEQ ID NO: 952051 - RNA, 21 nt, Mycobacterium avium subsp. paratuberculosis
ccgugcgacuugguggccagc

SEQ ID NO: 952052 - RNA, 16 nt, Mycobacterium avium subsp. paratuberculosis
ccgugcggggccucgu

SEQ ID NO: 952053 - RNA, 21 nt, Mycobacterium avium subsp. paratuberculosis
ccgugcggggccucgucgccg

SEQ ID NO: 952054 - RNA, 14 nt, Mycobacterium avium subsp. paratuberculosis
ccgugcggcggcgg

SEQ ID NO: 952055 - RNA, 19 nt, Mycobacterium avium subsp. paratuberculosis
ccgugcggcggcggcgguc

SEQ ID NO: 952056 - RNA, 15 nt, Mycobacterium avium subsp. paratuberculosis
ccgugcgggucgcgc

SEQ ID NO: 952057 - RNA, 16 nt, Mycobacterium avium subsp. paratuberculosis
ccgugcgcgcuggugc

SEQ ID NO: 952058 - RNA, 15 nt, Mycobacterium avium subsp. paratuberculosis
ccgugcgcggcgacc

SEQ ID NO: 952059 - RNA, 16 nt, Mycobacterium avium subsp. paratuberculosis
ccgugcgcggcgacca

SEQ ID NO: 952060 - RNA, 18 nt, Mycobacterium avium subsp. paratuberculosis
ccgugcggcacgccgcag

SEQ ID NO: 952061 - RNA, 19 nt, Mycobacterium avium subsp. paratuberculosis
ccgugcugugcugccugcc

SEQ ID NO: 952062 - RNA, 18 nt, Mycobacterium avium subsp. paratuberculosis
ccgugcuggccaccacgg

SEQ ID NO: 952063 - RNA, 20 nt, Mycobacterium avium subsp. paratuberculosis
ccgugcuggccaccacgggu

SEQ ID NO: 952064 - RNA, 20 nt, Mycobacterium avium subsp. paratuberculosis
ccgugcuggccaucgcgggu

SEQ ID NO: 952065 - RNA, 13 nt, Mycobacterium avium subsp. paratuberculosis
ccgugcugccggc

SEQ ID NO: 952066 - RNA, 16 nt, Mycobacterium avium subsp. paratuberculosis
ccgugcugccggccgg

SEQ ID NO: 952067 - RNA, 18 nt, Mycobacterium avium subsp. paratuberculosis
ccgugcugccggccggca

SEQ ID NO: 952068 - RNA, 19 nt, Mycobacterium avium subsp. paratuberculosis
ccgugcugccggccggcag

SEQ ID NO: 952069 - RNA, 14 nt, Mycobacterium avium subsp. paratuberculosis
ccgugcucggcggc

SEQ ID NO: 952070 - RNA, 15 nt, Mycobacterium avium subsp. paratuberculosis
ccgugcucggcggcg

SEQ ID NO: 952071 - RNA, 17 nt, Mycobacterium avium subsp. paratuberculosis
ccguggaggcguagugc

SEQ ID NO: 952072 - RNA, 21 nt, Mycobacterium avium subsp. paratuberculosis
ccguggaucaucccgaccagc

SEQ ID NO: 952073 - RNA, 13 nt, Mycobacterium avium subsp. paratuberculosis
ccguggacggcga

SEQ ID NO: 952074 - RNA, 18 nt, Mycobacterium avium subsp. paratuberculosis
ccguggacggcgagcggc

SEQ ID NO: 952075 - RNA, 21 nt, Mycobacterium avium subsp. paratuberculosis
ccguggaggacgaggcccgca

SEQ ID NO: 952076 - RNA, 16 nt, Mycobacterium avium subsp. paratuberculosis
ccguggaagucgccgu

SEQ ID NO: 952077 - RNA, 17 nt, Mycobacterium avium subsp. paratuberculosis
ccguggaagucgccguc

SEQ ID NO: 952078 - RNA, 19 nt, Mycobacterium avium subsp. paratuberculosis
ccguggaagucgccguccg

SEQ ID NO: 952079 - RNA, 13 nt, Mycobacterium avium subsp. paratuberculosis
ccguggacccgcc

SEQ ID NO: 952080 - RNA, 16 nt, Mycobacterium avium subsp. paratuberculosis
ccguggacccgccccg

SEQ ID NO: 952081 - RNA, 18 nt, Mycobacterium avium subsp. paratuberculosis
ccguggacccgccccgac

SEQ ID NO: 952082 - RNA, 21 nt, Mycobacterium avium subsp. paratuberculosis
ccguggacccgccccgacagc

SEQ ID NO: 952083 - RNA, 13 nt, Mycobacterium avium subsp. paratuberculosis
ccguggcaggcga

SEQ ID NO: 952084 - RNA, 19 nt, Mycobacterium avium subsp. paratuberculosis
ccguggcaggcgauggugc

SEQ ID NO: 952085 - RNA, 16 nt, Mycobacterium avium subsp. paratuberculosis
ccguggccagcgccag

SEQ ID NO: 952086 - RNA, 15 nt, Mycobacterium avium subsp. paratuberculosis
ccguggcccacggga

SEQ ID NO: 952087 - RNA, 21 nt, Mycobacterium avium subsp. paratuberculosis
ccguggcccacgggaugcggc

SEQ ID NO: 952088 - RNA, 19 nt, Mycobacterium avium subsp. paratuberculosis
ccguggcccauguggccug

SEQ ID NO: 952089 - RNA, 17 nt, Mycobacterium avium subsp. paratuberculosis
ccguggcccgcccagcg

SEQ ID NO: 952090 - RNA, 22 nt, Mycobacterium avium subsp. paratuberculosis
ccguggcccgcccagcgcagca

SEQ ID NO: 952091 - RNA, 17 nt, Mycobacterium avium subsp. paratuberculosis
ccguggcagggccagca

SEQ ID NO: 952092 - RNA, 18 nt, Mycobacterium avium subsp. paratuberculosis
ccguggcagggccagcag

SEQ ID NO: 952093 - RNA, 19 nt, Mycobacterium avium subsp. paratuberculosis
ccguggcugaccacgcucc

SEQ ID NO: 952094 - RNA, 13 nt, Mycobacterium avium subsp. paratuberculosis
ccguggcggcccg

SEQ ID NO: 952095 - RNA, 19 nt, Mycobacterium avium subsp. paratuberculosis
ccguggcggcccgaccagc

SEQ ID NO: 952096 - RNA, 16 nt, Mycobacterium avium subsp. paratuberculosis
ccguggcggcgggcca

SEQ ID NO: 952097 - RNA, 21 nt, Mycobacterium avium subsp. paratuberculosis
ccgucucaggaauuugcggcc

SEQ ID NO: 952098 - RNA, 16 nt, Mycobacterium avium subsp. paratuberculosis
ccgucuccggcgcggu

SEQ ID NO: 952099 - RNA, 20 nt, Mycobacterium avium subsp. paratuberculosis
ccgucguugaaggccugcag

SEQ ID NO: 952100 - RNA, 22 nt, Mycobacterium avium subsp. paratuberculosis
ccgucgugcucggcgagcaccg

SEQ ID NO: 952101 - RNA, 20 nt, Mycobacterium avium subsp. paratuberculosis
ccgucguggguauccgccgc

SEQ ID NO: 952102 - RNA, 21 nt, Mycobacterium avium subsp. paratuberculosis
ccgucguggguauccgccgcc

SEQ ID NO: 952103 - RNA, 16 nt, Mycobacterium avium subsp. paratuberculosis
ccgucgugguggccgc

SEQ ID NO: 952104 - RNA, 18 nt, Mycobacterium avium subsp. paratuberculosis
ccgucucggcgugcucgg

SEQ ID NO: 952105 - RNA, 14 nt, Mycobacterium avium subsp. paratuberculosis
ccgucugcuggccc

SEQ ID NO: 952106 - RNA, 16 nt, Mycobacterium avium subsp. paratuberculosis
ccgucucgucggccgc

SEQ ID NO: 952107 - RNA, 17 nt, Mycobacterium avium subsp. paratuberculosis
ccgucucgucggccgcg

SEQ ID NO: 952108 - RNA, 18 nt, Mycobacterium avium subsp. paratuberculosis
ccgucucgucggccgcga

SEQ ID NO: 952109 - RNA, 17 nt, Mycobacterium avium subsp. paratuberculosis
ccgucucgaccacccgg

SEQ ID NO: 952110 - RNA, 22 nt, Mycobacterium avium subsp. paratuberculosis
ccgucucgaccacccggcgggc

SEQ ID NO: 952111 - RNA, 19 nt, Mycobacterium avium subsp. paratuberculosis
ccgucucgagcuuccgccg

SEQ ID NO: 952112 - RNA, 21 nt, Mycobacterium avium subsp. paratuberculosis
ccgucucgagcuuccgccgag

SEQ ID NO: 952113 - RNA, 17 nt, Mycobacterium avium subsp. paratuberculosis
ccgucgucguuguuggc

SEQ ID NO: 952114 - RNA, 20 nt, Mycobacterium avium subsp. paratuberculosis
ccgucggugcggggcggguu

SEQ ID NO: 952115 - RNA, 14 nt, Mycobacterium avium subsp. paratuberculosis
ccgucgguggccgg

SEQ ID NO: 952116 - RNA, 13 nt, Mycobacterium avium subsp. paratuberculosis
ccgucgguggcgg

SEQ ID NO: 952117 - RNA, 20 nt, Mycobacterium avium subsp. paratuberculosis
ccgucgguggcgguggggcc

SEQ ID NO: 952118 - RNA, 22 nt, Mycobacterium avium subsp. paratuberculosis
ccgucgguggcgguggggccga

SEQ ID NO: 952119 - RNA, 16 nt, Mycobacterium avium subsp. paratuberculosis
ccgucggugggggcca

SEQ ID NO: 952120 - RNA, 21 nt, Mycobacterium avium subsp. paratuberculosis
ccgucggugggggccaggcgg

SEQ ID NO: 952121 - RNA, 19 nt, Mycobacterium avium subsp. paratuberculosis
ccgucgucgucggccgggc

SEQ ID NO: 952122 - RNA, 17 nt, Mycobacterium avium subsp. paratuberculosis
ccgucgucgugcaccac

SEQ ID NO: 952123 - RNA, 16 nt, Mycobacterium avium subsp. paratuberculosis
ccgucgguaucgaggu

SEQ ID NO: 952124 - RNA, 18 nt, Mycobacterium avium subsp. paratuberculosis
ccgucggucccgacgcgg

SEQ ID NO: 952125 - RNA, 21 nt, Mycobacterium avium subsp. paratuberculosis
ccgucggugaaguuggcggcg

SEQ ID NO: 952126 - RNA, 22 nt, Mycobacterium avium subsp. paratuberculosis
ccgucggugucgaagacggucc

SEQ ID NO: 952127 - RNA, 22 nt, Mycobacterium avium subsp. paratuberculosis
ccgucgguuucggucgcgguga

SEQ ID NO: 952128 - RNA, 16 nt, Mycobacterium avium subsp. paratuberculosis
ccgucguacucgaccg

SEQ ID NO: 952129 - RNA, 18 nt, Mycobacterium avium subsp. paratuberculosis
ccgucguacucgaccgcg

SEQ ID NO: 952130 - RNA, 19 nt, Mycobacterium avium subsp. paratuberculosis
ccgucguacucgaccgcga

SEQ ID NO: 952131 - RNA, 21 nt, Mycobacterium avium subsp. paratuberculosis
ccgucguacucgaccgcgacu

SEQ ID NO: 952132 - RNA, 18 nt, Mycobacterium avium subsp. paratuberculosis
ccgucgggucggcgagca

SEQ ID NO: 952133 - RNA, 20 nt, Mycobacterium avium subsp. paratuberculosis
ccgucgggucggcgagcagc

SEQ ID NO: 952134 - RNA, 21 nt, Mycobacterium avium subsp. paratuberculosis
ccgucgggguggggacgacgc

SEQ ID NO: 952135 - RNA, 18 nt, Mycobacterium avium subsp. paratuberculosis
ccgucggggugcggucgg

SEQ ID NO: 952136 - RNA, 15 nt, Mycobacterium avium subsp. paratuberculosis
ccgucggggucgcgc

SEQ ID NO: 952137 - RNA, 19 nt, Mycobacterium avium subsp. paratuberculosis
ccgucggggcgucggcggc

SEQ ID NO: 952138 - RNA, 23 nt, Mycobacterium avium subsp. paratuberculosis
ccgucggggcugaguucggugaa

SEQ ID NO: 952139 - RNA, 13 nt, Mycobacterium avium subsp. paratuberculosis
ccgucggggcccg

SEQ ID NO: 952140 - RNA, 19 nt, Mycobacterium avium subsp. paratuberculosis
ccgucggggcccggcccgg

SEQ ID NO: 952141 - RNA, 22 nt, Mycobacterium avium subsp. paratuberculosis
ccgucggggcccggcccggcga

SEQ ID NO: 952142 - RNA, 22 nt, Mycobacterium avium subsp. paratuberculosis
ccgucgcgccaggaccagcggg

SEQ ID NO: 952143 - RNA, 23 nt, Mycobacterium avium subsp. paratuberculosis
ccgucgcggacccuggccagcac

SEQ ID NO: 952144 - RNA, 13 nt, Mycobacterium avium subsp. paratuberculosis
ccgucgcggcgcg

SEQ ID NO: 952145 - RNA, 22 nt, Mycobacterium avium subsp. paratuberculosis
ccgucgcggcggugcgcagccg

SEQ ID NO: 952146 - RNA, 14 nt, Mycobacterium avium subsp. paratuberculosis
ccgucgcgggagag

SEQ ID NO: 952147 - RNA, 13 nt, Mycobacterium avium subsp. paratuberculosis
ccgucgggccguc

SEQ ID NO: 952148 - RNA, 14 nt, Mycobacterium avium subsp. paratuberculosis
ccgucgggcgcggc

SEQ ID NO: 952149 - RNA, 20 nt, Mycobacterium avium subsp. paratuberculosis
ccgucgggcgggguggccac

SEQ ID NO: 952150 - RNA, 20 nt, Mycobacterium avium subsp. paratuberculosis
ccguccagaucggccagcgc

SEQ ID NO: 952151 - RNA, 17 nt, Mycobacterium avium subsp. paratuberculosis
ccguccacggcgguggg

SEQ ID NO: 952152 - RNA, 15 nt, Mycobacterium avium subsp. paratuberculosis
ccguccacgggucgc

SEQ ID NO: 952153 - RNA, 15 nt, Mycobacterium avium subsp. paratuberculosis
ccguccagcaacgcc

SEQ ID NO: 952154 - RNA, 15 nt, Mycobacterium avium subsp. paratuberculosis
ccgucccggugucgc

SEQ ID NO: 952155 - RNA, 19 nt, Mycobacterium avium subsp. paratuberculosis
ccgucccgguugaccccgg

SEQ ID NO: 952156 - RNA, 22 nt, Mycobacterium avium subsp. paratuberculosis
ccgucccgguugaccccggccc

SEQ ID NO: 952157 - RNA, 17 nt, Mycobacterium avium subsp. paratuberculosis
ccgucccguccgacggc

SEQ ID NO: 952158 - RNA, 12 nt, Mycobacterium avium subsp. paratuberculosis
ccguccgccggc

SEQ ID NO: 952159 - RNA, 23 nt, Mycobacterium avium subsp. paratuberculosis
ccguccgccggcuggcgggcgau

SEQ ID NO: 952160 - RNA, 21 nt, Mycobacterium avium subsp. paratuberculosis
ccguccgaccguugaccgacg

SEQ ID NO: 952161 - RNA, 22 nt, Mycobacterium avium subsp. paratuberculosis
ccguccgaccguugaccgacgc

SEQ ID NO: 952162 - RNA, 19 nt, Mycobacterium avium subsp. paratuberculosis
ccgucccuguucgcgccgg

SEQ ID NO: 952163 - RNA, 20 nt, Mycobacterium avium subsp. paratuberculosis
ccgucccuguucgcgccggu

SEQ ID NO: 952164 - RNA, 20 nt, Mycobacterium avium subsp. paratuberculosis
ccguccgaaaaacgcgucgc

SEQ ID NO: 952165 - RNA, 23 nt, Mycobacterium avium subsp. paratuberculosis
ccguccgaaucguugagcaccac

SEQ ID NO: 952166 - RNA, 13 nt, Mycobacterium avium subsp. paratuberculosis
ccguccggcgaca

SEQ ID NO: 952167 - RNA, 21 nt, Mycobacterium avium subsp. paratuberculosis
ccguccggcgacaugcgcagc

SEQ ID NO: 952168 - RNA, 12 nt, Mycobacterium avium subsp. paratuberculosis
ccguccggcggc

SEQ ID NO: 952169 - RNA, 12 nt, Mycobacterium avium subsp. paratuberculosis
ccguccggccgg

SEQ ID NO: 952170 - RNA, 13 nt, Mycobacterium avium subsp. paratuberculosis
ccguccggccggu

SEQ ID NO: 952171 - RNA, 22 nt, Mycobacterium avium subsp. paratuberculosis
ccguccggccgguuggcggccg

SEQ ID NO: 952172 - RNA, 16 nt, Mycobacterium avium subsp. paratuberculosis
ccgucgauggcgcggc

SEQ ID NO: 952173 - RNA, 18 nt, Mycobacterium avium subsp. paratuberculosis
ccgucgauggcgcggccc

SEQ ID NO: 952174 - RNA, 19 nt, Mycobacterium avium subsp. paratuberculosis
ccgucgauggcgcggccca

SEQ ID NO: 952175 - RNA, 20 nt, Mycobacterium avium subsp. paratuberculosis
ccgucgauuucaaggggccg

SEQ ID NO: 952176 - RNA, 14 nt, Mycobacterium avium subsp. paratuberculosis
ccguccgcgcccac

SEQ ID NO: 952177 - RNA, 15 nt, Mycobacterium avium subsp. paratuberculosis
ccguccgcggcggcc

SEQ ID NO: 952178 - RNA, 16 nt, Mycobacterium avium subsp. paratuberculosis
ccguccgcggcggcca

SEQ ID NO: 952179 - RNA, 17 nt, Mycobacterium avium subsp. paratuberculosis
ccguccgcggcggccag

SEQ ID NO: 952180 - RNA, 19 nt, Mycobacterium avium subsp. paratuberculosis
ccguccggauagccgucgg

SEQ ID NO: 952181 - RNA, 15 nt, Mycobacterium avium subsp. paratuberculosis
ccgucgccccgcacc

SEQ ID NO: 952182 - RNA, 20 nt, Mycobacterium avium subsp. paratuberculosis
ccgucgcccgcccaggccgc

SEQ ID NO: 952183 - RNA, 14 nt, Mycobacterium avium subsp. paratuberculosis
ccgucgccgccgug

SEQ ID NO: 952184 - RNA, 11 nt, Mycobacterium avium subsp. paratuberculosis
ccgucgccgaa

SEQ ID NO: 952185 - RNA, 13 nt, Mycobacterium avium subsp. paratuberculosis
ccgucgccgacca

SEQ ID NO: 952186 - RNA, 13 nt, Mycobacterium avium subsp. paratuberculosis
ccgucgccgauca

SEQ ID NO: 952187 - RNA, 14 nt, Mycobacterium avium subsp. paratuberculosis
ccgucgccgaucag

SEQ ID NO: 952188 - RNA, 20 nt, Mycobacterium avium subsp. paratuberculosis
ccgucgccgaucagcaccag

SEQ ID NO: 952189 - RNA, 14 nt, Mycobacterium avium subsp. paratuberculosis
ccgucgccgcacgc

SEQ ID NO: 952190 - RNA, 20 nt, Mycobacterium avium subsp. paratuberculosis
ccgucgccaccaccgcgccg

SEQ ID NO: 952191 - RNA, 22 nt, Mycobacterium avium subsp. paratuberculosis
ccgucgccaccaccgcgccguc

SEQ ID NO: 952192 - RNA, 14 nt, Mycobacterium avium subsp. paratuberculosis
ccgucgccaccacg

SEQ ID NO: 952193 - RNA, 15 nt, Mycobacterium avium subsp. paratuberculosis
ccgucgccaccacgg

SEQ ID NO: 952194 - RNA, 19 nt, Mycobacterium avium subsp. paratuberculosis
ccgucgccacgaucaccac

SEQ ID NO: 952195 - RNA, 21 nt, Mycobacterium avium subsp. paratuberculosis
ccgucgcacuagguccggcgc

SEQ ID NO: 952196 - RNA, 22 nt, Mycobacterium avium subsp. paratuberculosis
ccgucgcacuagguccggcgcg

SEQ ID NO: 952197 - RNA, 23 nt, Mycobacterium avium subsp. paratuberculosis
ccgucgcacuagguccggcgcga

SEQ ID NO: 952198 - RNA, 15 nt, Mycobacterium avium subsp. paratuberculosis
ccgucgcaucagcuc

SEQ ID NO: 952199 - RNA, 17 nt, Mycobacterium avium subsp. paratuberculosis
ccgucgcaucagcucgg

SEQ ID NO: 952200 - RNA, 12 nt, Mycobacterium avium subsp. paratuberculosis
ccgucgccggac

SEQ ID NO: 952201 - RNA, 18 nt, Mycobacterium avium subsp. paratuberculosis
ccgucgccggcugacugc

SEQ ID NO: 952202 - RNA, 22 nt, Mycobacterium avium subsp. paratuberculosis
ccgucgccgggcgggguggugg

SEQ ID NO: 952203 - RNA, 14 nt, Mycobacterium avium subsp. paratuberculosis
ccgucgcgaucaca

SEQ ID NO: 952204 - RNA, 19 nt, Mycobacterium avium subsp. paratuberculosis
ccgucgcgcaccaccucga

SEQ ID NO: 952205 - RNA, 13 nt, Mycobacterium avium subsp. paratuberculosis
ccgucgcgcaccc

SEQ ID NO: 952206 - RNA, 15 nt, Mycobacterium avium subsp. paratuberculosis
ccgucaucaucaccg

SEQ ID NO: 952207 - RNA, 14 nt, Mycobacterium avium subsp. paratuberculosis
ccgucaucgacacc

SEQ ID NO: 952208 - RNA, 14 nt, Mycobacterium avium subsp. paratuberculosis
ccgucaucgccgac

SEQ ID NO: 952209 - RNA, 17 nt, Mycobacterium avium subsp. paratuberculosis
ccgucagcgccgcccgc

SEQ ID NO: 952210 - RNA, 12 nt, Mycobacterium avium subsp. paratuberculosis
ccgucagccagg

SEQ ID NO: 952211 - RNA, 21 nt, Mycobacterium avium subsp. paratuberculosis
ccgucaccgccgcaccgucgu

SEQ ID NO: 952212 - RNA, 14 nt, Mycobacterium avium subsp. paratuberculosis
ccguccacaccguu

SEQ ID NO: 952213 - RNA, 15 nt, Mycobacterium avium subsp. paratuberculosis
ccguccacccggccc

SEQ ID NO: 952214 - RNA, 14 nt, Mycobacterium avium subsp. paratuberculosis
ccguccaccggcac

SEQ ID NO: 952215 - RNA, 15 nt, Mycobacterium avium subsp. paratuberculosis
ccguccaccggcacg

SEQ ID NO: 952216 - RNA, 21 nt, Mycobacterium avium subsp. paratuberculosis
ccguccaccggcacggcaccg

SEQ ID NO: 952217 - RNA, 13 nt, Mycobacterium avium subsp. paratuberculosis
ccgucaucgcggc

SEQ ID NO: 952218 - RNA, 14 nt, Mycobacterium avium subsp. paratuberculosis
ccgucaucgcggcg

SEQ ID NO: 952219 - RNA, 16 nt, Mycobacterium avium subsp. paratuberculosis
ccgucaucgcggcgaa

SEQ ID NO: 952220 - RNA, 15 nt, Mycobacterium avium subsp. paratuberculosis
ccgucaucggcggaa

SEQ ID NO: 952221 - RNA, 14 nt, Mycobacterium avium subsp. paratuberculosis
ccgucaucuccgac

SEQ ID NO: 952222 - RNA, 24 nt, Mycobacterium avium subsp. paratuberculosis
ccgucaucuccgacucgauguagc

SEQ ID NO: 952223 - RNA, 18 nt, Mycobacterium avium subsp. paratuberculosis
ccgucaucucgguggugg

SEQ ID NO: 952224 - RNA, 15 nt, Mycobacterium avium subsp. paratuberculosis
ccgucaugccguuga

SEQ ID NO: 952225 - RNA, 16 nt, Mycobacterium avium subsp. paratuberculosis
ccgucacugucggcgc

SEQ ID NO: 952226 - RNA, 12 nt, Mycobacterium avium subsp. paratuberculosis
ccgucacgcugg

SEQ ID NO: 952227 - RNA, 16 nt, Mycobacterium avium subsp. paratuberculosis
ccgucacgcuggcgug

SEQ ID NO: 952228 - RNA, 20 nt, Mycobacterium avium subsp. paratuberculosis
ccgucacgcuggcgugacgc

SEQ ID NO: 952229 - RNA, 13 nt, Mycobacterium avium subsp. paratuberculosis
ccgucacggccgu

SEQ ID NO: 952230 - RNA, 14 nt, Mycobacterium avium subsp. paratuberculosis
ccgucacggccguc

SEQ ID NO: 952231 - RNA, 13 nt, Mycobacterium avium subsp. paratuberculosis
ccgucacggcugc

SEQ ID NO: 952232 - RNA, 21 nt, Mycobacterium avium subsp. paratuberculosis
ccgucacgucguugagcacac

SEQ ID NO: 952233 - RNA, 18 nt, Mycobacterium avium subsp. paratuberculosis
ccgucacccagaucgccc

SEQ ID NO: 952234 - RNA, 20 nt, Mycobacterium avium subsp. paratuberculosis
ccgucacccccggcgcgacg

SEQ ID NO: 952235 - RNA, 16 nt, Mycobacterium avium subsp. paratuberculosis
ccgucaccgacggcug

SEQ ID NO: 952236 - RNA, 21 nt, Mycobacterium avium subsp. paratuberculosis
ccgucaccggccauccgcugc

SEQ ID NO: 952237 - RNA, 15 nt, Mycobacterium avium subsp. paratuberculosis
ccgucaccggcugcc

SEQ ID NO: 952238 - RNA, 19 nt, Mycobacterium avium subsp. paratuberculosis
ccgucaccggcugcccgac

SEQ ID NO: 952239 - RNA, 23 nt, Mycobacterium avium subsp. paratuberculosis
ccgucaccggcugcccgacccgc

SEQ ID NO: 952240 - RNA, 15 nt, Mycobacterium avium subsp. paratuberculosis
ccgucaccguggcgg

SEQ ID NO: 952241 - RNA, 18 nt, Mycobacterium avium subsp. paratuberculosis
ccgucaccuucaccccca

SEQ ID NO: 952242 - RNA, 21 nt, Mycobacterium avium subsp. paratuberculosis
ccgucacaccgcggccagcgc

SEQ ID NO: 952243 - RNA, 14 nt, Mycobacterium avium subsp. paratuberculosis
ccgucacaggccgc

SEQ ID NO: 952244 - RNA, 17 nt, Mycobacterium avium subsp. paratuberculosis
ccgucacaggccgccug

SEQ ID NO: 952245 - RNA, 21 nt, Mycobacterium avium subsp. paratuberculosis
ccguagcucgcgccgacccgc

SEQ ID NO: 952246 - RNA, 22 nt, Mycobacterium avium subsp. paratuberculosis
ccguagcucgcgccgacccgcc

SEQ ID NO: 952247 - RNA, 18 nt, Mycobacterium avium subsp. paratuberculosis
ccguagcggucgccccag

SEQ ID NO: 952248 - RNA, 17 nt, Mycobacterium avium subsp. paratuberculosis
ccguagcggugggcgcg

SEQ ID NO: 952249 - RNA, 14 nt, Mycobacterium avium subsp. paratuberculosis
ccguagccggcggu

SEQ ID NO: 952250 - RNA, 13 nt, Mycobacterium avium subsp. paratuberculosis
ccguagcgagcgc

SEQ ID NO: 952251 - RNA, 20 nt, Mycobacterium avium subsp. paratuberculosis
ccguagcgcaacaccgaaag

SEQ ID NO: 952252 - RNA, 14 nt, Mycobacterium avium subsp. paratuberculosis
ccguagaucgucga

SEQ ID NO: 952253 - RNA, 23 nt, Mycobacterium avium subsp. paratuberculosis
ccguagaucgucgagugcucgau

SEQ ID NO: 952254 - RNA, 18 nt, Mycobacterium avium subsp. paratuberculosis
ccguagaucucgcgccgc

SEQ ID NO: 952255 - RNA, 15 nt, Mycobacterium avium subsp. paratuberculosis
ccguagaugccggua

SEQ ID NO: 952256 - RNA, 13 nt, Mycobacterium avium subsp. paratuberculosis
ccguagaucacgc

SEQ ID NO: 952257 - RNA, 21 nt, Mycobacterium avium subsp. paratuberculosis
ccguagaucacgccggugagc

SEQ ID NO: 952258 - RNA, 17 nt, Mycobacterium avium subsp. paratuberculosis
ccgguuggccagguggc

SEQ ID NO: 952259 - RNA, 19 nt, Mycobacterium avium subsp. paratuberculosis
ccgguugccuuuccgcgcg

SEQ ID NO: 952260 - RNA, 23 nt, Mycobacterium avium subsp. paratuberculosis
ccgguugccuuuccgcgcggcgg

SEQ ID NO: 952261 - RNA, 15 nt, Mycobacterium avium subsp. paratuberculosis
ccgguugcggcgaac

SEQ ID NO: 952262 - RNA, 14 nt, Mycobacterium avium subsp. paratuberculosis
ccgguugcgggccg

SEQ ID NO: 952263 - RNA, 17 nt, Mycobacterium avium subsp. paratuberculosis
ccgguugcgguggccga

SEQ ID NO: 952264 - RNA, 21 nt, Mycobacterium avium subsp. paratuberculosis
ccgguugcgguugccccaccc

SEQ ID NO: 952265 - RNA, 15 nt, Mycobacterium avium subsp. paratuberculosis
ccgguugaucacccg

SEQ ID NO: 952266 - RNA, 17 nt, Mycobacterium avium subsp. paratuberculosis
ccgguugauccggaucg

SEQ ID NO: 952267 - RNA, 19 nt, Mycobacterium avium subsp. paratuberculosis
ccgguugauccggaucggg

SEQ ID NO: 952268 - RNA, 16 nt, Mycobacterium avium subsp. paratuberculosis
ccgguugcaccgcgau

SEQ ID NO: 952269 - RNA, 18 nt, Mycobacterium avium subsp. paratuberculosis
ccgguugcccggaagccg

SEQ ID NO: 952270 - RNA, 14 nt, Mycobacterium avium subsp. paratuberculosis
ccguagcggacgac

SEQ ID NO: 952271 - RNA, 13 nt, Mycobacterium avium subsp. paratuberculosis
ccguagcggccca

SEQ ID NO: 952272 - RNA, 17 nt, Mycobacterium avium subsp. paratuberculosis
ccguagcggcucgccac

SEQ ID NO: 952273 - RNA, 14 nt, Mycobacterium avium subsp. paratuberculosis
ccguagucggcggc

SEQ ID NO: 952274 - RNA, 15 nt, Mycobacterium avium subsp. paratuberculosis
ccguagucggcggcg

SEQ ID NO: 952275 - RNA, 15 nt, Mycobacterium avium subsp. paratuberculosis
ccguaggccagguuc

SEQ ID NO: 952276 - RNA, 19 nt, Mycobacterium avium subsp. paratuberculosis
ccguaucggccccggccga

SEQ ID NO: 952277 - RNA, 15 nt, Mycobacterium avium subsp. paratuberculosis
ccguauugccgucgg

SEQ ID NO: 952278 - RNA, 19 nt, Mycobacterium avium subsp. paratuberculosis
ccguauuggcaggcgaugu

SEQ ID NO: 952279 - RNA, 19 nt, Mycobacterium avium subsp. paratuberculosis
ccguauuggguugcggugc

SEQ ID NO: 952280 - RNA, 20 nt, Mycobacterium avium subsp. paratuberculosis
ccguagguugccccacacga

SEQ ID NO: 952281 - RNA, 18 nt, Mycobacterium avium subsp. paratuberculosis
ccgguccaggcgaccggc

SEQ ID NO: 952282 - RNA, 21 nt, Mycobacterium avium subsp. paratuberculosis
ccgguccaggcgaccggcccc

SEQ ID NO: 952283 - RNA, 16 nt, Mycobacterium avium subsp. paratuberculosis
ccgguccaugugccgc

SEQ ID NO: 952284 - RNA, 13 nt, Mycobacterium avium subsp. paratuberculosis
ccgguccccggag

SEQ ID NO: 952285 - RNA, 16 nt, Mycobacterium avium subsp. paratuberculosis
ccgguccccggagucg

SEQ ID NO: 952286 - RNA, 21 nt, Mycobacterium avium subsp. paratuberculosis
ccgguccccggagucgucgaa

SEQ ID NO: 952287 - RNA, 15 nt, Mycobacterium avium subsp. paratuberculosis
ccgguccccggcgac

SEQ ID NO: 952288 - RNA, 12 nt, Mycobacterium avium subsp. paratuberculosis
ccggucccgcgg

SEQ ID NO: 952289 - RNA, 14 nt, Mycobacterium avium subsp. paratuberculosis
ccggucccgcggcg

SEQ ID NO: 952290 - RNA, 14 nt, Mycobacterium avium subsp. paratuberculosis
ccgguccgaccagc

SEQ ID NO: 952291 - RNA, 17 nt, Mycobacterium avium subsp. paratuberculosis
ccgguccgaccagcggc

SEQ ID NO: 952292 - RNA, 12 nt, Mycobacterium avium subsp. paratuberculosis
ccgguccgaccg

SEQ ID NO: 952293 - RNA, 23 nt, Mycobacterium avium subsp. paratuberculosis
ccgguccgaccgccaccacccgg

SEQ ID NO: 952294 - RNA, 13 nt, Mycobacterium avium subsp. paratuberculosis
ccgguccgacggc

SEQ ID NO: 952295 - RNA, 18 nt, Mycobacterium avium subsp. paratuberculosis
ccgguccgaucguccggc

SEQ ID NO: 952296 - RNA, 19 nt, Mycobacterium avium subsp. paratuberculosis
ccgguccgaucguccggcg

SEQ ID NO: 952297 - RNA, 13 nt, Mycobacterium avium subsp. paratuberculosis
ccgguccgcccag

SEQ ID NO: 952298 - RNA, 16 nt, Mycobacterium avium subsp. paratuberculosis
ccgguccgcccagacg

SEQ ID NO: 952299 - RNA, 14 nt, Mycobacterium avium subsp. paratuberculosis
ccgguccgccgccg

SEQ ID NO: 952300 - RNA, 18 nt, Mycobacterium avium subsp. paratuberculosis
ccgguccgccgccggcgg

SEQ ID NO: 952301 - RNA, 12 nt, Mycobacterium avium subsp. paratuberculosis
ccgguccgcggu

SEQ ID NO: 952302 - RNA, 16 nt, Mycobacterium avium subsp. paratuberculosis
ccgguccggcccgggg

SEQ ID NO: 952303 - RNA, 20 nt, Mycobacterium avium subsp. paratuberculosis
ccgguccggcccuggucggc

SEQ ID NO: 952304 - RNA, 15 nt, Mycobacterium avium subsp. paratuberculosis
ccgguccagaucggc

SEQ ID NO: 952305 - RNA, 13 nt, Mycobacterium avium subsp. paratuberculosis
ccgguccagcccg

SEQ ID NO: 952306 - RNA, 14 nt, Mycobacterium avium subsp. paratuberculosis
ccgguccagccgcc

SEQ ID NO: 952307 - RNA, 23 nt, Mycobacterium avium subsp. paratuberculosis
ccgguccaaagacguugaccgcg

SEQ ID NO: 952308 - RNA, 14 nt, Mycobacterium avium subsp. paratuberculosis
ccgguccaccuggc

SEQ ID NO: 952309 - RNA, 18 nt, Mycobacterium avium subsp. paratuberculosis
ccgguccacucgucggcg

SEQ ID NO: 952310 - RNA, 18 nt, Mycobacterium avium subsp. paratuberculosis
ccggucagucggccuugg

SEQ ID NO: 952311 - RNA, 20 nt, Mycobacterium avium subsp. paratuberculosis
ccggucaguucgucggucac

SEQ ID NO: 952312 - RNA, 16 nt, Mycobacterium avium subsp. paratuberculosis
ccggucauaggccgcg

SEQ ID NO: 952313 - RNA, 17 nt, Mycobacterium avium subsp. paratuberculosis
ccggucauaggccgcgc

SEQ ID NO: 952314 - RNA, 16 nt, Mycobacterium avium subsp. paratuberculosis
ccggucauccgggcca

SEQ ID NO: 952315 - RNA, 19 nt, Mycobacterium avium subsp. paratuberculosis
ccggucauccucgccgcgc

SEQ ID NO: 952316 - RNA, 20 nt, Mycobacterium avium subsp. paratuberculosis
ccggucauccucgccgcgcc

SEQ ID NO: 952317 - RNA, 21 nt, Mycobacterium avium subsp. paratuberculosis
ccggucauccucgccgcgcca

SEQ ID NO: 952318 - RNA, 14 nt, Mycobacterium avium subsp. paratuberculosis
ccggugaugccggc

SEQ ID NO: 952319 - RNA, 17 nt, Mycobacterium avium subsp. paratuberculosis
ccggugaugccggcauc

SEQ ID NO: 952320 - RNA, 17 nt, Mycobacterium avium subsp. paratuberculosis
ccggugccgccggcgca

SEQ ID NO: 952321 - RNA, 18 nt, Mycobacterium avium subsp. paratuberculosis
ccggugccgccggcgcau

SEQ ID NO: 952322 - RNA, 18 nt, Mycobacterium avium subsp. paratuberculosis
ccggugaucgccgcccac

SEQ ID NO: 952323 - RNA, 21 nt, Mycobacterium avium subsp. paratuberculosis
ccggugaucgcggcgcugccg

SEQ ID NO: 952324 - RNA, 12 nt, Mycobacterium avium subsp. paratuberculosis
ccggugaucggu

SEQ ID NO: 952325 - RNA, 19 nt, Mycobacterium avium subsp. paratuberculosis
ccggugaugaacgcgccgu

SEQ ID NO: 952326 - RNA, 13 nt, Mycobacterium avium subsp. paratuberculosis
ccggucccgccgg

SEQ ID NO: 952327 - RNA, 14 nt, Mycobacterium avium subsp. paratuberculosis
ccggugagcacgac

SEQ ID NO: 952328 - RNA, 17 nt, Mycobacterium avium subsp. paratuberculosis
ccggugagcacgaccgc

SEQ ID NO: 952329 - RNA, 20 nt, Mycobacterium avium subsp. paratuberculosis
ccggugagcacgaccgccag

SEQ ID NO: 952330 - RNA, 14 nt, Mycobacterium avium subsp. paratuberculosis
ccgguugaccccgg

SEQ ID NO: 952331 - RNA, 17 nt, Mycobacterium avium subsp. paratuberculosis
ccgguucggcggcauag

SEQ ID NO: 952332 - RNA, 18 nt, Mycobacterium avium subsp. paratuberculosis
ccggugugccgaagggca

SEQ ID NO: 952333 - RNA, 16 nt, Mycobacterium avium subsp. paratuberculosis
ccggugugaucgagca

SEQ ID NO: 952334 - RNA, 14 nt, Mycobacterium avium subsp. paratuberculosis
ccggugugcagcca

SEQ ID NO: 952335 - RNA, 20 nt, Mycobacterium avium subsp. paratuberculosis
ccgguucggacacggcgccg

SEQ ID NO: 952336 - RNA, 12 nt, Mycobacterium avium subsp. paratuberculosis
ccggugucggcg

SEQ ID NO: 952337 - RNA, 15 nt, Mycobacterium avium subsp. paratuberculosis
ccggugucggcgacc

SEQ ID NO: 952338 - RNA, 13 nt, Mycobacterium avium subsp. paratuberculosis
ccggugucgagcc

SEQ ID NO: 952339 - RNA, 16 nt, Mycobacterium avium subsp. paratuberculosis
ccggugucgccgucgc

SEQ ID NO: 952340 - RNA, 18 nt, Mycobacterium avium subsp. paratuberculosis
ccggugucgccgucgccg

SEQ ID NO: 952341 - RNA, 20 nt, Mycobacterium avium subsp. paratuberculosis
ccggugucggggucgucgac

SEQ ID NO: 952342 - RNA, 21 nt, Mycobacterium avium subsp. paratuberculosis
ccggugucggggucgucgacg

SEQ ID NO: 952343 - RNA, 23 nt, Mycobacterium avium subsp. paratuberculosis
ccggugucggggucgucgacggc

SEQ ID NO: 952344 - RNA, 23 nt, Mycobacterium avium subsp. paratuberculosis
ccgguguaucccaucagugcggc

SEQ ID NO: 952345 - RNA, 16 nt, Mycobacterium avium subsp. paratuberculosis
ccggugucugaccucg

SEQ ID NO: 952346 - RNA, 17 nt, Mycobacterium avium subsp. paratuberculosis
ccggugcucuccugcuu

SEQ ID NO: 952347 - RNA, 16 nt, Mycobacterium avium subsp. paratuberculosis
ccggugcugacccggu

SEQ ID NO: 952348 - RNA, 20 nt, Mycobacterium avium subsp. paratuberculosis
ccggugcuggucaugccguc

SEQ ID NO: 952349 - RNA, 15 nt, Mycobacterium avium subsp. paratuberculosis
ccggugucacgcugg

SEQ ID NO: 952350 - RNA, 16 nt, Mycobacterium avium subsp. paratuberculosis
ccggugucacgcuggc

SEQ ID NO: 952351 - RNA, 20 nt, Mycobacterium avium subsp. paratuberculosis
ccggugucacgcuggcguga

SEQ ID NO: 952352 - RNA, 15 nt, Mycobacterium avium subsp. paratuberculosis
ccgguguccacgucg

SEQ ID NO: 952353 - RNA, 21 nt, Mycobacterium avium subsp. paratuberculosis
ccgguguccacgucgcccagc

SEQ ID NO: 952354 - RNA, 24 nt, Mycobacterium avium subsp. paratuberculosis
ccggugcucccccggaccugccgg

SEQ ID NO: 952355 - RNA, 17 nt, Mycobacterium avium subsp. paratuberculosis
ccggugcguccgccggc

SEQ ID NO: 952356 - RNA, 13 nt, Mycobacterium avium subsp. paratuberculosis
ccggugcggccgc

SEQ ID NO: 952357 - RNA, 21 nt, Mycobacterium avium subsp. paratuberculosis
ccggugcggcggugacgaugu

SEQ ID NO: 952358 - RNA, 15 nt, Mycobacterium avium subsp. paratuberculosis
ccggugcggucggcg

SEQ ID NO: 952359 - RNA, 16 nt, Mycobacterium avium subsp. paratuberculosis
ccggugcggucggcgu

SEQ ID NO: 952360 - RNA, 18 nt, Mycobacterium avium subsp. paratuberculosis
ccggugcggucggcgucg

SEQ ID NO: 952361 - RNA, 17 nt, Mycobacterium avium subsp. paratuberculosis
ccggugcgcgucagccg

SEQ ID NO: 952362 - RNA, 18 nt, Mycobacterium avium subsp. paratuberculosis
ccggugcgcgucagccgu

SEQ ID NO: 952363 - RNA, 20 nt, Mycobacterium avium subsp. paratuberculosis
ccggugcgcgcaccaggccg

SEQ ID NO: 952364 - RNA, 23 nt, Mycobacterium avium subsp. paratuberculosis
ccggugcgccagcgugaacagcg

SEQ ID NO: 952365 - RNA, 13 nt, Mycobacterium avium subsp. paratuberculosis
ccggugcgcccgc

SEQ ID NO: 952366 - RNA, 19 nt, Mycobacterium avium subsp. paratuberculosis
ccggugcgccgaccgcgau

SEQ ID NO: 952367 - RNA, 21 nt, Mycobacterium avium subsp. paratuberculosis
ccggugcgccgaccgcgaucg

SEQ ID NO: 952368 - RNA, 14 nt, Mycobacterium avium subsp. paratuberculosis
ccggugcgacgccg

SEQ ID NO: 952369 - RNA, 20 nt, Mycobacterium avium subsp. paratuberculosis
ccggugccguugaucagggc

SEQ ID NO: 952370 - RNA, 16 nt, Mycobacterium avium subsp. paratuberculosis
ccuccuuggccaggcg

SEQ ID NO: 952371 - RNA, 15 nt, Mycobacterium avium subsp. paratuberculosis
ccucgaaagccgcug

SEQ ID NO: 952372 - RNA, 20 nt, Mycobacterium avium subsp. paratuberculosis
ccucgaacacaucguggcgc

SEQ ID NO: 952373 - RNA, 23 nt, Mycobacterium avium subsp. paratuberculosis
ccucgaacacaucguggcgcauc

SEQ ID NO: 952374 - RNA, 20 nt, Mycobacterium avium subsp. paratuberculosis
ccucgaacaccgcaccgguc

SEQ ID NO: 952375 - RNA, 20 nt, Mycobacterium avium subsp. paratuberculosis
ccuccucuucgcugccgccg

SEQ ID NO: 952376 - RNA, 17 nt, Mycobacterium avium subsp. paratuberculosis
ccuccucguccgcggcg

SEQ ID NO: 952377 - RNA, 19 nt, Mycobacterium avium subsp. paratuberculosis
ccuccucguccgcggcggc

SEQ ID NO: 952378 - RNA, 20 nt, Mycobacterium avium subsp. paratuberculosis
ccuccucguccgcggcggcg

SEQ ID NO: 952379 - RNA, 13 nt, Mycobacterium avium subsp. paratuberculosis
ccucgacggcgaa

SEQ ID NO: 952380 - RNA, 15 nt, Mycobacterium avium subsp. paratuberculosis
ccucgacggcgaagc

SEQ ID NO: 952381 - RNA, 16 nt, Mycobacterium avium subsp. paratuberculosis
ccucgacgccgggcag

SEQ ID NO: 952382 - RNA, 20 nt, Mycobacterium avium subsp. paratuberculosis
ccucgacgccgggcagcgcg

SEQ ID NO: 952383 - RNA, 22 nt, Mycobacterium avium subsp. paratuberculosis
ccucgacgauugucggggccgc

SEQ ID NO: 952384 - RNA, 16 nt, Mycobacterium avium subsp. paratuberculosis
ccucgaagauggucgc

SEQ ID NO: 952385 - RNA, 16 nt, Mycobacterium avium subsp. paratuberculosis
ccucgacgaucagcac

SEQ ID NO: 952386 - RNA, 17 nt, Mycobacterium avium subsp. paratuberculosis
ccucgacgaucagcacg

SEQ ID NO: 952387 - RNA, 19 nt, Mycobacterium avium subsp. paratuberculosis
ccucgaaccucgcggcggc

SEQ ID NO: 952388 - RNA, 16 nt, Mycobacterium avium subsp. paratuberculosis
ccucgaacuugaccgg

SEQ ID NO: 952389 - RNA, 19 nt, Mycobacterium avium subsp. paratuberculosis
ccuccgacuuacggcguga

SEQ ID NO: 952390 - RNA, 17 nt, Mycobacterium avium subsp. paratuberculosis
ccuccgaauccagcgcg

SEQ ID NO: 952391 - RNA, 21 nt, Mycobacterium avium subsp. paratuberculosis
ccuccgaauccagcgcgccgc

SEQ ID NO: 952392 - RNA, 12 nt, Mycobacterium avium subsp. paratuberculosis
ccucccagcgcc

SEQ ID NO: 952393 - RNA, 21 nt, Mycobacterium avium subsp. paratuberculosis
ccuccccauccgcggccaccg

SEQ ID NO: 952394 - RNA, 19 nt, Mycobacterium avium subsp. paratuberculosis
ccucccccgacgccgacac

SEQ ID NO: 952395 - RNA, 15 nt, Mycobacterium avium subsp. paratuberculosis
ccucccgcagcgcca

SEQ ID NO: 952396 - RNA, 12 nt, Mycobacterium avium subsp. paratuberculosis
ccucccggccga

SEQ ID NO: 952397 - RNA, 12 nt, Mycobacterium avium subsp. paratuberculosis
ccucccggcgcc

SEQ ID NO: 952398 - RNA, 13 nt, Mycobacterium avium subsp. paratuberculosis
ccucccggcgcca

SEQ ID NO: 952399 - RNA, 23 nt, Mycobacterium avium subsp. paratuberculosis
ccuccagguucgccgcccagaug

SEQ ID NO: 952400 - RNA, 13 nt, Mycobacterium avium subsp. paratuberculosis
ccucccaccacgg

SEQ ID NO: 952401 - RNA, 20 nt, Mycobacterium avium subsp. paratuberculosis
ccuccagcccggaaucgucg

SEQ ID NO: 952402 - RNA, 12 nt, Mycobacterium avium subsp. paratuberculosis
ccuccaccagcg

SEQ ID NO: 952403 - RNA, 21 nt, Mycobacterium avium subsp. paratuberculosis
ccuccagcuguugacgggccg

SEQ ID NO: 952404 - RNA, 16 nt, Mycobacterium avium subsp. paratuberculosis
ccucagcacggccgcg

SEQ ID NO: 952405 - RNA, 16 nt, Mycobacterium avium subsp. paratuberculosis
ccucacggucggcguc

SEQ ID NO: 952406 - RNA, 18 nt, Mycobacterium avium subsp. paratuberculosis
ccucacggucggcgucca

SEQ ID NO: 952407 - RNA, 14 nt, Mycobacterium avium subsp. paratuberculosis
ccucagcgcgcaac

SEQ ID NO: 952408 - RNA, 18 nt, Mycobacterium avium subsp. paratuberculosis
ccucagcagcugcuggcg

SEQ ID NO: 952409 - RNA, 12 nt, Mycobacterium avium subsp. paratuberculosis
ccucagcccggc

SEQ ID NO: 952410 - RNA, 15 nt, Mycobacterium avium subsp. paratuberculosis
ccucagcccggcagc

SEQ ID NO: 952411 - RNA, 14 nt, Mycobacterium avium subsp. paratuberculosis
ccuccaaugcgccc

SEQ ID NO: 952412 - RNA, 19 nt, Mycobacterium avium subsp. paratuberculosis
ccuccaacccaaccugugc

SEQ ID NO: 952413 - RNA, 11 nt, Mycobacterium avium subsp. paratuberculosis
ccuccaccggc

SEQ ID NO: 952414 - RNA, 12 nt, Mycobacterium avium subsp. paratuberculosis
ccuccaccggca

SEQ ID NO: 952415 - RNA, 18 nt, Mycobacterium avium subsp. paratuberculosis
ccuccagcacgucggggu

SEQ ID NO: 952416 - RNA, 23 nt, Mycobacterium avium subsp. paratuberculosis
ccuccacggugcgcaccgacauc

SEQ ID NO: 952417 - RNA, 14 nt, Mycobacterium avium subsp. paratuberculosis
ccgugguccagccg

SEQ ID NO: 952418 - RNA, 22 nt, Mycobacterium avium subsp. paratuberculosis
ccguggucggcagcaccggcag

SEQ ID NO: 952419 - RNA, 14 nt, Mycobacterium avium subsp. paratuberculosis
ccguggucggcgaa

SEQ ID NO: 952420 - RNA, 15 nt, Mycobacterium avium subsp. paratuberculosis
ccguggucggcgaac

SEQ ID NO: 952421 - RNA, 16 nt, Mycobacterium avium subsp. paratuberculosis
ccguggucggcgaacg

SEQ ID NO: 952422 - RNA, 21 nt, Mycobacterium avium subsp. paratuberculosis
ccguggucggcgaacgcccgg

SEQ ID NO: 952423 - RNA, 17 nt, Mycobacterium avium subsp. paratuberculosis
ccgugggcggcgcgauc

SEQ ID NO: 952424 - RNA, 21 nt, Mycobacterium avium subsp. paratuberculosis
ccgugggcggcgcgaucgucg

SEQ ID NO: 952425 - RNA, 19 nt, Mycobacterium avium subsp. paratuberculosis
ccgugggugccgacgagcu

SEQ ID NO: 952426 - RNA, 16 nt, Mycobacterium avium subsp. paratuberculosis
ccgugggugucggcga

SEQ ID NO: 952427 - RNA, 18 nt, Mycobacterium avium subsp. paratuberculosis
ccgugggugucggcgaag

SEQ ID NO: 952428 - RNA, 22 nt, Mycobacterium avium subsp. paratuberculosis
ccgugggugucggcgaaggugc

SEQ ID NO: 952429 - RNA, 20 nt, Mycobacterium avium subsp. paratuberculosis
ccguggucaacggcaccgac

SEQ ID NO: 952430 - RNA, 13 nt, Mycobacterium avium subsp. paratuberculosis
ccguggugacccg

SEQ ID NO: 952431 - RNA, 14 nt, Mycobacterium avium subsp. paratuberculosis
ccguggugacccgg

SEQ ID NO: 952432 - RNA, 17 nt, Mycobacterium avium subsp. paratuberculosis
ccguggugaucgccgcg

SEQ ID NO: 952433 - RNA, 18 nt, Mycobacterium avium subsp. paratuberculosis
ccguggugaucgccgcgg

SEQ ID NO: 952434 - RNA, 23 nt, Mycobacterium avium subsp. paratuberculosis
ccguggugggcgaacagcagcac

SEQ ID NO: 952435 - RNA, 13 nt, Mycobacterium avium subsp. paratuberculosis
ccucgccggcggc

SEQ ID NO: 952436 - RNA, 14 nt, Mycobacterium avium subsp. paratuberculosis
ccucgccggcggcg

SEQ ID NO: 952437 - RNA, 13 nt, Mycobacterium avium subsp. paratuberculosis
ccucgccgggcgu

SEQ ID NO: 952438 - RNA, 14 nt, Mycobacterium avium subsp. paratuberculosis
ccucgccgggcguc

SEQ ID NO: 952439 - RNA, 24 nt, Mycobacterium avium subsp. paratuberculosis
ccucgcagcgacaaucggcucgcc

SEQ ID NO: 952440 - RNA, 22 nt, Mycobacterium avium subsp. paratuberculosis
ccucgccggcgccgggcgggcg

SEQ ID NO: 952441 - RNA, 20 nt, Mycobacterium avium subsp. paratuberculosis
ccucgccguacgcgccggcc

SEQ ID NO: 952442 - RNA, 12 nt, Mycobacterium avium subsp. paratuberculosis
ccucgccgucga

SEQ ID NO: 952443 - RNA, 17 nt, Mycobacterium avium subsp. paratuberculosis
ccucgccguugccggcc

SEQ ID NO: 952444 - RNA, 21 nt, Mycobacterium avium subsp. paratuberculosis
ccucgccguugccggcccgca

SEQ ID NO: 952445 - RNA, 18 nt, Mycobacterium avium subsp. paratuberculosis
ccucgccuccagcaggga

SEQ ID NO: 952446 - RNA, 16 nt, Mycobacterium avium subsp. paratuberculosis
ccucggauuccgcgga

SEQ ID NO: 952447 - RNA, 18 nt, Mycobacterium avium subsp. paratuberculosis
ccucggaggccaccgcgc

SEQ ID NO: 952448 - RNA, 20 nt, Mycobacterium avium subsp. paratuberculosis
ccucggaggccaccgcgccg

SEQ ID NO: 952449 - RNA, 16 nt, Mycobacterium avium subsp. paratuberculosis
ccucggaggugccgcg

SEQ ID NO: 952450 - RNA, 18 nt, Mycobacterium avium subsp. paratuberculosis
ccucggaggugccgcgcg

SEQ ID NO: 952451 - RNA, 19 nt, Mycobacterium avium subsp. paratuberculosis
ccucggaggugccgcgcgg

SEQ ID NO: 952452 - RNA, 14 nt, Mycobacterium avium subsp. paratuberculosis
ccucgcgcggcacc

SEQ ID NO: 952453 - RNA, 15 nt, Mycobacterium avium subsp. paratuberculosis
ccucgcgcggcacca

SEQ ID NO: 952454 - RNA, 14 nt, Mycobacterium avium subsp. paratuberculosis
ccucgcgcggggcg

SEQ ID NO: 952455 - RNA, 20 nt, Mycobacterium avium subsp. paratuberculosis
ccucgcgcggggcggccgcc

SEQ ID NO: 952456 - RNA, 18 nt, Mycobacterium avium subsp. paratuberculosis
ccucgcgcgucacgcugg

SEQ ID NO: 952457 - RNA, 14 nt, Mycobacterium avium subsp. paratuberculosis
ccucgcgcccggcg

SEQ ID NO: 952458 - RNA, 17 nt, Mycobacterium avium subsp. paratuberculosis
ccucgcgcccggcgccg

SEQ ID NO: 952459 - RNA, 16 nt, Mycobacterium avium subsp. paratuberculosis
ccucgcgccgccacgc

SEQ ID NO: 952460 - RNA, 23 nt, Mycobacterium avium subsp. paratuberculosis
ccucgcgccgcgaucucggcgga

SEQ ID NO: 952461 - RNA, 16 nt, Mycobacterium avium subsp. paratuberculosis
ccucgcgcaucagcac

SEQ ID NO: 952462 - RNA, 14 nt, Mycobacterium avium subsp. paratuberculosis
ccucgcgcagcgcg

SEQ ID NO: 952463 - RNA, 20 nt, Mycobacterium avium subsp. paratuberculosis
ccucgcgcaaugccgccgcg

SEQ ID NO: 952464 - RNA, 18 nt, Mycobacterium avium subsp. paratuberculosis
ccucgcgcaccggcugcc

SEQ ID NO: 952465 - RNA, 16 nt, Mycobacterium avium subsp. paratuberculosis
ccucgauggucgucgg

SEQ ID NO: 952466 - RNA, 15 nt, Mycobacterium avium subsp. paratuberculosis
ccucgaugucggugg

SEQ ID NO: 952467 - RNA, 15 nt, Mycobacterium avium subsp. paratuberculosis
ccucgaugucgucga

SEQ ID NO: 952468 - RNA, 16 nt, Mycobacterium avium subsp. paratuberculosis
ccucgaugccgaccga

SEQ ID NO: 952469 - RNA, 14 nt, Mycobacterium avium subsp. paratuberculosis
ccucgaugcggccg

SEQ ID NO: 952470 - RNA, 15 nt, Mycobacterium avium subsp. paratuberculosis
ccucgauggcccgcu

SEQ ID NO: 952471 - RNA, 17 nt, Mycobacterium avium subsp. paratuberculosis
ccucgauggcggcggcu

SEQ ID NO: 952472 - RNA, 20 nt, Mycobacterium avium subsp. paratuberculosis
ccucgauggcggcggcugcc

SEQ ID NO: 952473 - RNA, 21 nt, Mycobacterium avium subsp. paratuberculosis
ccucgaagaguugggucgcgu

SEQ ID NO: 952474 - RNA, 10 nt, Mycobacterium avium subsp. paratuberculosis
ccucgacggu

SEQ ID NO: 952475 - RNA, 21 nt, Mycobacterium avium subsp. paratuberculosis
ccucgagagucgcuggcgcgc

SEQ ID NO: 952476 - RNA, 18 nt, Mycobacterium avium subsp. paratuberculosis
ccucgagauucugcagcc

SEQ ID NO: 952477 - RNA, 19 nt, Mycobacterium avium subsp. paratuberculosis
ccucgagauucugcagccg

SEQ ID NO: 952478 - RNA, 20 nt, Mycobacterium avium subsp. paratuberculosis
ccucgagcaaccgcaccuug

SEQ ID NO: 952479 - RNA, 17 nt, Mycobacterium avium subsp. paratuberculosis
ccucgagcaacggccgc

SEQ ID NO: 952480 - RNA, 13 nt, Mycobacterium avium subsp. paratuberculosis
ccucgagcaccac

SEQ ID NO: 952481 - RNA, 15 nt, Mycobacterium avium subsp. paratuberculosis
ccucgagcaccacgg

SEQ ID NO: 952482 - RNA, 19 nt, Mycobacterium avium subsp. paratuberculosis
ccucgagcaccacggcccg

SEQ ID NO: 952483 - RNA, 15 nt, Mycobacterium avium subsp. paratuberculosis
ccucgagcaccggcg

SEQ ID NO: 952484 - RNA, 18 nt, Mycobacterium avium subsp. paratuberculosis
ccucgagcaccggcggca

SEQ ID NO: 952485 - RNA, 16 nt, Mycobacterium avium subsp. paratuberculosis
ccucgagcacgcccug

SEQ ID NO: 952486 - RNA, 22 nt, Mycobacterium avium subsp. paratuberculosis
ccucgagcacgcccugcggcug

SEQ ID NO: 952487 - RNA, 20 nt, Mycobacterium avium subsp. paratuberculosis
ccucgagcacucgcgggacg

SEQ ID NO: 952488 - RNA, 13 nt, Mycobacterium avium subsp. paratuberculosis
ccucgagcagcgc

SEQ ID NO: 952489 - RNA, 21 nt, Mycobacterium avium subsp. paratuberculosis
ccucgagccauaaaccggccg

SEQ ID NO: 952490 - RNA, 14 nt, Mycobacterium avium subsp. paratuberculosis
ccucgaugacgccg

SEQ ID NO: 952491 - RNA, 15 nt, Mycobacterium avium subsp. paratuberculosis
ccucgaugacgccgg

SEQ ID NO: 952492 - RNA, 19 nt, Mycobacterium avium subsp. paratuberculosis
ccucgaugacgccggacag

SEQ ID NO: 952493 - RNA, 23 nt, Mycobacterium avium subsp. paratuberculosis
ccucgucgaagccgaucaccggc

SEQ ID NO: 952494 - RNA, 16 nt, Mycobacterium avium subsp. paratuberculosis
ccucgucgaccagggc

SEQ ID NO: 952495 - RNA, 17 nt, Mycobacterium avium subsp. paratuberculosis
ccucgucgaccagggcg

SEQ ID NO: 952496 - RNA, 23 nt, Mycobacterium avium subsp. paratuberculosis
ccucgucgaccagggcgaucacc

SEQ ID NO: 952497 - RNA, 21 nt, Mycobacterium avium subsp. paratuberculosis
ccucgucgggcgccagcccgc

SEQ ID NO: 952498 - RNA, 23 nt, Mycobacterium avium subsp. paratuberculosis
ccucgucgggcgccagcccgccc

SEQ ID NO: 952499 - RNA, 13 nt, Mycobacterium avium subsp. paratuberculosis
ccucgucggggaa

SEQ ID NO: 952500 - RNA, 17 nt, Mycobacterium avium subsp. paratuberculosis
ccucgucgucgaugaac

SEQ ID NO: 952501 - RNA, 19 nt, Mycobacterium avium subsp. paratuberculosis
ccucgugcguagcggcccg

SEQ ID NO: 952502 - RNA, 23 nt, Mycobacterium avium subsp. paratuberculosis
ccucguagacgaagcggccgggg

SEQ ID NO: 952503 - RNA, 14 nt, Mycobacterium avium subsp. paratuberculosis
ccucguagcggccg

SEQ ID NO: 952504 - RNA, 17 nt, Mycobacterium avium subsp. paratuberculosis
ccucguagcggccgcac

SEQ ID NO: 952505 - RNA, 21 nt, Mycobacterium avium subsp. paratuberculosis
ccucguagcggccgcacgcga

SEQ ID NO: 952506 - RNA, 12 nt, Mycobacterium avium subsp. paratuberculosis
ccucgucccagc

SEQ ID NO: 952507 - RNA, 15 nt, Mycobacterium avium subsp. paratuberculosis
ccucgucccagcgca

SEQ ID NO: 952508 - RNA, 15 nt, Mycobacterium avium subsp. paratuberculosis
ccucgguggacgccg

SEQ ID NO: 952509 - RNA, 13 nt, Mycobacterium avium subsp. paratuberculosis
ccucgguggccuc

SEQ ID NO: 952510 - RNA, 16 nt, Mycobacterium avium subsp. paratuberculosis
ccucgguggucgacga

SEQ ID NO: 952511 - RNA, 22 nt, Mycobacterium avium subsp. paratuberculosis
ccucgguggucgacgagcccgc

SEQ ID NO: 952512 - RNA, 17 nt, Mycobacterium avium subsp. paratuberculosis
ccucgguguacagcgcc

SEQ ID NO: 952513 - RNA, 21 nt, Mycobacterium avium subsp. paratuberculosis
ccucggugaugucgacgucgu

SEQ ID NO: 952514 - RNA, 19 nt, Mycobacterium avium subsp. paratuberculosis
ccucggugcggaacaccgc

SEQ ID NO: 952515 - RNA, 22 nt, Mycobacterium avium subsp. paratuberculosis
ccucggugcucuugacggccgc

SEQ ID NO: 952516 - RNA, 21 nt, Mycobacterium avium subsp. paratuberculosis
ccucggugucgaggucgucgg

SEQ ID NO: 952517 - RNA, 16 nt, Mycobacterium avium subsp. paratuberculosis
ccucggugugcugacc

SEQ ID NO: 952518 - RNA, 20 nt, Mycobacterium avium subsp. paratuberculosis
ccucgguucugcagcgagau

SEQ ID NO: 952519 - RNA, 15 nt, Mycobacterium avium subsp. paratuberculosis
ccucggcgucccguc

SEQ ID NO: 952520 - RNA, 14 nt, Mycobacterium avium subsp. paratuberculosis
ccucggcgggccgc

SEQ ID NO: 952521 - RNA, 16 nt, Mycobacterium avium subsp. paratuberculosis
ccucggcgggccgccc

SEQ ID NO: 952522 - RNA, 18 nt, Mycobacterium avium subsp. paratuberculosis
ccucggcgggccgcccgg

SEQ ID NO: 952523 - RNA, 22 nt, Mycobacterium avium subsp. paratuberculosis
ccucggcgggccgcccggcgcg

SEQ ID NO: 952524 - RNA, 16 nt, Mycobacterium avium subsp. paratuberculosis
ccucggcgucggcgcg

SEQ ID NO: 952525 - RNA, 21 nt, Mycobacterium avium subsp. paratuberculosis
ccucggcgucggcgcgugcca

SEQ ID NO: 952526 - RNA, 19 nt, Mycobacterium avium subsp. paratuberculosis
ccucggcggcggcgcgccg

SEQ ID NO: 952527 - RNA, 22 nt, Mycobacterium avium subsp. paratuberculosis
ccucggcggcggcgcgccggcc

SEQ ID NO: 952528 - RNA, 13 nt, Mycobacterium avium subsp. paratuberculosis
ccucggcggccgc

SEQ ID NO: 952529 - RNA, 16 nt, Mycobacterium avium subsp. paratuberculosis
ccucggcggccgcccg

SEQ ID NO: 952530 - RNA, 17 nt, Mycobacterium avium subsp. paratuberculosis
ccucggcggccgcccgg

SEQ ID NO: 952531 - RNA, 15 nt, Mycobacterium avium subsp. paratuberculosis
ccucggcggccgccu

SEQ ID NO: 952532 - RNA, 15 nt, Mycobacterium avium subsp. paratuberculosis
ccucggcggccggga

SEQ ID NO: 952533 - RNA, 16 nt, Mycobacterium avium subsp. paratuberculosis
ccucggcggccgggau

SEQ ID NO: 952534 - RNA, 17 nt, Mycobacterium avium subsp. paratuberculosis
ccucggcggccgggaug

SEQ ID NO: 952535 - RNA, 14 nt, Mycobacterium avium subsp. paratuberculosis
ccucggcggccguc

SEQ ID NO: 952536 - RNA, 16 nt, Mycobacterium avium subsp. paratuberculosis
ccucggcggccgucgg

SEQ ID NO: 952537 - RNA, 13 nt, Mycobacterium avium subsp. paratuberculosis
ccucggcggccuc

SEQ ID NO: 952538 - RNA, 19 nt, Mycobacterium avium subsp. paratuberculosis
ccucggcgcucgccgcgcg

SEQ ID NO: 952539 - RNA, 22 nt, Mycobacterium avium subsp. paratuberculosis
ccucggcgcucgccgcgcggcc

SEQ ID NO: 952540 - RNA, 16 nt, Mycobacterium avium subsp. paratuberculosis
ccucggcgcugcccgc

SEQ ID NO: 952541 - RNA, 19 nt, Mycobacterium avium subsp. paratuberculosis
ccucggcgcugcccgccgc

SEQ ID NO: 952542 - RNA, 20 nt, Mycobacterium avium subsp. paratuberculosis
ccucggcgcugcccgccgcg

SEQ ID NO: 952543 - RNA, 14 nt, Mycobacterium avium subsp. paratuberculosis
ccucggcggcaccg

SEQ ID NO: 952544 - RNA, 17 nt, Mycobacterium avium subsp. paratuberculosis
ccucggcggcaccgccc

SEQ ID NO: 952545 - RNA, 19 nt, Mycobacterium avium subsp. paratuberculosis
ccucggcggcaccgcccgg

SEQ ID NO: 952546 - RNA, 14 nt, Mycobacterium avium subsp. paratuberculosis
ccucggcggccagc

SEQ ID NO: 952547 - RNA, 17 nt, Mycobacterium avium subsp. paratuberculosis
ccucggcggccagcgcg

SEQ ID NO: 952548 - RNA, 17 nt, Mycobacterium avium subsp. paratuberculosis
ccucggccagcaccagc

SEQ ID NO: 952549 - RNA, 16 nt, Mycobacterium avium subsp. paratuberculosis
ccucggccagccccac

SEQ ID NO: 952550 - RNA, 21 nt, Mycobacterium avium subsp. paratuberculosis
ccucggccagccccaccaccg

SEQ ID NO: 952551 - RNA, 14 nt, Mycobacterium avium subsp. paratuberculosis
ccucgcgcagggcc

SEQ ID NO: 952552 - RNA, 17 nt, Mycobacterium avium subsp. paratuberculosis
ccucggccagcucaccg

SEQ ID NO: 952553 - RNA, 17 nt, Mycobacterium avium subsp. paratuberculosis
ccucggcaccgugccgc

SEQ ID NO: 952554 - RNA, 22 nt, Mycobacterium avium subsp. paratuberculosis
ccucggcauaacgcaaccgguc

SEQ ID NO: 952555 - RNA, 15 nt, Mycobacterium avium subsp. paratuberculosis
ccugaaccagcucgu

SEQ ID NO: 952556 - RNA, 13 nt, Mycobacterium avium subsp. paratuberculosis
ccugaacggccgc

SEQ ID NO: 952557 - RNA, 18 nt, Mycobacterium avium subsp. paratuberculosis
ccucuucggcgccggcau

SEQ ID NO: 952558 - RNA, 20 nt, Mycobacterium avium subsp. paratuberculosis
ccucuucggcgccggcaucc

SEQ ID NO: 952559 - RNA, 12 nt, Mycobacterium avium subsp. paratuberculosis
ccucuucgucgg

SEQ ID NO: 952560 - RNA, 19 nt, Mycobacterium avium subsp. paratuberculosis
ccucuucgucggccggcag

SEQ ID NO: 952561 - RNA, 18 nt, Mycobacterium avium subsp. paratuberculosis
ccucuucgaaagccaccc

SEQ ID NO: 952562 - RNA, 13 nt, Mycobacterium avium subsp. paratuberculosis
ccucucacggcgg

SEQ ID NO: 952563 - RNA, 20 nt, Mycobacterium avium subsp. paratuberculosis
ccucguggucccaggaccac

SEQ ID NO: 952564 - RNA, 15 nt, Mycobacterium avium subsp. paratuberculosis
ccucucggcgccguc

SEQ ID NO: 952565 - RNA, 17 nt, Mycobacterium avium subsp. paratuberculosis
ccucucggcgccgucca

SEQ ID NO: 952566 - RNA, 20 nt, Mycobacterium avium subsp. paratuberculosis
ccucucgggaaacgcgucgc

SEQ ID NO: 952567 - RNA, 17 nt, Mycobacterium avium subsp. paratuberculosis
ccugacuucugaaccga

SEQ ID NO: 952568 - RNA, 19 nt, Mycobacterium avium subsp. paratuberculosis
ccugacugagucaagccgg

SEQ ID NO: 952569 - RNA, 17 nt, Mycobacterium avium subsp. paratuberculosis
ccugagggugucggcga

SEQ ID NO: 952570 - RNA, 20 nt, Mycobacterium avium subsp. paratuberculosis
ccugagggugucggcgaucc

SEQ ID NO: 952571 - RNA, 16 nt, Mycobacterium avium subsp. paratuberculosis
ccugaggcccggugag

SEQ ID NO: 952572 - RNA, 22 nt, Mycobacterium avium subsp. paratuberculosis
ccugaggcccggugagccucag

SEQ ID NO: 952573 - RNA, 13 nt, Mycobacterium avium subsp. paratuberculosis
ccugagccgccgg

SEQ ID NO: 952574 - RNA, 16 nt, Mycobacterium avium subsp. paratuberculosis
ccugacccggccgugc

SEQ ID NO: 952575 - RNA, 17 nt, Mycobacterium avium subsp. paratuberculosis
ccugaccgucggccaga

SEQ ID NO: 952576 - RNA, 17 nt, Mycobacterium avium subsp. paratuberculosis
ccugaccgugcuuggcg

SEQ ID NO: 952577 - RNA, 14 nt, Mycobacterium avium subsp. paratuberculosis
ccugaccgcgggug

SEQ ID NO: 952578 - RNA, 18 nt, Mycobacterium avium subsp. paratuberculosis
ccugaccagcggcgcgcc

SEQ ID NO: 952579 - RNA, 19 nt, Mycobacterium avium subsp. paratuberculosis
ccugaccagcggcgcgccg

SEQ ID NO: 952580 - RNA, 21 nt, Mycobacterium avium subsp. paratuberculosis
ccugaccagcggcgcgccggg

SEQ ID NO: 952581 - RNA, 18 nt, Mycobacterium avium subsp. paratuberculosis
ccugacagacccgaucga

SEQ ID NO: 952582 - RNA, 21 nt, Mycobacterium avium subsp. paratuberculosis
ccugaucuucgagacacgcgc

SEQ ID NO: 952583 - RNA, 18 nt, Mycobacterium avium subsp. paratuberculosis
ccugaucgaguuccgcgu

SEQ ID NO: 952584 - RNA, 19 nt, Mycobacterium avium subsp. paratuberculosis
ccugaucgaguuccgcguc

SEQ ID NO: 952585 - RNA, 19 nt, Mycobacterium avium subsp. paratuberculosis
ccugauacgacguccgggc

SEQ ID NO: 952586 - RNA, 22 nt, Mycobacterium avium subsp. paratuberculosis
ccugauacgacguccgggccgc

SEQ ID NO: 952587 - RNA, 17 nt, Mycobacterium avium subsp. paratuberculosis
ccugauuucaucgcggc

SEQ ID NO: 952588 - RNA, 13 nt, Mycobacterium avium subsp. paratuberculosis
ccugaucggccgc

SEQ ID NO: 952589 - RNA, 21 nt, Mycobacterium avium subsp. paratuberculosis
ccugcaaggcccccgccucgc

SEQ ID NO: 952590 - RNA, 23 nt, Mycobacterium avium subsp. paratuberculosis
ccugcaacuggucgugcagcacc

SEQ ID NO: 952591 - RNA, 24 nt, Mycobacterium avium subsp. paratuberculosis
ccugcaacuggucgugcagcaccg

SEQ ID NO: 952592 - RNA, 14 nt, Mycobacterium avium subsp. paratuberculosis
ccugcaccaccaca

SEQ ID NO: 952593 - RNA, 16 nt, Mycobacterium avium subsp. paratuberculosis
ccugcaccaccacacc

SEQ ID NO: 952594 - RNA, 20 nt, Mycobacterium avium subsp. paratuberculosis
ccugcaccaccacacccagc

SEQ ID NO: 952595 - RNA, 22 nt, Mycobacterium avium subsp. paratuberculosis
ccugcaccacgaagcgggcggc

SEQ ID NO: 952596 - RNA, 14 nt, Mycobacterium avium subsp. paratuberculosis
ccugcaccgacugc

SEQ ID NO: 952597 - RNA, 20 nt, Mycobacterium avium subsp. paratuberculosis
ccugcaccggcgacggcggu

SEQ ID NO: 952598 - RNA, 21 nt, Mycobacterium avium subsp. paratuberculosis
ccugcaccggcgacggcgguu

SEQ ID NO: 952599 - RNA, 15 nt, Mycobacterium avium subsp. paratuberculosis
ccugcacccagccgu

SEQ ID NO: 952600 - RNA, 15 nt, Mycobacterium avium subsp. paratuberculosis
ccugccacagcgaca

SEQ ID NO: 952601 - RNA, 20 nt, Mycobacterium avium subsp. paratuberculosis
ccugccagaagaucugccgg

SEQ ID NO: 952602 - RNA, 13 nt, Mycobacterium avium subsp. paratuberculosis
ccugccaccgcga

SEQ ID NO: 952603 - RNA, 18 nt, Mycobacterium avium subsp. paratuberculosis
ccugcaguucgaucaccg

SEQ ID NO: 952604 - RNA, 18 nt, Mycobacterium avium subsp. paratuberculosis
ccugcagggauucggcca

SEQ ID NO: 952605 - RNA, 15 nt, Mycobacterium avium subsp. paratuberculosis
ccugcaggucgcggu

SEQ ID NO: 952606 - RNA, 14 nt, Mycobacterium avium subsp. paratuberculosis
ccugcacggggacg

SEQ ID NO: 952607 - RNA, 19 nt, Mycobacterium avium subsp. paratuberculosis
ccugcacggggacgucguc

SEQ ID NO: 952608 - RNA, 14 nt, Mycobacterium avium subsp. paratuberculosis
ccugcacggugccg

SEQ ID NO: 952609 - RNA, 15 nt, Mycobacterium avium subsp. paratuberculosis
ccugcacggugccgc

SEQ ID NO: 952610 - RNA, 13 nt, Mycobacterium avium subsp. paratuberculosis
ccugcacggugcg

SEQ ID NO: 952611 - RNA, 12 nt, Mycobacterium avium subsp. paratuberculosis
ccugcaccuugc

SEQ ID NO: 952612 - RNA, 23 nt, Mycobacterium avium subsp. paratuberculosis
ccugcacgaaauaaccgcgcggc

SEQ ID NO: 952613 - RNA, 19 nt, Mycobacterium avium subsp. paratuberculosis
ccugcacgaucucggcggu

SEQ ID NO: 952614 - RNA, 14 nt, Mycobacterium avium subsp. paratuberculosis
ccugcagcaccagg

SEQ ID NO: 952615 - RNA, 18 nt, Mycobacterium avium subsp. paratuberculosis
ccugcagcaccgaaccgg

SEQ ID NO: 952616 - RNA, 19 nt, Mycobacterium avium subsp. paratuberculosis
ccugcagcaacucgcgcuc

SEQ ID NO: 952617 - RNA, 12 nt, Mycobacterium avium subsp. paratuberculosis
ccugcacgucgg

SEQ ID NO: 952618 - RNA, 16 nt, Mycobacterium avium subsp. paratuberculosis
ccugcaggaucagcac

SEQ ID NO: 952619 - RNA, 16 nt, Mycobacterium avium subsp. paratuberculosis
ccugcaggcaggccgg

SEQ ID NO: 952620 - RNA, 21 nt, Mycobacterium avium subsp. paratuberculosis
ccugcaggcaggccggcagcc

SEQ ID NO: 952621 - RNA, 13 nt, Mycobacterium avium subsp. paratuberculosis
ccugcagcgcggu

SEQ ID NO: 952622 - RNA, 20 nt, Mycobacterium avium subsp. paratuberculosis
ccugcagcgccguccgcacc

SEQ ID NO: 952623 - RNA, 14 nt, Mycobacterium avium subsp. paratuberculosis
ccugcagcucgccg

SEQ ID NO: 952624 - RNA, 16 nt, Mycobacterium avium subsp. paratuberculosis
ccugcagcucgccggc

SEQ ID NO: 952625 - RNA, 12 nt, Mycobacterium avium subsp. paratuberculosis
ccugcagcucgg

SEQ ID NO: 952626 - RNA, 16 nt, Mycobacterium avium subsp. paratuberculosis
ccugcagcucggugcg

SEQ ID NO: 952627 - RNA, 18 nt, Mycobacterium avium subsp. paratuberculosis
ccugcacuaccccgucga

SEQ ID NO: 952628 - RNA, 23 nt, Mycobacterium avium subsp. paratuberculosis
ccugcagccgccgcgccaccgag

SEQ ID NO: 952629 - RNA, 20 nt, Mycobacterium avium subsp. paratuberculosis
ccugcucgcuugccagccgg

SEQ ID NO: 952630 - RNA, 14 nt, Mycobacterium avium subsp. paratuberculosis
ccugcucggugaug

SEQ ID NO: 952631 - RNA, 22 nt, Mycobacterium avium subsp. paratuberculosis
ccugcucggugaugccgagcgc

SEQ ID NO: 952632 - RNA, 17 nt, Mycobacterium avium subsp. paratuberculosis
ccugcucggccagcggg

SEQ ID NO: 952633 - RNA, 19 nt, Mycobacterium avium subsp. paratuberculosis
ccugcucggccagcgggug

SEQ ID NO: 952634 - RNA, 23 nt, Mycobacterium avium subsp. paratuberculosis
ccugcucgucggggcagccgucg

SEQ ID NO: 952635 - RNA, 17 nt, Mycobacterium avium subsp. paratuberculosis
ccugcucuucgcgcgcg

SEQ ID NO: 952636 - RNA, 23 nt, Mycobacterium avium subsp. paratuberculosis
ccugcucuucgcgcgcggcgugg

SEQ ID NO: 952637 - RNA, 14 nt, Mycobacterium avium subsp. paratuberculosis
ccugcugcucgucg

SEQ ID NO: 952638 - RNA, 16 nt, Mycobacterium avium subsp. paratuberculosis
ccugcugggcggcacc

SEQ ID NO: 952639 - RNA, 16 nt, Mycobacterium avium subsp. paratuberculosis
ccugcugggcgggcag

SEQ ID NO: 952640 - RNA, 18 nt, Mycobacterium avium subsp. paratuberculosis
ccugcuggcguucgccga

SEQ ID NO: 952641 - RNA, 19 nt, Mycobacterium avium subsp. paratuberculosis
ccugcuggcguucgccgag

SEQ ID NO: 952642 - RNA, 16 nt, Mycobacterium avium subsp. paratuberculosis
ccugcuggccgggcuc

SEQ ID NO: 952643 - RNA, 15 nt, Mycobacterium avium subsp. paratuberculosis
ccugcuucagcucgc

SEQ ID NO: 952644 - RNA, 17 nt, Mycobacterium avium subsp. paratuberculosis
ccugcuucagcucgcug

SEQ ID NO: 952645 - RNA, 17 nt, Mycobacterium avium subsp. paratuberculosis
ccugcuucucgccgucg

SEQ ID NO: 952646 - RNA, 16 nt, Mycobacterium avium subsp. paratuberculosis
ccugcuuggcggccug

SEQ ID NO: 952647 - RNA, 16 nt, Mycobacterium avium subsp. paratuberculosis
ccugcuugaacagcac

SEQ ID NO: 952648 - RNA, 17 nt, Mycobacterium avium subsp. paratuberculosis
ccugcuugaacagcacc

SEQ ID NO: 952649 - RNA, 22 nt, Mycobacterium avium subsp. paratuberculosis
ccugcuugaacagcacccccuc

SEQ ID NO: 952650 - RNA, 18 nt, Mycobacterium avium subsp. paratuberculosis
ccugcuugaccgccagac

SEQ ID NO: 952651 - RNA, 14 nt, Mycobacterium avium subsp. paratuberculosis
ccugcuugaccgcg

SEQ ID NO: 952652 - RNA, 16 nt, Mycobacterium avium subsp. paratuberculosis
ccugcuugaccgcgac

SEQ ID NO: 952653 - RNA, 20 nt, Mycobacterium avium subsp. paratuberculosis
ccugcuugagcccgucgacg

SEQ ID NO: 952654 - RNA, 22 nt, Mycobacterium avium subsp. paratuberculosis
ccugcuugaugaugccggccgc

SEQ ID NO: 952655 - RNA, 14 nt, Mycobacterium avium subsp. paratuberculosis
ccugcgggacgccg

SEQ ID NO: 952656 - RNA, 17 nt, Mycobacterium avium subsp. paratuberculosis
ccugcgggaacagcggg

SEQ ID NO: 952657 - RNA, 15 nt, Mycobacterium avium subsp. paratuberculosis
ccugcggcucgucgg

SEQ ID NO: 952658 - RNA, 17 nt, Mycobacterium avium subsp. paratuberculosis
ccugcggcgcggccacc

SEQ ID NO: 952659 - RNA, 20 nt, Mycobacterium avium subsp. paratuberculosis
ccugcggcugguagaugccg

SEQ ID NO: 952660 - RNA, 18 nt, Mycobacterium avium subsp. paratuberculosis
ccugcgggcccaccgcgc

SEQ ID NO: 952661 - RNA, 14 nt, Mycobacterium avium subsp. paratuberculosis
ccugcgggcccagc

SEQ ID NO: 952662 - RNA, 22 nt, Mycobacterium avium subsp. paratuberculosis
ccugcgggcccagcucggugcg

SEQ ID NO: 952663 - RNA, 12 nt, Mycobacterium avium subsp. paratuberculosis
ccugcgggcgcc

SEQ ID NO: 952664 - RNA, 14 nt, Mycobacterium avium subsp. paratuberculosis
ccugcgggcgccgg

SEQ ID NO: 952665 - RNA, 15 nt, Mycobacterium avium subsp. paratuberculosis
ccugcgggcgccggc

SEQ ID NO: 952666 - RNA, 17 nt, Mycobacterium avium subsp. paratuberculosis
ccugcgggcgccggcug

SEQ ID NO: 952667 - RNA, 18 nt, Mycobacterium avium subsp. paratuberculosis
ccugcgggcgccggcugc

SEQ ID NO: 952668 - RNA, 15 nt, Mycobacterium avium subsp. paratuberculosis
ccugcggcggcaguc

SEQ ID NO: 952669 - RNA, 16 nt, Mycobacterium avium subsp. paratuberculosis
ccugcggcccagcgua

SEQ ID NO: 952670 - RNA, 20 nt, Mycobacterium avium subsp. paratuberculosis
ccugcggccccugcggggug

SEQ ID NO: 952671 - RNA, 19 nt, Mycobacterium avium subsp. paratuberculosis
ccugcggcaacagcaccag

SEQ ID NO: 952672 - RNA, 19 nt, Mycobacterium avium subsp. paratuberculosis
ccugcgucacuccucgauc

SEQ ID NO: 952673 - RNA, 15 nt, Mycobacterium avium subsp. paratuberculosis
ccugcguccgauacc

SEQ ID NO: 952674 - RNA, 18 nt, Mycobacterium avium subsp. paratuberculosis
ccugcguccgauaccagc

SEQ ID NO: 952675 - RNA, 17 nt, Mycobacterium avium subsp. paratuberculosis
ccugcguccggcccggc

SEQ ID NO: 952676 - RNA, 19 nt, Mycobacterium avium subsp. paratuberculosis
ccugcguccggcccggcgu

SEQ ID NO: 952677 - RNA, 22 nt, Mycobacterium avium subsp. paratuberculosis
ccugcgggugcaacgugaugcc

SEQ ID NO: 952678 - RNA, 17 nt, Mycobacterium avium subsp. paratuberculosis
ccugcggugaugcgcgg

SEQ ID NO: 952679 - RNA, 18 nt, Mycobacterium avium subsp. paratuberculosis
ccugcggugaugcgcggc

SEQ ID NO: 952680 - RNA, 20 nt, Mycobacterium avium subsp. paratuberculosis
ccugcggugaugcgcggcga

SEQ ID NO: 952681 - RNA, 22 nt, Mycobacterium avium subsp. paratuberculosis
ccugcgguucgucgcggcggcc

SEQ ID NO: 952682 - RNA, 22 nt, Mycobacterium avium subsp. paratuberculosis
ccugcuccucgaaccucgcggc

SEQ ID NO: 952683 - RNA, 13 nt, Mycobacterium avium subsp. paratuberculosis
ccugcucagcggc

SEQ ID NO: 952684 - RNA, 15 nt, Mycobacterium avium subsp. paratuberculosis
ccugcgucugcuugu

SEQ ID NO: 952685 - RNA, 14 nt, Mycobacterium avium subsp. paratuberculosis
ccugcccgggcgcc

SEQ ID NO: 952686 - RNA, 14 nt, Mycobacterium avium subsp. paratuberculosis
ccugcccggucugc

SEQ ID NO: 952687 - RNA, 17 nt, Mycobacterium avium subsp. paratuberculosis
ccugcccggucugcggc

SEQ ID NO: 952688 - RNA, 21 nt, Mycobacterium avium subsp. paratuberculosis
ccugcccgggcccgauggcgg

SEQ ID NO: 952689 - RNA, 17 nt, Mycobacterium avium subsp. paratuberculosis
ccugcccgaagcugagg

SEQ ID NO: 952690 - RNA, 17 nt, Mycobacterium avium subsp. paratuberculosis
ccugcccggcggugccg

SEQ ID NO: 952691 - RNA, 14 nt, Mycobacterium avium subsp. paratuberculosis
ccugcccgcgcagg

SEQ ID NO: 952692 - RNA, 16 nt, Mycobacterium avium subsp. paratuberculosis
ccugcccagcggcacg

SEQ ID NO: 952693 - RNA, 14 nt, Mycobacterium avium subsp. paratuberculosis
ccugccggaugccg

SEQ ID NO: 952694 - RNA, 12 nt, Mycobacterium avium subsp. paratuberculosis
ccugccggccgc

SEQ ID NO: 952695 - RNA, 15 nt, Mycobacterium avium subsp. paratuberculosis
ccugccggccgccgc

SEQ ID NO: 952696 - RNA, 13 nt, Mycobacterium avium subsp. paratuberculosis
ccugccggcgauc

SEQ ID NO: 952697 - RNA, 16 nt, Mycobacterium avium subsp. paratuberculosis
ccugccgggcgucgac

SEQ ID NO: 952698 - RNA, 20 nt, Mycobacterium avium subsp. paratuberculosis
ccugccguucggccagcgcc

SEQ ID NO: 952699 - RNA, 17 nt, Mycobacterium avium subsp. paratuberculosis
ccugccggcgccggauc

SEQ ID NO: 952700 - RNA, 21 nt, Mycobacterium avium subsp. paratuberculosis
ccugccgucaccggccauccg

SEQ ID NO: 952701 - RNA, 15 nt, Mycobacterium avium subsp. paratuberculosis
ccugccgcaacgggc

SEQ ID NO: 952702 - RNA, 18 nt, Mycobacterium avium subsp. paratuberculosis
ccugccgcaacgggccgc

SEQ ID NO: 952703 - RNA, 14 nt, Mycobacterium avium subsp. paratuberculosis
ccugccgcacaccg

SEQ ID NO: 952704 - RNA, 20 nt, Mycobacterium avium subsp. paratuberculosis
ccugcccgucgggcgcggcg

SEQ ID NO: 952705 - RNA, 14 nt, Mycobacterium avium subsp. paratuberculosis
ccugcgccagcagc

SEQ ID NO: 952706 - RNA, 23 nt, Mycobacterium avium subsp. paratuberculosis
ccugcgccagcagcagcgcggca

SEQ ID NO: 952707 - RNA, 14 nt, Mycobacterium avium subsp. paratuberculosis
ccugcgcaccgcgg

SEQ ID NO: 952708 - RNA, 13 nt, Mycobacterium avium subsp. paratuberculosis
ccugcgagcacac

SEQ ID NO: 952709 - RNA, 18 nt, Mycobacterium avium subsp. paratuberculosis
ccugcgagcccgggaacg

SEQ ID NO: 952710 - RNA, 17 nt, Mycobacterium avium subsp. paratuberculosis
ccugcgacggcagcacc

SEQ ID NO: 952711 - RNA, 19 nt, Mycobacterium avium subsp. paratuberculosis
ccugcgacggcagcaccuc

SEQ ID NO: 952712 - RNA, 19 nt, Mycobacterium avium subsp. paratuberculosis
ccugcgacuucuacggcgg

SEQ ID NO: 952713 - RNA, 16 nt, Mycobacterium avium subsp. paratuberculosis
ccugcgaccgccgccg

SEQ ID NO: 952714 - RNA, 19 nt, Mycobacterium avium subsp. paratuberculosis
ccugcgaauacccgcccag

SEQ ID NO: 952715 - RNA, 22 nt, Mycobacterium avium subsp. paratuberculosis
ccugccuccacgucaccgacgc

SEQ ID NO: 952716 - RNA, 17 nt, Mycobacterium avium subsp. paratuberculosis
ccugcgcgacggcgcug

SEQ ID NO: 952717 - RNA, 16 nt, Mycobacterium avium subsp. paratuberculosis
ccugcgcgaucgccgg

SEQ ID NO: 952718 - RNA, 19 nt, Mycobacterium avium subsp. paratuberculosis
ccugcgcgaucgccggauc

SEQ ID NO: 952719 - RNA, 13 nt, Mycobacterium avium subsp. paratuberculosis
ccugcgccgcggu

SEQ ID NO: 952720 - RNA, 14 nt, Mycobacterium avium subsp. paratuberculosis
ccugcgccgcggug

SEQ ID NO: 952721 - RNA, 16 nt, Mycobacterium avium subsp. paratuberculosis
ccugcgccgcggugcg

SEQ ID NO: 952722 - RNA, 13 nt, Mycobacterium avium subsp. paratuberculosis
ccugcgcgucguc

SEQ ID NO: 952723 - RNA, 18 nt, Mycobacterium avium subsp. paratuberculosis
ccugcgcgucgucgcccg

SEQ ID NO: 952724 - RNA, 20 nt, Mycobacterium avium subsp. paratuberculosis
ccugcgcgucgucgcccgaa

SEQ ID NO: 952725 - RNA, 20 nt, Mycobacterium avium subsp. paratuberculosis
ccugcgcgugcuugccgaug

SEQ ID NO: 952726 - RNA, 15 nt, Mycobacterium avium subsp. paratuberculosis
ccugcgcugcggcca

SEQ ID NO: 952727 - RNA, 14 nt, Mycobacterium avium subsp. paratuberculosis
ccugcgcggcgaug

SEQ ID NO: 952728 - RNA, 15 nt, Mycobacterium avium subsp. paratuberculosis
ccugcgcggcgaugc

SEQ ID NO: 952729 - RNA, 16 nt, Mycobacterium avium subsp. paratuberculosis
ccugcgcggcggcguc

SEQ ID NO: 952730 - RNA, 16 nt, Mycobacterium avium subsp. paratuberculosis
ccugcgcuaccaggcg

SEQ ID NO: 952731 - RNA, 20 nt, Mycobacterium avium subsp. paratuberculosis
ccugcgcggaaguggaccgc

SEQ ID NO: 952732 - RNA, 22 nt, Mycobacterium avium subsp. paratuberculosis
ccugcgcggaaguggaccgcgu

SEQ ID NO: 952733 - RNA, 13 nt, Mycobacterium avium subsp. paratuberculosis
ccugcgcggccgc

SEQ ID NO: 952734 - RNA, 22 nt, Mycobacterium avium subsp. paratuberculosis
ccugcgcggccgcgucggcggc

SEQ ID NO: 952735 - RNA, 14 nt, Mycobacterium avium subsp. paratuberculosis
ccugcgcgccguug

SEQ ID NO: 952736 - RNA, 13 nt, Mycobacterium avium subsp. paratuberculosis
ccugcgcgccgau

SEQ ID NO: 952737 - RNA, 22 nt, Mycobacterium avium subsp. paratuberculosis
ccugcgcgccgauguggccggc

SEQ ID NO: 952738 - RNA, 17 nt, Mycobacterium avium subsp. paratuberculosis
ccugggcaauggccgcg

SEQ ID NO: 952739 - RNA, 19 nt, Mycobacterium avium subsp. paratuberculosis
ccugggaugucuagccgcc

SEQ ID NO: 952740 - RNA, 16 nt, Mycobacterium avium subsp. paratuberculosis
ccuggcuguagcgguc

SEQ ID NO: 952741 - RNA, 23 nt, Mycobacterium avium subsp. paratuberculosis
ccuggcuguagcggucgugcggg

SEQ ID NO: 952742 - RNA, 17 nt, Mycobacterium avium subsp. paratuberculosis
ccuggcugacggcgucg

SEQ ID NO: 952743 - RNA, 15 nt, Mycobacterium avium subsp. paratuberculosis
ccuggcuccccggcg

SEQ ID NO: 952744 - RNA, 22 nt, Mycobacterium avium subsp. paratuberculosis
ccuggcuccccggcgaucucga

SEQ ID NO: 952745 - RNA, 18 nt, Mycobacterium avium subsp. paratuberculosis
ccuggggcagaucgucgg

SEQ ID NO: 952746 - RNA, 19 nt, Mycobacterium avium subsp. paratuberculosis
ccuggggcagaucgucggc

SEQ ID NO: 952747 - RNA, 12 nt, Mycobacterium avium subsp. paratuberculosis
ccugggcgucga

SEQ ID NO: 952748 - RNA, 17 nt, Mycobacterium avium subsp. paratuberculosis
ccugggggucggugacc

SEQ ID NO: 952749 - RNA, 22 nt, Mycobacterium avium subsp. paratuberculosis
ccugggcggccaccgcgccccg

SEQ ID NO: 952750 - RNA, 23 nt, Mycobacterium avium subsp. paratuberculosis
ccugggcggccaccgcgccccgg

SEQ ID NO: 952751 - RNA, 24 nt, Mycobacterium avium subsp. paratuberculosis
ccugggcggccaccgcgccccggc

SEQ ID NO: 952752 - RNA, 19 nt, Mycobacterium avium subsp. paratuberculosis
ccugggcggcgacacgccg

SEQ ID NO: 952753 - RNA, 17 nt, Mycobacterium avium subsp. paratuberculosis
ccugggccuccggcggc

SEQ ID NO: 952754 - RNA, 16 nt, Mycobacterium avium subsp. paratuberculosis
ccugggucaucaccuu

SEQ ID NO: 952755 - RNA, 18 nt, Mycobacterium avium subsp. paratuberculosis
ccugggucaucaccuugu

SEQ ID NO: 952756 - RNA, 15 nt, Mycobacterium avium subsp. paratuberculosis
ccugggugagcggcg

SEQ ID NO: 952757 - RNA, 19 nt, Mycobacterium avium subsp. paratuberculosis
ccugggugagcggcgcguc

SEQ ID NO: 952758 - RNA, 19 nt, Mycobacterium avium subsp. paratuberculosis
ccugggugaguucgucggc

SEQ ID NO: 952759 - RNA, 16 nt, Mycobacterium avium subsp. paratuberculosis
ccugggugcgccacug

SEQ ID NO: 952760 - RNA, 18 nt, Mycobacterium avium subsp. paratuberculosis
ccugggugcgcggcgccg

SEQ ID NO: 952761 - RNA, 13 nt, Mycobacterium avium subsp. paratuberculosis
ccugguacgcgcc

SEQ ID NO: 952762 - RNA, 15 nt, Mycobacterium avium subsp. paratuberculosis
ccugguacagcaccg

SEQ ID NO: 952763 - RNA, 16 nt, Mycobacterium avium subsp. paratuberculosis
ccugguacagcaccgc

SEQ ID NO: 952764 - RNA, 18 nt, Mycobacterium avium subsp. paratuberculosis
ccugguacagcaccgccg

SEQ ID NO: 952765 - RNA, 19 nt, Mycobacterium avium subsp. paratuberculosis
ccugguacagcaccgccgc

SEQ ID NO: 952766 - RNA, 15 nt, Mycobacterium avium subsp. paratuberculosis
ccugguccugccccg

SEQ ID NO: 952767 - RNA, 20 nt, Mycobacterium avium subsp. paratuberculosis
ccugguccuuaaucgggacg

SEQ ID NO: 952768 - RNA, 12 nt, Mycobacterium avium subsp. paratuberculosis
ccugguccggcg

SEQ ID NO: 952769 - RNA, 18 nt, Mycobacterium avium subsp. paratuberculosis
ccugguccggcgcccgau

SEQ ID NO: 952770 - RNA, 22 nt, Mycobacterium avium subsp. paratuberculosis
ccugguccggcgcccgaucggc

SEQ ID NO: 952771 - RNA, 18 nt, Mycobacterium avium subsp. paratuberculosis
ccugguccucccgggugg

SEQ ID NO: 952772 - RNA, 16 nt, Mycobacterium avium subsp. paratuberculosis
ccugguccucgauccg

SEQ ID NO: 952773 - RNA, 23 nt, Mycobacterium avium subsp. paratuberculosis
ccugguaggccgccuugggccgg

SEQ ID NO: 952774 - RNA, 13 nt, Mycobacterium avium subsp. paratuberculosis
ccuggucggccgg

SEQ ID NO: 952775 - RNA, 16 nt, Mycobacterium avium subsp. paratuberculosis
ccuggugcaccaggua

SEQ ID NO: 952776 - RNA, 14 nt, Mycobacterium avium subsp. paratuberculosis
ccuggugaccgacg

SEQ ID NO: 952777 - RNA, 21 nt, Mycobacterium avium subsp. paratuberculosis
ccuggugaugaaucgucccgu

SEQ ID NO: 952778 - RNA, 13 nt, Mycobacterium avium subsp. paratuberculosis
ccuggugcucgcg

SEQ ID NO: 952779 - RNA, 17 nt, Mycobacterium avium subsp. paratuberculosis
ccuggugcucgcgcucg

SEQ ID NO: 952780 - RNA, 18 nt, Mycobacterium avium subsp. paratuberculosis
ccuggugcucgcgcucgu

SEQ ID NO: 952781 - RNA, 22 nt, Mycobacterium avium subsp. paratuberculosis
ccuggucgggguggaucgccca

SEQ ID NO: 952782 - RNA, 17 nt, Mycobacterium avium subsp. paratuberculosis
ccuggucggucagcucg

SEQ ID NO: 952783 - RNA, 22 nt, Mycobacterium avium subsp. paratuberculosis
ccuggucggucagcucgaaggu

SEQ ID NO: 952784 - RNA, 14 nt, Mycobacterium avium subsp. paratuberculosis
ccuggucggcgacc

SEQ ID NO: 952785 - RNA, 20 nt, Mycobacterium avium subsp. paratuberculosis
ccuggucgcuuucggugacc

SEQ ID NO: 952786 - RNA, 16 nt, Mycobacterium avium subsp. paratuberculosis
ccuggucggccagggc

SEQ ID NO: 952787 - RNA, 14 nt, Mycobacterium avium subsp. paratuberculosis
ccuggucgaacagc

SEQ ID NO: 952788 - RNA, 20 nt, Mycobacterium avium subsp. paratuberculosis
ccuggucgaacagcacgccg

SEQ ID NO: 952789 - RNA, 22 nt, Mycobacterium avium subsp. paratuberculosis
ccuggucgaacagcacgccggc

SEQ ID NO: 952790 - RNA, 23 nt, Mycobacterium avium subsp. paratuberculosis
ccuggaucagccaguugaucagc

SEQ ID NO: 952791 - RNA, 16 nt, Mycobacterium avium subsp. paratuberculosis
ccuggaugaacagcac

SEQ ID NO: 952792 - RNA, 18 nt, Mycobacterium avium subsp. paratuberculosis
ccuggcagcauccgccga

SEQ ID NO: 952793 - RNA, 19 nt, Mycobacterium avium subsp. paratuberculosis
ccuggcagcauccgccgac

SEQ ID NO: 952794 - RNA, 20 nt, Mycobacterium avium subsp. paratuberculosis
ccuggcagcauccgccgacg

SEQ ID NO: 952795 - RNA, 14 nt, Mycobacterium avium subsp. paratuberculosis
ccuggccaccagca

SEQ ID NO: 952796 - RNA, 18 nt, Mycobacterium avium subsp. paratuberculosis
ccuggacgucgucgcugu

SEQ ID NO: 952797 - RNA, 23 nt, Mycobacterium avium subsp. paratuberculosis
ccuggaggccaacgagcgcgccg

SEQ ID NO: 952798 - RNA, 19 nt, Mycobacterium avium subsp. paratuberculosis
ccuggacgccgcacgcgac

SEQ ID NO: 952799 - RNA, 22 nt, Mycobacterium avium subsp. paratuberculosis
ccuggacgccgcacgcgaccgc

SEQ ID NO: 952800 - RNA, 22 nt, Mycobacterium avium subsp. paratuberculosis
ccuggacgguuucaccgccguc

SEQ ID NO: 952801 - RNA, 20 nt, Mycobacterium avium subsp. paratuberculosis
ccuggacgacgucgaugugc

SEQ ID NO: 952802 - RNA, 21 nt, Mycobacterium avium subsp. paratuberculosis
ccuggacgaguggucggccgc

SEQ ID NO: 952803 - RNA, 22 nt, Mycobacterium avium subsp. paratuberculosis
ccugcuuuucggccgagucgac

SEQ ID NO: 952804 - RNA, 20 nt, Mycobacterium avium subsp. paratuberculosis
ccuggaaaccccucagccgg

SEQ ID NO: 952805 - RNA, 12 nt, Mycobacterium avium subsp. paratuberculosis
ccuggaaccggg

SEQ ID NO: 952806 - RNA, 18 nt, Mycobacterium avium subsp. paratuberculosis
ccuggaagaagucggugu

SEQ ID NO: 952807 - RNA, 21 nt, Mycobacterium avium subsp. paratuberculosis
ccuggaagcgcaucgccggcg

SEQ ID NO: 952808 - RNA, 16 nt, Mycobacterium avium subsp. paratuberculosis
ccuggaaggacgucag

SEQ ID NO: 952809 - RNA, 21 nt, Mycobacterium avium subsp. paratuberculosis
ccuggaaggacgucaggccgg

SEQ ID NO: 952810 - RNA, 22 nt, Mycobacterium avium subsp. paratuberculosis
ccuggaaggacgucaggccggu

SEQ ID NO: 952811 - RNA, 23 nt, Mycobacterium avium subsp. paratuberculosis
ccuggaaggacgucaggccgguc

SEQ ID NO: 952812 - RNA, 17 nt, Mycobacterium avium subsp. paratuberculosis
ccuggcgcuccagccac

SEQ ID NO: 952813 - RNA, 17 nt, Mycobacterium avium subsp. paratuberculosis
ccuggcggcgacccgga

SEQ ID NO: 952814 - RNA, 20 nt, Mycobacterium avium subsp. paratuberculosis
ccuggcgaaccgcggcggca

SEQ ID NO: 952815 - RNA, 13 nt, Mycobacterium avium subsp. paratuberculosis
ccuggcgcaccgc

SEQ ID NO: 952816 - RNA, 17 nt, Mycobacterium avium subsp. paratuberculosis
ccuggcgcagcaccgac

SEQ ID NO: 952817 - RNA, 19 nt, Mycobacterium avium subsp. paratuberculosis
ccuggcgggcggcccgcac

SEQ ID NO: 952818 - RNA, 22 nt, Mycobacterium avium subsp. paratuberculosis
ccuggcgggcggcccgcacggc

SEQ ID NO: 952819 - RNA, 20 nt, Mycobacterium avium subsp. paratuberculosis
ccuggcggguacagccgcag

SEQ ID NO: 952820 - RNA, 23 nt, Mycobacterium avium subsp. paratuberculosis
ccuggcggguacagccgcagggu

SEQ ID NO: 952821 - RNA, 12 nt, Mycobacterium avium subsp. paratuberculosis
ccuggccggcca

SEQ ID NO: 952822 - RNA, 13 nt, Mycobacterium avium subsp. paratuberculosis
ccuggccggccuc

SEQ ID NO: 952823 - RNA, 13 nt, Mycobacterium avium subsp. paratuberculosis
ccuggccgccgug

SEQ ID NO: 952824 - RNA, 16 nt, Mycobacterium avium subsp. paratuberculosis
ccuggcauccgucggc

SEQ ID NO: 952825 - RNA, 21 nt, Mycobacterium avium subsp. paratuberculosis
ccuggcccaaaaacaucguca

SEQ ID NO: 952826 - RNA, 23 nt, Mycobacterium avium subsp. paratuberculosis
ccuggccccagaaccgcucggcg

SEQ ID NO: 952827 - RNA, 17 nt, Mycobacterium avium subsp. paratuberculosis
ccuggcccccgccccag

SEQ ID NO: 952828 - RNA, 14 nt, Mycobacterium avium subsp. paratuberculosis
ccuggccuggucgg

SEQ ID NO: 952829 - RNA, 13 nt, Mycobacterium avium subsp. paratuberculosis
ccuggccggugcg

SEQ ID NO: 952830 - RNA, 20 nt, Mycobacterium avium subsp. paratuberculosis
ccuggccgucgguggccggu

SEQ ID NO: 952831 - RNA, 18 nt, Mycobacterium avium subsp. paratuberculosis
ccuggccguucaggucga

SEQ ID NO: 952832 - RNA, 16 nt, Mycobacterium avium subsp. paratuberculosis
ccgccuuugagcgaca

SEQ ID NO: 952833 - RNA, 13 nt, Mycobacterium avium subsp. paratuberculosis
ccgcgaaaacagc

SEQ ID NO: 952834 - RNA, 18 nt, Mycobacterium avium subsp. paratuberculosis
ccgcgaaaacagcgacca

SEQ ID NO: 952835 - RNA, 23 nt, Mycobacterium avium subsp. paratuberculosis
ccgcgaaaacagcgaccagucgg

SEQ ID NO: 952836 - RNA, 16 nt, Mycobacterium avium subsp. paratuberculosis
ccgcgaaaauaccgcc

SEQ ID NO: 952837 - RNA, 17 nt, Mycobacterium avium subsp. paratuberculosis
ccgcgaaaauaccgccg

SEQ ID NO: 952838 - RNA, 18 nt, Mycobacterium avium subsp. paratuberculosis
ccgcgaaaauaccgccgg

SEQ ID NO: 952839 - RNA, 21 nt, Mycobacterium avium subsp. paratuberculosis
ccgcgaaaauaccgccggccg

SEQ ID NO: 952840 - RNA, 15 nt, Mycobacterium avium subsp. paratuberculosis
ccgccuugcccggcu

SEQ ID NO: 952841 - RNA, 16 nt, Mycobacterium avium subsp. paratuberculosis
ccgccuugcccggcuc

SEQ ID NO: 952842 - RNA, 17 nt, Mycobacterium avium subsp. paratuberculosis
ccgccuugacgccgggc

SEQ ID NO: 952843 - RNA, 22 nt, Mycobacterium avium subsp. paratuberculosis
ccgccuugaucuuggccugggc

SEQ ID NO: 952844 - RNA, 19 nt, Mycobacterium avium subsp. paratuberculosis
ccgccuuggugauccgggg

SEQ ID NO: 952845 - RNA, 16 nt, Mycobacterium avium subsp. paratuberculosis
ccgcgaaagcgucggc

SEQ ID NO: 952846 - RNA, 16 nt, Mycobacterium avium subsp. paratuberculosis
ccgccuugggccgguc

SEQ ID NO: 952847 - RNA, 22 nt, Mycobacterium avium subsp. paratuberculosis
ccgcgaaagugcuacugccgac

SEQ ID NO: 952848 - RNA, 17 nt, Mycobacterium avium subsp. paratuberculosis
ccgcgaaacgcaacagc

SEQ ID NO: 952849 - RNA, 13 nt, Mycobacterium avium subsp. paratuberculosis
ccgcgaacggccc

SEQ ID NO: 952850 - RNA, 15 nt, Mycobacterium avium subsp. paratuberculosis
ccgcgaacggcccgc

SEQ ID NO: 952851 - RNA, 16 nt, Mycobacterium avium subsp. paratuberculosis
ccgcgaacggcccgcc

SEQ ID NO: 952852 - RNA, 17 nt, Mycobacterium avium subsp. paratuberculosis
ccgcgaacggcccgccg

SEQ ID NO: 952853 - RNA, 20 nt, Mycobacterium avium subsp. paratuberculosis
ccgcgaacggcccgccgccg

SEQ ID NO: 952854 - RNA, 14 nt, Mycobacterium avium subsp. paratuberculosis
ccgcgaacgccucg

SEQ ID NO: 952855 - RNA, 15 nt, Mycobacterium avium subsp. paratuberculosis
ccgcgaacgccucgg

SEQ ID NO: 952856 - RNA, 19 nt, Mycobacterium avium subsp. paratuberculosis
ccgcgaacgccucggcgag

SEQ ID NO: 952857 - RNA, 22 nt, Mycobacterium avium subsp. paratuberculosis
ccgcgaacgccucggcgagccg

SEQ ID NO: 952858 - RNA, 19 nt, Mycobacterium avium subsp. paratuberculosis
ccgcgaacgccucguuggc

SEQ ID NO: 952859 - RNA, 13 nt, Mycobacterium avium subsp. paratuberculosis
ccgcgaacacgcg

SEQ ID NO: 952860 - RNA, 14 nt, Mycobacterium avium subsp. paratuberculosis
ccgcgaacacgcga

SEQ ID NO: 952861 - RNA, 18 nt, Mycobacterium avium subsp. paratuberculosis
ccgcgaacaucgccagca

SEQ ID NO: 952862 - RNA, 23 nt, Mycobacterium avium subsp. paratuberculosis
ccgcgaacaucgccagcaacgac

SEQ ID NO: 952863 - RNA, 24 nt, Mycobacterium avium subsp. paratuberculosis
ccgcgaacaucgccagcaacgacc

SEQ ID NO: 952864 - RNA, 16 nt, Mycobacterium avium subsp. paratuberculosis
ccgccugugcgacggc

SEQ ID NO: 952865 - RNA, 18 nt, Mycobacterium avium subsp. paratuberculosis
ccgccugugcgacggcgu

SEQ ID NO: 952866 - RNA, 19 nt, Mycobacterium avium subsp. paratuberculosis
ccgccuggccaccucgacg

SEQ ID NO: 952867 - RNA, 23 nt, Mycobacterium avium subsp. paratuberculosis
ccgccugggucucgggaucgccg

SEQ ID NO: 952868 - RNA, 20 nt, Mycobacterium avium subsp. paratuberculosis
ccgccuucuugcgcggcgcg

SEQ ID NO: 952869 - RNA, 21 nt, Mycobacterium avium subsp. paratuberculosis
ccgccuucuugcgcggcgcga

SEQ ID NO: 952870 - RNA, 18 nt, Mycobacterium avium subsp. paratuberculosis
ccgccuucuccgggucgc

SEQ ID NO: 952871 - RNA, 14 nt, Mycobacterium avium subsp. paratuberculosis
ccgccuucgacgau

SEQ ID NO: 952872 - RNA, 22 nt, Mycobacterium avium subsp. paratuberculosis
ccgccuucgacgaugccguaga

SEQ ID NO: 952873 - RNA, 18 nt, Mycobacterium avium subsp. paratuberculosis
ccgccuucgacggccggc

SEQ ID NO: 952874 - RNA, 20 nt, Mycobacterium avium subsp. paratuberculosis
ccgccuucacgaccggcagc

SEQ ID NO: 952875 - RNA, 20 nt, Mycobacterium avium subsp. paratuberculosis
ccgccguugcgagucaucgc

SEQ ID NO: 952876 - RNA, 23 nt, Mycobacterium avium subsp. paratuberculosis
ccgccguugcgagucaucgccac

SEQ ID NO: 952877 - RNA, 16 nt, Mycobacterium avium subsp. paratuberculosis
ccgccguuucagcagc

SEQ ID NO: 952878 - RNA, 19 nt, Mycobacterium avium subsp. paratuberculosis
ccgccguuucagcagcgcg

SEQ ID NO: 952879 - RNA, 20 nt, Mycobacterium avium subsp. paratuberculosis
ccgccguuucagcagcgcgu

SEQ ID NO: 952880 - RNA, 12 nt, Mycobacterium avium subsp. paratuberculosis
ccgccgucgacc

SEQ ID NO: 952881 - RNA, 13 nt, Mycobacterium avium subsp. paratuberculosis
ccgccgucgacca

SEQ ID NO: 952882 - RNA, 14 nt, Mycobacterium avium subsp. paratuberculosis
ccgccgucgaccac

SEQ ID NO: 952883 - RNA, 16 nt, Mycobacterium avium subsp. paratuberculosis
ccgccgucgacgacga

SEQ ID NO: 952884 - RNA, 14 nt, Mycobacterium avium subsp. paratuberculosis
ccgccguugaccgg

SEQ ID NO: 952885 - RNA, 18 nt, Mycobacterium avium subsp. paratuberculosis
ccgccguugaccggugcg

SEQ ID NO: 952886 - RNA, 22 nt, Mycobacterium avium subsp. paratuberculosis
ccgccugcuugaugaugccggc

SEQ ID NO: 952887 - RNA, 23 nt, Mycobacterium avium subsp. paratuberculosis
ccgccugcgcgggcgcggacagc

SEQ ID NO: 952888 - RNA, 16 nt, Mycobacterium avium subsp. paratuberculosis
ccgccugcggguucug

SEQ ID NO: 952889 - RNA, 17 nt, Mycobacterium avium subsp. paratuberculosis
ccgccucccgcagcgcc

SEQ ID NO: 952890 - RNA, 13 nt, Mycobacterium avium subsp. paratuberculosis
ccgccucaugcca

SEQ ID NO: 952891 - RNA, 14 nt, Mycobacterium avium subsp. paratuberculosis
ccgccucaccgaau

SEQ ID NO: 952892 - RNA, 14 nt, Mycobacterium avium subsp. paratuberculosis
ccgccuccagcacg

SEQ ID NO: 952893 - RNA, 23 nt, Mycobacterium avium subsp. paratuberculosis
ccgccuccagcacgucggggugg

SEQ ID NO: 952894 - RNA, 16 nt, Mycobacterium avium subsp. paratuberculosis
ccgccucacagcgaca

SEQ ID NO: 952895 - RNA, 20 nt, Mycobacterium avium subsp. paratuberculosis
ccgccucacagcgacaacgg

SEQ ID NO: 952896 - RNA, 17 nt, Mycobacterium avium subsp. paratuberculosis
ccgccuacuugaccagc

SEQ ID NO: 952897 - RNA, 19 nt, Mycobacterium avium subsp. paratuberculosis
ccgccgggcugaccgucga

SEQ ID NO: 952898 - RNA, 21 nt, Mycobacterium avium subsp. paratuberculosis
ccgccgggcugaccgucgacc

SEQ ID NO: 952899 - RNA, 22 nt, Mycobacterium avium subsp. paratuberculosis
ccgccgggcugaccgucgacca

SEQ ID NO: 952900 - RNA, 14 nt, Mycobacterium avium subsp. paratuberculosis
ccgccgggcggcag

SEQ ID NO: 952901 - RNA, 16 nt, Mycobacterium avium subsp. paratuberculosis
ccgccgggcggcgucc

SEQ ID NO: 952902 - RNA, 15 nt, Mycobacterium avium subsp. paratuberculosis
ccgccgggcgggccg

SEQ ID NO: 952903 - RNA, 18 nt, Mycobacterium avium subsp. paratuberculosis
ccgccgggcgggccgcag

SEQ ID NO: 952904 - RNA, 12 nt, Mycobacterium avium subsp. paratuberculosis
ccgccgggccug

SEQ ID NO: 952905 - RNA, 14 nt, Mycobacterium avium subsp. paratuberculosis
ccgccgggcgccac

SEQ ID NO: 952906 - RNA, 15 nt, Mycobacterium avium subsp. paratuberculosis
ccgccgggcgccacc

SEQ ID NO: 952907 - RNA, 19 nt, Mycobacterium avium subsp. paratuberculosis
ccgccgggcgccacgcugg

SEQ ID NO: 952908 - RNA, 15 nt, Mycobacterium avium subsp. paratuberculosis
ccgccgggccgccga

SEQ ID NO: 952909 - RNA, 12 nt, Mycobacterium avium subsp. paratuberculosis
ccgccgggcgcg

SEQ ID NO: 952910 - RNA, 12 nt, Mycobacterium avium subsp. paratuberculosis
ccgccgggccgg

SEQ ID NO: 952911 - RNA, 16 nt, Mycobacterium avium subsp. paratuberculosis
ccgccgggccggcggc

SEQ ID NO: 952912 - RNA, 19 nt, Mycobacterium avium subsp. paratuberculosis
ccgccgggccggcggccag

SEQ ID NO: 952913 - RNA, 14 nt, Mycobacterium avium subsp. paratuberculosis
ccgccgggcacccg

SEQ ID NO: 952914 - RNA, 17 nt, Mycobacterium avium subsp. paratuberculosis
ccgccgggcacccgggu

SEQ ID NO: 952915 - RNA, 20 nt, Mycobacterium avium subsp. paratuberculosis
ccgccgggcaccucggcguc

SEQ ID NO: 952916 - RNA, 19 nt, Mycobacterium avium subsp. paratuberculosis
ccgccgggauaacccagca

SEQ ID NO: 952917 - RNA, 22 nt, Mycobacterium avium subsp. paratuberculosis
ccgccgggcauccgggccgccg

SEQ ID NO: 952918 - RNA, 16 nt, Mycobacterium avium subsp. paratuberculosis
ccgccguccccgcgcg

SEQ ID NO: 952919 - RNA, 21 nt, Mycobacterium avium subsp. paratuberculosis
ccgccguccccgcgcggcucg

SEQ ID NO: 952920 - RNA, 19 nt, Mycobacterium avium subsp. paratuberculosis
ccgccguccagcgucaccu

SEQ ID NO: 952921 - RNA, 17 nt, Mycobacterium avium subsp. paratuberculosis
ccgccgucccaccggcg

SEQ ID NO: 952922 - RNA, 18 nt, Mycobacterium avium subsp. paratuberculosis
ccgccgucccaccggcga

SEQ ID NO: 952923 - RNA, 21 nt, Mycobacterium avium subsp. paratuberculosis
ccgccgucccaccggcgaugu

SEQ ID NO: 952924 - RNA, 16 nt, Mycobacterium avium subsp. paratuberculosis
ccgccguagccggcgg

SEQ ID NO: 952925 - RNA, 17 nt, Mycobacterium avium subsp. paratuberculosis
ccgccguagccggcggu

SEQ ID NO: 952926 - RNA, 16 nt, Mycobacterium avium subsp. paratuberculosis
ccgccguagcgccggc

SEQ ID NO: 952927 - RNA, 15 nt, Mycobacterium avium subsp. paratuberculosis
ccgccgucaccgcca

SEQ ID NO: 952928 - RNA, 16 nt, Mycobacterium avium subsp. paratuberculosis
ccgccgucaccgccag

SEQ ID NO: 952929 - RNA, 19 nt, Mycobacterium avium subsp. paratuberculosis
ccgccgucaccgccaggac

SEQ ID NO: 952930 - RNA, 20 nt, Mycobacterium avium subsp. paratuberculosis
ccgccggguggccgccacgu

SEQ ID NO: 952931 - RNA, 21 nt, Mycobacterium avium subsp. paratuberculosis
ccgccggguggccgccacguc

SEQ ID NO: 952932 - RNA, 15 nt, Mycobacterium avium subsp. paratuberculosis
ccgccggguggcggg

SEQ ID NO: 952933 - RNA, 17 nt, Mycobacterium avium subsp. paratuberculosis
ccgccggucacggcguc

SEQ ID NO: 952934 - RNA, 20 nt, Mycobacterium avium subsp. paratuberculosis
ccgccggucacggcgucggc

SEQ ID NO: 952935 - RNA, 22 nt, Mycobacterium avium subsp. paratuberculosis
ccgccggucacggcgucggcgu

SEQ ID NO: 952936 - RNA, 14 nt, Mycobacterium avium subsp. paratuberculosis
ccgccgguccagug

SEQ ID NO: 952937 - RNA, 16 nt, Mycobacterium avium subsp. paratuberculosis
ccgccgguccagugcc

SEQ ID NO: 952938 - RNA, 19 nt, Mycobacterium avium subsp. paratuberculosis
ccgccggugucggcgacca

SEQ ID NO: 952939 - RNA, 16 nt, Mycobacterium avium subsp. paratuberculosis
ccgccgggaucggcgg

SEQ ID NO: 952940 - RNA, 18 nt, Mycobacterium avium subsp. paratuberculosis
ccgccgggaucggcgggg

SEQ ID NO: 952941 - RNA, 19 nt, Mycobacterium avium subsp. paratuberculosis
ccgccgggaucggcggggc

SEQ ID NO: 952942 - RNA, 15 nt, Mycobacterium avium subsp. paratuberculosis
ccgccggcggguugg

SEQ ID NO: 952943 - RNA, 11 nt, Mycobacterium avium subsp. paratuberculosis
ccgccggcggu

SEQ ID NO: 952944 - RNA, 17 nt, Mycobacterium avium subsp. paratuberculosis
ccgccggcucagcggca

SEQ ID NO: 952945 - RNA, 14 nt, Mycobacterium avium subsp. paratuberculosis
ccgccggcggcguc

SEQ ID NO: 952946 - RNA, 13 nt, Mycobacterium avium subsp. paratuberculosis
ccgccggcggugc

SEQ ID NO: 952947 - RNA, 14 nt, Mycobacterium avium subsp. paratuberculosis
ccgccggcggugcg

SEQ ID NO: 952948 - RNA, 19 nt, Mycobacterium avium subsp. paratuberculosis
ccgccggcggugcgggugg

SEQ ID NO: 952949 - RNA, 20 nt, Mycobacterium avium subsp. paratuberculosis
ccgccggcggugcggguggu

SEQ ID NO: 952950 - RNA, 23 nt, Mycobacterium avium subsp. paratuberculosis
ccgccggcgucagagguuggcga

SEQ ID NO: 952951 - RNA, 14 nt, Mycobacterium avium subsp. paratuberculosis
ccgccggcgucgac

SEQ ID NO: 952952 - RNA, 16 nt, Mycobacterium avium subsp. paratuberculosis
ccgccggcgucgacgu

SEQ ID NO: 952953 - RNA, 16 nt, Mycobacterium avium subsp. paratuberculosis
ccgccggcgucgccgc

SEQ ID NO: 952954 - RNA, 16 nt, Mycobacterium avium subsp. paratuberculosis
ccgccggcggcgauga

SEQ ID NO: 952955 - RNA, 15 nt, Mycobacterium avium subsp. paratuberculosis
ccgccggcggccucc

SEQ ID NO: 952956 - RNA, 22 nt, Mycobacterium avium subsp. paratuberculosis
ccgccggcggccuccgccaccu

SEQ ID NO: 952957 - RNA, 13 nt, Mycobacterium avium subsp. paratuberculosis
ccgccggcggcca

SEQ ID NO: 952958 - RNA, 14 nt, Mycobacterium avium subsp. paratuberculosis
ccgccggcggccac

SEQ ID NO: 952959 - RNA, 22 nt, Mycobacterium avium subsp. paratuberculosis
ccgccggcggccacgaugggga

SEQ ID NO: 952960 - RNA, 12 nt, Mycobacterium avium subsp. paratuberculosis
ccgccggcgcug

SEQ ID NO: 952961 - RNA, 18 nt, Mycobacterium avium subsp. paratuberculosis
ccgccggcgcuggcgcgc

SEQ ID NO: 952962 - RNA, 20 nt, Mycobacterium avium subsp. paratuberculosis
ccgccggcgcuggcgcgccg

SEQ ID NO: 952963 - RNA, 15 nt, Mycobacterium avium subsp. paratuberculosis
ccgccggcgcggacg

SEQ ID NO: 952964 - RNA, 13 nt, Mycobacterium avium subsp. paratuberculosis
ccgccgcggacau

SEQ ID NO: 952965 - RNA, 14 nt, Mycobacterium avium subsp. paratuberculosis
ccgccgcggagcgg

SEQ ID NO: 952966 - RNA, 17 nt, Mycobacterium avium subsp. paratuberculosis
ccgccgcggagcggcgg

SEQ ID NO: 952967 - RNA, 18 nt, Mycobacterium avium subsp. paratuberculosis
ccgccgcggagcggcggu

SEQ ID NO: 952968 - RNA, 14 nt, Mycobacterium avium subsp. paratuberculosis
ccgccgcgcucgca

SEQ ID NO: 952969 - RNA, 14 nt, Mycobacterium avium subsp. paratuberculosis
ccgccgcgcucggc

SEQ ID NO: 952970 - RNA, 20 nt, Mycobacterium avium subsp. paratuberculosis
ccgccgcgcggguacggcgg

SEQ ID NO: 952971 - RNA, 23 nt, Mycobacterium avium subsp. paratuberculosis
ccgccgcgcggguacggcggccg

SEQ ID NO: 952972 - RNA, 14 nt, Mycobacterium avium subsp. paratuberculosis
ccgccgcgcggccg

SEQ ID NO: 952973 - RNA, 19 nt, Mycobacterium avium subsp. paratuberculosis
ccgccgcgcggccgggcuc

SEQ ID NO: 952974 - RNA, 16 nt, Mycobacterium avium subsp. paratuberculosis
ccgccgcgcccggcuu

SEQ ID NO: 952975 - RNA, 15 nt, Mycobacterium avium subsp. paratuberculosis
ccgccgcgcgcggcc

SEQ ID NO: 952976 - RNA, 16 nt, Mycobacterium avium subsp. paratuberculosis
ccgccgcgcgcggcca

SEQ ID NO: 952977 - RNA, 18 nt, Mycobacterium avium subsp. paratuberculosis
ccgccgcgcgcggccacc

SEQ ID NO: 952978 - RNA, 19 nt, Mycobacterium avium subsp. paratuberculosis
ccgccgcgcgcggccaccg

SEQ ID NO: 952979 - RNA, 16 nt, Mycobacterium avium subsp. paratuberculosis
ccgccgcgcauccgca

SEQ ID NO: 952980 - RNA, 15 nt, Mycobacterium avium subsp. paratuberculosis
ccgccgcgcaggccg

SEQ ID NO: 952981 - RNA, 18 nt, Mycobacterium avium subsp. paratuberculosis
ccgccgcgcaggccgccg

SEQ ID NO: 952982 - RNA, 14 nt, Mycobacterium avium subsp. paratuberculosis
ccgccgcgcauccg

SEQ ID NO: 952983 - RNA, 14 nt, Mycobacterium avium subsp. paratuberculosis
ccgccgcgaccgcg

SEQ ID NO: 952984 - RNA, 15 nt, Mycobacterium avium subsp. paratuberculosis
ccgccgcgaccgcga

SEQ ID NO: 952985 - RNA, 13 nt, Mycobacterium avium subsp. paratuberculosis
ccgccgcgcaccg

SEQ ID NO: 952986 - RNA, 18 nt, Mycobacterium avium subsp. paratuberculosis
ccgccgcgacggccgccg

SEQ ID NO: 952987 - RNA, 19 nt, Mycobacterium avium subsp. paratuberculosis
ccgccgcgacggccgccga

SEQ ID NO: 952988 - RNA, 14 nt, Mycobacterium avium subsp. paratuberculosis
ccgccgcgacgggu

SEQ ID NO: 952989 - RNA, 15 nt, Mycobacterium avium subsp. paratuberculosis
ccgccgcgacggguu

SEQ ID NO: 952990 - RNA, 15 nt, Mycobacterium avium subsp. paratuberculosis
ccgccgcgagccgcc

SEQ ID NO: 952991 - RNA, 18 nt, Mycobacterium avium subsp. paratuberculosis
ccgcgcggguacggcggc

SEQ ID NO: 952992 - RNA, 19 nt, Mycobacterium avium subsp. paratuberculosis
ccgcgcggguacggcggcc

SEQ ID NO: 952993 - RNA, 21 nt, Mycobacterium avium subsp. paratuberculosis
ccgcgcggauuucucagcggc

SEQ ID NO: 952994 - RNA, 16 nt, Mycobacterium avium subsp. paratuberculosis
ccgcgcggcagguugc

SEQ ID NO: 952995 - RNA, 21 nt, Mycobacterium avium subsp. paratuberculosis
ccgcgcggugcaccaggacgc

SEQ ID NO: 952996 - RNA, 23 nt, Mycobacterium avium subsp. paratuberculosis
ccgcgcggugcaccaggacgcga

SEQ ID NO: 952997 - RNA, 17 nt, Mycobacterium avium subsp. paratuberculosis
ccgcgcggugcccggaa

SEQ ID NO: 952998 - RNA, 22 nt, Mycobacterium avium subsp. paratuberculosis
ccgcgcggugcucgcccugggg

SEQ ID NO: 952999 - RNA, 13 nt, Mycobacterium avium subsp. paratuberculosis
ccgcgcguagauc

SEQ ID NO: 953000 - RNA, 14 nt, Mycobacterium avium subsp. paratuberculosis
ccgcgcgucgcgca

SEQ ID NO: 953001 - RNA, 15 nt, Mycobacterium avium subsp. paratuberculosis
ccgcgcgucgggggu

SEQ ID NO: 953002 - RNA, 22 nt, Mycobacterium avium subsp. paratuberculosis
ccgcgcgucgggggugccgcuc

SEQ ID NO: 953003 - RNA, 22 nt, Mycobacterium avium subsp. paratuberculosis
ccgcgcgucucccccgaucagc

SEQ ID NO: 953004 - RNA, 13 nt, Mycobacterium avium subsp. paratuberculosis
ccgcgcgugcagc

SEQ ID NO: 953005 - RNA, 18 nt, Mycobacterium avium subsp. paratuberculosis
ccgcgcgugcagccgggc

SEQ ID NO: 953006 - RNA, 19 nt, Mycobacterium avium subsp. paratuberculosis
ccgcgcgugcagccgggcg

SEQ ID NO: 953007 - RNA, 21 nt, Mycobacterium avium subsp. paratuberculosis
ccgcgcgugcagccgggcggc

SEQ ID NO: 953008 - RNA, 16 nt, Mycobacterium avium subsp. paratuberculosis
ccgcgcgugcccgcgg

SEQ ID NO: 953009 - RNA, 17 nt, Mycobacterium avium subsp. paratuberculosis
ccgcgcggacgcggcgg

SEQ ID NO: 953010 - RNA, 22 nt, Mycobacterium avium subsp. paratuberculosis
ccgcgcggagaugguggucacc

SEQ ID NO: 953011 - RNA, 16 nt, Mycobacterium avium subsp. paratuberculosis
ccgcgcgggcggcguc

SEQ ID NO: 953012 - RNA, 23 nt, Mycobacterium avium subsp. paratuberculosis
ccgcgcgggcugcagggccgggu

SEQ ID NO: 953013 - RNA, 14 nt, Mycobacterium avium subsp. paratuberculosis
ccgcgcgggggccg

SEQ ID NO: 953014 - RNA, 15 nt, Mycobacterium avium subsp. paratuberculosis
ccgcgcgggggccgc

SEQ ID NO: 953015 - RNA, 17 nt, Mycobacterium avium subsp. paratuberculosis
ccgcgcgggggccgccg

SEQ ID NO: 953016 - RNA, 18 nt, Mycobacterium avium subsp. paratuberculosis
ccgcgcgggggccgccgc

SEQ ID NO: 953017 - RNA, 19 nt, Mycobacterium avium subsp. paratuberculosis
ccgcgcgggggccgccgcg

SEQ ID NO: 953018 - RNA, 19 nt, Mycobacterium avium subsp. paratuberculosis
ccgcgcgcugacccccguu

SEQ ID NO: 953019 - RNA, 13 nt, Mycobacterium avium subsp. paratuberculosis
ccgcgcgcugcag

SEQ ID NO: 953020 - RNA, 15 nt, Mycobacterium avium subsp. paratuberculosis
ccgcgcgcugccgcg

SEQ ID NO: 953021 - RNA, 18 nt, Mycobacterium avium subsp. paratuberculosis
ccgcgcgcgucgacguuc

SEQ ID NO: 953022 - RNA, 20 nt, Mycobacterium avium subsp. paratuberculosis
ccgcgcgcgucgacguucgc

SEQ ID NO: 953023 - RNA, 16 nt, Mycobacterium avium subsp. paratuberculosis
ccgcgcgcgcggccuc

SEQ ID NO: 953024 - RNA, 11 nt, Mycobacterium avium subsp. paratuberculosis
ccgcgcgcggg

SEQ ID NO: 953025 - RNA, 16 nt, Mycobacterium avium subsp. paratuberculosis
ccgcgcgugggccaac

SEQ ID NO: 953026 - RNA, 21 nt, Mycobacterium avium subsp. paratuberculosis
ccgcgcgugggccaacgcgau

SEQ ID NO: 953027 - RNA, 12 nt, Mycobacterium avium subsp. paratuberculosis
ccgcgcgugguc

SEQ ID NO: 953028 - RNA, 17 nt, Mycobacterium avium subsp. paratuberculosis
ccgcgcguuccagcacg

SEQ ID NO: 953029 - RNA, 19 nt, Mycobacterium avium subsp. paratuberculosis
ccgcgcguuccagcacgcc

SEQ ID NO: 953030 - RNA, 23 nt, Mycobacterium avium subsp. paratuberculosis
ccgcgcguucgaguucgucgacc

SEQ ID NO: 953031 - RNA, 17 nt, Mycobacterium avium subsp. paratuberculosis
ccgcgcucaacccgggc

SEQ ID NO: 953032 - RNA, 19 nt, Mycobacterium avium subsp. paratuberculosis
ccgcgcucaacccgggccg

SEQ ID NO: 953033 - RNA, 14 nt, Mycobacterium avium subsp. paratuberculosis
ccgcgcucaccgcg

SEQ ID NO: 953034 - RNA, 15 nt, Mycobacterium avium subsp. paratuberculosis
ccgcgcugaccagcg

SEQ ID NO: 953035 - RNA, 20 nt, Mycobacterium avium subsp. paratuberculosis
ccgcgcugaccagcgugacc

SEQ ID NO: 953036 - RNA, 13 nt, Mycobacterium avium subsp. paratuberculosis
ccgcgcucggcga

SEQ ID NO: 953037 - RNA, 16 nt, Mycobacterium avium subsp. paratuberculosis
ccgcgcucggcgacga

SEQ ID NO: 953038 - RNA, 22 nt, Mycobacterium avium subsp. paratuberculosis
ccgcgcucggccauccgggcgg

SEQ ID NO: 953039 - RNA, 13 nt, Mycobacterium avium subsp. paratuberculosis
ccgcgcucgucga

SEQ ID NO: 953040 - RNA, 15 nt, Mycobacterium avium subsp. paratuberculosis
ccgcgcucgucgauc

SEQ ID NO: 953041 - RNA, 12 nt, Mycobacterium avium subsp. paratuberculosis
ccgcgcucggcc

SEQ ID NO: 953042 - RNA, 19 nt, Mycobacterium avium subsp. paratuberculosis
ccgcgcucaccgucgcggu

SEQ ID NO: 953043 - RNA, 20 nt, Mycobacterium avium subsp. paratuberculosis
ccgcgcucaccgucgcgguc

SEQ ID NO: 953044 - RNA, 16 nt, Mycobacterium avium subsp. paratuberculosis
ccgcgcucgcaccagc

SEQ ID NO: 953045 - RNA, 16 nt, Mycobacterium avium subsp. paratuberculosis
ccgcgccgaacaacug

SEQ ID NO: 953046 - RNA, 21 nt, Mycobacterium avium subsp. paratuberculosis
ccgcgccgaacaccacgccga

SEQ ID NO: 953047 - RNA, 22 nt, Mycobacterium avium subsp. paratuberculosis
ccgcgccgaacgcaccaccgcg

SEQ ID NO: 953048 - RNA, 15 nt, Mycobacterium avium subsp. paratuberculosis
ccgcgcccgucgagc

SEQ ID NO: 953049 - RNA, 15 nt, Mycobacterium avium subsp. paratuberculosis
ccgcgcccuucuucg

SEQ ID NO: 953050 - RNA, 20 nt, Mycobacterium avium subsp. paratuberculosis
ccgcgcccuucuucgcgggu

SEQ ID NO: 953051 - RNA, 20 nt, Mycobacterium avium subsp. paratuberculosis
ccgcgcccggcuucgccgcg

SEQ ID NO: 953052 - RNA, 21 nt, Mycobacterium avium subsp. paratuberculosis
ccgcgccgacagaugcggcac

SEQ ID NO: 953053 - RNA, 16 nt, Mycobacterium avium subsp. paratuberculosis
ccgcgccgaccagcgc

SEQ ID NO: 953054 - RNA, 17 nt, Mycobacterium avium subsp. paratuberculosis
ccgcgccgaccagcgcg

SEQ ID NO: 953055 - RNA, 21 nt, Mycobacterium avium subsp. paratuberculosis
ccgcgccgaccagcgcguuga

SEQ ID NO: 953056 - RNA, 15 nt, Mycobacterium avium subsp. paratuberculosis
ccgcgcccuggugca

SEQ ID NO: 953057 - RNA, 20 nt, Mycobacterium avium subsp. paratuberculosis
ccgcgcccuggugcaacacc

SEQ ID NO: 953058 - RNA, 14 nt, Mycobacterium avium subsp. paratuberculosis
ccgcgccgaucacg

SEQ ID NO: 953059 - RNA, 11 nt, Mycobacterium avium subsp. paratuberculosis
ccgcgccgccc

SEQ ID NO: 953060 - RNA, 12 nt, Mycobacterium avium subsp. paratuberculosis
ccgcgccgcauu

SEQ ID NO: 953061 - RNA, 17 nt, Mycobacterium avium subsp. paratuberculosis
ccgcgccgaggcgcucg

SEQ ID NO: 953062 - RNA, 19 nt, Mycobacterium avium subsp. paratuberculosis
ccgcgccgaggcgcucggc

SEQ ID NO: 953063 - RNA, 22 nt, Mycobacterium avium subsp. paratuberculosis
ccgcgccgaggcgcucggcccg

SEQ ID NO: 953064 - RNA, 16 nt, Mycobacterium avium subsp. paratuberculosis
ccgcgccgagcaaccg

SEQ ID NO: 953065 - RNA, 19 nt, Mycobacterium avium subsp. paratuberculosis
ccgcgccgagcaaccggga

SEQ ID NO: 953066 - RNA, 17 nt, Mycobacterium avium subsp. paratuberculosis
ccgcgccgacggccgcg

SEQ ID NO: 953067 - RNA, 18 nt, Mycobacterium avium subsp. paratuberculosis
ccgcgccgacggccgcgc

SEQ ID NO: 953068 - RNA, 22 nt, Mycobacterium avium subsp. paratuberculosis
ccgcgccgacgcccacagcgcc

SEQ ID NO: 953069 - RNA, 14 nt, Mycobacterium avium subsp. paratuberculosis
ccgcgcgcggcgcc

SEQ ID NO: 953070 - RNA, 15 nt, Mycobacterium avium subsp. paratuberculosis
ccgcgcgcggcgccg

SEQ ID NO: 953071 - RNA, 21 nt, Mycobacterium avium subsp. paratuberculosis
ccgcgcgcggcgccgcguacc

SEQ ID NO: 953072 - RNA, 15 nt, Mycobacterium avium subsp. paratuberculosis
ccgcgcgcggcgcgg

SEQ ID NO: 953073 - RNA, 14 nt, Mycobacterium avium subsp. paratuberculosis
ccgcgcgcggcacg

SEQ ID NO: 953074 - RNA, 20 nt, Mycobacterium avium subsp. paratuberculosis
ccgcgcgcggcacgguggcc

SEQ ID NO: 953075 - RNA, 13 nt, Mycobacterium avium subsp. paratuberculosis
ccgcgcgcggcca

SEQ ID NO: 953076 - RNA, 15 nt, Mycobacterium avium subsp. paratuberculosis
ccgcgcgcggccacc

SEQ ID NO: 953077 - RNA, 18 nt, Mycobacterium avium subsp. paratuberculosis
ccgcgcgcggccaccgcg

SEQ ID NO: 953078 - RNA, 19 nt, Mycobacterium avium subsp. paratuberculosis
ccgcgcgcggccaccgcgc

SEQ ID NO: 953079 - RNA, 20 nt, Mycobacterium avium subsp. paratuberculosis
ccgcgcgcggccaccgcgcg

SEQ ID NO: 953080 - RNA, 20 nt, Mycobacterium avium subsp. paratuberculosis
ccgcgcgaucaggccggcca

SEQ ID NO: 953081 - RNA, 21 nt, Mycobacterium avium subsp. paratuberculosis
ccgcgcgaucaggccggccac

SEQ ID NO: 953082 - RNA, 14 nt, Mycobacterium avium subsp. paratuberculosis
ccgcgcgacgccgu

SEQ ID NO: 953083 - RNA, 17 nt, Mycobacterium avium subsp. paratuberculosis
ccgcgcgacgccguaga

SEQ ID NO: 953084 - RNA, 23 nt, Mycobacterium avium subsp. paratuberculosis
ccgcgcgagaguaucgccacgcc

SEQ ID NO: 953085 - RNA, 21 nt, Mycobacterium avium subsp. paratuberculosis
ccgcgcgagcgcagcgccagg

SEQ ID NO: 953086 - RNA, 14 nt, Mycobacterium avium subsp. paratuberculosis
ccgcgcgagcgcgc

SEQ ID NO: 953087 - RNA, 19 nt, Mycobacterium avium subsp. paratuberculosis
ccgcgcgaagucccacugc

SEQ ID NO: 953088 - RNA, 17 nt, Mycobacterium avium subsp. paratuberculosis
ccgcgcgacaucaccgc

SEQ ID NO: 953089 - RNA, 17 nt, Mycobacterium avium subsp. paratuberculosis
ccgcgcgaccaucagcc

SEQ ID NO: 953090 - RNA, 21 nt, Mycobacterium avium subsp. paratuberculosis
ccgcgcgaccaucagcccggu

SEQ ID NO: 953091 - RNA, 15 nt, Mycobacterium avium subsp. paratuberculosis
ccgcgccuggcgcag

SEQ ID NO: 953092 - RNA, 17 nt, Mycobacterium avium subsp. paratuberculosis
ccgcgccuggcgcaggg

SEQ ID NO: 953093 - RNA, 15 nt, Mycobacterium avium subsp. paratuberculosis
ccgcgccuucgaccc

SEQ ID NO: 953094 - RNA, 17 nt, Mycobacterium avium subsp. paratuberculosis
ccgcgccuucgacccgg

SEQ ID NO: 953095 - RNA, 20 nt, Mycobacterium avium subsp. paratuberculosis
ccgcgccuucgacccggugg

SEQ ID NO: 953096 - RNA, 20 nt, Mycobacterium avium subsp. paratuberculosis
ccgcgccuccauucgggcca

SEQ ID NO: 953097 - RNA, 16 nt, Mycobacterium avium subsp. paratuberculosis
ccgcgcagcgugucgg

SEQ ID NO: 953098 - RNA, 14 nt, Mycobacterium avium subsp. paratuberculosis
ccgcgccacagcgu

SEQ ID NO: 953099 - RNA, 24 nt, Mycobacterium avium subsp. paratuberculosis
ccgcgccacagcgucucgaccgcg

SEQ ID NO: 953100 - RNA, 16 nt, Mycobacterium avium subsp. paratuberculosis
ccgcgcagcggggcgc

SEQ ID NO: 953101 - RNA, 21 nt, Mycobacterium avium subsp. paratuberculosis
ccgcgcagcggggcgcgcagg

SEQ ID NO: 953102 - RNA, 23 nt, Mycobacterium avium subsp. paratuberculosis
ccgcgcagcagcguuccgucggc

SEQ ID NO: 953103 - RNA, 14 nt, Mycobacterium avium subsp. paratuberculosis
ccgcgcagaucgau

SEQ ID NO: 953104 - RNA, 19 nt, Mycobacterium avium subsp. paratuberculosis
ccgcgcagaucgaugggga

SEQ ID NO: 953105 - RNA, 13 nt, Mycobacterium avium subsp. paratuberculosis
ccgcgcagcaccg

SEQ ID NO: 953106 - RNA, 16 nt, Mycobacterium avium subsp. paratuberculosis
ccgcgcagcaccgcgu

SEQ ID NO: 953107 - RNA, 15 nt, Mycobacterium avium subsp. paratuberculosis
ccgcgcagcaccguc

SEQ ID NO: 953108 - RNA, 21 nt, Mycobacterium avium subsp. paratuberculosis
ccgcgcagcaccgucaccuuc

SEQ ID NO: 953109 - RNA, 17 nt, Mycobacterium avium subsp. paratuberculosis
ccgcgccagcaccucgg

SEQ ID NO: 953110 - RNA, 22 nt, Mycobacterium avium subsp. paratuberculosis
ccgcgccacguaucgcgccugc

SEQ ID NO: 953111 - RNA, 13 nt, Mycobacterium avium subsp. paratuberculosis
ccgcgccaccgag

SEQ ID NO: 953112 - RNA, 14 nt, Mycobacterium avium subsp. paratuberculosis
ccgcgccacgccgc

SEQ ID NO: 953113 - RNA, 17 nt, Mycobacterium avium subsp. paratuberculosis
ccgcgccagcucggcgg

SEQ ID NO: 953114 - RNA, 18 nt, Mycobacterium avium subsp. paratuberculosis
ccgcgccagcucggcggc

SEQ ID NO: 953115 - RNA, 23 nt, Mycobacterium avium subsp. paratuberculosis
ccgcgccagcucggcggccgggu

SEQ ID NO: 953116 - RNA, 18 nt, Mycobacterium avium subsp. paratuberculosis
ccgcgccagccgccgccg

SEQ ID NO: 953117 - RNA, 16 nt, Mycobacterium avium subsp. paratuberculosis
ccgcgcaaccgggccg

SEQ ID NO: 953118 - RNA, 17 nt, Mycobacterium avium subsp. paratuberculosis
ccgcgcaaccgggccgc

SEQ ID NO: 953119 - RNA, 18 nt, Mycobacterium avium subsp. paratuberculosis
ccgcgcaaccgggccgca

SEQ ID NO: 953120 - RNA, 22 nt, Mycobacterium avium subsp. paratuberculosis
ccgcgcaaucaaaaaccccgcu

SEQ ID NO: 953121 - RNA, 18 nt, Mycobacterium avium subsp. paratuberculosis
ccgcgcaauacccgacca

SEQ ID NO: 953122 - RNA, 23 nt, Mycobacterium avium subsp. paratuberculosis
ccgcgcaauacccgaccagcacc

SEQ ID NO: 953123 - RNA, 21 nt, Mycobacterium avium subsp. paratuberculosis
ccgcgauuuccgguugcggca

SEQ ID NO: 953124 - RNA, 12 nt, Mycobacterium avium subsp. paratuberculosis
ccgcgcagaacc

SEQ ID NO: 953125 - RNA, 21 nt, Mycobacterium avium subsp. paratuberculosis
ccgcgcacucgaacggcccgg

SEQ ID NO: 953126 - RNA, 23 nt, Mycobacterium avium subsp. paratuberculosis
ccgcgcacucgaacggcccggac

SEQ ID NO: 953127 - RNA, 15 nt, Mycobacterium avium subsp. paratuberculosis
ccgcgcacuggagug

SEQ ID NO: 953128 - RNA, 17 nt, Mycobacterium avium subsp. paratuberculosis
ccgcgcacgcucgcggu

SEQ ID NO: 953129 - RNA, 20 nt, Mycobacterium avium subsp. paratuberculosis
ccgcgcacgcucgcggugcg

SEQ ID NO: 953130 - RNA, 12 nt, Mycobacterium avium subsp. paratuberculosis
ccgcgcaccacg

SEQ ID NO: 953131 - RNA, 13 nt, Mycobacterium avium subsp. paratuberculosis
ccgcgcacgacgu

SEQ ID NO: 953132 - RNA, 17 nt, Mycobacterium avium subsp. paratuberculosis
ccgcgcaccggcgcugg

SEQ ID NO: 953133 - RNA, 13 nt, Mycobacterium avium subsp. paratuberculosis
ccgcgcaccguca

SEQ ID NO: 953134 - RNA, 15 nt, Mycobacterium avium subsp. paratuberculosis
ccgcgcaccgucauc

SEQ ID NO: 953135 - RNA, 23 nt, Mycobacterium avium subsp. paratuberculosis
ccgcgcaccccgaaccgcccgcc

SEQ ID NO: 953136 - RNA, 12 nt, Mycobacterium avium subsp. paratuberculosis
ccgcgcaccgcc

SEQ ID NO: 953137 - RNA, 15 nt, Mycobacterium avium subsp. paratuberculosis
ccgcgaaggcggcgu

SEQ ID NO: 953138 - RNA, 19 nt, Mycobacterium avium subsp. paratuberculosis
ccgcgaacgggugaccggc

SEQ ID NO: 953139 - RNA, 21 nt, Mycobacterium avium subsp. paratuberculosis
ccgcgaacgggugaccggcgg

SEQ ID NO: 953140 - RNA, 22 nt, Mycobacterium avium subsp. paratuberculosis
ccgcgaacgggugaccggcggc

SEQ ID NO: 953141 - RNA, 15 nt, Mycobacterium avium subsp. paratuberculosis
ccgcgaacgggugcg

SEQ ID NO: 953142 - RNA, 18 nt, Mycobacterium avium subsp. paratuberculosis
ccgcgaacucgucgacgc

SEQ ID NO: 953143 - RNA, 18 nt, Mycobacterium avium subsp. paratuberculosis
ccgcgaggaaucgcggca

SEQ ID NO: 953144 - RNA, 19 nt, Mycobacterium avium subsp. paratuberculosis
ccgcgaggaaucgcggcag

SEQ ID NO: 953145 - RNA, 17 nt, Mycobacterium avium subsp. paratuberculosis
ccgcgagcgcuaccgcg

SEQ ID NO: 953146 - RNA, 16 nt, Mycobacterium avium subsp. paratuberculosis
ccgcgaagguggcacg

SEQ ID NO: 953147 - RNA, 17 nt, Mycobacterium avium subsp. paratuberculosis
ccgcgaagguggcacgc

SEQ ID NO: 953148 - RNA, 15 nt, Mycobacterium avium subsp. paratuberculosis
ccgcgagcgcgcggu

SEQ ID NO: 953149 - RNA, 17 nt, Mycobacterium avium subsp. paratuberculosis
ccgcgagcgcgcgguga

SEQ ID NO: 953150 - RNA, 19 nt, Mycobacterium avium subsp. paratuberculosis
ccgcgagcgcgcggugaug

SEQ ID NO: 953151 - RNA, 21 nt, Mycobacterium avium subsp. paratuberculosis
ccgcgagcugccccuucgcga

SEQ ID NO: 953152 - RNA, 22 nt, Mycobacterium avium subsp. paratuberculosis
ccgcgaggauuucgcucagccg

SEQ ID NO: 953153 - RNA, 17 nt, Mycobacterium avium subsp. paratuberculosis
ccgcgaggugucgacgc

SEQ ID NO: 953154 - RNA, 19 nt, Mycobacterium avium subsp. paratuberculosis
ccgcgaugucggugggccg

SEQ ID NO: 953155 - RNA, 20 nt, Mycobacterium avium subsp. paratuberculosis
ccgcgaugucggugggccgc

SEQ ID NO: 953156 - RNA, 22 nt, Mycobacterium avium subsp. paratuberculosis
ccgcgaugucggugggccgcac

SEQ ID NO: 953157 - RNA, 13 nt, Mycobacterium avium subsp. paratuberculosis
ccgcgauccgggc

SEQ ID NO: 953158 - RNA, 16 nt, Mycobacterium avium subsp. paratuberculosis
ccgcgauccgggcaug

SEQ ID NO: 953159 - RNA, 17 nt, Mycobacterium avium subsp. paratuberculosis
ccgcgaucggauggugc

SEQ ID NO: 953160 - RNA, 17 nt, Mycobacterium avium subsp. paratuberculosis
ccgcgaucggcgccacg

SEQ ID NO: 953161 - RNA, 22 nt, Mycobacterium avium subsp. paratuberculosis
ccgcgaucggcgccacgaccag

SEQ ID NO: 953162 - RNA, 14 nt, Mycobacterium avium subsp. paratuberculosis
ccgcgaucggcgug

SEQ ID NO: 953163 - RNA, 20 nt, Mycobacterium avium subsp. paratuberculosis
ccgcgaucaccaccccggug

SEQ ID NO: 953164 - RNA, 23 nt, Mycobacterium avium subsp. paratuberculosis
ccgcgaucaccaccccggugccg

SEQ ID NO: 953165 - RNA, 17 nt, Mycobacterium avium subsp. paratuberculosis
ccgcgaucaccgagaug

SEQ ID NO: 953166 - RNA, 21 nt, Mycobacterium avium subsp. paratuberculosis
ccgcgaucagccccagggugc

SEQ ID NO: 953167 - RNA, 17 nt, Mycobacterium avium subsp. paratuberculosis
ccgcgauccagcgcugg

SEQ ID NO: 953168 - RNA, 18 nt, Mycobacterium avium subsp. paratuberculosis
ccgcgauccagcgcuggc

SEQ ID NO: 953169 - RNA, 18 nt, Mycobacterium avium subsp. paratuberculosis
ccgcgaucgccagcgcgg

SEQ ID NO: 953170 - RNA, 22 nt, Mycobacterium avium subsp. paratuberculosis
ccgcgaucgccagcgcgguguc

SEQ ID NO: 953171 - RNA, 13 nt, Mycobacterium avium subsp. paratuberculosis
ccgcgaucgccga

SEQ ID NO: 953172 - RNA, 15 nt, Mycobacterium avium subsp. paratuberculosis
ccgcgaucgccgacg

SEQ ID NO: 953173 - RNA, 13 nt, Mycobacterium avium subsp. paratuberculosis
ccgcgaucagcuc

SEQ ID NO: 953174 - RNA, 13 nt, Mycobacterium avium subsp. paratuberculosis
ccgcgaucagggc

SEQ ID NO: 953175 - RNA, 16 nt, Mycobacterium avium subsp. paratuberculosis
ccgcgaucagggccgc

SEQ ID NO: 953176 - RNA, 21 nt, Mycobacterium avium subsp. paratuberculosis
ccgcgaucagggccgcggccg

SEQ ID NO: 953177 - RNA, 23 nt, Mycobacterium avium subsp. paratuberculosis
ccgcgaucagggccgcggccgcc

SEQ ID NO: 953178 - RNA, 16 nt, Mycobacterium avium subsp. paratuberculosis
ccgcgauccagcgcug

SEQ ID NO: 953179 - RNA, 13 nt, Mycobacterium avium subsp. paratuberculosis
ccgcgaucaccac

SEQ ID NO: 953180 - RNA, 19 nt, Mycobacterium avium subsp. paratuberculosis
ccgcgauagccaucagaac

SEQ ID NO: 953181 - RNA, 13 nt, Mycobacterium avium subsp. paratuberculosis
ccgcgagucgagg

SEQ ID NO: 953182 - RNA, 16 nt, Mycobacterium avium subsp. paratuberculosis
ccgcgaguucgcgcac

SEQ ID NO: 953183 - RNA, 21 nt, Mycobacterium avium subsp. paratuberculosis
ccgcgaguucgcgcacgcugg

SEQ ID NO: 953184 - RNA, 21 nt, Mycobacterium avium subsp. paratuberculosis
ccgcgaguuguacccuucggc

SEQ ID NO: 953185 - RNA, 18 nt, Mycobacterium avium subsp. paratuberculosis
ccgccgacggagacgacc

SEQ ID NO: 953186 - RNA, 15 nt, Mycobacterium avium subsp. paratuberculosis
ccgccgacgguggcc

SEQ ID NO: 953187 - RNA, 16 nt, Mycobacterium avium subsp. paratuberculosis
ccgccgacgguggccc

SEQ ID NO: 953188 - RNA, 12 nt, Mycobacterium avium subsp. paratuberculosis
ccgccgacgucg

SEQ ID NO: 953189 - RNA, 19 nt, Mycobacterium avium subsp. paratuberculosis
ccgccgacgucgugggcga

SEQ ID NO: 953190 - RNA, 19 nt, Mycobacterium avium subsp. paratuberculosis
ccgccgacuccccgcccgg

SEQ ID NO: 953191 - RNA, 14 nt, Mycobacterium avium subsp. paratuberculosis
ccgccgagacggcg

SEQ ID NO: 953192 - RNA, 15 nt, Mycobacterium avium subsp. paratuberculosis
ccgccgagacggcgu

SEQ ID NO: 953193 - RNA, 17 nt, Mycobacterium avium subsp. paratuberculosis
ccgccgagacggcgugg

SEQ ID NO: 953194 - RNA, 22 nt, Mycobacterium avium subsp. paratuberculosis
ccgccgagauccaccgcgcggc

SEQ ID NO: 953195 - RNA, 23 nt, Mycobacterium avium subsp. paratuberculosis
ccgccgagcaacagcccgaccgu

SEQ ID NO: 953196 - RNA, 18 nt, Mycobacterium avium subsp. paratuberculosis
ccgccgagccgcggguga

SEQ ID NO: 953197 - RNA, 14 nt, Mycobacterium avium subsp. paratuberculosis
ccgccgagccgcuc

SEQ ID NO: 953198 - RNA, 15 nt, Mycobacterium avium subsp. paratuberculosis
ccgccgagccggcac

SEQ ID NO: 953199 - RNA, 19 nt, Mycobacterium avium subsp. paratuberculosis
ccgccgagccggcacggcc

SEQ ID NO: 953200 - RNA, 14 nt, Mycobacterium avium subsp. paratuberculosis
ccgccgagccgucg

SEQ ID NO: 953201 - RNA, 14 nt, Mycobacterium avium subsp. paratuberculosis
ccgccgagcgucac

SEQ ID NO: 953202 - RNA, 21 nt, Mycobacterium avium subsp. paratuberculosis
ccgccgagcgucacgcuagcg

SEQ ID NO: 953203 - RNA, 20 nt, Mycobacterium avium subsp. paratuberculosis
ccgccgaggcgaugccgugc

SEQ ID NO: 953204 - RNA, 16 nt, Mycobacterium avium subsp. paratuberculosis
ccgccgagggccagca

SEQ ID NO: 953205 - RNA, 19 nt, Mycobacterium avium subsp. paratuberculosis
ccgccgagggcccgggcag

SEQ ID NO: 953206 - RNA, 22 nt, Mycobacterium avium subsp. paratuberculosis
ccgccgagggggaagucgaccg

SEQ ID NO: 953207 - RNA, 23 nt, Mycobacterium avium subsp. paratuberculosis
ccgccgagggggaagucgaccgg

SEQ ID NO: 953208 - RNA, 13 nt, Mycobacterium avium subsp. paratuberculosis
ccgccgagucgcg

SEQ ID NO: 953209 - RNA, 16 nt, Mycobacterium avium subsp. paratuberculosis
ccgccgagucgcgccg

SEQ ID NO: 953210 - RNA, 18 nt, Mycobacterium avium subsp. paratuberculosis
ccgccgagucgcgccgcg

SEQ ID NO: 953211 - RNA, 12 nt, Mycobacterium avium subsp. paratuberculosis
ccgccgcaccca

SEQ ID NO: 953212 - RNA, 17 nt, Mycobacterium avium subsp. paratuberculosis
ccgccgcaccggccggc

SEQ ID NO: 953213 - RNA, 18 nt, Mycobacterium avium subsp. paratuberculosis
ccgccgcaccucgccggc

SEQ ID NO: 953214 - RNA, 19 nt, Mycobacterium avium subsp. paratuberculosis
ccgccgcaccucgccggcc

SEQ ID NO: 953215 - RNA, 20 nt, Mycobacterium avium subsp. paratuberculosis
ccgccgauucaaccccgcgc

SEQ ID NO: 953216 - RNA, 22 nt, Mycobacterium avium subsp. paratuberculosis
ccgccgauucaaccccgcgcgc

SEQ ID NO: 953217 - RNA, 24 nt, Mycobacterium avium subsp. paratuberculosis
ccgccgauucaaccccgcgcgcgg

SEQ ID NO: 953218 - RNA, 21 nt, Mycobacterium avium subsp. paratuberculosis
ccgccgauggacacgcugccg

SEQ ID NO: 953219 - RNA, 13 nt, Mycobacterium avium subsp. paratuberculosis
ccgccgauggcga

SEQ ID NO: 953220 - RNA, 20 nt, Mycobacterium avium subsp. paratuberculosis
ccgccgaugugaucggcggc

SEQ ID NO: 953221 - RNA, 22 nt, Mycobacterium avium subsp. paratuberculosis
ccgccgaugugaucggcggcca

SEQ ID NO: 953222 - RNA, 23 nt, Mycobacterium avium subsp. paratuberculosis
ccgccgaugugaucggcggccac

SEQ ID NO: 953223 - RNA, 16 nt, Mycobacterium avium subsp. paratuberculosis
ccgccgaugcgcccgc

SEQ ID NO: 953224 - RNA, 18 nt, Mycobacterium avium subsp. paratuberculosis
ccgccgaugcgcccgcug

SEQ ID NO: 953225 - RNA, 19 nt, Mycobacterium avium subsp. paratuberculosis
ccgccgaucaacaggccca

SEQ ID NO: 953226 - RNA, 21 nt, Mycobacterium avium subsp. paratuberculosis
ccgccgaucaacaggcccagc

SEQ ID NO: 953227 - RNA, 16 nt, Mycobacterium avium subsp. paratuberculosis
ccgccgaucgaucagc

SEQ ID NO: 953228 - RNA, 20 nt, Mycobacterium avium subsp. paratuberculosis
ccgccgaucuugagccggau

SEQ ID NO: 953229 - RNA, 17 nt, Mycobacterium avium subsp. paratuberculosis
ccgccgaugacggcgcg

SEQ ID NO: 953230 - RNA, 18 nt, Mycobacterium avium subsp. paratuberculosis
ccgccgaugacggcgcga

SEQ ID NO: 953231 - RNA, 18 nt, Mycobacterium avium subsp. paratuberculosis
ccgccgaugaugguggcg

SEQ ID NO: 953232 - RNA, 22 nt, Mycobacterium avium subsp. paratuberculosis
ccgccgaugaugguggcggcca

SEQ ID NO: 953233 - RNA, 13 nt, Mycobacterium avium subsp. paratuberculosis
ccgccgccauccg

SEQ ID NO: 953234 - RNA, 19 nt, Mycobacterium avium subsp. paratuberculosis
ccgccgccauccgcgccga

SEQ ID NO: 953235 - RNA, 20 nt, Mycobacterium avium subsp. paratuberculosis
ccgccgccauccguucggcu

SEQ ID NO: 953236 - RNA, 21 nt, Mycobacterium avium subsp. paratuberculosis
ccgccgccaucuccuccgggc

SEQ ID NO: 953237 - RNA, 15 nt, Mycobacterium avium subsp. paratuberculosis
ccgccgccagcacca

SEQ ID NO: 953238 - RNA, 13 nt, Mycobacterium avium subsp. paratuberculosis
ccgccgcccacgc

SEQ ID NO: 953239 - RNA, 14 nt, Mycobacterium avium subsp. paratuberculosis
ccgccgcccugcgg

SEQ ID NO: 953240 - RNA, 14 nt, Mycobacterium avium subsp. paratuberculosis
ccgccgcccgcgcg

SEQ ID NO: 953241 - RNA, 16 nt, Mycobacterium avium subsp. paratuberculosis
ccgccgcccaggccga

SEQ ID NO: 953242 - RNA, 19 nt, Mycobacterium avium subsp. paratuberculosis
ccgccgccccgucggucgg

SEQ ID NO: 953243 - RNA, 22 nt, Mycobacterium avium subsp. paratuberculosis
ccgccgccagcagcagcgccgc

SEQ ID NO: 953244 - RNA, 22 nt, Mycobacterium avium subsp. paratuberculosis
ccgccgccagccagccggugcg

SEQ ID NO: 953245 - RNA, 23 nt, Mycobacterium avium subsp. paratuberculosis
ccgccgccagccagccggugcgg

SEQ ID NO: 953246 - RNA, 21 nt, Mycobacterium avium subsp. paratuberculosis
ccgccgccagcgcggggucgg

SEQ ID NO: 953247 - RNA, 14 nt, Mycobacterium avium subsp. paratuberculosis
ccgccgccaccguc

SEQ ID NO: 953248 - RNA, 19 nt, Mycobacterium avium subsp. paratuberculosis
ccgccgccaccgucgccgg

SEQ ID NO: 953249 - RNA, 20 nt, Mycobacterium avium subsp. paratuberculosis
ccgccgccaccgucgccggc

SEQ ID NO: 953250 - RNA, 13 nt, Mycobacterium avium subsp. paratuberculosis
ccgccgcagcagc

SEQ ID NO: 953251 - RNA, 19 nt, Mycobacterium avium subsp. paratuberculosis
ccgccgcagcagccgcgcc

SEQ ID NO: 953252 - RNA, 19 nt, Mycobacterium avium subsp. paratuberculosis
ccgccgcagcccaggccca

SEQ ID NO: 953253 - RNA, 13 nt, Mycobacterium avium subsp. paratuberculosis
ccgccgcaacagc

SEQ ID NO: 953254 - RNA, 19 nt, Mycobacterium avium subsp. paratuberculosis
ccgccgcacacuuccggga

SEQ ID NO: 953255 - RNA, 14 nt, Mycobacterium avium subsp. paratuberculosis
ccgccgcagcgcag

SEQ ID NO: 953256 - RNA, 22 nt, Mycobacterium avium subsp. paratuberculosis
ccgccgcagcggcgccgcagcu

SEQ ID NO: 953257 - RNA, 13 nt, Mycobacterium avium subsp. paratuberculosis
ccgccgcauaccg

SEQ ID NO: 953258 - RNA, 18 nt, Mycobacterium avium subsp. paratuberculosis
ccgccgcauaccgcccgc

SEQ ID NO: 953259 - RNA, 20 nt, Mycobacterium avium subsp. paratuberculosis
ccgccgcauuccucggccag

SEQ ID NO: 953260 - RNA, 14 nt, Mycobacterium avium subsp. paratuberculosis
ccgccgccaccacg

SEQ ID NO: 953261 - RNA, 15 nt, Mycobacterium avium subsp. paratuberculosis
ccgccgccaccacgg

SEQ ID NO: 953262 - RNA, 12 nt, Mycobacterium avium subsp. paratuberculosis
ccgccgccgcgg

SEQ ID NO: 953263 - RNA, 14 nt, Mycobacterium avium subsp. paratuberculosis
ccgccgccgcggcc

SEQ ID NO: 953264 - RNA, 16 nt, Mycobacterium avium subsp. paratuberculosis
ccgccgccgcggccgc

SEQ ID NO: 953265 - RNA, 14 nt, Mycobacterium avium subsp. paratuberculosis
ccgccgccgcgggu

SEQ ID NO: 953266 - RNA, 16 nt, Mycobacterium avium subsp. paratuberculosis
ccgccgccgcgggugg

SEQ ID NO: 953267 - RNA, 13 nt, Mycobacterium avium subsp. paratuberculosis
ccgccgccgacuc

SEQ ID NO: 953268 - RNA, 14 nt, Mycobacterium avium subsp. paratuberculosis
ccgccgccgagcuc

SEQ ID NO: 953269 - RNA, 16 nt, Mycobacterium avium subsp. paratuberculosis
ccgccgccgagcucgg

SEQ ID NO: 953270 - RNA, 13 nt, Mycobacterium avium subsp. paratuberculosis
ccgccgccgaaca

SEQ ID NO: 953271 - RNA, 13 nt, Mycobacterium avium subsp. paratuberculosis
ccgccgccgacca

SEQ ID NO: 953272 - RNA, 14 nt, Mycobacterium avium subsp. paratuberculosis
ccgccgcgaccguc

SEQ ID NO: 953273 - RNA, 17 nt, Mycobacterium avium subsp. paratuberculosis
ccgccgcgaccgucagc

SEQ ID NO: 953274 - RNA, 14 nt, Mycobacterium avium subsp. paratuberculosis
ccgccgcgacgaug

SEQ ID NO: 953275 - RNA, 22 nt, Mycobacterium avium subsp. paratuberculosis
ccgccgcgacgaugccggcguc

SEQ ID NO: 953276 - RNA, 12 nt, Mycobacterium avium subsp. paratuberculosis
ccgccgcgacgg

SEQ ID NO: 953277 - RNA, 13 nt, Mycobacterium avium subsp. paratuberculosis
ccgccgcgacacc

SEQ ID NO: 953278 - RNA, 15 nt, Mycobacterium avium subsp. paratuberculosis
ccgccgcgaccacag

SEQ ID NO: 953279 - RNA, 14 nt, Mycobacterium avium subsp. paratuberculosis
ccgccgccggcgcu

SEQ ID NO: 953280 - RNA, 13 nt, Mycobacterium avium subsp. paratuberculosis
ccgccgccggcgg

SEQ ID NO: 953281 - RNA, 14 nt, Mycobacterium avium subsp. paratuberculosis
ccgccgccggcgga

SEQ ID NO: 953282 - RNA, 14 nt, Mycobacterium avium subsp. paratuberculosis
ccgccgccggcggu

SEQ ID NO: 953283 - RNA, 13 nt, Mycobacterium avium subsp. paratuberculosis
ccgccgccggcgu

SEQ ID NO: 953284 - RNA, 15 nt, Mycobacterium avium subsp. paratuberculosis
ccgccgccggcgucg

SEQ ID NO: 953285 - RNA, 12 nt, Mycobacterium avium subsp. paratuberculosis
ccgccgccggga

SEQ ID NO: 953286 - RNA, 12 nt, Mycobacterium avium subsp. paratuberculosis
ccgccgccgucg

SEQ ID NO: 953287 - RNA, 15 nt, Mycobacterium avium subsp. paratuberculosis
ccgccgccgugcauc

SEQ ID NO: 953288 - RNA, 16 nt, Mycobacterium avium subsp. paratuberculosis
ccgcccgcucgacggc

SEQ ID NO: 953289 - RNA, 19 nt, Mycobacterium avium subsp. paratuberculosis
ccgcccgggcggcccgggu

SEQ ID NO: 953290 - RNA, 20 nt, Mycobacterium avium subsp. paratuberculosis
ccgcccgggcggcccgggug

SEQ ID NO: 953291 - RNA, 14 nt, Mycobacterium avium subsp. paratuberculosis
ccgcccgcgcggcg

SEQ ID NO: 953292 - RNA, 15 nt, Mycobacterium avium subsp. paratuberculosis
ccgcccgcgcggcgg

SEQ ID NO: 953293 - RNA, 17 nt, Mycobacterium avium subsp. paratuberculosis
ccgcccgcgcggcggcc

SEQ ID NO: 953294 - RNA, 19 nt, Mycobacterium avium subsp. paratuberculosis
ccgcccgcgcggcggccaa

SEQ ID NO: 953295 - RNA, 16 nt, Mycobacterium avium subsp. paratuberculosis
ccgcccggggcggcga

SEQ ID NO: 953296 - RNA, 19 nt, Mycobacterium avium subsp. paratuberculosis
ccgcccggggcggcgaugc

SEQ ID NO: 953297 - RNA, 13 nt, Mycobacterium avium subsp. paratuberculosis
ccgcccgggucgu

SEQ ID NO: 953298 - RNA, 17 nt, Mycobacterium avium subsp. paratuberculosis
ccgcccgggucgucggu

SEQ ID NO: 953299 - RNA, 14 nt, Mycobacterium avium subsp. paratuberculosis
ccgcccgggugaug

SEQ ID NO: 953300 - RNA, 20 nt, Mycobacterium avium subsp. paratuberculosis
ccgcccgggugauggucucc

SEQ ID NO: 953301 - RNA, 13 nt, Mycobacterium avium subsp. paratuberculosis
ccgcccgggugca

SEQ ID NO: 953302 - RNA, 21 nt, Mycobacterium avium subsp. paratuberculosis
ccgcccgggugugggcgccgu

SEQ ID NO: 953303 - RNA, 22 nt, Mycobacterium avium subsp. paratuberculosis
ccgcccugcgggaacagcggga

SEQ ID NO: 953304 - RNA, 14 nt, Mycobacterium avium subsp. paratuberculosis
ccgcccucgccgaa

SEQ ID NO: 953305 - RNA, 15 nt, Mycobacterium avium subsp. paratuberculosis
ccgcccucgccgaac

SEQ ID NO: 953306 - RNA, 23 nt, Mycobacterium avium subsp. paratuberculosis
ccgcccucgccgaaccggggccg

SEQ ID NO: 953307 - RNA, 15 nt, Mycobacterium avium subsp. paratuberculosis
ccgcccucgcugccg

SEQ ID NO: 953308 - RNA, 13 nt, Mycobacterium avium subsp. paratuberculosis
ccgcccucggccg

SEQ ID NO: 953309 - RNA, 22 nt, Mycobacterium avium subsp. paratuberculosis
ccgcccucggccguaccggcgu

SEQ ID NO: 953310 - RNA, 13 nt, Mycobacterium avium subsp. paratuberculosis
ccgcccgucgggg

SEQ ID NO: 953311 - RNA, 18 nt, Mycobacterium avium subsp. paratuberculosis
ccgcccgucggggcccgg

SEQ ID NO: 953312 - RNA, 22 nt, Mycobacterium avium subsp. paratuberculosis
ccgcccgucggggcccggcccg

SEQ ID NO: 953313 - RNA, 23 nt, Mycobacterium avium subsp. paratuberculosis
ccgcccguuggcuuuucgggccg

SEQ ID NO: 953314 - RNA, 16 nt, Mycobacterium avium subsp. paratuberculosis
ccgcccguccgggccg

SEQ ID NO: 953315 - RNA, 16 nt, Mycobacterium avium subsp. paratuberculosis
ccgcccguccuggaug

SEQ ID NO: 953316 - RNA, 14 nt, Mycobacterium avium subsp. paratuberculosis
ccgcccgucgccuc

SEQ ID NO: 953317 - RNA, 15 nt, Mycobacterium avium subsp. paratuberculosis
ccgcccgucgccucc

SEQ ID NO: 953318 - RNA, 22 nt, Mycobacterium avium subsp. paratuberculosis
ccgcccgcgcgaugcgggcgcc

SEQ ID NO: 953319 - RNA, 16 nt, Mycobacterium avium subsp. paratuberculosis
ccgcccgccgguggcc

SEQ ID NO: 953320 - RNA, 12 nt, Mycobacterium avium subsp. paratuberculosis
ccgcccgcgacu

SEQ ID NO: 953321 - RNA, 20 nt, Mycobacterium avium subsp. paratuberculosis
ccgcccgcgacugucggcuc

SEQ ID NO: 953322 - RNA, 17 nt, Mycobacterium avium subsp. paratuberculosis
ccgcccgcagcggcggu

SEQ ID NO: 953323 - RNA, 15 nt, Mycobacterium avium subsp. paratuberculosis
ccgcccgcccggcac

SEQ ID NO: 953324 - RNA, 16 nt, Mycobacterium avium subsp. paratuberculosis
ccgcccgcaccagcag

SEQ ID NO: 953325 - RNA, 20 nt, Mycobacterium avium subsp. paratuberculosis
ccgcccgcaguucggccgcc

SEQ ID NO: 953326 - RNA, 17 nt, Mycobacterium avium subsp. paratuberculosis
ccgcccgaucccgucgu

SEQ ID NO: 953327 - RNA, 14 nt, Mycobacterium avium subsp. paratuberculosis
ccgccaucgccgcc

SEQ ID NO: 953328 - RNA, 20 nt, Mycobacterium avium subsp. paratuberculosis
ccgccaucgccgccgccauc

SEQ ID NO: 953329 - RNA, 15 nt, Mycobacterium avium subsp. paratuberculosis
ccgccauccgcgccg

SEQ ID NO: 953330 - RNA, 13 nt, Mycobacterium avium subsp. paratuberculosis
ccgccaucauccg

SEQ ID NO: 953331 - RNA, 18 nt, Mycobacterium avium subsp. paratuberculosis
ccgcccuugcucgcggcg

SEQ ID NO: 953332 - RNA, 19 nt, Mycobacterium avium subsp. paratuberculosis
ccgcccuugcucgcggcgu

SEQ ID NO: 953333 - RNA, 16 nt, Mycobacterium avium subsp. paratuberculosis
ccgcccuuggccgcgg

SEQ ID NO: 953334 - RNA, 18 nt, Mycobacterium avium subsp. paratuberculosis
ccgcccuugaacggcacc

SEQ ID NO: 953335 - RNA, 22 nt, Mycobacterium avium subsp. paratuberculosis
ccgcccuggcuguagcggucgu

SEQ ID NO: 953336 - RNA, 22 nt, Mycobacterium avium subsp. paratuberculosis
ccgcccugcuugaacagcaccc

SEQ ID NO: 953337 - RNA, 15 nt, Mycobacterium avium subsp. paratuberculosis
ccgccgaaccgauca

SEQ ID NO: 953338 - RNA, 17 nt, Mycobacterium avium subsp. paratuberculosis
ccgccgaaccgaucacc

SEQ ID NO: 953339 - RNA, 13 nt, Mycobacterium avium subsp. paratuberculosis
ccgccgaacgccu

SEQ ID NO: 953340 - RNA, 16 nt, Mycobacterium avium subsp. paratuberculosis
ccgccgaacagccggg

SEQ ID NO: 953341 - RNA, 20 nt, Mycobacterium avium subsp. paratuberculosis
ccgccgaaccagaucggcgg

SEQ ID NO: 953342 - RNA, 13 nt, Mycobacterium avium subsp. paratuberculosis
ccgccgaaacccg

SEQ ID NO: 953343 - RNA, 22 nt, Mycobacterium avium subsp. paratuberculosis
ccgccgaaagccuccgcgauca

SEQ ID NO: 953344 - RNA, 23 nt, Mycobacterium avium subsp. paratuberculosis
ccgccgaaagguuuucccggccg

SEQ ID NO: 953345 - RNA, 17 nt, Mycobacterium avium subsp. paratuberculosis
ccgccgaacaccggcag

SEQ ID NO: 953346 - RNA, 20 nt, Mycobacterium avium subsp. paratuberculosis
ccgccgaacaccggcagcgc

SEQ ID NO: 953347 - RNA, 22 nt, Mycobacterium avium subsp. paratuberculosis
ccgccgaacaccggcagcgcca

SEQ ID NO: 953348 - RNA, 12 nt, Mycobacterium avium subsp. paratuberculosis
ccgccgacgccc

SEQ ID NO: 953349 - RNA, 17 nt, Mycobacterium avium subsp. paratuberculosis
ccgccgacgcccaggcu

SEQ ID NO: 953350 - RNA, 19 nt, Mycobacterium avium subsp. paratuberculosis
ccgccgacgcccaggcuca

SEQ ID NO: 953351 - RNA, 16 nt, Mycobacterium avium subsp. paratuberculosis
ccgccgacgaugucga

SEQ ID NO: 953352 - RNA, 14 nt, Mycobacterium avium subsp. paratuberculosis
ccgccgacgacggc

SEQ ID NO: 953353 - RNA, 15 nt, Mycobacterium avium subsp. paratuberculosis
ccgccgaccgguccg

SEQ ID NO: 953354 - RNA, 17 nt, Mycobacterium avium subsp. paratuberculosis
ccgccgaccgguccgcc

SEQ ID NO: 953355 - RNA, 18 nt, Mycobacterium avium subsp. paratuberculosis
ccgccgaccgguccgccg

SEQ ID NO: 953356 - RNA, 15 nt, Mycobacterium avium subsp. paratuberculosis
ccgccgacaucgccc

SEQ ID NO: 953357 - RNA, 17 nt, Mycobacterium avium subsp. paratuberculosis
ccgccgacaucgcccgg

SEQ ID NO: 953358 - RNA, 20 nt, Mycobacterium avium subsp. paratuberculosis
ccgccgaccacaugccguug

SEQ ID NO: 953359 - RNA, 17 nt, Mycobacterium avium subsp. paratuberculosis
ccgccgaccacgccgcg

SEQ ID NO: 953360 - RNA, 18 nt, Mycobacterium avium subsp. paratuberculosis
ccgccgaccacgccgcgc

SEQ ID NO: 953361 - RNA, 13 nt, Mycobacterium avium subsp. paratuberculosis
ccgccgaccagga

SEQ ID NO: 953362 - RNA, 22 nt, Mycobacterium avium subsp. paratuberculosis
ccgccgacccaauacgaucagc

SEQ ID NO: 953363 - RNA, 14 nt, Mycobacterium avium subsp. paratuberculosis
ccgccgaccgccga

SEQ ID NO: 953364 - RNA, 18 nt, Mycobacterium avium subsp. paratuberculosis
ccgccgaccgccgagcgg

SEQ ID NO: 953365 - RNA, 16 nt, Mycobacterium avium subsp. paratuberculosis
ccgccgaagccggcuc

SEQ ID NO: 953366 - RNA, 17 nt, Mycobacterium avium subsp. paratuberculosis
ccgccgaagccggcucg

SEQ ID NO: 953367 - RNA, 17 nt, Mycobacterium avium subsp. paratuberculosis
ccgccgaagcggcgcac

SEQ ID NO: 953368 - RNA, 15 nt, Mycobacterium avium subsp. paratuberculosis
ccgccgaacgccucc

SEQ ID NO: 953369 - RNA, 21 nt, Mycobacterium avium subsp. paratuberculosis
ccgccgaacgccuccgccgcc

SEQ ID NO: 953370 - RNA, 13 nt, Mycobacterium avium subsp. paratuberculosis
ccgccgacaccag

SEQ ID NO: 953371 - RNA, 16 nt, Mycobacterium avium subsp. paratuberculosis
ccgccgacagcaccuc

SEQ ID NO: 953372 - RNA, 13 nt, Mycobacterium avium subsp. paratuberculosis
ccgccgacagcgg

SEQ ID NO: 953373 - RNA, 21 nt, Mycobacterium avium subsp. paratuberculosis
ccgccaguucccggccagcgc

SEQ ID NO: 953374 - RNA, 22 nt, Mycobacterium avium subsp. paratuberculosis
ccgccaguucccggccagcgca

SEQ ID NO: 953375 - RNA, 17 nt, Mycobacterium avium subsp. paratuberculosis
ccgccaguuguuggccg

SEQ ID NO: 953376 - RNA, 19 nt, Mycobacterium avium subsp. paratuberculosis
ccgccagguuggcggcggc

SEQ ID NO: 953377 - RNA, 22 nt, Mycobacterium avium subsp. paratuberculosis
ccgccagguuggcggcggcccg

SEQ ID NO: 953378 - RNA, 17 nt, Mycobacterium avium subsp. paratuberculosis
ccgccagggucucgggc

SEQ ID NO: 953379 - RNA, 23 nt, Mycobacterium avium subsp. paratuberculosis
ccgccagggucucgggcagcagc

SEQ ID NO: 953380 - RNA, 17 nt, Mycobacterium avium subsp. paratuberculosis
ccgccagggugccgcug

SEQ ID NO: 953381 - RNA, 20 nt, Mycobacterium avium subsp. paratuberculosis
ccgccagcgcggcgaucagc

SEQ ID NO: 953382 - RNA, 18 nt, Mycobacterium avium subsp. paratuberculosis
ccgccagcgcgccgaucg

SEQ ID NO: 953383 - RNA, 15 nt, Mycobacterium avium subsp. paratuberculosis
ccgccaggcggcgac

SEQ ID NO: 953384 - RNA, 17 nt, Mycobacterium avium subsp. paratuberculosis
ccgccaggcggcgacga

SEQ ID NO: 953385 - RNA, 23 nt, Mycobacterium avium subsp. paratuberculosis
ccgccaggcggcgacgaacgccg

SEQ ID NO: 953386 - RNA, 17 nt, Mycobacterium avium subsp. paratuberculosis
ccgccagggcgacgccg

SEQ ID NO: 953387 - RNA, 19 nt, Mycobacterium avium subsp. paratuberculosis
ccgccagggcgacgccgcg

SEQ ID NO: 953388 - RNA, 19 nt, Mycobacterium avium subsp. paratuberculosis
ccgccagggcgcggcgcac

SEQ ID NO: 953389 - RNA, 20 nt, Mycobacterium avium subsp. paratuberculosis
ccgccagggcgcggcgcacc

SEQ ID NO: 953390 - RNA, 16 nt, Mycobacterium avium subsp. paratuberculosis
ccgccagcgccggcag

SEQ ID NO: 953391 - RNA, 17 nt, Mycobacterium avium subsp. paratuberculosis
ccgccagcgccggcagc

SEQ ID NO: 953392 - RNA, 14 nt, Mycobacterium avium subsp. paratuberculosis
ccgccagcgcggcg

SEQ ID NO: 953393 - RNA, 15 nt, Mycobacterium avium subsp. paratuberculosis
ccgccagcgcggcgg

SEQ ID NO: 953394 - RNA, 16 nt, Mycobacterium avium subsp. paratuberculosis
ccgccagcgcggcggc

SEQ ID NO: 953395 - RNA, 17 nt, Mycobacterium avium subsp. paratuberculosis
ccgccagcgcggggucg

SEQ ID NO: 953396 - RNA, 15 nt, Mycobacterium avium subsp. paratuberculosis
ccgccagcaccucgc

SEQ ID NO: 953397 - RNA, 21 nt, Mycobacterium avium subsp. paratuberculosis
ccgccagcaccucgcggcagc

SEQ ID NO: 953398 - RNA, 15 nt, Mycobacterium avium subsp. paratuberculosis
ccgccagccgguacg

SEQ ID NO: 953399 - RNA, 16 nt, Mycobacterium avium subsp. paratuberculosis
ccgccagccggucauc

SEQ ID NO: 953400 - RNA, 17 nt, Mycobacterium avium subsp. paratuberculosis
ccgccagccggucaucg

SEQ ID NO: 953401 - RNA, 14 nt, Mycobacterium avium subsp. paratuberculosis
ccgccagcaccgac

SEQ ID NO: 953402 - RNA, 15 nt, Mycobacterium avium subsp. paratuberculosis
ccgccagcaccgaca

SEQ ID NO: 953403 - RNA, 18 nt, Mycobacterium avium subsp. paratuberculosis
ccgccagcaccgacaguc

SEQ ID NO: 953404 - RNA, 16 nt, Mycobacterium avium subsp. paratuberculosis
ccgccagcaccgacgc

SEQ ID NO: 953405 - RNA, 20 nt, Mycobacterium avium subsp. paratuberculosis
ccgccagcaccgacgcgccg

SEQ ID NO: 953406 - RNA, 21 nt, Mycobacterium avium subsp. paratuberculosis
ccgccagcaccgccaccggcc

SEQ ID NO: 953407 - RNA, 14 nt, Mycobacterium avium subsp. paratuberculosis
ccgccagcaccgcg

SEQ ID NO: 953408 - RNA, 15 nt, Mycobacterium avium subsp. paratuberculosis
ccgccagcaccaccg

SEQ ID NO: 953409 - RNA, 14 nt, Mycobacterium avium subsp. paratuberculosis
ccgccagcgcaccg

SEQ ID NO: 953410 - RNA, 16 nt, Mycobacterium avium subsp. paratuberculosis
ccgccagcgcaccgag

SEQ ID NO: 953411 - RNA, 18 nt, Mycobacterium avium subsp. paratuberculosis
ccgccagcgcaccgagcc

SEQ ID NO: 953412 - RNA, 23 nt, Mycobacterium avium subsp. paratuberculosis
ccgccagcgcaccgagcccguuc

SEQ ID NO: 953413 - RNA, 14 nt, Mycobacterium avium subsp. paratuberculosis
ccgccagcgcccgc

SEQ ID NO: 953414 - RNA, 14 nt, Mycobacterium avium subsp. paratuberculosis
ccgccacccgaggc

SEQ ID NO: 953415 - RNA, 22 nt, Mycobacterium avium subsp. paratuberculosis
ccgccacccgcugcucgaccuc

SEQ ID NO: 953416 - RNA, 12 nt, Mycobacterium avium subsp. paratuberculosis
ccgccaccagca

SEQ ID NO: 953417 - RNA, 13 nt, Mycobacterium avium subsp. paratuberculosis
ccgccaccagcag

SEQ ID NO: 953418 - RNA, 18 nt, Mycobacterium avium subsp. paratuberculosis
ccgccacccugcgcaccg

SEQ ID NO: 953419 - RNA, 18 nt, Mycobacterium avium subsp. paratuberculosis
ccgccaccggcccggccg

SEQ ID NO: 953420 - RNA, 20 nt, Mycobacterium avium subsp. paratuberculosis
ccgccaccggcccggccggc

SEQ ID NO: 953421 - RNA, 14 nt, Mycobacterium avium subsp. paratuberculosis
ccgccaccgcccgc

SEQ ID NO: 953422 - RNA, 12 nt, Mycobacterium avium subsp. paratuberculosis
ccgccaccgcga

SEQ ID NO: 953423 - RNA, 18 nt, Mycobacterium avium subsp. paratuberculosis
ccgccagcaaccccgcgg

SEQ ID NO: 953424 - RNA, 11 nt, Mycobacterium avium subsp. paratuberculosis
ccgccagcacc

SEQ ID NO: 953425 - RNA, 13 nt, Mycobacterium avium subsp. paratuberculosis
ccgccagaucgcc

SEQ ID NO: 953426 - RNA, 17 nt, Mycobacterium avium subsp. paratuberculosis
ccgccagaucgccuggc

SEQ ID NO: 953427 - RNA, 22 nt, Mycobacterium avium subsp. paratuberculosis
ccgccagaucgccuggcagcug

SEQ ID NO: 953428 - RNA, 21 nt, Mycobacterium avium subsp. paratuberculosis
ccgccaccaggccgugguugg

SEQ ID NO: 953429 - RNA, 16 nt, Mycobacterium avium subsp. paratuberculosis
ccgccaccacggcagu

SEQ ID NO: 953430 - RNA, 13 nt, Mycobacterium avium subsp. paratuberculosis
ccgccaccacccg

SEQ ID NO: 953431 - RNA, 14 nt, Mycobacterium avium subsp. paratuberculosis
ccgccaccacccgg

SEQ ID NO: 953432 - RNA, 17 nt, Mycobacterium avium subsp. paratuberculosis
ccgccaccacccggcga

SEQ ID NO: 953433 - RNA, 13 nt, Mycobacterium avium subsp. paratuberculosis
ccgcaucgcggcg

SEQ ID NO: 953434 - RNA, 15 nt, Mycobacterium avium subsp. paratuberculosis
ccgcauccgccgggc

SEQ ID NO: 953435 - RNA, 16 nt, Mycobacterium avium subsp. paratuberculosis
ccgcauccgccgggcg

SEQ ID NO: 953436 - RNA, 17 nt, Mycobacterium avium subsp. paratuberculosis
ccgcauccgccgggcgg

SEQ ID NO: 953437 - RNA, 16 nt, Mycobacterium avium subsp. paratuberculosis
ccgcauccgcgagccg

SEQ ID NO: 953438 - RNA, 21 nt, Mycobacterium avium subsp. paratuberculosis
ccgcauccgcgagccgagccg

SEQ ID NO: 953439 - RNA, 18 nt, Mycobacterium avium subsp. paratuberculosis
ccgcaucccccucggcgg

SEQ ID NO: 953440 - RNA, 19 nt, Mycobacterium avium subsp. paratuberculosis
ccgcaucgaaccgccgcgc

SEQ ID NO: 953441 - RNA, 20 nt, Mycobacterium avium subsp. paratuberculosis
ccgcaucgaaccgccgcgcu

SEQ ID NO: 953442 - RNA, 23 nt, Mycobacterium avium subsp. paratuberculosis
ccgcaucgcacagauacgcgacg

SEQ ID NO: 953443 - RNA, 17 nt, Mycobacterium avium subsp. paratuberculosis
ccgcaucgccgaaccgg

SEQ ID NO: 953444 - RNA, 13 nt, Mycobacterium avium subsp. paratuberculosis
ccgcaucgccgag

SEQ ID NO: 953445 - RNA, 18 nt, Mycobacterium avium subsp. paratuberculosis
ccgcaucgccgagggcga

SEQ ID NO: 953446 - RNA, 13 nt, Mycobacterium avium subsp. paratuberculosis
ccgcaggguggcc

SEQ ID NO: 953447 - RNA, 15 nt, Mycobacterium avium subsp. paratuberculosis
ccgcaggguggccag

SEQ ID NO: 953448 - RNA, 23 nt, Mycobacterium avium subsp. paratuberculosis
ccgcaggguggccagcaccgcgu

SEQ ID NO: 953449 - RNA, 17 nt, Mycobacterium avium subsp. paratuberculosis
ccgcagggccugcucgc

SEQ ID NO: 953450 - RNA, 14 nt, Mycobacterium avium subsp. paratuberculosis
ccgcagggcgccgg

SEQ ID NO: 953451 - RNA, 14 nt, Mycobacterium avium subsp. paratuberculosis
ccgcaggugcucgc

SEQ ID NO: 953452 - RNA, 18 nt, Mycobacterium avium subsp. paratuberculosis
ccgcaggugcucgccggc

SEQ ID NO: 953453 - RNA, 20 nt, Mycobacterium avium subsp. paratuberculosis
ccgcaggugcucgccggcgc

SEQ ID NO: 953454 - RNA, 21 nt, Mycobacterium avium subsp. paratuberculosis
ccgcaggugcucgccggcgcg

SEQ ID NO: 953455 - RNA, 23 nt, Mycobacterium avium subsp. paratuberculosis
ccgcaggugcucgccggcgcgga

SEQ ID NO: 953456 - RNA, 13 nt, Mycobacterium avium subsp. paratuberculosis
ccgcagguggugg

SEQ ID NO: 953457 - RNA, 20 nt, Mycobacterium avium subsp. paratuberculosis
ccgcaggcgaacaccucggu

SEQ ID NO: 953458 - RNA, 22 nt, Mycobacterium avium subsp. paratuberculosis
ccgcaggcgaacaccucgguga

SEQ ID NO: 953459 - RNA, 21 nt, Mycobacterium avium subsp. paratuberculosis
ccgcaggcgaaggucagaucg

SEQ ID NO: 953460 - RNA, 17 nt, Mycobacterium avium subsp. paratuberculosis
ccgcaggccgucgccgg

SEQ ID NO: 953461 - RNA, 20 nt, Mycobacterium avium subsp. paratuberculosis
ccgcagcuucugcagcucgc

SEQ ID NO: 953462 - RNA, 21 nt, Mycobacterium avium subsp. paratuberculosis
ccgcagcuucuggucaugaag

SEQ ID NO: 953463 - RNA, 19 nt, Mycobacterium avium subsp. paratuberculosis
ccgcaggagaucggcgcgg

SEQ ID NO: 953464 - RNA, 20 nt, Mycobacterium avium subsp. paratuberculosis
ccgcaggagaucggcgcgga

SEQ ID NO: 953465 - RNA, 22 nt, Mycobacterium avium subsp. paratuberculosis
ccgcaggagaucggcgcggagc

SEQ ID NO: 953466 - RNA, 22 nt, Mycobacterium avium subsp. paratuberculosis
ccgcaggaucgagccggccguc

SEQ ID NO: 953467 - RNA, 16 nt, Mycobacterium avium subsp. paratuberculosis
ccgcaggugcagcucc

SEQ ID NO: 953468 - RNA, 18 nt, Mycobacterium avium subsp. paratuberculosis
ccgcaucaacugcaccag

SEQ ID NO: 953469 - RNA, 21 nt, Mycobacterium avium subsp. paratuberculosis
ccgcaucaccuucugcgcgcc

SEQ ID NO: 953470 - RNA, 23 nt, Mycobacterium avium subsp. paratuberculosis
ccgcaucaccuucugcgcgccgu

SEQ ID NO: 953471 - RNA, 14 nt, Mycobacterium avium subsp. paratuberculosis
ccgcauccagcgcc

SEQ ID NO: 953472 - RNA, 15 nt, Mycobacterium avium subsp. paratuberculosis
ccgcauccagcgccg

SEQ ID NO: 953473 - RNA, 17 nt, Mycobacterium avium subsp. paratuberculosis
ccgcauccagcgccgcc

SEQ ID NO: 953474 - RNA, 23 nt, Mycobacterium avium subsp. paratuberculosis
ccgcauauaggugcugagcgugg

SEQ ID NO: 953475 - RNA, 18 nt, Mycobacterium avium subsp. paratuberculosis
ccgcagugcgucagaacc

SEQ ID NO: 953476 - RNA, 15 nt, Mycobacterium avium subsp. paratuberculosis
ccgcaguucggccgc

SEQ ID NO: 953477 - RNA, 22 nt, Mycobacterium avium subsp. paratuberculosis
ccgcaguucggccgccgugcug

SEQ ID NO: 953478 - RNA, 14 nt, Mycobacterium avium subsp. paratuberculosis
ccgcagucgaucac

SEQ ID NO: 953479 - RNA, 15 nt, Mycobacterium avium subsp. paratuberculosis
ccgcagucgaucacc

SEQ ID NO: 953480 - RNA, 17 nt, Mycobacterium avium subsp. paratuberculosis
ccgcagucgaucaccga

SEQ ID NO: 953481 - RNA, 15 nt, Mycobacterium avium subsp. paratuberculosis
ccgcagucguucggc

SEQ ID NO: 953482 - RNA, 23 nt, Mycobacterium avium subsp. paratuberculosis
ccgcagucguucggccagcacca

SEQ ID NO: 953483 - RNA, 15 nt, Mycobacterium avium subsp. paratuberculosis
ccgcagugccggcgc

SEQ ID NO: 953484 - RNA, 12 nt, Mycobacterium avium subsp. paratuberculosis
ccgcagccgcga

SEQ ID NO: 953485 - RNA, 18 nt, Mycobacterium avium subsp. paratuberculosis
ccgcagccgcgacggcgg

SEQ ID NO: 953486 - RNA, 19 nt, Mycobacterium avium subsp. paratuberculosis
ccgcagccgcgcggccggc

SEQ ID NO: 953487 - RNA, 18 nt, Mycobacterium avium subsp. paratuberculosis
ccgcagccgcuggccgcg

SEQ ID NO: 953488 - RNA, 16 nt, Mycobacterium avium subsp. paratuberculosis
ccgcagccggaucacc

SEQ ID NO: 953489 - RNA, 12 nt, Mycobacterium avium subsp. paratuberculosis
ccgcagccgggu

SEQ ID NO: 953490 - RNA, 14 nt, Mycobacterium avium subsp. paratuberculosis
ccgcagccgggugc

SEQ ID NO: 953491 - RNA, 14 nt, Mycobacterium avium subsp. paratuberculosis
ccgcagcccgucga

SEQ ID NO: 953492 - RNA, 16 nt, Mycobacterium avium subsp. paratuberculosis
ccgcagcccgucgauc

SEQ ID NO: 953493 - RNA, 19 nt, Mycobacterium avium subsp. paratuberculosis
ccgagcaucagcugccguc

SEQ ID NO: 953494 - RNA, 23 nt, Mycobacterium avium subsp. paratuberculosis
ccgagcaucggguugccggcggc

SEQ ID NO: 953495 - RNA, 16 nt, Mycobacterium avium subsp. paratuberculosis
ccgcagcucgcccagc

SEQ ID NO: 953496 - RNA, 17 nt, Mycobacterium avium subsp. paratuberculosis
ccgcagcucgcccagca

SEQ ID NO: 953497 - RNA, 20 nt, Mycobacterium avium subsp. paratuberculosis
ccgcagcucgcccagcaccg

SEQ ID NO: 953498 - RNA, 17 nt, Mycobacterium avium subsp. paratuberculosis
ccgcagcugaucggggc

SEQ ID NO: 953499 - RNA, 22 nt, Mycobacterium avium subsp. paratuberculosis
ccgcagcugaucggggcccacc

SEQ ID NO: 953500 - RNA, 15 nt, Mycobacterium avium subsp. paratuberculosis
ccgcagcgaccgcgg

SEQ ID NO: 953501 - RNA, 18 nt, Mycobacterium avium subsp. paratuberculosis
ccgcagcgaccgcggaug

SEQ ID NO: 953502 - RNA, 20 nt, Mycobacterium avium subsp. paratuberculosis
ccgcagcgaggcgauggugc

SEQ ID NO: 953503 - RNA, 16 nt, Mycobacterium avium subsp. paratuberculosis
ccgcagcgccagcgcg

SEQ ID NO: 953504 - RNA, 15 nt, Mycobacterium avium subsp. paratuberculosis
ccgcagcucgaucac

SEQ ID NO: 953505 - RNA, 11 nt, Mycobacterium avium subsp. paratuberculosis
ccgcagcucgc

SEQ ID NO: 953506 - RNA, 21 nt, Mycobacterium avium subsp. paratuberculosis
ccgcagccuucuuggcgggcg

SEQ ID NO: 953507 - RNA, 23 nt, Mycobacterium avium subsp. paratuberculosis
ccgcagccuucuuggcgggcgcc

SEQ ID NO: 953508 - RNA, 16 nt, Mycobacterium avium subsp. paratuberculosis
ccgcagcgaacgcggc

SEQ ID NO: 953509 - RNA, 19 nt, Mycobacterium avium subsp. paratuberculosis
ccgcagcgaacgcggcuga

SEQ ID NO: 953510 - RNA, 22 nt, Mycobacterium avium subsp. paratuberculosis
ccgcagcgcagcgucggcgugc

SEQ ID NO: 953511 - RNA, 16 nt, Mycobacterium avium subsp. paratuberculosis
ccgcagcgcaucgccg

SEQ ID NO: 953512 - RNA, 20 nt, Mycobacterium avium subsp. paratuberculosis
ccgcagcgcaucgccggcga

SEQ ID NO: 953513 - RNA, 23 nt, Mycobacterium avium subsp. paratuberculosis
ccgcagcgcaucgccggcgaugc

SEQ ID NO: 953514 - RNA, 18 nt, Mycobacterium avium subsp. paratuberculosis
ccgcagcgcaucggugag

SEQ ID NO: 953515 - RNA, 20 nt, Mycobacterium avium subsp. paratuberculosis
ccgcagcgcaucggugagac

SEQ ID NO: 953516 - RNA, 16 nt, Mycobacterium avium subsp. paratuberculosis
ccgcagcgcaucguug

SEQ ID NO: 953517 - RNA, 21 nt, Mycobacterium avium subsp. paratuberculosis
ccgcagcgcaucguugccggc

SEQ ID NO: 953518 - RNA, 15 nt, Mycobacterium avium subsp. paratuberculosis
ccgagcaccagcgga

SEQ ID NO: 953519 - RNA, 17 nt, Mycobacterium avium subsp. paratuberculosis
ccgagcaccaggcgcac

SEQ ID NO: 953520 - RNA, 23 nt, Mycobacterium avium subsp. paratuberculosis
ccgagcaccaggcgcaccagcug

SEQ ID NO: 953521 - RNA, 15 nt, Mycobacterium avium subsp. paratuberculosis
ccgagcaccccggcg

SEQ ID NO: 953522 - RNA, 16 nt, Mycobacterium avium subsp. paratuberculosis
ccgagcaccccgucga

SEQ ID NO: 953523 - RNA, 16 nt, Mycobacterium avium subsp. paratuberculosis
ccgagcaccggcagca

SEQ ID NO: 953524 - RNA, 13 nt, Mycobacterium avium subsp. paratuberculosis
ccgagcaccgggc

SEQ ID NO: 953525 - RNA, 18 nt, Mycobacterium avium subsp. paratuberculosis
ccgagcaccucgucgccg

SEQ ID NO: 953526 - RNA, 20 nt, Mycobacterium avium subsp. paratuberculosis
ccgagcaccucgucgccguc

SEQ ID NO: 953527 - RNA, 22 nt, Mycobacterium avium subsp. paratuberculosis
ccgagcaccucgucgccgucgg

SEQ ID NO: 953528 - RNA, 22 nt, Mycobacterium avium subsp. paratuberculosis
ccgagcaccugaacggccgcgc

SEQ ID NO: 953529 - RNA, 17 nt, Mycobacterium avium subsp. paratuberculosis
ccgagcacgaacgcggc

SEQ ID NO: 953530 - RNA, 20 nt, Mycobacterium avium subsp. paratuberculosis
ccgagcacgaacgcggccgc

SEQ ID NO: 953531 - RNA, 21 nt, Mycobacterium avium subsp. paratuberculosis
ccgagcacgaacgcggccgcc

SEQ ID NO: 953532 - RNA, 13 nt, Mycobacterium avium subsp. paratuberculosis
ccgagcacgcagc

SEQ ID NO: 953533 - RNA, 15 nt, Mycobacterium avium subsp. paratuberculosis
ccgagcacgcagccg

SEQ ID NO: 953534 - RNA, 17 nt, Mycobacterium avium subsp. paratuberculosis
ccgagcacgcagccgcg

SEQ ID NO: 953535 - RNA, 16 nt, Mycobacterium avium subsp. paratuberculosis
ccgagcaccgggcugu

SEQ ID NO: 953536 - RNA, 15 nt, Mycobacterium avium subsp. paratuberculosis
ccgagcacgcggccg

SEQ ID NO: 953537 - RNA, 16 nt, Mycobacterium avium subsp. paratuberculosis
ccgagcacgcggccgc

SEQ ID NO: 953538 - RNA, 16 nt, Mycobacterium avium subsp. paratuberculosis
ccgagcacgucgagca

SEQ ID NO: 953539 - RNA, 20 nt, Mycobacterium avium subsp. paratuberculosis
ccgagcacgucgagcaccgc

SEQ ID NO: 953540 - RNA, 21 nt, Mycobacterium avium subsp. paratuberculosis
ccgagcacgucgagcaccgcg

SEQ ID NO: 953541 - RNA, 12 nt, Mycobacterium avium subsp. paratuberculosis
ccgagcacaccg

SEQ ID NO: 953542 - RNA, 20 nt, Mycobacterium avium subsp. paratuberculosis
ccgagcagacgugaaauccc

SEQ ID NO: 953543 - RNA, 15 nt, Mycobacterium avium subsp. paratuberculosis
ccgagcagaucgggu

SEQ ID NO: 953544 - RNA, 15 nt, Mycobacterium avium subsp. paratuberculosis
ccgagcagcaccgcg

SEQ ID NO: 953545 - RNA, 18 nt, Mycobacterium avium subsp. paratuberculosis
ccgagcagcaccgcgacc

SEQ ID NO: 953546 - RNA, 14 nt, Mycobacterium avium subsp. paratuberculosis
ccgagcagcaccgg

SEQ ID NO: 953547 - RNA, 15 nt, Mycobacterium avium subsp. paratuberculosis
ccgagcagcaccggc

SEQ ID NO: 953548 - RNA, 15 nt, Mycobacterium avium subsp. paratuberculosis
ccgagcagccgggcc

SEQ ID NO: 953549 - RNA, 16 nt, Mycobacterium avium subsp. paratuberculosis
ccgagcagccgggcca

SEQ ID NO: 953550 - RNA, 18 nt, Mycobacterium avium subsp. paratuberculosis
ccgagcagcggggugagc

SEQ ID NO: 953551 - RNA, 23 nt, Mycobacterium avium subsp. paratuberculosis
ccgagcagcggggugagcaccgc

SEQ ID NO: 953552 - RNA, 16 nt, Mycobacterium avium subsp. paratuberculosis
ccgagcagcgggucgu

SEQ ID NO: 953553 - RNA, 16 nt, Mycobacterium avium subsp. paratuberculosis
ccgagcagcucagccg

SEQ ID NO: 953554 - RNA, 20 nt, Mycobacterium avium subsp. paratuberculosis
ccgagcagcucagccgccug

SEQ ID NO: 953555 - RNA, 17 nt, Mycobacterium avium subsp. paratuberculosis
ccgagcagcucggcggc

SEQ ID NO: 953556 - RNA, 16 nt, Mycobacterium avium subsp. paratuberculosis
ccgagcagcagccgca

SEQ ID NO: 953557 - RNA, 21 nt, Mycobacterium avium subsp. paratuberculosis
ccgagcaggcggaucggcccg

SEQ ID NO: 953558 - RNA, 21 nt, Mycobacterium avium subsp. paratuberculosis
ccgcuaacucacggcgcgauc

SEQ ID NO: 953559 - RNA, 14 nt, Mycobacterium avium subsp. paratuberculosis
ccgcuacccggcga

SEQ ID NO: 953560 - RNA, 12 nt, Mycobacterium avium subsp. paratuberculosis
ccgcuacccggc

SEQ ID NO: 953561 - RNA, 13 nt, Mycobacterium avium subsp. paratuberculosis
ccgcucccgcagc

SEQ ID NO: 953562 - RNA, 15 nt, Mycobacterium avium subsp. paratuberculosis
ccgcucccgggacag

SEQ ID NO: 953563 - RNA, 13 nt, Mycobacterium avium subsp. paratuberculosis
ccgcucgaacacc

SEQ ID NO: 953564 - RNA, 18 nt, Mycobacterium avium subsp. paratuberculosis
ccgcucgacgcgcacccg

SEQ ID NO: 953565 - RNA, 14 nt, Mycobacterium avium subsp. paratuberculosis
ccgcuccggcccga

SEQ ID NO: 953566 - RNA, 16 nt, Mycobacterium avium subsp. paratuberculosis
ccgcuccggcccgagc

SEQ ID NO: 953567 - RNA, 21 nt, Mycobacterium avium subsp. paratuberculosis
ccgcuccggcccgagcaccac

SEQ ID NO: 953568 - RNA, 12 nt, Mycobacterium avium subsp. paratuberculosis
ccgcuccgcggc

SEQ ID NO: 953569 - RNA, 18 nt, Mycobacterium avium subsp. paratuberculosis
ccgcuccggucgcgucgu

SEQ ID NO: 953570 - RNA, 19 nt, Mycobacterium avium subsp. paratuberculosis
ccgcuccggucgcgucgug

SEQ ID NO: 953571 - RNA, 22 nt, Mycobacterium avium subsp. paratuberculosis
ccgcuccgacgcgguggcgugc

SEQ ID NO: 953572 - RNA, 13 nt, Mycobacterium avium subsp. paratuberculosis
ccgcuccgcggcg

SEQ ID NO: 953573 - RNA, 14 nt, Mycobacterium avium subsp. paratuberculosis
ccgcuccgcggcgg

SEQ ID NO: 953574 - RNA, 18 nt, Mycobacterium avium subsp. paratuberculosis
ccgcuccgcggcgggcgu

SEQ ID NO: 953575 - RNA, 17 nt, Mycobacterium avium subsp. paratuberculosis
ccgcuccgcggugcugc

SEQ ID NO: 953576 - RNA, 17 nt, Mycobacterium avium subsp. paratuberculosis
ccgcgucgaccaccgcc

SEQ ID NO: 953577 - RNA, 20 nt, Mycobacterium avium subsp. paratuberculosis
ccgcgucgaccaccgccggc

SEQ ID NO: 953578 - RNA, 23 nt, Mycobacterium avium subsp. paratuberculosis
ccgcgucgaccaccgccggcccg

SEQ ID NO: 953579 - RNA, 14 nt, Mycobacterium avium subsp. paratuberculosis
ccgcgucgaccagc

SEQ ID NO: 953580 - RNA, 15 nt, Mycobacterium avium subsp. paratuberculosis
ccgcgucgaccagcc

SEQ ID NO: 953581 - RNA, 16 nt, Mycobacterium avium subsp. paratuberculosis
ccgcgucgaccagccg

SEQ ID NO: 953582 - RNA, 15 nt, Mycobacterium avium subsp. paratuberculosis
ccgcgucgggcaggu

SEQ ID NO: 953583 - RNA, 12 nt, Mycobacterium avium subsp. paratuberculosis
ccgcgucgucga

SEQ ID NO: 953584 - RNA, 17 nt, Mycobacterium avium subsp. paratuberculosis
ccgcgucgucgaggcgg

SEQ ID NO: 953585 - RNA, 12 nt, Mycobacterium avium subsp. paratuberculosis
ccgcgucgucgu

SEQ ID NO: 953586 - RNA, 16 nt, Mycobacterium avium subsp. paratuberculosis
ccgcgucgucgucgac

SEQ ID NO: 953587 - RNA, 17 nt, Mycobacterium avium subsp. paratuberculosis
ccgcgucgucgucgacc

SEQ ID NO: 953588 - RNA, 18 nt, Mycobacterium avium subsp. paratuberculosis
ccgcgucgucgucgaccg

SEQ ID NO: 953589 - RNA, 20 nt, Mycobacterium avium subsp. paratuberculosis
ccgcgucgucgucgaccguc

SEQ ID NO: 953590 - RNA, 17 nt, Mycobacterium avium subsp. paratuberculosis
ccgcgucgugccgagcg

SEQ ID NO: 953591 - RNA, 18 nt, Mycobacterium avium subsp. paratuberculosis
ccgcgucguggcccugcu

SEQ ID NO: 953592 - RNA, 19 nt, Mycobacterium avium subsp. paratuberculosis
ccgcgucguguccgggccc

SEQ ID NO: 953593 - RNA, 15 nt, Mycobacterium avium subsp. paratuberculosis
ccgcuaaagccgacu

SEQ ID NO: 953594 - RNA, 23 nt, Mycobacterium avium subsp. paratuberculosis
ccgcuaaagccgacugccccgcu

SEQ ID NO: 953595 - RNA, 15 nt, Mycobacterium avium subsp. paratuberculosis
ccgcgugacggccgc

SEQ ID NO: 953596 - RNA, 18 nt, Mycobacterium avium subsp. paratuberculosis
ccgcgucuugcgccgaag

SEQ ID NO: 953597 - RNA, 23 nt, Mycobacterium avium subsp. paratuberculosis
ccgcgucuuggacgcccgcgacc

SEQ ID NO: 953598 - RNA, 18 nt, Mycobacterium avium subsp. paratuberculosis
ccgcgugacggccgcggc

SEQ ID NO: 953599 - RNA, 19 nt, Mycobacterium avium subsp. paratuberculosis
ccgcgugacggccgcggcg

SEQ ID NO: 953600 - RNA, 20 nt, Mycobacterium avium subsp. paratuberculosis
ccgcgugacaagccggcguc

SEQ ID NO: 953601 - RNA, 22 nt, Mycobacterium avium subsp. paratuberculosis
ccgcgugacaagccggcgucga

SEQ ID NO: 953602 - RNA, 15 nt, Mycobacterium avium subsp. paratuberculosis
ccgcugcaaccggua

SEQ ID NO: 953603 - RNA, 14 nt, Mycobacterium avium subsp. paratuberculosis
ccgcugcaccagcc

SEQ ID NO: 953604 - RNA, 16 nt, Mycobacterium avium subsp. paratuberculosis
ccgcugcaccagcccg

SEQ ID NO: 953605 - RNA, 20 nt, Mycobacterium avium subsp. paratuberculosis
ccgcugcaccagcccgucgg

SEQ ID NO: 953606 - RNA, 15 nt, Mycobacterium avium subsp. paratuberculosis
ccgcugcagcgccgc

SEQ ID NO: 953607 - RNA, 19 nt, Mycobacterium avium subsp. paratuberculosis
ccgcugcagcgccgcccgc

SEQ ID NO: 953608 - RNA, 21 nt, Mycobacterium avium subsp. paratuberculosis
ccgcugcagcgccgcccgcac

SEQ ID NO: 953609 - RNA, 23 nt, Mycobacterium avium subsp. paratuberculosis
ccgcugcagcggguuuggccgcg

SEQ ID NO: 953610 - RNA, 11 nt, Mycobacterium avium subsp. paratuberculosis
ccgcugcagcu

SEQ ID NO: 953611 - RNA, 13 nt, Mycobacterium avium subsp. paratuberculosis
ccgcugcagcugc

SEQ ID NO: 953612 - RNA, 16 nt, Mycobacterium avium subsp. paratuberculosis
ccgcugcauccgcagc

SEQ ID NO: 953613 - RNA, 13 nt, Mycobacterium avium subsp. paratuberculosis
ccgcugccacggu

SEQ ID NO: 953614 - RNA, 14 nt, Mycobacterium avium subsp. paratuberculosis
ccgcugacgcggcg

SEQ ID NO: 953615 - RNA, 12 nt, Mycobacterium avium subsp. paratuberculosis
ccgcugacgguc

SEQ ID NO: 953616 - RNA, 17 nt, Mycobacterium avium subsp. paratuberculosis
ccgcugacggucgccga

SEQ ID NO: 953617 - RNA, 22 nt, Mycobacterium avium subsp. paratuberculosis
ccgcugacggucgccgacucgc

SEQ ID NO: 953618 - RNA, 17 nt, Mycobacterium avium subsp. paratuberculosis
ccgcugaagccgaacgc

SEQ ID NO: 953619 - RNA, 18 nt, Mycobacterium avium subsp. paratuberculosis
ccgcugacaaagcacaac

SEQ ID NO: 953620 - RNA, 19 nt, Mycobacterium avium subsp. paratuberculosis
ccgcugaccaggccgauga

SEQ ID NO: 953621 - RNA, 13 nt, Mycobacterium avium subsp. paratuberculosis
ccgcugaugccgc

SEQ ID NO: 953622 - RNA, 17 nt, Mycobacterium avium subsp. paratuberculosis
ccgcugaugccgccgaa

SEQ ID NO: 953623 - RNA, 14 nt, Mycobacterium avium subsp. paratuberculosis
ccgcucgcgcaccg

SEQ ID NO: 953624 - RNA, 13 nt, Mycobacterium avium subsp. paratuberculosis
ccgcucgcgggcc

SEQ ID NO: 953625 - RNA, 14 nt, Mycobacterium avium subsp. paratuberculosis
ccgcucgcgggcca

SEQ ID NO: 953626 - RNA, 18 nt, Mycobacterium avium subsp. paratuberculosis
ccgcucgcgggccacagc

SEQ ID NO: 953627 - RNA, 15 nt, Mycobacterium avium subsp. paratuberculosis
ccgcucgcgggcccg

SEQ ID NO: 953628 - RNA, 15 nt, Mycobacterium avium subsp. paratuberculosis
ccgcucgccgaugac

SEQ ID NO: 953629 - RNA, 18 nt, Mycobacterium avium subsp. paratuberculosis
ccgcucgccgaugacguu

SEQ ID NO: 953630 - RNA, 13 nt, Mycobacterium avium subsp. paratuberculosis
ccgcucgccgggg

SEQ ID NO: 953631 - RNA, 21 nt, Mycobacterium avium subsp. paratuberculosis
ccgcucgccggggacgacggc

SEQ ID NO: 953632 - RNA, 22 nt, Mycobacterium avium subsp. paratuberculosis
ccgcucgccaugcgaccacgac

SEQ ID NO: 953633 - RNA, 13 nt, Mycobacterium avium subsp. paratuberculosis
ccgcucgccgucg

SEQ ID NO: 953634 - RNA, 14 nt, Mycobacterium avium subsp. paratuberculosis
ccgcucgccgucgg

SEQ ID NO: 953635 - RNA, 23 nt, Mycobacterium avium subsp. paratuberculosis
ccgcucgaucuggcggacccgcu

SEQ ID NO: 953636 - RNA, 15 nt, Mycobacterium avium subsp. paratuberculosis
ccgcucgauggcgcc

SEQ ID NO: 953637 - RNA, 17 nt, Mycobacterium avium subsp. paratuberculosis
ccgcucgauggcgccga

SEQ ID NO: 953638 - RNA, 19 nt, Mycobacterium avium subsp. paratuberculosis
ccgcucgauggcgccgauc

SEQ ID NO: 953639 - RNA, 23 nt, Mycobacterium avium subsp. paratuberculosis
ccgcucgauggguguggcgucga

SEQ ID NO: 953640 - RNA, 16 nt, Mycobacterium avium subsp. paratuberculosis
ccgcucgcccagcgcg

SEQ ID NO: 953641 - RNA, 17 nt, Mycobacterium avium subsp. paratuberculosis
ccgcucgcccagcgcgg

SEQ ID NO: 953642 - RNA, 21 nt, Mycobacterium avium subsp. paratuberculosis
ccgcucgcccagcgcggcggc

SEQ ID NO: 953643 - RNA, 15 nt, Mycobacterium avium subsp. paratuberculosis
ccgcugaacgggcag

SEQ ID NO: 953644 - RNA, 16 nt, Mycobacterium avium subsp. paratuberculosis
ccgcugaacgggcagc

SEQ ID NO: 953645 - RNA, 18 nt, Mycobacterium avium subsp. paratuberculosis
ccgcugaacgggcagcca

SEQ ID NO: 953646 - RNA, 12 nt, Mycobacterium avium subsp. paratuberculosis
ccgcucggcgau

SEQ ID NO: 953647 - RNA, 13 nt, Mycobacterium avium subsp. paratuberculosis
ccgcucggcgauc

SEQ ID NO: 953648 - RNA, 11 nt, Mycobacterium avium subsp. paratuberculosis
ccgcucggcgg

SEQ ID NO: 953649 - RNA, 21 nt, Mycobacterium avium subsp. paratuberculosis
ccgcucggccagcgcagcgac

SEQ ID NO: 953650 - RNA, 20 nt, Mycobacterium avium subsp. paratuberculosis
ccgcucggccagcgcgccgc

SEQ ID NO: 953651 - RNA, 22 nt, Mycobacterium avium subsp. paratuberculosis
ccgcucgcuauaucgcaccggc

SEQ ID NO: 953652 - RNA, 11 nt, Mycobacterium avium subsp. paratuberculosis
ccgcucggcga

SEQ ID NO: 953653 - RNA, 13 nt, Mycobacterium avium subsp. paratuberculosis
ccgcggggccggc

SEQ ID NO: 953654 - RNA, 16 nt, Mycobacterium avium subsp. paratuberculosis
ccgcggggccggcgcu

SEQ ID NO: 953655 - RNA, 20 nt, Mycobacterium avium subsp. paratuberculosis
ccgcggggcguacgcgcugc

SEQ ID NO: 953656 - RNA, 15 nt, Mycobacterium avium subsp. paratuberculosis
ccgcgggcguggcgg

SEQ ID NO: 953657 - RNA, 21 nt, Mycobacterium avium subsp. paratuberculosis
ccgcgggcguggcggucggug

SEQ ID NO: 953658 - RNA, 23 nt, Mycobacterium avium subsp. paratuberculosis
ccgcgggcguucaucaccugguc

SEQ ID NO: 953659 - RNA, 14 nt, Mycobacterium avium subsp. paratuberculosis
ccgcgggcgggccg

SEQ ID NO: 953660 - RNA, 15 nt, Mycobacterium avium subsp. paratuberculosis
ccgcgggcggggccu

SEQ ID NO: 953661 - RNA, 20 nt, Mycobacterium avium subsp. paratuberculosis
ccgcgggcggggccugcggg

SEQ ID NO: 953662 - RNA, 22 nt, Mycobacterium avium subsp. paratuberculosis
ccgcgcuggcgcaggcgcuggg

SEQ ID NO: 953663 - RNA, 16 nt, Mycobacterium avium subsp. paratuberculosis
ccgcgcuggugcugcu

SEQ ID NO: 953664 - RNA, 12 nt, Mycobacterium avium subsp. paratuberculosis
ccgcgcugucca

SEQ ID NO: 953665 - RNA, 15 nt, Mycobacterium avium subsp. paratuberculosis
ccgcgcuggcguuga

SEQ ID NO: 953666 - RNA, 12 nt, Mycobacterium avium subsp. paratuberculosis
ccgcgcugggcu

SEQ ID NO: 953667 - RNA, 17 nt, Mycobacterium avium subsp. paratuberculosis
ccgcgcugggcuggccg

SEQ ID NO: 953668 - RNA, 19 nt, Mycobacterium avium subsp. paratuberculosis
ccgcgcugggcuggccguc

SEQ ID NO: 953669 - RNA, 17 nt, Mycobacterium avium subsp. paratuberculosis
ccgcgcuggucaacucg

SEQ ID NO: 953670 - RNA, 22 nt, Mycobacterium avium subsp. paratuberculosis
ccgcgcuggucaacucgacccg

SEQ ID NO: 953671 - RNA, 14 nt, Mycobacterium avium subsp. paratuberculosis
ccgcgcuggcgcag

SEQ ID NO: 953672 - RNA, 15 nt, Mycobacterium avium subsp. paratuberculosis
ccgcgcugcgcgcgu

SEQ ID NO: 953673 - RNA, 17 nt, Mycobacterium avium subsp. paratuberculosis
ccgcgcuggccagcguc

SEQ ID NO: 953674 - RNA, 18 nt, Mycobacterium avium subsp. paratuberculosis
ccgcgcuggccagcguca

SEQ ID NO: 953675 - RNA, 22 nt, Mycobacterium avium subsp. paratuberculosis
ccgcgcuggccgaucccggcca

SEQ ID NO: 953676 - RNA, 23 nt, Mycobacterium avium subsp. paratuberculosis
ccgcgcuggccgaucccggccac

SEQ ID NO: 953677 - RNA, 18 nt, Mycobacterium avium subsp. paratuberculosis
ccgcgcugaacgcggugg

SEQ ID NO: 953678 - RNA, 15 nt, Mycobacterium avium subsp. paratuberculosis
ccgcgcugcccagcg

SEQ ID NO: 953679 - RNA, 19 nt, Mycobacterium avium subsp. paratuberculosis
ccgcgcugcccagcgcggu

SEQ ID NO: 953680 - RNA, 13 nt, Mycobacterium avium subsp. paratuberculosis
ccgcggucgcacu

SEQ ID NO: 953681 - RNA, 14 nt, Mycobacterium avium subsp. paratuberculosis
ccgcggucggcggc

SEQ ID NO: 953682 - RNA, 16 nt, Mycobacterium avium subsp. paratuberculosis
ccgcggucucgaccga

SEQ ID NO: 953683 - RNA, 19 nt, Mycobacterium avium subsp. paratuberculosis
ccgcggucugcgccagcuc

SEQ ID NO: 953684 - RNA, 21 nt, Mycobacterium avium subsp. paratuberculosis
ccgcggucugcgccagcucca

SEQ ID NO: 953685 - RNA, 16 nt, Mycobacterium avium subsp. paratuberculosis
ccgcgggucgcggccc

SEQ ID NO: 953686 - RNA, 14 nt, Mycobacterium avium subsp. paratuberculosis
ccgcggugaccgcg

SEQ ID NO: 953687 - RNA, 17 nt, Mycobacterium avium subsp. paratuberculosis
ccgcggugaccgcgccg

SEQ ID NO: 953688 - RNA, 18 nt, Mycobacterium avium subsp. paratuberculosis
ccgcggugaccgcgccgc

SEQ ID NO: 953689 - RNA, 13 nt, Mycobacterium avium subsp. paratuberculosis
ccgcggugagcac

SEQ ID NO: 953690 - RNA, 16 nt, Mycobacterium avium subsp. paratuberculosis
ccgcggugagcaccgg

SEQ ID NO: 953691 - RNA, 14 nt, Mycobacterium avium subsp. paratuberculosis
ccgcggugagcggc

SEQ ID NO: 953692 - RNA, 22 nt, Mycobacterium avium subsp. paratuberculosis
ccgcggugagcggccgcagcgc

SEQ ID NO: 953693 - RNA, 21 nt, Mycobacterium avium subsp. paratuberculosis
ccgcggugaguucaucgacgu

SEQ ID NO: 953694 - RNA, 12 nt, Mycobacterium avium subsp. paratuberculosis
ccgcggugccgc

SEQ ID NO: 953695 - RNA, 15 nt, Mycobacterium avium subsp. paratuberculosis
ccgcggugccgcagc

SEQ ID NO: 953696 - RNA, 17 nt, Mycobacterium avium subsp. paratuberculosis
ccgcggugccgcagcuc

SEQ ID NO: 953697 - RNA, 22 nt, Mycobacterium avium subsp. paratuberculosis
ccgcggugccgcagcucgauca

SEQ ID NO: 953698 - RNA, 18 nt, Mycobacterium avium subsp. paratuberculosis
ccgcgguccuccuggaug

SEQ ID NO: 953699 - RNA, 12 nt, Mycobacterium avium subsp. paratuberculosis
ccgcggucgacc

SEQ ID NO: 953700 - RNA, 22 nt, Mycobacterium avium subsp. paratuberculosis
ccgcggucgaccaagacggugg

SEQ ID NO: 953701 - RNA, 19 nt, Mycobacterium avium subsp. paratuberculosis
ccgcgggucgauaugcugc

SEQ ID NO: 953702 - RNA, 16 nt, Mycobacterium avium subsp. paratuberculosis
ccgcggucgccccggc

SEQ ID NO: 953703 - RNA, 17 nt, Mycobacterium avium subsp. paratuberculosis
ccgcggucgccccggcc

SEQ ID NO: 953704 - RNA, 18 nt, Mycobacterium avium subsp. paratuberculosis
ccgcggucgccccggccg

SEQ ID NO: 953705 - RNA, 23 nt, Mycobacterium avium subsp. paratuberculosis
ccgcggucgccccggccgcggug

SEQ ID NO: 953706 - RNA, 12 nt, Mycobacterium avium subsp. paratuberculosis
ccgcggucgcgg

SEQ ID NO: 953707 - RNA, 17 nt, Mycobacterium avium subsp. paratuberculosis
ccgcggucgcggcgccg

SEQ ID NO: 953708 - RNA, 19 nt, Mycobacterium avium subsp. paratuberculosis
ccgcggucgcggcgccggu

SEQ ID NO: 953709 - RNA, 17 nt, Mycobacterium avium subsp. paratuberculosis
ccgcggucgcugacccg

SEQ ID NO: 953710 - RNA, 18 nt, Mycobacterium avium subsp. paratuberculosis
ccgcggguagcccgucga

SEQ ID NO: 953711 - RNA, 22 nt, Mycobacterium avium subsp. paratuberculosis
ccgcggguauccgugaccccgg

SEQ ID NO: 953712 - RNA, 23 nt, Mycobacterium avium subsp. paratuberculosis
ccgcggguauccgugaccccgga

SEQ ID NO: 953713 - RNA, 14 nt, Mycobacterium avium subsp. paratuberculosis
ccgcggggugcccg

SEQ ID NO: 953714 - RNA, 18 nt, Mycobacterium avium subsp. paratuberculosis
ccgcgggggcggccgggc

SEQ ID NO: 953715 - RNA, 21 nt, Mycobacterium avium subsp. paratuberculosis
ccgcgggggcggccgggccgc

SEQ ID NO: 953716 - RNA, 23 nt, Mycobacterium avium subsp. paratuberculosis
ccgcgggggcggccgggccgcgg

SEQ ID NO: 953717 - RNA, 15 nt, Mycobacterium avium subsp. paratuberculosis
ccgcgggggcggccg

SEQ ID NO: 953718 - RNA, 16 nt, Mycobacterium avium subsp. paratuberculosis
ccgcgguuuggucagc

SEQ ID NO: 953719 - RNA, 19 nt, Mycobacterium avium subsp. paratuberculosis
ccgcgguuuggucagcgcc

SEQ ID NO: 953720 - RNA, 17 nt, Mycobacterium avium subsp. paratuberculosis
ccgcguaccagcgccac

SEQ ID NO: 953721 - RNA, 19 nt, Mycobacterium avium subsp. paratuberculosis
ccgcgguucgaucuccucg

SEQ ID NO: 953722 - RNA, 23 nt, Mycobacterium avium subsp. paratuberculosis
ccgcgguucgaucuccucggcgu

SEQ ID NO: 953723 - RNA, 13 nt, Mycobacterium avium subsp. paratuberculosis
ccgcgguucggcg

SEQ ID NO: 953724 - RNA, 14 nt, Mycobacterium avium subsp. paratuberculosis
ccgcgguuggucac

SEQ ID NO: 953725 - RNA, 20 nt, Mycobacterium avium subsp. paratuberculosis
ccgcgguuggucaccagguc

SEQ ID NO: 953726 - RNA, 19 nt, Mycobacterium avium subsp. paratuberculosis
ccgcgguuucaccgugcgc

SEQ ID NO: 953727 - RNA, 14 nt, Mycobacterium avium subsp. paratuberculosis
ccgcguacaccggc

SEQ ID NO: 953728 - RNA, 18 nt, Mycobacterium avium subsp. paratuberculosis
ccgcguacagcagcugcc

SEQ ID NO: 953729 - RNA, 16 nt, Mycobacterium avium subsp. paratuberculosis
ccgcguacagccagcc

SEQ ID NO: 953730 - RNA, 16 nt, Mycobacterium avium subsp. paratuberculosis
ccgcguacagcggguc

SEQ ID NO: 953731 - RNA, 22 nt, Mycobacterium avium subsp. paratuberculosis
ccgcguacagcgggucguuggc

SEQ ID NO: 953732 - RNA, 15 nt, Mycobacterium avium subsp. paratuberculosis
ccgcgguggcggugc

SEQ ID NO: 953733 - RNA, 13 nt, Mycobacterium avium subsp. paratuberculosis
ccgcggugggcca

SEQ ID NO: 953734 - RNA, 13 nt, Mycobacterium avium subsp. paratuberculosis
ccgcgguggccgg

SEQ ID NO: 953735 - RNA, 17 nt, Mycobacterium avium subsp. paratuberculosis
ccgcgguggccgggaug

SEQ ID NO: 953736 - RNA, 20 nt, Mycobacterium avium subsp. paratuberculosis
ccgcgguggcgccgcgggcg

SEQ ID NO: 953737 - RNA, 12 nt, Mycobacterium avium subsp. paratuberculosis
ccgcgguggcgg

SEQ ID NO: 953738 - RNA, 20 nt, Mycobacterium avium subsp. paratuberculosis
ccgcgguggguccgccgggc

SEQ ID NO: 953739 - RNA, 14 nt, Mycobacterium avium subsp. paratuberculosis
ccgcgguggugauu

SEQ ID NO: 953740 - RNA, 12 nt, Mycobacterium avium subsp. paratuberculosis
ccgcgguggugg

SEQ ID NO: 953741 - RNA, 18 nt, Mycobacterium avium subsp. paratuberculosis
ccgcggugugcccggcgu

SEQ ID NO: 953742 - RNA, 16 nt, Mycobacterium avium subsp. paratuberculosis
ccgcggugcgccacgc

SEQ ID NO: 953743 - RNA, 20 nt, Mycobacterium avium subsp. paratuberculosis
ccgcggugcgccacgcccgc

SEQ ID NO: 953744 - RNA, 22 nt, Mycobacterium avium subsp. paratuberculosis
ccgcggugcgccacgcccgcag

SEQ ID NO: 953745 - RNA, 13 nt, Mycobacterium avium subsp. paratuberculosis
ccgcggugcggcc

SEQ ID NO: 953746 - RNA, 14 nt, Mycobacterium avium subsp. paratuberculosis
ccgcggugcggccc

SEQ ID NO: 953747 - RNA, 15 nt, Mycobacterium avium subsp. paratuberculosis
ccgcggugcggcccg

SEQ ID NO: 953748 - RNA, 16 nt, Mycobacterium avium subsp. paratuberculosis
ccgcggugcggcccgc

SEQ ID NO: 953749 - RNA, 20 nt, Mycobacterium avium subsp. paratuberculosis
ccgcggugcggcccgcggca

SEQ ID NO: 953750 - RNA, 22 nt, Mycobacterium avium subsp. paratuberculosis
ccgcggugcguuugaugacgcg

SEQ ID NO: 953751 - RNA, 19 nt, Mycobacterium avium subsp. paratuberculosis
ccgcggugcugcagcgcga

SEQ ID NO: 953752 - RNA, 20 nt, Mycobacterium avium subsp. paratuberculosis
ccgcggugcugcagcgcgag

SEQ ID NO: 953753 - RNA, 12 nt, Mycobacterium avium subsp. paratuberculosis
ccgcguccacga

SEQ ID NO: 953754 - RNA, 21 nt, Mycobacterium avium subsp. paratuberculosis
ccgcguccacgaccccggcgg

SEQ ID NO: 953755 - RNA, 17 nt, Mycobacterium avium subsp. paratuberculosis
ccgcgucaucgggcccg

SEQ ID NO: 953756 - RNA, 19 nt, Mycobacterium avium subsp. paratuberculosis
ccgcgucaucgggcccgac

SEQ ID NO: 953757 - RNA, 20 nt, Mycobacterium avium subsp. paratuberculosis
ccgcgucaucgggcccgacg

SEQ ID NO: 953758 - RNA, 22 nt, Mycobacterium avium subsp. paratuberculosis
ccgcgucaucgggcccgacgac

SEQ ID NO: 953759 - RNA, 14 nt, Mycobacterium avium subsp. paratuberculosis
ccgcguccagcagc

SEQ ID NO: 953760 - RNA, 22 nt, Mycobacterium avium subsp. paratuberculosis
ccgcguccagcagcauguuggc

SEQ ID NO: 953761 - RNA, 14 nt, Mycobacterium avium subsp. paratuberculosis
ccgcguccuucucc

SEQ ID NO: 953762 - RNA, 21 nt, Mycobacterium avium subsp. paratuberculosis
ccgcguccuucuccgccgggc

SEQ ID NO: 953763 - RNA, 24 nt, Mycobacterium avium subsp. paratuberculosis
ccgcguccucgccguacgcgccgg

SEQ ID NO: 953764 - RNA, 15 nt, Mycobacterium avium subsp. paratuberculosis
ccgcguccucgucga

SEQ ID NO: 953765 - RNA, 17 nt, Mycobacterium avium subsp. paratuberculosis
ccgcguccugcagcgcc

SEQ ID NO: 953766 - RNA, 20 nt, Mycobacterium avium subsp. paratuberculosis
ccgcguccugcagcgccguc

SEQ ID NO: 953767 - RNA, 16 nt, Mycobacterium avium subsp. paratuberculosis
ccgcguccgcgucguc

SEQ ID NO: 953768 - RNA, 18 nt, Mycobacterium avium subsp. paratuberculosis
ccgcguccgcgucgucga

SEQ ID NO: 953769 - RNA, 17 nt, Mycobacterium avium subsp. paratuberculosis
ccgcgucagcggcgggc

SEQ ID NO: 953770 - RNA, 15 nt, Mycobacterium avium subsp. paratuberculosis
ccgcgucacgucggc

SEQ ID NO: 953771 - RNA, 19 nt, Mycobacterium avium subsp. paratuberculosis
ccgcgucacgucggccugc

SEQ ID NO: 953772 - RNA, 18 nt, Mycobacterium avium subsp. paratuberculosis
ccgcguauugcacggcgg

SEQ ID NO: 953773 - RNA, 20 nt, Mycobacterium avium subsp. paratuberculosis
ccgcguauugcacggcggcg

SEQ ID NO: 953774 - RNA, 21 nt, Mycobacterium avium subsp. paratuberculosis
ccgcgucacauccgucacgcc

SEQ ID NO: 953775 - RNA, 16 nt, Mycobacterium avium subsp. paratuberculosis
ccgcguaaccggcggc

SEQ ID NO: 953776 - RNA, 21 nt, Mycobacterium avium subsp. paratuberculosis
ccgcguagucguugucggcgg

SEQ ID NO: 953777 - RNA, 19 nt, Mycobacterium avium subsp. paratuberculosis
ccgcguagcucgccgcggc

SEQ ID NO: 953778 - RNA, 21 nt, Mycobacterium avium subsp. paratuberculosis
ccgcguagcucgccgcggcca

SEQ ID NO: 953779 - RNA, 22 nt, Mycobacterium avium subsp. paratuberculosis
ccgcguagcucgccgcggccac

SEQ ID NO: 953780 - RNA, 17 nt, Mycobacterium avium subsp. paratuberculosis
ccgcugcugcucggccg

SEQ ID NO: 953781 - RNA, 19 nt, Mycobacterium avium subsp. paratuberculosis
ccgcugcuccggguccgcg

SEQ ID NO: 953782 - RNA, 20 nt, Mycobacterium avium subsp. paratuberculosis
ccgcugcuccggguccgcgg

SEQ ID NO: 953783 - RNA, 21 nt, Mycobacterium avium subsp. paratuberculosis
ccgcugcuccggguccgcggu

SEQ ID NO: 953784 - RNA, 18 nt, Mycobacterium avium subsp. paratuberculosis
ccgcugcugggugccgcg

SEQ ID NO: 953785 - RNA, 20 nt, Mycobacterium avium subsp. paratuberculosis
ccgcugcugggugccgcguu

SEQ ID NO: 953786 - RNA, 16 nt, Mycobacterium avium subsp. paratuberculosis
ccgcuggaacagcggg

SEQ ID NO: 953787 - RNA, 17 nt, Mycobacterium avium subsp. paratuberculosis
ccgcuggaacagcgggc

SEQ ID NO: 953788 - RNA, 23 nt, Mycobacterium avium subsp. paratuberculosis
ccgcuggaacagcgggccggcgu

SEQ ID NO: 953789 - RNA, 17 nt, Mycobacterium avium subsp. paratuberculosis
ccgcuggaucccgguga

SEQ ID NO: 953790 - RNA, 20 nt, Mycobacterium avium subsp. paratuberculosis
ccgcuggaucccggugagcg

SEQ ID NO: 953791 - RNA, 23 nt, Mycobacterium avium subsp. paratuberculosis
ccgcuggauuccaccguggucgg

SEQ ID NO: 953792 - RNA, 13 nt, Mycobacterium avium subsp. paratuberculosis
ccgcugcggcugg

SEQ ID NO: 953793 - RNA, 17 nt, Mycobacterium avium subsp. paratuberculosis
ccgcugcgggccaucga

SEQ ID NO: 953794 - RNA, 24 nt, Mycobacterium avium subsp. paratuberculosis
ccgcugcgggccaucgacuccagc

SEQ ID NO: 953795 - RNA, 17 nt, Mycobacterium avium subsp. paratuberculosis
ccgcugcgggcgggccg

SEQ ID NO: 953796 - RNA, 18 nt, Mycobacterium avium subsp. paratuberculosis
ccgcugcgggcgggccgc

SEQ ID NO: 953797 - RNA, 20 nt, Mycobacterium avium subsp. paratuberculosis
ccgcugcgggcgggccgcca

SEQ ID NO: 953798 - RNA, 14 nt, Mycobacterium avium subsp. paratuberculosis
ccgcugcggcgcag

SEQ ID NO: 953799 - RNA, 12 nt, Mycobacterium avium subsp. paratuberculosis
ccgcugcccggc

SEQ ID NO: 953800 - RNA, 13 nt, Mycobacterium avium subsp. paratuberculosis
ccgcugcccggcg

SEQ ID NO: 953801 - RNA, 15 nt, Mycobacterium avium subsp. paratuberculosis
ccgcugcccgggcau

SEQ ID NO: 953802 - RNA, 18 nt, Mycobacterium avium subsp. paratuberculosis
ccgcugccgcaccccgug

SEQ ID NO: 953803 - RNA, 22 nt, Mycobacterium avium subsp. paratuberculosis
ccggaacagcuuggcgcagccg

SEQ ID NO: 953804 - RNA, 18 nt, Mycobacterium avium subsp. paratuberculosis
ccggaacgcgucgcccac

SEQ ID NO: 953805 - RNA, 22 nt, Mycobacterium avium subsp. paratuberculosis
ccggaacgcgucgcccacgccg

SEQ ID NO: 953806 - RNA, 17 nt, Mycobacterium avium subsp. paratuberculosis
ccggaaccgggcacccg

SEQ ID NO: 953807 - RNA, 19 nt, Mycobacterium avium subsp. paratuberculosis
ccggaaccguuuucggguu

SEQ ID NO: 953808 - RNA, 18 nt, Mycobacterium avium subsp. paratuberculosis
ccggaacgacgcguccgu

SEQ ID NO: 953809 - RNA, 23 nt, Mycobacterium avium subsp. paratuberculosis
ccggaacgacgcguccguagugc

SEQ ID NO: 953810 - RNA, 18 nt, Mycobacterium avium subsp. paratuberculosis
ccggaaccgcgccuucga

SEQ ID NO: 953811 - RNA, 16 nt, Mycobacterium avium subsp. paratuberculosis
ccggaacucggccggc

SEQ ID NO: 953812 - RNA, 23 nt, Mycobacterium avium subsp. paratuberculosis
ccggaacucggccggcaccucga

SEQ ID NO: 953813 - RNA, 19 nt, Mycobacterium avium subsp. paratuberculosis
ccggaagaucagcaggcug

SEQ ID NO: 953814 - RNA, 14 nt, Mycobacterium avium subsp. paratuberculosis
ccggaagccgucgg

SEQ ID NO: 953815 - RNA, 17 nt, Mycobacterium avium subsp. paratuberculosis
ccggaagccgucggugc

SEQ ID NO: 953816 - RNA, 19 nt, Mycobacterium avium subsp. paratuberculosis
ccggaaucaccuugcccug

SEQ ID NO: 953817 - RNA, 19 nt, Mycobacterium avium subsp. paratuberculosis
ccggaaggccaaggccagc

SEQ ID NO: 953818 - RNA, 17 nt, Mycobacterium avium subsp. paratuberculosis
ccggaaggccagguugc

SEQ ID NO: 953819 - RNA, 16 nt, Mycobacterium avium subsp. paratuberculosis
ccggaagugccggcga

SEQ ID NO: 953820 - RNA, 17 nt, Mycobacterium avium subsp. paratuberculosis
ccggaaguucucgccgu

SEQ ID NO: 953821 - RNA, 18 nt, Mycobacterium avium subsp. paratuberculosis
ccggacagaucgcccauc

SEQ ID NO: 953822 - RNA, 16 nt, Mycobacterium avium subsp. paratuberculosis
ccggaaucgucggcca

SEQ ID NO: 953823 - RNA, 16 nt, Mycobacterium avium subsp. paratuberculosis
ccggacaccaccgcgg

SEQ ID NO: 953824 - RNA, 16 nt, Mycobacterium avium subsp. paratuberculosis
ccggacaccccggcca

SEQ ID NO: 953825 - RNA, 17 nt, Mycobacterium avium subsp. paratuberculosis
ccggacaccccggccag

SEQ ID NO: 953826 - RNA, 20 nt, Mycobacterium avium subsp. paratuberculosis
ccggacaccgaaccgccccg

SEQ ID NO: 953827 - RNA, 14 nt, Mycobacterium avium subsp. paratuberculosis
ccggacaccggcac

SEQ ID NO: 953828 - RNA, 20 nt, Mycobacterium avium subsp. paratuberculosis
ccggacaccggcacgucggc

SEQ ID NO: 953829 - RNA, 15 nt, Mycobacterium avium subsp. paratuberculosis
ccggacacggccagc

SEQ ID NO: 953830 - RNA, 18 nt, Mycobacterium avium subsp. paratuberculosis
ccggacacggccagcgcc

SEQ ID NO: 953831 - RNA, 15 nt, Mycobacterium avium subsp. paratuberculosis
ccggacagcgcgacg

SEQ ID NO: 953832 - RNA, 23 nt, Mycobacterium avium subsp. paratuberculosis
ccggacagcgcgacgcacgccgg

SEQ ID NO: 953833 - RNA, 15 nt, Mycobacterium avium subsp. paratuberculosis
ccggacagcgggccg

SEQ ID NO: 953834 - RNA, 22 nt, Mycobacterium avium subsp. paratuberculosis
ccggacagcgggccgacccggc

SEQ ID NO: 953835 - RNA, 19 nt, Mycobacterium avium subsp. paratuberculosis
ccggacagcuggcggucgc

SEQ ID NO: 953836 - RNA, 15 nt, Mycobacterium avium subsp. paratuberculosis
ccggacaggucgggc

SEQ ID NO: 953837 - RNA, 16 nt, Mycobacterium avium subsp. paratuberculosis
ccggacaggucgggca

SEQ ID NO: 953838 - RNA, 12 nt, Mycobacterium avium subsp. paratuberculosis
ccggacagccgg

SEQ ID NO: 953839 - RNA, 23 nt, Mycobacterium avium subsp. paratuberculosis
ccggaaugcggugcugccgugcc

SEQ ID NO: 953840 - RNA, 20 nt, Mycobacterium avium subsp. paratuberculosis
ccggaauggcaaggccagca

SEQ ID NO: 953841 - RNA, 16 nt, Mycobacterium avium subsp. paratuberculosis
ccggaauggcagcagc

SEQ ID NO: 953842 - RNA, 19 nt, Mycobacterium avium subsp. paratuberculosis
ccggaauggcagcagccgg

SEQ ID NO: 953843 - RNA, 20 nt, Mycobacterium avium subsp. paratuberculosis
ccggacauccauugggccgc

SEQ ID NO: 953844 - RNA, 23 nt, Mycobacterium avium subsp. paratuberculosis
ccggacauccauugggccgcggc

SEQ ID NO: 953845 - RNA, 22 nt, Mycobacterium avium subsp. paratuberculosis
ccggacauaggcgucgcggucg

SEQ ID NO: 953846 - RNA, 16 nt, Mycobacterium avium subsp. paratuberculosis
ccggacccgcucgccg

SEQ ID NO: 953847 - RNA, 18 nt, Mycobacterium avium subsp. paratuberculosis
ccggacccgcucgccgaa

SEQ ID NO: 953848 - RNA, 17 nt, Mycobacterium avium subsp. paratuberculosis
ccggaccccacagcgcg

SEQ ID NO: 953849 - RNA, 21 nt, Mycobacterium avium subsp. paratuberculosis
ccggaccagguauucaucgcg

SEQ ID NO: 953850 - RNA, 17 nt, Mycobacterium avium subsp. paratuberculosis
ccggacccauucgucgg

SEQ ID NO: 953851 - RNA, 21 nt, Mycobacterium avium subsp. paratuberculosis
ccggacgaacaucgagcccac

SEQ ID NO: 953852 - RNA, 17 nt, Mycobacterium avium subsp. paratuberculosis
ccggaccguucgguccg

SEQ ID NO: 953853 - RNA, 16 nt, Mycobacterium avium subsp. paratuberculosis
ccggaccucgaccagc

SEQ ID NO: 953854 - RNA, 18 nt, Mycobacterium avium subsp. paratuberculosis
ccggaccucgaccagccg

SEQ ID NO: 953855 - RNA, 12 nt, Mycobacterium avium subsp. paratuberculosis
ccggaccgccgc

SEQ ID NO: 953856 - RNA, 13 nt, Mycobacterium avium subsp. paratuberculosis
ccggaccgccgcg

SEQ ID NO: 953857 - RNA, 17 nt, Mycobacterium avium subsp. paratuberculosis
ccggaccgccgcggcgg

SEQ ID NO: 953858 - RNA, 17 nt, Mycobacterium avium subsp. paratuberculosis
ccggaccgcggucgggu

SEQ ID NO: 953859 - RNA, 17 nt, Mycobacterium avium subsp. paratuberculosis
ccggaccgcuugacgcc

SEQ ID NO: 953860 - RNA, 21 nt, Mycobacterium avium subsp. paratuberculosis
ccggaccgcuugacgccgccg

SEQ ID NO: 953861 - RNA, 12 nt, Mycobacterium avium subsp. paratuberculosis
ccggaccggcca

SEQ ID NO: 953862 - RNA, 14 nt, Mycobacterium avium subsp. paratuberculosis
ccggaccggccagc

SEQ ID NO: 953863 - RNA, 12 nt, Mycobacterium avium subsp. paratuberculosis
ccggaccggccg

SEQ ID NO: 953864 - RNA, 22 nt, Mycobacterium avium subsp. paratuberculosis
ccggaccggccgugcgcgucga

SEQ ID NO: 953865 - RNA, 13 nt, Mycobacterium avium subsp. paratuberculosis
ccggaccggcucg

SEQ ID NO: 953866 - RNA, 21 nt, Mycobacterium avium subsp. paratuberculosis
ccggaccgggugaccggcgcg

SEQ ID NO: 953867 - RNA, 23 nt, Mycobacterium avium subsp. paratuberculosis
ccggaccgggugaccggcgcgca

SEQ ID NO: 953868 - RNA, 22 nt, Mycobacterium avium subsp. paratuberculosis
ccggacggccgaaacgcccggc

SEQ ID NO: 953869 - RNA, 23 nt, Mycobacterium avium subsp. paratuberculosis
ccggacggccgaaacgcccggcu

SEQ ID NO: 953870 - RNA, 18 nt, Mycobacterium avium subsp. paratuberculosis
ccggacgcagcgaucggc

SEQ ID NO: 953871 - RNA, 21 nt, Mycobacterium avium subsp. paratuberculosis
ccggacgcagcgaucggcggc

SEQ ID NO: 953872 - RNA, 23 nt, Mycobacterium avium subsp. paratuberculosis
ccggacgaccugggcgccgucgc

SEQ ID NO: 953873 - RNA, 21 nt, Mycobacterium avium subsp. paratuberculosis
ccggacgaugacccagcccag

SEQ ID NO: 953874 - RNA, 18 nt, Mycobacterium avium subsp. paratuberculosis
ccggacgaugccgcggcg

SEQ ID NO: 953875 - RNA, 17 nt, Mycobacterium avium subsp. paratuberculosis
ccggacgaugcgcaccc

SEQ ID NO: 953876 - RNA, 17 nt, Mycobacterium avium subsp. paratuberculosis
ccggacgaggaucgcag

SEQ ID NO: 953877 - RNA, 22 nt, Mycobacterium avium subsp. paratuberculosis
ccggacgaggaucgcaggaugg

SEQ ID NO: 953878 - RNA, 22 nt, Mycobacterium avium subsp. paratuberculosis
ccggacugcuugggcgccucgc

SEQ ID NO: 953879 - RNA, 22 nt, Mycobacterium avium subsp. paratuberculosis
ccggacgcugcgguacacgugg

SEQ ID NO: 953880 - RNA, 18 nt, Mycobacterium avium subsp. paratuberculosis
ccggacuauacacgccug

SEQ ID NO: 953881 - RNA, 19 nt, Mycobacterium avium subsp. paratuberculosis
ccggacucgaagaucgccu

SEQ ID NO: 953882 - RNA, 15 nt, Mycobacterium avium subsp. paratuberculosis
ccggacgugaucgcg

SEQ ID NO: 953883 - RNA, 17 nt, Mycobacterium avium subsp. paratuberculosis
ccggacgugaucgcggu

SEQ ID NO: 953884 - RNA, 16 nt, Mycobacterium avium subsp. paratuberculosis
ccggacgggaucggcg

SEQ ID NO: 953885 - RNA, 17 nt, Mycobacterium avium subsp. paratuberculosis
ccggacgggaucggcgc

SEQ ID NO: 953886 - RNA, 20 nt, Mycobacterium avium subsp. paratuberculosis
ccggacgggaucggcgcguc

SEQ ID NO: 953887 - RNA, 17 nt, Mycobacterium avium subsp. paratuberculosis
ccggacgggucgaccgc

SEQ ID NO: 953888 - RNA, 19 nt, Mycobacterium avium subsp. paratuberculosis
ccggacgggucgaccgccg

SEQ ID NO: 953889 - RNA, 15 nt, Mycobacterium avium subsp. paratuberculosis
ccggagccuucuucg

SEQ ID NO: 953890 - RNA, 22 nt, Mycobacterium avium subsp. paratuberculosis
ccggagccuucuucgccgcagc

SEQ ID NO: 953891 - RNA, 22 nt, Mycobacterium avium subsp. paratuberculosis
ccggagccuugcuggcggccuu

SEQ ID NO: 953892 - RNA, 17 nt, Mycobacterium avium subsp. paratuberculosis
ccggagccuuggucgcg

SEQ ID NO: 953893 - RNA, 18 nt, Mycobacterium avium subsp. paratuberculosis
ccggagccuuggucgcgg

SEQ ID NO: 953894 - RNA, 19 nt, Mycobacterium avium subsp. paratuberculosis
ccggagccuuggucgcggc

SEQ ID NO: 953895 - RNA, 21 nt, Mycobacterium avium subsp. paratuberculosis
ccggagccuuggucgcggccu

SEQ ID NO: 953896 - RNA, 22 nt, Mycobacterium avium subsp. paratuberculosis
ccggagccuuggucgcggccuu

SEQ ID NO: 953897 - RNA, 12 nt, Mycobacterium avium subsp. paratuberculosis
ccggagccggag

SEQ ID NO: 953898 - RNA, 11 nt, Mycobacterium avium subsp. paratuberculosis
ccggagccggc

SEQ ID NO: 953899 - RNA, 21 nt, Mycobacterium avium subsp. paratuberculosis
ccggagccggccucgccggcg

SEQ ID NO: 953900 - RNA, 18 nt, Mycobacterium avium subsp. paratuberculosis
ccggagcgaaggugccgc

SEQ ID NO: 953901 - RNA, 22 nt, Mycobacterium avium subsp. paratuberculosis
ccggagcgaaggugccgcgaug

SEQ ID NO: 953902 - RNA, 22 nt, Mycobacterium avium subsp. paratuberculosis
ccggagcaaagguaguccagca

SEQ ID NO: 953903 - RNA, 21 nt, Mycobacterium avium subsp. paratuberculosis
ccggacuugaugcugcccggc

SEQ ID NO: 953904 - RNA, 14 nt, Mycobacterium avium subsp. paratuberculosis
ccggagaccagcag

SEQ ID NO: 953905 - RNA, 17 nt, Mycobacterium avium subsp. paratuberculosis
ccggagaaaccgucggc

SEQ ID NO: 953906 - RNA, 21 nt, Mycobacterium avium subsp. paratuberculosis
ccggagaaaccgucggcccgc

SEQ ID NO: 953907 - RNA, 16 nt, Mycobacterium avium subsp. paratuberculosis
ccggagaacaucagcc

SEQ ID NO: 953908 - RNA, 16 nt, Mycobacterium avium subsp. paratuberculosis
ccggagaaccgcucga

SEQ ID NO: 953909 - RNA, 20 nt, Mycobacterium avium subsp. paratuberculosis
ccggagaucccguaggucgc

SEQ ID NO: 953910 - RNA, 16 nt, Mycobacterium avium subsp. paratuberculosis
ccggagauccggccgc

SEQ ID NO: 953911 - RNA, 18 nt, Mycobacterium avium subsp. paratuberculosis
ccggagaugaucaugucg

SEQ ID NO: 953912 - RNA, 23 nt, Mycobacterium avium subsp. paratuberculosis
ccggagaugaucaugucguccuc

SEQ ID NO: 953913 - RNA, 13 nt, Mycobacterium avium subsp. paratuberculosis
ccggaucgccgag

SEQ ID NO: 953914 - RNA, 21 nt, Mycobacterium avium subsp. paratuberculosis
ccggaucgccgagguagccgc

SEQ ID NO: 953915 - RNA, 12 nt, Mycobacterium avium subsp. paratuberculosis
ccggaucgccga

SEQ ID NO: 953916 - RNA, 14 nt, Mycobacterium avium subsp. paratuberculosis
ccggaucgcgcagu

SEQ ID NO: 953917 - RNA, 11 nt, Mycobacterium avium subsp. paratuberculosis
ccggaucggcc

SEQ ID NO: 953918 - RNA, 23 nt, Mycobacterium avium subsp. paratuberculosis
ccggaucggccauggugccgccg

SEQ ID NO: 953919 - RNA, 21 nt, Mycobacterium avium subsp. paratuberculosis
ccggaucgaacuugaucaccg

SEQ ID NO: 953920 - RNA, 16 nt, Mycobacterium avium subsp. paratuberculosis
ccggaucgaauccggc

SEQ ID NO: 953921 - RNA, 18 nt, Mycobacterium avium subsp. paratuberculosis
ccggaucgaauccggcgg

SEQ ID NO: 953922 - RNA, 23 nt, Mycobacterium avium subsp. paratuberculosis
ccggaucgaccaacuccaccgcc

SEQ ID NO: 953923 - RNA, 12 nt, Mycobacterium avium subsp. paratuberculosis
ccggauccggua

SEQ ID NO: 953924 - RNA, 15 nt, Mycobacterium avium subsp. paratuberculosis
ccggauccgucgccc

SEQ ID NO: 953925 - RNA, 23 nt, Mycobacterium avium subsp. paratuberculosis
ccggaucccagaauucgccgggg

SEQ ID NO: 953926 - RNA, 13 nt, Mycobacterium avium subsp. paratuberculosis
ccggauagccguc

SEQ ID NO: 953927 - RNA, 15 nt, Mycobacterium avium subsp. paratuberculosis
ccggauagccgucgg

SEQ ID NO: 953928 - RNA, 19 nt, Mycobacterium avium subsp. paratuberculosis
ccggaucagcguuccggcg

SEQ ID NO: 953929 - RNA, 13 nt, Mycobacterium avium subsp. paratuberculosis
ccggaucagcuga

SEQ ID NO: 953930 - RNA, 20 nt, Mycobacterium avium subsp. paratuberculosis
ccggaucagcugaccggcga

SEQ ID NO: 953931 - RNA, 14 nt, Mycobacterium avium subsp. paratuberculosis
ccggauaccccgga

SEQ ID NO: 953932 - RNA, 18 nt, Mycobacterium avium subsp. paratuberculosis
ccggagcugucggugacg

SEQ ID NO: 953933 - RNA, 18 nt, Mycobacterium avium subsp. paratuberculosis
ccggaggccagcucgacc

SEQ ID NO: 953934 - RNA, 21 nt, Mycobacterium avium subsp. paratuberculosis
ccggaggccagcucgaccgcg

SEQ ID NO: 953935 - RNA, 13 nt, Mycobacterium avium subsp. paratuberculosis
ccggagcggugcg

SEQ ID NO: 953936 - RNA, 18 nt, Mycobacterium avium subsp. paratuberculosis
ccggagcggauggcgccg

SEQ ID NO: 953937 - RNA, 19 nt, Mycobacterium avium subsp. paratuberculosis
ccggagcggauggcgccgu

SEQ ID NO: 953938 - RNA, 21 nt, Mycobacterium avium subsp. paratuberculosis
ccggagcggauggcgccgucg

SEQ ID NO: 953939 - RNA, 22 nt, Mycobacterium avium subsp. paratuberculosis
ccggagcggauggcgccgucga

SEQ ID NO: 953940 - RNA, 12 nt, Mycobacterium avium subsp. paratuberculosis
ccggaggcggcg

SEQ ID NO: 953941 - RNA, 19 nt, Mycobacterium avium subsp. paratuberculosis
ccggaggggcgacgggccg

SEQ ID NO: 953942 - RNA, 20 nt, Mycobacterium avium subsp. paratuberculosis
ccggaggggcgacgggccga

SEQ ID NO: 953943 - RNA, 19 nt, Mycobacterium avium subsp. paratuberculosis
ccggaggguauucgugugc

SEQ ID NO: 953944 - RNA, 15 nt, Mycobacterium avium subsp. paratuberculosis
ccggaggugccggcc

SEQ ID NO: 953945 - RNA, 19 nt, Mycobacterium avium subsp. paratuberculosis
ccggaggugcgggucucga

SEQ ID NO: 953946 - RNA, 14 nt, Mycobacterium avium subsp. paratuberculosis
ccggagguucgccg

SEQ ID NO: 953947 - RNA, 16 nt, Mycobacterium avium subsp. paratuberculosis
ccggaguagccgguuc

SEQ ID NO: 953948 - RNA, 15 nt, Mycobacterium avium subsp. paratuberculosis
ccggaguccggcucg

SEQ ID NO: 953949 - RNA, 15 nt, Mycobacterium avium subsp. paratuberculosis
ccggagugacgucgc

SEQ ID NO: 953950 - RNA, 18 nt, Mycobacterium avium subsp. paratuberculosis
ccggagugacgucgcgcg

SEQ ID NO: 953951 - RNA, 14 nt, Mycobacterium avium subsp. paratuberculosis
ccggcccaccaccg

SEQ ID NO: 953952 - RNA, 16 nt, Mycobacterium avium subsp. paratuberculosis
ccggcccaccaccgcc

SEQ ID NO: 953953 - RNA, 22 nt, Mycobacterium avium subsp. paratuberculosis
ccggcccaccaccgccucgacg

SEQ ID NO: 953954 - RNA, 12 nt, Mycobacterium avium subsp. paratuberculosis
ccggcccaccgg

SEQ ID NO: 953955 - RNA, 20 nt, Mycobacterium avium subsp. paratuberculosis
ccggcccaccggcccggcgg

SEQ ID NO: 953956 - RNA, 21 nt, Mycobacterium avium subsp. paratuberculosis
ccggcccaccggcccggcggg

SEQ ID NO: 953957 - RNA, 16 nt, Mycobacterium avium subsp. paratuberculosis
ccggcccaagacccgc

SEQ ID NO: 953958 - RNA, 13 nt, Mycobacterium avium subsp. paratuberculosis
ccggcccacgccg

SEQ ID NO: 953959 - RNA, 16 nt, Mycobacterium avium subsp. paratuberculosis
ccggcccagccgcugc

SEQ ID NO: 953960 - RNA, 15 nt, Mycobacterium avium subsp. paratuberculosis
ccggcccagccggcg

SEQ ID NO: 953961 - RNA, 16 nt, Mycobacterium avium subsp. paratuberculosis
ccggcccagccggcgg

SEQ ID NO: 953962 - RNA, 17 nt, Mycobacterium avium subsp. paratuberculosis
ccggcccagccggucgc

SEQ ID NO: 953963 - RNA, 13 nt, Mycobacterium avium subsp. paratuberculosis
ccggcccagcagc

SEQ ID NO: 953964 - RNA, 14 nt, Mycobacterium avium subsp. paratuberculosis
ccggccccaccgcc

SEQ ID NO: 953965 - RNA, 17 nt, Mycobacterium avium subsp. paratuberculosis
ccggccccaccgccgcu

SEQ ID NO: 953966 - RNA, 16 nt, Mycobacterium avium subsp. paratuberculosis
ccggccccaacggcgu

SEQ ID NO: 953967 - RNA, 18 nt, Mycobacterium avium subsp. paratuberculosis
ccggccccaacggcgugc

SEQ ID NO: 953968 - RNA, 23 nt, Mycobacterium avium subsp. paratuberculosis
ccggccccaacggcgugcagccg

SEQ ID NO: 953969 - RNA, 16 nt, Mycobacterium avium subsp. paratuberculosis
ccggcccaguggaucg

SEQ ID NO: 953970 - RNA, 22 nt, Mycobacterium avium subsp. paratuberculosis
ccggcccaguggaucggcccga

SEQ ID NO: 953971 - RNA, 21 nt, Mycobacterium avium subsp. paratuberculosis
ccggcccaucaccggaccggc

SEQ ID NO: 953972 - RNA, 17 nt, Mycobacterium avium subsp. paratuberculosis
ccggcccagcgcgcggc

SEQ ID NO: 953973 - RNA, 18 nt, Mycobacterium avium subsp. paratuberculosis
ccggcccagcgcgcggcg

SEQ ID NO: 953974 - RNA, 19 nt, Mycobacterium avium subsp. paratuberculosis
ccggcccagcgcgcggcgg

SEQ ID NO: 953975 - RNA, 22 nt, Mycobacterium avium subsp. paratuberculosis
ccggcccgucaggccucgagga

SEQ ID NO: 953976 - RNA, 19 nt, Mycobacterium avium subsp. paratuberculosis
ccggcccguccagaucggc

SEQ ID NO: 953977 - RNA, 22 nt, Mycobacterium avium subsp. paratuberculosis
ccggcccguccagaucggccag

SEQ ID NO: 953978 - RNA, 21 nt, Mycobacterium avium subsp. paratuberculosis
ccggccgauggcccaggccgc

SEQ ID NO: 953979 - RNA, 23 nt, Mycobacterium avium subsp. paratuberculosis
ccggccgauggcccaggccgcgg

SEQ ID NO: 953980 - RNA, 15 nt, Mycobacterium avium subsp. paratuberculosis
ccggccgcacaccac

SEQ ID NO: 953981 - RNA, 13 nt, Mycobacterium avium subsp. paratuberculosis
ccggcccggcguc

SEQ ID NO: 953982 - RNA, 15 nt, Mycobacterium avium subsp. paratuberculosis
ccggcccagcuccac

SEQ ID NO: 953983 - RNA, 14 nt, Mycobacterium avium subsp. paratuberculosis
ccggcccggcccga

SEQ ID NO: 953984 - RNA, 15 nt, Mycobacterium avium subsp. paratuberculosis
ccggcccggccggcg

SEQ ID NO: 953985 - RNA, 17 nt, Mycobacterium avium subsp. paratuberculosis
ccggcccggcgaugccg

SEQ ID NO: 953986 - RNA, 15 nt, Mycobacterium avium subsp. paratuberculosis
ccggcccggcgcggc

SEQ ID NO: 953987 - RNA, 17 nt, Mycobacterium avium subsp. paratuberculosis
ccggcccggcgcggccg

SEQ ID NO: 953988 - RNA, 19 nt, Mycobacterium avium subsp. paratuberculosis
ccggcccggcgcggccggu

SEQ ID NO: 953989 - RNA, 20 nt, Mycobacterium avium subsp. paratuberculosis
ccggcccggcgcggccggug

SEQ ID NO: 953990 - RNA, 14 nt, Mycobacterium avium subsp. paratuberculosis
ccggcccggcggcc

SEQ ID NO: 953991 - RNA, 21 nt, Mycobacterium avium subsp. paratuberculosis
ccggcccggcggccggccgcg

SEQ ID NO: 953992 - RNA, 14 nt, Mycobacterium avium subsp. paratuberculosis
ccggcccgcucggc

SEQ ID NO: 953993 - RNA, 15 nt, Mycobacterium avium subsp. paratuberculosis
ccggcccgcucggcg

SEQ ID NO: 953994 - RNA, 16 nt, Mycobacterium avium subsp. paratuberculosis
ccggcccgcucggcgg

SEQ ID NO: 953995 - RNA, 16 nt, Mycobacterium avium subsp. paratuberculosis
ccggcccgcuggccgc

SEQ ID NO: 953996 - RNA, 18 nt, Mycobacterium avium subsp. paratuberculosis
ccggcccgcuggccgccg

SEQ ID NO: 953997 - RNA, 20 nt, Mycobacterium avium subsp. paratuberculosis
ccggcccgcuggccgccgcu

SEQ ID NO: 953998 - RNA, 19 nt, Mycobacterium avium subsp. paratuberculosis
ccggcccggaacgcgucgc

SEQ ID NO: 953999 - RNA, 13 nt, Mycobacterium avium subsp. paratuberculosis
ccggcccgcggcg

SEQ ID NO: 954000 - RNA, 15 nt, Mycobacterium avium subsp. paratuberculosis
ccggcccgcccggcg

SEQ ID NO: 954001 - RNA, 16 nt, Mycobacterium avium subsp. paratuberculosis
ccggcccgcccggcgg

SEQ ID NO: 954002 - RNA, 12 nt, Mycobacterium avium subsp. paratuberculosis
ccggcccgccgc

SEQ ID NO: 954003 - RNA, 15 nt, Mycobacterium avium subsp. paratuberculosis
ccggcccgccgcugc

SEQ ID NO: 954004 - RNA, 18 nt, Mycobacterium avium subsp. paratuberculosis
ccggcccgccgcugcagc

SEQ ID NO: 954005 - RNA, 20 nt, Mycobacterium avium subsp. paratuberculosis
ccggcccgccgcugcagcug

SEQ ID NO: 954006 - RNA, 16 nt, Mycobacterium avium subsp. paratuberculosis
ccggcccccugcucag

SEQ ID NO: 954007 - RNA, 18 nt, Mycobacterium avium subsp. paratuberculosis
ccggcccccugcucagcg

SEQ ID NO: 954008 - RNA, 23 nt, Mycobacterium avium subsp. paratuberculosis
ccggcccccugcucagcggccau

SEQ ID NO: 954009 - RNA, 14 nt, Mycobacterium avium subsp. paratuberculosis
ccggccccgagccg

SEQ ID NO: 954010 - RNA, 18 nt, Mycobacterium avium subsp. paratuberculosis
ccggccccgagcgucacg

SEQ ID NO: 954011 - RNA, 15 nt, Mycobacterium avium subsp. paratuberculosis
ccggcaucggcucgu

SEQ ID NO: 954012 - RNA, 17 nt, Mycobacterium avium subsp. paratuberculosis
ccggcaucggcucguag

SEQ ID NO: 954013 - RNA, 22 nt, Mycobacterium avium subsp. paratuberculosis
ccggccagcgucgcgccgccac

SEQ ID NO: 954014 - RNA, 19 nt, Mycobacterium avium subsp. paratuberculosis
ccggccagcgucuccggcg

SEQ ID NO: 954015 - RNA, 20 nt, Mycobacterium avium subsp. paratuberculosis
ccggccagcgucuccggcgg

SEQ ID NO: 954016 - RNA, 19 nt, Mycobacterium avium subsp. paratuberculosis
ccggcauccagcacggccg

SEQ ID NO: 954017 - RNA, 20 nt, Mycobacterium avium subsp. paratuberculosis
ccggcaucgacaugcccggc

SEQ ID NO: 954018 - RNA, 21 nt, Mycobacterium avium subsp. paratuberculosis
ccggcaucgacaugcccggcg

SEQ ID NO: 954019 - RNA, 22 nt, Mycobacterium avium subsp. paratuberculosis
ccggcaucgacaugcccggcga

SEQ ID NO: 954020 - RNA, 15 nt, Mycobacterium avium subsp. paratuberculosis
ccggcaucgaccgcc

SEQ ID NO: 954021 - RNA, 20 nt, Mycobacterium avium subsp. paratuberculosis
ccggcaucgaccgcccgcug

SEQ ID NO: 954022 - RNA, 13 nt, Mycobacterium avium subsp. paratuberculosis
ccggcauccucgg

SEQ ID NO: 954023 - RNA, 15 nt, Mycobacterium avium subsp. paratuberculosis
ccggcauccucggcg

SEQ ID NO: 954024 - RNA, 16 nt, Mycobacterium avium subsp. paratuberculosis
ccggcauaggccagca

SEQ ID NO: 954025 - RNA, 18 nt, Mycobacterium avium subsp. paratuberculosis
ccggcauaggccagcacc

SEQ ID NO: 954026 - RNA, 22 nt, Mycobacterium avium subsp. paratuberculosis
ccggcauaggccagcaccagcg

SEQ ID NO: 954027 - RNA, 18 nt, Mycobacterium avium subsp. paratuberculosis
ccggcaguuccucgccgg

SEQ ID NO: 954028 - RNA, 20 nt, Mycobacterium avium subsp. paratuberculosis
ccggcaguuccucgccggag

SEQ ID NO: 954029 - RNA, 18 nt, Mycobacterium avium subsp. paratuberculosis
ccggcagugaucggcgga

SEQ ID NO: 954030 - RNA, 14 nt, Mycobacterium avium subsp. paratuberculosis
ccggccagggccgc

SEQ ID NO: 954031 - RNA, 15 nt, Mycobacterium avium subsp. paratuberculosis
ccggccagggccgcc

SEQ ID NO: 954032 - RNA, 19 nt, Mycobacterium avium subsp. paratuberculosis
ccggccagggccgccgcau

SEQ ID NO: 954033 - RNA, 23 nt, Mycobacterium avium subsp. paratuberculosis
ccggccaugaccaugucgacgcu

SEQ ID NO: 954034 - RNA, 17 nt, Mycobacterium avium subsp. paratuberculosis
ccggccaggccggccug

SEQ ID NO: 954035 - RNA, 17 nt, Mycobacterium avium subsp. paratuberculosis
ccggccaggcacagcag

SEQ ID NO: 954036 - RNA, 20 nt, Mycobacterium avium subsp. paratuberculosis
ccggccagcuuuccggccgc

SEQ ID NO: 954037 - RNA, 21 nt, Mycobacterium avium subsp. paratuberculosis
ccggccagcuuuccggccgcc

SEQ ID NO: 954038 - RNA, 23 nt, Mycobacterium avium subsp. paratuberculosis
ccggccagcuuuccggccgccuc

SEQ ID NO: 954039 - RNA, 21 nt, Mycobacterium avium subsp. paratuberculosis
ccggccaggaucuugucggcg

SEQ ID NO: 954040 - RNA, 13 nt, Mycobacterium avium subsp. paratuberculosis
ccggccaggaugg

SEQ ID NO: 954041 - RNA, 13 nt, Mycobacterium avium subsp. paratuberculosis
ccggccagcucga

SEQ ID NO: 954042 - RNA, 22 nt, Mycobacterium avium subsp. paratuberculosis
ccggccagcucgagcaucacga

SEQ ID NO: 954043 - RNA, 15 nt, Mycobacterium avium subsp. paratuberculosis
ccggccagcucgccg

SEQ ID NO: 954044 - RNA, 17 nt, Mycobacterium avium subsp. paratuberculosis
ccggccagcucgccgcc

SEQ ID NO: 954045 - RNA, 18 nt, Mycobacterium avium subsp. paratuberculosis
ccggccagcucgccgccg

SEQ ID NO: 954046 - RNA, 14 nt, Mycobacterium avium subsp. paratuberculosis
ccggcgauccgcgc

SEQ ID NO: 954047 - RNA, 14 nt, Mycobacterium avium subsp. paratuberculosis
ccggcgaucaccgg

SEQ ID NO: 954048 - RNA, 16 nt, Mycobacterium avium subsp. paratuberculosis
ccggcgaucaccggga

SEQ ID NO: 954049 - RNA, 17 nt, Mycobacterium avium subsp. paratuberculosis
ccggcgaggcggucggc

SEQ ID NO: 954050 - RNA, 18 nt, Mycobacterium avium subsp. paratuberculosis
ccggcgauaggcggccag

SEQ ID NO: 954051 - RNA, 20 nt, Mycobacterium avium subsp. paratuberculosis
ccggcgauaggcggccagcu

SEQ ID NO: 954052 - RNA, 21 nt, Mycobacterium avium subsp. paratuberculosis
ccggcgauaggcggccagcuc

SEQ ID NO: 954053 - RNA, 16 nt, Mycobacterium avium subsp. paratuberculosis
ccggcgagcgcgcuga

SEQ ID NO: 954054 - RNA, 17 nt, Mycobacterium avium subsp. paratuberculosis
ccggcgagcgcgcugau

SEQ ID NO: 954055 - RNA, 15 nt, Mycobacterium avium subsp. paratuberculosis
ccggcgagcggcacc

SEQ ID NO: 954056 - RNA, 18 nt, Mycobacterium avium subsp. paratuberculosis
ccggcgagcucgcggccg

SEQ ID NO: 954057 - RNA, 17 nt, Mycobacterium avium subsp. paratuberculosis
ccggcgaggugaaccgc

SEQ ID NO: 954058 - RNA, 18 nt, Mycobacterium avium subsp. paratuberculosis
ccggcgaggugaaccgcg

SEQ ID NO: 954059 - RNA, 21 nt, Mycobacterium avium subsp. paratuberculosis
ccggcgaggugaaccgcgacg

SEQ ID NO: 954060 - RNA, 14 nt, Mycobacterium avium subsp. paratuberculosis
ccggcgaggugcgc

SEQ ID NO: 954061 - RNA, 15 nt, Mycobacterium avium subsp. paratuberculosis
ccggcgaggugcgcc

SEQ ID NO: 954062 - RNA, 16 nt, Mycobacterium avium subsp. paratuberculosis
ccggcgaggugcgcca

SEQ ID NO: 954063 - RNA, 19 nt, Mycobacterium avium subsp. paratuberculosis
ccggcgaguacccgccgca

SEQ ID NO: 954064 - RNA, 16 nt, Mycobacterium avium subsp. paratuberculosis
ccggcgaguccgcgga

SEQ ID NO: 954065 - RNA, 18 nt, Mycobacterium avium subsp. paratuberculosis
ccggcgagucgcggauca

SEQ ID NO: 954066 - RNA, 18 nt, Mycobacterium avium subsp. paratuberculosis
ccggcgagugcgaaucau

SEQ ID NO: 954067 - RNA, 21 nt, Mycobacterium avium subsp. paratuberculosis
ccggcgaguggaagucagcgc

SEQ ID NO: 954068 - RNA, 23 nt, Mycobacterium avium subsp. paratuberculosis
ccggcgagaucccugcgcucagc

SEQ ID NO: 954069 - RNA, 16 nt, Mycobacterium avium subsp. paratuberculosis
ccggcgagcacgccgc

SEQ ID NO: 954070 - RNA, 17 nt, Mycobacterium avium subsp. paratuberculosis
ccggcgagcacgccgcc

SEQ ID NO: 954071 - RNA, 18 nt, Mycobacterium avium subsp. paratuberculosis
ccggcgagcacgccgccg

SEQ ID NO: 954072 - RNA, 22 nt, Mycobacterium avium subsp. paratuberculosis
ccggcgagcacaggaacgcgac

SEQ ID NO: 954073 - RNA, 21 nt, Mycobacterium avium subsp. paratuberculosis
ccggcgacgguggcgcccagc

SEQ ID NO: 954074 - RNA, 17 nt, Mycobacterium avium subsp. paratuberculosis
ccggcgacgucgccggc

SEQ ID NO: 954075 - RNA, 20 nt, Mycobacterium avium subsp. paratuberculosis
ccggcgacgucgccggccug

SEQ ID NO: 954076 - RNA, 14 nt, Mycobacterium avium subsp. paratuberculosis
ccggcgacgucguc

SEQ ID NO: 954077 - RNA, 20 nt, Mycobacterium avium subsp. paratuberculosis
ccggcgacggccagcgcggc

SEQ ID NO: 954078 - RNA, 23 nt, Mycobacterium avium subsp. paratuberculosis
ccggcgacggcgaguucgaugac

SEQ ID NO: 954079 - RNA, 13 nt, Mycobacterium avium subsp. paratuberculosis
ccggcgacggcgc

SEQ ID NO: 954080 - RNA, 14 nt, Mycobacterium avium subsp. paratuberculosis
ccggcgacggcgcc

SEQ ID NO: 954081 - RNA, 16 nt, Mycobacterium avium subsp. paratuberculosis
ccggcgacggcgccug

SEQ ID NO: 954082 - RNA, 18 nt, Mycobacterium avium subsp. paratuberculosis
ccggcgacggcgccugau

SEQ ID NO: 954083 - RNA, 15 nt, Mycobacterium avium subsp. paratuberculosis
ccggcgacggcggcc

SEQ ID NO: 954084 - RNA, 15 nt, Mycobacterium avium subsp. paratuberculosis
ccggcgacgccggcg

SEQ ID NO: 954085 - RNA, 17 nt, Mycobacterium avium subsp. paratuberculosis
ccggcgacgccggcgag

SEQ ID NO: 954086 - RNA, 15 nt, Mycobacterium avium subsp. paratuberculosis
ccggcgacgcggcgg

SEQ ID NO: 954087 - RNA, 16 nt, Mycobacterium avium subsp. paratuberculosis
ccggcgacgcggcggg

SEQ ID NO: 954088 - RNA, 14 nt, Mycobacterium avium subsp. paratuberculosis
ccggcgacgccgcg

SEQ ID NO: 954089 - RNA, 19 nt, Mycobacterium avium subsp. paratuberculosis
ccggcgacgccgcgcuggc

SEQ ID NO: 954090 - RNA, 21 nt, Mycobacterium avium subsp. paratuberculosis
ccggcgacgccgcgcuggccg

SEQ ID NO: 954091 - RNA, 19 nt, Mycobacterium avium subsp. paratuberculosis
ccggcgacgauaucggccg

SEQ ID NO: 954092 - RNA, 22 nt, Mycobacterium avium subsp. paratuberculosis
ccggcgacgauaucggccgcgg

SEQ ID NO: 954093 - RNA, 17 nt, Mycobacterium avium subsp. paratuberculosis
ccggcgaccgugcccac

SEQ ID NO: 954094 - RNA, 23 nt, Mycobacterium avium subsp. paratuberculosis
ccggcgaccgugcccaccagccg

SEQ ID NO: 954095 - RNA, 19 nt, Mycobacterium avium subsp. paratuberculosis
ccggcgacgaacgcuucca

SEQ ID NO: 954096 - RNA, 21 nt, Mycobacterium avium subsp. paratuberculosis
ccggcgacgaagcagcucgcg

SEQ ID NO: 954097 - RNA, 12 nt, Mycobacterium avium subsp. paratuberculosis
ccggcgacgacc

SEQ ID NO: 954098 - RNA, 18 nt, Mycobacterium avium subsp. paratuberculosis
ccggcgacgaccgcaccg

SEQ ID NO: 954099 - RNA, 14 nt, Mycobacterium avium subsp. paratuberculosis
ccggcgaccgccuu

SEQ ID NO: 954100 - RNA, 23 nt, Mycobacterium avium subsp. paratuberculosis
ccggcgaccgccuugucggcgau

SEQ ID NO: 954101 - RNA, 18 nt, Mycobacterium avium subsp. paratuberculosis
ccggcgacaugcgcagcg

SEQ ID NO: 954102 - RNA, 23 nt, Mycobacterium avium subsp. paratuberculosis
ccggcgacaccgcauggccggcg

SEQ ID NO: 954103 - RNA, 20 nt, Mycobacterium avium subsp. paratuberculosis
ccggcgaccaccagccgcag

SEQ ID NO: 954104 - RNA, 20 nt, Mycobacterium avium subsp. paratuberculosis
ccggcgaccagcaggucgag

SEQ ID NO: 954105 - RNA, 15 nt, Mycobacterium avium subsp. paratuberculosis
ccggcgaccagcccc

SEQ ID NO: 954106 - RNA, 14 nt, Mycobacterium avium subsp. paratuberculosis
ccggcgacaccgca

SEQ ID NO: 954107 - RNA, 22 nt, Mycobacterium avium subsp. paratuberculosis
ccggcgaauucggugaucgcgg

SEQ ID NO: 954108 - RNA, 23 nt, Mycobacterium avium subsp. paratuberculosis
ccggcgaauucggugaucgcggu

SEQ ID NO: 954109 - RNA, 16 nt, Mycobacterium avium subsp. paratuberculosis
ccggccuugcucgccg

SEQ ID NO: 954110 - RNA, 16 nt, Mycobacterium avium subsp. paratuberculosis
ccggcgaauccgaccg

SEQ ID NO: 954111 - RNA, 23 nt, Mycobacterium avium subsp. paratuberculosis
ccggcgaauccgaccggcucagc

SEQ ID NO: 954112 - RNA, 21 nt, Mycobacterium avium subsp. paratuberculosis
ccggcgaauccgaguuggccg

SEQ ID NO: 954113 - RNA, 16 nt, Mycobacterium avium subsp. paratuberculosis
ccggccuggcccagcc

SEQ ID NO: 954114 - RNA, 18 nt, Mycobacterium avium subsp. paratuberculosis
ccggccuucaccagggug

SEQ ID NO: 954115 - RNA, 19 nt, Mycobacterium avium subsp. paratuberculosis
ccggccuucaccagggugc

SEQ ID NO: 954116 - RNA, 17 nt, Mycobacterium avium subsp. paratuberculosis
ccggccuucucgcgcac

SEQ ID NO: 954117 - RNA, 20 nt, Mycobacterium avium subsp. paratuberculosis
ccggccuucucgcgcaccgc

SEQ ID NO: 954118 - RNA, 22 nt, Mycobacterium avium subsp. paratuberculosis
ccggccuucucgcgcaccgcgg

SEQ ID NO: 954119 - RNA, 23 nt, Mycobacterium avium subsp. paratuberculosis
ccggccgugccggcucggcggcu

SEQ ID NO: 954120 - RNA, 22 nt, Mycobacterium avium subsp. paratuberculosis
ccggccguggacccgccccgac

SEQ ID NO: 954121 - RNA, 13 nt, Mycobacterium avium subsp. paratuberculosis
ccggccgucgucg

SEQ ID NO: 954122 - RNA, 19 nt, Mycobacterium avium subsp. paratuberculosis
ccggccgugaugcgccggc

SEQ ID NO: 954123 - RNA, 23 nt, Mycobacterium avium subsp. paratuberculosis
ccggccgugaugcgccggcgguc

SEQ ID NO: 954124 - RNA, 13 nt, Mycobacterium avium subsp. paratuberculosis
ccggccguucgcc

SEQ ID NO: 954125 - RNA, 17 nt, Mycobacterium avium subsp. paratuberculosis
ccggccguucgccggcc

SEQ ID NO: 954126 - RNA, 18 nt, Mycobacterium avium subsp. paratuberculosis
ccggccguucgccggcca

SEQ ID NO: 954127 - RNA, 16 nt, Mycobacterium avium subsp. paratuberculosis
ccggccugccaccgcg

SEQ ID NO: 954128 - RNA, 17 nt, Mycobacterium avium subsp. paratuberculosis
ccggccugccaccgcga

SEQ ID NO: 954129 - RNA, 13 nt, Mycobacterium avium subsp. paratuberculosis
ccggccugcccgc

SEQ ID NO: 954130 - RNA, 20 nt, Mycobacterium avium subsp. paratuberculosis
ccggccugcccgccgcggcc

SEQ ID NO: 954131 - RNA, 22 nt, Mycobacterium avium subsp. paratuberculosis
ccggccugcccgccgcggccgc

SEQ ID NO: 954132 - RNA, 22 nt, Mycobacterium avium subsp. paratuberculosis
ccggccgguggccggugggcgg

SEQ ID NO: 954133 - RNA, 18 nt, Mycobacterium avium subsp. paratuberculosis
ccggccgguuggcggccg

SEQ ID NO: 954134 - RNA, 22 nt, Mycobacterium avium subsp. paratuberculosis
ccggccgguuggcggccggguc

SEQ ID NO: 954135 - RNA, 22 nt, Mycobacterium avium subsp. paratuberculosis
ccggccgguuguugcgguccag

SEQ ID NO: 954136 - RNA, 23 nt, Mycobacterium avium subsp. paratuberculosis
ccggccguagcggacgacggcca

SEQ ID NO: 954137 - RNA, 17 nt, Mycobacterium avium subsp. paratuberculosis
ccggccguaucggccaa

SEQ ID NO: 954138 - RNA, 13 nt, Mycobacterium avium subsp. paratuberculosis
ccggccgucacgc

SEQ ID NO: 954139 - RNA, 16 nt, Mycobacterium avium subsp. paratuberculosis
ccggccgucacgcugg

SEQ ID NO: 954140 - RNA, 20 nt, Mycobacterium avium subsp. paratuberculosis
ccggccguccacggcggugg

SEQ ID NO: 954141 - RNA, 12 nt, Mycobacterium avium subsp. paratuberculosis
ccggccggucgc

SEQ ID NO: 954142 - RNA, 16 nt, Mycobacterium avium subsp. paratuberculosis
ccggccggucgccgau

SEQ ID NO: 954143 - RNA, 18 nt, Mycobacterium avium subsp. paratuberculosis
ccggccggucgccgaugg

SEQ ID NO: 954144 - RNA, 16 nt, Mycobacterium avium subsp. paratuberculosis
ccggccggggcggcgg

SEQ ID NO: 954145 - RNA, 15 nt, Mycobacterium avium subsp. paratuberculosis
ccggccgggucgacc

SEQ ID NO: 954146 - RNA, 13 nt, Mycobacterium avium subsp. paratuberculosis
ccggccggggcgc

SEQ ID NO: 954147 - RNA, 13 nt, Mycobacterium avium subsp. paratuberculosis
ccggccgccggau

SEQ ID NO: 954148 - RNA, 14 nt, Mycobacterium avium subsp. paratuberculosis
ccggccgccggauc

SEQ ID NO: 954149 - RNA, 14 nt, Mycobacterium avium subsp. paratuberculosis
ccggccgccggcgg

SEQ ID NO: 954150 - RNA, 15 nt, Mycobacterium avium subsp. paratuberculosis
ccggccgccggcggc

SEQ ID NO: 954151 - RNA, 17 nt, Mycobacterium avium subsp. paratuberculosis
ccggccgccggcggcca

SEQ ID NO: 954152 - RNA, 16 nt, Mycobacterium avium subsp. paratuberculosis
ccggccgccguggccc

SEQ ID NO: 954153 - RNA, 13 nt, Mycobacterium avium subsp. paratuberculosis
ccggccgccgaag

SEQ ID NO: 954154 - RNA, 14 nt, Mycobacterium avium subsp. paratuberculosis
ccggccgccgaagc

SEQ ID NO: 954155 - RNA, 13 nt, Mycobacterium avium subsp. paratuberculosis
ccggccgccgagg

SEQ ID NO: 954156 - RNA, 15 nt, Mycobacterium avium subsp. paratuberculosis
ccggccgccgaggac

SEQ ID NO: 954157 - RNA, 16 nt, Mycobacterium avium subsp. paratuberculosis
ccggccgccgcgcauc

SEQ ID NO: 954158 - RNA, 18 nt, Mycobacterium avium subsp. paratuberculosis
ccggccgccagcgcccgc

SEQ ID NO: 954159 - RNA, 14 nt, Mycobacterium avium subsp. paratuberculosis
ccggccgcccgcac

SEQ ID NO: 954160 - RNA, 20 nt, Mycobacterium avium subsp. paratuberculosis
ccggccgcccgcaccagcag

SEQ ID NO: 954161 - RNA, 14 nt, Mycobacterium avium subsp. paratuberculosis
ccggccgcagcugc

SEQ ID NO: 954162 - RNA, 21 nt, Mycobacterium avium subsp. paratuberculosis
ccggccgcagcugcugcggcc

SEQ ID NO: 954163 - RNA, 14 nt, Mycobacterium avium subsp. paratuberculosis
ccggcacuggcgaa

SEQ ID NO: 954164 - RNA, 23 nt, Mycobacterium avium subsp. paratuberculosis
ccggcacggugcacacgccgagg

SEQ ID NO: 954165 - RNA, 18 nt, Mycobacterium avium subsp. paratuberculosis
ccggcacggcaccgcgag

SEQ ID NO: 954166 - RNA, 16 nt, Mycobacterium avium subsp. paratuberculosis
ccggcacucgccucgg

SEQ ID NO: 954167 - RNA, 21 nt, Mycobacterium avium subsp. paratuberculosis
ccggcacucgccucggaggcc

SEQ ID NO: 954168 - RNA, 14 nt, Mycobacterium avium subsp. paratuberculosis
ccggcacucgucgu

SEQ ID NO: 954169 - RNA, 23 nt, Mycobacterium avium subsp. paratuberculosis
ccggcacuucgaucaucuccacc

SEQ ID NO: 954170 - RNA, 17 nt, Mycobacterium avium subsp. paratuberculosis
ccggcagaacgacgcca

SEQ ID NO: 954171 - RNA, 15 nt, Mycobacterium avium subsp. paratuberculosis
ccggcagaucgcggc

SEQ ID NO: 954172 - RNA, 17 nt, Mycobacterium avium subsp. paratuberculosis
ccggcagaucgcggccc

SEQ ID NO: 954173 - RNA, 18 nt, Mycobacterium avium subsp. paratuberculosis
ccggcagaucgcggcccg

SEQ ID NO: 954174 - RNA, 19 nt, Mycobacterium avium subsp. paratuberculosis
ccggcagaucgcggcccgc

SEQ ID NO: 954175 - RNA, 20 nt, Mycobacterium avium subsp. paratuberculosis
ccggcagaucgcggcccgcc

SEQ ID NO: 954176 - RNA, 22 nt, Mycobacterium avium subsp. paratuberculosis
ccggcagaucgcggcccgccgc

SEQ ID NO: 954177 - RNA, 23 nt, Mycobacterium avium subsp. paratuberculosis
ccggcagaucgcggcccgccgcu

SEQ ID NO: 954178 - RNA, 15 nt, Mycobacterium avium subsp. paratuberculosis
ccggcacgucggcca

SEQ ID NO: 954179 - RNA, 16 nt, Mycobacterium avium subsp. paratuberculosis
ccggcacgucggccac

SEQ ID NO: 954180 - RNA, 18 nt, Mycobacterium avium subsp. paratuberculosis
ccggcacgugcggguugg

SEQ ID NO: 954181 - RNA, 14 nt, Mycobacterium avium subsp. paratuberculosis
ccggcacguugacg

SEQ ID NO: 954182 - RNA, 15 nt, Mycobacterium avium subsp. paratuberculosis
ccggcacguugacgu

SEQ ID NO: 954183 - RNA, 14 nt, Mycobacterium avium subsp. paratuberculosis
ccggcacggccggc

SEQ ID NO: 954184 - RNA, 15 nt, Mycobacterium avium subsp. paratuberculosis
ccggcacggccggcc

SEQ ID NO: 954185 - RNA, 17 nt, Mycobacterium avium subsp. paratuberculosis
ccggcacggccggccgg

SEQ ID NO: 954186 - RNA, 15 nt, Mycobacterium avium subsp. paratuberculosis
ccggcacgcgcgccg

SEQ ID NO: 954187 - RNA, 13 nt, Mycobacterium avium subsp. paratuberculosis
ccggcacgcgcgc

SEQ ID NO: 954188 - RNA, 16 nt, Mycobacterium avium subsp. paratuberculosis
ccggcaccgccagcca

SEQ ID NO: 954189 - RNA, 17 nt, Mycobacterium avium subsp. paratuberculosis
ccggcaccgccagccac

SEQ ID NO: 954190 - RNA, 13 nt, Mycobacterium avium subsp. paratuberculosis
ccggcaccgcccc

SEQ ID NO: 954191 - RNA, 18 nt, Mycobacterium avium subsp. paratuberculosis
ccggcaccgcccccgcgg

SEQ ID NO: 954192 - RNA, 19 nt, Mycobacterium avium subsp. paratuberculosis
ccggcaccgcccccgcggc

SEQ ID NO: 954193 - RNA, 20 nt, Mycobacterium avium subsp. paratuberculosis
ccggcaccgcccccgcggcg

SEQ ID NO: 954194 - RNA, 22 nt, Mycobacterium avium subsp. paratuberculosis
ccggcaccgcccccgcggcggc

SEQ ID NO: 954195 - RNA, 14 nt, Mycobacterium avium subsp. paratuberculosis
ccggcaccagcagc

SEQ ID NO: 954196 - RNA, 22 nt, Mycobacterium avium subsp. paratuberculosis
ccggcaccagcagccgcagcgc

SEQ ID NO: 954197 - RNA, 19 nt, Mycobacterium avium subsp. paratuberculosis
ccggcacccgccagcccga

SEQ ID NO: 954198 - RNA, 13 nt, Mycobacterium avium subsp. paratuberculosis
ccggcaccgcggc

SEQ ID NO: 954199 - RNA, 14 nt, Mycobacterium avium subsp. paratuberculosis
ccggcaccgcggcg

SEQ ID NO: 954200 - RNA, 15 nt, Mycobacterium avium subsp. paratuberculosis
ccggcaccgcggcga

SEQ ID NO: 954201 - RNA, 15 nt, Mycobacterium avium subsp. paratuberculosis
ccggcaccgcggcgg

SEQ ID NO: 954202 - RNA, 19 nt, Mycobacterium avium subsp. paratuberculosis
ccggcaccggugcggcggu

SEQ ID NO: 954203 - RNA, 17 nt, Mycobacterium avium subsp. paratuberculosis
ccggcacgaacgcgacg

SEQ ID NO: 954204 - RNA, 16 nt, Mycobacterium avium subsp. paratuberculosis
ccggcaccguccggcg

SEQ ID NO: 954205 - RNA, 21 nt, Mycobacterium avium subsp. paratuberculosis
ccggcaccucgaagggcgcca

SEQ ID NO: 954206 - RNA, 18 nt, Mycobacterium avium subsp. paratuberculosis
ccggcacgaucgucgccg

SEQ ID NO: 954207 - RNA, 19 nt, Mycobacterium avium subsp. paratuberculosis
ccggcacgaucgucgccgc

SEQ ID NO: 954208 - RNA, 16 nt, Mycobacterium avium subsp. paratuberculosis
ccggcacgauggcgcg

SEQ ID NO: 954209 - RNA, 21 nt, Mycobacterium avium subsp. paratuberculosis
ccggcacgauggcgcggcgca

SEQ ID NO: 954210 - RNA, 22 nt, Mycobacterium avium subsp. paratuberculosis
ccggcacgauggcgcggcgcac

SEQ ID NO: 954211 - RNA, 17 nt, Mycobacterium avium subsp. paratuberculosis
ccggcaggucgaggccg

SEQ ID NO: 954212 - RNA, 19 nt, Mycobacterium avium subsp. paratuberculosis
ccggcaggucgaggccggc

SEQ ID NO: 954213 - RNA, 20 nt, Mycobacterium avium subsp. paratuberculosis
ccggcaggucgaggccggcc

SEQ ID NO: 954214 - RNA, 23 nt, Mycobacterium avium subsp. paratuberculosis
ccggcaggucgaggccggccagc

SEQ ID NO: 954215 - RNA, 15 nt, Mycobacterium avium subsp. paratuberculosis
ccggcaguacgcgcc

SEQ ID NO: 954216 - RNA, 17 nt, Mycobacterium avium subsp. paratuberculosis
ccggcaguacgcgccgg

SEQ ID NO: 954217 - RNA, 18 nt, Mycobacterium avium subsp. paratuberculosis
ccggcaguacgcgccggc

SEQ ID NO: 954218 - RNA, 21 nt, Mycobacterium avium subsp. paratuberculosis
ccggcaguccggacacggcca

SEQ ID NO: 954219 - RNA, 14 nt, Mycobacterium avium subsp. paratuberculosis
ccggcaggccgcgg

SEQ ID NO: 954220 - RNA, 15 nt, Mycobacterium avium subsp. paratuberculosis
ccggcaggccgcggc

SEQ ID NO: 954221 - RNA, 17 nt, Mycobacterium avium subsp. paratuberculosis
ccggcaggccgcggccg

SEQ ID NO: 954222 - RNA, 19 nt, Mycobacterium avium subsp. paratuberculosis
ccggcaggccgcggccguc

SEQ ID NO: 954223 - RNA, 21 nt, Mycobacterium avium subsp. paratuberculosis
ccggcaggccgcggccgucgu

SEQ ID NO: 954224 - RNA, 19 nt, Mycobacterium avium subsp. paratuberculosis
ccggcaggcucagcagcac

SEQ ID NO: 954225 - RNA, 17 nt, Mycobacterium avium subsp. paratuberculosis
ccggcaggccgcccgac

SEQ ID NO: 954226 - RNA, 18 nt, Mycobacterium avium subsp. paratuberculosis
ccggcaggacgggggccg

SEQ ID NO: 954227 - RNA, 14 nt, Mycobacterium avium subsp. paratuberculosis
ccggcagcgcucgu

SEQ ID NO: 954228 - RNA, 19 nt, Mycobacterium avium subsp. paratuberculosis
ccggcagcgcucgucgucg

SEQ ID NO: 954229 - RNA, 21 nt, Mycobacterium avium subsp. paratuberculosis
ccggcagcgcucgucgucgga

SEQ ID NO: 954230 - RNA, 14 nt, Mycobacterium avium subsp. paratuberculosis
ccggcagcggccgc

SEQ ID NO: 954231 - RNA, 15 nt, Mycobacterium avium subsp. paratuberculosis
ccggcagcggccgca

SEQ ID NO: 954232 - RNA, 16 nt, Mycobacterium avium subsp. paratuberculosis
ccggcagcggcugcug

SEQ ID NO: 954233 - RNA, 22 nt, Mycobacterium avium subsp. paratuberculosis
ccggcagcggcugcugcagcgc

SEQ ID NO: 954234 - RNA, 20 nt, Mycobacterium avium subsp. paratuberculosis
ccggcagcggggcgaacccg

SEQ ID NO: 954235 - RNA, 22 nt, Mycobacterium avium subsp. paratuberculosis
ccggcagcggggcgaacccggc

SEQ ID NO: 954236 - RNA, 21 nt, Mycobacterium avium subsp. paratuberculosis
ccggcagcggucauugaugcc

SEQ ID NO: 954237 - RNA, 15 nt, Mycobacterium avium subsp. paratuberculosis
ccggcagcggugccg

SEQ ID NO: 954238 - RNA, 22 nt, Mycobacterium avium subsp. paratuberculosis
ccggcagcggugccgcccggag

SEQ ID NO: 954239 - RNA, 15 nt, Mycobacterium avium subsp. paratuberculosis
ccggcagccgcagcg

SEQ ID NO: 954240 - RNA, 16 nt, Mycobacterium avium subsp. paratuberculosis
ccggcagccgcgccca

SEQ ID NO: 954241 - RNA, 13 nt, Mycobacterium avium subsp. paratuberculosis
ccggcagccgcuc

SEQ ID NO: 954242 - RNA, 13 nt, Mycobacterium avium subsp. paratuberculosis
ccggcagccggcg

SEQ ID NO: 954243 - RNA, 14 nt, Mycobacterium avium subsp. paratuberculosis
ccggcagccggcgc

SEQ ID NO: 954244 - RNA, 15 nt, Mycobacterium avium subsp. paratuberculosis
ccggcagccggcgcg

SEQ ID NO: 954245 - RNA, 16 nt, Mycobacterium avium subsp. paratuberculosis
ccggcagccggcgcgg

SEQ ID NO: 954246 - RNA, 19 nt, Mycobacterium avium subsp. paratuberculosis
ccggcagccggcgcgguga

SEQ ID NO: 954247 - RNA, 14 nt, Mycobacterium avium subsp. paratuberculosis
ccggcagccggcgu

SEQ ID NO: 954248 - RNA, 16 nt, Mycobacterium avium subsp. paratuberculosis
ccggcagccggcguac

SEQ ID NO: 954249 - RNA, 15 nt, Mycobacterium avium subsp. paratuberculosis
ccggcagccggggug

SEQ ID NO: 954250 - RNA, 16 nt, Mycobacterium avium subsp. paratuberculosis
ccggcagccggggugc

SEQ ID NO: 954251 - RNA, 14 nt, Mycobacterium avium subsp. paratuberculosis
ccggcagcgaaacc

SEQ ID NO: 954252 - RNA, 14 nt, Mycobacterium avium subsp. paratuberculosis
ccggcagcgccacc

SEQ ID NO: 954253 - RNA, 15 nt, Mycobacterium avium subsp. paratuberculosis
ccggcagcgcgccca

SEQ ID NO: 954254 - RNA, 14 nt, Mycobacterium avium subsp. paratuberculosis
ccggcagcaggugc

SEQ ID NO: 954255 - RNA, 15 nt, Mycobacterium avium subsp. paratuberculosis
ccggcagcaggugca

SEQ ID NO: 954256 - RNA, 20 nt, Mycobacterium avium subsp. paratuberculosis
ccggcagcaggugcaccacc

SEQ ID NO: 954257 - RNA, 20 nt, Mycobacterium avium subsp. paratuberculosis
ccggcagcaucgggacgccu

SEQ ID NO: 954258 - RNA, 21 nt, Mycobacterium avium subsp. paratuberculosis
ccggcagcaucgggacgccug

SEQ ID NO: 954259 - RNA, 15 nt, Mycobacterium avium subsp. paratuberculosis
ccggcagcagcgcgu

SEQ ID NO: 954260 - RNA, 12 nt, Mycobacterium avium subsp. paratuberculosis
ccggcagcaccg

SEQ ID NO: 954261 - RNA, 15 nt, Mycobacterium avium subsp. paratuberculosis
ccggcagcaccgccg

SEQ ID NO: 954262 - RNA, 13 nt, Mycobacterium avium subsp. paratuberculosis
ccggcagcaccgg

SEQ ID NO: 954263 - RNA, 15 nt, Mycobacterium avium subsp. paratuberculosis
ccggcagcaccggcc

SEQ ID NO: 954264 - RNA, 19 nt, Mycobacterium avium subsp. paratuberculosis
ccggcagcaccggccggau

SEQ ID NO: 954265 - RNA, 13 nt, Mycobacterium avium subsp. paratuberculosis
ccggcagcaaccg

SEQ ID NO: 954266 - RNA, 19 nt, Mycobacterium avium subsp. paratuberculosis
ccggcagcaaccggcggcu

SEQ ID NO: 954267 - RNA, 23 nt, Mycobacterium avium subsp. paratuberculosis
ccggcagcagcgagucgaagccg

SEQ ID NO: 954268 - RNA, 13 nt, Mycobacterium avium subsp. paratuberculosis
ccggcaacgaggc

SEQ ID NO: 954269 - RNA, 15 nt, Mycobacterium avium subsp. paratuberculosis
ccggcaacgaggcca

SEQ ID NO: 954270 - RNA, 15 nt, Mycobacterium avium subsp. paratuberculosis
ccggcaaccgccacg

SEQ ID NO: 954271 - RNA, 17 nt, Mycobacterium avium subsp. paratuberculosis
ccggcaaccgccacgac

SEQ ID NO: 954272 - RNA, 20 nt, Mycobacterium avium subsp. paratuberculosis
ccggcaaccgccacgacgcg

SEQ ID NO: 954273 - RNA, 17 nt, Mycobacterium avium subsp. paratuberculosis
ccggcaaccgcugcggu

SEQ ID NO: 954274 - RNA, 17 nt, Mycobacterium avium subsp. paratuberculosis
ccggcaacaacgccagc

SEQ ID NO: 954275 - RNA, 14 nt, Mycobacterium avium subsp. paratuberculosis
ccggcaacacagcc

SEQ ID NO: 954276 - RNA, 16 nt, Mycobacterium avium subsp. paratuberculosis
ccggcaacaccggcgg

SEQ ID NO: 954277 - RNA, 17 nt, Mycobacterium avium subsp. paratuberculosis
ccggcaacaccggcggc

SEQ ID NO: 954278 - RNA, 19 nt, Mycobacterium avium subsp. paratuberculosis
ccggcaacaccggcggcga

SEQ ID NO: 954279 - RNA, 21 nt, Mycobacterium avium subsp. paratuberculosis
ccggcaacacguagucgccga

SEQ ID NO: 954280 - RNA, 23 nt, Mycobacterium avium subsp. paratuberculosis
ccggcaacacguagucgccgaug

SEQ ID NO: 954281 - RNA, 20 nt, Mycobacterium avium subsp. paratuberculosis
ccggcaaggugccguccggg

SEQ ID NO: 954282 - RNA, 13 nt, Mycobacterium avium subsp. paratuberculosis
ccggcaaucggga

SEQ ID NO: 954283 - RNA, 16 nt, Mycobacterium avium subsp. paratuberculosis
ccggcaaucgggacgc

SEQ ID NO: 954284 - RNA, 18 nt, Mycobacterium avium subsp. paratuberculosis
ccggcaaucgggacgcca

SEQ ID NO: 954285 - RNA, 12 nt, Mycobacterium avium subsp. paratuberculosis
ccggcaccacca

SEQ ID NO: 954286 - RNA, 14 nt, Mycobacterium avium subsp. paratuberculosis
ccggcaccaccacc

SEQ ID NO: 954287 - RNA, 16 nt, Mycobacterium avium subsp. paratuberculosis
ccggcaccacgaucac

SEQ ID NO: 954288 - RNA, 17 nt, Mycobacterium avium subsp. paratuberculosis
ccggcaccacgaucacc

SEQ ID NO: 954289 - RNA, 14 nt, Mycobacterium avium subsp. paratuberculosis
ccggaugucgggcg

SEQ ID NO: 954290 - RNA, 14 nt, Mycobacterium avium subsp. paratuberculosis
ccggauggccgggc

SEQ ID NO: 954291 - RNA, 18 nt, Mycobacterium avium subsp. paratuberculosis
ccggauggcgcccggcag

SEQ ID NO: 954292 - RNA, 15 nt, Mycobacterium avium subsp. paratuberculosis
ccggauggcggucgc

SEQ ID NO: 954293 - RNA, 18 nt, Mycobacterium avium subsp. paratuberculosis
ccggauggcggucgcgcc

SEQ ID NO: 954294 - RNA, 18 nt, Mycobacterium avium subsp. paratuberculosis
ccggauuacucgccggcg

SEQ ID NO: 954295 - RNA, 19 nt, Mycobacterium avium subsp. paratuberculosis
ccggauuacucgccggcgg

SEQ ID NO: 954296 - RNA, 21 nt, Mycobacterium avium subsp. paratuberculosis
ccggauucgcggcggcgccgc

SEQ ID NO: 954297 - RNA, 17 nt, Mycobacterium avium subsp. paratuberculosis
ccggauucucgcccggc

SEQ ID NO: 954298 - RNA, 19 nt, Mycobacterium avium subsp. paratuberculosis
ccggauucucgcccggcuc

SEQ ID NO: 954299 - RNA, 20 nt, Mycobacterium avium subsp. paratuberculosis
ccggauucucgcccggcucc

SEQ ID NO: 954300 - RNA, 16 nt, Mycobacterium avium subsp. paratuberculosis
ccggauugccgggcag

SEQ ID NO: 954301 - RNA, 23 nt, Mycobacterium avium subsp. paratuberculosis
ccggauuucgucccaguccagcc

SEQ ID NO: 954302 - RNA, 24 nt, Mycobacterium avium subsp. paratuberculosis
ccggauuucgucccaguccagccg

SEQ ID NO: 954303 - RNA, 17 nt, Mycobacterium avium subsp. paratuberculosis
ccggaugaccagggugg

SEQ ID NO: 954304 - RNA, 19 nt, Mycobacterium avium subsp. paratuberculosis
ccggaucuugccgucggcc

SEQ ID NO: 954305 - RNA, 20 nt, Mycobacterium avium subsp. paratuberculosis
ccggaucuugccgucggccg

SEQ ID NO: 954306 - RNA, 14 nt, Mycobacterium avium subsp. paratuberculosis
ccggaugcacgugc

SEQ ID NO: 954307 - RNA, 19 nt, Mycobacterium avium subsp. paratuberculosis
ccggaugcacgugcaccgc

SEQ ID NO: 954308 - RNA, 22 nt, Mycobacterium avium subsp. paratuberculosis
ccggaugcacgugcaccgcggc

SEQ ID NO: 954309 - RNA, 23 nt, Mycobacterium avium subsp. paratuberculosis
ccggaugcacgugcaccgcggcc

SEQ ID NO: 954310 - RNA, 14 nt, Mycobacterium avium subsp. paratuberculosis
ccggaugcaccggc

SEQ ID NO: 954311 - RNA, 16 nt, Mycobacterium avium subsp. paratuberculosis
ccggaugcaccggcag

SEQ ID NO: 954312 - RNA, 19 nt, Mycobacterium avium subsp. paratuberculosis
ccggaugcaccggcagcca

SEQ ID NO: 954313 - RNA, 17 nt, Mycobacterium avium subsp. paratuberculosis
ccggaucgugucccggc

SEQ ID NO: 954314 - RNA, 21 nt, Mycobacterium avium subsp. paratuberculosis
ccggaucgugucccggcgccc

SEQ ID NO: 954315 - RNA, 21 nt, Mycobacterium avium subsp. paratuberculosis
ccggaucucgucgggcaccgc

SEQ ID NO: 954316 - RNA, 15 nt, Mycobacterium avium subsp. paratuberculosis
ccggaucuggcccug

SEQ ID NO: 954317 - RNA, 21 nt, Mycobacterium avium subsp. paratuberculosis
ccggaucggcugcgggccagc

SEQ ID NO: 954318 - RNA, 14 nt, Mycobacterium avium subsp. paratuberculosis
ccggaucgggcggu

SEQ ID NO: 954319 - RNA, 17 nt, Mycobacterium avium subsp. paratuberculosis
ccggaucgggcggucca

SEQ ID NO: 954320 - RNA, 14 nt, Mycobacterium avium subsp. paratuberculosis
ccggaucggggugg

SEQ ID NO: 954321 - RNA, 22 nt, Mycobacterium avium subsp. paratuberculosis
ccggaucgggguggacgcgacc

SEQ ID NO: 954322 - RNA, 13 nt, Mycobacterium avium subsp. paratuberculosis
ccggaugccagca

SEQ ID NO: 954323 - RNA, 18 nt, Mycobacterium avium subsp. paratuberculosis
ccggaugccagcaggucc

SEQ ID NO: 954324 - RNA, 16 nt, Mycobacterium avium subsp. paratuberculosis
ccggaugccgcgcggc

SEQ ID NO: 954325 - RNA, 20 nt, Mycobacterium avium subsp. paratuberculosis
ccggaugccgcgcggcgcca

SEQ ID NO: 954326 - RNA, 22 nt, Mycobacterium avium subsp. paratuberculosis
ccggaugccgcgcggcgccagc

SEQ ID NO: 954327 - RNA, 12 nt, Mycobacterium avium subsp. paratuberculosis
ccggaugccggc

SEQ ID NO: 954328 - RNA, 13 nt, Mycobacterium avium subsp. paratuberculosis
ccggaugccggcg

SEQ ID NO: 954329 - RNA, 19 nt, Mycobacterium avium subsp. paratuberculosis
ccggaugccggcgcccagc

SEQ ID NO: 954330 - RNA, 22 nt, Mycobacterium avium subsp. paratuberculosis
ccggaugccggcgcccagcggc

SEQ ID NO: 954331 - RNA, 16 nt, Mycobacterium avium subsp. paratuberculosis
ccggaugcggcgccca

SEQ ID NO: 954332 - RNA, 22 nt, Mycobacterium avium subsp. paratuberculosis
ccggaugcggcgcccacagcag

SEQ ID NO: 954333 - RNA, 19 nt, Mycobacterium avium subsp. paratuberculosis
ccggaugcugcgcaacacc

SEQ ID NO: 954334 - RNA, 20 nt, Mycobacterium avium subsp. paratuberculosis
ccggauggagcgcgacgggc

SEQ ID NO: 954335 - RNA, 23 nt, Mycobacterium avium subsp. paratuberculosis
ccggauggagcgcgacgggcugc

SEQ ID NO: 954336 - RNA, 13 nt, Mycobacterium avium subsp. paratuberculosis
ccggauggccagc

SEQ ID NO: 954337 - RNA, 14 nt, Mycobacterium avium subsp. paratuberculosis
ccggauggccagca

SEQ ID NO: 954338 - RNA, 15 nt, Mycobacterium avium subsp. paratuberculosis
ccggauggccagcag

SEQ ID NO: 954339 - RNA, 22 nt, Mycobacterium avium subsp. paratuberculosis
cgauguggguggucagcgcggu

SEQ ID NO: 954340 - RNA, 16 nt, Mycobacterium avium subsp. paratuberculosis
cgaugugcgcgcuggc

SEQ ID NO: 954341 - RNA, 20 nt, Mycobacterium avium subsp. paratuberculosis
cgaugugcgcgcuggccgcg

SEQ ID NO: 954342 - RNA, 21 nt, Mycobacterium avium subsp. paratuberculosis
cgaugugcgcgcuggccgcgu

SEQ ID NO: 954343 - RNA, 15 nt, Mycobacterium avium subsp. paratuberculosis
cgauguggacgaugc

SEQ ID NO: 954344 - RNA, 13 nt, Mycobacterium avium subsp. paratuberculosis
cgauguggccggc

SEQ ID NO: 954345 - RNA, 14 nt, Mycobacterium avium subsp. paratuberculosis
cgauguggccggcg

SEQ ID NO: 954346 - RNA, 21 nt, Mycobacterium avium subsp. paratuberculosis
cgauguggccggcgauggcgc

SEQ ID NO: 954347 - RNA, 15 nt, Mycobacterium avium subsp. paratuberculosis
cgauguugaucgcca

SEQ ID NO: 954348 - RNA, 21 nt, Mycobacterium avium subsp. paratuberculosis
cgauguugaucgccaugcugg

SEQ ID NO: 954349 - RNA, 19 nt, Mycobacterium avium subsp. paratuberculosis
cgauguugaugucgcgcgg

SEQ ID NO: 954350 - RNA, 16 nt, Mycobacterium avium subsp. paratuberculosis
cgaugugaucggcggc

SEQ ID NO: 954351 - RNA, 20 nt, Mycobacterium avium subsp. paratuberculosis
cgaugugaucggcggccacc

SEQ ID NO: 954352 - RNA, 13 nt, Mycobacterium avium subsp. paratuberculosis
cgaugucgucgaa

SEQ ID NO: 954353 - RNA, 17 nt, Mycobacterium avium subsp. paratuberculosis
cgaugucgucgaacgcg

SEQ ID NO: 954354 - RNA, 21 nt, Mycobacterium avium subsp. paratuberculosis
cgaugucgucgaacgcggcga

SEQ ID NO: 954355 - RNA, 15 nt, Mycobacterium avium subsp. paratuberculosis
cgaugucgguggcgc

SEQ ID NO: 954356 - RNA, 17 nt, Mycobacterium avium subsp. paratuberculosis
cgaugucgguggcgcgc

SEQ ID NO: 954357 - RNA, 19 nt, Mycobacterium avium subsp. paratuberculosis
cgaugucggugggccgcac

SEQ ID NO: 954358 - RNA, 13 nt, Mycobacterium avium subsp. paratuberculosis
cgaugucgucgau

SEQ ID NO: 954359 - RNA, 14 nt, Mycobacterium avium subsp. paratuberculosis
cgaugucgucgaug

SEQ ID NO: 954360 - RNA, 15 nt, Mycobacterium avium subsp. paratuberculosis
cgaugucgucgccgg

SEQ ID NO: 954361 - RNA, 17 nt, Mycobacterium avium subsp. paratuberculosis
cgaugucgucgccggug

SEQ ID NO: 954362 - RNA, 15 nt, Mycobacterium avium subsp. paratuberculosis
cgaugucgucgucga

SEQ ID NO: 954363 - RNA, 16 nt, Mycobacterium avium subsp. paratuberculosis
cgaugucgucgucgac

SEQ ID NO: 954364 - RNA, 18 nt, Mycobacterium avium subsp. paratuberculosis
cgaugucgucgucgacgc

SEQ ID NO: 954365 - RNA, 21 nt, Mycobacterium avium subsp. paratuberculosis
cgaugucgucgucgacgcuga

SEQ ID NO: 954366 - RNA, 17 nt, Mycobacterium avium subsp. paratuberculosis
cgaugucggcggcccgg

SEQ ID NO: 954367 - RNA, 14 nt, Mycobacterium avium subsp. paratuberculosis
cgaugucggcuucg

SEQ ID NO: 954368 - RNA, 21 nt, Mycobacterium avium subsp. paratuberculosis
cgaugucggcuucguacggcc

SEQ ID NO: 954369 - RNA, 13 nt, Mycobacterium avium subsp. paratuberculosis
cgaugucggccag

SEQ ID NO: 954370 - RNA, 16 nt, Mycobacterium avium subsp. paratuberculosis
cgaugucggccagcgc

SEQ ID NO: 954371 - RNA, 20 nt, Mycobacterium avium subsp. paratuberculosis
cgaugucggccgguccgugc

SEQ ID NO: 954372 - RNA, 15 nt, Mycobacterium avium subsp. paratuberculosis
cgaugucgccggcga

SEQ ID NO: 954373 - RNA, 17 nt, Mycobacterium avium subsp. paratuberculosis
cgaugucgccggcgacc

SEQ ID NO: 954374 - RNA, 16 nt, Mycobacterium avium subsp. paratuberculosis
cgaugucgcccggcgc

SEQ ID NO: 954375 - RNA, 17 nt, Mycobacterium avium subsp. paratuberculosis
cgaugucgcccggcgcg

SEQ ID NO: 954376 - RNA, 22 nt, Mycobacterium avium subsp. paratuberculosis
cgaugucgcccggcgcggcauc

SEQ ID NO: 954377 - RNA, 20 nt, Mycobacterium avium subsp. paratuberculosis
cgaugucgacccgcggcgcc

SEQ ID NO: 954378 - RNA, 21 nt, Mycobacterium avium subsp. paratuberculosis
cgaugucgacccgcggcgccg

SEQ ID NO: 954379 - RNA, 18 nt, Mycobacterium avium subsp. paratuberculosis
cgaugucgaugacggcgg

SEQ ID NO: 954380 - RNA, 19 nt, Mycobacterium avium subsp. paratuberculosis
cgaugucgaugacggcggc

SEQ ID NO: 954381 - RNA, 21 nt, Mycobacterium avium subsp. paratuberculosis
cgaugucgaugacggcggcgc

SEQ ID NO: 954382 - RNA, 13 nt, Mycobacterium avium subsp. paratuberculosis
cgaugucgacgcc

SEQ ID NO: 954383 - RNA, 15 nt, Mycobacterium avium subsp. paratuberculosis
cgaugucgacgccgu

SEQ ID NO: 954384 - RNA, 17 nt, Mycobacterium avium subsp. paratuberculosis
cgaugucgacgccgugc

SEQ ID NO: 954385 - RNA, 20 nt, Mycobacterium avium subsp. paratuberculosis
cgaugucgacgccgugcugc

SEQ ID NO: 954386 - RNA, 12 nt, Mycobacterium avium subsp. paratuberculosis
cgaugucgacgg

SEQ ID NO: 954387 - RNA, 13 nt, Mycobacterium avium subsp. paratuberculosis
cgaugucgacgga

SEQ ID NO: 954388 - RNA, 23 nt, Mycobacterium avium subsp. paratuberculosis
cgauguccccgcgggugacgcug

SEQ ID NO: 954389 - RNA, 14 nt, Mycobacterium avium subsp. paratuberculosis
cgauguccgacagc

SEQ ID NO: 954390 - RNA, 15 nt, Mycobacterium avium subsp. paratuberculosis
cgauguccgccggcc

SEQ ID NO: 954391 - RNA, 16 nt, Mycobacterium avium subsp. paratuberculosis
cgauguccgccggccg

SEQ ID NO: 954392 - RNA, 17 nt, Mycobacterium avium subsp. paratuberculosis
cgauguccgccggccgg

SEQ ID NO: 954393 - RNA, 20 nt, Mycobacterium avium subsp. paratuberculosis
cgauguccgccggccggucc

SEQ ID NO: 954394 - RNA, 21 nt, Mycobacterium avium subsp. paratuberculosis
cgaugggaaccgcucggcucg

SEQ ID NO: 954395 - RNA, 18 nt, Mycobacterium avium subsp. paratuberculosis
cgauggggacgucgacgu

SEQ ID NO: 954396 - RNA, 22 nt, Mycobacterium avium subsp. paratuberculosis
cgauggggacgucgacgugggc

SEQ ID NO: 954397 - RNA, 21 nt, Mycobacterium avium subsp. paratuberculosis
cgauggggauggugcgccggg

SEQ ID NO: 954398 - RNA, 19 nt, Mycobacterium avium subsp. paratuberculosis
cgaugggcaauaccggcag

SEQ ID NO: 954399 - RNA, 20 nt, Mycobacterium avium subsp. paratuberculosis
cgaugggcaauaccggcagc

SEQ ID NO: 954400 - RNA, 15 nt, Mycobacterium avium subsp. paratuberculosis
cgaugggccgcccgc

SEQ ID NO: 954401 - RNA, 23 nt, Mycobacterium avium subsp. paratuberculosis
cgaugggcgcgaucaggcugccg

SEQ ID NO: 954402 - RNA, 13 nt, Mycobacterium avium subsp. paratuberculosis
cgaugggcucgag

SEQ ID NO: 954403 - RNA, 14 nt, Mycobacterium avium subsp. paratuberculosis
cgaugguacgcgag

SEQ ID NO: 954404 - RNA, 20 nt, Mycobacterium avium subsp. paratuberculosis
cgauggguguggcgucgaug

SEQ ID NO: 954405 - RNA, 18 nt, Mycobacterium avium subsp. paratuberculosis
cgauggguuggccgucgc

SEQ ID NO: 954406 - RNA, 18 nt, Mycobacterium avium subsp. paratuberculosis
cgauggucagcugccgca

SEQ ID NO: 954407 - RNA, 20 nt, Mycobacterium avium subsp. paratuberculosis
cgauggucagcugccgcacc

SEQ ID NO: 954408 - RNA, 22 nt, Mycobacterium avium subsp. paratuberculosis
cgauggucagcugccgcaccgc

SEQ ID NO: 954409 - RNA, 17 nt, Mycobacterium avium subsp. paratuberculosis
cgauggucugcccgccg

SEQ ID NO: 954410 - RNA, 17 nt, Mycobacterium avium subsp. paratuberculosis
cgauguacugggccguc

SEQ ID NO: 954411 - RNA, 18 nt, Mycobacterium avium subsp. paratuberculosis
cgauguacugggccgucg

SEQ ID NO: 954412 - RNA, 14 nt, Mycobacterium avium subsp. paratuberculosis
cgauguagagcggg

SEQ ID NO: 954413 - RNA, 19 nt, Mycobacterium avium subsp. paratuberculosis
cgauguagcggacgggccg

SEQ ID NO: 954414 - RNA, 16 nt, Mycobacterium avium subsp. paratuberculosis
cgauguaggacgccgc

SEQ ID NO: 954415 - RNA, 16 nt, Mycobacterium avium subsp. paratuberculosis
cgauguaggugcgcga

SEQ ID NO: 954416 - RNA, 20 nt, Mycobacterium avium subsp. paratuberculosis
cgauggugacggugccgccg

SEQ ID NO: 954417 - RNA, 22 nt, Mycobacterium avium subsp. paratuberculosis
cgauggugacggugccgccgug

SEQ ID NO: 954418 - RNA, 18 nt, Mycobacterium avium subsp. paratuberculosis
cgauggugaccucggucg

SEQ ID NO: 954419 - RNA, 17 nt, Mycobacterium avium subsp. paratuberculosis
cgauggugccgccggug

SEQ ID NO: 954420 - RNA, 20 nt, Mycobacterium avium subsp. paratuberculosis
cgauggugggcagccggcaa

SEQ ID NO: 954421 - RNA, 15 nt, Mycobacterium avium subsp. paratuberculosis
cgaugguggucgccg

SEQ ID NO: 954422 - RNA, 19 nt, Mycobacterium avium subsp. paratuberculosis
cgaugguggucgccgucgu

SEQ ID NO: 954423 - RNA, 23 nt, Mycobacterium avium subsp. paratuberculosis
cgaugguguaguccugcuucagc

SEQ ID NO: 954424 - RNA, 20 nt, Mycobacterium avium subsp. paratuberculosis
cgauggugcugcccggcgcg

SEQ ID NO: 954425 - RNA, 17 nt, Mycobacterium avium subsp. paratuberculosis
cgaugguggcgcugccg

SEQ ID NO: 954426 - RNA, 14 nt, Mycobacterium avium subsp. paratuberculosis
cgauucaucgccga

SEQ ID NO: 954427 - RNA, 15 nt, Mycobacterium avium subsp. paratuberculosis
cgauucaucgccgaa

SEQ ID NO: 954428 - RNA, 19 nt, Mycobacterium avium subsp. paratuberculosis
cgauucagccggcgggcgc

SEQ ID NO: 954429 - RNA, 16 nt, Mycobacterium avium subsp. paratuberculosis
cgauucaaccccgcgc

SEQ ID NO: 954430 - RNA, 18 nt, Mycobacterium avium subsp. paratuberculosis
cgauucaaccccgcgcgc

SEQ ID NO: 954431 - RNA, 15 nt, Mycobacterium avium subsp. paratuberculosis
cgauguuggcgacga

SEQ ID NO: 954432 - RNA, 12 nt, Mycobacterium avium subsp. paratuberculosis
cgauucgucguc

SEQ ID NO: 954433 - RNA, 18 nt, Mycobacterium avium subsp. paratuberculosis
cgauucggcgccgcgacc

SEQ ID NO: 954434 - RNA, 18 nt, Mycobacterium avium subsp. paratuberculosis
cgauucucgcugcggcgc

SEQ ID NO: 954435 - RNA, 19 nt, Mycobacterium avium subsp. paratuberculosis
cgauucgguaccagggcag

SEQ ID NO: 954436 - RNA, 16 nt, Mycobacterium avium subsp. paratuberculosis
cgauuccggccggccg

SEQ ID NO: 954437 - RNA, 20 nt, Mycobacterium avium subsp. paratuberculosis
cgauuccggccggccgccgg

SEQ ID NO: 954438 - RNA, 13 nt, Mycobacterium avium subsp. paratuberculosis
cgauucccgccgg

SEQ ID NO: 954439 - RNA, 20 nt, Mycobacterium avium subsp. paratuberculosis
cgcaaagacauucggggcca

SEQ ID NO: 954440 - RNA, 19 nt, Mycobacterium avium subsp. paratuberculosis
cgcaaacgaaucgagccgc

SEQ ID NO: 954441 - RNA, 19 nt, Mycobacterium avium subsp. paratuberculosis
cgcaacagggccaccgcgu

SEQ ID NO: 954442 - RNA, 15 nt, Mycobacterium avium subsp. paratuberculosis
cgcaaccaacucgcg

SEQ ID NO: 954443 - RNA, 18 nt, Mycobacterium avium subsp. paratuberculosis
cgcaaccacugauccguc

SEQ ID NO: 954444 - RNA, 18 nt, Mycobacterium avium subsp. paratuberculosis
cgcaaccacuuucgcgag

SEQ ID NO: 954445 - RNA, 19 nt, Mycobacterium avium subsp. paratuberculosis
cgauucuugaccaccuugg

SEQ ID NO: 954446 - RNA, 15 nt, Mycobacterium avium subsp. paratuberculosis
cgauugccgcggccg

SEQ ID NO: 954447 - RNA, 16 nt, Mycobacterium avium subsp. paratuberculosis
cgauugccgcggccgc

SEQ ID NO: 954448 - RNA, 17 nt, Mycobacterium avium subsp. paratuberculosis
cgauugccggacgagga

SEQ ID NO: 954449 - RNA, 13 nt, Mycobacterium avium subsp. paratuberculosis
cgauugcggccgc

SEQ ID NO: 954450 - RNA, 18 nt, Mycobacterium avium subsp. paratuberculosis
cgauugcggccgccggcc

SEQ ID NO: 954451 - RNA, 14 nt, Mycobacterium avium subsp. paratuberculosis
cgauugcguugauc

SEQ ID NO: 954452 - RNA, 19 nt, Mycobacterium avium subsp. paratuberculosis
cgauugguggcccggucgu

SEQ ID NO: 954453 - RNA, 21 nt, Mycobacterium avium subsp. paratuberculosis
cgauugucgcugcgaggcggg

SEQ ID NO: 954454 - RNA, 18 nt, Mycobacterium avium subsp. paratuberculosis
cgcaaaacggugcggccu

SEQ ID NO: 954455 - RNA, 16 nt, Mycobacterium avium subsp. paratuberculosis
cgaucuggcgcagcgu

SEQ ID NO: 954456 - RNA, 17 nt, Mycobacterium avium subsp. paratuberculosis
cgaucuggcgcagcguc

SEQ ID NO: 954457 - RNA, 18 nt, Mycobacterium avium subsp. paratuberculosis
cgaucugguucaccgcca

SEQ ID NO: 954458 - RNA, 21 nt, Mycobacterium avium subsp. paratuberculosis
cgaucugguucaccgccacca

SEQ ID NO: 954459 - RNA, 13 nt, Mycobacterium avium subsp. paratuberculosis
cgaucugucgcgc

SEQ ID NO: 954460 - RNA, 20 nt, Mycobacterium avium subsp. paratuberculosis
cgaucuggcggauggcgccc

SEQ ID NO: 954461 - RNA, 15 nt, Mycobacterium avium subsp. paratuberculosis
cgaucuggcgggcgg

SEQ ID NO: 954462 - RNA, 17 nt, Mycobacterium avium subsp. paratuberculosis
cgaucugcucggugucg

SEQ ID NO: 954463 - RNA, 22 nt, Mycobacterium avium subsp. paratuberculosis
cgaucugcucggugucgaucga

SEQ ID NO: 954464 - RNA, 20 nt, Mycobacterium avium subsp. paratuberculosis
cgaucaacaccaacgacagc

SEQ ID NO: 954465 - RNA, 21 nt, Mycobacterium avium subsp. paratuberculosis
cgaucaacaccaacgacagcg

SEQ ID NO: 954466 - RNA, 14 nt, Mycobacterium avium subsp. paratuberculosis
cgaucaacaccgcc

SEQ ID NO: 954467 - RNA, 15 nt, Mycobacterium avium subsp. paratuberculosis
cgaucaacaccgcca

SEQ ID NO: 954468 - RNA, 23 nt, Mycobacterium avium subsp. paratuberculosis
cgaucuugagccggaugcggccg

SEQ ID NO: 954469 - RNA, 21 nt, Mycobacterium avium subsp. paratuberculosis
cgaucuuugcggccguggcga

SEQ ID NO: 954470 - RNA, 19 nt, Mycobacterium avium subsp. paratuberculosis
cgaugaaaccccagccggc

SEQ ID NO: 954471 - RNA, 20 nt, Mycobacterium avium subsp. paratuberculosis
cgaucuugcguuccucgacg

SEQ ID NO: 954472 - RNA, 15 nt, Mycobacterium avium subsp. paratuberculosis
cgaucuugucgaccu

SEQ ID NO: 954473 - RNA, 14 nt, Mycobacterium avium subsp. paratuberculosis
cgaucuugucgucc

SEQ ID NO: 954474 - RNA, 16 nt, Mycobacterium avium subsp. paratuberculosis
cgaugaacagucggcc

SEQ ID NO: 954475 - RNA, 17 nt, Mycobacterium avium subsp. paratuberculosis
cgaugaacagucggccg

SEQ ID NO: 954476 - RNA, 20 nt, Mycobacterium avium subsp. paratuberculosis
cgaugaacagucggccggcg

SEQ ID NO: 954477 - RNA, 15 nt, Mycobacterium avium subsp. paratuberculosis
cgaugaacaucgccg

SEQ ID NO: 954478 - RNA, 17 nt, Mycobacterium avium subsp. paratuberculosis
cgaugaacaucgccggu

SEQ ID NO: 954479 - RNA, 23 nt, Mycobacterium avium subsp. paratuberculosis
cgaugaaccgcugcugcucggcc

SEQ ID NO: 954480 - RNA, 23 nt, Mycobacterium avium subsp. paratuberculosis
cgaugaacgcacucgguguggcc

SEQ ID NO: 954481 - RNA, 15 nt, Mycobacterium avium subsp. paratuberculosis
cgaugaacuccucga

SEQ ID NO: 954482 - RNA, 16 nt, Mycobacterium avium subsp. paratuberculosis
cgaugaacucgcgggc

SEQ ID NO: 954483 - RNA, 19 nt, Mycobacterium avium subsp. paratuberculosis
cgaugaacuugccgaucac

SEQ ID NO: 954484 - RNA, 20 nt, Mycobacterium avium subsp. paratuberculosis
cgaugaagaacaccccgacc

SEQ ID NO: 954485 - RNA, 21 nt, Mycobacterium avium subsp. paratuberculosis
cgaugaccgccugcggcaggu

SEQ ID NO: 954486 - RNA, 18 nt, Mycobacterium avium subsp. paratuberculosis
cgaugaccgcggcgggca

SEQ ID NO: 954487 - RNA, 20 nt, Mycobacterium avium subsp. paratuberculosis
cgaugcacaaccgcugcugc

SEQ ID NO: 954488 - RNA, 15 nt, Mycobacterium avium subsp. paratuberculosis
cgaugcacggucggc

SEQ ID NO: 954489 - RNA, 16 nt, Mycobacterium avium subsp. paratuberculosis
cgaugcacggucggcc

SEQ ID NO: 954490 - RNA, 19 nt, Mycobacterium avium subsp. paratuberculosis
cgaugcacggucggccccg

SEQ ID NO: 954491 - RNA, 22 nt, Mycobacterium avium subsp. paratuberculosis
cgaugcacggucggccccgcgc

SEQ ID NO: 954492 - RNA, 18 nt, Mycobacterium avium subsp. paratuberculosis
cgaugcagaacagccggu

SEQ ID NO: 954493 - RNA, 18 nt, Mycobacterium avium subsp. paratuberculosis
cgaugcagaucaccacgg

SEQ ID NO: 954494 - RNA, 21 nt, Mycobacterium avium subsp. paratuberculosis
cgaugcagaucaccacggugg

SEQ ID NO: 954495 - RNA, 20 nt, Mycobacterium avium subsp. paratuberculosis
cgaugcagcacauccagccc

SEQ ID NO: 954496 - RNA, 15 nt, Mycobacterium avium subsp. paratuberculosis
cgaugcauucgucca

SEQ ID NO: 954497 - RNA, 20 nt, Mycobacterium avium subsp. paratuberculosis
cgaugcauuggugcacgccg

SEQ ID NO: 954498 - RNA, 12 nt, Mycobacterium avium subsp. paratuberculosis
cgaugcagggcc

SEQ ID NO: 954499 - RNA, 20 nt, Mycobacterium avium subsp. paratuberculosis
cgaugaugucggccggcagu

SEQ ID NO: 954500 - RNA, 18 nt, Mycobacterium avium subsp. paratuberculosis
cgaugaugguggcggcca

SEQ ID NO: 954501 - RNA, 21 nt, Mycobacterium avium subsp. paratuberculosis
cgaugaucccgaggaugccgc

SEQ ID NO: 954502 - RNA, 23 nt, Mycobacterium avium subsp. paratuberculosis
cgaugauccuggccuggucggcc

SEQ ID NO: 954503 - RNA, 14 nt, Mycobacterium avium subsp. paratuberculosis
cgaugaucgccggc

SEQ ID NO: 954504 - RNA, 15 nt, Mycobacterium avium subsp. paratuberculosis
cgaugaucgccggcg

SEQ ID NO: 954505 - RNA, 16 nt, Mycobacterium avium subsp. paratuberculosis
cgaugaucgccggcgc

SEQ ID NO: 954506 - RNA, 18 nt, Mycobacterium avium subsp. paratuberculosis
cgaugaucgccggcgccg

SEQ ID NO: 954507 - RNA, 14 nt, Mycobacterium avium subsp. paratuberculosis
cgaugacgaugccc

SEQ ID NO: 954508 - RNA, 17 nt, Mycobacterium avium subsp. paratuberculosis
cgaugacgaccgggucc

SEQ ID NO: 954509 - RNA, 14 nt, Mycobacterium avium subsp. paratuberculosis
cgaugacgagcagc

SEQ ID NO: 954510 - RNA, 17 nt, Mycobacterium avium subsp. paratuberculosis
cgaugaccucgcgcccg

SEQ ID NO: 954511 - RNA, 21 nt, Mycobacterium avium subsp. paratuberculosis
cgaugaccucgcgcccggcgc

SEQ ID NO: 954512 - RNA, 24 nt, Mycobacterium avium subsp. paratuberculosis
cgaugaccucgcgcccggcgccgg

SEQ ID NO: 954513 - RNA, 15 nt, Mycobacterium avium subsp. paratuberculosis
cgaugaccggcccgg

SEQ ID NO: 954514 - RNA, 18 nt, Mycobacterium avium subsp. paratuberculosis
cgaugaccggcccggcgg

SEQ ID NO: 954515 - RNA, 20 nt, Mycobacterium avium subsp. paratuberculosis
cgaugaccggcccggcggcc

SEQ ID NO: 954516 - RNA, 21 nt, Mycobacterium avium subsp. paratuberculosis
cgaugaccggcccggcggccg

SEQ ID NO: 954517 - RNA, 21 nt, Mycobacterium avium subsp. paratuberculosis
cgaugagcuggugcagcgacu

SEQ ID NO: 954518 - RNA, 18 nt, Mycobacterium avium subsp. paratuberculosis
cgaugacgccgcgccgcc

SEQ ID NO: 954519 - RNA, 16 nt, Mycobacterium avium subsp. paratuberculosis
cgaugacgccggacag

SEQ ID NO: 954520 - RNA, 17 nt, Mycobacterium avium subsp. paratuberculosis
cgaugacgccggacagc

SEQ ID NO: 954521 - RNA, 21 nt, Mycobacterium avium subsp. paratuberculosis
cgaugacgccggacagcuggc

SEQ ID NO: 954522 - RNA, 20 nt, Mycobacterium avium subsp. paratuberculosis
cgaugagcgagaugaucagc

SEQ ID NO: 954523 - RNA, 22 nt, Mycobacterium avium subsp. paratuberculosis
cgaugagcgagaugaucagccg

SEQ ID NO: 954524 - RNA, 20 nt, Mycobacterium avium subsp. paratuberculosis
cgaugaucagcucgcgcauc

SEQ ID NO: 954525 - RNA, 17 nt, Mycobacterium avium subsp. paratuberculosis
cgaugcuggccaucgcc

SEQ ID NO: 954526 - RNA, 17 nt, Mycobacterium avium subsp. paratuberculosis
cgauggaauucgucggc

SEQ ID NO: 954527 - RNA, 18 nt, Mycobacterium avium subsp. paratuberculosis
cgauggaauucgucggcg

SEQ ID NO: 954528 - RNA, 22 nt, Mycobacterium avium subsp. paratuberculosis
cgauggaauucgucggcggugu

SEQ ID NO: 954529 - RNA, 15 nt, Mycobacterium avium subsp. paratuberculosis
cgauggacacgcugc

SEQ ID NO: 954530 - RNA, 19 nt, Mycobacterium avium subsp. paratuberculosis
cgauggacaggcacucgcc

SEQ ID NO: 954531 - RNA, 14 nt, Mycobacterium avium subsp. paratuberculosis
cgauggacagggcg

SEQ ID NO: 954532 - RNA, 15 nt, Mycobacterium avium subsp. paratuberculosis
cgauggacagggcga

SEQ ID NO: 954533 - RNA, 17 nt, Mycobacterium avium subsp. paratuberculosis
cgauggacagggcgaca

SEQ ID NO: 954534 - RNA, 15 nt, Mycobacterium avium subsp. paratuberculosis
cgauggaagcgcccg

SEQ ID NO: 954535 - RNA, 20 nt, Mycobacterium avium subsp. paratuberculosis
cgauggaagcgcccgcgcgc

SEQ ID NO: 954536 - RNA, 14 nt, Mycobacterium avium subsp. paratuberculosis
cgaugcugucgcgg

SEQ ID NO: 954537 - RNA, 14 nt, Mycobacterium avium subsp. paratuberculosis
cgaugcgcggcccg

SEQ ID NO: 954538 - RNA, 16 nt, Mycobacterium avium subsp. paratuberculosis
cgaugcgcgccagcag

SEQ ID NO: 954539 - RNA, 18 nt, Mycobacterium avium subsp. paratuberculosis
cgaugcgcgccagcagcg

SEQ ID NO: 954540 - RNA, 23 nt, Mycobacterium avium subsp. paratuberculosis
cgaugcgcgccagcagcgcgccg

SEQ ID NO: 954541 - RNA, 14 nt, Mycobacterium avium subsp. paratuberculosis
cgaugcgcugcugu

SEQ ID NO: 954542 - RNA, 22 nt, Mycobacterium avium subsp. paratuberculosis
cgaugcgcugugcgggugaggc

SEQ ID NO: 954543 - RNA, 12 nt, Mycobacterium avium subsp. paratuberculosis
cgaugcgcgccu

SEQ ID NO: 954544 - RNA, 20 nt, Mycobacterium avium subsp. paratuberculosis
cgaugcgcgguaacagagcg

SEQ ID NO: 954545 - RNA, 14 nt, Mycobacterium avium subsp. paratuberculosis
cgaugcgcgugacg

SEQ ID NO: 954546 - RNA, 16 nt, Mycobacterium avium subsp. paratuberculosis
cgaugcgcgugacgcg

SEQ ID NO: 954547 - RNA, 14 nt, Mycobacterium avium subsp. paratuberculosis
cgaugcgcucggcg

SEQ ID NO: 954548 - RNA, 19 nt, Mycobacterium avium subsp. paratuberculosis
cgaugcgcucggcgaccug

SEQ ID NO: 954549 - RNA, 18 nt, Mycobacterium avium subsp. paratuberculosis
cgaugccgaucacgguga

SEQ ID NO: 954550 - RNA, 18 nt, Mycobacterium avium subsp. paratuberculosis
cgaugccgaucggggcgc

SEQ ID NO: 954551 - RNA, 15 nt, Mycobacterium avium subsp. paratuberculosis
cgaugccgagccggc

SEQ ID NO: 954552 - RNA, 17 nt, Mycobacterium avium subsp. paratuberculosis
cgaugccgagccggccg

SEQ ID NO: 954553 - RNA, 21 nt, Mycobacterium avium subsp. paratuberculosis
cgaugccgaacuccgccgaac

SEQ ID NO: 954554 - RNA, 13 nt, Mycobacterium avium subsp. paratuberculosis
cgaugccgacacc

SEQ ID NO: 954555 - RNA, 17 nt, Mycobacterium avium subsp. paratuberculosis
cgaugccgaccaacacc

SEQ ID NO: 954556 - RNA, 22 nt, Mycobacterium avium subsp. paratuberculosis
cgaugccgaccaacacccccgc

SEQ ID NO: 954557 - RNA, 17 nt, Mycobacterium avium subsp. paratuberculosis
cgaugccgaccgacagc

SEQ ID NO: 954558 - RNA, 22 nt, Mycobacterium avium subsp. paratuberculosis
cgaugccgaccgacagccgcac

SEQ ID NO: 954559 - RNA, 23 nt, Mycobacterium avium subsp. paratuberculosis
cgaugccgaccgacagccgcacc

SEQ ID NO: 954560 - RNA, 15 nt, Mycobacterium avium subsp. paratuberculosis
cgaugccagacgcuc

SEQ ID NO: 954561 - RNA, 16 nt, Mycobacterium avium subsp. paratuberculosis
cgaugccagacgcucu

SEQ ID NO: 954562 - RNA, 16 nt, Mycobacterium avium subsp. paratuberculosis
cgaugccagcgcaccg

SEQ ID NO: 954563 - RNA, 14 nt, Mycobacterium avium subsp. paratuberculosis
cgaugcgccgcacc

SEQ ID NO: 954564 - RNA, 16 nt, Mycobacterium avium subsp. paratuberculosis
cgaugcgccgcaccag

SEQ ID NO: 954565 - RNA, 14 nt, Mycobacterium avium subsp. paratuberculosis
cgaugcgcccgcgc

SEQ ID NO: 954566 - RNA, 22 nt, Mycobacterium avium subsp. paratuberculosis
cgaugcgcccgcgccaccccga

SEQ ID NO: 954567 - RNA, 13 nt, Mycobacterium avium subsp. paratuberculosis
cgaugcgcagcag

SEQ ID NO: 954568 - RNA, 17 nt, Mycobacterium avium subsp. paratuberculosis
cgaugcgcagcagcggc

SEQ ID NO: 954569 - RNA, 14 nt, Mycobacterium avium subsp. paratuberculosis
cgaugccgccgacg

SEQ ID NO: 954570 - RNA, 15 nt, Mycobacterium avium subsp. paratuberculosis
cgaugccgccgaggg

SEQ ID NO: 954571 - RNA, 20 nt, Mycobacterium avium subsp. paratuberculosis
cgaugccgaggauuucgcga

SEQ ID NO: 954572 - RNA, 22 nt, Mycobacterium avium subsp. paratuberculosis
cgaugccgaggauuucgcgauc

SEQ ID NO: 954573 - RNA, 16 nt, Mycobacterium avium subsp. paratuberculosis
cgauggcgacggggug

SEQ ID NO: 954574 - RNA, 19 nt, Mycobacterium avium subsp. paratuberculosis
cgauggcgacggucugccg

SEQ ID NO: 954575 - RNA, 13 nt, Mycobacterium avium subsp. paratuberculosis
cgauggcgaccgc

SEQ ID NO: 954576 - RNA, 17 nt, Mycobacterium avium subsp. paratuberculosis
cgauggcgaccgcgcag

SEQ ID NO: 954577 - RNA, 22 nt, Mycobacterium avium subsp. paratuberculosis
cgauggcgaccgcgcaggcggc

SEQ ID NO: 954578 - RNA, 11 nt, Mycobacterium avium subsp. paratuberculosis
cgauggcgacg

SEQ ID NO: 954579 - RNA, 18 nt, Mycobacterium avium subsp. paratuberculosis
cgauggcgacgcacgaaa

SEQ ID NO: 954580 - RNA, 14 nt, Mycobacterium avium subsp. paratuberculosis
cgauggccgggaag

SEQ ID NO: 954581 - RNA, 14 nt, Mycobacterium avium subsp. paratuberculosis
cgauggccuccgac

SEQ ID NO: 954582 - RNA, 23 nt, Mycobacterium avium subsp. paratuberculosis
cgauggccugguggcccaggcag

SEQ ID NO: 954583 - RNA, 14 nt, Mycobacterium avium subsp. paratuberculosis
cgauggcgcccagc

SEQ ID NO: 954584 - RNA, 22 nt, Mycobacterium avium subsp. paratuberculosis
cgauggcgcccagcgucucggc

SEQ ID NO: 954585 - RNA, 23 nt, Mycobacterium avium subsp. paratuberculosis
cgauggcgcccagcgucucggcg

SEQ ID NO: 954586 - RNA, 14 nt, Mycobacterium avium subsp. paratuberculosis
cgauggcgccgauc

SEQ ID NO: 954587 - RNA, 17 nt, Mycobacterium avium subsp. paratuberculosis
cgauggcgccgaucgcg

SEQ ID NO: 954588 - RNA, 21 nt, Mycobacterium avium subsp. paratuberculosis
cgauggcgccgaucgcgcgca

SEQ ID NO: 954589 - RNA, 16 nt, Mycobacterium avium subsp. paratuberculosis
cgauggccucgucgau

SEQ ID NO: 954590 - RNA, 12 nt, Mycobacterium avium subsp. paratuberculosis
cgauggccgccc

SEQ ID NO: 954591 - RNA, 14 nt, Mycobacterium avium subsp. paratuberculosis
cgauggccgcccgc

SEQ ID NO: 954592 - RNA, 20 nt, Mycobacterium avium subsp. paratuberculosis
cgauggaccggguggugggc

SEQ ID NO: 954593 - RNA, 23 nt, Mycobacterium avium subsp. paratuberculosis
cgauggaggugccgcgcagcacc

SEQ ID NO: 954594 - RNA, 19 nt, Mycobacterium avium subsp. paratuberculosis
cgauggaguagcugaccga

SEQ ID NO: 954595 - RNA, 17 nt, Mycobacterium avium subsp. paratuberculosis
cgauggcaacgccgguc

SEQ ID NO: 954596 - RNA, 18 nt, Mycobacterium avium subsp. paratuberculosis
cgauggcaacgccggucu

SEQ ID NO: 954597 - RNA, 23 nt, Mycobacterium avium subsp. paratuberculosis
cgauggcggguuggugucgaaca

SEQ ID NO: 954598 - RNA, 16 nt, Mycobacterium avium subsp. paratuberculosis
cgauggcgguccacca

SEQ ID NO: 954599 - RNA, 17 nt, Mycobacterium avium subsp. paratuberculosis
cgauggcgguccaccac

SEQ ID NO: 954600 - RNA, 21 nt, Mycobacterium avium subsp. paratuberculosis
cgauggcgguccaccaccaca

SEQ ID NO: 954601 - RNA, 12 nt, Mycobacterium avium subsp. paratuberculosis
cgauggcggcgg

SEQ ID NO: 954602 - RNA, 19 nt, Mycobacterium avium subsp. paratuberculosis
cgauggcggcggcccgccg

SEQ ID NO: 954603 - RNA, 20 nt, Mycobacterium avium subsp. paratuberculosis
cgauggcggcggcccgccgc

SEQ ID NO: 954604 - RNA, 15 nt, Mycobacterium avium subsp. paratuberculosis
cgauggcggcggcug

SEQ ID NO: 954605 - RNA, 17 nt, Mycobacterium avium subsp. paratuberculosis
cgauggcggcgucgagu

SEQ ID NO: 954606 - RNA, 13 nt, Mycobacterium avium subsp. paratuberculosis
cgauggcgggccg

SEQ ID NO: 954607 - RNA, 17 nt, Mycobacterium avium subsp. paratuberculosis
cgauggcgggccgcuuc

SEQ ID NO: 954608 - RNA, 22 nt, Mycobacterium avium subsp. paratuberculosis
cgauggcgggccgcuucgaggu

SEQ ID NO: 954609 - RNA, 13 nt, Mycobacterium avium subsp. paratuberculosis
cgauggcgggcgc

SEQ ID NO: 954610 - RNA, 15 nt, Mycobacterium avium subsp. paratuberculosis
cgauggcgggcgcgc

SEQ ID NO: 954611 - RNA, 16 nt, Mycobacterium avium subsp. paratuberculosis
cgauggcgggcgcgcc

SEQ ID NO: 954612 - RNA, 17 nt, Mycobacterium avium subsp. paratuberculosis
cgauggcgggcgcgccg

SEQ ID NO: 954613 - RNA, 18 nt, Mycobacterium avium subsp. paratuberculosis
cgauggcgggcgcgccgg

SEQ ID NO: 954614 - RNA, 19 nt, Mycobacterium avium subsp. paratuberculosis
cgauggcgggcgcgccggc

SEQ ID NO: 954615 - RNA, 12 nt, Mycobacterium avium subsp. paratuberculosis
cgauggcggccu

SEQ ID NO: 954616 - RNA, 14 nt, Mycobacterium avium subsp. paratuberculosis
cgauggcggccugc

SEQ ID NO: 954617 - RNA, 22 nt, Mycobacterium avium subsp. paratuberculosis
cgauggcggcgcgcucgucguc

SEQ ID NO: 954618 - RNA, 13 nt, Mycobacterium avium subsp. paratuberculosis
cgauggcggugug

SEQ ID NO: 954619 - RNA, 18 nt, Mycobacterium avium subsp. paratuberculosis
cgauggcguagcggguca

SEQ ID NO: 954620 - RNA, 17 nt, Mycobacterium avium subsp. paratuberculosis
cgauggcguccaccgac

SEQ ID NO: 954621 - RNA, 18 nt, Mycobacterium avium subsp. paratuberculosis
cgauggcguccaccgaca

SEQ ID NO: 954622 - RNA, 13 nt, Mycobacterium avium subsp. paratuberculosis
cgauggcgucggc

SEQ ID NO: 954623 - RNA, 15 nt, Mycobacterium avium subsp. paratuberculosis
cgauggcgucggcca

SEQ ID NO: 954624 - RNA, 20 nt, Mycobacterium avium subsp. paratuberculosis
cgauggcgucggccagcggc

SEQ ID NO: 954625 - RNA, 22 nt, Mycobacterium avium subsp. paratuberculosis
cgauggcgucggccagcggcag

SEQ ID NO: 954626 - RNA, 14 nt, Mycobacterium avium subsp. paratuberculosis
cgauggcgugccgg

SEQ ID NO: 954627 - RNA, 17 nt, Mycobacterium avium subsp. paratuberculosis
cgauggcgugccggcgc

SEQ ID NO: 954628 - RNA, 18 nt, Mycobacterium avium subsp. paratuberculosis
cgauggcgugccggcgcu

SEQ ID NO: 954629 - RNA, 20 nt, Mycobacterium avium subsp. paratuberculosis
cgauggcguucaucguccac

SEQ ID NO: 954630 - RNA, 13 nt, Mycobacterium avium subsp. paratuberculosis
cgauggcgcggcc

SEQ ID NO: 954631 - RNA, 15 nt, Mycobacterium avium subsp. paratuberculosis
cgauggcgcggccgg

SEQ ID NO: 954632 - RNA, 16 nt, Mycobacterium avium subsp. paratuberculosis
cgauggcgcuggccgc

SEQ ID NO: 954633 - RNA, 16 nt, Mycobacterium avium subsp. paratuberculosis
cgauggcgcggccggc

SEQ ID NO: 954634 - RNA, 21 nt, Mycobacterium avium subsp. paratuberculosis
cgauggcgcggccggccgaca

SEQ ID NO: 954635 - RNA, 23 nt, Mycobacterium avium subsp. paratuberculosis
cgauggcgcggccggccgacacc

SEQ ID NO: 954636 - RNA, 15 nt, Mycobacterium avium subsp. paratuberculosis
cgcagcauccgcacc

SEQ ID NO: 954637 - RNA, 18 nt, Mycobacterium avium subsp. paratuberculosis
cgcagcaucuccgagucg

SEQ ID NO: 954638 - RNA, 19 nt, Mycobacterium avium subsp. paratuberculosis
cgcagcaucuccgagucgg

SEQ ID NO: 954639 - RNA, 21 nt, Mycobacterium avium subsp. paratuberculosis
cgcagcaucucuugaugcagc

SEQ ID NO: 954640 - RNA, 22 nt, Mycobacterium avium subsp. paratuberculosis
cgcacuuggccucgggcgacga

SEQ ID NO: 954641 - RNA, 18 nt, Mycobacterium avium subsp. paratuberculosis
cgcagaaaaaggccgccg

SEQ ID NO: 954642 - RNA, 21 nt, Mycobacterium avium subsp. paratuberculosis
cgcagaaaaaggccgccgcug

SEQ ID NO: 954643 - RNA, 14 nt, Mycobacterium avium subsp. paratuberculosis
cgcagaacaccacg

SEQ ID NO: 954644 - RNA, 15 nt, Mycobacterium avium subsp. paratuberculosis
cgcagaacaccacgg

SEQ ID NO: 954645 - RNA, 18 nt, Mycobacterium avium subsp. paratuberculosis
cgcagaacaccacggugu

SEQ ID NO: 954646 - RNA, 15 nt, Mycobacterium avium subsp. paratuberculosis
cgcagaacaccagcg

SEQ ID NO: 954647 - RNA, 15 nt, Mycobacterium avium subsp. paratuberculosis
cgcagaaccgcaccc

SEQ ID NO: 954648 - RNA, 16 nt, Mycobacterium avium subsp. paratuberculosis
cgcagaaccguugagc

SEQ ID NO: 954649 - RNA, 19 nt, Mycobacterium avium subsp. paratuberculosis
cgcagaaccguugagcagc

SEQ ID NO: 954650 - RNA, 21 nt, Mycobacterium avium subsp. paratuberculosis
cgcagaacucgucgccaccga

SEQ ID NO: 954651 - RNA, 16 nt, Mycobacterium avium subsp. paratuberculosis
cgcagcauggcccaca

SEQ ID NO: 954652 - RNA, 20 nt, Mycobacterium avium subsp. paratuberculosis
cgcagcaucuuggccacggg

SEQ ID NO: 954653 - RNA, 20 nt, Mycobacterium avium subsp. paratuberculosis
cgcagccagaccucgccgac

SEQ ID NO: 954654 - RNA, 22 nt, Mycobacterium avium subsp. paratuberculosis
cgcagccaccgcccgaaccgcg

SEQ ID NO: 954655 - RNA, 14 nt, Mycobacterium avium subsp. paratuberculosis
cgcagccacgagcc

SEQ ID NO: 954656 - RNA, 18 nt, Mycobacterium avium subsp. paratuberculosis
cgcagccacgagcccagc

SEQ ID NO: 954657 - RNA, 20 nt, Mycobacterium avium subsp. paratuberculosis
cgcagccgaugucgucgaac

SEQ ID NO: 954658 - RNA, 17 nt, Mycobacterium avium subsp. paratuberculosis
cgcagccgaucgacgaa

SEQ ID NO: 954659 - RNA, 13 nt, Mycobacterium avium subsp. paratuberculosis
cgcagccgccggg

SEQ ID NO: 954660 - RNA, 15 nt, Mycobacterium avium subsp. paratuberculosis
cgcagccgccgggcu

SEQ ID NO: 954661 - RNA, 14 nt, Mycobacterium avium subsp. paratuberculosis
cgcagccgcgacgg

SEQ ID NO: 954662 - RNA, 18 nt, Mycobacterium avium subsp. paratuberculosis
cgcagccgcgacggcggg

SEQ ID NO: 954663 - RNA, 19 nt, Mycobacterium avium subsp. paratuberculosis
cgcagccgcgacggcgggu

SEQ ID NO: 954664 - RNA, 13 nt, Mycobacterium avium subsp. paratuberculosis
cgcagccgcgcgg

SEQ ID NO: 954665 - RNA, 16 nt, Mycobacterium avium subsp. paratuberculosis
cgcagccgcgcggccg

SEQ ID NO: 954666 - RNA, 21 nt, Mycobacterium avium subsp. paratuberculosis
cgcagccgcgcggccggccac

SEQ ID NO: 954667 - RNA, 13 nt, Mycobacterium avium subsp. paratuberculosis
cgcagccgcggug

SEQ ID NO: 954668 - RNA, 14 nt, Mycobacterium avium subsp. paratuberculosis
cgcagccgcggugg

SEQ ID NO: 954669 - RNA, 20 nt, Mycobacterium avium subsp. paratuberculosis
cgcagccgcgguggcggugu

SEQ ID NO: 954670 - RNA, 21 nt, Mycobacterium avium subsp. paratuberculosis
cgcagccgcgguggcgguguu

SEQ ID NO: 954671 - RNA, 13 nt, Mycobacterium avium subsp. paratuberculosis
cgcagcgcucagu

SEQ ID NO: 954672 - RNA, 12 nt, Mycobacterium avium subsp. paratuberculosis
cgcagcgcggcg

SEQ ID NO: 954673 - RNA, 15 nt, Mycobacterium avium subsp. paratuberculosis
cgcagcgcggcgaca

SEQ ID NO: 954674 - RNA, 16 nt, Mycobacterium avium subsp. paratuberculosis
cgcagcgcggcgacau

SEQ ID NO: 954675 - RNA, 13 nt, Mycobacterium avium subsp. paratuberculosis
cgcagcgcgucgc

SEQ ID NO: 954676 - RNA, 15 nt, Mycobacterium avium subsp. paratuberculosis
cgcagcgcgucgcgc

SEQ ID NO: 954677 - RNA, 17 nt, Mycobacterium avium subsp. paratuberculosis
cgcagcgcgucgcgccc

SEQ ID NO: 954678 - RNA, 16 nt, Mycobacterium avium subsp. paratuberculosis
cgcagcgcgucgucgg

SEQ ID NO: 954679 - RNA, 17 nt, Mycobacterium avium subsp. paratuberculosis
cgcagcgcgucgucggu

SEQ ID NO: 954680 - RNA, 14 nt, Mycobacterium avium subsp. paratuberculosis
cgcagcgcgcgcuc

SEQ ID NO: 954681 - RNA, 22 nt, Mycobacterium avium subsp. paratuberculosis
cgcagcgcgcgcucggucagca

SEQ ID NO: 954682 - RNA, 13 nt, Mycobacterium avium subsp. paratuberculosis
cgcagcgcgcggc

SEQ ID NO: 954683 - RNA, 17 nt, Mycobacterium avium subsp. paratuberculosis
cgcagcgcgcggcgcag

SEQ ID NO: 954684 - RNA, 16 nt, Mycobacterium avium subsp. paratuberculosis
cgcagcgcgcggguga

SEQ ID NO: 954685 - RNA, 13 nt, Mycobacterium avium subsp. paratuberculosis
cgcagcgcgacga

SEQ ID NO: 954686 - RNA, 19 nt, Mycobacterium avium subsp. paratuberculosis
cgcagcgcgacgaacagca

SEQ ID NO: 954687 - RNA, 21 nt, Mycobacterium avium subsp. paratuberculosis
cgcagcgcgacgaacagcacc

SEQ ID NO: 954688 - RNA, 12 nt, Mycobacterium avium subsp. paratuberculosis
cgcagcggcgcc

SEQ ID NO: 954689 - RNA, 13 nt, Mycobacterium avium subsp. paratuberculosis
cgcagcggcgccg

SEQ ID NO: 954690 - RNA, 13 nt, Mycobacterium avium subsp. paratuberculosis
cgcagcggcaggu

SEQ ID NO: 954691 - RNA, 15 nt, Mycobacterium avium subsp. paratuberculosis
cgcagcggcaggucg

SEQ ID NO: 954692 - RNA, 15 nt, Mycobacterium avium subsp. paratuberculosis
cgcagcggcgccgca

SEQ ID NO: 954693 - RNA, 16 nt, Mycobacterium avium subsp. paratuberculosis
cgcagcggcgccgcag

SEQ ID NO: 954694 - RNA, 19 nt, Mycobacterium avium subsp. paratuberculosis
cgcagcggcgccgcagcuc

SEQ ID NO: 954695 - RNA, 14 nt, Mycobacterium avium subsp. paratuberculosis
cgcagcggcgccgg

SEQ ID NO: 954696 - RNA, 16 nt, Mycobacterium avium subsp. paratuberculosis
cgcagcggcgccggga

SEQ ID NO: 954697 - RNA, 16 nt, Mycobacterium avium subsp. paratuberculosis
cgcagcggcggcacgg

SEQ ID NO: 954698 - RNA, 22 nt, Mycobacterium avium subsp. paratuberculosis
cgcagcggcggcacgguuggcc

SEQ ID NO: 954699 - RNA, 13 nt, Mycobacterium avium subsp. paratuberculosis
cgcagcggcggcu

SEQ ID NO: 954700 - RNA, 15 nt, Mycobacterium avium subsp. paratuberculosis
cgcagcggcggcucg

SEQ ID NO: 954701 - RNA, 13 nt, Mycobacterium avium subsp. paratuberculosis
cgcagcggcgguu

SEQ ID NO: 954702 - RNA, 22 nt, Mycobacterium avium subsp. paratuberculosis
cgcagcggcgguugcucgucgg

SEQ ID NO: 954703 - RNA, 12 nt, Mycobacterium avium subsp. paratuberculosis
cgcagcggcguc

SEQ ID NO: 954704 - RNA, 13 nt, Mycobacterium avium subsp. paratuberculosis
cgcagcggcguca

SEQ ID NO: 954705 - RNA, 22 nt, Mycobacterium avium subsp. paratuberculosis
cgcagcgaucggcggcucgccg

SEQ ID NO: 954706 - RNA, 13 nt, Mycobacterium avium subsp. paratuberculosis
cgcagcgaggcga

SEQ ID NO: 954707 - RNA, 15 nt, Mycobacterium avium subsp. paratuberculosis
cgcagcgaggcgaug

SEQ ID NO: 954708 - RNA, 19 nt, Mycobacterium avium subsp. paratuberculosis
cgcagcgaggcgauggugc

SEQ ID NO: 954709 - RNA, 13 nt, Mycobacterium avium subsp. paratuberculosis
cgcagcgagucgg

SEQ ID NO: 954710 - RNA, 16 nt, Mycobacterium avium subsp. paratuberculosis
cgcagcgcagcgucgg

SEQ ID NO: 954711 - RNA, 17 nt, Mycobacterium avium subsp. paratuberculosis
cgcagcgcagcgucggc

SEQ ID NO: 954712 - RNA, 18 nt, Mycobacterium avium subsp. paratuberculosis
cgcagcgcagcgucggcg

SEQ ID NO: 954713 - RNA, 18 nt, Mycobacterium avium subsp. paratuberculosis
cgcagcgcacgucgccgc

SEQ ID NO: 954714 - RNA, 20 nt, Mycobacterium avium subsp. paratuberculosis
cgcagcgcacgucgccgccg

SEQ ID NO: 954715 - RNA, 15 nt, Mycobacterium avium subsp. paratuberculosis
cgcagcgcagcacca

SEQ ID NO: 954716 - RNA, 17 nt, Mycobacterium avium subsp. paratuberculosis
cgcagcgcagcaccauc

SEQ ID NO: 954717 - RNA, 20 nt, Mycobacterium avium subsp. paratuberculosis
cgcagccgcugcagcgccgc

SEQ ID NO: 954718 - RNA, 22 nt, Mycobacterium avium subsp. paratuberculosis
cgcagccgcugcagcgccgccc

SEQ ID NO: 954719 - RNA, 13 nt, Mycobacterium avium subsp. paratuberculosis
cgcagccgcuggc

SEQ ID NO: 954720 - RNA, 20 nt, Mycobacterium avium subsp. paratuberculosis
cgcagccgcuggccgcgcca

SEQ ID NO: 954721 - RNA, 18 nt, Mycobacterium avium subsp. paratuberculosis
cgcagcgaagcgaggcgc

SEQ ID NO: 954722 - RNA, 12 nt, Mycobacterium avium subsp. paratuberculosis
cgcagcgccucg

SEQ ID NO: 954723 - RNA, 15 nt, Mycobacterium avium subsp. paratuberculosis
cgcagcgccucggcg

SEQ ID NO: 954724 - RNA, 17 nt, Mycobacterium avium subsp. paratuberculosis
cgcagcgccucggcggc

SEQ ID NO: 954725 - RNA, 18 nt, Mycobacterium avium subsp. paratuberculosis
cgcagcgccucggcggcc

SEQ ID NO: 954726 - RNA, 16 nt, Mycobacterium avium subsp. paratuberculosis
cgcagcgccucggcgu

SEQ ID NO: 954727 - RNA, 17 nt, Mycobacterium avium subsp. paratuberculosis
cgcagcgccucggcgug

SEQ ID NO: 954728 - RNA, 13 nt, Mycobacterium avium subsp. paratuberculosis
cgcagcgcccggc

SEQ ID NO: 954729 - RNA, 15 nt, Mycobacterium avium subsp. paratuberculosis
cgcagcgccagcgcg

SEQ ID NO: 954730 - RNA, 18 nt, Mycobacterium avium subsp. paratuberculosis
cgcagcgccagcgcgccc

SEQ ID NO: 954731 - RNA, 17 nt, Mycobacterium avium subsp. paratuberculosis
cgcagcgccgcgccgac

SEQ ID NO: 954732 - RNA, 19 nt, Mycobacterium avium subsp. paratuberculosis
cgcagcgcauccgacaccg

SEQ ID NO: 954733 - RNA, 23 nt, Mycobacterium avium subsp. paratuberculosis
cgcagcgcauccgacaccgccuu

SEQ ID NO: 954734 - RNA, 13 nt, Mycobacterium avium subsp. paratuberculosis
cgcagcgcaucgc

SEQ ID NO: 954735 - RNA, 16 nt, Mycobacterium avium subsp. paratuberculosis
cgcagcgcaucgccgg

SEQ ID NO: 954736 - RNA, 19 nt, Mycobacterium avium subsp. paratuberculosis
cgcagcgcaucgccggcga

SEQ ID NO: 954737 - RNA, 16 nt, Mycobacterium avium subsp. paratuberculosis
cgcagcgcaucgguga

SEQ ID NO: 954738 - RNA, 23 nt, Mycobacterium avium subsp. paratuberculosis
cgcagcgcaucguugccggcggc

SEQ ID NO: 954739 - RNA, 15 nt, Mycobacterium avium subsp. paratuberculosis
cgcagcuccagcgag

SEQ ID NO: 954740 - RNA, 16 nt, Mycobacterium avium subsp. paratuberculosis
cgcagcuccagcgagu

SEQ ID NO: 954741 - RNA, 18 nt, Mycobacterium avium subsp. paratuberculosis
cgcagcucccccggcgug

SEQ ID NO: 954742 - RNA, 21 nt, Mycobacterium avium subsp. paratuberculosis
cgcagcucccccggcgugagc

SEQ ID NO: 954743 - RNA, 15 nt, Mycobacterium avium subsp. paratuberculosis
cgcagcucgacgacc

SEQ ID NO: 954744 - RNA, 18 nt, Mycobacterium avium subsp. paratuberculosis
cgcagcucgaucacccag

SEQ ID NO: 954745 - RNA, 18 nt, Mycobacterium avium subsp. paratuberculosis
cgcagcucgcccagcacc

SEQ ID NO: 954746 - RNA, 19 nt, Mycobacterium avium subsp. paratuberculosis
cgcagcucgcccagcaccg

SEQ ID NO: 954747 - RNA, 21 nt, Mycobacterium avium subsp. paratuberculosis
cgcagcucgcccagcaccguc

SEQ ID NO: 954748 - RNA, 12 nt, Mycobacterium avium subsp. paratuberculosis
cgcagcucgccg

SEQ ID NO: 954749 - RNA, 15 nt, Mycobacterium avium subsp. paratuberculosis
cgcagcucgccgagc

SEQ ID NO: 954750 - RNA, 22 nt, Mycobacterium avium subsp. paratuberculosis
cgcagcucgccgguggcggcga

SEQ ID NO: 954751 - RNA, 15 nt, Mycobacterium avium subsp. paratuberculosis
cgcagcucgcgcagc

SEQ ID NO: 954752 - RNA, 19 nt, Mycobacterium avium subsp. paratuberculosis
cgcagcucgcgcagccggc

SEQ ID NO: 954753 - RNA, 20 nt, Mycobacterium avium subsp. paratuberculosis
cgcagcucgcgcagcuggcc

SEQ ID NO: 954754 - RNA, 21 nt, Mycobacterium avium subsp. paratuberculosis
cgcagcucgcgcagcuggccg

SEQ ID NO: 954755 - RNA, 21 nt, Mycobacterium avium subsp. paratuberculosis
cgcagcucugcucguucguca

SEQ ID NO: 954756 - RNA, 15 nt, Mycobacterium avium subsp. paratuberculosis
cgcagcucgucgugg

SEQ ID NO: 954757 - RNA, 18 nt, Mycobacterium avium subsp. paratuberculosis
cgcagcucggggucggcg

SEQ ID NO: 954758 - RNA, 19 nt, Mycobacterium avium subsp. paratuberculosis
cgcagcucggggucggcgu

SEQ ID NO: 954759 - RNA, 18 nt, Mycobacterium avium subsp. paratuberculosis
cgcagcugaucggggccc

SEQ ID NO: 954760 - RNA, 18 nt, Mycobacterium avium subsp. paratuberculosis
cgcagcugcgccgcgucg

SEQ ID NO: 954761 - RNA, 17 nt, Mycobacterium avium subsp. paratuberculosis
cgcagcugcugcggccg

SEQ ID NO: 954762 - RNA, 19 nt, Mycobacterium avium subsp. paratuberculosis
cgcagcugcugcggccgga

SEQ ID NO: 954763 - RNA, 13 nt, Mycobacterium avium subsp. paratuberculosis
cgcagcuggccgu

SEQ ID NO: 954764 - RNA, 15 nt, Mycobacterium avium subsp. paratuberculosis
cgcagcuggccgugc

SEQ ID NO: 954765 - RNA, 16 nt, Mycobacterium avium subsp. paratuberculosis
cgcagcugggagaugu

SEQ ID NO: 954766 - RNA, 21 nt, Mycobacterium avium subsp. paratuberculosis
cgcagcgugucggggucggcg

SEQ ID NO: 954767 - RNA, 22 nt, Mycobacterium avium subsp. paratuberculosis
cgcagcgugucggggucggcgc

SEQ ID NO: 954768 - RNA, 15 nt, Mycobacterium avium subsp. paratuberculosis
cgcagcgugugcacc

SEQ ID NO: 954769 - RNA, 18 nt, Mycobacterium avium subsp. paratuberculosis
cgcagcgugggcaccggc

SEQ ID NO: 954770 - RNA, 21 nt, Mycobacterium avium subsp. paratuberculosis
cgcagcgugggcaccggcacc

SEQ ID NO: 954771 - RNA, 21 nt, Mycobacterium avium subsp. paratuberculosis
cgcagcgucuucuucucgccg

SEQ ID NO: 954772 - RNA, 21 nt, Mycobacterium avium subsp. paratuberculosis
cgcagcgucuccucgaccgcc

SEQ ID NO: 954773 - RNA, 16 nt, Mycobacterium avium subsp. paratuberculosis
cgcagcgucucgaucg

SEQ ID NO: 954774 - RNA, 19 nt, Mycobacterium avium subsp. paratuberculosis
cgcagcgucucgaucgacg

SEQ ID NO: 954775 - RNA, 20 nt, Mycobacterium avium subsp. paratuberculosis
cgcagcgucucgaucgacga

SEQ ID NO: 954776 - RNA, 17 nt, Mycobacterium avium subsp. paratuberculosis
cgcagcggugacaccca

SEQ ID NO: 954777 - RNA, 18 nt, Mycobacterium avium subsp. paratuberculosis
cgcagcggcccgaacacc

SEQ ID NO: 954778 - RNA, 13 nt, Mycobacterium avium subsp. paratuberculosis
cgcagcggcggca

SEQ ID NO: 954779 - RNA, 16 nt, Mycobacterium avium subsp. paratuberculosis
cgcagcgggauuggcg

SEQ ID NO: 954780 - RNA, 19 nt, Mycobacterium avium subsp. paratuberculosis
cgcagcgggauuggcgcca

SEQ ID NO: 954781 - RNA, 23 nt, Mycobacterium avium subsp. paratuberculosis
cgcagcgggauuggcgccacugc

SEQ ID NO: 954782 - RNA, 19 nt, Mycobacterium avium subsp. paratuberculosis
cgcagcggggaggcccagc

SEQ ID NO: 954783 - RNA, 21 nt, Mycobacterium avium subsp. paratuberculosis
cgcagcggggaggcccagccc

SEQ ID NO: 954784 - RNA, 23 nt, Mycobacterium avium subsp. paratuberculosis
cgcagcggggaggcccagcccgc

SEQ ID NO: 954785 - RNA, 12 nt, Mycobacterium avium subsp. paratuberculosis
cgcagcggggcg

SEQ ID NO: 954786 - RNA, 13 nt, Mycobacterium avium subsp. paratuberculosis
cgcagcggggcgc

SEQ ID NO: 954787 - RNA, 16 nt, Mycobacterium avium subsp. paratuberculosis
cgcagcggggcgcugu

SEQ ID NO: 954788 - RNA, 21 nt, Mycobacterium avium subsp. paratuberculosis
cgcagcuguucgggcagaugg

SEQ ID NO: 954789 - RNA, 16 nt, Mycobacterium avium subsp. paratuberculosis
cgcagcuucugcagcu

SEQ ID NO: 954790 - RNA, 18 nt, Mycobacterium avium subsp. paratuberculosis
cgcaggaacuccagcagc

SEQ ID NO: 954791 - RNA, 21 nt, Mycobacterium avium subsp. paratuberculosis
cgcaggaaaggaaggcgcaug

SEQ ID NO: 954792 - RNA, 15 nt, Mycobacterium avium subsp. paratuberculosis
cgcaggccggucacc

SEQ ID NO: 954793 - RNA, 18 nt, Mycobacterium avium subsp. paratuberculosis
cgcaggcgaacaccucgg

SEQ ID NO: 954794 - RNA, 13 nt, Mycobacterium avium subsp. paratuberculosis
cgcaggcgagccg

SEQ ID NO: 954795 - RNA, 14 nt, Mycobacterium avium subsp. paratuberculosis
cgcaggcgagccga

SEQ ID NO: 954796 - RNA, 17 nt, Mycobacterium avium subsp. paratuberculosis
cgcaggcgagccgacag

SEQ ID NO: 954797 - RNA, 18 nt, Mycobacterium avium subsp. paratuberculosis
cgcaggcgagccgacagu

SEQ ID NO: 954798 - RNA, 14 nt, Mycobacterium avium subsp. paratuberculosis
cgcaggcgagccgg

SEQ ID NO: 954799 - RNA, 11 nt, Mycobacterium avium subsp. paratuberculosis
cgcaggccguc

SEQ ID NO: 954800 - RNA, 17 nt, Mycobacterium avium subsp. paratuberculosis
cgcaggccguccagcag

SEQ ID NO: 954801 - RNA, 18 nt, Mycobacterium avium subsp. paratuberculosis
cgcaggccguccagcagc

SEQ ID NO: 954802 - RNA, 18 nt, Mycobacterium avium subsp. paratuberculosis
cgcaggccgucgccgguc

SEQ ID NO: 954803 - RNA, 20 nt, Mycobacterium avium subsp. paratuberculosis
cgcaggccguuguggccacc

SEQ ID NO: 954804 - RNA, 18 nt, Mycobacterium avium subsp. paratuberculosis
cgcaggccgcgagcccgc

SEQ ID NO: 954805 - RNA, 16 nt, Mycobacterium avium subsp. paratuberculosis
cgcaggcggcgcgcag

SEQ ID NO: 954806 - RNA, 17 nt, Mycobacterium avium subsp. paratuberculosis
cgcaggcggcgcgcagc

SEQ ID NO: 954807 - RNA, 14 nt, Mycobacterium avium subsp. paratuberculosis
cgcaggcggccagc

SEQ ID NO: 954808 - RNA, 17 nt, Mycobacterium avium subsp. paratuberculosis
cgcaggcggccagcacc

SEQ ID NO: 954809 - RNA, 18 nt, Mycobacterium avium subsp. paratuberculosis
cgcaggcggccagcacca

SEQ ID NO: 954810 - RNA, 20 nt, Mycobacterium avium subsp. paratuberculosis
cgcaggcggccagcaccagu

SEQ ID NO: 954811 - RNA, 14 nt, Mycobacterium avium subsp. paratuberculosis
cgcaggcgcgcggc

SEQ ID NO: 954812 - RNA, 16 nt, Mycobacterium avium subsp. paratuberculosis
cgcaggcgcgcggcca

SEQ ID NO: 954813 - RNA, 18 nt, Mycobacterium avium subsp. paratuberculosis
cgcaggcgcgcggccagc

SEQ ID NO: 954814 - RNA, 13 nt, Mycobacterium avium subsp. paratuberculosis
cgcaggcgcgcac

SEQ ID NO: 954815 - RNA, 14 nt, Mycobacterium avium subsp. paratuberculosis
cgcaggcgcgcacc

SEQ ID NO: 954816 - RNA, 20 nt, Mycobacterium avium subsp. paratuberculosis
cgcaggcgcgcaccaucgcg

SEQ ID NO: 954817 - RNA, 12 nt, Mycobacterium avium subsp. paratuberculosis
cgcaggcuggca

SEQ ID NO: 954818 - RNA, 16 nt, Mycobacterium avium subsp. paratuberculosis
cgcaggcuggcaucgu

SEQ ID NO: 954819 - RNA, 17 nt, Mycobacterium avium subsp. paratuberculosis
cgcaggcuggcaucguc

SEQ ID NO: 954820 - RNA, 19 nt, Mycobacterium avium subsp. paratuberculosis
cgcaggcguccagggccac

SEQ ID NO: 954821 - RNA, 15 nt, Mycobacterium avium subsp. paratuberculosis
cgcaggcguggccca

SEQ ID NO: 954822 - RNA, 20 nt, Mycobacterium avium subsp. paratuberculosis
cgcaggcguggcccagccgg

SEQ ID NO: 954823 - RNA, 21 nt, Mycobacterium avium subsp. paratuberculosis
cgcaggcguggcccagccggu

SEQ ID NO: 954824 - RNA, 16 nt, Mycobacterium avium subsp. paratuberculosis
cgcacgaccaugucgg

SEQ ID NO: 954825 - RNA, 19 nt, Mycobacterium avium subsp. paratuberculosis
cgcacgaccaugucggcga

SEQ ID NO: 954826 - RNA, 16 nt, Mycobacterium avium subsp. paratuberculosis
cgcacgaauugccggu

SEQ ID NO: 954827 - RNA, 17 nt, Mycobacterium avium subsp. paratuberculosis
cgcacgaauugccggug

SEQ ID NO: 954828 - RNA, 19 nt, Mycobacterium avium subsp. paratuberculosis
cgcacgaauugccgguggu

SEQ ID NO: 954829 - RNA, 20 nt, Mycobacterium avium subsp. paratuberculosis
cgcacgaaaccgcguggcgc

SEQ ID NO: 954830 - RNA, 17 nt, Mycobacterium avium subsp. paratuberculosis
cgcacgaaaugcgggcg

SEQ ID NO: 954831 - RNA, 21 nt, Mycobacterium avium subsp. paratuberculosis
cgcacgaaaugcgggcgaugg

SEQ ID NO: 954832 - RNA, 15 nt, Mycobacterium avium subsp. paratuberculosis
cgcacgaacggcgcg

SEQ ID NO: 954833 - RNA, 21 nt, Mycobacterium avium subsp. paratuberculosis
cgcacgaacggcgcgaaccgg

SEQ ID NO: 954834 - RNA, 14 nt, Mycobacterium avium subsp. paratuberculosis
cgcaccggacgcag

SEQ ID NO: 954835 - RNA, 13 nt, Mycobacterium avium subsp. paratuberculosis
cgcaccgcggcgg

SEQ ID NO: 954836 - RNA, 14 nt, Mycobacterium avium subsp. paratuberculosis
cgcaccgcggcggg

SEQ ID NO: 954837 - RNA, 17 nt, Mycobacterium avium subsp. paratuberculosis
cgcaccgcggcgggguc

SEQ ID NO: 954838 - RNA, 15 nt, Mycobacterium avium subsp. paratuberculosis
cgcaccgcggcgugc

SEQ ID NO: 954839 - RNA, 19 nt, Mycobacterium avium subsp. paratuberculosis
cgcaccgcggcgugcgcca

SEQ ID NO: 954840 - RNA, 16 nt, Mycobacterium avium subsp. paratuberculosis
cgcaccgcggcgugga

SEQ ID NO: 954841 - RNA, 14 nt, Mycobacterium avium subsp. paratuberculosis
cgcaccgcgggcag

SEQ ID NO: 954842 - RNA, 16 nt, Mycobacterium avium subsp. paratuberculosis
cgcaccgcgggcagca

SEQ ID NO: 954843 - RNA, 14 nt, Mycobacterium avium subsp. paratuberculosis
cgcaccgcgggcuc

SEQ ID NO: 954844 - RNA, 16 nt, Mycobacterium avium subsp. paratuberculosis
cgcaccgcgggcucga

SEQ ID NO: 954845 - RNA, 13 nt, Mycobacterium avium subsp. paratuberculosis
cgcaccgcggccu

SEQ ID NO: 954846 - RNA, 22 nt, Mycobacterium avium subsp. paratuberculosis
cgcaccgcggccucggcgucga

SEQ ID NO: 954847 - RNA, 12 nt, Mycobacterium avium subsp. paratuberculosis
cgcaccgcggcc

SEQ ID NO: 954848 - RNA, 13 nt, Mycobacterium avium subsp. paratuberculosis
cgcaccgcgucga

SEQ ID NO: 954849 - RNA, 16 nt, Mycobacterium avium subsp. paratuberculosis
cgcaccgcgucgaugc

SEQ ID NO: 954850 - RNA, 24 nt, Mycobacterium avium subsp. paratuberculosis
cgcacgcggacacgaacgacgcgg

SEQ ID NO: 954851 - RNA, 14 nt, Mycobacterium avium subsp. paratuberculosis
cgcacgccggcggg

SEQ ID NO: 954852 - RNA, 22 nt, Mycobacterium avium subsp. paratuberculosis
cgcacgcgaacaccagaugccg

SEQ ID NO: 954853 - RNA, 13 nt, Mycobacterium avium subsp. paratuberculosis
cgcacgcgaccgc

SEQ ID NO: 954854 - RNA, 15 nt, Mycobacterium avium subsp. paratuberculosis
cgcacgcgaccgcgu

SEQ ID NO: 954855 - RNA, 18 nt, Mycobacterium avium subsp. paratuberculosis
cgcacgcgaccgcgucga

SEQ ID NO: 954856 - RNA, 19 nt, Mycobacterium avium subsp. paratuberculosis
cgcacgcgaccgcgucgac

SEQ ID NO: 954857 - RNA, 21 nt, Mycobacterium avium subsp. paratuberculosis
cgcacgcccaugaucacaccg

SEQ ID NO: 954858 - RNA, 13 nt, Mycobacterium avium subsp. paratuberculosis
cgcacgcccgggc

SEQ ID NO: 954859 - RNA, 18 nt, Mycobacterium avium subsp. paratuberculosis
cgcacgaucugcaggccg

SEQ ID NO: 954860 - RNA, 19 nt, Mycobacterium avium subsp. paratuberculosis
cgcacgaucugcaggccga

SEQ ID NO: 954861 - RNA, 19 nt, Mycobacterium avium subsp. paratuberculosis
cgcacgcagugccgcacca

SEQ ID NO: 954862 - RNA, 20 nt, Mycobacterium avium subsp. paratuberculosis
cgcacgcagugccgcaccag

SEQ ID NO: 954863 - RNA, 22 nt, Mycobacterium avium subsp. paratuberculosis
cgcacgcagugccgcaccagca

SEQ ID NO: 954864 - RNA, 17 nt, Mycobacterium avium subsp. paratuberculosis
cgcacgaugccgcgcuc

SEQ ID NO: 954865 - RNA, 19 nt, Mycobacterium avium subsp. paratuberculosis
cgcacgaugccgcgcucga

SEQ ID NO: 954866 - RNA, 15 nt, Mycobacterium avium subsp. paratuberculosis
cgcacgaucgggcgc

SEQ ID NO: 954867 - RNA, 15 nt, Mycobacterium avium subsp. paratuberculosis
cgcacguagcccagc

SEQ ID NO: 954868 - RNA, 17 nt, Mycobacterium avium subsp. paratuberculosis
cgcacguagcccagcgc

SEQ ID NO: 954869 - RNA, 18 nt, Mycobacterium avium subsp. paratuberculosis
cgcacguagcccagcgcg

SEQ ID NO: 954870 - RNA, 17 nt, Mycobacterium avium subsp. paratuberculosis
cgcacguauccgcgguc

SEQ ID NO: 954871 - RNA, 18 nt, Mycobacterium avium subsp. paratuberculosis
cgcacguauccgcggucg

SEQ ID NO: 954872 - RNA, 13 nt, Mycobacterium avium subsp. paratuberculosis
cgcacgucaccgc

SEQ ID NO: 954873 - RNA, 13 nt, Mycobacterium avium subsp. paratuberculosis
cgcacggccgcca

SEQ ID NO: 954874 - RNA, 13 nt, Mycobacterium avium subsp. paratuberculosis
cgcacggcccauc

SEQ ID NO: 954875 - RNA, 15 nt, Mycobacterium avium subsp. paratuberculosis
cgcacgcugucgggg

SEQ ID NO: 954876 - RNA, 22 nt, Mycobacterium avium subsp. paratuberculosis
cgcacgcuuuuucgcgaacuuc

SEQ ID NO: 954877 - RNA, 16 nt, Mycobacterium avium subsp. paratuberculosis
cgcacgcuggccggca

SEQ ID NO: 954878 - RNA, 19 nt, Mycobacterium avium subsp. paratuberculosis
cgcacgcuggccggcagcg

SEQ ID NO: 954879 - RNA, 21 nt, Mycobacterium avium subsp. paratuberculosis
cgcacgcuggccggcagcguc

SEQ ID NO: 954880 - RNA, 22 nt, Mycobacterium avium subsp. paratuberculosis
cgcacgcugaucccacauucgg

SEQ ID NO: 954881 - RNA, 15 nt, Mycobacterium avium subsp. paratuberculosis
cgcacgcucgcggug

SEQ ID NO: 954882 - RNA, 16 nt, Mycobacterium avium subsp. paratuberculosis
cgcacgcucgcggugc

SEQ ID NO: 954883 - RNA, 16 nt, Mycobacterium avium subsp. paratuberculosis
cgcacuagguccggcg

SEQ ID NO: 954884 - RNA, 17 nt, Mycobacterium avium subsp. paratuberculosis
cgcacuagguccggcgc

SEQ ID NO: 954885 - RNA, 19 nt, Mycobacterium avium subsp. paratuberculosis
cgcacuagguccggcgcga

SEQ ID NO: 954886 - RNA, 20 nt, Mycobacterium avium subsp. paratuberculosis
cgcacuagguccggcgcgac

SEQ ID NO: 954887 - RNA, 21 nt, Mycobacterium avium subsp. paratuberculosis
cgcacuagguccggcgcgacc

SEQ ID NO: 954888 - RNA, 17 nt, Mycobacterium avium subsp. paratuberculosis
cgcacgucccgcccggc

SEQ ID NO: 954889 - RNA, 19 nt, Mycobacterium avium subsp. paratuberculosis
cgcacgucccgcccggcgc

SEQ ID NO: 954890 - RNA, 21 nt, Mycobacterium avium subsp. paratuberculosis
cgcacgucccgcccggcgccg

SEQ ID NO: 954891 - RNA, 16 nt, Mycobacterium avium subsp. paratuberculosis
cgcacgucgaggucgg

SEQ ID NO: 954892 - RNA, 15 nt, Mycobacterium avium subsp. paratuberculosis
cgcacgucgccgccg

SEQ ID NO: 954893 - RNA, 21 nt, Mycobacterium avium subsp. paratuberculosis
cgcacugcuucgggucgccgg

SEQ ID NO: 954894 - RNA, 22 nt, Mycobacterium avium subsp. paratuberculosis
cgcacuggagugcugcagaccg

SEQ ID NO: 954895 - RNA, 18 nt, Mycobacterium avium subsp. paratuberculosis
cgcacguuggcggccagc

SEQ ID NO: 954896 - RNA, 21 nt, Mycobacterium avium subsp. paratuberculosis
cgcacguuggcggccagcgcg

SEQ ID NO: 954897 - RNA, 22 nt, Mycobacterium avium subsp. paratuberculosis
cgcacguuggcggccagcgcgc

SEQ ID NO: 954898 - RNA, 15 nt, Mycobacterium avium subsp. paratuberculosis
cgcacgugcgcgccg

SEQ ID NO: 954899 - RNA, 17 nt, Mycobacterium avium subsp. paratuberculosis
cgcacgugcgcgccgac

SEQ ID NO: 954900 - RNA, 18 nt, Mycobacterium avium subsp. paratuberculosis
cgcacgugcgcgccgacc

SEQ ID NO: 954901 - RNA, 22 nt, Mycobacterium avium subsp. paratuberculosis
cgcacgugcgcgccgaccgcga

SEQ ID NO: 954902 - RNA, 18 nt, Mycobacterium avium subsp. paratuberculosis
cgcacguggcugaccgac

SEQ ID NO: 954903 - RNA, 22 nt, Mycobacterium avium subsp. paratuberculosis
cgcacguggcugaccgacggcg

SEQ ID NO: 954904 - RNA, 23 nt, Mycobacterium avium subsp. paratuberculosis
cgcacguggcugaccgacggcga

SEQ ID NO: 954905 - RNA, 14 nt, Mycobacterium avium subsp. paratuberculosis
cgcacuucgcgggc

SEQ ID NO: 954906 - RNA, 17 nt, Mycobacterium avium subsp. paratuberculosis
cgcacuucgcgggcggc

SEQ ID NO: 954907 - RNA, 18 nt, Mycobacterium avium subsp. paratuberculosis
cgcacuucgcgggcggcg

SEQ ID NO: 954908 - RNA, 19 nt, Mycobacterium avium subsp. paratuberculosis
cgcacuucgcgggcggcgc

SEQ ID NO: 954909 - RNA, 21 nt, Mycobacterium avium subsp. paratuberculosis
cgcaccaccagcucgucgccg

SEQ ID NO: 954910 - RNA, 15 nt, Mycobacterium avium subsp. paratuberculosis
cgcaccaccucggcg

SEQ ID NO: 954911 - RNA, 16 nt, Mycobacterium avium subsp. paratuberculosis
cgcaccaccucggcga

SEQ ID NO: 954912 - RNA, 19 nt, Mycobacterium avium subsp. paratuberculosis
cgcaccaccucuucgugca

SEQ ID NO: 954913 - RNA, 16 nt, Mycobacterium avium subsp. paratuberculosis
cgcaccaccgcgguga

SEQ ID NO: 954914 - RNA, 23 nt, Mycobacterium avium subsp. paratuberculosis
cgcaccaccgcggugagcggccg

SEQ ID NO: 954915 - RNA, 23 nt, Mycobacterium avium subsp. paratuberculosis
cgcaccaccacguugcacggcag

SEQ ID NO: 954916 - RNA, 16 nt, Mycobacterium avium subsp. paratuberculosis
cgcaccaccgcccgga

SEQ ID NO: 954917 - RNA, 15 nt, Mycobacterium avium subsp. paratuberculosis
cgcaccaucaccugu

SEQ ID NO: 954918 - RNA, 13 nt, Mycobacterium avium subsp. paratuberculosis
cgcaccacgcccg

SEQ ID NO: 954919 - RNA, 15 nt, Mycobacterium avium subsp. paratuberculosis
cgcaccacgagcagc

SEQ ID NO: 954920 - RNA, 18 nt, Mycobacterium avium subsp. paratuberculosis
cgcaccacgagcagccga

SEQ ID NO: 954921 - RNA, 23 nt, Mycobacterium avium subsp. paratuberculosis
cgcaccacgagcagccgaucugg

SEQ ID NO: 954922 - RNA, 19 nt, Mycobacterium avium subsp. paratuberculosis
cgcaccacgguggcgccgc

SEQ ID NO: 954923 - RNA, 20 nt, Mycobacterium avium subsp. paratuberculosis
cgcaccacgguggcgccgcg

SEQ ID NO: 954924 - RNA, 22 nt, Mycobacterium avium subsp. paratuberculosis
cgcaccacgguggcgccgcgca

SEQ ID NO: 954925 - RNA, 13 nt, Mycobacterium avium subsp. paratuberculosis
cgcaccacgucgg

SEQ ID NO: 954926 - RNA, 14 nt, Mycobacterium avium subsp. paratuberculosis
cgcaccacgucggg

SEQ ID NO: 954927 - RNA, 20 nt, Mycobacterium avium subsp. paratuberculosis
cgcaccagggugucgucgcg

SEQ ID NO: 954928 - RNA, 13 nt, Mycobacterium avium subsp. paratuberculosis
cgcaaccggucca

SEQ ID NO: 954929 - RNA, 20 nt, Mycobacterium avium subsp. paratuberculosis
cgcaaccgguccaguccggc

SEQ ID NO: 954930 - RNA, 22 nt, Mycobacterium avium subsp. paratuberculosis
cgcaaccgguccaguccggccg

SEQ ID NO: 954931 - RNA, 18 nt, Mycobacterium avium subsp. paratuberculosis
cgcaaccuucuuggccgg

SEQ ID NO: 954932 - RNA, 19 nt, Mycobacterium avium subsp. paratuberculosis
cgcaaccuucuuggccgga

SEQ ID NO: 954933 - RNA, 21 nt, Mycobacterium avium subsp. paratuberculosis
cgcaaccuucuuggccggagc

SEQ ID NO: 954934 - RNA, 18 nt, Mycobacterium avium subsp. paratuberculosis
cgcaaccguucaacggcc

SEQ ID NO: 954935 - RNA, 14 nt, Mycobacterium avium subsp. paratuberculosis
cgcaaccgggccgc

SEQ ID NO: 954936 - RNA, 12 nt, Mycobacterium avium subsp. paratuberculosis
cgcaaccgccgg

SEQ ID NO: 954937 - RNA, 13 nt, Mycobacterium avium subsp. paratuberculosis
cgcaaccgccggc

SEQ ID NO: 954938 - RNA, 16 nt, Mycobacterium avium subsp. paratuberculosis
cgcaaccgccggcagc

SEQ ID NO: 954939 - RNA, 19 nt, Mycobacterium avium subsp. paratuberculosis
cgcaaccgccggcagcggc

SEQ ID NO: 954940 - RNA, 19 nt, Mycobacterium avium subsp. paratuberculosis
cgcaaccgcggcggcggcc

SEQ ID NO: 954941 - RNA, 18 nt, Mycobacterium avium subsp. paratuberculosis
cgcaccgcaaagcaccgc

SEQ ID NO: 954942 - RNA, 12 nt, Mycobacterium avium subsp. paratuberculosis
cgcaccgccacc

SEQ ID NO: 954943 - RNA, 13 nt, Mycobacterium avium subsp. paratuberculosis
cgcaccgccaccg

SEQ ID NO: 954944 - RNA, 15 nt, Mycobacterium avium subsp. paratuberculosis
cgcaccgccaccgcc

SEQ ID NO: 954945 - RNA, 21 nt, Mycobacterium avium subsp. paratuberculosis
cgcaccgccaccgcccgcuga

SEQ ID NO: 954946 - RNA, 14 nt, Mycobacterium avium subsp. paratuberculosis
cgcaccgccagcac

SEQ ID NO: 954947 - RNA, 18 nt, Mycobacterium avium subsp. paratuberculosis
cgcaccgccagcaccgac

SEQ ID NO: 954948 - RNA, 20 nt, Mycobacterium avium subsp. paratuberculosis
cgcaccgccugugcgacggc

SEQ ID NO: 954949 - RNA, 22 nt, Mycobacterium avium subsp. paratuberculosis
cgcaccgccugugcgacggcgu

SEQ ID NO: 954950 - RNA, 13 nt, Mycobacterium avium subsp. paratuberculosis
cgcaccgcgaccg

SEQ ID NO: 954951 - RNA, 15 nt, Mycobacterium avium subsp. paratuberculosis
cgcaccgcgaccguc

SEQ ID NO: 954952 - RNA, 12 nt, Mycobacterium avium subsp. paratuberculosis
cgcaccgcgacg

SEQ ID NO: 954953 - RNA, 14 nt, Mycobacterium avium subsp. paratuberculosis
cgcacccgggcagc

SEQ ID NO: 954954 - RNA, 16 nt, Mycobacterium avium subsp. paratuberculosis
cgcaccgcccgcggug

SEQ ID NO: 954955 - RNA, 15 nt, Mycobacterium avium subsp. paratuberculosis
cgcaccgccgcggga

SEQ ID NO: 954956 - RNA, 18 nt, Mycobacterium avium subsp. paratuberculosis
cgcaccgccgggcauccg

SEQ ID NO: 954957 - RNA, 15 nt, Mycobacterium avium subsp. paratuberculosis
cgcaccgccgucggg

SEQ ID NO: 954958 - RNA, 21 nt, Mycobacterium avium subsp. paratuberculosis
cgcaccgccucaugccagacg

SEQ ID NO: 954959 - RNA, 16 nt, Mycobacterium avium subsp. paratuberculosis
cgcaccgacaucacca

SEQ ID NO: 954960 - RNA, 14 nt, Mycobacterium avium subsp. paratuberculosis
cgcaccgaccagcg

SEQ ID NO: 954961 - RNA, 15 nt, Mycobacterium avium subsp. paratuberculosis
cgcaccgaccagcgg

SEQ ID NO: 954962 - RNA, 17 nt, Mycobacterium avium subsp. paratuberculosis
cgcaccgaccagcggga

SEQ ID NO: 954963 - RNA, 21 nt, Mycobacterium avium subsp. paratuberculosis
cgcacccuugacuaccgcgcc

SEQ ID NO: 954964 - RNA, 22 nt, Mycobacterium avium subsp. paratuberculosis
cgcacccuugacuaccgcgccc

SEQ ID NO: 954965 - RNA, 15 nt, Mycobacterium avium subsp. paratuberculosis
cgcacccggucaggu

SEQ ID NO: 954966 - RNA, 19 nt, Mycobacterium avium subsp. paratuberculosis
cgcacccgguccggcuggu

SEQ ID NO: 954967 - RNA, 21 nt, Mycobacterium avium subsp. paratuberculosis
cgcacccguaacacgaucacc

SEQ ID NO: 954968 - RNA, 16 nt, Mycobacterium avium subsp. paratuberculosis
cgcacccguucggcgu

SEQ ID NO: 954969 - RNA, 18 nt, Mycobacterium avium subsp. paratuberculosis
cgcacccguucggcgucg

SEQ ID NO: 954970 - RNA, 15 nt, Mycobacterium avium subsp. paratuberculosis
cgcacccgcgggucg

SEQ ID NO: 954971 - RNA, 16 nt, Mycobacterium avium subsp. paratuberculosis
cgcacccgcgggucgu

SEQ ID NO: 954972 - RNA, 13 nt, Mycobacterium avium subsp. paratuberculosis
cgcacccgccgcc

SEQ ID NO: 954973 - RNA, 14 nt, Mycobacterium avium subsp. paratuberculosis
cgcacccgccgccc

SEQ ID NO: 954974 - RNA, 20 nt, Mycobacterium avium subsp. paratuberculosis
cgcacccgcgggucgucggg

SEQ ID NO: 954975 - RNA, 21 nt, Mycobacterium avium subsp. paratuberculosis
cgcacccgcgggucgucgggc

SEQ ID NO: 954976 - RNA, 21 nt, Mycobacterium avium subsp. paratuberculosis
cgcacccggccacgccggguu

SEQ ID NO: 954977 - RNA, 20 nt, Mycobacterium avium subsp. paratuberculosis
cgcacccgacacgccgaucg

SEQ ID NO: 954978 - RNA, 14 nt, Mycobacterium avium subsp. paratuberculosis
cgcacccccuccac

SEQ ID NO: 954979 - RNA, 12 nt, Mycobacterium avium subsp. paratuberculosis
cgcaccccgucg

SEQ ID NO: 954980 - RNA, 16 nt, Mycobacterium avium subsp. paratuberculosis
cgcaccccgucgcgga

SEQ ID NO: 954981 - RNA, 12 nt, Mycobacterium avium subsp. paratuberculosis
cgcaccccgugg

SEQ ID NO: 954982 - RNA, 20 nt, Mycobacterium avium subsp. paratuberculosis
cgcaccccguugccgccggc

SEQ ID NO: 954983 - RNA, 14 nt, Mycobacterium avium subsp. paratuberculosis
cgcacccagccgca

SEQ ID NO: 954984 - RNA, 15 nt, Mycobacterium avium subsp. paratuberculosis
cgcacccagccgcau

SEQ ID NO: 954985 - RNA, 16 nt, Mycobacterium avium subsp. paratuberculosis
cgcacccagccgcauu

SEQ ID NO: 954986 - RNA, 17 nt, Mycobacterium avium subsp. paratuberculosis
cgcacccagcgggcgac

SEQ ID NO: 954987 - RNA, 21 nt, Mycobacterium avium subsp. paratuberculosis
cgcacccagcgggcgacgucg

SEQ ID NO: 954988 - RNA, 16 nt, Mycobacterium avium subsp. paratuberculosis
cgcaccaucgcgaugg

SEQ ID NO: 954989 - RNA, 18 nt, Mycobacterium avium subsp. paratuberculosis
cgcaccccacccgcgcga

SEQ ID NO: 954990 - RNA, 16 nt, Mycobacterium avium subsp. paratuberculosis
cgcaccccaccgacag

SEQ ID NO: 954991 - RNA, 17 nt, Mycobacterium avium subsp. paratuberculosis
cgcaccccaccgacagc

SEQ ID NO: 954992 - RNA, 19 nt, Mycobacterium avium subsp. paratuberculosis
cgcaccccaccgacagccg

SEQ ID NO: 954993 - RNA, 19 nt, Mycobacterium avium subsp. paratuberculosis
cgcaccauccgcgacgcca

SEQ ID NO: 954994 - RNA, 16 nt, Mycobacterium avium subsp. paratuberculosis
cgccaauaaagcgggc

SEQ ID NO: 954995 - RNA, 15 nt, Mycobacterium avium subsp. paratuberculosis
cgccaauccggcggg

SEQ ID NO: 954996 - RNA, 20 nt, Mycobacterium avium subsp. paratuberculosis
cgccaauccggcgggccucg

SEQ ID NO: 954997 - RNA, 14 nt, Mycobacterium avium subsp. paratuberculosis
cgccaccaccagcg

SEQ ID NO: 954998 - RNA, 16 nt, Mycobacterium avium subsp. paratuberculosis
cgccaccaccagcggg

SEQ ID NO: 954999 - RNA, 16 nt, Mycobacterium avium subsp. paratuberculosis
cgccaccacccggcga

SEQ ID NO: 955000 - RNA, 18 nt, Mycobacterium avium subsp. paratuberculosis
cgccaccacccggcgauu

SEQ ID NO: 955001 - RNA, 14 nt, Mycobacterium avium subsp. paratuberculosis
cgccaccaccgcgc

SEQ ID NO: 955002 - RNA, 18 nt, Mycobacterium avium subsp. paratuberculosis
cgccaccaccacggggcg

SEQ ID NO: 955003 - RNA, 22 nt, Mycobacterium avium subsp. paratuberculosis
cgccaccaccacggggcggguc

SEQ ID NO: 955004 - RNA, 23 nt, Mycobacterium avium subsp. paratuberculosis
cgccaccaccacggggcgggucg

SEQ ID NO: 955005 - RNA, 21 nt, Mycobacterium avium subsp. paratuberculosis
cgccaacugaauuccuggccg

SEQ ID NO: 955006 - RNA, 23 nt, Mycobacterium avium subsp. paratuberculosis
cgccaacugaauuccuggccggu

SEQ ID NO: 955007 - RNA, 19 nt, Mycobacterium avium subsp. paratuberculosis
cgccaacugguccugcggc

SEQ ID NO: 955008 - RNA, 21 nt, Mycobacterium avium subsp. paratuberculosis
cgccaacugguccugcggcug

SEQ ID NO: 955009 - RNA, 20 nt, Mycobacterium avium subsp. paratuberculosis
cgccaagaagugggccauca

SEQ ID NO: 955010 - RNA, 15 nt, Mycobacterium avium subsp. paratuberculosis
cgccaaggcgcugug

SEQ ID NO: 955011 - RNA, 14 nt, Mycobacterium avium subsp. paratuberculosis
cgccaagugcggug

SEQ ID NO: 955012 - RNA, 16 nt, Mycobacterium avium subsp. paratuberculosis
cgccaagugcggugug

SEQ ID NO: 955013 - RNA, 22 nt, Mycobacterium avium subsp. paratuberculosis
cgccaagugcgguguggccgcg

SEQ ID NO: 955014 - RNA, 19 nt, Mycobacterium avium subsp. paratuberculosis
cgcauuggugccggccucg

SEQ ID NO: 955015 - RNA, 23 nt, Mycobacterium avium subsp. paratuberculosis
cgcauuggugccggccucgucgg

SEQ ID NO: 955016 - RNA, 13 nt, Mycobacterium avium subsp. paratuberculosis
cgcauucggcgac

SEQ ID NO: 955017 - RNA, 14 nt, Mycobacterium avium subsp. paratuberculosis
cgcauucggcgacg

SEQ ID NO: 955018 - RNA, 21 nt, Mycobacterium avium subsp. paratuberculosis
cgcauucggcgacgcucaggc

SEQ ID NO: 955019 - RNA, 16 nt, Mycobacterium avium subsp. paratuberculosis
cgcagguccggcagcg

SEQ ID NO: 955020 - RNA, 21 nt, Mycobacterium avium subsp. paratuberculosis
cgcagguccggcagcgcgccc

SEQ ID NO: 955021 - RNA, 13 nt, Mycobacterium avium subsp. paratuberculosis
cgcagguccaccc

SEQ ID NO: 955022 - RNA, 13 nt, Mycobacterium avium subsp. paratuberculosis
cgcaggucgaugg

SEQ ID NO: 955023 - RNA, 15 nt, Mycobacterium avium subsp. paratuberculosis
cgcagguagccgccg

SEQ ID NO: 955024 - RNA, 18 nt, Mycobacterium avium subsp. paratuberculosis
cgcagguagccgccguag

SEQ ID NO: 955025 - RNA, 15 nt, Mycobacterium avium subsp. paratuberculosis
cgcagguacgcggcg

SEQ ID NO: 955026 - RNA, 16 nt, Mycobacterium avium subsp. paratuberculosis
cgcagguacgcggcgu

SEQ ID NO: 955027 - RNA, 17 nt, Mycobacterium avium subsp. paratuberculosis
cgcagguacgcggcguu

SEQ ID NO: 955028 - RNA, 19 nt, Mycobacterium avium subsp. paratuberculosis
cgcaggguggccagcaccg

SEQ ID NO: 955029 - RNA, 17 nt, Mycobacterium avium subsp. paratuberculosis
cgccacgccguggcccg

SEQ ID NO: 955030 - RNA, 18 nt, Mycobacterium avium subsp. paratuberculosis
cgccacgcccgcagcgca

SEQ ID NO: 955031 - RNA, 13 nt, Mycobacterium avium subsp. paratuberculosis
cgccacgcggcgc

SEQ ID NO: 955032 - RNA, 22 nt, Mycobacterium avium subsp. paratuberculosis
cgccacgcggcgcgcaucgucg

SEQ ID NO: 955033 - RNA, 17 nt, Mycobacterium avium subsp. paratuberculosis
cgccacgcgcagggcga

SEQ ID NO: 955034 - RNA, 20 nt, Mycobacterium avium subsp. paratuberculosis
cgccacgcucaugcccgcca

SEQ ID NO: 955035 - RNA, 13 nt, Mycobacterium avium subsp. paratuberculosis
cgccacgcuggcg

SEQ ID NO: 955036 - RNA, 13 nt, Mycobacterium avium subsp. paratuberculosis
cgccacgcuggug

SEQ ID NO: 955037 - RNA, 14 nt, Mycobacterium avium subsp. paratuberculosis
cgccacgcgucagg

SEQ ID NO: 955038 - RNA, 19 nt, Mycobacterium avium subsp. paratuberculosis
cgccacgcgucaggcgucg

SEQ ID NO: 955039 - RNA, 20 nt, Mycobacterium avium subsp. paratuberculosis
cgccacgcgucaggcgucgu

SEQ ID NO: 955040 - RNA, 13 nt, Mycobacterium avium subsp. paratuberculosis
cgccacggcacgu

SEQ ID NO: 955041 - RNA, 15 nt, Mycobacterium avium subsp. paratuberculosis
cgccacggcacgucg

SEQ ID NO: 955042 - RNA, 18 nt, Mycobacterium avium subsp. paratuberculosis
cgccacggcacgucgagg

SEQ ID NO: 955043 - RNA, 14 nt, Mycobacterium avium subsp. paratuberculosis
cgccacggccggca

SEQ ID NO: 955044 - RNA, 15 nt, Mycobacterium avium subsp. paratuberculosis
cgccacggccggcag

SEQ ID NO: 955045 - RNA, 17 nt, Mycobacterium avium subsp. paratuberculosis
cgccacggccggcagca

SEQ ID NO: 955046 - RNA, 20 nt, Mycobacterium avium subsp. paratuberculosis
cgccacggccggcagcaucg

SEQ ID NO: 955047 - RNA, 13 nt, Mycobacterium avium subsp. paratuberculosis
cgccacggcgaac

SEQ ID NO: 955048 - RNA, 22 nt, Mycobacterium avium subsp. paratuberculosis
cgccacggcgaacaccucggga

SEQ ID NO: 955049 - RNA, 12 nt, Mycobacterium avium subsp. paratuberculosis
cgccacggcgac

SEQ ID NO: 955050 - RNA, 13 nt, Mycobacterium avium subsp. paratuberculosis
cgccacggcgacg

SEQ ID NO: 955051 - RNA, 14 nt, Mycobacterium avium subsp. paratuberculosis
cgccacggcgacga

SEQ ID NO: 955052 - RNA, 15 nt, Mycobacterium avium subsp. paratuberculosis
cgccacggcgacgac

SEQ ID NO: 955053 - RNA, 19 nt, Mycobacterium avium subsp. paratuberculosis
cgccacggcgacgaccacc

SEQ ID NO: 955054 - RNA, 13 nt, Mycobacterium avium subsp. paratuberculosis
cgccacggcggcc

SEQ ID NO: 955055 - RNA, 14 nt, Mycobacterium avium subsp. paratuberculosis
cgccacggcggccg

SEQ ID NO: 955056 - RNA, 16 nt, Mycobacterium avium subsp. paratuberculosis
cgccacggcggccgaa

SEQ ID NO: 955057 - RNA, 15 nt, Mycobacterium avium subsp. paratuberculosis
cgccacggcgggguc

SEQ ID NO: 955058 - RNA, 16 nt, Mycobacterium avium subsp. paratuberculosis
cgccacggcgggguca

SEQ ID NO: 955059 - RNA, 16 nt, Mycobacterium avium subsp. paratuberculosis
cgccacggcggugucg

SEQ ID NO: 955060 - RNA, 17 nt, Mycobacterium avium subsp. paratuberculosis
cgccacggcggugucgg

SEQ ID NO: 955061 - RNA, 18 nt, Mycobacterium avium subsp. paratuberculosis
cgccacggcggugucggc

SEQ ID NO: 955062 - RNA, 18 nt, Mycobacterium avium subsp. paratuberculosis
cgccacgacugcgcggcc

SEQ ID NO: 955063 - RNA, 20 nt, Mycobacterium avium subsp. paratuberculosis
cgccacgacugcgcggccgg

SEQ ID NO: 955064 - RNA, 23 nt, Mycobacterium avium subsp. paratuberculosis
cgccacgacugcgcggccggcgu

SEQ ID NO: 955065 - RNA, 13 nt, Mycobacterium avium subsp. paratuberculosis
cgccacgaucacc

SEQ ID NO: 955066 - RNA, 14 nt, Mycobacterium avium subsp. paratuberculosis
cgccacgaucacca

SEQ ID NO: 955067 - RNA, 23 nt, Mycobacterium avium subsp. paratuberculosis
cgccacgaucaccaccaccgccg

SEQ ID NO: 955068 - RNA, 18 nt, Mycobacterium avium subsp. paratuberculosis
cgccaccuggaagcgcau

SEQ ID NO: 955069 - RNA, 14 nt, Mycobacterium avium subsp. paratuberculosis
cgccaccuucaccg

SEQ ID NO: 955070 - RNA, 17 nt, Mycobacterium avium subsp. paratuberculosis
cgccaccuucaccgcgc

SEQ ID NO: 955071 - RNA, 21 nt, Mycobacterium avium subsp. paratuberculosis
cgccacgacauccccgcaaac

SEQ ID NO: 955072 - RNA, 13 nt, Mycobacterium avium subsp. paratuberculosis
cgccacgaccagc

SEQ ID NO: 955073 - RNA, 14 nt, Mycobacterium avium subsp. paratuberculosis
cgccacgacgcggc

SEQ ID NO: 955074 - RNA, 18 nt, Mycobacterium avium subsp. paratuberculosis
cgccacgacgcggcgauc

SEQ ID NO: 955075 - RNA, 12 nt, Mycobacterium avium subsp. paratuberculosis
cgccacgccgac

SEQ ID NO: 955076 - RNA, 13 nt, Mycobacterium avium subsp. paratuberculosis
cgccacgccgacc

SEQ ID NO: 955077 - RNA, 15 nt, Mycobacterium avium subsp. paratuberculosis
cgccacgccgaccag

SEQ ID NO: 955078 - RNA, 20 nt, Mycobacterium avium subsp. paratuberculosis
cgccacgccgcccccgccgc

SEQ ID NO: 955079 - RNA, 13 nt, Mycobacterium avium subsp. paratuberculosis
cgccacgccgcga

SEQ ID NO: 955080 - RNA, 17 nt, Mycobacterium avium subsp. paratuberculosis
cgccacgccgcgauccg

SEQ ID NO: 955081 - RNA, 14 nt, Mycobacterium avium subsp. paratuberculosis
cgccacgcacaccg

SEQ ID NO: 955082 - RNA, 16 nt, Mycobacterium avium subsp. paratuberculosis
cgccacgccccggcgc

SEQ ID NO: 955083 - RNA, 17 nt, Mycobacterium avium subsp. paratuberculosis
cgccacgccccggcgcc

SEQ ID NO: 955084 - RNA, 18 nt, Mycobacterium avium subsp. paratuberculosis
cgccacgccccggcgccg

SEQ ID NO: 955085 - RNA, 22 nt, Mycobacterium avium subsp. paratuberculosis
cgccaccagaucguguccgcgc

SEQ ID NO: 955086 - RNA, 13 nt, Mycobacterium avium subsp. paratuberculosis
cgccaccagcacc

SEQ ID NO: 955087 - RNA, 14 nt, Mycobacterium avium subsp. paratuberculosis
cgccaccagcaccg

SEQ ID NO: 955088 - RNA, 14 nt, Mycobacterium avium subsp. paratuberculosis
cgccaccacggcgc

SEQ ID NO: 955089 - RNA, 15 nt, Mycobacterium avium subsp. paratuberculosis
cgccaccacggcgcc

SEQ ID NO: 955090 - RNA, 14 nt, Mycobacterium avium subsp. paratuberculosis
cgccaccacggcgu

SEQ ID NO: 955091 - RNA, 17 nt, Mycobacterium avium subsp. paratuberculosis
cgccaccaccuccucgc

SEQ ID NO: 955092 - RNA, 20 nt, Mycobacterium avium subsp. paratuberculosis
cgccaccaccuucaucgccg

SEQ ID NO: 955093 - RNA, 12 nt, Mycobacterium avium subsp. paratuberculosis
cgccaccagcag

SEQ ID NO: 955094 - RNA, 14 nt, Mycobacterium avium subsp. paratuberculosis
cgccaccagccaca

SEQ ID NO: 955095 - RNA, 22 nt, Mycobacterium avium subsp. paratuberculosis
cgccaccagccacaccgccgcg

SEQ ID NO: 955096 - RNA, 23 nt, Mycobacterium avium subsp. paratuberculosis
cgccaccagccacaccgccgcgg

SEQ ID NO: 955097 - RNA, 14 nt, Mycobacterium avium subsp. paratuberculosis
cgccaccagcaggc

SEQ ID NO: 955098 - RNA, 16 nt, Mycobacterium avium subsp. paratuberculosis
cgccaccagcaggccc

SEQ ID NO: 955099 - RNA, 19 nt, Mycobacterium avium subsp. paratuberculosis
cgccaccagcaggcccaac

SEQ ID NO: 955100 - RNA, 22 nt, Mycobacterium avium subsp. paratuberculosis
cgccaccagcaggcccaacgug

SEQ ID NO: 955101 - RNA, 23 nt, Mycobacterium avium subsp. paratuberculosis
cgccaccagcaggcccaacguga

SEQ ID NO: 955102 - RNA, 21 nt, Mycobacterium avium subsp. paratuberculosis
cgccaccaggccgugguuggc

SEQ ID NO: 955103 - RNA, 17 nt, Mycobacterium avium subsp. paratuberculosis
cgccaccaggcgguccg

SEQ ID NO: 955104 - RNA, 13 nt, Mycobacterium avium subsp. paratuberculosis
cgccaccaggcug

SEQ ID NO: 955105 - RNA, 13 nt, Mycobacterium avium subsp. paratuberculosis
cgccaccagcgca

SEQ ID NO: 955106 - RNA, 14 nt, Mycobacterium avium subsp. paratuberculosis
cgccaccgucgccg

SEQ ID NO: 955107 - RNA, 19 nt, Mycobacterium avium subsp. paratuberculosis
cgccaccgucgccggcuga

SEQ ID NO: 955108 - RNA, 13 nt, Mycobacterium avium subsp. paratuberculosis
cgccaccgucguc

SEQ ID NO: 955109 - RNA, 15 nt, Mycobacterium avium subsp. paratuberculosis
cgccaccgucgucga

SEQ ID NO: 955110 - RNA, 19 nt, Mycobacterium avium subsp. paratuberculosis
cgccaccuccuccgguccg

SEQ ID NO: 955111 - RNA, 14 nt, Mycobacterium avium subsp. paratuberculosis
cgccaccucgagcu

SEQ ID NO: 955112 - RNA, 16 nt, Mycobacterium avium subsp. paratuberculosis
cgccaccucggagaug

SEQ ID NO: 955113 - RNA, 17 nt, Mycobacterium avium subsp. paratuberculosis
cgccaccucggagauga

SEQ ID NO: 955114 - RNA, 23 nt, Mycobacterium avium subsp. paratuberculosis
cgccaccucggagaugauggccg

SEQ ID NO: 955115 - RNA, 15 nt, Mycobacterium avium subsp. paratuberculosis
cgccaccccaggcga

SEQ ID NO: 955116 - RNA, 18 nt, Mycobacterium avium subsp. paratuberculosis
cgccaccccaggcgaugc

SEQ ID NO: 955117 - RNA, 13 nt, Mycobacterium avium subsp. paratuberculosis
cgccaccggccgg

SEQ ID NO: 955118 - RNA, 17 nt, Mycobacterium avium subsp. paratuberculosis
cgccaccggccgguccg

SEQ ID NO: 955119 - RNA, 13 nt, Mycobacterium avium subsp. paratuberculosis
cgccaccggcccg

SEQ ID NO: 955120 - RNA, 17 nt, Mycobacterium avium subsp. paratuberculosis
cgccaccggcccggccg

SEQ ID NO: 955121 - RNA, 19 nt, Mycobacterium avium subsp. paratuberculosis
cgccaccggcccggccggc

SEQ ID NO: 955122 - RNA, 12 nt, Mycobacterium avium subsp. paratuberculosis
cgccaccggccg

SEQ ID NO: 955123 - RNA, 22 nt, Mycobacterium avium subsp. paratuberculosis
cgccaccccgaacccggccagc

SEQ ID NO: 955124 - RNA, 12 nt, Mycobacterium avium subsp. paratuberculosis
cgccaccggcug

SEQ ID NO: 955125 - RNA, 14 nt, Mycobacterium avium subsp. paratuberculosis
cgccaccggcuggc

SEQ ID NO: 955126 - RNA, 13 nt, Mycobacterium avium subsp. paratuberculosis
cgccaccgggacc

SEQ ID NO: 955127 - RNA, 20 nt, Mycobacterium avium subsp. paratuberculosis
cgccaccgggaccugcugcu

SEQ ID NO: 955128 - RNA, 19 nt, Mycobacterium avium subsp. paratuberculosis
cgccagcacgugaugcagc

SEQ ID NO: 955129 - RNA, 20 nt, Mycobacterium avium subsp. paratuberculosis
cgccagcacguggccgggcu

SEQ ID NO: 955130 - RNA, 22 nt, Mycobacterium avium subsp. paratuberculosis
cgccagcacguggccgggcucg

SEQ ID NO: 955131 - RNA, 16 nt, Mycobacterium avium subsp. paratuberculosis
cgccagcaccggcgcg

SEQ ID NO: 955132 - RNA, 22 nt, Mycobacterium avium subsp. paratuberculosis
cgccagcaccgggcccagcucg

SEQ ID NO: 955133 - RNA, 13 nt, Mycobacterium avium subsp. paratuberculosis
cgccagcaccgac

SEQ ID NO: 955134 - RNA, 16 nt, Mycobacterium avium subsp. paratuberculosis
cgccagcaccgacagc

SEQ ID NO: 955135 - RNA, 18 nt, Mycobacterium avium subsp. paratuberculosis
cgccagcaccgacagucc

SEQ ID NO: 955136 - RNA, 15 nt, Mycobacterium avium subsp. paratuberculosis
cgccagcaccgacgc

SEQ ID NO: 955137 - RNA, 16 nt, Mycobacterium avium subsp. paratuberculosis
cgccagcaccgacgcg

SEQ ID NO: 955138 - RNA, 16 nt, Mycobacterium avium subsp. paratuberculosis
cgccagcaccgccacc

SEQ ID NO: 955139 - RNA, 17 nt, Mycobacterium avium subsp. paratuberculosis
cgccagcaccgccaccg

SEQ ID NO: 955140 - RNA, 20 nt, Mycobacterium avium subsp. paratuberculosis
cgccagcaccgccaccggcc

SEQ ID NO: 955141 - RNA, 22 nt, Mycobacterium avium subsp. paratuberculosis
cgccagcaccgccaccggcccg

SEQ ID NO: 955142 - RNA, 14 nt, Mycobacterium avium subsp. paratuberculosis
cgccagcaccgccu

SEQ ID NO: 955143 - RNA, 23 nt, Mycobacterium avium subsp. paratuberculosis
cgccagcaccgccugggucucgg

SEQ ID NO: 955144 - RNA, 16 nt, Mycobacterium avium subsp. paratuberculosis
cgccagcaccgcgggg

SEQ ID NO: 955145 - RNA, 23 nt, Mycobacterium avium subsp. paratuberculosis
cgccagcaccgcgggggcggccg

SEQ ID NO: 955146 - RNA, 16 nt, Mycobacterium avium subsp. paratuberculosis
cgccagcaccucgaac

SEQ ID NO: 955147 - RNA, 21 nt, Mycobacterium avium subsp. paratuberculosis
cgccagcaccucgaacgccgg

SEQ ID NO: 955148 - RNA, 15 nt, Mycobacterium avium subsp. paratuberculosis
cgccagcaccucgcg

SEQ ID NO: 955149 - RNA, 19 nt, Mycobacterium avium subsp. paratuberculosis
cgccagcaccucgcggcag

SEQ ID NO: 955150 - RNA, 15 nt, Mycobacterium avium subsp. paratuberculosis
cgccagcaccucggc

SEQ ID NO: 955151 - RNA, 17 nt, Mycobacterium avium subsp. paratuberculosis
cgccagcaccucggcga

SEQ ID NO: 955152 - RNA, 18 nt, Mycobacterium avium subsp. paratuberculosis
cgccagcaccucggcgac

SEQ ID NO: 955153 - RNA, 20 nt, Mycobacterium avium subsp. paratuberculosis
cgccagcaccuucgggccga

SEQ ID NO: 955154 - RNA, 14 nt, Mycobacterium avium subsp. paratuberculosis
cgccagcagcgccg

SEQ ID NO: 955155 - RNA, 15 nt, Mycobacterium avium subsp. paratuberculosis
cgccagcagcgccgc

SEQ ID NO: 955156 - RNA, 16 nt, Mycobacterium avium subsp. paratuberculosis
cgccagcagcgccgcu

SEQ ID NO: 955157 - RNA, 20 nt, Mycobacterium avium subsp. paratuberculosis
cgccagcagcgcgccgcgcu

SEQ ID NO: 955158 - RNA, 12 nt, Mycobacterium avium subsp. paratuberculosis
cgccagcagcgc

SEQ ID NO: 955159 - RNA, 13 nt, Mycobacterium avium subsp. paratuberculosis
cgccagcagcgca

SEQ ID NO: 955160 - RNA, 13 nt, Mycobacterium avium subsp. paratuberculosis
cgccagcagcgcc

SEQ ID NO: 955161 - RNA, 11 nt, Mycobacterium avium subsp. paratuberculosis
cgccagcagcc

SEQ ID NO: 955162 - RNA, 15 nt, Mycobacterium avium subsp. paratuberculosis
cgccagcagcagcgc

SEQ ID NO: 955163 - RNA, 17 nt, Mycobacterium avium subsp. paratuberculosis
cgccagcagcagcgccg

SEQ ID NO: 955164 - RNA, 18 nt, Mycobacterium avium subsp. paratuberculosis
cgccagcagcagcgccgc

SEQ ID NO: 955165 - RNA, 19 nt, Mycobacterium avium subsp. paratuberculosis
cgccagcagcagcgccgcc

SEQ ID NO: 955166 - RNA, 20 nt, Mycobacterium avium subsp. paratuberculosis
cgccagcagcagcgccgcca

SEQ ID NO: 955167 - RNA, 17 nt, Mycobacterium avium subsp. paratuberculosis
cgccagcagcagcgcgg

SEQ ID NO: 955168 - RNA, 16 nt, Mycobacterium avium subsp. paratuberculosis
cgccagcagaugccgc

SEQ ID NO: 955169 - RNA, 20 nt, Mycobacterium avium subsp. paratuberculosis
cgccagcagaugccgcccag

SEQ ID NO: 955170 - RNA, 18 nt, Mycobacterium avium subsp. paratuberculosis
cgccagcagcaacgcggu

SEQ ID NO: 955171 - RNA, 14 nt, Mycobacterium avium subsp. paratuberculosis
cgccagcagcaccu

SEQ ID NO: 955172 - RNA, 13 nt, Mycobacterium avium subsp. paratuberculosis
cgccagcagcacg

SEQ ID NO: 955173 - RNA, 16 nt, Mycobacterium avium subsp. paratuberculosis
cgccagcagcacggca

SEQ ID NO: 955174 - RNA, 15 nt, Mycobacterium avium subsp. paratuberculosis
cgccagcagcagccg

SEQ ID NO: 955175 - RNA, 14 nt, Mycobacterium avium subsp. paratuberculosis
cgccagcagcagcg

SEQ ID NO: 955176 - RNA, 17 nt, Mycobacterium avium subsp. paratuberculosis
cgccagcauccgcuggu

SEQ ID NO: 955177 - RNA, 18 nt, Mycobacterium avium subsp. paratuberculosis
cgccagcauccgcuggug

SEQ ID NO: 955178 - RNA, 18 nt, Mycobacterium avium subsp. paratuberculosis
cgccagcaugaucaccgc

SEQ ID NO: 955179 - RNA, 20 nt, Mycobacterium avium subsp. paratuberculosis
cgccagcaugaucaccgcca

SEQ ID NO: 955180 - RNA, 19 nt, Mycobacterium avium subsp. paratuberculosis
cgccagcagccgcagcagu

SEQ ID NO: 955181 - RNA, 17 nt, Mycobacterium avium subsp. paratuberculosis
cgccagcagcggcaccc

SEQ ID NO: 955182 - RNA, 23 nt, Mycobacterium avium subsp. paratuberculosis
cgccagcagcggcacccgguccg

SEQ ID NO: 955183 - RNA, 15 nt, Mycobacterium avium subsp. paratuberculosis
cgccagcgacggccg

SEQ ID NO: 955184 - RNA, 17 nt, Mycobacterium avium subsp. paratuberculosis
cgccagcgacggccggg

SEQ ID NO: 955185 - RNA, 18 nt, Mycobacterium avium subsp. paratuberculosis
cgccagcgacggccgggu

SEQ ID NO: 955186 - RNA, 12 nt, Mycobacterium avium subsp. paratuberculosis
cgccagcgaccg

SEQ ID NO: 955187 - RNA, 14 nt, Mycobacterium avium subsp. paratuberculosis
cgccagcgaccgca

SEQ ID NO: 955188 - RNA, 15 nt, Mycobacterium avium subsp. paratuberculosis
cgccagcgaccgcag

SEQ ID NO: 955189 - RNA, 15 nt, Mycobacterium avium subsp. paratuberculosis
cgccagcgcaccgag

SEQ ID NO: 955190 - RNA, 19 nt, Mycobacterium avium subsp. paratuberculosis
cgccagcgcaccgagcccg

SEQ ID NO: 955191 - RNA, 12 nt, Mycobacterium avium subsp. paratuberculosis
cgccagccgggu

SEQ ID NO: 955192 - RNA, 13 nt, Mycobacterium avium subsp. paratuberculosis
cgccagccgggug

SEQ ID NO: 955193 - RNA, 14 nt, Mycobacterium avium subsp. paratuberculosis
cgccagccgggugg

SEQ ID NO: 955194 - RNA, 19 nt, Mycobacterium avium subsp. paratuberculosis
cgccagccggguggcccgc

SEQ ID NO: 955195 - RNA, 20 nt, Mycobacterium avium subsp. paratuberculosis
cgccagccggguggcccgcg

SEQ ID NO: 955196 - RNA, 23 nt, Mycobacterium avium subsp. paratuberculosis
cgccagccggguggcccgcgcgc

SEQ ID NO: 955197 - RNA, 23 nt, Mycobacterium avium subsp. paratuberculosis
cgccagccgguacggaucgccgg

SEQ ID NO: 955198 - RNA, 12 nt, Mycobacterium avium subsp. paratuberculosis
cgccagccgucc

SEQ ID NO: 955199 - RNA, 16 nt, Mycobacterium avium subsp. paratuberculosis
cgccagccguccuggu

SEQ ID NO: 955200 - RNA, 18 nt, Mycobacterium avium subsp. paratuberculosis
cgccagccguccuggucg

SEQ ID NO: 955201 - RNA, 13 nt, Mycobacterium avium subsp. paratuberculosis
cgccagccgucgc

SEQ ID NO: 955202 - RNA, 15 nt, Mycobacterium avium subsp. paratuberculosis
cgccagccgucgccg

SEQ ID NO: 955203 - RNA, 20 nt, Mycobacterium avium subsp. paratuberculosis
cgccagccgucgccgcgccc

SEQ ID NO: 955204 - RNA, 17 nt, Mycobacterium avium subsp. paratuberculosis
cgccagccgcaccgcga

SEQ ID NO: 955205 - RNA, 18 nt, Mycobacterium avium subsp. paratuberculosis
cgccagccgcaccgcgac

SEQ ID NO: 955206 - RNA, 19 nt, Mycobacterium avium subsp. paratuberculosis
cgccagccgcaccgcgacc

SEQ ID NO: 955207 - RNA, 20 nt, Mycobacterium avium subsp. paratuberculosis
cgccagccgcaccgcgaccg

SEQ ID NO: 955208 - RNA, 18 nt, Mycobacterium avium subsp. paratuberculosis
cgccagccgcagcaggca

SEQ ID NO: 955209 - RNA, 15 nt, Mycobacterium avium subsp. paratuberculosis
cgccagccgccgccg

SEQ ID NO: 955210 - RNA, 16 nt, Mycobacterium avium subsp. paratuberculosis
cgccagccgccgccga

SEQ ID NO: 955211 - RNA, 21 nt, Mycobacterium avium subsp. paratuberculosis
cgccagccgccgccgaccaca

SEQ ID NO: 955212 - RNA, 16 nt, Mycobacterium avium subsp. paratuberculosis
cgccagccgccggcuc

SEQ ID NO: 955213 - RNA, 13 nt, Mycobacterium avium subsp. paratuberculosis
cgccagcccggcg

SEQ ID NO: 955214 - RNA, 16 nt, Mycobacterium avium subsp. paratuberculosis
cgccagcccggcguac

SEQ ID NO: 955215 - RNA, 13 nt, Mycobacterium avium subsp. paratuberculosis
cgccagcccggug

SEQ ID NO: 955216 - RNA, 14 nt, Mycobacterium avium subsp. paratuberculosis
cgccagcccgguga

SEQ ID NO: 955217 - RNA, 13 nt, Mycobacterium avium subsp. paratuberculosis
cgccagcccgccc

SEQ ID NO: 955218 - RNA, 17 nt, Mycobacterium avium subsp. paratuberculosis
cgccagcccgcccagcg

SEQ ID NO: 955219 - RNA, 19 nt, Mycobacterium avium subsp. paratuberculosis
cgccagcccgcccagcgcc

SEQ ID NO: 955220 - RNA, 22 nt, Mycobacterium avium subsp. paratuberculosis
cgccagccagccggugcggucg

SEQ ID NO: 955221 - RNA, 16 nt, Mycobacterium avium subsp. paratuberculosis
cgccagccccaccggc

SEQ ID NO: 955222 - RNA, 18 nt, Mycobacterium avium subsp. paratuberculosis
cgccagccccaccggcca

SEQ ID NO: 955223 - RNA, 14 nt, Mycobacterium avium subsp. paratuberculosis
cgccagccaggcga

SEQ ID NO: 955224 - RNA, 13 nt, Mycobacterium avium subsp. paratuberculosis
cgccacgguggcg

SEQ ID NO: 955225 - RNA, 18 nt, Mycobacterium avium subsp. paratuberculosis
cgccacgguggcggucag

SEQ ID NO: 955226 - RNA, 17 nt, Mycobacterium avium subsp. paratuberculosis
cgccacggccagcaccg

SEQ ID NO: 955227 - RNA, 16 nt, Mycobacterium avium subsp. paratuberculosis
cgccacggggcccgcg

SEQ ID NO: 955228 - RNA, 19 nt, Mycobacterium avium subsp. paratuberculosis
cgccacggggcccgcgacc

SEQ ID NO: 955229 - RNA, 15 nt, Mycobacterium avium subsp. paratuberculosis
cgccacggggcgccg

SEQ ID NO: 955230 - RNA, 20 nt, Mycobacterium avium subsp. paratuberculosis
cgccacggggcgccgcugcg

SEQ ID NO: 955231 - RNA, 21 nt, Mycobacterium avium subsp. paratuberculosis
cgccacggggcgccgcugcgg

SEQ ID NO: 955232 - RNA, 22 nt, Mycobacterium avium subsp. paratuberculosis
cgccacggggcgccgcugcggg

SEQ ID NO: 955233 - RNA, 19 nt, Mycobacterium avium subsp. paratuberculosis
cgccacggggcugcgggcc

SEQ ID NO: 955234 - RNA, 20 nt, Mycobacterium avium subsp. paratuberculosis
cgccacggggcugcgggcca

SEQ ID NO: 955235 - RNA, 13 nt, Mycobacterium avium subsp. paratuberculosis
cgccacucgggcg

SEQ ID NO: 955236 - RNA, 19 nt, Mycobacterium avium subsp. paratuberculosis
cgccacucgggcggccgcg

SEQ ID NO: 955237 - RNA, 21 nt, Mycobacterium avium subsp. paratuberculosis
cgccacucgggcggccgcgga

SEQ ID NO: 955238 - RNA, 15 nt, Mycobacterium avium subsp. paratuberculosis
cgccacucgucgacg

SEQ ID NO: 955239 - RNA, 16 nt, Mycobacterium avium subsp. paratuberculosis
cgccacucgucgacgu

SEQ ID NO: 955240 - RNA, 16 nt, Mycobacterium avium subsp. paratuberculosis
cgccacguccggaugc

SEQ ID NO: 955241 - RNA, 21 nt, Mycobacterium avium subsp. paratuberculosis
cgccacgucgaacccgacccc

SEQ ID NO: 955242 - RNA, 23 nt, Mycobacterium avium subsp. paratuberculosis
cgccacgucguucaugaucggca

SEQ ID NO: 955243 - RNA, 16 nt, Mycobacterium avium subsp. paratuberculosis
cgccacgugcggcugc

SEQ ID NO: 955244 - RNA, 17 nt, Mycobacterium avium subsp. paratuberculosis
cgccacgugcggcugcg

SEQ ID NO: 955245 - RNA, 16 nt, Mycobacterium avium subsp. paratuberculosis
cgccacguggucgagc

SEQ ID NO: 955246 - RNA, 24 nt, Mycobacterium avium subsp. paratuberculosis
cgccacguggucgagcaugcgggu

SEQ ID NO: 955247 - RNA, 14 nt, Mycobacterium avium subsp. paratuberculosis
cgccacuggcuggu

SEQ ID NO: 955248 - RNA, 15 nt, Mycobacterium avium subsp. paratuberculosis
cgccacuggcugguc

SEQ ID NO: 955249 - RNA, 20 nt, Mycobacterium avium subsp. paratuberculosis
cgccacuggcuggucaccca

SEQ ID NO: 955250 - RNA, 12 nt, Mycobacterium avium subsp. paratuberculosis
cgccacugggcg

SEQ ID NO: 955251 - RNA, 15 nt, Mycobacterium avium subsp. paratuberculosis
cgccacugggcgucg

SEQ ID NO: 955252 - RNA, 17 nt, Mycobacterium avium subsp. paratuberculosis
cgccacugggcgucggc

SEQ ID NO: 955253 - RNA, 19 nt, Mycobacterium avium subsp. paratuberculosis
cgccacugggcgucggcgc

SEQ ID NO: 955254 - RNA, 20 nt, Mycobacterium avium subsp. paratuberculosis
cgccacugggcgucggcgcc

SEQ ID NO: 955255 - RNA, 13 nt, Mycobacterium avium subsp. paratuberculosis
cgccacugccgcc

SEQ ID NO: 955256 - RNA, 16 nt, Mycobacterium avium subsp. paratuberculosis
cgccacugccgccgcc

SEQ ID NO: 955257 - RNA, 17 nt, Mycobacterium avium subsp. paratuberculosis
cgccacugccgccgccc

SEQ ID NO: 955258 - RNA, 20 nt, Mycobacterium avium subsp. paratuberculosis
cgccacuucuccacgccgac

SEQ ID NO: 955259 - RNA, 13 nt, Mycobacterium avium subsp. paratuberculosis
cgccagaucccgc

SEQ ID NO: 955260 - RNA, 18 nt, Mycobacterium avium subsp. paratuberculosis
cgccagcaacacccagcc

SEQ ID NO: 955261 - RNA, 19 nt, Mycobacterium avium subsp. paratuberculosis
cgccagcaaccccgcggug

SEQ ID NO: 955262 - RNA, 21 nt, Mycobacterium avium subsp. paratuberculosis
cgccagcaaccccgcggugca

SEQ ID NO: 955263 - RNA, 17 nt, Mycobacterium avium subsp. paratuberculosis
cgccagaucgccaucag

SEQ ID NO: 955264 - RNA, 20 nt, Mycobacterium avium subsp. paratuberculosis
cgccagaugcgccgcggaug

SEQ ID NO: 955265 - RNA, 17 nt, Mycobacterium avium subsp. paratuberculosis
cgccagcaacgacccgg

SEQ ID NO: 955266 - RNA, 18 nt, Mycobacterium avium subsp. paratuberculosis
cgccagcaacgacccggc

SEQ ID NO: 955267 - RNA, 19 nt, Mycobacterium avium subsp. paratuberculosis
cgccagcaacgacccggcc

SEQ ID NO: 955268 - RNA, 22 nt, Mycobacterium avium subsp. paratuberculosis
cgccagcaacgacccggccacc

SEQ ID NO: 955269 - RNA, 12 nt, Mycobacterium avium subsp. paratuberculosis
cgccagaccggu

SEQ ID NO: 955270 - RNA, 18 nt, Mycobacterium avium subsp. paratuberculosis
cgccagaccgguugcggc

SEQ ID NO: 955271 - RNA, 14 nt, Mycobacterium avium subsp. paratuberculosis
cgccagacguccag

SEQ ID NO: 955272 - RNA, 17 nt, Mycobacterium avium subsp. paratuberculosis
cgccagacguccagcgc

SEQ ID NO: 955273 - RNA, 19 nt, Mycobacterium avium subsp. paratuberculosis
cgccagacguccagcgccg

SEQ ID NO: 955274 - RNA, 12 nt, Mycobacterium avium subsp. paratuberculosis
cgccagaacggg

SEQ ID NO: 955275 - RNA, 22 nt, Mycobacterium avium subsp. paratuberculosis
cgccagaacggguucggucucg

SEQ ID NO: 955276 - RNA, 17 nt, Mycobacterium avium subsp. paratuberculosis
cgccagacucacggcgg

SEQ ID NO: 955277 - RNA, 19 nt, Mycobacterium avium subsp. paratuberculosis
cgccagacucacggcggca

SEQ ID NO: 955278 - RNA, 18 nt, Mycobacterium avium subsp. paratuberculosis
cgccagagcgcgaaaacc

SEQ ID NO: 955279 - RNA, 20 nt, Mycobacterium avium subsp. paratuberculosis
cgccagauagggcagcgucc

SEQ ID NO: 955280 - RNA, 17 nt, Mycobacterium avium subsp. paratuberculosis
cgccagaucagcguggu

SEQ ID NO: 955281 - RNA, 21 nt, Mycobacterium avium subsp. paratuberculosis
cgccaguugcacuuucggcag

SEQ ID NO: 955282 - RNA, 16 nt, Mycobacterium avium subsp. paratuberculosis
cgccaguugcucgggu

SEQ ID NO: 955283 - RNA, 23 nt, Mycobacterium avium subsp. paratuberculosis
cgccaguugcucgggugacgccu

SEQ ID NO: 955284 - RNA, 17 nt, Mycobacterium avium subsp. paratuberculosis
cgccaguuugccgucgg

SEQ ID NO: 955285 - RNA, 13 nt, Mycobacterium avium subsp. paratuberculosis
cgccaucagcacc

SEQ ID NO: 955286 - RNA, 14 nt, Mycobacterium avium subsp. paratuberculosis
cgccaucagcacca

SEQ ID NO: 955287 - RNA, 22 nt, Mycobacterium avium subsp. paratuberculosis
cgccaucagcagcgccucgccg

SEQ ID NO: 955288 - RNA, 23 nt, Mycobacterium avium subsp. paratuberculosis
cgccaucagcagcgccucgccgg

SEQ ID NO: 955289 - RNA, 14 nt, Mycobacterium avium subsp. paratuberculosis
cgccaucaccagcg

SEQ ID NO: 955290 - RNA, 13 nt, Mycobacterium avium subsp. paratuberculosis
cgccaucaccgcg

SEQ ID NO: 955291 - RNA, 23 nt, Mycobacterium avium subsp. paratuberculosis
cgccaucaaccgauuucggccag

SEQ ID NO: 955292 - RNA, 24 nt, Mycobacterium avium subsp. paratuberculosis
cgccaucaaccgauuucggccagc

SEQ ID NO: 955293 - RNA, 17 nt, Mycobacterium avium subsp. paratuberculosis
cgccaucguggccgcgu

SEQ ID NO: 955294 - RNA, 19 nt, Mycobacterium avium subsp. paratuberculosis
cgccaucuccuccgggcug

SEQ ID NO: 955295 - RNA, 20 nt, Mycobacterium avium subsp. paratuberculosis
cgccaucuccuccgggcuga

SEQ ID NO: 955296 - RNA, 13 nt, Mycobacterium avium subsp. paratuberculosis
cgccaucgcggcg

SEQ ID NO: 955297 - RNA, 15 nt, Mycobacterium avium subsp. paratuberculosis
cgccaucgcggcguu

SEQ ID NO: 955298 - RNA, 17 nt, Mycobacterium avium subsp. paratuberculosis
cgccaucgcggcguugu

SEQ ID NO: 955299 - RNA, 12 nt, Mycobacterium avium subsp. paratuberculosis
cgccaucggcau

SEQ ID NO: 955300 - RNA, 22 nt, Mycobacterium avium subsp. paratuberculosis
cgccaucggcaucgcgcgcggc

SEQ ID NO: 955301 - RNA, 20 nt, Mycobacterium avium subsp. paratuberculosis
cgccaucucgggagugcggc

SEQ ID NO: 955302 - RNA, 22 nt, Mycobacterium avium subsp. paratuberculosis
cgccaucucgggagugcggccc

SEQ ID NO: 955303 - RNA, 18 nt, Mycobacterium avium subsp. paratuberculosis
cgccaucuucacgugcgc

SEQ ID NO: 955304 - RNA, 22 nt, Mycobacterium avium subsp. paratuberculosis
cgccaucuucacgugcgcggcg

SEQ ID NO: 955305 - RNA, 23 nt, Mycobacterium avium subsp. paratuberculosis
cgccaucuucacgugcgcggcgu

SEQ ID NO: 955306 - RNA, 21 nt, Mycobacterium avium subsp. paratuberculosis
cgccaugaacucguccaccga

SEQ ID NO: 955307 - RNA, 23 nt, Mycobacterium avium subsp. paratuberculosis
cgccaugaacucguccaccgaca

SEQ ID NO: 955308 - RNA, 24 nt, Mycobacterium avium subsp. paratuberculosis
cgccaugaacucguccaccgacag

SEQ ID NO: 955309 - RNA, 17 nt, Mycobacterium avium subsp. paratuberculosis
cgccaugaacggcgggg

SEQ ID NO: 955310 - RNA, 23 nt, Mycobacterium avium subsp. paratuberculosis
cgccaugaacggcggggccucca

SEQ ID NO: 955311 - RNA, 20 nt, Mycobacterium avium subsp. paratuberculosis
cgccauccguucggcucugc

SEQ ID NO: 955312 - RNA, 18 nt, Mycobacterium avium subsp. paratuberculosis
cgccauccugucauccgu

SEQ ID NO: 955313 - RNA, 22 nt, Mycobacterium avium subsp. paratuberculosis
cgccauccugucauccgucgcc

SEQ ID NO: 955314 - RNA, 14 nt, Mycobacterium avium subsp. paratuberculosis
cgccauccgcagcc

SEQ ID NO: 955315 - RNA, 15 nt, Mycobacterium avium subsp. paratuberculosis
cgccauccgcagccc

SEQ ID NO: 955316 - RNA, 16 nt, Mycobacterium avium subsp. paratuberculosis
cgccauccgcagcccg

SEQ ID NO: 955317 - RNA, 13 nt, Mycobacterium avium subsp. paratuberculosis
cgccauccgccac

SEQ ID NO: 955318 - RNA, 16 nt, Mycobacterium avium subsp. paratuberculosis
cgccauccgccacccg

SEQ ID NO: 955319 - RNA, 19 nt, Mycobacterium avium subsp. paratuberculosis
cgccauccgccacccgcug

SEQ ID NO: 955320 - RNA, 18 nt, Mycobacterium avium subsp. paratuberculosis
cgccauccccgcuucggc

SEQ ID NO: 955321 - RNA, 15 nt, Mycobacterium avium subsp. paratuberculosis
cgccauccgcgccga

SEQ ID NO: 955322 - RNA, 17 nt, Mycobacterium avium subsp. paratuberculosis
cgccaucgccgccgcca

SEQ ID NO: 955323 - RNA, 22 nt, Mycobacterium avium subsp. paratuberculosis
cgccaucgcccggugcgccagc

SEQ ID NO: 955324 - RNA, 15 nt, Mycobacterium avium subsp. paratuberculosis
cgccaucgccucggc

SEQ ID NO: 955325 - RNA, 19 nt, Mycobacterium avium subsp. paratuberculosis
cgccaucgccucggccacc

SEQ ID NO: 955326 - RNA, 20 nt, Mycobacterium avium subsp. paratuberculosis
cgccaucgccucggccacca

SEQ ID NO: 955327 - RNA, 15 nt, Mycobacterium avium subsp. paratuberculosis
cgccaucgccucguc

SEQ ID NO: 955328 - RNA, 18 nt, Mycobacterium avium subsp. paratuberculosis
cgccaucgaucgggcguc

SEQ ID NO: 955329 - RNA, 20 nt, Mycobacterium avium subsp. paratuberculosis
cgccaucgaucgggcgucgc

SEQ ID NO: 955330 - RNA, 18 nt, Mycobacterium avium subsp. paratuberculosis
cgccaucgcaccgcgagc

SEQ ID NO: 955331 - RNA, 19 nt, Mycobacterium avium subsp. paratuberculosis
cgccaucgcaccgcgagca

SEQ ID NO: 955332 - RNA, 19 nt, Mycobacterium avium subsp. paratuberculosis
cgcccaccgacgcggcggc

SEQ ID NO: 955333 - RNA, 13 nt, Mycobacterium avium subsp. paratuberculosis
cgcccacgccgag

SEQ ID NO: 955334 - RNA, 14 nt, Mycobacterium avium subsp. paratuberculosis
cgcccacgccgagg

SEQ ID NO: 955335 - RNA, 15 nt, Mycobacterium avium subsp. paratuberculosis
cgcccacgccggugg

SEQ ID NO: 955336 - RNA, 22 nt, Mycobacterium avium subsp. paratuberculosis
cgcccaccuggaggccaacgag

SEQ ID NO: 955337 - RNA, 18 nt, Mycobacterium avium subsp. paratuberculosis
cgcccaccgcucgucggg

SEQ ID NO: 955338 - RNA, 13 nt, Mycobacterium avium subsp. paratuberculosis
cgcccaccuuggc

SEQ ID NO: 955339 - RNA, 18 nt, Mycobacterium avium subsp. paratuberculosis
cgcccaccuuggcgucga

SEQ ID NO: 955340 - RNA, 14 nt, Mycobacterium avium subsp. paratuberculosis
cgcccaccaccggc

SEQ ID NO: 955341 - RNA, 15 nt, Mycobacterium avium subsp. paratuberculosis
cgcccaccaccggcu

SEQ ID NO: 955342 - RNA, 13 nt, Mycobacterium avium subsp. paratuberculosis
cgcccaccacgaa

SEQ ID NO: 955343 - RNA, 14 nt, Mycobacterium avium subsp. paratuberculosis
cgcccacaggucca

SEQ ID NO: 955344 - RNA, 21 nt, Mycobacterium avium subsp. paratuberculosis
cgcccaccacgaaccaggcgc

SEQ ID NO: 955345 - RNA, 15 nt, Mycobacterium avium subsp. paratuberculosis
cgcccaccacgacga

SEQ ID NO: 955346 - RNA, 20 nt, Mycobacterium avium subsp. paratuberculosis
cgcccaccacgacgacgugg

SEQ ID NO: 955347 - RNA, 22 nt, Mycobacterium avium subsp. paratuberculosis
cgcccaccacgacgacguggug

SEQ ID NO: 955348 - RNA, 22 nt, Mycobacterium avium subsp. paratuberculosis
cgcccaccccggcguccacgcc

SEQ ID NO: 955349 - RNA, 24 nt, Mycobacterium avium subsp. paratuberculosis
cgcccacccgaugaccggcccggc

SEQ ID NO: 955350 - RNA, 16 nt, Mycobacterium avium subsp. paratuberculosis
cgcccacccgccagcc

SEQ ID NO: 955351 - RNA, 17 nt, Mycobacterium avium subsp. paratuberculosis
cgcccacccgccagccc

SEQ ID NO: 955352 - RNA, 21 nt, Mycobacterium avium subsp. paratuberculosis
cgcccacccgccagcccgcgu

SEQ ID NO: 955353 - RNA, 23 nt, Mycobacterium avium subsp. paratuberculosis
cgcccacccgccagcccgcgucg

SEQ ID NO: 955354 - RNA, 17 nt, Mycobacterium avium subsp. paratuberculosis
cgcccacccgcgccggc

SEQ ID NO: 955355 - RNA, 12 nt, Mycobacterium avium subsp. paratuberculosis
cgcccacccggg

SEQ ID NO: 955356 - RNA, 14 nt, Mycobacterium avium subsp. paratuberculosis
cgcccacccggggc

SEQ ID NO: 955357 - RNA, 23 nt, Mycobacterium avium subsp. paratuberculosis
cgccauuuccguugugccaccgc

SEQ ID NO: 955358 - RNA, 23 nt, Mycobacterium avium subsp. paratuberculosis
cgcccaaaacgugauagcggccg

SEQ ID NO: 955359 - RNA, 21 nt, Mycobacterium avium subsp. paratuberculosis
cgcccacaccgacaccggccg

SEQ ID NO: 955360 - RNA, 23 nt, Mycobacterium avium subsp. paratuberculosis
cgcccacaccgacaccggccggg

SEQ ID NO: 955361 - RNA, 13 nt, Mycobacterium avium subsp. paratuberculosis
cgcccacaccgga

SEQ ID NO: 955362 - RNA, 14 nt, Mycobacterium avium subsp. paratuberculosis
cgcccacagcaacg

SEQ ID NO: 955363 - RNA, 13 nt, Mycobacterium avium subsp. paratuberculosis
cgcccacagcagg

SEQ ID NO: 955364 - RNA, 17 nt, Mycobacterium avium subsp. paratuberculosis
cgcccacagcgccagca

SEQ ID NO: 955365 - RNA, 19 nt, Mycobacterium avium subsp. paratuberculosis
cgcccacagcgccagcacg

SEQ ID NO: 955366 - RNA, 24 nt, Mycobacterium avium subsp. paratuberculosis
cgcccaacaacucgacguucggcg

SEQ ID NO: 955367 - RNA, 16 nt, Mycobacterium avium subsp. paratuberculosis
cgcccaacgacgucgg

SEQ ID NO: 955368 - RNA, 20 nt, Mycobacterium avium subsp. paratuberculosis
cgcccaacgacgucggcguc

SEQ ID NO: 955369 - RNA, 18 nt, Mycobacterium avium subsp. paratuberculosis
cgcccaacuacccgccga

SEQ ID NO: 955370 - RNA, 15 nt, Mycobacterium avium subsp. paratuberculosis
cgccaugccgucgcg

SEQ ID NO: 955371 - RNA, 17 nt, Mycobacterium avium subsp. paratuberculosis
cgccaugccgucgcgca

SEQ ID NO: 955372 - RNA, 20 nt, Mycobacterium avium subsp. paratuberculosis
cgccaugccgucgcgcaccg

SEQ ID NO: 955373 - RNA, 15 nt, Mycobacterium avium subsp. paratuberculosis
cgccaugccgccgac

SEQ ID NO: 955374 - RNA, 18 nt, Mycobacterium avium subsp. paratuberculosis
cgccaugccgccgaccgc

SEQ ID NO: 955375 - RNA, 19 nt, Mycobacterium avium subsp. paratuberculosis
cgccaugccgccgaccgcc

SEQ ID NO: 955376 - RNA, 20 nt, Mycobacterium avium subsp. paratuberculosis
cgccaugccgccgaccgccg

SEQ ID NO: 955377 - RNA, 14 nt, Mycobacterium avium subsp. paratuberculosis
cgccaugcgaccac

SEQ ID NO: 955378 - RNA, 15 nt, Mycobacterium avium subsp. paratuberculosis
cgccaugcgccgcgc

SEQ ID NO: 955379 - RNA, 20 nt, Mycobacterium avium subsp. paratuberculosis
cgccauggcggcauccccag

SEQ ID NO: 955380 - RNA, 16 nt, Mycobacterium avium subsp. paratuberculosis
cgccauggcccacgac

SEQ ID NO: 955381 - RNA, 15 nt, Mycobacterium avium subsp. paratuberculosis
cgccaugugccggcg

SEQ ID NO: 955382 - RNA, 16 nt, Mycobacterium avium subsp. paratuberculosis
cgccaugugccggcgc

SEQ ID NO: 955383 - RNA, 20 nt, Mycobacterium avium subsp. paratuberculosis
cgccaugugccggcgcucgu

SEQ ID NO: 955384 - RNA, 21 nt, Mycobacterium avium subsp. paratuberculosis
cgccaugugccggcgcucguc

SEQ ID NO: 955385 - RNA, 17 nt, Mycobacterium avium subsp. paratuberculosis
cgccauguccggcaggc

SEQ ID NO: 955386 - RNA, 20 nt, Mycobacterium avium subsp. paratuberculosis
cgccauguccggcaggcuca

SEQ ID NO: 955387 - RNA, 16 nt, Mycobacterium avium subsp. paratuberculosis
cgccauguacagaccc

SEQ ID NO: 955388 - RNA, 19 nt, Mycobacterium avium subsp. paratuberculosis
cgccauguacagaccccac

SEQ ID NO: 955389 - RNA, 13 nt, Mycobacterium avium subsp. paratuberculosis
cgccagcgccccc

SEQ ID NO: 955390 - RNA, 14 nt, Mycobacterium avium subsp. paratuberculosis
cgccagcgccccca

SEQ ID NO: 955391 - RNA, 15 nt, Mycobacterium avium subsp. paratuberculosis
cgccagcgcccccag

SEQ ID NO: 955392 - RNA, 22 nt, Mycobacterium avium subsp. paratuberculosis
cgccagcgcccccagcggggca

SEQ ID NO: 955393 - RNA, 20 nt, Mycobacterium avium subsp. paratuberculosis
cgccagccguucccggcaga

SEQ ID NO: 955394 - RNA, 20 nt, Mycobacterium avium subsp. paratuberculosis
cgccagcgccagcguggcca

SEQ ID NO: 955395 - RNA, 12 nt, Mycobacterium avium subsp. paratuberculosis
cgccagcgcccg

SEQ ID NO: 955396 - RNA, 14 nt, Mycobacterium avium subsp. paratuberculosis
cgccagcgcccgau

SEQ ID NO: 955397 - RNA, 18 nt, Mycobacterium avium subsp. paratuberculosis
cgccagcgcccgauucgc

SEQ ID NO: 955398 - RNA, 22 nt, Mycobacterium avium subsp. paratuberculosis
cgccagcgcccgauucgcggcc

SEQ ID NO: 955399 - RNA, 24 nt, Mycobacterium avium subsp. paratuberculosis
cgccagcgcccgauucgcggccac

SEQ ID NO: 955400 - RNA, 14 nt, Mycobacterium avium subsp. paratuberculosis
cgccagcgcccgcg

SEQ ID NO: 955401 - RNA, 18 nt, Mycobacterium avium subsp. paratuberculosis
cgccagcgcccgcgcgug

SEQ ID NO: 955402 - RNA, 19 nt, Mycobacterium avium subsp. paratuberculosis
cgccagcgcccgcgcgugg

SEQ ID NO: 955403 - RNA, 14 nt, Mycobacterium avium subsp. paratuberculosis
cgccagcgccgcaa

SEQ ID NO: 955404 - RNA, 13 nt, Mycobacterium avium subsp. paratuberculosis
cgccagcgccggc

SEQ ID NO: 955405 - RNA, 15 nt, Mycobacterium avium subsp. paratuberculosis
cgccagcgccggcag

SEQ ID NO: 955406 - RNA, 17 nt, Mycobacterium avium subsp. paratuberculosis
cgccagcgccggcagca

SEQ ID NO: 955407 - RNA, 15 nt, Mycobacterium avium subsp. paratuberculosis
cgccagcgcgacccg

SEQ ID NO: 955408 - RNA, 16 nt, Mycobacterium avium subsp. paratuberculosis
cgccagcgcgccgauc

SEQ ID NO: 955409 - RNA, 13 nt, Mycobacterium avium subsp. paratuberculosis
cgccagcgcgcag

SEQ ID NO: 955410 - RNA, 23 nt, Mycobacterium avium subsp. paratuberculosis
cgccagcgcgcagaacaccaccg

SEQ ID NO: 955411 - RNA, 15 nt, Mycobacterium avium subsp. paratuberculosis
cgccagcgcgcccgc

SEQ ID NO: 955412 - RNA, 16 nt, Mycobacterium avium subsp. paratuberculosis
cgccagcgcgcccgcc

SEQ ID NO: 955413 - RNA, 17 nt, Mycobacterium avium subsp. paratuberculosis
cgccagcgcgcccgcca

SEQ ID NO: 955414 - RNA, 13 nt, Mycobacterium avium subsp. paratuberculosis
cgccagcgcgccg

SEQ ID NO: 955415 - RNA, 15 nt, Mycobacterium avium subsp. paratuberculosis
cgccagcgcgccgau

SEQ ID NO: 955416 - RNA, 15 nt, Mycobacterium avium subsp. paratuberculosis
cgccagcgcgggguc

SEQ ID NO: 955417 - RNA, 16 nt, Mycobacterium avium subsp. paratuberculosis
cgccagcgcggggucg

SEQ ID NO: 955418 - RNA, 14 nt, Mycobacterium avium subsp. paratuberculosis
cgccagcgcggugc

SEQ ID NO: 955419 - RNA, 16 nt, Mycobacterium avium subsp. paratuberculosis
cgccagcgcggugccc

SEQ ID NO: 955420 - RNA, 22 nt, Mycobacterium avium subsp. paratuberculosis
cgccagcgcggugcccagccag

SEQ ID NO: 955421 - RNA, 14 nt, Mycobacterium avium subsp. paratuberculosis
cgccagcgcggugu

SEQ ID NO: 955422 - RNA, 17 nt, Mycobacterium avium subsp. paratuberculosis
cgccagcgcggugucga

SEQ ID NO: 955423 - RNA, 23 nt, Mycobacterium avium subsp. paratuberculosis
cgccagcgcggugucgacgucgg

SEQ ID NO: 955424 - RNA, 16 nt, Mycobacterium avium subsp. paratuberculosis
cgccagcgcggcggcg

SEQ ID NO: 955425 - RNA, 18 nt, Mycobacterium avium subsp. paratuberculosis
cgccagcgcggcggcgcc

SEQ ID NO: 955426 - RNA, 15 nt, Mycobacterium avium subsp. paratuberculosis
cgccagcgcggcgau

SEQ ID NO: 955427 - RNA, 16 nt, Mycobacterium avium subsp. paratuberculosis
cgccagcgcggcgauc

SEQ ID NO: 955428 - RNA, 17 nt, Mycobacterium avium subsp. paratuberculosis
cgccagcgcggcgauca

SEQ ID NO: 955429 - RNA, 11 nt, Mycobacterium avium subsp. paratuberculosis
cgccagcgcgg

SEQ ID NO: 955430 - RNA, 13 nt, Mycobacterium avium subsp. paratuberculosis
cgccagcggccga

SEQ ID NO: 955431 - RNA, 14 nt, Mycobacterium avium subsp. paratuberculosis
cgccagcggccgau

SEQ ID NO: 955432 - RNA, 17 nt, Mycobacterium avium subsp. paratuberculosis
cgccagcggccgaucau

SEQ ID NO: 955433 - RNA, 17 nt, Mycobacterium avium subsp. paratuberculosis
cgccagcggcagcgcca

SEQ ID NO: 955434 - RNA, 18 nt, Mycobacterium avium subsp. paratuberculosis
cgccagcggcagcgccag

SEQ ID NO: 955435 - RNA, 19 nt, Mycobacterium avium subsp. paratuberculosis
cgccagcgcgugcggggug

SEQ ID NO: 955436 - RNA, 20 nt, Mycobacterium avium subsp. paratuberculosis
cgccagcgcgugcggggugu

SEQ ID NO: 955437 - RNA, 13 nt, Mycobacterium avium subsp. paratuberculosis
cgccagcguggcg

SEQ ID NO: 955438 - RNA, 21 nt, Mycobacterium avium subsp. paratuberculosis
cgccagcguggcgaacgcgac

SEQ ID NO: 955439 - RNA, 13 nt, Mycobacterium avium subsp. paratuberculosis
cgccagcggucca

SEQ ID NO: 955440 - RNA, 17 nt, Mycobacterium avium subsp. paratuberculosis
cgccagcguggccagca

SEQ ID NO: 955441 - RNA, 19 nt, Mycobacterium avium subsp. paratuberculosis
cgccagcguggccagcacc

SEQ ID NO: 955442 - RNA, 20 nt, Mycobacterium avium subsp. paratuberculosis
cgccagcguggccagcaccg

SEQ ID NO: 955443 - RNA, 16 nt, Mycobacterium avium subsp. paratuberculosis
cgccagcgucugcugc

SEQ ID NO: 955444 - RNA, 18 nt, Mycobacterium avium subsp. paratuberculosis
cgccagcgucugcugcgc

SEQ ID NO: 955445 - RNA, 23 nt, Mycobacterium avium subsp. paratuberculosis
cgccagcgugaacagcgcccggc

SEQ ID NO: 955446 - RNA, 20 nt, Mycobacterium avium subsp. paratuberculosis
cgccagcgugacgcccggcg

SEQ ID NO: 955447 - RNA, 23 nt, Mycobacterium avium subsp. paratuberculosis
cgccagcgugacgcccggcgccg

SEQ ID NO: 955448 - RNA, 18 nt, Mycobacterium avium subsp. paratuberculosis
cgccagcgugacgccggg

SEQ ID NO: 955449 - RNA, 19 nt, Mycobacterium avium subsp. paratuberculosis
cgccagcgugacgccgggc

SEQ ID NO: 955450 - RNA, 21 nt, Mycobacterium avium subsp. paratuberculosis
cgccagcgugacgccgggccg

SEQ ID NO: 955451 - RNA, 15 nt, Mycobacterium avium subsp. paratuberculosis
cgccagcgugacgcu

SEQ ID NO: 955452 - RNA, 20 nt, Mycobacterium avium subsp. paratuberculosis
cgccagcgugacgcucgggc

SEQ ID NO: 955453 - RNA, 12 nt, Mycobacterium avium subsp. paratuberculosis
cgccagcgggug

SEQ ID NO: 955454 - RNA, 19 nt, Mycobacterium avium subsp. paratuberculosis
cgccagcggcuugccguug

SEQ ID NO: 955455 - RNA, 23 nt, Mycobacterium avium subsp. paratuberculosis
cgccagcggcuugccguugucga

SEQ ID NO: 955456 - RNA, 13 nt, Mycobacterium avium subsp. paratuberculosis
cgccagcgggccg

SEQ ID NO: 955457 - RNA, 14 nt, Mycobacterium avium subsp. paratuberculosis
cgccagcgggccga

SEQ ID NO: 955458 - RNA, 16 nt, Mycobacterium avium subsp. paratuberculosis
cgccagcgggccgacc

SEQ ID NO: 955459 - RNA, 20 nt, Mycobacterium avium subsp. paratuberculosis
cgccagcgggccgaccuggc

SEQ ID NO: 955460 - RNA, 17 nt, Mycobacterium avium subsp. paratuberculosis
cgccagcuccagcagcc

SEQ ID NO: 955461 - RNA, 13 nt, Mycobacterium avium subsp. paratuberculosis
cgccagcucggcg

SEQ ID NO: 955462 - RNA, 16 nt, Mycobacterium avium subsp. paratuberculosis
cgccagcucggcggcc

SEQ ID NO: 955463 - RNA, 18 nt, Mycobacterium avium subsp. paratuberculosis
cgccagcucggcggccgg

SEQ ID NO: 955464 - RNA, 21 nt, Mycobacterium avium subsp. paratuberculosis
cgccagcucggcggccgggug

SEQ ID NO: 955465 - RNA, 19 nt, Mycobacterium avium subsp. paratuberculosis
cgccagcucguccagcgug

SEQ ID NO: 955466 - RNA, 22 nt, Mycobacterium avium subsp. paratuberculosis
cgccagcucguccagcgugccg

SEQ ID NO: 955467 - RNA, 17 nt, Mycobacterium avium subsp. paratuberculosis
cgccaggaaccacaccc

SEQ ID NO: 955468 - RNA, 21 nt, Mycobacterium avium subsp. paratuberculosis
cgccaggaaccacaccccggc

SEQ ID NO: 955469 - RNA, 13 nt, Mycobacterium avium subsp. paratuberculosis
cgccagcugggug

SEQ ID NO: 955470 - RNA, 23 nt, Mycobacterium avium subsp. paratuberculosis
cgccagcuggguggucaccagcg

SEQ ID NO: 955471 - RNA, 17 nt, Mycobacterium avium subsp. paratuberculosis
cgccagcugcggaucgg

SEQ ID NO: 955472 - RNA, 18 nt, Mycobacterium avium subsp. paratuberculosis
cgccagcugcggaucggg

SEQ ID NO: 955473 - RNA, 17 nt, Mycobacterium avium subsp. paratuberculosis
cgccagcugggcagcca

SEQ ID NO: 955474 - RNA, 21 nt, Mycobacterium avium subsp. paratuberculosis
cgccaggcagaagcuccacgc

SEQ ID NO: 955475 - RNA, 18 nt, Mycobacterium avium subsp. paratuberculosis
cgccaggcaggcggccag

SEQ ID NO: 955476 - RNA, 19 nt, Mycobacterium avium subsp. paratuberculosis
cgccaggaugucguccucg

SEQ ID NO: 955477 - RNA, 20 nt, Mycobacterium avium subsp. paratuberculosis
cgccaggccauggcgcaccg

SEQ ID NO: 955478 - RNA, 16 nt, Mycobacterium avium subsp. paratuberculosis
cgccaggaaggccagu

SEQ ID NO: 955479 - RNA, 22 nt, Mycobacterium avium subsp. paratuberculosis
cgccaggaauaacgccggcccc

SEQ ID NO: 955480 - RNA, 14 nt, Mycobacterium avium subsp. paratuberculosis
cgccaggaccaccc

SEQ ID NO: 955481 - RNA, 14 nt, Mycobacterium avium subsp. paratuberculosis
cgccaggaccagcg

SEQ ID NO: 955482 - RNA, 17 nt, Mycobacterium avium subsp. paratuberculosis
cgccaggauccgcccgc

SEQ ID NO: 955483 - RNA, 18 nt, Mycobacterium avium subsp. paratuberculosis
cgccaggauccgcccgcc

SEQ ID NO: 955484 - RNA, 19 nt, Mycobacterium avium subsp. paratuberculosis
cgccaggauccgcccgccg

SEQ ID NO: 955485 - RNA, 20 nt, Mycobacterium avium subsp. paratuberculosis
cgccaggauccgcccgccgg

SEQ ID NO: 955486 - RNA, 21 nt, Mycobacterium avium subsp. paratuberculosis
cgccaggauccgcccgccggu

SEQ ID NO: 955487 - RNA, 22 nt, Mycobacterium avium subsp. paratuberculosis
cgccaggauccgcccgccggug

SEQ ID NO: 955488 - RNA, 23 nt, Mycobacterium avium subsp. paratuberculosis
cgccaggauccgcccgccggugg

SEQ ID NO: 955489 - RNA, 18 nt, Mycobacterium avium subsp. paratuberculosis
cgccaggaucugcucggc

SEQ ID NO: 955490 - RNA, 22 nt, Mycobacterium avium subsp. paratuberculosis
cgccaggaucugcucggcgucg

SEQ ID NO: 955491 - RNA, 14 nt, Mycobacterium avium subsp. paratuberculosis
cgccagggcgcggc

SEQ ID NO: 955492 - RNA, 16 nt, Mycobacterium avium subsp. paratuberculosis
cgccagggcgcggcgc

SEQ ID NO: 955493 - RNA, 20 nt, Mycobacterium avium subsp. paratuberculosis
cgccagggcgcggcgcaccg

SEQ ID NO: 955494 - RNA, 13 nt, Mycobacterium avium subsp. paratuberculosis
cgccagggcgcgg

SEQ ID NO: 955495 - RNA, 13 nt, Mycobacterium avium subsp. paratuberculosis
cgccagggccccg

SEQ ID NO: 955496 - RNA, 17 nt, Mycobacterium avium subsp. paratuberculosis
cgccagggccccguugg

SEQ ID NO: 955497 - RNA, 20 nt, Mycobacterium avium subsp. paratuberculosis
cgccagggucucgggcagca

SEQ ID NO: 955498 - RNA, 21 nt, Mycobacterium avium subsp. paratuberculosis
cgccagggucucgggcagcag

SEQ ID NO: 955499 - RNA, 14 nt, Mycobacterium avium subsp. paratuberculosis
cgccagggucuggc

SEQ ID NO: 955500 - RNA, 21 nt, Mycobacterium avium subsp. paratuberculosis
cgccagggucuggcccggugc

SEQ ID NO: 955501 - RNA, 22 nt, Mycobacterium avium subsp. paratuberculosis
cgccagggucuggcccggugcg

SEQ ID NO: 955502 - RNA, 17 nt, Mycobacterium avium subsp. paratuberculosis
cgccagggugccgcugc

SEQ ID NO: 955503 - RNA, 21 nt, Mycobacterium avium subsp. paratuberculosis
cgccagggugccgcugcccgc

SEQ ID NO: 955504 - RNA, 24 nt, Mycobacterium avium subsp. paratuberculosis
cgccaggcuggccaggcuggcguc

SEQ ID NO: 955505 - RNA, 14 nt, Mycobacterium avium subsp. paratuberculosis
cgccaggcggcgac

SEQ ID NO: 955506 - RNA, 16 nt, Mycobacterium avium subsp. paratuberculosis
cgccaggcggcgacga

SEQ ID NO: 955507 - RNA, 20 nt, Mycobacterium avium subsp. paratuberculosis
cgccaggcggcgacgaacgc

SEQ ID NO: 955508 - RNA, 15 nt, Mycobacterium avium subsp. paratuberculosis
cgccaggccggcgac

SEQ ID NO: 955509 - RNA, 20 nt, Mycobacterium avium subsp. paratuberculosis
cgccaggccggcgacgccgg

SEQ ID NO: 955510 - RNA, 21 nt, Mycobacterium avium subsp. paratuberculosis
cgccaggccggcgacgccggc

SEQ ID NO: 955511 - RNA, 18 nt, Mycobacterium avium subsp. paratuberculosis
cgccagguuggcggcggc

SEQ ID NO: 955512 - RNA, 19 nt, Mycobacterium avium subsp. paratuberculosis
cgccagguuggcggcggcc

SEQ ID NO: 955513 - RNA, 21 nt, Mycobacterium avium subsp. paratuberculosis
cgccagguuggcggcggcccg

SEQ ID NO: 955514 - RNA, 18 nt, Mycobacterium avium subsp. paratuberculosis
cgccaguaguggaucagc

SEQ ID NO: 955515 - RNA, 14 nt, Mycobacterium avium subsp. paratuberculosis
cgccagucgcggcg

SEQ ID NO: 955516 - RNA, 21 nt, Mycobacterium avium subsp. paratuberculosis
cgccagucgcggcgaaccagc

SEQ ID NO: 955517 - RNA, 13 nt, Mycobacterium avium subsp. paratuberculosis
cgccaguccggcg

SEQ ID NO: 955518 - RNA, 14 nt, Mycobacterium avium subsp. paratuberculosis
cgccaguccggcgc

SEQ ID NO: 955519 - RNA, 15 nt, Mycobacterium avium subsp. paratuberculosis
cgccaguccggcgcc

SEQ ID NO: 955520 - RNA, 17 nt, Mycobacterium avium subsp. paratuberculosis
cgccaguccggcgccga

SEQ ID NO: 955521 - RNA, 19 nt, Mycobacterium avium subsp. paratuberculosis
cgccaguccggcgccgacc

SEQ ID NO: 955522 - RNA, 20 nt, Mycobacterium avium subsp. paratuberculosis
cgccaguccggcgccgaccc

SEQ ID NO: 955523 - RNA, 21 nt, Mycobacterium avium subsp. paratuberculosis
cgccaguccggcgccgacccc

SEQ ID NO: 955524 - RNA, 23 nt, Mycobacterium avium subsp. paratuberculosis
cgccaguccggcgccgacccccg

SEQ ID NO: 955525 - RNA, 15 nt, Mycobacterium avium subsp. paratuberculosis
cgccagugccgcgcg

SEQ ID NO: 955526 - RNA, 21 nt, Mycobacterium avium subsp. paratuberculosis
cgccagucauggcaguuguuc

SEQ ID NO: 955527 - RNA, 19 nt, Mycobacterium avium subsp. paratuberculosis
cgccagucugagcccgggc

SEQ ID NO: 955528 - RNA, 16 nt, Mycobacterium avium subsp. paratuberculosis
cgccaguggcugcacg

SEQ ID NO: 955529 - RNA, 20 nt, Mycobacterium avium subsp. paratuberculosis
cgccaguguggccgcggcgg

SEQ ID NO: 955530 - RNA, 22 nt, Mycobacterium avium subsp. paratuberculosis
cgccaguguggccgcggcggcc

SEQ ID NO: 955531 - RNA, 16 nt, Mycobacterium avium subsp. paratuberculosis
cgccaguucccggcca

SEQ ID NO: 955532 - RNA, 18 nt, Mycobacterium avium subsp. paratuberculosis
cgccaguucccggccagc

SEQ ID NO: 955533 - RNA, 14 nt, Mycobacterium avium subsp. paratuberculosis
cgccaguucgucgg

SEQ ID NO: 955534 - RNA, 15 nt, Mycobacterium avium subsp. paratuberculosis
cgccaguucgucggc

SEQ ID NO: 955535 - RNA, 17 nt, Mycobacterium avium subsp. paratuberculosis
cgccaguucgucggccg

SEQ ID NO: 955536 - RNA, 18 nt, Mycobacterium avium subsp. paratuberculosis
cgccaguucgucggccgu

SEQ ID NO: 955537 - RNA, 20 nt, Mycobacterium avium subsp. paratuberculosis
cgccaguucgucggccgucg

SEQ ID NO: 955538 - RNA, 21 nt, Mycobacterium avium subsp. paratuberculosis
cgccaguucgucggccgucgg

SEQ ID NO: 955539 - RNA, 23 nt, Mycobacterium avium subsp. paratuberculosis
cgccaguucgucggccgucggcg

SEQ ID NO: 955540 - RNA, 15 nt, Mycobacterium avium subsp. paratuberculosis
cgaagaucaccgcga

SEQ ID NO: 955541 - RNA, 17 nt, Mycobacterium avium subsp. paratuberculosis
cgaagaucaccgcgucg

SEQ ID NO: 955542 - RNA, 15 nt, Mycobacterium avium subsp. paratuberculosis
cgaagaucagcgcgu

SEQ ID NO: 955543 - RNA, 15 nt, Mycobacterium avium subsp. paratuberculosis
cgaagagccggcguu

SEQ ID NO: 955544 - RNA, 20 nt, Mycobacterium avium subsp. paratuberculosis
cgaagagcuggucgcccacc

SEQ ID NO: 955545 - RNA, 21 nt, Mycobacterium avium subsp. paratuberculosis
cgaagagcuggucgcccacca

SEQ ID NO: 955546 - RNA, 16 nt, Mycobacterium avium subsp. paratuberculosis
cgaacuugaccgggcu

SEQ ID NO: 955547 - RNA, 17 nt, Mycobacterium avium subsp. paratuberculosis
cgaagacccgaaacugg

SEQ ID NO: 955548 - RNA, 17 nt, Mycobacterium avium subsp. paratuberculosis
cgaacuugaucaccgcg

SEQ ID NO: 955549 - RNA, 15 nt, Mycobacterium avium subsp. paratuberculosis
cgaacuugcuggccg

SEQ ID NO: 955550 - RNA, 15 nt, Mycobacterium avium subsp. paratuberculosis
cgaagaccgggccga

SEQ ID NO: 955551 - RNA, 15 nt, Mycobacterium avium subsp. paratuberculosis
cgaagaccgggucgu

SEQ ID NO: 955552 - RNA, 16 nt, Mycobacterium avium subsp. paratuberculosis
cgaagaccggugcgcg

SEQ ID NO: 955553 - RNA, 24 nt, Mycobacterium avium subsp. paratuberculosis
cgaagaccggugcgcgcaccaggc

SEQ ID NO: 955554 - RNA, 23 nt, Mycobacterium avium subsp. paratuberculosis
cgaagacgaugaaaccccagccg

SEQ ID NO: 955555 - RNA, 13 nt, Mycobacterium avium subsp. paratuberculosis
cgaagcgcgaugc

SEQ ID NO: 955556 - RNA, 18 nt, Mycobacterium avium subsp. paratuberculosis
cgaagcgcgaugcggcuc

SEQ ID NO: 955557 - RNA, 14 nt, Mycobacterium avium subsp. paratuberculosis
cgaagcgccgcaug

SEQ ID NO: 955558 - RNA, 15 nt, Mycobacterium avium subsp. paratuberculosis
cgaagcgccgcaugc

SEQ ID NO: 955559 - RNA, 14 nt, Mycobacterium avium subsp. paratuberculosis
cgaagcgccacggg

SEQ ID NO: 955560 - RNA, 17 nt, Mycobacterium avium subsp. paratuberculosis
cgaagcgccacggggcg

SEQ ID NO: 955561 - RNA, 18 nt, Mycobacterium avium subsp. paratuberculosis
cgaagcgccacggggcgc

SEQ ID NO: 955562 - RNA, 20 nt, Mycobacterium avium subsp. paratuberculosis
cgaagcgccacggggcgccg

SEQ ID NO: 955563 - RNA, 21 nt, Mycobacterium avium subsp. paratuberculosis
cgaagcgccacggggcgccgc

SEQ ID NO: 955564 - RNA, 15 nt, Mycobacterium avium subsp. paratuberculosis
cgaagcgcagcaccu

SEQ ID NO: 955565 - RNA, 18 nt, Mycobacterium avium subsp. paratuberculosis
cgaagcgcagcagcucgu

SEQ ID NO: 955566 - RNA, 15 nt, Mycobacterium avium subsp. paratuberculosis
cgaagcgcagcgucu

SEQ ID NO: 955567 - RNA, 17 nt, Mycobacterium avium subsp. paratuberculosis
cgaagcagccuucuugg

SEQ ID NO: 955568 - RNA, 24 nt, Mycobacterium avium subsp. paratuberculosis
cgaagcagcucgcguagcgaggug

SEQ ID NO: 955569 - RNA, 23 nt, Mycobacterium avium subsp. paratuberculosis
cgaagcagaacuucuccgccggc

SEQ ID NO: 955570 - RNA, 16 nt, Mycobacterium avium subsp. paratuberculosis
cgaagauggccagcgc

SEQ ID NO: 955571 - RNA, 16 nt, Mycobacterium avium subsp. paratuberculosis
cgaagauggccaggaa

SEQ ID NO: 955572 - RNA, 17 nt, Mycobacterium avium subsp. paratuberculosis
cgaagauggucgcgccg

SEQ ID NO: 955573 - RNA, 21 nt, Mycobacterium avium subsp. paratuberculosis
cgaagauggucgcgccgcggc

SEQ ID NO: 955574 - RNA, 22 nt, Mycobacterium avium subsp. paratuberculosis
cgaagauggucgcgccgcggcg

SEQ ID NO: 955575 - RNA, 15 nt, Mycobacterium avium subsp. paratuberculosis
cgaagaugucgcggc

SEQ ID NO: 955576 - RNA, 17 nt, Mycobacterium avium subsp. paratuberculosis
cgaagaugucgcggcgc

SEQ ID NO: 955577 - RNA, 15 nt, Mycobacterium avium subsp. paratuberculosis
cgaagaugucggugc

SEQ ID NO: 955578 - RNA, 17 nt, Mycobacterium avium subsp. paratuberculosis
cgaagaucuccgggaac

SEQ ID NO: 955579 - RNA, 16 nt, Mycobacterium avium subsp. paratuberculosis
cgaagaugaucagcgc

SEQ ID NO: 955580 - RNA, 18 nt, Mycobacterium avium subsp. paratuberculosis
cgaagaugaucagcgcgc

SEQ ID NO: 955581 - RNA, 20 nt, Mycobacterium avium subsp. paratuberculosis
cgaagaugaucagcgcgccc

SEQ ID NO: 955582 - RNA, 21 nt, Mycobacterium avium subsp. paratuberculosis
cgaagaugaucagcgcgccca

SEQ ID NO: 955583 - RNA, 18 nt, Mycobacterium avium subsp. paratuberculosis
cgaacuacuucgucagca

SEQ ID NO: 955584 - RNA, 22 nt, Mycobacterium avium subsp. paratuberculosis
cgaacuacuucgucagcagcga

SEQ ID NO: 955585 - RNA, 17 nt, Mycobacterium avium subsp. paratuberculosis
cgaacucaagggcguca

SEQ ID NO: 955586 - RNA, 19 nt, Mycobacterium avium subsp. paratuberculosis
cgaacucaagggcgucacg

SEQ ID NO: 955587 - RNA, 19 nt, Mycobacterium avium subsp. paratuberculosis
cgaacuccacccugccgac

SEQ ID NO: 955588 - RNA, 20 nt, Mycobacterium avium subsp. paratuberculosis
cgaacuccacccugccgacc

SEQ ID NO: 955589 - RNA, 22 nt, Mycobacterium avium subsp. paratuberculosis
cgaacuccauccgccgucgacc

SEQ ID NO: 955590 - RNA, 14 nt, Mycobacterium avium subsp. paratuberculosis
cgaacuccgccgaa

SEQ ID NO: 955591 - RNA, 18 nt, Mycobacterium avium subsp. paratuberculosis
cgaacuccgccgaaccga

SEQ ID NO: 955592 - RNA, 16 nt, Mycobacterium avium subsp. paratuberculosis
cgaacuucagcgcguc

SEQ ID NO: 955593 - RNA, 19 nt, Mycobacterium avium subsp. paratuberculosis
cgaacugcuugaucagguc

SEQ ID NO: 955594 - RNA, 21 nt, Mycobacterium avium subsp. paratuberculosis
cgaacugguuguagucgucga

SEQ ID NO: 955595 - RNA, 23 nt, Mycobacterium avium subsp. paratuberculosis
cgaacugguuguagucgucgacc

SEQ ID NO: 955596 - RNA, 20 nt, Mycobacterium avium subsp. paratuberculosis
cgaacugggugggcagcgga

SEQ ID NO: 955597 - RNA, 16 nt, Mycobacterium avium subsp. paratuberculosis
cgaacugccggcauag

SEQ ID NO: 955598 - RNA, 23 nt, Mycobacterium avium subsp. paratuberculosis
cgaacugccaucccucguucagc

SEQ ID NO: 955599 - RNA, 16 nt, Mycobacterium avium subsp. paratuberculosis
cgaacugccgaugcug

SEQ ID NO: 955600 - RNA, 23 nt, Mycobacterium avium subsp. paratuberculosis
cgaacugccgaugcugagcgggu

SEQ ID NO: 955601 - RNA, 21 nt, Mycobacterium avium subsp. paratuberculosis
ccugguugccgcccucggccg

SEQ ID NO: 955602 - RNA, 23 nt, Mycobacterium avium subsp. paratuberculosis
ccugguugccgcccucggccgua

SEQ ID NO: 955603 - RNA, 20 nt, Mycobacterium avium subsp. paratuberculosis
ccugguugacgcccccggug

SEQ ID NO: 955604 - RNA, 16 nt, Mycobacterium avium subsp. paratuberculosis
ccugguugagcaccgc

SEQ ID NO: 955605 - RNA, 18 nt, Mycobacterium avium subsp. paratuberculosis
ccugguugagcaccgcga

SEQ ID NO: 955606 - RNA, 20 nt, Mycobacterium avium subsp. paratuberculosis
ccuguacgugucccugcggc

SEQ ID NO: 955607 - RNA, 15 nt, Mycobacterium avium subsp. paratuberculosis
cgaacgugauggcga

SEQ ID NO: 955608 - RNA, 20 nt, Mycobacterium avium subsp. paratuberculosis
cgaacgugcacucagggcga

SEQ ID NO: 955609 - RNA, 20 nt, Mycobacterium avium subsp. paratuberculosis
cgaacgugcgcggcgcgcga

SEQ ID NO: 955610 - RNA, 17 nt, Mycobacterium avium subsp. paratuberculosis
cgaacgucaggccgugc

SEQ ID NO: 955611 - RNA, 16 nt, Mycobacterium avium subsp. paratuberculosis
cgaacgucgagcgcgg

SEQ ID NO: 955612 - RNA, 15 nt, Mycobacterium avium subsp. paratuberculosis
cgaaugucgaccacc

SEQ ID NO: 955613 - RNA, 22 nt, Mycobacterium avium subsp. paratuberculosis
cgaaugucucgaugacauggau

SEQ ID NO: 955614 - RNA, 15 nt, Mycobacterium avium subsp. paratuberculosis
cgaauccgggcaugc

SEQ ID NO: 955615 - RNA, 17 nt, Mycobacterium avium subsp. paratuberculosis
cgaauccgggugucgac

SEQ ID NO: 955616 - RNA, 18 nt, Mycobacterium avium subsp. paratuberculosis
cgaauccgggugucgacg

SEQ ID NO: 955617 - RNA, 19 nt, Mycobacterium avium subsp. paratuberculosis
cgaauccgggugucgacgc

SEQ ID NO: 955618 - RNA, 22 nt, Mycobacterium avium subsp. paratuberculosis
cgaauccggucaacgccgcgcg

SEQ ID NO: 955619 - RNA, 12 nt, Mycobacterium avium subsp. paratuberculosis
cgaauccgguga

SEQ ID NO: 955620 - RNA, 20 nt, Mycobacterium avium subsp. paratuberculosis
cgaauccgauugcggcgcag

SEQ ID NO: 955621 - RNA, 15 nt, Mycobacterium avium subsp. paratuberculosis
cgaauccggcggcgc

SEQ ID NO: 955622 - RNA, 15 nt, Mycobacterium avium subsp. paratuberculosis
cgaauccggcgggga

SEQ ID NO: 955623 - RNA, 16 nt, Mycobacterium avium subsp. paratuberculosis
cgaaucccggccucgu

SEQ ID NO: 955624 - RNA, 15 nt, Mycobacterium avium subsp. paratuberculosis
cgaauccgaccggcu

SEQ ID NO: 955625 - RNA, 21 nt, Mycobacterium avium subsp. paratuberculosis
cgaauccgaguuggccggcac

SEQ ID NO: 955626 - RNA, 14 nt, Mycobacterium avium subsp. paratuberculosis
cgaauccagcgcgc

SEQ ID NO: 955627 - RNA, 15 nt, Mycobacterium avium subsp. paratuberculosis
cgaauccagcgcgcc

SEQ ID NO: 955628 - RNA, 15 nt, Mycobacterium avium subsp. paratuberculosis
cgaaucaucguggcg

SEQ ID NO: 955629 - RNA, 20 nt, Mycobacterium avium subsp. paratuberculosis
cgaaucaucguggcgcgacg

SEQ ID NO: 955630 - RNA, 23 nt, Mycobacterium avium subsp. paratuberculosis
cgaauccaaggagaaggccgcgc

SEQ ID NO: 955631 - RNA, 13 nt, Mycobacterium avium subsp. paratuberculosis
cgaagugacgccg

SEQ ID NO: 955632 - RNA, 15 nt, Mycobacterium avium subsp. paratuberculosis
cgaagugacgccgcu

SEQ ID NO: 955633 - RNA, 16 nt, Mycobacterium avium subsp. paratuberculosis
cgaagugacgccgcuc

SEQ ID NO: 955634 - RNA, 21 nt, Mycobacterium avium subsp. paratuberculosis
cgaagugacgccgcucggcca

SEQ ID NO: 955635 - RNA, 23 nt, Mycobacterium avium subsp. paratuberculosis
cgaagugacgccgcucggccagc

SEQ ID NO: 955636 - RNA, 23 nt, Mycobacterium avium subsp. paratuberculosis
cgaagucaaaccccuuggcgucc

SEQ ID NO: 955637 - RNA, 20 nt, Mycobacterium avium subsp. paratuberculosis
cgaaguccgacgagucgacg

SEQ ID NO: 955638 - RNA, 14 nt, Mycobacterium avium subsp. paratuberculosis
cgaaguccgccagg

SEQ ID NO: 955639 - RNA, 16 nt, Mycobacterium avium subsp. paratuberculosis
cgaaguccgccagggu

SEQ ID NO: 955640 - RNA, 14 nt, Mycobacterium avium subsp. paratuberculosis
cgaagucaucaccg

SEQ ID NO: 955641 - RNA, 20 nt, Mycobacterium avium subsp. paratuberculosis
cgaaguauccggucagcgcc

SEQ ID NO: 955642 - RNA, 15 nt, Mycobacterium avium subsp. paratuberculosis
cgaaguagggccgca

SEQ ID NO: 955643 - RNA, 17 nt, Mycobacterium avium subsp. paratuberculosis
cgaaguagggccgcagc

SEQ ID NO: 955644 - RNA, 15 nt, Mycobacterium avium subsp. paratuberculosis
cgaaguccugcgccg

SEQ ID NO: 955645 - RNA, 14 nt, Mycobacterium avium subsp. paratuberculosis
cgaagucgagcagg

SEQ ID NO: 955646 - RNA, 20 nt, Mycobacterium avium subsp. paratuberculosis
cgaagucgccgcccgggccg

SEQ ID NO: 955647 - RNA, 16 nt, Mycobacterium avium subsp. paratuberculosis
cgaagucggucagcgu

SEQ ID NO: 955648 - RNA, 18 nt, Mycobacterium avium subsp. paratuberculosis
cgaagucggucagcgucg

SEQ ID NO: 955649 - RNA, 21 nt, Mycobacterium avium subsp. paratuberculosis
cgaaggcaacucgcgaggccg

SEQ ID NO: 955650 - RNA, 16 nt, Mycobacterium avium subsp. paratuberculosis
cgaaggccaggugcac

SEQ ID NO: 955651 - RNA, 19 nt, Mycobacterium avium subsp. paratuberculosis
cgaaggccaggugcacgcc

SEQ ID NO: 955652 - RNA, 16 nt, Mycobacterium avium subsp. paratuberculosis
cgaaggccccggucaa

SEQ ID NO: 955653 - RNA, 13 nt, Mycobacterium avium subsp. paratuberculosis
cgaaggccgccgg

SEQ ID NO: 955654 - RNA, 12 nt, Mycobacterium avium subsp. paratuberculosis
cgaaggccgggg

SEQ ID NO: 955655 - RNA, 15 nt, Mycobacterium avium subsp. paratuberculosis
cgaaggccggggugu

SEQ ID NO: 955656 - RNA, 15 nt, Mycobacterium avium subsp. paratuberculosis
cgaaggccgggucgg

SEQ ID NO: 955657 - RNA, 14 nt, Mycobacterium avium subsp. paratuberculosis
cgaagcggcgcacg

SEQ ID NO: 955658 - RNA, 19 nt, Mycobacterium avium subsp. paratuberculosis
cgaagcgggacugcagcgc

SEQ ID NO: 955659 - RNA, 15 nt, Mycobacterium avium subsp. paratuberculosis
cgaaggcggccgcga

SEQ ID NO: 955660 - RNA, 17 nt, Mycobacterium avium subsp. paratuberculosis
cgaaggcucgccacgcg

SEQ ID NO: 955661 - RNA, 18 nt, Mycobacterium avium subsp. paratuberculosis
cgaagggcgccagcaccu

SEQ ID NO: 955662 - RNA, 17 nt, Mycobacterium avium subsp. paratuberculosis
cgaaguagccggcgauc

SEQ ID NO: 955663 - RNA, 21 nt, Mycobacterium avium subsp. paratuberculosis
cgaaggcguuggagccgacca

SEQ ID NO: 955664 - RNA, 23 nt, Mycobacterium avium subsp. paratuberculosis
cgaaggcguuggagccgaccagc

SEQ ID NO: 955665 - RNA, 12 nt, Mycobacterium avium subsp. paratuberculosis
cgaaggcggcgc

SEQ ID NO: 955666 - RNA, 17 nt, Mycobacterium avium subsp. paratuberculosis
cgaaggcggcgccggcc

SEQ ID NO: 955667 - RNA, 21 nt, Mycobacterium avium subsp. paratuberculosis
cgaaggcggcgucgaugucgc

SEQ ID NO: 955668 - RNA, 20 nt, Mycobacterium avium subsp. paratuberculosis
cgaauucggagaccaggucg

SEQ ID NO: 955669 - RNA, 20 nt, Mycobacterium avium subsp. paratuberculosis
cgaauugccgguggugcggc

SEQ ID NO: 955670 - RNA, 14 nt, Mycobacterium avium subsp. paratuberculosis
cgacaacgacagca

SEQ ID NO: 955671 - RNA, 14 nt, Mycobacterium avium subsp. paratuberculosis
cgacaacgggccgc

SEQ ID NO: 955672 - RNA, 16 nt, Mycobacterium avium subsp. paratuberculosis
cgacaacgggccgccu

SEQ ID NO: 955673 - RNA, 16 nt, Mycobacterium avium subsp. paratuberculosis
cgacaagcagauucga

SEQ ID NO: 955674 - RNA, 23 nt, Mycobacterium avium subsp. paratuberculosis
cgacaaggucgaccgcgcaccgg

SEQ ID NO: 955675 - RNA, 17 nt, Mycobacterium avium subsp. paratuberculosis
cgacaaucucgggcacc

SEQ ID NO: 955676 - RNA, 14 nt, Mycobacterium avium subsp. paratuberculosis
cgacaccaccgcgc

SEQ ID NO: 955677 - RNA, 16 nt, Mycobacterium avium subsp. paratuberculosis
cgacaccaccgcgcgc

SEQ ID NO: 955678 - RNA, 14 nt, Mycobacterium avium subsp. paratuberculosis
cgacaccaccggcc

SEQ ID NO: 955679 - RNA, 15 nt, Mycobacterium avium subsp. paratuberculosis
cgacaccaccggccg

SEQ ID NO: 955680 - RNA, 19 nt, Mycobacterium avium subsp. paratuberculosis
cgacaccaccggccgcccg

SEQ ID NO: 955681 - RNA, 23 nt, Mycobacterium avium subsp. paratuberculosis
cgacaccaccggccgcccggcga

SEQ ID NO: 955682 - RNA, 21 nt, Mycobacterium avium subsp. paratuberculosis
cgacaccaccgugcuggccac

SEQ ID NO: 955683 - RNA, 23 nt, Mycobacterium avium subsp. paratuberculosis
cgacaccaccgugcuggccacca

SEQ ID NO: 955684 - RNA, 19 nt, Mycobacterium avium subsp. paratuberculosis
cgacaccaccacgaacugg

SEQ ID NO: 955685 - RNA, 14 nt, Mycobacterium avium subsp. paratuberculosis
cgacaccagcgcgc

SEQ ID NO: 955686 - RNA, 19 nt, Mycobacterium avium subsp. paratuberculosis
cgacaccagcgcgcacgcg

SEQ ID NO: 955687 - RNA, 13 nt, Mycobacterium avium subsp. paratuberculosis
cgacaccagcguc

SEQ ID NO: 955688 - RNA, 15 nt, Mycobacterium avium subsp. paratuberculosis
cgacaccagcgucgc

SEQ ID NO: 955689 - RNA, 20 nt, Mycobacterium avium subsp. paratuberculosis
cgacaccagggugcgcacga

SEQ ID NO: 955690 - RNA, 19 nt, Mycobacterium avium subsp. paratuberculosis
cgacaccaggucgaggucc

SEQ ID NO: 955691 - RNA, 16 nt, Mycobacterium avium subsp. paratuberculosis
aacaacagggccgcgc

SEQ ID NO: 955692 - RNA, 15 nt, Mycobacterium avium subsp. paratuberculosis
aacaacccggccgcg

SEQ ID NO: 955693 - RNA, 20 nt, Mycobacterium avium subsp. paratuberculosis
aacaacgcggugaccgcggc

SEQ ID NO: 955694 - RNA, 19 nt, Mycobacterium avium subsp. paratuberculosis
cgacaccccgaugccgaac

SEQ ID NO: 955695 - RNA, 17 nt, Mycobacterium avium subsp. paratuberculosis
cgacaccccgcucggcc

SEQ ID NO: 955696 - RNA, 19 nt, Mycobacterium avium subsp. paratuberculosis
cgacaccccgcucggccag

SEQ ID NO: 955697 - RNA, 13 nt, Mycobacterium avium subsp. paratuberculosis
cgacacccagcgg

SEQ ID NO: 955698 - RNA, 14 nt, Mycobacterium avium subsp. paratuberculosis
cgacacccagcggc

SEQ ID NO: 955699 - RNA, 15 nt, Mycobacterium avium subsp. paratuberculosis
cgacacccagcggcg

SEQ ID NO: 955700 - RNA, 22 nt, Mycobacterium avium subsp. paratuberculosis
cgacaccccacaccguccgacc

SEQ ID NO: 955701 - RNA, 23 nt, Mycobacterium avium subsp. paratuberculosis
cgacaccccacaccguccgaccg

SEQ ID NO: 955702 - RNA, 13 nt, Mycobacterium avium subsp. paratuberculosis
cgacacccgggcg

SEQ ID NO: 955703 - RNA, 20 nt, Mycobacterium avium subsp. paratuberculosis
aacaacucgacguucggcgg

SEQ ID NO: 955704 - RNA, 14 nt, Mycobacterium avium subsp. paratuberculosis
aacaacuucgagca

SEQ ID NO: 955705 - RNA, 18 nt, Mycobacterium avium subsp. paratuberculosis
cgacacccuucaucagca

SEQ ID NO: 955706 - RNA, 21 nt, Mycobacterium avium subsp. paratuberculosis
cgacacccuucaucagcaccg

SEQ ID NO: 955707 - RNA, 14 nt, Mycobacterium avium subsp. paratuberculosis
cgacaccgaaccca

SEQ ID NO: 955708 - RNA, 22 nt, Mycobacterium avium subsp. paratuberculosis
cgacaccgaacccaccagcgcc

SEQ ID NO: 955709 - RNA, 14 nt, Mycobacterium avium subsp. paratuberculosis
cgacaccgacgacc

SEQ ID NO: 955710 - RNA, 19 nt, Mycobacterium avium subsp. paratuberculosis
cgacaccgcacggcccauc

SEQ ID NO: 955711 - RNA, 20 nt, Mycobacterium avium subsp. paratuberculosis
cgacaccgcauggccggcga

SEQ ID NO: 955712 - RNA, 13 nt, Mycobacterium avium subsp. paratuberculosis
cgacaccgccagc

SEQ ID NO: 955713 - RNA, 17 nt, Mycobacterium avium subsp. paratuberculosis
cgacaccgucgccguga

SEQ ID NO: 955714 - RNA, 13 nt, Mycobacterium avium subsp. paratuberculosis
cgacaccucgccg

SEQ ID NO: 955715 - RNA, 12 nt, Mycobacterium avium subsp. paratuberculosis
cgacaccggcgg

SEQ ID NO: 955716 - RNA, 13 nt, Mycobacterium avium subsp. paratuberculosis
cgacaccggcgug

SEQ ID NO: 955717 - RNA, 15 nt, Mycobacterium avium subsp. paratuberculosis
cgacaccgguggcgu

SEQ ID NO: 955718 - RNA, 16 nt, Mycobacterium avium subsp. paratuberculosis
cgacaccgguggcguu

SEQ ID NO: 955719 - RNA, 21 nt, Mycobacterium avium subsp. paratuberculosis
cgacaccgguggcguugcggg

SEQ ID NO: 955720 - RNA, 17 nt, Mycobacterium avium subsp. paratuberculosis
cgacaccgccagcagcg

SEQ ID NO: 955721 - RNA, 21 nt, Mycobacterium avium subsp. paratuberculosis
cgacaccgccagcagcgccgc

SEQ ID NO: 955722 - RNA, 16 nt, Mycobacterium avium subsp. paratuberculosis
cgacaccgccccgccg

SEQ ID NO: 955723 - RNA, 17 nt, Mycobacterium avium subsp. paratuberculosis
cgacaccgccccgccgc

SEQ ID NO: 955724 - RNA, 18 nt, Mycobacterium avium subsp. paratuberculosis
cgacaccgccccgccgcg

SEQ ID NO: 955725 - RNA, 19 nt, Mycobacterium avium subsp. paratuberculosis
cgacaccgccccgccgcgc

SEQ ID NO: 955726 - RNA, 14 nt, Mycobacterium avium subsp. paratuberculosis
cgacaccgccuucg

SEQ ID NO: 955727 - RNA, 19 nt, Mycobacterium avium subsp. paratuberculosis
cgacaccgccuucgacggc

SEQ ID NO: 955728 - RNA, 22 nt, Mycobacterium avium subsp. paratuberculosis
cgacaccgccuucgacggccgg

SEQ ID NO: 955729 - RNA, 13 nt, Mycobacterium avium subsp. paratuberculosis
cgacaccgcggcg

SEQ ID NO: 955730 - RNA, 20 nt, Mycobacterium avium subsp. paratuberculosis
cgacaccgcggcgacgucgu

SEQ ID NO: 955731 - RNA, 22 nt, Mycobacterium avium subsp. paratuberculosis
cgacagucccgcguugugcacc

SEQ ID NO: 955732 - RNA, 15 nt, Mycobacterium avium subsp. paratuberculosis
cgacagucgcgggca

SEQ ID NO: 955733 - RNA, 16 nt, Mycobacterium avium subsp. paratuberculosis
cgacagucgcgggcga

SEQ ID NO: 955734 - RNA, 22 nt, Mycobacterium avium subsp. paratuberculosis
cgacagucgcgggcggggcgcc

SEQ ID NO: 955735 - RNA, 23 nt, Mycobacterium avium subsp. paratuberculosis
cgacagucgcgggcggggcgccg

SEQ ID NO: 955736 - RNA, 17 nt, Mycobacterium avium subsp. paratuberculosis
cgacaggucggcggucg

SEQ ID NO: 955737 - RNA, 23 nt, Mycobacterium avium subsp. paratuberculosis
cgacaggucggcggucgcggugc

SEQ ID NO: 955738 - RNA, 20 nt, Mycobacterium avium subsp. paratuberculosis
cgacagguucuuggcggccu

SEQ ID NO: 955739 - RNA, 22 nt, Mycobacterium avium subsp. paratuberculosis
cgacagguucuuggcggccugc

SEQ ID NO: 955740 - RNA, 14 nt, Mycobacterium avium subsp. paratuberculosis
cgacaggucgaagg

SEQ ID NO: 955741 - RNA, 15 nt, Mycobacterium avium subsp. paratuberculosis
cgacaggucgagcac

SEQ ID NO: 955742 - RNA, 18 nt, Mycobacterium avium subsp. paratuberculosis
cgacaggucgagcaccag

SEQ ID NO: 955743 - RNA, 23 nt, Mycobacterium avium subsp. paratuberculosis
cgacagggugccaaggucgccgg

SEQ ID NO: 955744 - RNA, 18 nt, Mycobacterium avium subsp. paratuberculosis
cgacagggugccgaacag

SEQ ID NO: 955745 - RNA, 13 nt, Mycobacterium avium subsp. paratuberculosis
cgacagguagcag

SEQ ID NO: 955746 - RNA, 19 nt, Mycobacterium avium subsp. paratuberculosis
cgacagguagcaggcgcgc

SEQ ID NO: 955747 - RNA, 21 nt, Mycobacterium avium subsp. paratuberculosis
cgacagguagcaggcgcgcag

SEQ ID NO: 955748 - RNA, 14 nt, Mycobacterium avium subsp. paratuberculosis
cgacagggagccga

SEQ ID NO: 955749 - RNA, 16 nt, Mycobacterium avium subsp. paratuberculosis
cgacagggagccgacg

SEQ ID NO: 955750 - RNA, 17 nt, Mycobacterium avium subsp. paratuberculosis
cgacagggccagcgcca

SEQ ID NO: 955751 - RNA, 22 nt, Mycobacterium avium subsp. paratuberculosis
cgacagggccagcgccaugccg

SEQ ID NO: 955752 - RNA, 14 nt, Mycobacterium avium subsp. paratuberculosis
cgacaggcccaccc

SEQ ID NO: 955753 - RNA, 14 nt, Mycobacterium avium subsp. paratuberculosis
cgacagccggucgc

SEQ ID NO: 955754 - RNA, 16 nt, Mycobacterium avium subsp. paratuberculosis
cgacagccggucgcgc

SEQ ID NO: 955755 - RNA, 18 nt, Mycobacterium avium subsp. paratuberculosis
cgacagccggacgggauc

SEQ ID NO: 955756 - RNA, 21 nt, Mycobacterium avium subsp. paratuberculosis
cgacagccgggaaucgagggc

SEQ ID NO: 955757 - RNA, 12 nt, Mycobacterium avium subsp. paratuberculosis
cgacagcgacgg

SEQ ID NO: 955758 - RNA, 18 nt, Mycobacterium avium subsp. paratuberculosis
cgacagccugaccgcggg

SEQ ID NO: 955759 - RNA, 19 nt, Mycobacterium avium subsp. paratuberculosis
cgacagccugaccgcgggu

SEQ ID NO: 955760 - RNA, 20 nt, Mycobacterium avium subsp. paratuberculosis
cgacagccugaccgcgggug

SEQ ID NO: 955761 - RNA, 21 nt, Mycobacterium avium subsp. paratuberculosis
cgacagccugaccgcggguga

SEQ ID NO: 955762 - RNA, 19 nt, Mycobacterium avium subsp. paratuberculosis
cgacagcgccugcccggag

SEQ ID NO: 955763 - RNA, 21 nt, Mycobacterium avium subsp. paratuberculosis
cgacagcgacgggccgggcac

SEQ ID NO: 955764 - RNA, 17 nt, Mycobacterium avium subsp. paratuberculosis
cgacagcgcgucggcca

SEQ ID NO: 955765 - RNA, 19 nt, Mycobacterium avium subsp. paratuberculosis
cgacagcgcgucggccagc

SEQ ID NO: 955766 - RNA, 22 nt, Mycobacterium avium subsp. paratuberculosis
cgacagcgcgucggccagcgcg

SEQ ID NO: 955767 - RNA, 17 nt, Mycobacterium avium subsp. paratuberculosis
cgacaggaucgacaacg

SEQ ID NO: 955768 - RNA, 20 nt, Mycobacterium avium subsp. paratuberculosis
cgacaggaugcuggggucgg

SEQ ID NO: 955769 - RNA, 23 nt, Mycobacterium avium subsp. paratuberculosis
cgacaggaugcuggggucggcca

SEQ ID NO: 955770 - RNA, 17 nt, Mycobacterium avium subsp. paratuberculosis
cgacaggcagcccggcu

SEQ ID NO: 955771 - RNA, 21 nt, Mycobacterium avium subsp. paratuberculosis
cgacaggcagcccggcugcgc

SEQ ID NO: 955772 - RNA, 22 nt, Mycobacterium avium subsp. paratuberculosis
cgacaggaaccuggucggggug

SEQ ID NO: 955773 - RNA, 15 nt, Mycobacterium avium subsp. paratuberculosis
cgacagcugagcagc

SEQ ID NO: 955774 - RNA, 22 nt, Mycobacterium avium subsp. paratuberculosis
cgacaggaggguuuucggggcg

SEQ ID NO: 955775 - RNA, 20 nt, Mycobacterium avium subsp. paratuberculosis
cgacagcuccaacagccggu

SEQ ID NO: 955776 - RNA, 21 nt, Mycobacterium avium subsp. paratuberculosis
cgacagcggccuaugcgcccg

SEQ ID NO: 955777 - RNA, 13 nt, Mycobacterium avium subsp. paratuberculosis
cgacagcccgccc

SEQ ID NO: 955778 - RNA, 13 nt, Mycobacterium avium subsp. paratuberculosis
cgacagccgcacc

SEQ ID NO: 955779 - RNA, 15 nt, Mycobacterium avium subsp. paratuberculosis
cgacagccgcaccag

SEQ ID NO: 955780 - RNA, 16 nt, Mycobacterium avium subsp. paratuberculosis
cgacagccgcaccaga

SEQ ID NO: 955781 - RNA, 16 nt, Mycobacterium avium subsp. paratuberculosis
cgacagccgcaccggc

SEQ ID NO: 955782 - RNA, 18 nt, Mycobacterium avium subsp. paratuberculosis
cgacagccgcaccggcgc

SEQ ID NO: 955783 - RNA, 21 nt, Mycobacterium avium subsp. paratuberculosis
cgacagccgcaccggcgccgc

SEQ ID NO: 955784 - RNA, 22 nt, Mycobacterium avium subsp. paratuberculosis
cgacagccgcaccggcgccgcc

SEQ ID NO: 955785 - RNA, 14 nt, Mycobacterium avium subsp. paratuberculosis
cgacagccgcccgg

SEQ ID NO: 955786 - RNA, 17 nt, Mycobacterium avium subsp. paratuberculosis
cgacagccgcccggcgc

SEQ ID NO: 955787 - RNA, 16 nt, Mycobacterium avium subsp. paratuberculosis
cgacagcaccucgccc

SEQ ID NO: 955788 - RNA, 18 nt, Mycobacterium avium subsp. paratuberculosis
cgacagccaaacagguug

SEQ ID NO: 955789 - RNA, 14 nt, Mycobacterium avium subsp. paratuberculosis
cgacagcagcgugg

SEQ ID NO: 955790 - RNA, 20 nt, Mycobacterium avium subsp. paratuberculosis
cgacagcagcucauacagcg

SEQ ID NO: 955791 - RNA, 22 nt, Mycobacterium avium subsp. paratuberculosis
cgacagcaggaucuccggccgg

SEQ ID NO: 955792 - RNA, 23 nt, Mycobacterium avium subsp. paratuberculosis
cgacagcaggaucuccggccggu

SEQ ID NO: 955793 - RNA, 24 nt, Mycobacterium avium subsp. paratuberculosis
cgacagcaggaucuccggccggug

SEQ ID NO: 955794 - RNA, 16 nt, Mycobacterium avium subsp. paratuberculosis
cgacagcacgggcggg

SEQ ID NO: 955795 - RNA, 14 nt, Mycobacterium avium subsp. paratuberculosis
cgacagcacccgcu

SEQ ID NO: 955796 - RNA, 16 nt, Mycobacterium avium subsp. paratuberculosis
cgacagcacccgcugc

SEQ ID NO: 955797 - RNA, 21 nt, Mycobacterium avium subsp. paratuberculosis
cgacagcacccgcugcagccg

SEQ ID NO: 955798 - RNA, 16 nt, Mycobacterium avium subsp. paratuberculosis
cgacacgaucggcaug

SEQ ID NO: 955799 - RNA, 23 nt, Mycobacterium avium subsp. paratuberculosis
cgacacgccgacgauccgcgccc

SEQ ID NO: 955800 - RNA, 23 nt, Mycobacterium avium subsp. paratuberculosis
cgacacgccgacgauccgcgccg

SEQ ID NO: 955801 - RNA, 14 nt, Mycobacterium avium subsp. paratuberculosis
cgacacgccgaucg

SEQ ID NO: 955802 - RNA, 17 nt, Mycobacterium avium subsp. paratuberculosis
cgacacgccgaucggga

SEQ ID NO: 955803 - RNA, 16 nt, Mycobacterium avium subsp. paratuberculosis
cgacacgucgacacgc

SEQ ID NO: 955804 - RNA, 21 nt, Mycobacterium avium subsp. paratuberculosis
cgacacgucgacacgccggcc

SEQ ID NO: 955805 - RNA, 19 nt, Mycobacterium avium subsp. paratuberculosis
cgacacguggaccgagcgc

SEQ ID NO: 955806 - RNA, 11 nt, Mycobacterium avium subsp. paratuberculosis
cgacacgccga

SEQ ID NO: 955807 - RNA, 15 nt, Mycobacterium avium subsp. paratuberculosis
cgacacgggccgcgc

SEQ ID NO: 955808 - RNA, 18 nt, Mycobacterium avium subsp. paratuberculosis
cgacacgggccgcgccga

SEQ ID NO: 955809 - RNA, 23 nt, Mycobacterium avium subsp. paratuberculosis
cgacacgggccgcgccgaggcgc

SEQ ID NO: 955810 - RNA, 20 nt, Mycobacterium avium subsp. paratuberculosis
cgacacggugaacgucgauc

SEQ ID NO: 955811 - RNA, 21 nt, Mycobacterium avium subsp. paratuberculosis
cgacagaaaagagaucgcccc

SEQ ID NO: 955812 - RNA, 17 nt, Mycobacterium avium subsp. paratuberculosis
cgacacguaggccgccu

SEQ ID NO: 955813 - RNA, 22 nt, Mycobacterium avium subsp. paratuberculosis
cgacagcaaaccgaccgccgcg

SEQ ID NO: 955814 - RNA, 16 nt, Mycobacterium avium subsp. paratuberculosis
cgacagaugcggcacc

SEQ ID NO: 955815 - RNA, 24 nt, Mycobacterium avium subsp. paratuberculosis
cgacagauacuucgucgaacucca

SEQ ID NO: 955816 - RNA, 19 nt, Mycobacterium avium subsp. paratuberculosis
cgacgcgaacgcgccccgc

SEQ ID NO: 955817 - RNA, 17 nt, Mycobacterium avium subsp. paratuberculosis
cgacgcgaccggcccga

SEQ ID NO: 955818 - RNA, 13 nt, Mycobacterium avium subsp. paratuberculosis
cgacgccugcgcg

SEQ ID NO: 955819 - RNA, 14 nt, Mycobacterium avium subsp. paratuberculosis
cgacgccgucgagc

SEQ ID NO: 955820 - RNA, 21 nt, Mycobacterium avium subsp. paratuberculosis
cgacgccgucgagccugguga

SEQ ID NO: 955821 - RNA, 22 nt, Mycobacterium avium subsp. paratuberculosis
cgacgccuccacauacgcggcg

SEQ ID NO: 955822 - RNA, 17 nt, Mycobacterium avium subsp. paratuberculosis
cgacgccggcgaggcgg

SEQ ID NO: 955823 - RNA, 14 nt, Mycobacterium avium subsp. paratuberculosis
cgacgccguagauc

SEQ ID NO: 955824 - RNA, 20 nt, Mycobacterium avium subsp. paratuberculosis
cgacgccguagaucacgccg

SEQ ID NO: 955825 - RNA, 20 nt, Mycobacterium avium subsp. paratuberculosis
cgacgccgugcugccggaac

SEQ ID NO: 955826 - RNA, 17 nt, Mycobacterium avium subsp. paratuberculosis
cgacgccgugguccagc

SEQ ID NO: 955827 - RNA, 19 nt, Mycobacterium avium subsp. paratuberculosis
cgacgccgugguccagccg

SEQ ID NO: 955828 - RNA, 14 nt, Mycobacterium avium subsp. paratuberculosis
cgacgccggccacc

SEQ ID NO: 955829 - RNA, 20 nt, Mycobacterium avium subsp. paratuberculosis
cgacgccggucucgaacacg

SEQ ID NO: 955830 - RNA, 20 nt, Mycobacterium avium subsp. paratuberculosis
cgacgccggugaaaccggcg

SEQ ID NO: 955831 - RNA, 22 nt, Mycobacterium avium subsp. paratuberculosis
cgacgccggugaaaccggcgcc

SEQ ID NO: 955832 - RNA, 13 nt, Mycobacterium avium subsp. paratuberculosis
cgacgccgggcag

SEQ ID NO: 955833 - RNA, 18 nt, Mycobacterium avium subsp. paratuberculosis
cgacgccgggcagcgcgc

SEQ ID NO: 955834 - RNA, 13 nt, Mycobacterium avium subsp. paratuberculosis
cgacgccgggcuc

SEQ ID NO: 955835 - RNA, 14 nt, Mycobacterium avium subsp. paratuberculosis
cgacgccgggcucg

SEQ ID NO: 955836 - RNA, 14 nt, Mycobacterium avium subsp. paratuberculosis
cgacgccgcugccg

SEQ ID NO: 955837 - RNA, 12 nt, Mycobacterium avium subsp. paratuberculosis
cgacgccgcugg

SEQ ID NO: 955838 - RNA, 14 nt, Mycobacterium avium subsp. paratuberculosis
cgacgcggcacgcc

SEQ ID NO: 955839 - RNA, 19 nt, Mycobacterium avium subsp. paratuberculosis
cgacgcggcacgccgcucg

SEQ ID NO: 955840 - RNA, 23 nt, Mycobacterium avium subsp. paratuberculosis
cgacgcggcacgccgcucgucgg

SEQ ID NO: 955841 - RNA, 13 nt, Mycobacterium avium subsp. paratuberculosis
cgacgcggccucg

SEQ ID NO: 955842 - RNA, 13 nt, Mycobacterium avium subsp. paratuberculosis
cgacgcggcgacc

SEQ ID NO: 955843 - RNA, 14 nt, Mycobacterium avium subsp. paratuberculosis
cgacgcggcgacca

SEQ ID NO: 955844 - RNA, 15 nt, Mycobacterium avium subsp. paratuberculosis
cgacgcggcgaccac

SEQ ID NO: 955845 - RNA, 18 nt, Mycobacterium avium subsp. paratuberculosis
cgacgcggcgaccaccac

SEQ ID NO: 955846 - RNA, 13 nt, Mycobacterium avium subsp. paratuberculosis
cgacgcggcgauc

SEQ ID NO: 955847 - RNA, 14 nt, Mycobacterium avium subsp. paratuberculosis
cgacgcggcgaucu

SEQ ID NO: 955848 - RNA, 16 nt, Mycobacterium avium subsp. paratuberculosis
cgacgcgcucagcccc

SEQ ID NO: 955849 - RNA, 17 nt, Mycobacterium avium subsp. paratuberculosis
cgacgcgcucagcccca

SEQ ID NO: 955850 - RNA, 21 nt, Mycobacterium avium subsp. paratuberculosis
cgacgcgcucagccccagcgg

SEQ ID NO: 955851 - RNA, 22 nt, Mycobacterium avium subsp. paratuberculosis
cgacgcgcucagccccagcgga

SEQ ID NO: 955852 - RNA, 15 nt, Mycobacterium avium subsp. paratuberculosis
cgacgcgcucggcga

SEQ ID NO: 955853 - RNA, 16 nt, Mycobacterium avium subsp. paratuberculosis
cgacgcgcucggcgac

SEQ ID NO: 955854 - RNA, 17 nt, Mycobacterium avium subsp. paratuberculosis
cgacgcgcucggcgacc

SEQ ID NO: 955855 - RNA, 18 nt, Mycobacterium avium subsp. paratuberculosis
cgacgcgcucggcgaccg

SEQ ID NO: 955856 - RNA, 20 nt, Mycobacterium avium subsp. paratuberculosis
cgacgcgcucggcgaccgcc

SEQ ID NO: 955857 - RNA, 22 nt, Mycobacterium avium subsp. paratuberculosis
cgacgcgcucggcgaccgccgg

SEQ ID NO: 955858 - RNA, 15 nt, Mycobacterium avium subsp. paratuberculosis
cgacgcgcugcgcgc

SEQ ID NO: 955859 - RNA, 20 nt, Mycobacterium avium subsp. paratuberculosis
cgacgcgcugcgcgccgccc

SEQ ID NO: 955860 - RNA, 19 nt, Mycobacterium avium subsp. paratuberculosis
cgacgcgcugcuugacccg

SEQ ID NO: 955861 - RNA, 16 nt, Mycobacterium avium subsp. paratuberculosis
cgacgcgccgcacugc

SEQ ID NO: 955862 - RNA, 17 nt, Mycobacterium avium subsp. paratuberculosis
cgacgcgccgucggccc

SEQ ID NO: 955863 - RNA, 22 nt, Mycobacterium avium subsp. paratuberculosis
cgacgcgccgucggcccacggu

SEQ ID NO: 955864 - RNA, 14 nt, Mycobacterium avium subsp. paratuberculosis
cgacgcgacggucg

SEQ ID NO: 955865 - RNA, 24 nt, Mycobacterium avium subsp. paratuberculosis
cgacgcgacggucgugcugggccg

SEQ ID NO: 955866 - RNA, 14 nt, Mycobacterium avium subsp. paratuberculosis
cgacgcgacgcgcu

SEQ ID NO: 955867 - RNA, 19 nt, Mycobacterium avium subsp. paratuberculosis
cgacgcgacgcgcucggcg

SEQ ID NO: 955868 - RNA, 18 nt, Mycobacterium avium subsp. paratuberculosis
cgacgcgaccgaggucga

SEQ ID NO: 955869 - RNA, 15 nt, Mycobacterium avium subsp. paratuberculosis
cgacgccgcgcuggc

SEQ ID NO: 955870 - RNA, 17 nt, Mycobacterium avium subsp. paratuberculosis
cgacgccgcgcuggccg

SEQ ID NO: 955871 - RNA, 20 nt, Mycobacterium avium subsp. paratuberculosis
cgacgccgcggaagccccag

SEQ ID NO: 955872 - RNA, 23 nt, Mycobacterium avium subsp. paratuberculosis
cgacgccgcggaagccccaggcc

SEQ ID NO: 955873 - RNA, 22 nt, Mycobacterium avium subsp. paratuberculosis
cgacgccgcgcaccccgaaccg

SEQ ID NO: 955874 - RNA, 13 nt, Mycobacterium avium subsp. paratuberculosis
cgacgccgcggug

SEQ ID NO: 955875 - RNA, 16 nt, Mycobacterium avium subsp. paratuberculosis
cgacgccgcgguggcc

SEQ ID NO: 955876 - RNA, 21 nt, Mycobacterium avium subsp. paratuberculosis
cgacgccgcgcagcggggcgc

SEQ ID NO: 955877 - RNA, 17 nt, Mycobacterium avium subsp. paratuberculosis
cgacgccgauggugacc

SEQ ID NO: 955878 - RNA, 18 nt, Mycobacterium avium subsp. paratuberculosis
cgacgccgccgccgagcu

SEQ ID NO: 955879 - RNA, 14 nt, Mycobacterium avium subsp. paratuberculosis
cgacgccgccgucg

SEQ ID NO: 955880 - RNA, 15 nt, Mycobacterium avium subsp. paratuberculosis
cgacgccgccgucgu

SEQ ID NO: 955881 - RNA, 15 nt, Mycobacterium avium subsp. paratuberculosis
cgacgcccuuggcgc

SEQ ID NO: 955882 - RNA, 20 nt, Mycobacterium avium subsp. paratuberculosis
cgacgcccuuggcgcccagc

SEQ ID NO: 955883 - RNA, 24 nt, Mycobacterium avium subsp. paratuberculosis
cgacgcccuuggcgcccagcgugg

SEQ ID NO: 955884 - RNA, 13 nt, Mycobacterium avium subsp. paratuberculosis
cgacgccgaacug

SEQ ID NO: 955885 - RNA, 16 nt, Mycobacterium avium subsp. paratuberculosis
cgacgccgaccgcggu

SEQ ID NO: 955886 - RNA, 18 nt, Mycobacterium avium subsp. paratuberculosis
cgacgccgaccgcggucg

SEQ ID NO: 955887 - RNA, 19 nt, Mycobacterium avium subsp. paratuberculosis
cgacgccgaccgcggucgc

SEQ ID NO: 955888 - RNA, 22 nt, Mycobacterium avium subsp. paratuberculosis
cgacgccgaccgcggucgcggc

SEQ ID NO: 955889 - RNA, 14 nt, Mycobacterium avium subsp. paratuberculosis
cgacgccgacacca

SEQ ID NO: 955890 - RNA, 16 nt, Mycobacterium avium subsp. paratuberculosis
cgacgccgacaccagc

SEQ ID NO: 955891 - RNA, 14 nt, Mycobacterium avium subsp. paratuberculosis
cgacgccgacaucg

SEQ ID NO: 955892 - RNA, 16 nt, Mycobacterium avium subsp. paratuberculosis
cgacgccgacaucgcg

SEQ ID NO: 955893 - RNA, 17 nt, Mycobacterium avium subsp. paratuberculosis
cgacgccgauccgcagc

SEQ ID NO: 955894 - RNA, 23 nt, Mycobacterium avium subsp. paratuberculosis
cgacgccgauccgcagccgcugc

SEQ ID NO: 955895 - RNA, 19 nt, Mycobacterium avium subsp. paratuberculosis
cgacgccgaguaacucggc

SEQ ID NO: 955896 - RNA, 17 nt, Mycobacterium avium subsp. paratuberculosis
cgacgcccugccacagc

SEQ ID NO: 955897 - RNA, 18 nt, Mycobacterium avium subsp. paratuberculosis
cgacgcccugccacagcg

SEQ ID NO: 955898 - RNA, 21 nt, Mycobacterium avium subsp. paratuberculosis
cgacgcccugccacagcgaca

SEQ ID NO: 955899 - RNA, 15 nt, Mycobacterium avium subsp. paratuberculosis
cgacgcccggcuucg

SEQ ID NO: 955900 - RNA, 19 nt, Mycobacterium avium subsp. paratuberculosis
cgacgcccggcuucgccgc

SEQ ID NO: 955901 - RNA, 20 nt, Mycobacterium avium subsp. paratuberculosis
cgacgcccggcuucgccgcc

SEQ ID NO: 955902 - RNA, 21 nt, Mycobacterium avium subsp. paratuberculosis
cgacgcccggcuucgccgccg

SEQ ID NO: 955903 - RNA, 22 nt, Mycobacterium avium subsp. paratuberculosis
cgacgcccggcuucgccgccgc

SEQ ID NO: 955904 - RNA, 14 nt, Mycobacterium avium subsp. paratuberculosis
cgacgcccagcgcg

SEQ ID NO: 955905 - RNA, 17 nt, Mycobacterium avium subsp. paratuberculosis
cgacgcccagcgcggcg

SEQ ID NO: 955906 - RNA, 16 nt, Mycobacterium avium subsp. paratuberculosis
cgacgcccaggugcac

SEQ ID NO: 955907 - RNA, 16 nt, Mycobacterium avium subsp. paratuberculosis
cgacgccaugucgaug

SEQ ID NO: 955908 - RNA, 19 nt, Mycobacterium avium subsp. paratuberculosis
cgacgccaugucgaugucg

SEQ ID NO: 955909 - RNA, 23 nt, Mycobacterium avium subsp. paratuberculosis
cgacgccaugucgaugucgacgc

SEQ ID NO: 955910 - RNA, 14 nt, Mycobacterium avium subsp. paratuberculosis
cgacgcccacagcg

SEQ ID NO: 955911 - RNA, 17 nt, Mycobacterium avium subsp. paratuberculosis
cgacgcccacagcgcca

SEQ ID NO: 955912 - RNA, 21 nt, Mycobacterium avium subsp. paratuberculosis
cgacgcccacagcgccagcac

SEQ ID NO: 955913 - RNA, 18 nt, Mycobacterium avium subsp. paratuberculosis
cgacgccaugggcccagc

SEQ ID NO: 955914 - RNA, 19 nt, Mycobacterium avium subsp. paratuberculosis
cgacgccaugggcccagca

SEQ ID NO: 955915 - RNA, 15 nt, Mycobacterium avium subsp. paratuberculosis
cgacgcccacuggua

SEQ ID NO: 955916 - RNA, 13 nt, Mycobacterium avium subsp. paratuberculosis
cgacgcccagcac

SEQ ID NO: 955917 - RNA, 14 nt, Mycobacterium avium subsp. paratuberculosis
cgacgcccagcacc

SEQ ID NO: 955918 - RNA, 15 nt, Mycobacterium avium subsp. paratuberculosis
cgacgaggcgggcga

SEQ ID NO: 955919 - RNA, 18 nt, Mycobacterium avium subsp. paratuberculosis
cgacgaggcgggcgaucu

SEQ ID NO: 955920 - RNA, 13 nt, Mycobacterium avium subsp. paratuberculosis
cgacgagccgggc

SEQ ID NO: 955921 - RNA, 15 nt, Mycobacterium avium subsp. paratuberculosis
cgacgagccgggcca

SEQ ID NO: 955922 - RNA, 13 nt, Mycobacterium avium subsp. paratuberculosis
cgacgagccgucg

SEQ ID NO: 955923 - RNA, 15 nt, Mycobacterium avium subsp. paratuberculosis
cgacgagcgggccga

SEQ ID NO: 955924 - RNA, 17 nt, Mycobacterium avium subsp. paratuberculosis
cgacgagcucgccgcug

SEQ ID NO: 955925 - RNA, 14 nt, Mycobacterium avium subsp. paratuberculosis
cgacgauccgggcc

SEQ ID NO: 955926 - RNA, 16 nt, Mycobacterium avium subsp. paratuberculosis
cgacgauccgggccgg

SEQ ID NO: 955927 - RNA, 18 nt, Mycobacterium avium subsp. paratuberculosis
cgacgauccgggccgguc

SEQ ID NO: 955928 - RNA, 20 nt, Mycobacterium avium subsp. paratuberculosis
cgacgauccgggccggucgg

SEQ ID NO: 955929 - RNA, 23 nt, Mycobacterium avium subsp. paratuberculosis
cgacgauccgggccggucgguca

SEQ ID NO: 955930 - RNA, 21 nt, Mycobacterium avium subsp. paratuberculosis
cgacgaggugaugccguccag

SEQ ID NO: 955931 - RNA, 22 nt, Mycobacterium avium subsp. paratuberculosis
cgacgaggugaugccguccagc

SEQ ID NO: 955932 - RNA, 21 nt, Mycobacterium avium subsp. paratuberculosis
cgacgagguugucccgggcga

SEQ ID NO: 955933 - RNA, 22 nt, Mycobacterium avium subsp. paratuberculosis
cgacgagguugucccgggcgaa

SEQ ID NO: 955934 - RNA, 13 nt, Mycobacterium avium subsp. paratuberculosis
cgacgagucgacg

SEQ ID NO: 955935 - RNA, 15 nt, Mycobacterium avium subsp. paratuberculosis
cgacgagcccgccgg

SEQ ID NO: 955936 - RNA, 19 nt, Mycobacterium avium subsp. paratuberculosis
cgacgagcccgccggcggg

SEQ ID NO: 955937 - RNA, 22 nt, Mycobacterium avium subsp. paratuberculosis
cgacgagcccgccggcggguug

SEQ ID NO: 955938 - RNA, 13 nt, Mycobacterium avium subsp. paratuberculosis
cgacgagccgacg

SEQ ID NO: 955939 - RNA, 14 nt, Mycobacterium avium subsp. paratuberculosis
cgacgacgccagcu

SEQ ID NO: 955940 - RNA, 14 nt, Mycobacterium avium subsp. paratuberculosis
cgacgacgccguca

SEQ ID NO: 955941 - RNA, 15 nt, Mycobacterium avium subsp. paratuberculosis
cgacgacgccgucac

SEQ ID NO: 955942 - RNA, 14 nt, Mycobacterium avium subsp. paratuberculosis
cgacgacgcggucg

SEQ ID NO: 955943 - RNA, 21 nt, Mycobacterium avium subsp. paratuberculosis
cgacgagcaggcugaucucgg

SEQ ID NO: 955944 - RNA, 15 nt, Mycobacterium avium subsp. paratuberculosis
cgacgaugccggccg

SEQ ID NO: 955945 - RNA, 16 nt, Mycobacterium avium subsp. paratuberculosis
cgacgaugccggccgg

SEQ ID NO: 955946 - RNA, 17 nt, Mycobacterium avium subsp. paratuberculosis
cgacgcaccucggccgg

SEQ ID NO: 955947 - RNA, 14 nt, Mycobacterium avium subsp. paratuberculosis
cgacgcacgaaacc

SEQ ID NO: 955948 - RNA, 13 nt, Mycobacterium avium subsp. paratuberculosis
cgacgcacgccgg

SEQ ID NO: 955949 - RNA, 15 nt, Mycobacterium avium subsp. paratuberculosis
cgacgcacgccggcg

SEQ ID NO: 955950 - RNA, 16 nt, Mycobacterium avium subsp. paratuberculosis
cgacgcacgccggcgg

SEQ ID NO: 955951 - RNA, 17 nt, Mycobacterium avium subsp. paratuberculosis
cgacgcacgccggcggg

SEQ ID NO: 955952 - RNA, 18 nt, Mycobacterium avium subsp. paratuberculosis
cgacgcacgccggcgggg

SEQ ID NO: 955953 - RNA, 20 nt, Mycobacterium avium subsp. paratuberculosis
cgacgcacgccggcgggggu

SEQ ID NO: 955954 - RNA, 18 nt, Mycobacterium avium subsp. paratuberculosis
cgacgaucuugccgaaca

SEQ ID NO: 955955 - RNA, 19 nt, Mycobacterium avium subsp. paratuberculosis
cgacgaucuugccgaacag

SEQ ID NO: 955956 - RNA, 19 nt, Mycobacterium avium subsp. paratuberculosis
cgacgaugaaauccgggac

SEQ ID NO: 955957 - RNA, 22 nt, Mycobacterium avium subsp. paratuberculosis
cgacgaugaacagucggccggc

SEQ ID NO: 955958 - RNA, 19 nt, Mycobacterium avium subsp. paratuberculosis
cgacgaugaagacccgccg

SEQ ID NO: 955959 - RNA, 15 nt, Mycobacterium avium subsp. paratuberculosis
cgacgaucgcgacgg

SEQ ID NO: 955960 - RNA, 19 nt, Mycobacterium avium subsp. paratuberculosis
cgacgaucgcgacggccgg

SEQ ID NO: 955961 - RNA, 13 nt, Mycobacterium avium subsp. paratuberculosis
cgacgaucgcgcc

SEQ ID NO: 955962 - RNA, 18 nt, Mycobacterium avium subsp. paratuberculosis
cgacgaucgcgccggccg

SEQ ID NO: 955963 - RNA, 19 nt, Mycobacterium avium subsp. paratuberculosis
cgacgaucgcgccggccgc

SEQ ID NO: 955964 - RNA, 22 nt, Mycobacterium avium subsp. paratuberculosis
cgacgaucgcgccggccgccgc

SEQ ID NO: 955965 - RNA, 17 nt, Mycobacterium avium subsp. paratuberculosis
cgacgaucggcucgagc

SEQ ID NO: 955966 - RNA, 15 nt, Mycobacterium avium subsp. paratuberculosis
cgacgaccgcaccga

SEQ ID NO: 955967 - RNA, 17 nt, Mycobacterium avium subsp. paratuberculosis
cgacgaccgcaccgacc

SEQ ID NO: 955968 - RNA, 22 nt, Mycobacterium avium subsp. paratuberculosis
cgacgaccgcaccgaccagcgg

SEQ ID NO: 955969 - RNA, 15 nt, Mycobacterium avium subsp. paratuberculosis
cgacgaccgcgacgg

SEQ ID NO: 955970 - RNA, 21 nt, Mycobacterium avium subsp. paratuberculosis
cgacgaccgcgacggcgcccg

SEQ ID NO: 955971 - RNA, 14 nt, Mycobacterium avium subsp. paratuberculosis
cgacgaccgucauc

SEQ ID NO: 955972 - RNA, 19 nt, Mycobacterium avium subsp. paratuberculosis
cgacgaccucccccgacgc

SEQ ID NO: 955973 - RNA, 20 nt, Mycobacterium avium subsp. paratuberculosis
cgacgaccucccccgacgcc

SEQ ID NO: 955974 - RNA, 21 nt, Mycobacterium avium subsp. paratuberculosis
cgacgaccucccccgacgccg

SEQ ID NO: 955975 - RNA, 22 nt, Mycobacterium avium subsp. paratuberculosis
cgacgaccucccccgacgccga

SEQ ID NO: 955976 - RNA, 23 nt, Mycobacterium avium subsp. paratuberculosis
cgacgaccucccccgacgccgac

SEQ ID NO: 955977 - RNA, 18 nt, Mycobacterium avium subsp. paratuberculosis
cgacgaccucgcccgccg

SEQ ID NO: 955978 - RNA, 20 nt, Mycobacterium avium subsp. paratuberculosis
cgacgaccucgcccgccgcg

SEQ ID NO: 955979 - RNA, 15 nt, Mycobacterium avium subsp. paratuberculosis
cgacgaccucgccga

SEQ ID NO: 955980 - RNA, 15 nt, Mycobacterium avium subsp. paratuberculosis
cgacgacgacgucga

SEQ ID NO: 955981 - RNA, 12 nt, Mycobacterium avium subsp. paratuberculosis
cgacgacccgau

SEQ ID NO: 955982 - RNA, 15 nt, Mycobacterium avium subsp. paratuberculosis
cgacgaagcggucgc

SEQ ID NO: 955983 - RNA, 17 nt, Mycobacterium avium subsp. paratuberculosis
cgacgaagcggucgcgg

SEQ ID NO: 955984 - RNA, 18 nt, Mycobacterium avium subsp. paratuberculosis
cgacgaagaucccgcugg

SEQ ID NO: 955985 - RNA, 21 nt, Mycobacterium avium subsp. paratuberculosis
cgacgaagaucccgcuggcca

SEQ ID NO: 955986 - RNA, 15 nt, Mycobacterium avium subsp. paratuberculosis
cgacgaagaugcgcc

SEQ ID NO: 955987 - RNA, 17 nt, Mycobacterium avium subsp. paratuberculosis
cgacgaagaugcgcccg

SEQ ID NO: 955988 - RNA, 18 nt, Mycobacterium avium subsp. paratuberculosis
cgacgaagaugcgcccgg

SEQ ID NO: 955989 - RNA, 13 nt, Mycobacterium avium subsp. paratuberculosis
cgacgaagccgcc

SEQ ID NO: 955990 - RNA, 15 nt, Mycobacterium avium subsp. paratuberculosis
cgacgaagccgccgc

SEQ ID NO: 955991 - RNA, 17 nt, Mycobacterium avium subsp. paratuberculosis
cgacgaagccgccgccc

SEQ ID NO: 955992 - RNA, 21 nt, Mycobacterium avium subsp. paratuberculosis
cgacgaagccgccgcccucgg

SEQ ID NO: 955993 - RNA, 21 nt, Mycobacterium avium subsp. paratuberculosis
cgacgaaccgugcacgaucgc

SEQ ID NO: 955994 - RNA, 17 nt, Mycobacterium avium subsp. paratuberculosis
cgacgaaccgccacacg

SEQ ID NO: 955995 - RNA, 15 nt, Mycobacterium avium subsp. paratuberculosis
cgacgaacgccggca

SEQ ID NO: 955996 - RNA, 20 nt, Mycobacterium avium subsp. paratuberculosis
cgacgaacgccggcaucagc

SEQ ID NO: 955997 - RNA, 15 nt, Mycobacterium avium subsp. paratuberculosis
cgacgaacgcggcgg

SEQ ID NO: 955998 - RNA, 20 nt, Mycobacterium avium subsp. paratuberculosis
cgacgaacgcuuccagcacc

SEQ ID NO: 955999 - RNA, 16 nt, Mycobacterium avium subsp. paratuberculosis
cgacgaacagcaccgc

SEQ ID NO: 956000 - RNA, 21 nt, Mycobacterium avium subsp. paratuberculosis
cgaccugaacgcgcaguggac

SEQ ID NO: 956001 - RNA, 16 nt, Mycobacterium avium subsp. paratuberculosis
cgaccugcaucucgac

SEQ ID NO: 956002 - RNA, 20 nt, Mycobacterium avium subsp. paratuberculosis
cgaccugcaucucgacccgg

SEQ ID NO: 956003 - RNA, 22 nt, Mycobacterium avium subsp. paratuberculosis
cgaccugcaucucgacccgggc

SEQ ID NO: 956004 - RNA, 23 nt, Mycobacterium avium subsp. paratuberculosis
cgaccugaucuucgagacacgcg

SEQ ID NO: 956005 - RNA, 18 nt, Mycobacterium avium subsp. paratuberculosis
cgaccugauuucaucgcg

SEQ ID NO: 956006 - RNA, 20 nt, Mycobacterium avium subsp. paratuberculosis
cgaccugauuucaucgcggc

SEQ ID NO: 956007 - RNA, 21 nt, Mycobacterium avium subsp. paratuberculosis
cgaccugauuucaucgcggcg

SEQ ID NO: 956008 - RNA, 22 nt, Mycobacterium avium subsp. paratuberculosis
cgaccugauuucaucgcggcga

SEQ ID NO: 956009 - RNA, 13 nt, Mycobacterium avium subsp. paratuberculosis
cgaccucccccga

SEQ ID NO: 956010 - RNA, 15 nt, Mycobacterium avium subsp. paratuberculosis
cgaccucccccgacg

SEQ ID NO: 956011 - RNA, 18 nt, Mycobacterium avium subsp. paratuberculosis
cgaccucccccgacgccg

SEQ ID NO: 956012 - RNA, 23 nt, Mycobacterium avium subsp. paratuberculosis
cgaccucuucgcuggacagccac

SEQ ID NO: 956013 - RNA, 14 nt, Mycobacterium avium subsp. paratuberculosis
cgaccucuucggcg

SEQ ID NO: 956014 - RNA, 17 nt, Mycobacterium avium subsp. paratuberculosis
cgaccucuucggcgccg

SEQ ID NO: 956015 - RNA, 19 nt, Mycobacterium avium subsp. paratuberculosis
cgaccucuucggcgccggc

SEQ ID NO: 956016 - RNA, 22 nt, Mycobacterium avium subsp. paratuberculosis
cgaccucuucggcgccggcauc

SEQ ID NO: 956017 - RNA, 23 nt, Mycobacterium avium subsp. paratuberculosis
cgaccucuucggcgccggcaucc

SEQ ID NO: 956018 - RNA, 22 nt, Mycobacterium avium subsp. paratuberculosis
cgaccucggggucggccggauc

SEQ ID NO: 956019 - RNA, 23 nt, Mycobacterium avium subsp. paratuberculosis
cgaccucggggucggccggaucg

SEQ ID NO: 956020 - RNA, 13 nt, Mycobacterium avium subsp. paratuberculosis
cgaccucgggugu

SEQ ID NO: 956021 - RNA, 18 nt, Mycobacterium avium subsp. paratuberculosis
cgaccucgguggugcuga

SEQ ID NO: 956022 - RNA, 23 nt, Mycobacterium avium subsp. paratuberculosis
cgaccucggugucgaggucgucg

SEQ ID NO: 956023 - RNA, 13 nt, Mycobacterium avium subsp. paratuberculosis
cgaccucgucgac

SEQ ID NO: 956024 - RNA, 14 nt, Mycobacterium avium subsp. paratuberculosis
cgaccucgucgacg

SEQ ID NO: 956025 - RNA, 20 nt, Mycobacterium avium subsp. paratuberculosis
cgaccucgucgacggcggcg

SEQ ID NO: 956026 - RNA, 21 nt, Mycobacterium avium subsp. paratuberculosis
cgaccucgucgacggcggcgu

SEQ ID NO: 956027 - RNA, 23 nt, Mycobacterium avium subsp. paratuberculosis
cgaccucgucgacggcggcgucc

SEQ ID NO: 956028 - RNA, 18 nt, Mycobacterium avium subsp. paratuberculosis
cgaccucgucggcggcga

SEQ ID NO: 956029 - RNA, 20 nt, Mycobacterium avium subsp. paratuberculosis
cgaccucgucggcggcgacg

SEQ ID NO: 956030 - RNA, 21 nt, Mycobacterium avium subsp. paratuberculosis
cgaccucgucggcggcgacgg

SEQ ID NO: 956031 - RNA, 22 nt, Mycobacterium avium subsp. paratuberculosis
cgaccucgucggcggcgacggc

SEQ ID NO: 956032 - RNA, 21 nt, Mycobacterium avium subsp. paratuberculosis
cgaccucgucggcggugccga

SEQ ID NO: 956033 - RNA, 18 nt, Mycobacterium avium subsp. paratuberculosis
cgaccucgucgucgauga

SEQ ID NO: 956034 - RNA, 21 nt, Mycobacterium avium subsp. paratuberculosis
cgacccuuccggaacgacgcg

SEQ ID NO: 956035 - RNA, 13 nt, Mycobacterium avium subsp. paratuberculosis
cgaccgacagccg

SEQ ID NO: 956036 - RNA, 19 nt, Mycobacterium avium subsp. paratuberculosis
cgaccgacaguucggcgcg

SEQ ID NO: 956037 - RNA, 21 nt, Mycobacterium avium subsp. paratuberculosis
cgaccgacaguucggcgcgca

SEQ ID NO: 956038 - RNA, 14 nt, Mycobacterium avium subsp. paratuberculosis
cgaccgacccggcc

SEQ ID NO: 956039 - RNA, 15 nt, Mycobacterium avium subsp. paratuberculosis
cgaccgacccggcca

SEQ ID NO: 956040 - RNA, 16 nt, Mycobacterium avium subsp. paratuberculosis
cgaccgacccggccag

SEQ ID NO: 956041 - RNA, 17 nt, Mycobacterium avium subsp. paratuberculosis
cgaccgacccggccagc

SEQ ID NO: 956042 - RNA, 21 nt, Mycobacterium avium subsp. paratuberculosis
cgaccgacccggccagcggca

SEQ ID NO: 956043 - RNA, 19 nt, Mycobacterium avium subsp. paratuberculosis
cgacccgcucgacgcgcac

SEQ ID NO: 956044 - RNA, 16 nt, Mycobacterium avium subsp. paratuberculosis
cgaccgagggcgcggg

SEQ ID NO: 956045 - RNA, 16 nt, Mycobacterium avium subsp. paratuberculosis
cgaccgaggucgacgc

SEQ ID NO: 956046 - RNA, 17 nt, Mycobacterium avium subsp. paratuberculosis
cgaccgaggucgacgcc

SEQ ID NO: 956047 - RNA, 19 nt, Mycobacterium avium subsp. paratuberculosis
cgaccgacgcggucaccgg

SEQ ID NO: 956048 - RNA, 18 nt, Mycobacterium avium subsp. paratuberculosis
cgaccgcaagugcgguca

SEQ ID NO: 956049 - RNA, 19 nt, Mycobacterium avium subsp. paratuberculosis
cgaccgcaagugcggucag

SEQ ID NO: 956050 - RNA, 17 nt, Mycobacterium avium subsp. paratuberculosis
cgaccgcaccgaccagc

SEQ ID NO: 956051 - RNA, 18 nt, Mycobacterium avium subsp. paratuberculosis
cgaccgcaccgaccagcg

SEQ ID NO: 956052 - RNA, 19 nt, Mycobacterium avium subsp. paratuberculosis
cgaccgcaccgaccagcgg

SEQ ID NO: 956053 - RNA, 20 nt, Mycobacterium avium subsp. paratuberculosis
cgaccgcaccgaccagcggg

SEQ ID NO: 956054 - RNA, 15 nt, Mycobacterium avium subsp. paratuberculosis
cgaccgacgcccggc

SEQ ID NO: 956055 - RNA, 12 nt, Mycobacterium avium subsp. paratuberculosis
cgaccgaucagc

SEQ ID NO: 956056 - RNA, 15 nt, Mycobacterium avium subsp. paratuberculosis
cgaccgaucagcgga

SEQ ID NO: 956057 - RNA, 13 nt, Mycobacterium avium subsp. paratuberculosis
cgaccgccgcgaa

SEQ ID NO: 956058 - RNA, 21 nt, Mycobacterium avium subsp. paratuberculosis
cgaccgccgcgaacgggucgg

SEQ ID NO: 956059 - RNA, 16 nt, Mycobacterium avium subsp. paratuberculosis
cgaccgccgcggccgc

SEQ ID NO: 956060 - RNA, 14 nt, Mycobacterium avium subsp. paratuberculosis
cgaccgccgcgucg

SEQ ID NO: 956061 - RNA, 20 nt, Mycobacterium avium subsp. paratuberculosis
cgaccgccgcuagguuuggc

SEQ ID NO: 956062 - RNA, 16 nt, Mycobacterium avium subsp. paratuberculosis
cgaccgccggacacca

SEQ ID NO: 956063 - RNA, 13 nt, Mycobacterium avium subsp. paratuberculosis
cgaccgcgccggg

SEQ ID NO: 956064 - RNA, 14 nt, Mycobacterium avium subsp. paratuberculosis
cgaccgcgccgggg

SEQ ID NO: 956065 - RNA, 13 nt, Mycobacterium avium subsp. paratuberculosis
cgaccgccgccgc

SEQ ID NO: 956066 - RNA, 22 nt, Mycobacterium avium subsp. paratuberculosis
cgaccgcccgggccaggcgcgc

SEQ ID NO: 956067 - RNA, 14 nt, Mycobacterium avium subsp. paratuberculosis
cgaccgcccggggc

SEQ ID NO: 956068 - RNA, 16 nt, Mycobacterium avium subsp. paratuberculosis
cgaccgccgagcgggc

SEQ ID NO: 956069 - RNA, 21 nt, Mycobacterium avium subsp. paratuberculosis
cgaccgccgagcgggcgaucu

SEQ ID NO: 956070 - RNA, 18 nt, Mycobacterium avium subsp. paratuberculosis
cgaccgccagcagcagcc

SEQ ID NO: 956071 - RNA, 23 nt, Mycobacterium avium subsp. paratuberculosis
cgaccgccagcagcagccgcgcc

SEQ ID NO: 956072 - RNA, 17 nt, Mycobacterium avium subsp. paratuberculosis
cgaccgccaccucgagc

SEQ ID NO: 956073 - RNA, 14 nt, Mycobacterium avium subsp. paratuberculosis
cgaccgccccgccg

SEQ ID NO: 956074 - RNA, 15 nt, Mycobacterium avium subsp. paratuberculosis
cgaccgccccgccgg

SEQ ID NO: 956075 - RNA, 18 nt, Mycobacterium avium subsp. paratuberculosis
cgaccgccccgccggugu

SEQ ID NO: 956076 - RNA, 22 nt, Mycobacterium avium subsp. paratuberculosis
cgaccgccccgccggugucggc

SEQ ID NO: 956077 - RNA, 12 nt, Mycobacterium avium subsp. paratuberculosis
cgaccgccacca

SEQ ID NO: 956078 - RNA, 16 nt, Mycobacterium avium subsp. paratuberculosis
cgaccgccaccacccg

SEQ ID NO: 956079 - RNA, 17 nt, Mycobacterium avium subsp. paratuberculosis
cgaccgccaccacccgg

SEQ ID NO: 956080 - RNA, 19 nt, Mycobacterium avium subsp. paratuberculosis
cgaccgccaccacccggcg

SEQ ID NO: 956081 - RNA, 20 nt, Mycobacterium avium subsp. paratuberculosis
cgaccgccaccacccggcga

SEQ ID NO: 956082 - RNA, 22 nt, Mycobacterium avium subsp. paratuberculosis
cgaccgggaucguguggccgcc

SEQ ID NO: 956083 - RNA, 19 nt, Mycobacterium avium subsp. paratuberculosis
cgaccggcucucagccgga

SEQ ID NO: 956084 - RNA, 18 nt, Mycobacterium avium subsp. paratuberculosis
cgaccggcucagcccggc

SEQ ID NO: 956085 - RNA, 23 nt, Mycobacterium avium subsp. paratuberculosis
cgaccggcucagcccggcgcuca

SEQ ID NO: 956086 - RNA, 16 nt, Mycobacterium avium subsp. paratuberculosis
cgaccgcggucgcggc

SEQ ID NO: 956087 - RNA, 17 nt, Mycobacterium avium subsp. paratuberculosis
cgaccgcggucgcggcg

SEQ ID NO: 956088 - RNA, 19 nt, Mycobacterium avium subsp. paratuberculosis
cgaccgcggucgcggcgcc

SEQ ID NO: 956089 - RNA, 19 nt, Mycobacterium avium subsp. paratuberculosis
cgaccgcgguggcggugcg

SEQ ID NO: 956090 - RNA, 19 nt, Mycobacterium avium subsp. paratuberculosis
cgaccgcguacagggcguc

SEQ ID NO: 956091 - RNA, 17 nt, Mycobacterium avium subsp. paratuberculosis
cgaccgcguccgaggcg

SEQ ID NO: 956092 - RNA, 13 nt, Mycobacterium avium subsp. paratuberculosis
cgaccgcgucgac

SEQ ID NO: 956093 - RNA, 14 nt, Mycobacterium avium subsp. paratuberculosis
cgaccgcgucgacg

SEQ ID NO: 956094 - RNA, 17 nt, Mycobacterium avium subsp. paratuberculosis
cgaccgcgucgacggcg

SEQ ID NO: 956095 - RNA, 21 nt, Mycobacterium avium subsp. paratuberculosis
cgaccgcgucgacggcgugga

SEQ ID NO: 956096 - RNA, 14 nt, Mycobacterium avium subsp. paratuberculosis
cgaccgcgugucgg

SEQ ID NO: 956097 - RNA, 18 nt, Mycobacterium avium subsp. paratuberculosis
cgaccgcgugucggcaca

SEQ ID NO: 956098 - RNA, 21 nt, Mycobacterium avium subsp. paratuberculosis
cgaccgcgugucggcacacca

SEQ ID NO: 956099 - RNA, 12 nt, Mycobacterium avium subsp. paratuberculosis
cgaccgcggcga

SEQ ID NO: 956100 - RNA, 20 nt, Mycobacterium avium subsp. paratuberculosis
cgaccgcggcgauggcccgc

SEQ ID NO: 956101 - RNA, 23 nt, Mycobacterium avium subsp. paratuberculosis
cgaccgcggcgauggcccgcugc

SEQ ID NO: 956102 - RNA, 13 nt, Mycobacterium avium subsp. paratuberculosis
cgaccgcggcgcc

SEQ ID NO: 956103 - RNA, 15 nt, Mycobacterium avium subsp. paratuberculosis
cgaccgcggcgccga

SEQ ID NO: 956104 - RNA, 18 nt, Mycobacterium avium subsp. paratuberculosis
cgaccgcggcuccggccg

SEQ ID NO: 956105 - RNA, 21 nt, Mycobacterium avium subsp. paratuberculosis
cgaccgcggcuccggccgcgc

SEQ ID NO: 956106 - RNA, 14 nt, Mycobacterium avium subsp. paratuberculosis
cgaccgcgcgcggc

SEQ ID NO: 956107 - RNA, 15 nt, Mycobacterium avium subsp. paratuberculosis
cgaccgcgcgcggcg

SEQ ID NO: 956108 - RNA, 18 nt, Mycobacterium avium subsp. paratuberculosis
cgaccgcgcgcggcgccg

SEQ ID NO: 956109 - RNA, 21 nt, Mycobacterium avium subsp. paratuberculosis
cgaccgcgcgcggcgccgcgu

SEQ ID NO: 956110 - RNA, 14 nt, Mycobacterium avium subsp. paratuberculosis
cgaccgcggccgcg

SEQ ID NO: 956111 - RNA, 18 nt, Mycobacterium avium subsp. paratuberculosis
cgaccgcggccgcgacgg

SEQ ID NO: 956112 - RNA, 13 nt, Mycobacterium avium subsp. paratuberculosis
cgaccgcggccug

SEQ ID NO: 956113 - RNA, 18 nt, Mycobacterium avium subsp. paratuberculosis
cgaccgcggccuggguga

SEQ ID NO: 956114 - RNA, 15 nt, Mycobacterium avium subsp. paratuberculosis
cgaccgugcccacca

SEQ ID NO: 956115 - RNA, 16 nt, Mycobacterium avium subsp. paratuberculosis
cgaccuccacgagccg

SEQ ID NO: 956116 - RNA, 18 nt, Mycobacterium avium subsp. paratuberculosis
cgaccucaccccgcuugc

SEQ ID NO: 956117 - RNA, 18 nt, Mycobacterium avium subsp. paratuberculosis
cgaccgucgucccgguga

SEQ ID NO: 956118 - RNA, 20 nt, Mycobacterium avium subsp. paratuberculosis
cgaccgguccgccgccggcg

SEQ ID NO: 956119 - RNA, 19 nt, Mycobacterium avium subsp. paratuberculosis
cgaccggucucgaccgcgg

SEQ ID NO: 956120 - RNA, 22 nt, Mycobacterium avium subsp. paratuberculosis
cgaccgucgggacggccagcag

SEQ ID NO: 956121 - RNA, 22 nt, Mycobacterium avium subsp. paratuberculosis
cgaccgucuucuucagccgcag

SEQ ID NO: 956122 - RNA, 17 nt, Mycobacterium avium subsp. paratuberculosis
cgaccgugaggcccggc

SEQ ID NO: 956123 - RNA, 20 nt, Mycobacterium avium subsp. paratuberculosis
cgaccgugaggcccggcgug

SEQ ID NO: 956124 - RNA, 15 nt, Mycobacterium avium subsp. paratuberculosis
cgaccgggcgcuccg

SEQ ID NO: 956125 - RNA, 18 nt, Mycobacterium avium subsp. paratuberculosis
cgaccggggcgccccgcu

SEQ ID NO: 956126 - RNA, 18 nt, Mycobacterium avium subsp. paratuberculosis
cgaccggguccgagguga

SEQ ID NO: 956127 - RNA, 20 nt, Mycobacterium avium subsp. paratuberculosis
cgaccggguccgaggugauc

SEQ ID NO: 956128 - RNA, 15 nt, Mycobacterium avium subsp. paratuberculosis
cgaccgggucugcca

SEQ ID NO: 956129 - RNA, 18 nt, Mycobacterium avium subsp. paratuberculosis
cgaccgggugaacgaggc

SEQ ID NO: 956130 - RNA, 13 nt, Mycobacterium avium subsp. paratuberculosis
cgaccggguuggc

SEQ ID NO: 956131 - RNA, 23 nt, Mycobacterium avium subsp. paratuberculosis
cgaccagguccgguucgaccggc

SEQ ID NO: 956132 - RNA, 21 nt, Mycobacterium avium subsp. paratuberculosis
cgaccaguucgcccuggccgc

SEQ ID NO: 956133 - RNA, 18 nt, Mycobacterium avium subsp. paratuberculosis
cgaccaucagcccgguga

SEQ ID NO: 956134 - RNA, 16 nt, Mycobacterium avium subsp. paratuberculosis
cgaccaucagcgcccg

SEQ ID NO: 956135 - RNA, 20 nt, Mycobacterium avium subsp. paratuberculosis
cgaccaguucuucgaugacg

SEQ ID NO: 956136 - RNA, 13 nt, Mycobacterium avium subsp. paratuberculosis
cgaccagucggcg

SEQ ID NO: 956137 - RNA, 15 nt, Mycobacterium avium subsp. paratuberculosis
cgaccagucggcguc

SEQ ID NO: 956138 - RNA, 17 nt, Mycobacterium avium subsp. paratuberculosis
cgaccagugcccggcca

SEQ ID NO: 956139 - RNA, 18 nt, Mycobacterium avium subsp. paratuberculosis
cgaccagugcccggccaa

SEQ ID NO: 956140 - RNA, 18 nt, Mycobacterium avium subsp. paratuberculosis
cgaccaguuccacaccga

SEQ ID NO: 956141 - RNA, 15 nt, Mycobacterium avium subsp. paratuberculosis
cgacccaggccgccg

SEQ ID NO: 956142 - RNA, 16 nt, Mycobacterium avium subsp. paratuberculosis
cgacccaggccgccgc

SEQ ID NO: 956143 - RNA, 19 nt, Mycobacterium avium subsp. paratuberculosis
cgacccaggccgccgccac

SEQ ID NO: 956144 - RNA, 20 nt, Mycobacterium avium subsp. paratuberculosis
cgacccaggccgccgccacc

SEQ ID NO: 956145 - RNA, 18 nt, Mycobacterium avium subsp. paratuberculosis
cgacccccaccgcgacac

SEQ ID NO: 956146 - RNA, 14 nt, Mycobacterium avium subsp. paratuberculosis
cgacccccgccgcg

SEQ ID NO: 956147 - RNA, 16 nt, Mycobacterium avium subsp. paratuberculosis
cgacccccgccgcguc

SEQ ID NO: 956148 - RNA, 14 nt, Mycobacterium avium subsp. paratuberculosis
cgaccccgaugcgc

SEQ ID NO: 956149 - RNA, 15 nt, Mycobacterium avium subsp. paratuberculosis
cgaccccgccagcac

SEQ ID NO: 956150 - RNA, 18 nt, Mycobacterium avium subsp. paratuberculosis
cgaccccgccagcaccga

SEQ ID NO: 956151 - RNA, 14 nt, Mycobacterium avium subsp. paratuberculosis
cgaccccgcccagc

SEQ ID NO: 956152 - RNA, 16 nt, Mycobacterium avium subsp. paratuberculosis
cgaccccgcccagcga

SEQ ID NO: 956153 - RNA, 14 nt, Mycobacterium avium subsp. paratuberculosis
cgaccccgaaggcg

SEQ ID NO: 956154 - RNA, 24 nt, Mycobacterium avium subsp. paratuberculosis
cgaccccgaaggcguuggagccga

SEQ ID NO: 956155 - RNA, 13 nt, Mycobacterium avium subsp. paratuberculosis
cgaccccgccggc

SEQ ID NO: 956156 - RNA, 14 nt, Mycobacterium avium subsp. paratuberculosis
cgaccccgccggcc

SEQ ID NO: 956157 - RNA, 16 nt, Mycobacterium avium subsp. paratuberculosis
cgaccccgccggcccg

SEQ ID NO: 956158 - RNA, 17 nt, Mycobacterium avium subsp. paratuberculosis
cgaccccgccggcccgg

SEQ ID NO: 956159 - RNA, 23 nt, Mycobacterium avium subsp. paratuberculosis
cgaccccgccggcccggucgacu

SEQ ID NO: 956160 - RNA, 12 nt, Mycobacterium avium subsp. paratuberculosis
cgaccccgccgu

SEQ ID NO: 956161 - RNA, 17 nt, Mycobacterium avium subsp. paratuberculosis
cgaccccgccgucgacg

SEQ ID NO: 956162 - RNA, 18 nt, Mycobacterium avium subsp. paratuberculosis
cgaccccgccgucgacgc

SEQ ID NO: 956163 - RNA, 15 nt, Mycobacterium avium subsp. paratuberculosis
cgacccgggccgcca

SEQ ID NO: 956164 - RNA, 17 nt, Mycobacterium avium subsp. paratuberculosis
cgacccgggccgccacg

SEQ ID NO: 956165 - RNA, 20 nt, Mycobacterium avium subsp. paratuberculosis
cgacccgggccgccacggcg

SEQ ID NO: 956166 - RNA, 21 nt, Mycobacterium avium subsp. paratuberculosis
cgacccggcguaguucgucga

SEQ ID NO: 956167 - RNA, 16 nt, Mycobacterium avium subsp. paratuberculosis
cgacccguucuugugg

SEQ ID NO: 956168 - RNA, 14 nt, Mycobacterium avium subsp. paratuberculosis
cgacccggccaccg

SEQ ID NO: 956169 - RNA, 17 nt, Mycobacterium avium subsp. paratuberculosis
cgacccggccaccgccg

SEQ ID NO: 956170 - RNA, 13 nt, Mycobacterium avium subsp. paratuberculosis
cgacccggccagc

SEQ ID NO: 956171 - RNA, 15 nt, Mycobacterium avium subsp. paratuberculosis
cgacccggccagcgg

SEQ ID NO: 956172 - RNA, 17 nt, Mycobacterium avium subsp. paratuberculosis
cgacccggccagcggca

SEQ ID NO: 956173 - RNA, 17 nt, Mycobacterium avium subsp. paratuberculosis
cgacccggauacacggu

SEQ ID NO: 956174 - RNA, 19 nt, Mycobacterium avium subsp. paratuberculosis
cgacccggccgagcgcgcc

SEQ ID NO: 956175 - RNA, 22 nt, Mycobacterium avium subsp. paratuberculosis
cgacccggccgagcgcgccgag

SEQ ID NO: 956176 - RNA, 12 nt, Mycobacterium avium subsp. paratuberculosis
cgacccgggcca

SEQ ID NO: 956177 - RNA, 16 nt, Mycobacterium avium subsp. paratuberculosis
cgacccgggccagcag

SEQ ID NO: 956178 - RNA, 17 nt, Mycobacterium avium subsp. paratuberculosis
cgacccgggccagcagg

SEQ ID NO: 956179 - RNA, 23 nt, Mycobacterium avium subsp. paratuberculosis
cgacccgggccagguucgcgccg

SEQ ID NO: 956180 - RNA, 18 nt, Mycobacterium avium subsp. paratuberculosis
cgacccgcuucgcccggc

SEQ ID NO: 956181 - RNA, 23 nt, Mycobacterium avium subsp. paratuberculosis
cgacccgcuggaacagcgggccg

SEQ ID NO: 956182 - RNA, 14 nt, Mycobacterium avium subsp. paratuberculosis
cgacccgcggcgcc

SEQ ID NO: 956183 - RNA, 20 nt, Mycobacterium avium subsp. paratuberculosis
cgacccgcggcgccgcggcg

SEQ ID NO: 956184 - RNA, 22 nt, Mycobacterium avium subsp. paratuberculosis
cgacccgcuccccgauccggcu

SEQ ID NO: 956185 - RNA, 18 nt, Mycobacterium avium subsp. paratuberculosis
cgacccgcuccgacgcgg

SEQ ID NO: 956186 - RNA, 13 nt, Mycobacterium avium subsp. paratuberculosis
cgaccccggccag

SEQ ID NO: 956187 - RNA, 13 nt, Mycobacterium avium subsp. paratuberculosis
cgaccccggcggc

SEQ ID NO: 956188 - RNA, 16 nt, Mycobacterium avium subsp. paratuberculosis
cgaccaggaucgggau

SEQ ID NO: 956189 - RNA, 22 nt, Mycobacterium avium subsp. paratuberculosis
cgaccaggaucgggaucggcuu

SEQ ID NO: 956190 - RNA, 15 nt, Mycobacterium avium subsp. paratuberculosis
cgaccaggacgucgg

SEQ ID NO: 956191 - RNA, 17 nt, Mycobacterium avium subsp. paratuberculosis
cgaccaggacgucggcc

SEQ ID NO: 956192 - RNA, 20 nt, Mycobacterium avium subsp. paratuberculosis
cgaccaggacgucggccggc

SEQ ID NO: 956193 - RNA, 23 nt, Mycobacterium avium subsp. paratuberculosis
cgaccaggccguuguccgucgaa

SEQ ID NO: 956194 - RNA, 16 nt, Mycobacterium avium subsp. paratuberculosis
cgaccaggcccagcgg

SEQ ID NO: 956195 - RNA, 22 nt, Mycobacterium avium subsp. paratuberculosis
cgaccaguagaaguggccgacc

SEQ ID NO: 956196 - RNA, 17 nt, Mycobacterium avium subsp. paratuberculosis
cgaccaguaggccagca

SEQ ID NO: 956197 - RNA, 18 nt, Mycobacterium avium subsp. paratuberculosis
cgaccaguaggccagcau

SEQ ID NO: 956198 - RNA, 21 nt, Mycobacterium avium subsp. paratuberculosis
cgaccagguccaccccgccaa

SEQ ID NO: 956199 - RNA, 17 nt, Mycobacterium avium subsp. paratuberculosis
cgaccaggcuuggcccg

SEQ ID NO: 956200 - RNA, 20 nt, Mycobacterium avium subsp. paratuberculosis
cgaccaggcucgcgagggcg

SEQ ID NO: 956201 - RNA, 17 nt, Mycobacterium avium subsp. paratuberculosis
cgaccagggcgaucacc

SEQ ID NO: 956202 - RNA, 17 nt, Mycobacterium avium subsp. paratuberculosis
cgaccagguagcgcugc

SEQ ID NO: 956203 - RNA, 15 nt, Mycobacterium avium subsp. paratuberculosis
cgaccagcaccgcgg

SEQ ID NO: 956204 - RNA, 17 nt, Mycobacterium avium subsp. paratuberculosis
cgaccagcaccgcggcg

SEQ ID NO: 956205 - RNA, 15 nt, Mycobacterium avium subsp. paratuberculosis
cgaccagcacccggg

SEQ ID NO: 956206 - RNA, 16 nt, Mycobacterium avium subsp. paratuberculosis
cgaccagcacccgggc

SEQ ID NO: 956207 - RNA, 17 nt, Mycobacterium avium subsp. paratuberculosis
cgaccagcacccgggcc

SEQ ID NO: 956208 - RNA, 23 nt, Mycobacterium avium subsp. paratuberculosis
cgacaguuuaccgugccucgcca

SEQ ID NO: 956209 - RNA, 15 nt, Mycobacterium avium subsp. paratuberculosis
cgaccagccgaggcg

SEQ ID NO: 956210 - RNA, 16 nt, Mycobacterium avium subsp. paratuberculosis
cgaccagccgaggcgc

SEQ ID NO: 956211 - RNA, 22 nt, Mycobacterium avium subsp. paratuberculosis
cgaccagccgaggcgcucgcac

SEQ ID NO: 956212 - RNA, 17 nt, Mycobacterium avium subsp. paratuberculosis
cgaccagcccccgcggg

SEQ ID NO: 956213 - RNA, 19 nt, Mycobacterium avium subsp. paratuberculosis
cgaccagcccccgcggguc

SEQ ID NO: 956214 - RNA, 13 nt, Mycobacterium avium subsp. paratuberculosis
cgaccagccgcau

SEQ ID NO: 956215 - RNA, 13 nt, Mycobacterium avium subsp. paratuberculosis
cgaccagccgggu

SEQ ID NO: 956216 - RNA, 16 nt, Mycobacterium avium subsp. paratuberculosis
cgaccagccggguccg

SEQ ID NO: 956217 - RNA, 20 nt, Mycobacterium avium subsp. paratuberculosis
cgaccagccgguaggccugc

SEQ ID NO: 956218 - RNA, 14 nt, Mycobacterium avium subsp. paratuberculosis
cgaccagcgacggc

SEQ ID NO: 956219 - RNA, 15 nt, Mycobacterium avium subsp. paratuberculosis
cgaccagcgacggca

SEQ ID NO: 956220 - RNA, 17 nt, Mycobacterium avium subsp. paratuberculosis
cgaccagcgacggcagg

SEQ ID NO: 956221 - RNA, 15 nt, Mycobacterium avium subsp. paratuberculosis
cgaccagcgagccca

SEQ ID NO: 956222 - RNA, 19 nt, Mycobacterium avium subsp. paratuberculosis
cgaccagcgagcccagcug

SEQ ID NO: 956223 - RNA, 20 nt, Mycobacterium avium subsp. paratuberculosis
cgaccaggaacacggcucgg

SEQ ID NO: 956224 - RNA, 20 nt, Mycobacterium avium subsp. paratuberculosis
cgaccaggaaguacaccacc

SEQ ID NO: 956225 - RNA, 21 nt, Mycobacterium avium subsp. paratuberculosis
cgaccaggaaguacucgguca

SEQ ID NO: 956226 - RNA, 24 nt, Mycobacterium avium subsp. paratuberculosis
cgagcucaugguguuccaccagcg

SEQ ID NO: 956227 - RNA, 13 nt, Mycobacterium avium subsp. paratuberculosis
cgagcucgauguc

SEQ ID NO: 956228 - RNA, 17 nt, Mycobacterium avium subsp. paratuberculosis
cgagcucgcagucgauc

SEQ ID NO: 956229 - RNA, 19 nt, Mycobacterium avium subsp. paratuberculosis
cgagcugaucgcggccggc

SEQ ID NO: 956230 - RNA, 20 nt, Mycobacterium avium subsp. paratuberculosis
cgagcugaucgcggccggcg

SEQ ID NO: 956231 - RNA, 17 nt, Mycobacterium avium subsp. paratuberculosis
cgagcugaucggcguug

SEQ ID NO: 956232 - RNA, 14 nt, Mycobacterium avium subsp. paratuberculosis
cgagcugcaacgcg

SEQ ID NO: 956233 - RNA, 24 nt, Mycobacterium avium subsp. paratuberculosis
cgagcugcaacgcgucggcgccgg

SEQ ID NO: 956234 - RNA, 17 nt, Mycobacterium avium subsp. paratuberculosis
cgagcugcacgggcgug

SEQ ID NO: 956235 - RNA, 19 nt, Mycobacterium avium subsp. paratuberculosis
cgagcugccccuucgcgac

SEQ ID NO: 956236 - RNA, 18 nt, Mycobacterium avium subsp. paratuberculosis
cgagcugccggcggccgc

SEQ ID NO: 956237 - RNA, 22 nt, Mycobacterium avium subsp. paratuberculosis
cgagcugccggcggccgccggc

SEQ ID NO: 956238 - RNA, 23 nt, Mycobacterium avium subsp. paratuberculosis
cgagcgugcccgcgcccaccugg

SEQ ID NO: 956239 - RNA, 16 nt, Mycobacterium avium subsp. paratuberculosis
cgagcugggcccgcgc

SEQ ID NO: 956240 - RNA, 19 nt, Mycobacterium avium subsp. paratuberculosis
cgagcugggcccgcgcauc

SEQ ID NO: 956241 - RNA, 14 nt, Mycobacterium avium subsp. paratuberculosis
cgagcugggccggc

SEQ ID NO: 956242 - RNA, 20 nt, Mycobacterium avium subsp. paratuberculosis
cgagcugggccggcgccgaa

SEQ ID NO: 956243 - RNA, 13 nt, Mycobacterium avium subsp. paratuberculosis
cgagcuggccgcc

SEQ ID NO: 956244 - RNA, 14 nt, Mycobacterium avium subsp. paratuberculosis
cgagcuggccgccc

SEQ ID NO: 956245 - RNA, 17 nt, Mycobacterium avium subsp. paratuberculosis
cgagcuggccgcccacc

SEQ ID NO: 956246 - RNA, 18 nt, Mycobacterium avium subsp. paratuberculosis
cgagcuggccgcccacca

SEQ ID NO: 956247 - RNA, 14 nt, Mycobacterium avium subsp. paratuberculosis
cgagcugcgggugc

SEQ ID NO: 956248 - RNA, 19 nt, Mycobacterium avium subsp. paratuberculosis
cgagcugcgggugcucagc

SEQ ID NO: 956249 - RNA, 18 nt, Mycobacterium avium subsp. paratuberculosis
cgagcugcuucgucgccg

SEQ ID NO: 956250 - RNA, 20 nt, Mycobacterium avium subsp. paratuberculosis
cgagcugcuucgucgccggg

SEQ ID NO: 956251 - RNA, 15 nt, Mycobacterium avium subsp. paratuberculosis
cgaggaauccggucc

SEQ ID NO: 956252 - RNA, 20 nt, Mycobacterium avium subsp. paratuberculosis
cgaggaaucgcggcaggcga

SEQ ID NO: 956253 - RNA, 21 nt, Mycobacterium avium subsp. paratuberculosis
cgaggaaccggcagccggcgu

SEQ ID NO: 956254 - RNA, 15 nt, Mycobacterium avium subsp. paratuberculosis
cgaggaacuugcgcc

SEQ ID NO: 956255 - RNA, 15 nt, Mycobacterium avium subsp. paratuberculosis
cgaggaccggcgccg

SEQ ID NO: 956256 - RNA, 16 nt, Mycobacterium avium subsp. paratuberculosis
cgaggaccggcgccgg

SEQ ID NO: 956257 - RNA, 20 nt, Mycobacterium avium subsp. paratuberculosis
cgaggaccggcgccggccgc

SEQ ID NO: 956258 - RNA, 21 nt, Mycobacterium avium subsp. paratuberculosis
cgaggaccggcgccggccgcc

SEQ ID NO: 956259 - RNA, 21 nt, Mycobacterium avium subsp. paratuberculosis
cgaggacggcuuggguguggc

SEQ ID NO: 956260 - RNA, 13 nt, Mycobacterium avium subsp. paratuberculosis
cgaggaugccgcc

SEQ ID NO: 956261 - RNA, 16 nt, Mycobacterium avium subsp. paratuberculosis
cgaggaugccgcccac

SEQ ID NO: 956262 - RNA, 22 nt, Mycobacterium avium subsp. paratuberculosis
cgaggaugccgcccaccaccgg

SEQ ID NO: 956263 - RNA, 20 nt, Mycobacterium avium subsp. paratuberculosis
cgaggaugaccgcggcgaau

SEQ ID NO: 956264 - RNA, 19 nt, Mycobacterium avium subsp. paratuberculosis
cgaggauggggucgcgggc

SEQ ID NO: 956265 - RNA, 23 nt, Mycobacterium avium subsp. paratuberculosis
cgaggauggggucgcgggcgccg

SEQ ID NO: 956266 - RNA, 17 nt, Mycobacterium avium subsp. paratuberculosis
cgagcggcgcaggccgg

SEQ ID NO: 956267 - RNA, 16 nt, Mycobacterium avium subsp. paratuberculosis
cgagcggccguccacc

SEQ ID NO: 956268 - RNA, 19 nt, Mycobacterium avium subsp. paratuberculosis
cgagcggccguccaccacc

SEQ ID NO: 956269 - RNA, 16 nt, Mycobacterium avium subsp. paratuberculosis
cgagcggcgcugcagc

SEQ ID NO: 956270 - RNA, 22 nt, Mycobacterium avium subsp. paratuberculosis
cgagcggcgcugcagcagcccg

SEQ ID NO: 956271 - RNA, 14 nt, Mycobacterium avium subsp. paratuberculosis
cgagcggcugcugg

SEQ ID NO: 956272 - RNA, 21 nt, Mycobacterium avium subsp. paratuberculosis
cgagcggcugcuggucgacgu

SEQ ID NO: 956273 - RNA, 17 nt, Mycobacterium avium subsp. paratuberculosis
cgagcggcuugccgccg

SEQ ID NO: 956274 - RNA, 18 nt, Mycobacterium avium subsp. paratuberculosis
cgagcggcuugccgccgc

SEQ ID NO: 956275 - RNA, 14 nt, Mycobacterium avium subsp. paratuberculosis
cgagcgggcacgcc

SEQ ID NO: 956276 - RNA, 15 nt, Mycobacterium avium subsp. paratuberculosis
cgagcgggcacgccg

SEQ ID NO: 956277 - RNA, 17 nt, Mycobacterium avium subsp. paratuberculosis
cgagcgggcacgccgcc

SEQ ID NO: 956278 - RNA, 18 nt, Mycobacterium avium subsp. paratuberculosis
cgagcgggcacgccgccg

SEQ ID NO: 956279 - RNA, 13 nt, Mycobacterium avium subsp. paratuberculosis
cgagcggaugccg

SEQ ID NO: 956280 - RNA, 22 nt, Mycobacterium avium subsp. paratuberculosis
cgagcggaugccguagcgcaug

SEQ ID NO: 956281 - RNA, 21 nt, Mycobacterium avium subsp. paratuberculosis
cgagcggcccgucgccgauca

SEQ ID NO: 956282 - RNA, 20 nt, Mycobacterium avium subsp. paratuberculosis
cgagcggcccugcgcggccu

SEQ ID NO: 956283 - RNA, 16 nt, Mycobacterium avium subsp. paratuberculosis
cgagcguggggccugg

SEQ ID NO: 956284 - RNA, 15 nt, Mycobacterium avium subsp. paratuberculosis
cgagcgugggggcca

SEQ ID NO: 956285 - RNA, 23 nt, Mycobacterium avium subsp. paratuberculosis
cgagcgugggggccauguacgga

SEQ ID NO: 956286 - RNA, 18 nt, Mycobacterium avium subsp. paratuberculosis
cgagcguucggcgcggau

SEQ ID NO: 956287 - RNA, 13 nt, Mycobacterium avium subsp. paratuberculosis
cgagcucaccgac

SEQ ID NO: 956288 - RNA, 13 nt, Mycobacterium avium subsp. paratuberculosis
cgagcucaccgcc

SEQ ID NO: 956289 - RNA, 17 nt, Mycobacterium avium subsp. paratuberculosis
cgagcucaccgccgaug

SEQ ID NO: 956290 - RNA, 12 nt, Mycobacterium avium subsp. paratuberculosis
cgagcgggccgu

SEQ ID NO: 956291 - RNA, 15 nt, Mycobacterium avium subsp. paratuberculosis
cgagcgggccguggc

SEQ ID NO: 956292 - RNA, 13 nt, Mycobacterium avium subsp. paratuberculosis
cgagcggacgggc

SEQ ID NO: 956293 - RNA, 16 nt, Mycobacterium avium subsp. paratuberculosis
cgagcgcgucguugcc

SEQ ID NO: 956294 - RNA, 22 nt, Mycobacterium avium subsp. paratuberculosis
cgagcgcgugcacgaacgcggc

SEQ ID NO: 956295 - RNA, 22 nt, Mycobacterium avium subsp. paratuberculosis
cgagcgcguucuccaccgcgcg

SEQ ID NO: 956296 - RNA, 20 nt, Mycobacterium avium subsp. paratuberculosis
cgagcgcuaccgcgcucacc

SEQ ID NO: 956297 - RNA, 13 nt, Mycobacterium avium subsp. paratuberculosis
cgagcgcgucgac

SEQ ID NO: 956298 - RNA, 19 nt, Mycobacterium avium subsp. paratuberculosis
cgagcgcgucgaccagccg

SEQ ID NO: 956299 - RNA, 13 nt, Mycobacterium avium subsp. paratuberculosis
cgagcgcgcgauc

SEQ ID NO: 956300 - RNA, 22 nt, Mycobacterium avium subsp. paratuberculosis
cgagcgcgcgaucuccgucacc

SEQ ID NO: 956301 - RNA, 19 nt, Mycobacterium avium subsp. paratuberculosis
cgagcgcgcuguaggucgc

SEQ ID NO: 956302 - RNA, 21 nt, Mycobacterium avium subsp. paratuberculosis
cgagcgcgcuguaggucgcgu

SEQ ID NO: 956303 - RNA, 18 nt, Mycobacterium avium subsp. paratuberculosis
cgagcgcgcugugcgcca

SEQ ID NO: 956304 - RNA, 14 nt, Mycobacterium avium subsp. paratuberculosis
cgagcgcggcccgc

SEQ ID NO: 956305 - RNA, 16 nt, Mycobacterium avium subsp. paratuberculosis
cgagcgcggcccgccg

SEQ ID NO: 956306 - RNA, 17 nt, Mycobacterium avium subsp. paratuberculosis
cgagcgcggcccgccga

SEQ ID NO: 956307 - RNA, 19 nt, Mycobacterium avium subsp. paratuberculosis
cgagcgcgcggugaugacc

SEQ ID NO: 956308 - RNA, 14 nt, Mycobacterium avium subsp. paratuberculosis
cgagccgccgccgg

SEQ ID NO: 956309 - RNA, 22 nt, Mycobacterium avium subsp. paratuberculosis
cgagccgccgccggcgucgccg

SEQ ID NO: 956310 - RNA, 23 nt, Mycobacterium avium subsp. paratuberculosis
cgagccgccgccggcgucgccgc

SEQ ID NO: 956311 - RNA, 13 nt, Mycobacterium avium subsp. paratuberculosis
cgagccgccgcgg

SEQ ID NO: 956312 - RNA, 22 nt, Mycobacterium avium subsp. paratuberculosis
cgagccgccgcgggucggcgac

SEQ ID NO: 956313 - RNA, 23 nt, Mycobacterium avium subsp. paratuberculosis
cgagccgccgcgggucggcgacg

SEQ ID NO: 956314 - RNA, 22 nt, Mycobacterium avium subsp. paratuberculosis
cgagccgccggaucggcagcgc

SEQ ID NO: 956315 - RNA, 14 nt, Mycobacterium avium subsp. paratuberculosis
cgagccgcccaggc

SEQ ID NO: 956316 - RNA, 17 nt, Mycobacterium avium subsp. paratuberculosis
cgagccgcccaggcggg

SEQ ID NO: 956317 - RNA, 18 nt, Mycobacterium avium subsp. paratuberculosis
cgagccgcccaggcgggc

SEQ ID NO: 956318 - RNA, 12 nt, Mycobacterium avium subsp. paratuberculosis
cgagccgcccac

SEQ ID NO: 956319 - RNA, 16 nt, Mycobacterium avium subsp. paratuberculosis
cgagccgcagucgauc

SEQ ID NO: 956320 - RNA, 17 nt, Mycobacterium avium subsp. paratuberculosis
cgagccgcagucgauca

SEQ ID NO: 956321 - RNA, 14 nt, Mycobacterium avium subsp. paratuberculosis
cgagccgcaccgcc

SEQ ID NO: 956322 - RNA, 14 nt, Mycobacterium avium subsp. paratuberculosis
cgagccggcacgcg

SEQ ID NO: 956323 - RNA, 19 nt, Mycobacterium avium subsp. paratuberculosis
cgagccggcacgcgcgccg

SEQ ID NO: 956324 - RNA, 22 nt, Mycobacterium avium subsp. paratuberculosis
cgagccgcgggugacgaucacc

SEQ ID NO: 956325 - RNA, 14 nt, Mycobacterium avium subsp. paratuberculosis
cgagccgcgcgccg

SEQ ID NO: 956326 - RNA, 23 nt, Mycobacterium avium subsp. paratuberculosis
cgagccgcggauggccucggcga

SEQ ID NO: 956327 - RNA, 16 nt, Mycobacterium avium subsp. paratuberculosis
cgagccgcuccaccgc

SEQ ID NO: 956328 - RNA, 20 nt, Mycobacterium avium subsp. paratuberculosis
cgagccgcucccgcagcggg

SEQ ID NO: 956329 - RNA, 23 nt, Mycobacterium avium subsp. paratuberculosis
cgagccgcucccgcagcggggcg

SEQ ID NO: 956330 - RNA, 17 nt, Mycobacterium avium subsp. paratuberculosis
cgagccgcucgcgcacc

SEQ ID NO: 956331 - RNA, 18 nt, Mycobacterium avium subsp. paratuberculosis
cgagccgcucgcgcaccg

SEQ ID NO: 956332 - RNA, 19 nt, Mycobacterium avium subsp. paratuberculosis
cgagccgcucgcgcaccgg

SEQ ID NO: 956333 - RNA, 21 nt, Mycobacterium avium subsp. paratuberculosis
cgagccgcucgcgcaccggga

SEQ ID NO: 956334 - RNA, 13 nt, Mycobacterium avium subsp. paratuberculosis
cgagccgucgacc

SEQ ID NO: 956335 - RNA, 16 nt, Mycobacterium avium subsp. paratuberculosis
cgagccgucgaccggg

SEQ ID NO: 956336 - RNA, 15 nt, Mycobacterium avium subsp. paratuberculosis
cgagccgucgcggga

SEQ ID NO: 956337 - RNA, 21 nt, Mycobacterium avium subsp. paratuberculosis
cgagccggugguuuugcggcc

SEQ ID NO: 956338 - RNA, 23 nt, Mycobacterium avium subsp. paratuberculosis
cgagccggugguuuugcggcccu

SEQ ID NO: 956339 - RNA, 14 nt, Mycobacterium avium subsp. paratuberculosis
cgagccgguugacc

SEQ ID NO: 956340 - RNA, 20 nt, Mycobacterium avium subsp. paratuberculosis
cgagccgguugacccucagc

SEQ ID NO: 956341 - RNA, 12 nt, Mycobacterium avium subsp. paratuberculosis
cgagccgggcag

SEQ ID NO: 956342 - RNA, 12 nt, Mycobacterium avium subsp. paratuberculosis
cgagccgggacc

SEQ ID NO: 956343 - RNA, 17 nt, Mycobacterium avium subsp. paratuberculosis
cgagccgguacggcucg

SEQ ID NO: 956344 - RNA, 19 nt, Mycobacterium avium subsp. paratuberculosis
cgagccgguccgaccagcg

SEQ ID NO: 956345 - RNA, 21 nt, Mycobacterium avium subsp. paratuberculosis
cgagccgguccgaccagcggc

SEQ ID NO: 956346 - RNA, 17 nt, Mycobacterium avium subsp. paratuberculosis
cgagccggucugggcga

SEQ ID NO: 956347 - RNA, 21 nt, Mycobacterium avium subsp. paratuberculosis
cgagccggucugggcgaccau

SEQ ID NO: 956348 - RNA, 15 nt, Mycobacterium avium subsp. paratuberculosis
cgagccggugccgag

SEQ ID NO: 956349 - RNA, 17 nt, Mycobacterium avium subsp. paratuberculosis
cgagccggugccgaggc

SEQ ID NO: 956350 - RNA, 19 nt, Mycobacterium avium subsp. paratuberculosis
cgagccggugccgaggcag

SEQ ID NO: 956351 - RNA, 14 nt, Mycobacterium avium subsp. paratuberculosis
cgagccggugccgc

SEQ ID NO: 956352 - RNA, 13 nt, Mycobacterium avium subsp. paratuberculosis
cgagccgggcgcg

SEQ ID NO: 956353 - RNA, 14 nt, Mycobacterium avium subsp. paratuberculosis
cgagccgggcgcgg

SEQ ID NO: 956354 - RNA, 15 nt, Mycobacterium avium subsp. paratuberculosis
cgagccgggcgcggg

SEQ ID NO: 956355 - RNA, 23 nt, Mycobacterium avium subsp. paratuberculosis
cgagccgggcgcgggcgccgucg

SEQ ID NO: 956356 - RNA, 12 nt, Mycobacterium avium subsp. paratuberculosis
cgagccgggcgg

SEQ ID NO: 956357 - RNA, 13 nt, Mycobacterium avium subsp. paratuberculosis
cgagccgggcggc

SEQ ID NO: 956358 - RNA, 14 nt, Mycobacterium avium subsp. paratuberculosis
cgagccgggcggcc

SEQ ID NO: 956359 - RNA, 15 nt, Mycobacterium avium subsp. paratuberculosis
cgagccgggccaggu

SEQ ID NO: 956360 - RNA, 17 nt, Mycobacterium avium subsp. paratuberculosis
cgagccgggccaggucc

SEQ ID NO: 956361 - RNA, 16 nt, Mycobacterium avium subsp. paratuberculosis
cgagccgggccggguc

SEQ ID NO: 956362 - RNA, 12 nt, Mycobacterium avium subsp. paratuberculosis
cgagccggcggc

SEQ ID NO: 956363 - RNA, 18 nt, Mycobacterium avium subsp. paratuberculosis
cgagccggccggacaccg

SEQ ID NO: 956364 - RNA, 20 nt, Mycobacterium avium subsp. paratuberculosis
cgagccggccggacaccgaa

SEQ ID NO: 956365 - RNA, 15 nt, Mycobacterium avium subsp. paratuberculosis
cgagccggccguagc

SEQ ID NO: 956366 - RNA, 13 nt, Mycobacterium avium subsp. paratuberculosis
cgagccggccguc

SEQ ID NO: 956367 - RNA, 11 nt, Mycobacterium avium subsp. paratuberculosis
cgagccggccc

SEQ ID NO: 956368 - RNA, 13 nt, Mycobacterium avium subsp. paratuberculosis
cgagccggcccgg

SEQ ID NO: 956369 - RNA, 14 nt, Mycobacterium avium subsp. paratuberculosis
cgagccggcggcgu

SEQ ID NO: 956370 - RNA, 21 nt, Mycobacterium avium subsp. paratuberculosis
cgagccggcggcguugaggcg

SEQ ID NO: 956371 - RNA, 14 nt, Mycobacterium avium subsp. paratuberculosis
cgagccggcguacc

SEQ ID NO: 956372 - RNA, 22 nt, Mycobacterium avium subsp. paratuberculosis
cgagccggcguacccgcccaug

SEQ ID NO: 956373 - RNA, 16 nt, Mycobacterium avium subsp. paratuberculosis
cgagccggcgucgccg

SEQ ID NO: 956374 - RNA, 18 nt, Mycobacterium avium subsp. paratuberculosis
cgagcgaacacgugcagc

SEQ ID NO: 956375 - RNA, 22 nt, Mycobacterium avium subsp. paratuberculosis
cgagcgaacacgugcagcucgg

SEQ ID NO: 956376 - RNA, 11 nt, Mycobacterium avium subsp. paratuberculosis
cgagcgagccg

SEQ ID NO: 956377 - RNA, 14 nt, Mycobacterium avium subsp. paratuberculosis
cgagcgagcgcacc

SEQ ID NO: 956378 - RNA, 15 nt, Mycobacterium avium subsp. paratuberculosis
cgagcgagcgcacca

SEQ ID NO: 956379 - RNA, 15 nt, Mycobacterium avium subsp. paratuberculosis
cgagccuggcgcgca

SEQ ID NO: 956380 - RNA, 22 nt, Mycobacterium avium subsp. paratuberculosis
cgagccugggauugccgggcac

SEQ ID NO: 956381 - RNA, 16 nt, Mycobacterium avium subsp. paratuberculosis
cgagcgacgccacggg

SEQ ID NO: 956382 - RNA, 14 nt, Mycobacterium avium subsp. paratuberculosis
cgagcgcaccgccc

SEQ ID NO: 956383 - RNA, 16 nt, Mycobacterium avium subsp. paratuberculosis
cgagcgcaccgcccaa

SEQ ID NO: 956384 - RNA, 14 nt, Mycobacterium avium subsp. paratuberculosis
cgagcgcaccgcgg

SEQ ID NO: 956385 - RNA, 20 nt, Mycobacterium avium subsp. paratuberculosis
cgagcgcaagggccgacauc

SEQ ID NO: 956386 - RNA, 13 nt, Mycobacterium avium subsp. paratuberculosis
cgagcgcccgggc

SEQ ID NO: 956387 - RNA, 14 nt, Mycobacterium avium subsp. paratuberculosis
cgagcgcccgggcg

SEQ ID NO: 956388 - RNA, 15 nt, Mycobacterium avium subsp. paratuberculosis
cgagcgcccgggcgu

SEQ ID NO: 956389 - RNA, 14 nt, Mycobacterium avium subsp. paratuberculosis
cgagcgcagcgggg

SEQ ID NO: 956390 - RNA, 23 nt, Mycobacterium avium subsp. paratuberculosis
cgagcgcagcggggaggcccagc

SEQ ID NO: 956391 - RNA, 12 nt, Mycobacterium avium subsp. paratuberculosis
cgagcgcagcgc

SEQ ID NO: 956392 - RNA, 14 nt, Mycobacterium avium subsp. paratuberculosis
cgagcgcagcgcca

SEQ ID NO: 956393 - RNA, 13 nt, Mycobacterium avium subsp. paratuberculosis
cgagcgcgccgag

SEQ ID NO: 956394 - RNA, 14 nt, Mycobacterium avium subsp. paratuberculosis
cgagcgcgccgaga

SEQ ID NO: 956395 - RNA, 17 nt, Mycobacterium avium subsp. paratuberculosis
cgagcgcgccgagcagc

SEQ ID NO: 956396 - RNA, 22 nt, Mycobacterium avium subsp. paratuberculosis
cgagcgcgccgagguggcccgc

SEQ ID NO: 956397 - RNA, 14 nt, Mycobacterium avium subsp. paratuberculosis
cgagcgcgccgccg

SEQ ID NO: 956398 - RNA, 12 nt, Mycobacterium avium subsp. paratuberculosis
cgagcgcaccag

SEQ ID NO: 956399 - RNA, 14 nt, Mycobacterium avium subsp. paratuberculosis
cgagcgccgcggcc

SEQ ID NO: 956400 - RNA, 20 nt, Mycobacterium avium subsp. paratuberculosis
cgaguuucccgucgucgaug

SEQ ID NO: 956401 - RNA, 15 nt, Mycobacterium avium subsp. paratuberculosis
cgaguuuggcgucga

SEQ ID NO: 956402 - RNA, 18 nt, Mycobacterium avium subsp. paratuberculosis
cgaguucugguaggcggc

SEQ ID NO: 956403 - RNA, 22 nt, Mycobacterium avium subsp. paratuberculosis
cgaguucugguaggcggccggg

SEQ ID NO: 956404 - RNA, 16 nt, Mycobacterium avium subsp. paratuberculosis
cgaguucggcggcccg

SEQ ID NO: 956405 - RNA, 21 nt, Mycobacterium avium subsp. paratuberculosis
cgaguucgucgaccagcgggc

SEQ ID NO: 956406 - RNA, 21 nt, Mycobacterium avium subsp. paratuberculosis
cgaguugauaggucacgccgg

SEQ ID NO: 956407 - RNA, 14 nt, Mycobacterium avium subsp. paratuberculosis
cgaguugccguugu

SEQ ID NO: 956408 - RNA, 13 nt, Mycobacterium avium subsp. paratuberculosis
cgaguuggccggc

SEQ ID NO: 956409 - RNA, 24 nt, Mycobacterium avium subsp. paratuberculosis
cgaguuggccggcacucgccucgg

SEQ ID NO: 956410 - RNA, 14 nt, Mycobacterium avium subsp. paratuberculosis
cgaguggucggccg

SEQ ID NO: 956411 - RNA, 16 nt, Mycobacterium avium subsp. paratuberculosis
cgaguggucggccgcc

SEQ ID NO: 956412 - RNA, 18 nt, Mycobacterium avium subsp. paratuberculosis
cgaguggucggccgccca

SEQ ID NO: 956413 - RNA, 23 nt, Mycobacterium avium subsp. paratuberculosis
cgagugugcauccugggcgucga

SEQ ID NO: 956414 - RNA, 20 nt, Mycobacterium avium subsp. paratuberculosis
cgaguuaugccgucacccag

SEQ ID NO: 956415 - RNA, 13 nt, Mycobacterium avium subsp. paratuberculosis
cgaguucacccga

SEQ ID NO: 956416 - RNA, 19 nt, Mycobacterium avium subsp. paratuberculosis
cgaguucagaagucgcccg

SEQ ID NO: 956417 - RNA, 22 nt, Mycobacterium avium subsp. paratuberculosis
cgaguucagaagucgcccgcgu

SEQ ID NO: 956418 - RNA, 19 nt, Mycobacterium avium subsp. paratuberculosis
cgaguuccaccucgggccg

SEQ ID NO: 956419 - RNA, 20 nt, Mycobacterium avium subsp. paratuberculosis
cgaguuccaccucgggccgg

SEQ ID NO: 956420 - RNA, 14 nt, Mycobacterium avium subsp. paratuberculosis
cgaguuccagcucc

SEQ ID NO: 956421 - RNA, 14 nt, Mycobacterium avium subsp. paratuberculosis
cgaguuccgcgucg

SEQ ID NO: 956422 - RNA, 17 nt, Mycobacterium avium subsp. paratuberculosis
cgaguuccgcgucggcc

SEQ ID NO: 956423 - RNA, 14 nt, Mycobacterium avium subsp. paratuberculosis
cgaguuccugcgac

SEQ ID NO: 956424 - RNA, 22 nt, Mycobacterium avium subsp. paratuberculosis
cgaguuccugcgaccgccgccg

SEQ ID NO: 956425 - RNA, 19 nt, Mycobacterium avium subsp. paratuberculosis
cgaguucgaugacgucgcg

SEQ ID NO: 956426 - RNA, 23 nt, Mycobacterium avium subsp. paratuberculosis
cgaguucgaugacgucgcgcugc

SEQ ID NO: 956427 - RNA, 15 nt, Mycobacterium avium subsp. paratuberculosis
cgaguucgccgucga

SEQ ID NO: 956428 - RNA, 17 nt, Mycobacterium avium subsp. paratuberculosis
cgaguucgccgucgacg

SEQ ID NO: 956429 - RNA, 16 nt, Mycobacterium avium subsp. paratuberculosis
cgaguucggccagauc

SEQ ID NO: 956430 - RNA, 23 nt, Mycobacterium avium subsp. paratuberculosis
cgaguucggccagaucggccagg

SEQ ID NO: 956431 - RNA, 22 nt, Mycobacterium avium subsp. paratuberculosis
cgagugguaccggguggccgug

SEQ ID NO: 956432 - RNA, 14 nt, Mycobacterium avium subsp. paratuberculosis
cgaguggcgaacgg

SEQ ID NO: 956433 - RNA, 15 nt, Mycobacterium avium subsp. paratuberculosis
cgagugcggcgcggu

SEQ ID NO: 956434 - RNA, 17 nt, Mycobacterium avium subsp. paratuberculosis
cgagugcggcgcggugc

SEQ ID NO: 956435 - RNA, 23 nt, Mycobacterium avium subsp. paratuberculosis
cgagugcucgauggccagcgcgu

SEQ ID NO: 956436 - RNA, 21 nt, Mycobacterium avium subsp. paratuberculosis
cgaguggaagucagcgcguga

SEQ ID NO: 956437 - RNA, 13 nt, Mycobacterium avium subsp. paratuberculosis
cgauaccagccgc

SEQ ID NO: 956438 - RNA, 18 nt, Mycobacterium avium subsp. paratuberculosis
cgauaccagccgcggacg

SEQ ID NO: 956439 - RNA, 15 nt, Mycobacterium avium subsp. paratuberculosis
cgauaccguccgcgc

SEQ ID NO: 956440 - RNA, 14 nt, Mycobacterium avium subsp. paratuberculosis
cgauacccgggagc

SEQ ID NO: 956441 - RNA, 22 nt, Mycobacterium avium subsp. paratuberculosis
cgauaugcugcaacggcuggcg

SEQ ID NO: 956442 - RNA, 18 nt, Mycobacterium avium subsp. paratuberculosis
cgauaucggccgcggggc

SEQ ID NO: 956443 - RNA, 15 nt, Mycobacterium avium subsp. paratuberculosis
cgaggcugugggcca

SEQ ID NO: 956444 - RNA, 21 nt, Mycobacterium avium subsp. paratuberculosis
cgaggcugugggccagcagcg

SEQ ID NO: 956445 - RNA, 22 nt, Mycobacterium avium subsp. paratuberculosis
cgaggcugugggccagcagcgu

SEQ ID NO: 956446 - RNA, 21 nt, Mycobacterium avium subsp. paratuberculosis
cgaggcugacgaucgucgacg

SEQ ID NO: 956447 - RNA, 13 nt, Mycobacterium avium subsp. paratuberculosis
cgaggccagcacg

SEQ ID NO: 956448 - RNA, 16 nt, Mycobacterium avium subsp. paratuberculosis
cgaggcguccuccucg

SEQ ID NO: 956449 - RNA, 20 nt, Mycobacterium avium subsp. paratuberculosis
cgaggcguccuccucguccg

SEQ ID NO: 956450 - RNA, 18 nt, Mycobacterium avium subsp. paratuberculosis
cgaggcacagcagcacgu

SEQ ID NO: 956451 - RNA, 19 nt, Mycobacterium avium subsp. paratuberculosis
cgaggcagaaaugcaggcc

SEQ ID NO: 956452 - RNA, 20 nt, Mycobacterium avium subsp. paratuberculosis
cgagguccucgcgcaacugg

SEQ ID NO: 956453 - RNA, 17 nt, Mycobacterium avium subsp. paratuberculosis
cgagguccucggcgaug

SEQ ID NO: 956454 - RNA, 14 nt, Mycobacterium avium subsp. paratuberculosis
cgaggucaccgcga

SEQ ID NO: 956455 - RNA, 17 nt, Mycobacterium avium subsp. paratuberculosis
cgaggucaccgcgggaa

SEQ ID NO: 956456 - RNA, 16 nt, Mycobacterium avium subsp. paratuberculosis
cgaggucaucgagccg

SEQ ID NO: 956457 - RNA, 18 nt, Mycobacterium avium subsp. paratuberculosis
cgaggucaucgagccgag

SEQ ID NO: 956458 - RNA, 21 nt, Mycobacterium avium subsp. paratuberculosis
cgaggucaucgagccgagcac

SEQ ID NO: 956459 - RNA, 16 nt, Mycobacterium avium subsp. paratuberculosis
cgaggucaccaacgcg

SEQ ID NO: 956460 - RNA, 13 nt, Mycobacterium avium subsp. paratuberculosis
cgaggucaccacc

SEQ ID NO: 956461 - RNA, 15 nt, Mycobacterium avium subsp. paratuberculosis
cgaggucaccaccga

SEQ ID NO: 956462 - RNA, 17 nt, Mycobacterium avium subsp. paratuberculosis
cgaggucaccaccgagc

SEQ ID NO: 956463 - RNA, 19 nt, Mycobacterium avium subsp. paratuberculosis
cgaggucaccaccgagccg

SEQ ID NO: 956464 - RNA, 22 nt, Mycobacterium avium subsp. paratuberculosis
cgaggucaccaccgagccggug

SEQ ID NO: 956465 - RNA, 14 nt, Mycobacterium avium subsp. paratuberculosis
cgagguagucggcc

SEQ ID NO: 956466 - RNA, 15 nt, Mycobacterium avium subsp. paratuberculosis
cgagguagucggccu

SEQ ID NO: 956467 - RNA, 15 nt, Mycobacterium avium subsp. paratuberculosis
cgagguagugcgcga

SEQ ID NO: 956468 - RNA, 23 nt, Mycobacterium avium subsp. paratuberculosis
cgagguagugcgcgauggcgugc

SEQ ID NO: 956469 - RNA, 20 nt, Mycobacterium avium subsp. paratuberculosis
cgagguaauggugggcgugg

SEQ ID NO: 956470 - RNA, 14 nt, Mycobacterium avium subsp. paratuberculosis
cgaggguucggugg

SEQ ID NO: 956471 - RNA, 15 nt, Mycobacterium avium subsp. paratuberculosis
cgaggguucgguggc

SEQ ID NO: 956472 - RNA, 21 nt, Mycobacterium avium subsp. paratuberculosis
cgaggguucgguggccccggg

SEQ ID NO: 956473 - RNA, 17 nt, Mycobacterium avium subsp. paratuberculosis
cgagguacugcagcagu

SEQ ID NO: 956474 - RNA, 14 nt, Mycobacterium avium subsp. paratuberculosis
cgagguagaccgcc

SEQ ID NO: 956475 - RNA, 16 nt, Mycobacterium avium subsp. paratuberculosis
cgagguagaccgccga

SEQ ID NO: 956476 - RNA, 17 nt, Mycobacterium avium subsp. paratuberculosis
cgagguagaccgccgag

SEQ ID NO: 956477 - RNA, 19 nt, Mycobacterium avium subsp. paratuberculosis
cgagguagcgugcgcccga

SEQ ID NO: 956478 - RNA, 18 nt, Mycobacterium avium subsp. paratuberculosis
cgagguaggccaccgggu

SEQ ID NO: 956479 - RNA, 19 nt, Mycobacterium avium subsp. paratuberculosis
cgagggcaacgucuggcca

SEQ ID NO: 956480 - RNA, 14 nt, Mycobacterium avium subsp. paratuberculosis
cgagguagggccgg

SEQ ID NO: 956481 - RNA, 16 nt, Mycobacterium avium subsp. paratuberculosis
cgagguagggccgggu

SEQ ID NO: 956482 - RNA, 19 nt, Mycobacterium avium subsp. paratuberculosis
cgagucgaucgccagcgcg

SEQ ID NO: 956483 - RNA, 20 nt, Mycobacterium avium subsp. paratuberculosis
cgagucgaucgccagcgcgc

SEQ ID NO: 956484 - RNA, 20 nt, Mycobacterium avium subsp. paratuberculosis
cgagucgaugaccucgcgcc

SEQ ID NO: 956485 - RNA, 22 nt, Mycobacterium avium subsp. paratuberculosis
cgagucgaagccguccaggccg

SEQ ID NO: 956486 - RNA, 17 nt, Mycobacterium avium subsp. paratuberculosis
cgagucgaagccguggc

SEQ ID NO: 956487 - RNA, 19 nt, Mycobacterium avium subsp. paratuberculosis
cgagucgaagccguggcag

SEQ ID NO: 956488 - RNA, 13 nt, Mycobacterium avium subsp. paratuberculosis
cgagucgaaggcg

SEQ ID NO: 956489 - RNA, 18 nt, Mycobacterium avium subsp. paratuberculosis
cgagucgaaggcgcgggc

SEQ ID NO: 956490 - RNA, 16 nt, Mycobacterium avium subsp. paratuberculosis
cgagucgagcaccgcg

SEQ ID NO: 956491 - RNA, 19 nt, Mycobacterium avium subsp. paratuberculosis
cgagucgagcaccgcgacc

SEQ ID NO: 956492 - RNA, 23 nt, Mycobacterium avium subsp. paratuberculosis
cgagucgagcaccgcgaccacgc

SEQ ID NO: 956493 - RNA, 14 nt, Mycobacterium avium subsp. paratuberculosis
cgaguccgugguca

SEQ ID NO: 956494 - RNA, 15 nt, Mycobacterium avium subsp. paratuberculosis
cgaguccggccaggu

SEQ ID NO: 956495 - RNA, 23 nt, Mycobacterium avium subsp. paratuberculosis
cgaguccggccaggucgccgcgc

SEQ ID NO: 956496 - RNA, 18 nt, Mycobacterium avium subsp. paratuberculosis
cgaguccgcggaggcgag

SEQ ID NO: 956497 - RNA, 20 nt, Mycobacterium avium subsp. paratuberculosis
cgaguccgcggaggcgagca

SEQ ID NO: 956498 - RNA, 18 nt, Mycobacterium avium subsp. paratuberculosis
cgagguuguagaccggga

SEQ ID NO: 956499 - RNA, 20 nt, Mycobacterium avium subsp. paratuberculosis
cgagguuguagaccgggaug

SEQ ID NO: 956500 - RNA, 17 nt, Mycobacterium avium subsp. paratuberculosis
cgagguugaugccgacg

SEQ ID NO: 956501 - RNA, 15 nt, Mycobacterium avium subsp. paratuberculosis
cgaguaacucggccu

SEQ ID NO: 956502 - RNA, 19 nt, Mycobacterium avium subsp. paratuberculosis
cgaguaacucggccuucgc

SEQ ID NO: 956503 - RNA, 17 nt, Mycobacterium avium subsp. paratuberculosis
cgaguaaggccgaggcg

SEQ ID NO: 956504 - RNA, 18 nt, Mycobacterium avium subsp. paratuberculosis
cgaguaaggccgaggcga

SEQ ID NO: 956505 - RNA, 16 nt, Mycobacterium avium subsp. paratuberculosis
cgaggucucccggucc

SEQ ID NO: 956506 - RNA, 17 nt, Mycobacterium avium subsp. paratuberculosis
cgaggucggucgcggca

SEQ ID NO: 956507 - RNA, 12 nt, Mycobacterium avium subsp. paratuberculosis
cgaggucgguga

SEQ ID NO: 956508 - RNA, 12 nt, Mycobacterium avium subsp. paratuberculosis
cgaggucgucga

SEQ ID NO: 956509 - RNA, 14 nt, Mycobacterium avium subsp. paratuberculosis
cgaggucgucggcc

SEQ ID NO: 956510 - RNA, 16 nt, Mycobacterium avium subsp. paratuberculosis
cgaggucgucggccag

SEQ ID NO: 956511 - RNA, 19 nt, Mycobacterium avium subsp. paratuberculosis
cgaggucgucgggcgccgg

SEQ ID NO: 956512 - RNA, 20 nt, Mycobacterium avium subsp. paratuberculosis
cgaggucgucgggcgccggu

SEQ ID NO: 956513 - RNA, 23 nt, Mycobacterium avium subsp. paratuberculosis
cgaggugguuucggggucgccgu

SEQ ID NO: 956514 - RNA, 20 nt, Mycobacterium avium subsp. paratuberculosis
cgaggugugaggagucgggc

SEQ ID NO: 956515 - RNA, 18 nt, Mycobacterium avium subsp. paratuberculosis
cgagguguugucgugccg

SEQ ID NO: 956516 - RNA, 17 nt, Mycobacterium avium subsp. paratuberculosis
cgaggucggacgccucc

SEQ ID NO: 956517 - RNA, 11 nt, Mycobacterium avium subsp. paratuberculosis
cgaggucggcc

SEQ ID NO: 956518 - RNA, 17 nt, Mycobacterium avium subsp. paratuberculosis
cgaggucgccgguguca

SEQ ID NO: 956519 - RNA, 17 nt, Mycobacterium avium subsp. paratuberculosis
cgaggucgcgcagcacc

SEQ ID NO: 956520 - RNA, 18 nt, Mycobacterium avium subsp. paratuberculosis
cgaggucgcgcagcaccu

SEQ ID NO: 956521 - RNA, 16 nt, Mycobacterium avium subsp. paratuberculosis
cgaggucgcggcggcc

SEQ ID NO: 956522 - RNA, 18 nt, Mycobacterium avium subsp. paratuberculosis
cgaggucgcggcggccgg

SEQ ID NO: 956523 - RNA, 13 nt, Mycobacterium avium subsp. paratuberculosis
cgaggucgccgac

SEQ ID NO: 956524 - RNA, 16 nt, Mycobacterium avium subsp. paratuberculosis
cgaggucgccgacagc

SEQ ID NO: 956525 - RNA, 20 nt, Mycobacterium avium subsp. paratuberculosis
cgaggucgccgacagcgucg

SEQ ID NO: 956526 - RNA, 14 nt, Mycobacterium avium subsp. paratuberculosis
cgaggucgccgacg

SEQ ID NO: 956527 - RNA, 18 nt, Mycobacterium avium subsp. paratuberculosis
cgaggucgccgacgccgu

SEQ ID NO: 956528 - RNA, 22 nt, Mycobacterium avium subsp. paratuberculosis
cgaggucgaaccacgcggcggc

SEQ ID NO: 956529 - RNA, 14 nt, Mycobacterium avium subsp. paratuberculosis
cgacgugggcggcc

SEQ ID NO: 956530 - RNA, 18 nt, Mycobacterium avium subsp. paratuberculosis
cgacgugggcggccacca

SEQ ID NO: 956531 - RNA, 13 nt, Mycobacterium avium subsp. paratuberculosis
cgacguggugcac

SEQ ID NO: 956532 - RNA, 19 nt, Mycobacterium avium subsp. paratuberculosis
cgacguggugcaccgccag

SEQ ID NO: 956533 - RNA, 21 nt, Mycobacterium avium subsp. paratuberculosis
cgacguggugcaccgccagcg

SEQ ID NO: 956534 - RNA, 22 nt, Mycobacterium avium subsp. paratuberculosis
cgacguggugcaccgccagcgc

SEQ ID NO: 956535 - RNA, 24 nt, Mycobacterium avium subsp. paratuberculosis
cgacguggugcaccgccagcgcgg

SEQ ID NO: 956536 - RNA, 20 nt, Mycobacterium avium subsp. paratuberculosis
cgacgugucgucgucgccgc

SEQ ID NO: 956537 - RNA, 23 nt, Mycobacterium avium subsp. paratuberculosis
cgacgugucgucgucgccgccgg

SEQ ID NO: 956538 - RNA, 17 nt, Mycobacterium avium subsp. paratuberculosis
cgacguguucaacgcgc

SEQ ID NO: 956539 - RNA, 22 nt, Mycobacterium avium subsp. paratuberculosis
cgacguguucaacgcgccgaug

SEQ ID NO: 956540 - RNA, 18 nt, Mycobacterium avium subsp. paratuberculosis
cgacgugcuuggccagcu

SEQ ID NO: 956541 - RNA, 20 nt, Mycobacterium avium subsp. paratuberculosis
cgacgugcuuggccagcucg

SEQ ID NO: 956542 - RNA, 21 nt, Mycobacterium avium subsp. paratuberculosis
cgacgugcuuggccagcucgg

SEQ ID NO: 956543 - RNA, 23 nt, Mycobacterium avium subsp. paratuberculosis
cgacgugcuuggccagcucggcg

SEQ ID NO: 956544 - RNA, 15 nt, Mycobacterium avium subsp. paratuberculosis
cgacguucgagucgg

SEQ ID NO: 956545 - RNA, 17 nt, Mycobacterium avium subsp. paratuberculosis
cgacguucgagucggcc

SEQ ID NO: 956546 - RNA, 18 nt, Mycobacterium avium subsp. paratuberculosis
cgacguucgagucggcca

SEQ ID NO: 956547 - RNA, 20 nt, Mycobacterium avium subsp. paratuberculosis
cgacguucgagucggccacg

SEQ ID NO: 956548 - RNA, 21 nt, Mycobacterium avium subsp. paratuberculosis
cgacguucgagucggccacgu

SEQ ID NO: 956549 - RNA, 17 nt, Mycobacterium avium subsp. paratuberculosis
cgacguucggcgggcag

SEQ ID NO: 956550 - RNA, 20 nt, Mycobacterium avium subsp. paratuberculosis
cgacguucggcgggcaggcc

SEQ ID NO: 956551 - RNA, 14 nt, Mycobacterium avium subsp. paratuberculosis
cgacguucuuguag

SEQ ID NO: 956552 - RNA, 20 nt, Mycobacterium avium subsp. paratuberculosis
cgacgucugcggcucggcgc

SEQ ID NO: 956553 - RNA, 18 nt, Mycobacterium avium subsp. paratuberculosis
cgacgucugggccgccga

SEQ ID NO: 956554 - RNA, 20 nt, Mycobacterium avium subsp. paratuberculosis
cgacgucugggccgccgagc

SEQ ID NO: 956555 - RNA, 22 nt, Mycobacterium avium subsp. paratuberculosis
cgacgucugggccgccgagcag

SEQ ID NO: 956556 - RNA, 15 nt, Mycobacterium avium subsp. paratuberculosis
cgacgucgucgaccc

SEQ ID NO: 956557 - RNA, 16 nt, Mycobacterium avium subsp. paratuberculosis
cgacgucgucgacccg

SEQ ID NO: 956558 - RNA, 14 nt, Mycobacterium avium subsp. paratuberculosis
cgacgucgucgaug

SEQ ID NO: 956559 - RNA, 21 nt, Mycobacterium avium subsp. paratuberculosis
cgacgucgugcacgccguggc

SEQ ID NO: 956560 - RNA, 17 nt, Mycobacterium avium subsp. paratuberculosis
cgacgucgugggcgauc

SEQ ID NO: 956561 - RNA, 14 nt, Mycobacterium avium subsp. paratuberculosis
cgacgugcgcggcg

SEQ ID NO: 956562 - RNA, 22 nt, Mycobacterium avium subsp. paratuberculosis
cgacgugcucaugucaaugccg

SEQ ID NO: 956563 - RNA, 13 nt, Mycobacterium avium subsp. paratuberculosis
cgacgugcucggc

SEQ ID NO: 956564 - RNA, 14 nt, Mycobacterium avium subsp. paratuberculosis
cgacgugcucggcg

SEQ ID NO: 956565 - RNA, 17 nt, Mycobacterium avium subsp. paratuberculosis
cgacgugcucggcggcc

SEQ ID NO: 956566 - RNA, 18 nt, Mycobacterium avium subsp. paratuberculosis
cgacgugcucggcggccg

SEQ ID NO: 956567 - RNA, 13 nt, Mycobacterium avium subsp. paratuberculosis
cgacgugcagcgc

SEQ ID NO: 956568 - RNA, 15 nt, Mycobacterium avium subsp. paratuberculosis
cgacgugcagcgcca

SEQ ID NO: 956569 - RNA, 21 nt, Mycobacterium avium subsp. paratuberculosis
cgacgugcagcgccagcaccg

SEQ ID NO: 956570 - RNA, 21 nt, Mycobacterium avium subsp. paratuberculosis
cgacgugcccuuccccggcgg

SEQ ID NO: 956571 - RNA, 14 nt, Mycobacterium avium subsp. paratuberculosis
cgacgugccggcga

SEQ ID NO: 956572 - RNA, 16 nt, Mycobacterium avium subsp. paratuberculosis
cgacgugccggcgaug

SEQ ID NO: 956573 - RNA, 17 nt, Mycobacterium avium subsp. paratuberculosis
cgacgugccggcgaugg

SEQ ID NO: 956574 - RNA, 21 nt, Mycobacterium avium subsp. paratuberculosis
cgacgugccguugacgaacag

SEQ ID NO: 956575 - RNA, 21 nt, Mycobacterium avium subsp. paratuberculosis
cgacgucugguuggccggcgg

SEQ ID NO: 956576 - RNA, 20 nt, Mycobacterium avium subsp. paratuberculosis
cgacgugauaguggucgucg

SEQ ID NO: 956577 - RNA, 20 nt, Mycobacterium avium subsp. paratuberculosis
cgacgugaucggcggccugc

SEQ ID NO: 956578 - RNA, 20 nt, Mycobacterium avium subsp. paratuberculosis
cgacgugaucuggucggcca

SEQ ID NO: 956579 - RNA, 24 nt, Mycobacterium avium subsp. paratuberculosis
cgacgugaucuggucggccagcgc

SEQ ID NO: 956580 - RNA, 13 nt, Mycobacterium avium subsp. paratuberculosis
cgacgugaugcac

SEQ ID NO: 956581 - RNA, 20 nt, Mycobacterium avium subsp. paratuberculosis
cgacgugauggucgucgugg

SEQ ID NO: 956582 - RNA, 20 nt, Mycobacterium avium subsp. paratuberculosis
cgacgcguuguugcucggcg

SEQ ID NO: 956583 - RNA, 22 nt, Mycobacterium avium subsp. paratuberculosis
cgacgcguuguugcucggcggc

SEQ ID NO: 956584 - RNA, 15 nt, Mycobacterium avium subsp. paratuberculosis
cgacgcggucgaaca

SEQ ID NO: 956585 - RNA, 23 nt, Mycobacterium avium subsp. paratuberculosis
cgacgcguccguagugcucggcg

SEQ ID NO: 956586 - RNA, 12 nt, Mycobacterium avium subsp. paratuberculosis
cgacgcgucgac

SEQ ID NO: 956587 - RNA, 13 nt, Mycobacterium avium subsp. paratuberculosis
cgacgcgucgcgg

SEQ ID NO: 956588 - RNA, 14 nt, Mycobacterium avium subsp. paratuberculosis
cgacgcgucgcggc

SEQ ID NO: 956589 - RNA, 19 nt, Mycobacterium avium subsp. paratuberculosis
cgacgcggucaccggcucg

SEQ ID NO: 956590 - RNA, 18 nt, Mycobacterium avium subsp. paratuberculosis
cgacgcggugagcgcgcc

SEQ ID NO: 956591 - RNA, 19 nt, Mycobacterium avium subsp. paratuberculosis
cgacgcggugagcgcgccg

SEQ ID NO: 956592 - RNA, 22 nt, Mycobacterium avium subsp. paratuberculosis
cgacgcggugagcgcgccggcc

SEQ ID NO: 956593 - RNA, 15 nt, Mycobacterium avium subsp. paratuberculosis
cgacgcggggcggcg

SEQ ID NO: 956594 - RNA, 17 nt, Mycobacterium avium subsp. paratuberculosis
cgacgcggggcggcggc

SEQ ID NO: 956595 - RNA, 18 nt, Mycobacterium avium subsp. paratuberculosis
cgacgcggggcggcggcg

SEQ ID NO: 956596 - RNA, 20 nt, Mycobacterium avium subsp. paratuberculosis
cgacgcggggcggcggcgcc

SEQ ID NO: 956597 - RNA, 23 nt, Mycobacterium avium subsp. paratuberculosis
cgacgcggggcggcggcgccggg

SEQ ID NO: 956598 - RNA, 19 nt, Mycobacterium avium subsp. paratuberculosis
cgacgcggcucgcgcggug

SEQ ID NO: 956599 - RNA, 14 nt, Mycobacterium avium subsp. paratuberculosis
cgacgcggcggccg

SEQ ID NO: 956600 - RNA, 20 nt, Mycobacterium avium subsp. paratuberculosis
cgacgcggcggccgacagcg

SEQ ID NO: 956601 - RNA, 13 nt, Mycobacterium avium subsp. paratuberculosis
cgacgcggcggga

SEQ ID NO: 956602 - RNA, 14 nt, Mycobacterium avium subsp. paratuberculosis
cgacgcggcgggaa

SEQ ID NO: 956603 - RNA, 14 nt, Mycobacterium avium subsp. paratuberculosis
cgacgcggcgcgac

SEQ ID NO: 956604 - RNA, 15 nt, Mycobacterium avium subsp. paratuberculosis
cgacgcggcgcgaca

SEQ ID NO: 956605 - RNA, 17 nt, Mycobacterium avium subsp. paratuberculosis
cgacgcggcgcgacacc

SEQ ID NO: 956606 - RNA, 18 nt, Mycobacterium avium subsp. paratuberculosis
cgacgcggcgcgacaccg

SEQ ID NO: 956607 - RNA, 19 nt, Mycobacterium avium subsp. paratuberculosis
cgacgcggcgcgacaccgc

SEQ ID NO: 956608 - RNA, 13 nt, Mycobacterium avium subsp. paratuberculosis
cgacgcggcgcgc

SEQ ID NO: 956609 - RNA, 15 nt, Mycobacterium avium subsp. paratuberculosis
cgacgcggcgcgcga

SEQ ID NO: 956610 - RNA, 21 nt, Mycobacterium avium subsp. paratuberculosis
cgacgcggcgcgcgauggaca

SEQ ID NO: 956611 - RNA, 13 nt, Mycobacterium avium subsp. paratuberculosis
cgacgucgguggu

SEQ ID NO: 956612 - RNA, 14 nt, Mycobacterium avium subsp. paratuberculosis
cgacgucgguggug

SEQ ID NO: 956613 - RNA, 17 nt, Mycobacterium avium subsp. paratuberculosis
cgacgucgguggugacg

SEQ ID NO: 956614 - RNA, 21 nt, Mycobacterium avium subsp. paratuberculosis
cgacgucgguguagucggcga

SEQ ID NO: 956615 - RNA, 23 nt, Mycobacterium avium subsp. paratuberculosis
cgacgucgguguagucggcgauc

SEQ ID NO: 956616 - RNA, 16 nt, Mycobacterium avium subsp. paratuberculosis
cgacgucggcgucauc

SEQ ID NO: 956617 - RNA, 17 nt, Mycobacterium avium subsp. paratuberculosis
cgacgucggcgucaucg

SEQ ID NO: 956618 - RNA, 19 nt, Mycobacterium avium subsp. paratuberculosis
cgacgucggcgucaucgac

SEQ ID NO: 956619 - RNA, 15 nt, Mycobacterium avium subsp. paratuberculosis
cgacgucgggcacgg

SEQ ID NO: 956620 - RNA, 18 nt, Mycobacterium avium subsp. paratuberculosis
cgacgucgggcacgguca

SEQ ID NO: 956621 - RNA, 14 nt, Mycobacterium avium subsp. paratuberculosis
cgacgucggggaug

SEQ ID NO: 956622 - RNA, 15 nt, Mycobacterium avium subsp. paratuberculosis
cgacgucggagauca

SEQ ID NO: 956623 - RNA, 18 nt, Mycobacterium avium subsp. paratuberculosis
cgacgcugaacagcagca

SEQ ID NO: 956624 - RNA, 19 nt, Mycobacterium avium subsp. paratuberculosis
cgacgcugaacagcagcag

SEQ ID NO: 956625 - RNA, 18 nt, Mycobacterium avium subsp. paratuberculosis
cgacgcugacgaugcggc

SEQ ID NO: 956626 - RNA, 20 nt, Mycobacterium avium subsp. paratuberculosis
cgacgcugacgaugcggccg

SEQ ID NO: 956627 - RNA, 14 nt, Mycobacterium avium subsp. paratuberculosis
cgacgcugagcacc

SEQ ID NO: 956628 - RNA, 15 nt, Mycobacterium avium subsp. paratuberculosis
cgacgcugagcaccc

SEQ ID NO: 956629 - RNA, 16 nt, Mycobacterium avium subsp. paratuberculosis
cgacgcugagcacccg

SEQ ID NO: 956630 - RNA, 17 nt, Mycobacterium avium subsp. paratuberculosis
cgacgcugagcacccgc

SEQ ID NO: 956631 - RNA, 18 nt, Mycobacterium avium subsp. paratuberculosis
cgacgcugagcacccgcc

SEQ ID NO: 956632 - RNA, 24 nt, Mycobacterium avium subsp. paratuberculosis
cgacgcugagcacccgcccggacg

SEQ ID NO: 956633 - RNA, 23 nt, Mycobacterium avium subsp. paratuberculosis
cgacgcugagccgcucgucgagu

SEQ ID NO: 956634 - RNA, 17 nt, Mycobacterium avium subsp. paratuberculosis
cgacgcugagcgccagg

SEQ ID NO: 956635 - RNA, 21 nt, Mycobacterium avium subsp. paratuberculosis
cgacguccuugaucagcaugu

SEQ ID NO: 956636 - RNA, 14 nt, Mycobacterium avium subsp. paratuberculosis
cgacgucgaacgcg

SEQ ID NO: 956637 - RNA, 23 nt, Mycobacterium avium subsp. paratuberculosis
cgacgucgaacgcguacacggcc

SEQ ID NO: 956638 - RNA, 17 nt, Mycobacterium avium subsp. paratuberculosis
cgacgucgaccgcgacg

SEQ ID NO: 956639 - RNA, 17 nt, Mycobacterium avium subsp. paratuberculosis
cgacgucgaccgcgccg

SEQ ID NO: 956640 - RNA, 22 nt, Mycobacterium avium subsp. paratuberculosis
cgacgucgaccgcgccggggug

SEQ ID NO: 956641 - RNA, 13 nt, Mycobacterium avium subsp. paratuberculosis
cgacgucgacgac

SEQ ID NO: 956642 - RNA, 14 nt, Mycobacterium avium subsp. paratuberculosis
cgacgcucggcgau

SEQ ID NO: 956643 - RNA, 16 nt, Mycobacterium avium subsp. paratuberculosis
cgacgcucggcgaugg

SEQ ID NO: 956644 - RNA, 12 nt, Mycobacterium avium subsp. paratuberculosis
cgacgucgacgg

SEQ ID NO: 956645 - RNA, 13 nt, Mycobacterium avium subsp. paratuberculosis
cgacgucgacggc

SEQ ID NO: 956646 - RNA, 17 nt, Mycobacterium avium subsp. paratuberculosis
cgacgucgagccagcgg

SEQ ID NO: 956647 - RNA, 21 nt, Mycobacterium avium subsp. paratuberculosis
cgacgucgagccagcgggccg

SEQ ID NO: 956648 - RNA, 16 nt, Mycobacterium avium subsp. paratuberculosis
cgacgucgagggcgcc

SEQ ID NO: 956649 - RNA, 18 nt, Mycobacterium avium subsp. paratuberculosis
cgacgucgagggcgccgu

SEQ ID NO: 956650 - RNA, 20 nt, Mycobacterium avium subsp. paratuberculosis
cgacgucgagggcgccguug

SEQ ID NO: 956651 - RNA, 13 nt, Mycobacterium avium subsp. paratuberculosis
cgacgucgccacc

SEQ ID NO: 956652 - RNA, 18 nt, Mycobacterium avium subsp. paratuberculosis
cgacgucgccaccagacc

SEQ ID NO: 956653 - RNA, 23 nt, Mycobacterium avium subsp. paratuberculosis
cgacgucgccaccagaccggcga

SEQ ID NO: 956654 - RNA, 16 nt, Mycobacterium avium subsp. paratuberculosis
cgagaucucgucgaug

SEQ ID NO: 956655 - RNA, 17 nt, Mycobacterium avium subsp. paratuberculosis
cgagaucucgucgaugg

SEQ ID NO: 956656 - RNA, 20 nt, Mycobacterium avium subsp. paratuberculosis
cgagaucuucuccccgccuc

SEQ ID NO: 956657 - RNA, 22 nt, Mycobacterium avium subsp. paratuberculosis
cgagaucuucuccccgccucgg

SEQ ID NO: 956658 - RNA, 21 nt, Mycobacterium avium subsp. paratuberculosis
cgagaugaagacccggccgug

SEQ ID NO: 956659 - RNA, 15 nt, Mycobacterium avium subsp. paratuberculosis
cgagaugaucagccg

SEQ ID NO: 956660 - RNA, 14 nt, Mycobacterium avium subsp. paratuberculosis
cgagaugccgggaa

SEQ ID NO: 956661 - RNA, 18 nt, Mycobacterium avium subsp. paratuberculosis
cgagaugccgggaagcga

SEQ ID NO: 956662 - RNA, 16 nt, Mycobacterium avium subsp. paratuberculosis
cgagaugcguucggcc

SEQ ID NO: 956663 - RNA, 18 nt, Mycobacterium avium subsp. paratuberculosis
cgagaugcguucggccgc

SEQ ID NO: 956664 - RNA, 19 nt, Mycobacterium avium subsp. paratuberculosis
cgagaugcguucggccgca

SEQ ID NO: 956665 - RNA, 21 nt, Mycobacterium avium subsp. paratuberculosis
cgagaugcguucggccgcagc

SEQ ID NO: 956666 - RNA, 14 nt, Mycobacterium avium subsp. paratuberculosis
cgagaugcccaccc

SEQ ID NO: 956667 - RNA, 18 nt, Mycobacterium avium subsp. paratuberculosis
cgagaugcccacccgcuc

SEQ ID NO: 956668 - RNA, 20 nt, Mycobacterium avium subsp. paratuberculosis
cgagaugcccacccgcucgg

SEQ ID NO: 956669 - RNA, 23 nt, Mycobacterium avium subsp. paratuberculosis
cgagaugcccacccgcucggcga

SEQ ID NO: 956670 - RNA, 16 nt, Mycobacterium avium subsp. paratuberculosis
cgagaugccccaggcg

SEQ ID NO: 956671 - RNA, 20 nt, Mycobacterium avium subsp. paratuberculosis
cgagaguuugcccucgucga

SEQ ID NO: 956672 - RNA, 15 nt, Mycobacterium avium subsp. paratuberculosis
cgagaguccgccgcc

SEQ ID NO: 956673 - RNA, 19 nt, Mycobacterium avium subsp. paratuberculosis
cgagaguccgccgccgggc

SEQ ID NO: 956674 - RNA, 16 nt, Mycobacterium avium subsp. paratuberculosis
cgagagucgcuggcgc

SEQ ID NO: 956675 - RNA, 22 nt, Mycobacterium avium subsp. paratuberculosis
cgagagugcaacuagcgacggc

SEQ ID NO: 956676 - RNA, 23 nt, Mycobacterium avium subsp. paratuberculosis
cgagaguaucgccacgccgacca

SEQ ID NO: 956677 - RNA, 13 nt, Mycobacterium avium subsp. paratuberculosis
cgagaucgcggug

SEQ ID NO: 956678 - RNA, 19 nt, Mycobacterium avium subsp. paratuberculosis
cgagaucgcgguggcgccc

SEQ ID NO: 956679 - RNA, 15 nt, Mycobacterium avium subsp. paratuberculosis
cgagagcgcgucgac

SEQ ID NO: 956680 - RNA, 16 nt, Mycobacterium avium subsp. paratuberculosis
cgagagcgcgucgacg

SEQ ID NO: 956681 - RNA, 19 nt, Mycobacterium avium subsp. paratuberculosis
cgagagcgcgucgacgcgg

SEQ ID NO: 956682 - RNA, 20 nt, Mycobacterium avium subsp. paratuberculosis
cgagagcgcgucgacgcggu

SEQ ID NO: 956683 - RNA, 19 nt, Mycobacterium avium subsp. paratuberculosis
cgagagcggaucggcggcg

SEQ ID NO: 956684 - RNA, 20 nt, Mycobacterium avium subsp. paratuberculosis
cgagagcggaucggcggcga

SEQ ID NO: 956685 - RNA, 21 nt, Mycobacterium avium subsp. paratuberculosis
cgagacgaaguccgagccggc

SEQ ID NO: 956686 - RNA, 15 nt, Mycobacterium avium subsp. paratuberculosis
cgagacgagccgccg

SEQ ID NO: 956687 - RNA, 17 nt, Mycobacterium avium subsp. paratuberculosis
cgagacgaugcggucca

SEQ ID NO: 956688 - RNA, 16 nt, Mycobacterium avium subsp. paratuberculosis
cgagaccaugccgccg

SEQ ID NO: 956689 - RNA, 19 nt, Mycobacterium avium subsp. paratuberculosis
cgagaccgucggugcgggg

SEQ ID NO: 956690 - RNA, 14 nt, Mycobacterium avium subsp. paratuberculosis
cgagaccucccggc

SEQ ID NO: 956691 - RNA, 15 nt, Mycobacterium avium subsp. paratuberculosis
cgagaccucccggcg

SEQ ID NO: 956692 - RNA, 18 nt, Mycobacterium avium subsp. paratuberculosis
cgagaccucccggcgcca

SEQ ID NO: 956693 - RNA, 19 nt, Mycobacterium avium subsp. paratuberculosis
cgagaccucccggcgccac

SEQ ID NO: 956694 - RNA, 15 nt, Mycobacterium avium subsp. paratuberculosis
cgagaaaaucgcccg

SEQ ID NO: 956695 - RNA, 19 nt, Mycobacterium avium subsp. paratuberculosis
cgagaaaaucgcccgcgaa

SEQ ID NO: 956696 - RNA, 20 nt, Mycobacterium avium subsp. paratuberculosis
cgagaaaaucgcccgcgaaa

SEQ ID NO: 956697 - RNA, 17 nt, Mycobacterium avium subsp. paratuberculosis
cgagaaacgcgcgcagu

SEQ ID NO: 956698 - RNA, 15 nt, Mycobacterium avium subsp. paratuberculosis
cgagaaaagcggcga

SEQ ID NO: 956699 - RNA, 18 nt, Mycobacterium avium subsp. paratuberculosis
cgagaacagaugccggug

SEQ ID NO: 956700 - RNA, 15 nt, Mycobacterium avium subsp. paratuberculosis
cgagaaaggccagca

SEQ ID NO: 956701 - RNA, 19 nt, Mycobacterium avium subsp. paratuberculosis
cgacuuggucagcccgcgc

SEQ ID NO: 956702 - RNA, 23 nt, Mycobacterium avium subsp. paratuberculosis
cgacuuggucagcccgcgcaccg

SEQ ID NO: 956703 - RNA, 18 nt, Mycobacterium avium subsp. paratuberculosis
cgacuuggugccaugccg

SEQ ID NO: 956704 - RNA, 20 nt, Mycobacterium avium subsp. paratuberculosis
cgacuugguggccagcacca

SEQ ID NO: 956705 - RNA, 15 nt, Mycobacterium avium subsp. paratuberculosis
cgacuugaucgcggc

SEQ ID NO: 956706 - RNA, 16 nt, Mycobacterium avium subsp. paratuberculosis
cgacuucggcucggcg

SEQ ID NO: 956707 - RNA, 18 nt, Mycobacterium avium subsp. paratuberculosis
cgacuucggcucggcgac

SEQ ID NO: 956708 - RNA, 22 nt, Mycobacterium avium subsp. paratuberculosis
cgacuugccaauucacgagucg

SEQ ID NO: 956709 - RNA, 13 nt, Mycobacterium avium subsp. paratuberculosis
cgacuugcgcgcc

SEQ ID NO: 956710 - RNA, 14 nt, Mycobacterium avium subsp. paratuberculosis
cgacuugcgcgccg

SEQ ID NO: 956711 - RNA, 17 nt, Mycobacterium avium subsp. paratuberculosis
cgacuugccgccgcaca

SEQ ID NO: 956712 - RNA, 18 nt, Mycobacterium avium subsp. paratuberculosis
cgacuugccgccggcgca

SEQ ID NO: 956713 - RNA, 15 nt, Mycobacterium avium subsp. paratuberculosis
cgacuucccaguccg

SEQ ID NO: 956714 - RNA, 19 nt, Mycobacterium avium subsp. paratuberculosis
cgacuucccaguccggcca

SEQ ID NO: 956715 - RNA, 20 nt, Mycobacterium avium subsp. paratuberculosis
cgacuucccaguccggccag

SEQ ID NO: 956716 - RNA, 19 nt, Mycobacterium avium subsp. paratuberculosis
cgacuccugguccucgauc

SEQ ID NO: 956717 - RNA, 18 nt, Mycobacterium avium subsp. paratuberculosis
cgacuugaccagcagcug

SEQ ID NO: 956718 - RNA, 19 nt, Mycobacterium avium subsp. paratuberculosis
cgacuugaccagcagcugg

SEQ ID NO: 956719 - RNA, 18 nt, Mycobacterium avium subsp. paratuberculosis
cgacuucuucgccggcgc

SEQ ID NO: 956720 - RNA, 16 nt, Mycobacterium avium subsp. paratuberculosis
cgacuucuacggcggg

SEQ ID NO: 956721 - RNA, 14 nt, Mycobacterium avium subsp. paratuberculosis
cgacuucggccucg

SEQ ID NO: 956722 - RNA, 16 nt, Mycobacterium avium subsp. paratuberculosis
cgacuccucacaccuc

SEQ ID NO: 956723 - RNA, 22 nt, Mycobacterium avium subsp. paratuberculosis
cgacuccucacaccucgcuacg

SEQ ID NO: 956724 - RNA, 16 nt, Mycobacterium avium subsp. paratuberculosis
cgacuccuccggcccg

SEQ ID NO: 956725 - RNA, 13 nt, Mycobacterium avium subsp. paratuberculosis
cgacuccuggccg

SEQ ID NO: 956726 - RNA, 16 nt, Mycobacterium avium subsp. paratuberculosis
cgacuccuggccgaac

SEQ ID NO: 956727 - RNA, 14 nt, Mycobacterium avium subsp. paratuberculosis
cgacuccggcgaca

SEQ ID NO: 956728 - RNA, 13 nt, Mycobacterium avium subsp. paratuberculosis
cgacuccggcgcc

SEQ ID NO: 956729 - RNA, 14 nt, Mycobacterium avium subsp. paratuberculosis
cgacuccggcgccg

SEQ ID NO: 956730 - RNA, 23 nt, Mycobacterium avium subsp. paratuberculosis
cgacuccggcgccggucagcggc

SEQ ID NO: 956731 - RNA, 17 nt, Mycobacterium avium subsp. paratuberculosis
cgacucauucgacuccg

SEQ ID NO: 956732 - RNA, 19 nt, Mycobacterium avium subsp. paratuberculosis
cgacuccaccaccuggccg

SEQ ID NO: 956733 - RNA, 23 nt, Mycobacterium avium subsp. paratuberculosis
cgacuccaccaccuggccggcca

SEQ ID NO: 956734 - RNA, 14 nt, Mycobacterium avium subsp. paratuberculosis
cgacuccagcaccg

SEQ ID NO: 956735 - RNA, 20 nt, Mycobacterium avium subsp. paratuberculosis
cgacuccagcaccggcgcca

SEQ ID NO: 956736 - RNA, 23 nt, Mycobacterium avium subsp. paratuberculosis
cgacuccagcagcgccagcaccg

SEQ ID NO: 956737 - RNA, 17 nt, Mycobacterium avium subsp. paratuberculosis
cgacuccagcagcgccu

SEQ ID NO: 956738 - RNA, 22 nt, Mycobacterium avium subsp. paratuberculosis
cgacuccagcagcgccuugccg

SEQ ID NO: 956739 - RNA, 19 nt, Mycobacterium avium subsp. paratuberculosis
cgacuccccgcccggcaac

SEQ ID NO: 956740 - RNA, 19 nt, Mycobacterium avium subsp. paratuberculosis
aacacagccaaucgccgau

SEQ ID NO: 956741 - RNA, 22 nt, Mycobacterium avium subsp. paratuberculosis
cgagcagagcuacggacgcauc

SEQ ID NO: 956742 - RNA, 20 nt, Mycobacterium avium subsp. paratuberculosis
cgagcagacgugaaaucccc

SEQ ID NO: 956743 - RNA, 22 nt, Mycobacterium avium subsp. paratuberculosis
aacaccacgguguagcggcggc

SEQ ID NO: 956744 - RNA, 14 nt, Mycobacterium avium subsp. paratuberculosis
aacaccacgucguc

SEQ ID NO: 956745 - RNA, 14 nt, Mycobacterium avium subsp. paratuberculosis
aacaccagcccggc

SEQ ID NO: 956746 - RNA, 21 nt, Mycobacterium avium subsp. paratuberculosis
aacaccaccggcaaccgccac

SEQ ID NO: 956747 - RNA, 21 nt, Mycobacterium avium subsp. paratuberculosis
aacacccagaugcccagcggc

SEQ ID NO: 956748 - RNA, 22 nt, Mycobacterium avium subsp. paratuberculosis
aacacccagaugcccagcggca

SEQ ID NO: 956749 - RNA, 22 nt, Mycobacterium avium subsp. paratuberculosis
aacacccagccgcugaacgcga

SEQ ID NO: 956750 - RNA, 16 nt, Mycobacterium avium subsp. paratuberculosis
aacaccaccaggccgu

SEQ ID NO: 956751 - RNA, 20 nt, Mycobacterium avium subsp. paratuberculosis
aacacccggcuucgcugcgc

SEQ ID NO: 956752 - RNA, 14 nt, Mycobacterium avium subsp. paratuberculosis
aacaccccgaccga

SEQ ID NO: 956753 - RNA, 16 nt, Mycobacterium avium subsp. paratuberculosis
aacaccgaaagccgac

SEQ ID NO: 956754 - RNA, 21 nt, Mycobacterium avium subsp. paratuberculosis
aacaccgaaagccgacaccuc

SEQ ID NO: 956755 - RNA, 14 nt, Mycobacterium avium subsp. paratuberculosis
aacacccucggucg

SEQ ID NO: 956756 - RNA, 14 nt, Mycobacterium avium subsp. paratuberculosis
aacacccugcgcca

SEQ ID NO: 956757 - RNA, 19 nt, Mycobacterium avium subsp. paratuberculosis
cgagcagaucacguugauc

SEQ ID NO: 956758 - RNA, 22 nt, Mycobacterium avium subsp. paratuberculosis
cgagcagaucgggucgcccggg

SEQ ID NO: 956759 - RNA, 14 nt, Mycobacterium avium subsp. paratuberculosis
cgagcagcaccacc

SEQ ID NO: 956760 - RNA, 16 nt, Mycobacterium avium subsp. paratuberculosis
cgagcagcaccacccg

SEQ ID NO: 956761 - RNA, 12 nt, Mycobacterium avium subsp. paratuberculosis
cgagcagcaccg

SEQ ID NO: 956762 - RNA, 16 nt, Mycobacterium avium subsp. paratuberculosis
cgagcagcaccgcgac

SEQ ID NO: 956763 - RNA, 18 nt, Mycobacterium avium subsp. paratuberculosis
cgagcagcaccgcgaccc

SEQ ID NO: 956764 - RNA, 17 nt, Mycobacterium avium subsp. paratuberculosis
cgagcagcagccgcagc

SEQ ID NO: 956765 - RNA, 21 nt, Mycobacterium avium subsp. paratuberculosis
cgagcagcagccgcagcggcg

SEQ ID NO: 956766 - RNA, 20 nt, Mycobacterium avium subsp. paratuberculosis
cgagcagcagccgccgggcc

SEQ ID NO: 956767 - RNA, 14 nt, Mycobacterium avium subsp. paratuberculosis
cgagcagcagcgcg

SEQ ID NO: 956768 - RNA, 15 nt, Mycobacterium avium subsp. paratuberculosis
cgagcagcagcgcgg

SEQ ID NO: 956769 - RNA, 17 nt, Mycobacterium avium subsp. paratuberculosis
cgagcagcagcgcggug

SEQ ID NO: 956770 - RNA, 22 nt, Mycobacterium avium subsp. paratuberculosis
cgagcagcagcgcggugccgac

SEQ ID NO: 956771 - RNA, 23 nt, Mycobacterium avium subsp. paratuberculosis
cgagcagcagcgcggugccgacc

SEQ ID NO: 956772 - RNA, 23 nt, Mycobacterium avium subsp. paratuberculosis
cgagcagcccggcgaacaccacg

SEQ ID NO: 956773 - RNA, 18 nt, Mycobacterium avium subsp. paratuberculosis
cgagcagccgaucuggcg

SEQ ID NO: 956774 - RNA, 20 nt, Mycobacterium avium subsp. paratuberculosis
cgagcagccgaucuggcggg

SEQ ID NO: 956775 - RNA, 14 nt, Mycobacterium avium subsp. paratuberculosis
cgagcagccgcgcc

SEQ ID NO: 956776 - RNA, 15 nt, Mycobacterium avium subsp. paratuberculosis
cgagcagccgcgccg

SEQ ID NO: 956777 - RNA, 18 nt, Mycobacterium avium subsp. paratuberculosis
cgagcagccgcgccgggc

SEQ ID NO: 956778 - RNA, 20 nt, Mycobacterium avium subsp. paratuberculosis
cgagcagccgcgccgggcgg

SEQ ID NO: 956779 - RNA, 24 nt, Mycobacterium avium subsp. paratuberculosis
cgagcagccgcgccgggcggaugu

SEQ ID NO: 956780 - RNA, 11 nt, Mycobacterium avium subsp. paratuberculosis
cgagcagccgg

SEQ ID NO: 956781 - RNA, 18 nt, Mycobacterium avium subsp. paratuberculosis
cgagcagccgggccagca

SEQ ID NO: 956782 - RNA, 14 nt, Mycobacterium avium subsp. paratuberculosis
cgagcagccggucc

SEQ ID NO: 956783 - RNA, 14 nt, Mycobacterium avium subsp. paratuberculosis
cgagcagcgcccgg

SEQ ID NO: 956784 - RNA, 19 nt, Mycobacterium avium subsp. paratuberculosis
cgagcagcgcccggcgauc

SEQ ID NO: 956785 - RNA, 20 nt, Mycobacterium avium subsp. paratuberculosis
cgagcagcgcccggcgaucg

SEQ ID NO: 956786 - RNA, 15 nt, Mycobacterium avium subsp. paratuberculosis
cgagcagcgcccggg

SEQ ID NO: 956787 - RNA, 12 nt, Mycobacterium avium subsp. paratuberculosis
cgagcagcgcga

SEQ ID NO: 956788 - RNA, 14 nt, Mycobacterium avium subsp. paratuberculosis
cgagcagccgcaac

SEQ ID NO: 956789 - RNA, 19 nt, Mycobacterium avium subsp. paratuberculosis
cgagcagccgcaaccaaaa

SEQ ID NO: 956790 - RNA, 14 nt, Mycobacterium avium subsp. paratuberculosis
cgagcagcggggug

SEQ ID NO: 956791 - RNA, 14 nt, Mycobacterium avium subsp. paratuberculosis
cgagcagcgggucg

SEQ ID NO: 956792 - RNA, 18 nt, Mycobacterium avium subsp. paratuberculosis
cgagcagcgggucgucgg

SEQ ID NO: 956793 - RNA, 19 nt, Mycobacterium avium subsp. paratuberculosis
cgagcagcgggucgucggg

SEQ ID NO: 956794 - RNA, 23 nt, Mycobacterium avium subsp. paratuberculosis
cgagcagcgugcugacgucgucg

SEQ ID NO: 956795 - RNA, 17 nt, Mycobacterium avium subsp. paratuberculosis
cgagcagcugcagcguc

SEQ ID NO: 956796 - RNA, 19 nt, Mycobacterium avium subsp. paratuberculosis
cgagcagcugcagcgucgg

SEQ ID NO: 956797 - RNA, 15 nt, Mycobacterium avium subsp. paratuberculosis
cgagcagacacaaaa

SEQ ID NO: 956798 - RNA, 22 nt, Mycobacterium avium subsp. paratuberculosis
cgagcagacacaaaagcgcccg

SEQ ID NO: 956799 - RNA, 15 nt, Mycobacterium avium subsp. paratuberculosis
cgagcagacgcgaaa

SEQ ID NO: 956800 - RNA, 18 nt, Mycobacterium avium subsp. paratuberculosis
cgagcagacgcgaaagca

SEQ ID NO: 956801 - RNA, 14 nt, Mycobacterium avium subsp. paratuberculosis
cgagcagacccgcc

SEQ ID NO: 956802 - RNA, 15 nt, Mycobacterium avium subsp. paratuberculosis
cgagcagacccgccg

SEQ ID NO: 956803 - RNA, 16 nt, Mycobacterium avium subsp. paratuberculosis
cgagcagacccgccgc

SEQ ID NO: 956804 - RNA, 18 nt, Mycobacterium avium subsp. paratuberculosis
cgagcagacccgccgcgg

SEQ ID NO: 956805 - RNA, 19 nt, Mycobacterium avium subsp. paratuberculosis
cgagcagacccgccgcggc

SEQ ID NO: 956806 - RNA, 14 nt, Mycobacterium avium subsp. paratuberculosis
cgagcagacgcaaa

SEQ ID NO: 956807 - RNA, 13 nt, Mycobacterium avium subsp. paratuberculosis
cgagcacgccgcc

SEQ ID NO: 956808 - RNA, 15 nt, Mycobacterium avium subsp. paratuberculosis
cgagcacgccgccgg

SEQ ID NO: 956809 - RNA, 12 nt, Mycobacterium avium subsp. paratuberculosis
cgagcacgcggc

SEQ ID NO: 956810 - RNA, 13 nt, Mycobacterium avium subsp. paratuberculosis
cgagcacgcggcc

SEQ ID NO: 956811 - RNA, 16 nt, Mycobacterium avium subsp. paratuberculosis
cgagcaccucgucgcc

SEQ ID NO: 956812 - RNA, 19 nt, Mycobacterium avium subsp. paratuberculosis
cgagcacgcagccgcgccc

SEQ ID NO: 956813 - RNA, 21 nt, Mycobacterium avium subsp. paratuberculosis
cgagcacgcccugcggcuggg

SEQ ID NO: 956814 - RNA, 15 nt, Mycobacterium avium subsp. paratuberculosis
cgagcacggcacgcc

SEQ ID NO: 956815 - RNA, 12 nt, Mycobacterium avium subsp. paratuberculosis
cgagcacgucga

SEQ ID NO: 956816 - RNA, 16 nt, Mycobacterium avium subsp. paratuberculosis
cgagcacgucgacgcc

SEQ ID NO: 956817 - RNA, 13 nt, Mycobacterium avium subsp. paratuberculosis
cgagcacgucgag

SEQ ID NO: 956818 - RNA, 17 nt, Mycobacterium avium subsp. paratuberculosis
cgagcacgucgagcacc

SEQ ID NO: 956819 - RNA, 20 nt, Mycobacterium avium subsp. paratuberculosis
cgagcacgucgagcaccgcg

SEQ ID NO: 956820 - RNA, 23 nt, Mycobacterium avium subsp. paratuberculosis
cgagcacguugugcuucuggcuc

SEQ ID NO: 956821 - RNA, 17 nt, Mycobacterium avium subsp. paratuberculosis
cgagcacucgcgggacg

SEQ ID NO: 956822 - RNA, 22 nt, Mycobacterium avium subsp. paratuberculosis
cgagcacucgcgggacggcggc

SEQ ID NO: 956823 - RNA, 23 nt, Mycobacterium avium subsp. paratuberculosis
cgagcacucgcgggacggcggcg

SEQ ID NO: 956824 - RNA, 22 nt, Mycobacterium avium subsp. paratuberculosis
cgagauguaguccuccgucgcc

SEQ ID NO: 956825 - RNA, 17 nt, Mycobacterium avium subsp. paratuberculosis
cgagauguaucugcgga

SEQ ID NO: 956826 - RNA, 20 nt, Mycobacterium avium subsp. paratuberculosis
cgagauguaucugcggacca

SEQ ID NO: 956827 - RNA, 14 nt, Mycobacterium avium subsp. paratuberculosis
cgagauggcgauca

SEQ ID NO: 956828 - RNA, 14 nt, Mycobacterium avium subsp. paratuberculosis
cgagaugcugugga

SEQ ID NO: 956829 - RNA, 16 nt, Mycobacterium avium subsp. paratuberculosis
cgagauggccaccauc

SEQ ID NO: 956830 - RNA, 18 nt, Mycobacterium avium subsp. paratuberculosis
cgagauuggacgacacca

SEQ ID NO: 956831 - RNA, 23 nt, Mycobacterium avium subsp. paratuberculosis
cgagauuggacgacaccacgguc

SEQ ID NO: 956832 - RNA, 15 nt, Mycobacterium avium subsp. paratuberculosis
cgagcaacagcccga

SEQ ID NO: 956833 - RNA, 16 nt, Mycobacterium avium subsp. paratuberculosis
cgagcaacagcccgac

SEQ ID NO: 956834 - RNA, 17 nt, Mycobacterium avium subsp. paratuberculosis
cgagcaacagcccgacc

SEQ ID NO: 956835 - RNA, 17 nt, Mycobacterium avium subsp. paratuberculosis
cgagcaacggccgcagc

SEQ ID NO: 956836 - RNA, 18 nt, Mycobacterium avium subsp. paratuberculosis
cgagcaacggccgcagcg

SEQ ID NO: 956837 - RNA, 19 nt, Mycobacterium avium subsp. paratuberculosis
cgagcaacggccgcagcga

SEQ ID NO: 956838 - RNA, 20 nt, Mycobacterium avium subsp. paratuberculosis
cgagauucugcagccgcacu

SEQ ID NO: 956839 - RNA, 14 nt, Mycobacterium avium subsp. paratuberculosis
cgagcaaccgcacc

SEQ ID NO: 956840 - RNA, 23 nt, Mycobacterium avium subsp. paratuberculosis
cgagcaaccgcaccuugcgcccg

SEQ ID NO: 956841 - RNA, 22 nt, Mycobacterium avium subsp. paratuberculosis
cgagcaccuccgacaucaggcc

SEQ ID NO: 956842 - RNA, 21 nt, Mycobacterium avium subsp. paratuberculosis
cgagcaccuggagcggguccg

SEQ ID NO: 956843 - RNA, 23 nt, Mycobacterium avium subsp. paratuberculosis
cgagcaccuggagcggguccgcc

SEQ ID NO: 956844 - RNA, 15 nt, Mycobacterium avium subsp. paratuberculosis
cgagcaccuggccgu

SEQ ID NO: 956845 - RNA, 17 nt, Mycobacterium avium subsp. paratuberculosis
cgagcaccuggccguuc

SEQ ID NO: 956846 - RNA, 14 nt, Mycobacterium avium subsp. paratuberculosis
cgagcacgaacgcg

SEQ ID NO: 956847 - RNA, 21 nt, Mycobacterium avium subsp. paratuberculosis
cgagcacgaacgcggccgcca

SEQ ID NO: 956848 - RNA, 20 nt, Mycobacterium avium subsp. paratuberculosis
cgagcacgaaguacagcguc

SEQ ID NO: 956849 - RNA, 17 nt, Mycobacterium avium subsp. paratuberculosis
cgagcacgacgucgacg

SEQ ID NO: 956850 - RNA, 17 nt, Mycobacterium avium subsp. paratuberculosis
cgagccauaaaccggcc

SEQ ID NO: 956851 - RNA, 18 nt, Mycobacterium avium subsp. paratuberculosis
cgagccauaaaccggccg

SEQ ID NO: 956852 - RNA, 19 nt, Mycobacterium avium subsp. paratuberculosis
cgagccauaaaccggccgg

SEQ ID NO: 956853 - RNA, 22 nt, Mycobacterium avium subsp. paratuberculosis
cgagccauaaaccggccggcgc

SEQ ID NO: 956854 - RNA, 23 nt, Mycobacterium avium subsp. paratuberculosis
cgagccauaaaccggccggcgcg

SEQ ID NO: 956855 - RNA, 15 nt, Mycobacterium avium subsp. paratuberculosis
cgagccagcgggccg

SEQ ID NO: 956856 - RNA, 18 nt, Mycobacterium avium subsp. paratuberculosis
cgagccagcugcgcgucg

SEQ ID NO: 956857 - RNA, 13 nt, Mycobacterium avium subsp. paratuberculosis
cgagccaccucga

SEQ ID NO: 956858 - RNA, 22 nt, Mycobacterium avium subsp. paratuberculosis
cgagccaccucgaucagcggca

SEQ ID NO: 956859 - RNA, 13 nt, Mycobacterium avium subsp. paratuberculosis
cgagcccaccgcg

SEQ ID NO: 956860 - RNA, 14 nt, Mycobacterium avium subsp. paratuberculosis
cgagcccaccgcgc

SEQ ID NO: 956861 - RNA, 17 nt, Mycobacterium avium subsp. paratuberculosis
cgagcccaccgcgccca

SEQ ID NO: 956862 - RNA, 19 nt, Mycobacterium avium subsp. paratuberculosis
cgagcccaccgcgcccagc

SEQ ID NO: 956863 - RNA, 13 nt, Mycobacterium avium subsp. paratuberculosis
cgagcccagccgu

SEQ ID NO: 956864 - RNA, 15 nt, Mycobacterium avium subsp. paratuberculosis
cgagcccagcugcgc

SEQ ID NO: 956865 - RNA, 18 nt, Mycobacterium avium subsp. paratuberculosis
cgagccccaguucgauca

SEQ ID NO: 956866 - RNA, 14 nt, Mycobacterium avium subsp. paratuberculosis
cgagcccgacggca

SEQ ID NO: 956867 - RNA, 16 nt, Mycobacterium avium subsp. paratuberculosis
cgagcccgacggcagc

SEQ ID NO: 956868 - RNA, 19 nt, Mycobacterium avium subsp. paratuberculosis
cgagcccgacggcagcacc

SEQ ID NO: 956869 - RNA, 20 nt, Mycobacterium avium subsp. paratuberculosis
cgagcccgacggcagcaccg

SEQ ID NO: 956870 - RNA, 18 nt, Mycobacterium avium subsp. paratuberculosis
cgagccgauugucgcugc

SEQ ID NO: 956871 - RNA, 16 nt, Mycobacterium avium subsp. paratuberculosis
cgagccgagccgaccc

SEQ ID NO: 956872 - RNA, 23 nt, Mycobacterium avium subsp. paratuberculosis
cgagccgagccgguccgaccagc

SEQ ID NO: 956873 - RNA, 17 nt, Mycobacterium avium subsp. paratuberculosis
cgagccgaggccgaugg

SEQ ID NO: 956874 - RNA, 19 nt, Mycobacterium avium subsp. paratuberculosis
cgagccgaggccgauggcg

SEQ ID NO: 956875 - RNA, 16 nt, Mycobacterium avium subsp. paratuberculosis
cgagccgaugcccagc

SEQ ID NO: 956876 - RNA, 23 nt, Mycobacterium avium subsp. paratuberculosis
cgagccgaugcccagcagcgggg

SEQ ID NO: 956877 - RNA, 12 nt, Mycobacterium avium subsp. paratuberculosis
cgagccgagcac

SEQ ID NO: 956878 - RNA, 14 nt, Mycobacterium avium subsp. paratuberculosis
cgagccgagcaccg

SEQ ID NO: 956879 - RNA, 16 nt, Mycobacterium avium subsp. paratuberculosis
cgagccgagcaccggc

SEQ ID NO: 956880 - RNA, 17 nt, Mycobacterium avium subsp. paratuberculosis
cgagccgagcaccggca

SEQ ID NO: 956881 - RNA, 22 nt, Mycobacterium avium subsp. paratuberculosis
cgagccgagcaccggcagcacc

SEQ ID NO: 956882 - RNA, 23 nt, Mycobacterium avium subsp. paratuberculosis
cgagccgagcaccggcagcaccg

SEQ ID NO: 956883 - RNA, 17 nt, Mycobacterium avium subsp. paratuberculosis
cgagccgagcacgcagc

SEQ ID NO: 956884 - RNA, 19 nt, Mycobacterium avium subsp. paratuberculosis
cgagccgagcacgcagccg

SEQ ID NO: 956885 - RNA, 22 nt, Mycobacterium avium subsp. paratuberculosis
cgagccgagcacgcagccgcgc

SEQ ID NO: 956886 - RNA, 17 nt, Mycobacterium avium subsp. paratuberculosis
cgagcccuucgcggugu

SEQ ID NO: 956887 - RNA, 19 nt, Mycobacterium avium subsp. paratuberculosis
cgagcccuucgcggugugc

SEQ ID NO: 956888 - RNA, 18 nt, Mycobacterium avium subsp. paratuberculosis
cgagccgacccgggcuag

SEQ ID NO: 956889 - RNA, 14 nt, Mycobacterium avium subsp. paratuberculosis
cgagcccggcgacg

SEQ ID NO: 956890 - RNA, 20 nt, Mycobacterium avium subsp. paratuberculosis
cgagcccggcgacgucgucg

SEQ ID NO: 956891 - RNA, 20 nt, Mycobacterium avium subsp. paratuberculosis
cgagcccugcgccagcagca

SEQ ID NO: 956892 - RNA, 22 nt, Mycobacterium avium subsp. paratuberculosis
cgagccgaaacggugcccgcag

SEQ ID NO: 956893 - RNA, 15 nt, Mycobacterium avium subsp. paratuberculosis
cgagccgaagcgggu

SEQ ID NO: 956894 - RNA, 18 nt, Mycobacterium avium subsp. paratuberculosis
cgagccgacagucgcggg

SEQ ID NO: 956895 - RNA, 19 nt, Mycobacterium avium subsp. paratuberculosis
cgagccgacagucgcgggc

SEQ ID NO: 956896 - RNA, 23 nt, Mycobacterium avium subsp. paratuberculosis
cgagccgacagucgcgggcgagc

SEQ ID NO: 956897 - RNA, 15 nt, Mycobacterium avium subsp. paratuberculosis
cgagcccgaucugau

SEQ ID NO: 956898 - RNA, 12 nt, Mycobacterium avium subsp. paratuberculosis
cgagcccgccgg

SEQ ID NO: 956899 - RNA, 14 nt, Mycobacterium avium subsp. paratuberculosis
cgagcccgccggcg

SEQ ID NO: 956900 - RNA, 15 nt, Mycobacterium avium subsp. paratuberculosis
cgagcccgccggcgg

SEQ ID NO: 956901 - RNA, 17 nt, Mycobacterium avium subsp. paratuberculosis
cgagcccgccggcggcg

SEQ ID NO: 956902 - RNA, 21 nt, Mycobacterium avium subsp. paratuberculosis
cgagcccgccggcggguuggc

SEQ ID NO: 956903 - RNA, 12 nt, Mycobacterium avium subsp. paratuberculosis
cgagcaucaccg

SEQ ID NO: 956904 - RNA, 17 nt, Mycobacterium avium subsp. paratuberculosis
cgagcaucacgaacccg

SEQ ID NO: 956905 - RNA, 24 nt, Mycobacterium avium subsp. paratuberculosis
cgagcagugcaucgcugccgucca

SEQ ID NO: 956906 - RNA, 16 nt, Mycobacterium avium subsp. paratuberculosis
cgagcagggcgggcag

SEQ ID NO: 956907 - RNA, 17 nt, Mycobacterium avium subsp. paratuberculosis
cgagcagggcgggcagg

SEQ ID NO: 956908 - RNA, 16 nt, Mycobacterium avium subsp. paratuberculosis
cgagcaggcggaucgg

SEQ ID NO: 956909 - RNA, 18 nt, Mycobacterium avium subsp. paratuberculosis
cgagcaggcggaucggcc

SEQ ID NO: 956910 - RNA, 21 nt, Mycobacterium avium subsp. paratuberculosis
cgagcaggcggaucggcccga

SEQ ID NO: 956911 - RNA, 14 nt, Mycobacterium avium subsp. paratuberculosis
cgagcaggcugauc

SEQ ID NO: 956912 - RNA, 20 nt, Mycobacterium avium subsp. paratuberculosis
cgagcaggcugaucucggcg

SEQ ID NO: 956913 - RNA, 13 nt, Mycobacterium avium subsp. paratuberculosis
cgagcagcucggc

SEQ ID NO: 956914 - RNA, 14 nt, Mycobacterium avium subsp. paratuberculosis
cgagcagcucggcg

SEQ ID NO: 956915 - RNA, 17 nt, Mycobacterium avium subsp. paratuberculosis
cgagcagcucggcggcc

SEQ ID NO: 956916 - RNA, 18 nt, Mycobacterium avium subsp. paratuberculosis
cgagcagcucggcggccu

SEQ ID NO: 956917 - RNA, 22 nt, Mycobacterium avium subsp. paratuberculosis
cgagcaucggguugccggcggc

SEQ ID NO: 956918 - RNA, 18 nt, Mycobacterium avium subsp. paratuberculosis
cgagcaucuccagccggc

SEQ ID NO: 956919 - RNA, 20 nt, Mycobacterium avium subsp. paratuberculosis
cgagcaucuccagccggcga

SEQ ID NO: 956920 - RNA, 17 nt, Mycobacterium avium subsp. paratuberculosis
cgagcaucgccgagcgc

SEQ ID NO: 956921 - RNA, 18 nt, Mycobacterium avium subsp. paratuberculosis
cgagcaucgccgagcgca

SEQ ID NO: 956922 - RNA, 15 nt, Mycobacterium avium subsp. paratuberculosis
cgagcaggccgaggc

SEQ ID NO: 956923 - RNA, 13 nt, Mycobacterium avium subsp. paratuberculosis
cgagcauccggcg

SEQ ID NO: 956924 - RNA, 14 nt, Mycobacterium avium subsp. paratuberculosis
cgagcauccggcgc

SEQ ID NO: 956925 - RNA, 15 nt, Mycobacterium avium subsp. paratuberculosis
cgagcauccggcgca

SEQ ID NO: 956926 - RNA, 16 nt, Mycobacterium avium subsp. paratuberculosis
cgagcauccggcgcac

SEQ ID NO: 956927 - RNA, 18 nt, Mycobacterium avium subsp. paratuberculosis
cgagcauccggugccgag

SEQ ID NO: 956928 - RNA, 21 nt, Mycobacterium avium subsp. paratuberculosis
cgagcaucucggugccgucga

SEQ ID NO: 956929 - RNA, 20 nt, Mycobacterium avium subsp. paratuberculosis
cgagcauuucgcgcacgucg

SEQ ID NO: 956930 - RNA, 21 nt, Mycobacterium avium subsp. paratuberculosis
cgagcauuucgcgcacgucga

SEQ ID NO: 956931 - RNA, 17 nt, Mycobacterium avium subsp. paratuberculosis
cgagccaccacugcgcc

SEQ ID NO: 956932 - RNA, 22 nt, Mycobacterium avium subsp. paratuberculosis
cgagccaccacugcgccgucau

SEQ ID NO: 956933 - RNA, 14 nt, Mycobacterium avium subsp. paratuberculosis
cgagcaugcgggug

SEQ ID NO: 956934 - RNA, 14 nt, Mycobacterium avium subsp. paratuberculosis
cccuuuacccggac

SEQ ID NO: 956935 - RNA, 22 nt, Mycobacterium avium subsp. paratuberculosis
cccuugggcggauuggugccga

SEQ ID NO: 956936 - RNA, 15 nt, Mycobacterium avium subsp. paratuberculosis
cccuuuugccgaucg

SEQ ID NO: 956937 - RNA, 18 nt, Mycobacterium avium subsp. paratuberculosis
cccuuugcgcugcccgau

SEQ ID NO: 956938 - RNA, 13 nt, Mycobacterium avium subsp. paratuberculosis
cccuugacgguga

SEQ ID NO: 956939 - RNA, 15 nt, Mycobacterium avium subsp. paratuberculosis
cccuugccccaccac

SEQ ID NO: 956940 - RNA, 15 nt, Mycobacterium avium subsp. paratuberculosis
cccuuggcggccacg

SEQ ID NO: 956941 - RNA, 17 nt, Mycobacterium avium subsp. paratuberculosis
cccuuggcggccacgac

SEQ ID NO: 956942 - RNA, 22 nt, Mycobacterium avium subsp. paratuberculosis
cccuuggcggccacgacggcgc

SEQ ID NO: 956943 - RNA, 20 nt, Mycobacterium avium subsp. paratuberculosis
cccuuggcguauucggcgcg

SEQ ID NO: 956944 - RNA, 12 nt, Mycobacterium avium subsp. paratuberculosis
cccuggccgcgu

SEQ ID NO: 956945 - RNA, 19 nt, Mycobacterium avium subsp. paratuberculosis
cccuucgaacgcgacgaag

SEQ ID NO: 956946 - RNA, 18 nt, Mycobacterium avium subsp. paratuberculosis
cccuucgaugucgccggc

SEQ ID NO: 956947 - RNA, 15 nt, Mycobacterium avium subsp. paratuberculosis
cccuuccccggcggc

SEQ ID NO: 956948 - RNA, 15 nt, Mycobacterium avium subsp. paratuberculosis
cccuucggccggcag

SEQ ID NO: 956949 - RNA, 17 nt, Mycobacterium avium subsp. paratuberculosis
cccuucggcgcccgcuc

SEQ ID NO: 956950 - RNA, 19 nt, Mycobacterium avium subsp. paratuberculosis
cccuugacggugaggucgg

SEQ ID NO: 956951 - RNA, 13 nt, Mycobacterium avium subsp. paratuberculosis
cccuggccgccgg

SEQ ID NO: 956952 - RNA, 19 nt, Mycobacterium avium subsp. paratuberculosis
cccuggccgccggccgcgc

SEQ ID NO: 956953 - RNA, 16 nt, Mycobacterium avium subsp. paratuberculosis
cccuggccagcaccgc

SEQ ID NO: 956954 - RNA, 15 nt, Mycobacterium avium subsp. paratuberculosis
cccugccgucaccgg

SEQ ID NO: 956955 - RNA, 19 nt, Mycobacterium avium subsp. paratuberculosis
cccugccugcugcccaucc

SEQ ID NO: 956956 - RNA, 19 nt, Mycobacterium avium subsp. paratuberculosis
cccugcgccagcagcagcg

SEQ ID NO: 956957 - RNA, 13 nt, Mycobacterium avium subsp. paratuberculosis
cccugcgagcccg

SEQ ID NO: 956958 - RNA, 18 nt, Mycobacterium avium subsp. paratuberculosis
cccugcuugaccgcgacg

SEQ ID NO: 956959 - RNA, 23 nt, Mycobacterium avium subsp. paratuberculosis
cccugcgcggaaguggaccgcgu

SEQ ID NO: 956960 - RNA, 22 nt, Mycobacterium avium subsp. paratuberculosis
cccugcgcggccugcagcaccg

SEQ ID NO: 956961 - RNA, 18 nt, Mycobacterium avium subsp. paratuberculosis
cccugcgcggcgaugcgc

SEQ ID NO: 956962 - RNA, 17 nt, Mycobacterium avium subsp. paratuberculosis
cccugcgcgcccugcug

SEQ ID NO: 956963 - RNA, 23 nt, Mycobacterium avium subsp. paratuberculosis
cccucccaccacggccgaugcag

SEQ ID NO: 956964 - RNA, 15 nt, Mycobacterium avium subsp. paratuberculosis
cccuacccguccagc

SEQ ID NO: 956965 - RNA, 12 nt, Mycobacterium avium subsp. paratuberculosis
cccuacgggcgc

SEQ ID NO: 956966 - RNA, 17 nt, Mycobacterium avium subsp. paratuberculosis
cccuacgggcgcaccgc

SEQ ID NO: 956967 - RNA, 20 nt, Mycobacterium avium subsp. paratuberculosis
cccuacgggcgcaccgcgcg

SEQ ID NO: 956968 - RNA, 20 nt, Mycobacterium avium subsp. paratuberculosis
cccuccgggcggcaccgcug

SEQ ID NO: 956969 - RNA, 12 nt, Mycobacterium avium subsp. paratuberculosis
cccuccucgccg

SEQ ID NO: 956970 - RNA, 19 nt, Mycobacterium avium subsp. paratuberculosis
cccucgacgaacgcggcgg

SEQ ID NO: 956971 - RNA, 18 nt, Mycobacterium avium subsp. paratuberculosis
cccugcccgucgggcgcg

SEQ ID NO: 956972 - RNA, 23 nt, Mycobacterium avium subsp. paratuberculosis
cccugcccgucgggcgcggcggc

SEQ ID NO: 956973 - RNA, 19 nt, Mycobacterium avium subsp. paratuberculosis
cccucgcucaacccgucgc

SEQ ID NO: 956974 - RNA, 17 nt, Mycobacterium avium subsp. paratuberculosis
cccucgcgcagggccag

SEQ ID NO: 956975 - RNA, 16 nt, Mycobacterium avium subsp. paratuberculosis
cccucgacgccgggca

SEQ ID NO: 956976 - RNA, 15 nt, Mycobacterium avium subsp. paratuberculosis
cccucgacguccagg

SEQ ID NO: 956977 - RNA, 17 nt, Mycobacterium avium subsp. paratuberculosis
cccucgacguccaggcc

SEQ ID NO: 956978 - RNA, 12 nt, Mycobacterium avium subsp. paratuberculosis
cccucgccgccg

SEQ ID NO: 956979 - RNA, 15 nt, Mycobacterium avium subsp. paratuberculosis
cccucgccgccgccg

SEQ ID NO: 956980 - RNA, 15 nt, Mycobacterium avium subsp. paratuberculosis
cccucgccgcgguca

SEQ ID NO: 956981 - RNA, 13 nt, Mycobacterium avium subsp. paratuberculosis
cccucgccggcgg

SEQ ID NO: 956982 - RNA, 16 nt, Mycobacterium avium subsp. paratuberculosis
cccucgccgggcguca

SEQ ID NO: 956983 - RNA, 15 nt, Mycobacterium avium subsp. paratuberculosis
cccucgccggucagc

SEQ ID NO: 956984 - RNA, 20 nt, Mycobacterium avium subsp. paratuberculosis
ccgaacaucgccucggccgc

SEQ ID NO: 956985 - RNA, 21 nt, Mycobacterium avium subsp. paratuberculosis
ccgaacaucgccucggccgcg

SEQ ID NO: 956986 - RNA, 15 nt, Mycobacterium avium subsp. paratuberculosis
ccgaaccagaucggc

SEQ ID NO: 956987 - RNA, 19 nt, Mycobacterium avium subsp. paratuberculosis
ccgaaccagaucggcgggu

SEQ ID NO: 956988 - RNA, 16 nt, Mycobacterium avium subsp. paratuberculosis
ccgaacagggcgacgg

SEQ ID NO: 956989 - RNA, 20 nt, Mycobacterium avium subsp. paratuberculosis
ccgaacagggcgacggcggc

SEQ ID NO: 956990 - RNA, 18 nt, Mycobacterium avium subsp. paratuberculosis
ccgaacagcuugccgauc

SEQ ID NO: 956991 - RNA, 23 nt, Mycobacterium avium subsp. paratuberculosis
ccgaacagcuugccgaucugguc

SEQ ID NO: 956992 - RNA, 13 nt, Mycobacterium avium subsp. paratuberculosis
ccgaacaggcgca

SEQ ID NO: 956993 - RNA, 20 nt, Mycobacterium avium subsp. paratuberculosis
ccgaaccggaucuggcccug

SEQ ID NO: 956994 - RNA, 13 nt, Mycobacterium avium subsp. paratuberculosis
ccgaaccgcucgu

SEQ ID NO: 956995 - RNA, 12 nt, Mycobacterium avium subsp. paratuberculosis
ccgaaccgcugc

SEQ ID NO: 956996 - RNA, 17 nt, Mycobacterium avium subsp. paratuberculosis
ccgaaccaguucgccac

SEQ ID NO: 956997 - RNA, 19 nt, Mycobacterium avium subsp. paratuberculosis
ccgaaccaguucgccacca

SEQ ID NO: 956998 - RNA, 13 nt, Mycobacterium avium subsp. paratuberculosis
ccgaacccaccag

SEQ ID NO: 956999 - RNA, 17 nt, Mycobacterium avium subsp. paratuberculosis
ccgaacccaccagcgcc

SEQ ID NO: 957000 - RNA, 19 nt, Mycobacterium avium subsp. paratuberculosis
ccgaacccaccagcgccug

SEQ ID NO: 957001 - RNA, 13 nt, Mycobacterium avium subsp. paratuberculosis
ccgaacccagcgc

SEQ ID NO: 957002 - RNA, 14 nt, Mycobacterium avium subsp. paratuberculosis
ccgaacccagcgcc

SEQ ID NO: 957003 - RNA, 21 nt, Mycobacterium avium subsp. paratuberculosis
ccgaacccagcgccucgagca

SEQ ID NO: 957004 - RNA, 14 nt, Mycobacterium avium subsp. paratuberculosis
ccgaacccggaucg

SEQ ID NO: 957005 - RNA, 14 nt, Mycobacterium avium subsp. paratuberculosis
ccgaacccggccag

SEQ ID NO: 957006 - RNA, 15 nt, Mycobacterium avium subsp. paratuberculosis
ccgaacccggccagc

SEQ ID NO: 957007 - RNA, 14 nt, Mycobacterium avium subsp. paratuberculosis
ccgaacccgggcgc

SEQ ID NO: 957008 - RNA, 15 nt, Mycobacterium avium subsp. paratuberculosis
ccgaacccgggcgcg

SEQ ID NO: 957009 - RNA, 16 nt, Mycobacterium avium subsp. paratuberculosis
ccgaacccgggcgcgc

SEQ ID NO: 957010 - RNA, 19 nt, Mycobacterium avium subsp. paratuberculosis
ccgaacccgggcgcgccca

SEQ ID NO: 957011 - RNA, 12 nt, Mycobacterium avium subsp. paratuberculosis
ccgaacccguuc

SEQ ID NO: 957012 - RNA, 20 nt, Mycobacterium avium subsp. paratuberculosis
ccgaacccguucccgacagc

SEQ ID NO: 957013 - RNA, 12 nt, Mycobacterium avium subsp. paratuberculosis
ccgaaccgcagc

SEQ ID NO: 957014 - RNA, 14 nt, Mycobacterium avium subsp. paratuberculosis
ccgaaccgcagccg

SEQ ID NO: 957015 - RNA, 15 nt, Mycobacterium avium subsp. paratuberculosis
ccgaaccgccccgcg

SEQ ID NO: 957016 - RNA, 16 nt, Mycobacterium avium subsp. paratuberculosis
ccgaaccgccccgcgc

SEQ ID NO: 957017 - RNA, 18 nt, Mycobacterium avium subsp. paratuberculosis
ccgaacggaccgggcggg

SEQ ID NO: 957018 - RNA, 13 nt, Mycobacterium avium subsp. paratuberculosis
ccgaacgcgucgu

SEQ ID NO: 957019 - RNA, 13 nt, Mycobacterium avium subsp. paratuberculosis
ccgaacgccagca

SEQ ID NO: 957020 - RNA, 13 nt, Mycobacterium avium subsp. paratuberculosis
ccgaaccgggcgc

SEQ ID NO: 957021 - RNA, 22 nt, Mycobacterium avium subsp. paratuberculosis
ccgaaccgggcgcgcagaucgu

SEQ ID NO: 957022 - RNA, 15 nt, Mycobacterium avium subsp. paratuberculosis
ccgaaccggggccgc

SEQ ID NO: 957023 - RNA, 12 nt, Mycobacterium avium subsp. paratuberculosis
ccgaaccguccc

SEQ ID NO: 957024 - RNA, 17 nt, Mycobacterium avium subsp. paratuberculosis
ccgaacgcaccaccgcg

SEQ ID NO: 957025 - RNA, 16 nt, Mycobacterium avium subsp. paratuberculosis
ccgaacucggcgccgc

SEQ ID NO: 957026 - RNA, 19 nt, Mycobacterium avium subsp. paratuberculosis
ccgaacucggcgccgccgg

SEQ ID NO: 957027 - RNA, 20 nt, Mycobacterium avium subsp. paratuberculosis
ccgaacucggcgccgccggu

SEQ ID NO: 957028 - RNA, 23 nt, Mycobacterium avium subsp. paratuberculosis
ccgaacucggcgccgccggucgc

SEQ ID NO: 957029 - RNA, 22 nt, Mycobacterium avium subsp. paratuberculosis
ccgaacugcaucauguccaggu

SEQ ID NO: 957030 - RNA, 13 nt, Mycobacterium avium subsp. paratuberculosis
ccgaacugccgcg

SEQ ID NO: 957031 - RNA, 17 nt, Mycobacterium avium subsp. paratuberculosis
ccgaacgugauggcgaa

SEQ ID NO: 957032 - RNA, 19 nt, Mycobacterium avium subsp. paratuberculosis
ccgaacgugcgcggcgcgc

SEQ ID NO: 957033 - RNA, 23 nt, Mycobacterium avium subsp. paratuberculosis
ccgaacgugcgcggcgcgcgaaa

SEQ ID NO: 957034 - RNA, 15 nt, Mycobacterium avium subsp. paratuberculosis
ccgaacucauggcgu

SEQ ID NO: 957035 - RNA, 17 nt, Mycobacterium avium subsp. paratuberculosis
ccgaacgggucggcgac

SEQ ID NO: 957036 - RNA, 21 nt, Mycobacterium avium subsp. paratuberculosis
ccgaacgggucggcgaccaug

SEQ ID NO: 957037 - RNA, 15 nt, Mycobacterium avium subsp. paratuberculosis
ccgaacgucacggcg

SEQ ID NO: 957038 - RNA, 19 nt, Mycobacterium avium subsp. paratuberculosis
ccgaacgucacggcgagga

SEQ ID NO: 957039 - RNA, 15 nt, Mycobacterium avium subsp. paratuberculosis
ccgaacgucgagcgc

SEQ ID NO: 957040 - RNA, 18 nt, Mycobacterium avium subsp. paratuberculosis
ccgaacgucgagcgcggc

SEQ ID NO: 957041 - RNA, 20 nt, Mycobacterium avium subsp. paratuberculosis
ccgaacgucgagcgcggccc

SEQ ID NO: 957042 - RNA, 15 nt, Mycobacterium avium subsp. paratuberculosis
ccgaagaucaccgcg

SEQ ID NO: 957043 - RNA, 15 nt, Mycobacterium avium subsp. paratuberculosis
ccgaagaccgggccg

SEQ ID NO: 957044 - RNA, 17 nt, Mycobacterium avium subsp. paratuberculosis
ccgaagaacucagccga

SEQ ID NO: 957045 - RNA, 12 nt, Mycobacterium avium subsp. paratuberculosis
ccgaacggcaug

SEQ ID NO: 957046 - RNA, 22 nt, Mycobacterium avium subsp. paratuberculosis
ccgaacugguuguagucgucga

SEQ ID NO: 957047 - RNA, 13 nt, Mycobacterium avium subsp. paratuberculosis
ccgaagccgacac

SEQ ID NO: 957048 - RNA, 18 nt, Mycobacterium avium subsp. paratuberculosis
ccgaagccgacaccgggu

SEQ ID NO: 957049 - RNA, 23 nt, Mycobacterium avium subsp. paratuberculosis
ccgaagcccgacaucugccgggc

SEQ ID NO: 957050 - RNA, 15 nt, Mycobacterium avium subsp. paratuberculosis
ccgaagccgucgacc

SEQ ID NO: 957051 - RNA, 20 nt, Mycobacterium avium subsp. paratuberculosis
ccgaagccgucgaccccgcc

SEQ ID NO: 957052 - RNA, 13 nt, Mycobacterium avium subsp. paratuberculosis
ccgaagccguuga

SEQ ID NO: 957053 - RNA, 19 nt, Mycobacterium avium subsp. paratuberculosis
ccgaagcgccacggggcgc

SEQ ID NO: 957054 - RNA, 15 nt, Mycobacterium avium subsp. paratuberculosis
ccgaagcgccgcaug

SEQ ID NO: 957055 - RNA, 18 nt, Mycobacterium avium subsp. paratuberculosis
ccgaagcgccgcaugccc

SEQ ID NO: 957056 - RNA, 21 nt, Mycobacterium avium subsp. paratuberculosis
ccgaagaugucggugccgauc

SEQ ID NO: 957057 - RNA, 18 nt, Mycobacterium avium subsp. paratuberculosis
ccgaaguuggcgucgggc

SEQ ID NO: 957058 - RNA, 22 nt, Mycobacterium avium subsp. paratuberculosis
ccgaaguuggcgucgggcaccu

SEQ ID NO: 957059 - RNA, 13 nt, Mycobacterium avium subsp. paratuberculosis
ccgaaguccgcca

SEQ ID NO: 957060 - RNA, 21 nt, Mycobacterium avium subsp. paratuberculosis
ccgaaguauccggucagcgcc

SEQ ID NO: 957061 - RNA, 21 nt, Mycobacterium avium subsp. paratuberculosis
ccgaagggaaaggcagcagcc

SEQ ID NO: 957062 - RNA, 13 nt, Mycobacterium avium subsp. paratuberculosis
ccgaaggccgggu

SEQ ID NO: 957063 - RNA, 14 nt, Mycobacterium avium subsp. paratuberculosis
ccgaagcggcccga

SEQ ID NO: 957064 - RNA, 15 nt, Mycobacterium avium subsp. paratuberculosis
ccgaagcggcccgag

SEQ ID NO: 957065 - RNA, 13 nt, Mycobacterium avium subsp. paratuberculosis
ccgaagcggcgca

SEQ ID NO: 957066 - RNA, 17 nt, Mycobacterium avium subsp. paratuberculosis
ccgaagcguuccgccgu

SEQ ID NO: 957067 - RNA, 18 nt, Mycobacterium avium subsp. paratuberculosis
ccgaagcguuccgccguc

SEQ ID NO: 957068 - RNA, 20 nt, Mycobacterium avium subsp. paratuberculosis
ccgaagcgggucggggagcc

SEQ ID NO: 957069 - RNA, 20 nt, Mycobacterium avium subsp. paratuberculosis
cccguccugggccuggcgcu

SEQ ID NO: 957070 - RNA, 18 nt, Mycobacterium avium subsp. paratuberculosis
aaaucguggcuuucggcg

SEQ ID NO: 957071 - RNA, 21 nt, Mycobacterium avium subsp. paratuberculosis
cccguccuggaugaacagcac

SEQ ID NO: 957072 - RNA, 22 nt, Mycobacterium avium subsp. paratuberculosis
cccguccuggaugaacagcacg

SEQ ID NO: 957073 - RNA, 22 nt, Mycobacterium avium subsp. paratuberculosis
cccguccgccccgcugccggac

SEQ ID NO: 957074 - RNA, 17 nt, Mycobacterium avium subsp. paratuberculosis
cccguccaucgccgcgc

SEQ ID NO: 957075 - RNA, 16 nt, Mycobacterium avium subsp. paratuberculosis
cccguccccaccaccg

SEQ ID NO: 957076 - RNA, 20 nt, Mycobacterium avium subsp. paratuberculosis
cccguccccaccaccgacag

SEQ ID NO: 957077 - RNA, 22 nt, Mycobacterium avium subsp. paratuberculosis
cccguccccaccaccgacagca

SEQ ID NO: 957078 - RNA, 14 nt, Mycobacterium avium subsp. paratuberculosis
cccgucccgccgac

SEQ ID NO: 957079 - RNA, 15 nt, Mycobacterium avium subsp. paratuberculosis
cccgucccgccgacg

SEQ ID NO: 957080 - RNA, 18 nt, Mycobacterium avium subsp. paratuberculosis
cccgucacggcugccgac

SEQ ID NO: 957081 - RNA, 13 nt, Mycobacterium avium subsp. paratuberculosis
cccguccagaucg

SEQ ID NO: 957082 - RNA, 13 nt, Mycobacterium avium subsp. paratuberculosis
cccguccagcgca

SEQ ID NO: 957083 - RNA, 13 nt, Mycobacterium avium subsp. paratuberculosis
cccguccagcgug

SEQ ID NO: 957084 - RNA, 21 nt, Mycobacterium avium subsp. paratuberculosis
cccguccaggaugagcugggc

SEQ ID NO: 957085 - RNA, 16 nt, Mycobacterium avium subsp. paratuberculosis
cccguauugccgucgg

SEQ ID NO: 957086 - RNA, 20 nt, Mycobacterium avium subsp. paratuberculosis
cccgucaggccucgaggauc

SEQ ID NO: 957087 - RNA, 13 nt, Mycobacterium avium subsp. paratuberculosis
cccguagccguag

SEQ ID NO: 957088 - RNA, 15 nt, Mycobacterium avium subsp. paratuberculosis
cccguagcggcggaa

SEQ ID NO: 957089 - RNA, 20 nt, Mycobacterium avium subsp. paratuberculosis
cccguagcucgcgccgaccc

SEQ ID NO: 957090 - RNA, 18 nt, Mycobacterium avium subsp. paratuberculosis
cccguaggagcugacggc

SEQ ID NO: 957091 - RNA, 14 nt, Mycobacterium avium subsp. paratuberculosis
cccguaggucgccu

SEQ ID NO: 957092 - RNA, 13 nt, Mycobacterium avium subsp. paratuberculosis
cccguagucaccc

SEQ ID NO: 957093 - RNA, 16 nt, Mycobacterium avium subsp. paratuberculosis
cccguagucacccggc

SEQ ID NO: 957094 - RNA, 16 nt, Mycobacterium avium subsp. paratuberculosis
cccguagucggcggcg

SEQ ID NO: 957095 - RNA, 17 nt, Mycobacterium avium subsp. paratuberculosis
cccguagucggcggcga

SEQ ID NO: 957096 - RNA, 19 nt, Mycobacterium avium subsp. paratuberculosis
cccguagucggcggcgagg

SEQ ID NO: 957097 - RNA, 12 nt, Mycobacterium avium subsp. paratuberculosis
cccgguguccac

SEQ ID NO: 957098 - RNA, 23 nt, Mycobacterium avium subsp. paratuberculosis
cccgguguccacgucgcccagcg

SEQ ID NO: 957099 - RNA, 20 nt, Mycobacterium avium subsp. paratuberculosis
cccgguggacgcgauggcgc

SEQ ID NO: 957100 - RNA, 13 nt, Mycobacterium avium subsp. paratuberculosis
cccgguggcccgg

SEQ ID NO: 957101 - RNA, 12 nt, Mycobacterium avium subsp. paratuberculosis
cccgguggccga

SEQ ID NO: 957102 - RNA, 14 nt, Mycobacterium avium subsp. paratuberculosis
cccggugucgccgu

SEQ ID NO: 957103 - RNA, 19 nt, Mycobacterium avium subsp. paratuberculosis
cccguacggguugccgucg

SEQ ID NO: 957104 - RNA, 19 nt, Mycobacterium avium subsp. paratuberculosis
cccguacuugcuggcgcug

SEQ ID NO: 957105 - RNA, 20 nt, Mycobacterium avium subsp. paratuberculosis
cccguagaacaguucgacgu

SEQ ID NO: 957106 - RNA, 21 nt, Mycobacterium avium subsp. paratuberculosis
cccguagaacaguucgacgua

SEQ ID NO: 957107 - RNA, 12 nt, Mycobacterium avium subsp. paratuberculosis
cccguagaccca

SEQ ID NO: 957108 - RNA, 23 nt, Mycobacterium avium subsp. paratuberculosis
cccguagacccacagcugccggc

SEQ ID NO: 957109 - RNA, 14 nt, Mycobacterium avium subsp. paratuberculosis
cccguagaugcggc

SEQ ID NO: 957110 - RNA, 19 nt, Mycobacterium avium subsp. paratuberculosis
cccguagaugcggcccagc

SEQ ID NO: 957111 - RNA, 14 nt, Mycobacterium avium subsp. paratuberculosis
cccuaccgccgagc

SEQ ID NO: 957112 - RNA, 14 nt, Mycobacterium avium subsp. paratuberculosis
cccguuuccucgcg

SEQ ID NO: 957113 - RNA, 14 nt, Mycobacterium avium subsp. paratuberculosis
cccguuggcgccgg

SEQ ID NO: 957114 - RNA, 19 nt, Mycobacterium avium subsp. paratuberculosis
cccguuggcgccggucgac

SEQ ID NO: 957115 - RNA, 19 nt, Mycobacterium avium subsp. paratuberculosis
cccguugggguccucgaug

SEQ ID NO: 957116 - RNA, 23 nt, Mycobacterium avium subsp. paratuberculosis
cccguugcugcguucggcgauca

SEQ ID NO: 957117 - RNA, 21 nt, Mycobacterium avium subsp. paratuberculosis
cccguugcgccgcaacggcgc

SEQ ID NO: 957118 - RNA, 17 nt, Mycobacterium avium subsp. paratuberculosis
cccguugagcaccgcga

SEQ ID NO: 957119 - RNA, 20 nt, Mycobacterium avium subsp. paratuberculosis
cccguugaucuugaccgucg

SEQ ID NO: 957120 - RNA, 22 nt, Mycobacterium avium subsp. paratuberculosis
cccguugcacaggcacacgaac

SEQ ID NO: 957121 - RNA, 15 nt, Mycobacterium avium subsp. paratuberculosis
cccguugccaacacc

SEQ ID NO: 957122 - RNA, 17 nt, Mycobacterium avium subsp. paratuberculosis
cccguucgagcgccgga

SEQ ID NO: 957123 - RNA, 23 nt, Mycobacterium avium subsp. paratuberculosis
cccguucgaugaugggcgaucga

SEQ ID NO: 957124 - RNA, 17 nt, Mycobacterium avium subsp. paratuberculosis
cccguucgccgacagca

SEQ ID NO: 957125 - RNA, 12 nt, Mycobacterium avium subsp. paratuberculosis
cccguucggcgu

SEQ ID NO: 957126 - RNA, 15 nt, Mycobacterium avium subsp. paratuberculosis
cccguucggcgucga

SEQ ID NO: 957127 - RNA, 16 nt, Mycobacterium avium subsp. paratuberculosis
cccguucgguggccac

SEQ ID NO: 957128 - RNA, 23 nt, Mycobacterium avium subsp. paratuberculosis
cccguucgguggccaccgcgacg

SEQ ID NO: 957129 - RNA, 21 nt, Mycobacterium avium subsp. paratuberculosis
cccguugaaguuggccaccgg

SEQ ID NO: 957130 - RNA, 15 nt, Mycobacterium avium subsp. paratuberculosis
cccgucgaccaggac

SEQ ID NO: 957131 - RNA, 15 nt, Mycobacterium avium subsp. paratuberculosis
cccgucgacgggcca

SEQ ID NO: 957132 - RNA, 22 nt, Mycobacterium avium subsp. paratuberculosis
cccgucgagcggcuugccgccg

SEQ ID NO: 957133 - RNA, 23 nt, Mycobacterium avium subsp. paratuberculosis
cccgucgagcgucauuccgccgc

SEQ ID NO: 957134 - RNA, 13 nt, Mycobacterium avium subsp. paratuberculosis
cccguuccccggc

SEQ ID NO: 957135 - RNA, 17 nt, Mycobacterium avium subsp. paratuberculosis
cccguuccccggccgac

SEQ ID NO: 957136 - RNA, 18 nt, Mycobacterium avium subsp. paratuberculosis
cccguuccccggccgacg

SEQ ID NO: 957137 - RNA, 12 nt, Mycobacterium avium subsp. paratuberculosis
cccguucccgac

SEQ ID NO: 957138 - RNA, 13 nt, Mycobacterium avium subsp. paratuberculosis
cccgucgccacca

SEQ ID NO: 957139 - RNA, 17 nt, Mycobacterium avium subsp. paratuberculosis
cccgucgccaccacggc

SEQ ID NO: 957140 - RNA, 19 nt, Mycobacterium avium subsp. paratuberculosis
cccgucgccaccacggcgc

SEQ ID NO: 957141 - RNA, 15 nt, Mycobacterium avium subsp. paratuberculosis
cccgucgagcagccg

SEQ ID NO: 957142 - RNA, 12 nt, Mycobacterium avium subsp. paratuberculosis
cccgucgccgau

SEQ ID NO: 957143 - RNA, 20 nt, Mycobacterium avium subsp. paratuberculosis
cccgucgccgaucagcacca

SEQ ID NO: 957144 - RNA, 16 nt, Mycobacterium avium subsp. paratuberculosis
cccgugucgcggccuc

SEQ ID NO: 957145 - RNA, 13 nt, Mycobacterium avium subsp. paratuberculosis
cccggugcgccgg

SEQ ID NO: 957146 - RNA, 14 nt, Mycobacterium avium subsp. paratuberculosis
cccggugcgccggu

SEQ ID NO: 957147 - RNA, 20 nt, Mycobacterium avium subsp. paratuberculosis
cccggugcgacgccgcgcag

SEQ ID NO: 957148 - RNA, 16 nt, Mycobacterium avium subsp. paratuberculosis
cccggugccgcuggau

SEQ ID NO: 957149 - RNA, 17 nt, Mycobacterium avium subsp. paratuberculosis
cccggugaucgccgccc

SEQ ID NO: 957150 - RNA, 22 nt, Mycobacterium avium subsp. paratuberculosis
cccgguccgcugugcggcccgg

SEQ ID NO: 957151 - RNA, 15 nt, Mycobacterium avium subsp. paratuberculosis
cccgguccggcccgg

SEQ ID NO: 957152 - RNA, 14 nt, Mycobacterium avium subsp. paratuberculosis
cccgguccgggucg

SEQ ID NO: 957153 - RNA, 24 nt, Mycobacterium avium subsp. paratuberculosis
cccggucccggggcucgacaggca

SEQ ID NO: 957154 - RNA, 21 nt, Mycobacterium avium subsp. paratuberculosis
cccgguccuugagguagucgc

SEQ ID NO: 957155 - RNA, 14 nt, Mycobacterium avium subsp. paratuberculosis
cccggucgacgaug

SEQ ID NO: 957156 - RNA, 20 nt, Mycobacterium avium subsp. paratuberculosis
cccggucgacgauggcccgg

SEQ ID NO: 957157 - RNA, 22 nt, Mycobacterium avium subsp. paratuberculosis
cccgguccaggcgaccggcccc

SEQ ID NO: 957158 - RNA, 13 nt, Mycobacterium avium subsp. paratuberculosis
cccggucccgccg

SEQ ID NO: 957159 - RNA, 15 nt, Mycobacterium avium subsp. paratuberculosis
cccgguccacggugu

SEQ ID NO: 957160 - RNA, 16 nt, Mycobacterium avium subsp. paratuberculosis
cccgguccacgguguc

SEQ ID NO: 957161 - RNA, 21 nt, Mycobacterium avium subsp. paratuberculosis
cccgguccacggugucgcugu

SEQ ID NO: 957162 - RNA, 23 nt, Mycobacterium avium subsp. paratuberculosis
cccgguccacggugucgcuguag

SEQ ID NO: 957163 - RNA, 14 nt, Mycobacterium avium subsp. paratuberculosis
cccggguggcccgc

SEQ ID NO: 957164 - RNA, 17 nt, Mycobacterium avium subsp. paratuberculosis
cccgguaggccgccgcg

SEQ ID NO: 957165 - RNA, 21 nt, Mycobacterium avium subsp. paratuberculosis
cccggucagguugacgccgau

SEQ ID NO: 957166 - RNA, 16 nt, Mycobacterium avium subsp. paratuberculosis
cccgguaggcggcgag

SEQ ID NO: 957167 - RNA, 20 nt, Mycobacterium avium subsp. paratuberculosis
cccggucaccaucagcaccg

SEQ ID NO: 957168 - RNA, 15 nt, Mycobacterium avium subsp. paratuberculosis
cccggucacccgugg

SEQ ID NO: 957169 - RNA, 17 nt, Mycobacterium avium subsp. paratuberculosis
cccggucaccgguccgg

SEQ ID NO: 957170 - RNA, 16 nt, Mycobacterium avium subsp. paratuberculosis
cccggucagcucgccg

SEQ ID NO: 957171 - RNA, 19 nt, Mycobacterium avium subsp. paratuberculosis
cccgggugcaggcccagcu

SEQ ID NO: 957172 - RNA, 21 nt, Mycobacterium avium subsp. paratuberculosis
cccgggugcgcgucgcggugg

SEQ ID NO: 957173 - RNA, 19 nt, Mycobacterium avium subsp. paratuberculosis
cccgggugcgcuugucggc

SEQ ID NO: 957174 - RNA, 23 nt, Mycobacterium avium subsp. paratuberculosis
cccgggugcgcuugucggcgugg

SEQ ID NO: 957175 - RNA, 18 nt, Mycobacterium avium subsp. paratuberculosis
cccggguccuggaucagc

SEQ ID NO: 957176 - RNA, 12 nt, Mycobacterium avium subsp. paratuberculosis
cccggguggccc

SEQ ID NO: 957177 - RNA, 12 nt, Mycobacterium avium subsp. paratuberculosis
cccggggugcug

SEQ ID NO: 957178 - RNA, 16 nt, Mycobacterium avium subsp. paratuberculosis
cccgggccgcgcccag

SEQ ID NO: 957179 - RNA, 16 nt, Mycobacterium avium subsp. paratuberculosis
cccgggucgucggugc

SEQ ID NO: 957180 - RNA, 19 nt, Mycobacterium avium subsp. paratuberculosis
cccgggucgugcggcggcg

SEQ ID NO: 957181 - RNA, 21 nt, Mycobacterium avium subsp. paratuberculosis
cccgggggaagcccagcaccc

SEQ ID NO: 957182 - RNA, 21 nt, Mycobacterium avium subsp. paratuberculosis
cccgggggaccagcgcaaccg

SEQ ID NO: 957183 - RNA, 14 nt, Mycobacterium avium subsp. paratuberculosis
cccggggguccagg

SEQ ID NO: 957184 - RNA, 23 nt, Mycobacterium avium subsp. paratuberculosis
cccggggguggcggucccggcgg

SEQ ID NO: 957185 - RNA, 14 nt, Mycobacterium avium subsp. paratuberculosis
cccggggugaugcc

SEQ ID NO: 957186 - RNA, 20 nt, Mycobacterium avium subsp. paratuberculosis
cccggggugaugccggcggu

SEQ ID NO: 957187 - RNA, 21 nt, Mycobacterium avium subsp. paratuberculosis
cccgggcgcgugcacaccggc

SEQ ID NO: 957188 - RNA, 14 nt, Mycobacterium avium subsp. paratuberculosis
cccgggcggcccgc

SEQ ID NO: 957189 - RNA, 15 nt, Mycobacterium avium subsp. paratuberculosis
cccgggcggcccgca

SEQ ID NO: 957190 - RNA, 14 nt, Mycobacterium avium subsp. paratuberculosis
cccgggcggcccgg

SEQ ID NO: 957191 - RNA, 13 nt, Mycobacterium avium subsp. paratuberculosis
cccgggcggcgag

SEQ ID NO: 957192 - RNA, 14 nt, Mycobacterium avium subsp. paratuberculosis
cccgggcggcgccg

SEQ ID NO: 957193 - RNA, 12 nt, Mycobacterium avium subsp. paratuberculosis
cccgggcggcgg

SEQ ID NO: 957194 - RNA, 16 nt, Mycobacterium avium subsp. paratuberculosis
cccgggcggcggggcu

SEQ ID NO: 957195 - RNA, 20 nt, Mycobacterium avium subsp. paratuberculosis
cccgggcgugccggacaccg

SEQ ID NO: 957196 - RNA, 14 nt, Mycobacterium avium subsp. paratuberculosis
cccgggcugcagca

SEQ ID NO: 957197 - RNA, 20 nt, Mycobacterium avium subsp. paratuberculosis
cccgggcugcccggcgccgg

SEQ ID NO: 957198 - RNA, 14 nt, Mycobacterium avium subsp. paratuberculosis
cccggggccguccg

SEQ ID NO: 957199 - RNA, 13 nt, Mycobacterium avium subsp. paratuberculosis
cccggggccucca

SEQ ID NO: 957200 - RNA, 16 nt, Mycobacterium avium subsp. paratuberculosis
cccggggccuccagcc

SEQ ID NO: 957201 - RNA, 13 nt, Mycobacterium avium subsp. paratuberculosis
cccggggcgcgcu

SEQ ID NO: 957202 - RNA, 15 nt, Mycobacterium avium subsp. paratuberculosis
cccggggcgcgcugg

SEQ ID NO: 957203 - RNA, 18 nt, Mycobacterium avium subsp. paratuberculosis
cccggggcgcggaccgca

SEQ ID NO: 957204 - RNA, 13 nt, Mycobacterium avium subsp. paratuberculosis
cccggggcggcga

SEQ ID NO: 957205 - RNA, 20 nt, Mycobacterium avium subsp. paratuberculosis
cccggggcggcgaugcgcgg

SEQ ID NO: 957206 - RNA, 16 nt, Mycobacterium avium subsp. paratuberculosis
cccggaugucgggcga

SEQ ID NO: 957207 - RNA, 19 nt, Mycobacterium avium subsp. paratuberculosis
cccggaugucguagacgga

SEQ ID NO: 957208 - RNA, 21 nt, Mycobacterium avium subsp. paratuberculosis
cccggaugucgugcggucgca

SEQ ID NO: 957209 - RNA, 21 nt, Mycobacterium avium subsp. paratuberculosis
cccggauucgcggcggcgccg

SEQ ID NO: 957210 - RNA, 12 nt, Mycobacterium avium subsp. paratuberculosis
cccggcggccgg

SEQ ID NO: 957211 - RNA, 14 nt, Mycobacterium avium subsp. paratuberculosis
cccggcggccggcc

SEQ ID NO: 957212 - RNA, 18 nt, Mycobacterium avium subsp. paratuberculosis
cccggcggccggccccgg

SEQ ID NO: 957213 - RNA, 21 nt, Mycobacterium avium subsp. paratuberculosis
cccggcggccggccccggccg

SEQ ID NO: 957214 - RNA, 18 nt, Mycobacterium avium subsp. paratuberculosis
cccggcggccggccgcgc

SEQ ID NO: 957215 - RNA, 17 nt, Mycobacterium avium subsp. paratuberculosis
cccggcgggcagguuca

SEQ ID NO: 957216 - RNA, 20 nt, Mycobacterium avium subsp. paratuberculosis
cccggcgggcaucaucgcua

SEQ ID NO: 957217 - RNA, 12 nt, Mycobacterium avium subsp. paratuberculosis
cccggcgggcca

SEQ ID NO: 957218 - RNA, 12 nt, Mycobacterium avium subsp. paratuberculosis
cccggcggcgcu

SEQ ID NO: 957219 - RNA, 21 nt, Mycobacterium avium subsp. paratuberculosis
cccggcguccaguagccgccg

SEQ ID NO: 957220 - RNA, 12 nt, Mycobacterium avium subsp. paratuberculosis
cccggcggucgc

SEQ ID NO: 957221 - RNA, 15 nt, Mycobacterium avium subsp. paratuberculosis
cccggcggucgccga

SEQ ID NO: 957222 - RNA, 16 nt, Mycobacterium avium subsp. paratuberculosis
cccggcggucgccgaa

SEQ ID NO: 957223 - RNA, 14 nt, Mycobacterium avium subsp. paratuberculosis
cccggcguacagca

SEQ ID NO: 957224 - RNA, 23 nt, Mycobacterium avium subsp. paratuberculosis
cccggcguccgcgaacgggugcg

SEQ ID NO: 957225 - RNA, 15 nt, Mycobacterium avium subsp. paratuberculosis
cccggcgucgaugac

SEQ ID NO: 957226 - RNA, 15 nt, Mycobacterium avium subsp. paratuberculosis
cccggcgucucggcg

SEQ ID NO: 957227 - RNA, 12 nt, Mycobacterium avium subsp. paratuberculosis
cccggcgugagc

SEQ ID NO: 957228 - RNA, 19 nt, Mycobacterium avium subsp. paratuberculosis
cccggcgggcucgccggcc

SEQ ID NO: 957229 - RNA, 21 nt, Mycobacterium avium subsp. paratuberculosis
cccggcgggggcggcggggug

SEQ ID NO: 957230 - RNA, 18 nt, Mycobacterium avium subsp. paratuberculosis
cccggcgggucagcaccg

SEQ ID NO: 957231 - RNA, 24 nt, Mycobacterium avium subsp. paratuberculosis
cccggcgggucugugaccacgguc

SEQ ID NO: 957232 - RNA, 19 nt, Mycobacterium avium subsp. paratuberculosis
cccggcuggcaggucgcgc

SEQ ID NO: 957233 - RNA, 21 nt, Mycobacterium avium subsp. paratuberculosis
cccggcuggcaggucgcgccg

SEQ ID NO: 957234 - RNA, 12 nt, Mycobacterium avium subsp. paratuberculosis
cccggcuggccg

SEQ ID NO: 957235 - RNA, 15 nt, Mycobacterium avium subsp. paratuberculosis
cccggcuggccgcac

SEQ ID NO: 957236 - RNA, 14 nt, Mycobacterium avium subsp. paratuberculosis
cccggcugcugcac

SEQ ID NO: 957237 - RNA, 20 nt, Mycobacterium avium subsp. paratuberculosis
cccggcugcugcacgacgac

SEQ ID NO: 957238 - RNA, 23 nt, Mycobacterium avium subsp. paratuberculosis
cccggcgugcuccagcaggcgcg

SEQ ID NO: 957239 - RNA, 20 nt, Mycobacterium avium subsp. paratuberculosis
cccggcgugagcgagccggc

SEQ ID NO: 957240 - RNA, 14 nt, Mycobacterium avium subsp. paratuberculosis
cccggcuucgccgc

SEQ ID NO: 957241 - RNA, 16 nt, Mycobacterium avium subsp. paratuberculosis
cccggcuucgccgccg

SEQ ID NO: 957242 - RNA, 19 nt, Mycobacterium avium subsp. paratuberculosis
cccggcuucgccgccgcac

SEQ ID NO: 957243 - RNA, 15 nt, Mycobacterium avium subsp. paratuberculosis
cccggcuucgccgcg

SEQ ID NO: 957244 - RNA, 16 nt, Mycobacterium avium subsp. paratuberculosis
cccggcuucgccgcgc

SEQ ID NO: 957245 - RNA, 19 nt, Mycobacterium avium subsp. paratuberculosis
cccggcuucgcugcgccgg

SEQ ID NO: 957246 - RNA, 21 nt, Mycobacterium avium subsp. paratuberculosis
cccggcuucgcugcgccggcg

SEQ ID NO: 957247 - RNA, 22 nt, Mycobacterium avium subsp. paratuberculosis
cccggcuucgcugcgccggcgg

SEQ ID NO: 957248 - RNA, 10 nt, Mycobacterium avium subsp. paratuberculosis
cccgggccgg

SEQ ID NO: 957249 - RNA, 20 nt, Mycobacterium avium subsp. paratuberculosis
cccgggccugcggcggccgc

SEQ ID NO: 957250 - RNA, 20 nt, Mycobacterium avium subsp. paratuberculosis
cccgggccgucaucgccgac

SEQ ID NO: 957251 - RNA, 14 nt, Mycobacterium avium subsp. paratuberculosis
cccgggccguccgg

SEQ ID NO: 957252 - RNA, 23 nt, Mycobacterium avium subsp. paratuberculosis
cccgggcgacuucguuggugguc

SEQ ID NO: 957253 - RNA, 14 nt, Mycobacterium avium subsp. paratuberculosis
cccgggcgaucagc

SEQ ID NO: 957254 - RNA, 12 nt, Mycobacterium avium subsp. paratuberculosis
cccgggcgaugg

SEQ ID NO: 957255 - RNA, 22 nt, Mycobacterium avium subsp. paratuberculosis
cccgggcgauggugccgccggu

SEQ ID NO: 957256 - RNA, 21 nt, Mycobacterium avium subsp. paratuberculosis
cccgggcgccauccgcagccc

SEQ ID NO: 957257 - RNA, 16 nt, Mycobacterium avium subsp. paratuberculosis
cccgggcgccgagaac

SEQ ID NO: 957258 - RNA, 20 nt, Mycobacterium avium subsp. paratuberculosis
cccgggcgccggcgaugaac

SEQ ID NO: 957259 - RNA, 13 nt, Mycobacterium avium subsp. paratuberculosis
cccgggcgcgacg

SEQ ID NO: 957260 - RNA, 15 nt, Mycobacterium avium subsp. paratuberculosis
cccggcuuuccgacg

SEQ ID NO: 957261 - RNA, 17 nt, Mycobacterium avium subsp. paratuberculosis
cccgggaaaugcugcac

SEQ ID NO: 957262 - RNA, 19 nt, Mycobacterium avium subsp. paratuberculosis
cccgggaaaugcugcaccc

SEQ ID NO: 957263 - RNA, 20 nt, Mycobacterium avium subsp. paratuberculosis
cccgggaaaugcugcaccca

SEQ ID NO: 957264 - RNA, 20 nt, Mycobacterium avium subsp. paratuberculosis
cccgggaaccagcccagguc

SEQ ID NO: 957265 - RNA, 18 nt, Mycobacterium avium subsp. paratuberculosis
cccgggaacgacggugcg

SEQ ID NO: 957266 - RNA, 18 nt, Mycobacterium avium subsp. paratuberculosis
cccgggaagccgcagcag

SEQ ID NO: 957267 - RNA, 13 nt, Mycobacterium avium subsp. paratuberculosis
ccgaauccagcgc

SEQ ID NO: 957268 - RNA, 15 nt, Mycobacterium avium subsp. paratuberculosis
ccgaauccagcgcgc

SEQ ID NO: 957269 - RNA, 14 nt, Mycobacterium avium subsp. paratuberculosis
ccgaauccgggcau

SEQ ID NO: 957270 - RNA, 12 nt, Mycobacterium avium subsp. paratuberculosis
ccgaaucgagcc

SEQ ID NO: 957271 - RNA, 18 nt, Mycobacterium avium subsp. paratuberculosis
ccgaaucgccgagcucga

SEQ ID NO: 957272 - RNA, 18 nt, Mycobacterium avium subsp. paratuberculosis
ccgaaucggucgaccagc

SEQ ID NO: 957273 - RNA, 23 nt, Mycobacterium avium subsp. paratuberculosis
ccgaauugcuuacgcaucgccga

SEQ ID NO: 957274 - RNA, 22 nt, Mycobacterium avium subsp. paratuberculosis
ccgaauuguucggccaccgcgc

SEQ ID NO: 957275 - RNA, 14 nt, Mycobacterium avium subsp. paratuberculosis
ccgacaccaccggc

SEQ ID NO: 957276 - RNA, 15 nt, Mycobacterium avium subsp. paratuberculosis
ccgacaccaccggcc

SEQ ID NO: 957277 - RNA, 16 nt, Mycobacterium avium subsp. paratuberculosis
ccgacaccaccggccg

SEQ ID NO: 957278 - RNA, 17 nt, Mycobacterium avium subsp. paratuberculosis
ccgacaccaccggccgc

SEQ ID NO: 957279 - RNA, 15 nt, Mycobacterium avium subsp. paratuberculosis
ccgacaccaccugca

SEQ ID NO: 957280 - RNA, 13 nt, Mycobacterium avium subsp. paratuberculosis
ccgacaccagcgc

SEQ ID NO: 957281 - RNA, 17 nt, Mycobacterium avium subsp. paratuberculosis
ccgacaccagcgcgcac

SEQ ID NO: 957282 - RNA, 16 nt, Mycobacterium avium subsp. paratuberculosis
ccgacaccagggugcg

SEQ ID NO: 957283 - RNA, 18 nt, Mycobacterium avium subsp. paratuberculosis
ccgacaagggccgggcgc

SEQ ID NO: 957284 - RNA, 20 nt, Mycobacterium avium subsp. paratuberculosis
ccgacaagggccgggcgcug

SEQ ID NO: 957285 - RNA, 18 nt, Mycobacterium avium subsp. paratuberculosis
ccgacaccccgaugcggu

SEQ ID NO: 957286 - RNA, 24 nt, Mycobacterium avium subsp. paratuberculosis
ccgacaccgcauuugccgacaugc

SEQ ID NO: 957287 - RNA, 11 nt, Mycobacterium avium subsp. paratuberculosis
ccgacaccgcc

SEQ ID NO: 957288 - RNA, 14 nt, Mycobacterium avium subsp. paratuberculosis
ccgacaccgccagc

SEQ ID NO: 957289 - RNA, 20 nt, Mycobacterium avium subsp. paratuberculosis
ccgacaccgccccgccgcgc

SEQ ID NO: 957290 - RNA, 21 nt, Mycobacterium avium subsp. paratuberculosis
ccgacaccgccccgccgcgcc

SEQ ID NO: 957291 - RNA, 22 nt, Mycobacterium avium subsp. paratuberculosis
ccgacaccgccccgccgcgccg

SEQ ID NO: 957292 - RNA, 14 nt, Mycobacterium avium subsp. paratuberculosis
ccgacaccgccuuc

SEQ ID NO: 957293 - RNA, 18 nt, Mycobacterium avium subsp. paratuberculosis
ccgacaccggccgggacg

SEQ ID NO: 957294 - RNA, 23 nt, Mycobacterium avium subsp. paratuberculosis
ccgacaccgggucccccgccgac

SEQ ID NO: 957295 - RNA, 16 nt, Mycobacterium avium subsp. paratuberculosis
ccgacaccucgccguc

SEQ ID NO: 957296 - RNA, 12 nt, Mycobacterium avium subsp. paratuberculosis
ccgacacgccga

SEQ ID NO: 957297 - RNA, 15 nt, Mycobacterium avium subsp. paratuberculosis
ccgacaccguggugg

SEQ ID NO: 957298 - RNA, 17 nt, Mycobacterium avium subsp. paratuberculosis
ccgacaucagaucgccg

SEQ ID NO: 957299 - RNA, 22 nt, Mycobacterium avium subsp. paratuberculosis
ccgacaucagugcgggcaucgg

SEQ ID NO: 957300 - RNA, 23 nt, Mycobacterium avium subsp. paratuberculosis
ccgacauccaggaccgcgcgccg

SEQ ID NO: 957301 - RNA, 14 nt, Mycobacterium avium subsp. paratuberculosis
ccgacaucgccauc

SEQ ID NO: 957302 - RNA, 15 nt, Mycobacterium avium subsp. paratuberculosis
ccgacaucgccauca

SEQ ID NO: 957303 - RNA, 13 nt, Mycobacterium avium subsp. paratuberculosis
ccgacaucgcggc

SEQ ID NO: 957304 - RNA, 15 nt, Mycobacterium avium subsp. paratuberculosis
ccgacaucgcggcga

SEQ ID NO: 957305 - RNA, 16 nt, Mycobacterium avium subsp. paratuberculosis
ccgacauaggucaggu

SEQ ID NO: 957306 - RNA, 21 nt, Mycobacterium avium subsp. paratuberculosis
ccgacaucaccaaccgcucgg

SEQ ID NO: 957307 - RNA, 17 nt, Mycobacterium avium subsp. paratuberculosis
ccgacagucgcgggcag

SEQ ID NO: 957308 - RNA, 16 nt, Mycobacterium avium subsp. paratuberculosis
ccgacagucgcgggcg

SEQ ID NO: 957309 - RNA, 17 nt, Mycobacterium avium subsp. paratuberculosis
ccgacagucgcgggcga

SEQ ID NO: 957310 - RNA, 18 nt, Mycobacterium avium subsp. paratuberculosis
ccgacagucgcgggcgag

SEQ ID NO: 957311 - RNA, 18 nt, Mycobacterium avium subsp. paratuberculosis
ccgacagucgcgggcggg

SEQ ID NO: 957312 - RNA, 22 nt, Mycobacterium avium subsp. paratuberculosis
ccgacagucgcgggcggggcgc

SEQ ID NO: 957313 - RNA, 15 nt, Mycobacterium avium subsp. paratuberculosis
ccgacauggccagca

SEQ ID NO: 957314 - RNA, 18 nt, Mycobacterium avium subsp. paratuberculosis
ccgacauggccagcacca

SEQ ID NO: 957315 - RNA, 17 nt, Mycobacterium avium subsp. paratuberculosis
ccgacaucugccgggcg

SEQ ID NO: 957316 - RNA, 18 nt, Mycobacterium avium subsp. paratuberculosis
ccgacaucugccgggcgg

SEQ ID NO: 957317 - RNA, 19 nt, Mycobacterium avium subsp. paratuberculosis
ccgacaucugccgggcggc

SEQ ID NO: 957318 - RNA, 14 nt, Mycobacterium avium subsp. paratuberculosis
ccgacaucgucggc

SEQ ID NO: 957319 - RNA, 23 nt, Mycobacterium avium subsp. paratuberculosis
ccgacaucgucggcucguguccg

SEQ ID NO: 957320 - RNA, 13 nt, Mycobacterium avium subsp. paratuberculosis
ccgaccaacgggc

SEQ ID NO: 957321 - RNA, 14 nt, Mycobacterium avium subsp. paratuberculosis
ccgaccaacgggcg

SEQ ID NO: 957322 - RNA, 18 nt, Mycobacterium avium subsp. paratuberculosis
ccgaccaacgggcggcgg

SEQ ID NO: 957323 - RNA, 13 nt, Mycobacterium avium subsp. paratuberculosis
ccgaccacaccgg

SEQ ID NO: 957324 - RNA, 18 nt, Mycobacterium avium subsp. paratuberculosis
ccgaccacaccggcgcug

SEQ ID NO: 957325 - RNA, 19 nt, Mycobacterium avium subsp. paratuberculosis
ccgaccacaccggcgcugc

SEQ ID NO: 957326 - RNA, 19 nt, Mycobacterium avium subsp. paratuberculosis
ccgacaggucgaagggcau

SEQ ID NO: 957327 - RNA, 22 nt, Mycobacterium avium subsp. paratuberculosis
ccgacaggucgaagggcaucgg

SEQ ID NO: 957328 - RNA, 18 nt, Mycobacterium avium subsp. paratuberculosis
ccgacagggagccgacga

SEQ ID NO: 957329 - RNA, 15 nt, Mycobacterium avium subsp. paratuberculosis
ccgacagggccagcg

SEQ ID NO: 957330 - RNA, 16 nt, Mycobacterium avium subsp. paratuberculosis
ccgacagggccagcgc

SEQ ID NO: 957331 - RNA, 14 nt, Mycobacterium avium subsp. paratuberculosis
ccgacaguccgacc

SEQ ID NO: 957332 - RNA, 16 nt, Mycobacterium avium subsp. paratuberculosis
ccgacaguccgaccgc

SEQ ID NO: 957333 - RNA, 17 nt, Mycobacterium avium subsp. paratuberculosis
ccgacaguccgaccgcg

SEQ ID NO: 957334 - RNA, 19 nt, Mycobacterium avium subsp. paratuberculosis
ccgacagcugagcagcccg

SEQ ID NO: 957335 - RNA, 18 nt, Mycobacterium avium subsp. paratuberculosis
ccgacagcuugauguugc

SEQ ID NO: 957336 - RNA, 21 nt, Mycobacterium avium subsp. paratuberculosis
ccgacaggaugcuggggucgg

SEQ ID NO: 957337 - RNA, 13 nt, Mycobacterium avium subsp. paratuberculosis
ccgacaggcccac

SEQ ID NO: 957338 - RNA, 13 nt, Mycobacterium avium subsp. paratuberculosis
ccgacagcgucgu

SEQ ID NO: 957339 - RNA, 23 nt, Mycobacterium avium subsp. paratuberculosis
ccgacagcgggauguagccgguc

SEQ ID NO: 957340 - RNA, 13 nt, Mycobacterium avium subsp. paratuberculosis
ccgacagcgccug

SEQ ID NO: 957341 - RNA, 17 nt, Mycobacterium avium subsp. paratuberculosis
ccgacagccgcaccggc

SEQ ID NO: 957342 - RNA, 22 nt, Mycobacterium avium subsp. paratuberculosis
ccgacagccgcaccggcgccgc

SEQ ID NO: 957343 - RNA, 16 nt, Mycobacterium avium subsp. paratuberculosis
ccgacagcacccggcc

SEQ ID NO: 957344 - RNA, 15 nt, Mycobacterium avium subsp. paratuberculosis
ccgacagcaccucgc

SEQ ID NO: 957345 - RNA, 17 nt, Mycobacterium avium subsp. paratuberculosis
ccgacagcccccgcagc

SEQ ID NO: 957346 - RNA, 18 nt, Mycobacterium avium subsp. paratuberculosis
ccgacagcccccgcagcc

SEQ ID NO: 957347 - RNA, 19 nt, Mycobacterium avium subsp. paratuberculosis
ccgacagcccgcccacaua

SEQ ID NO: 957348 - RNA, 17 nt, Mycobacterium avium subsp. paratuberculosis
ccgacagcacgccgggc

SEQ ID NO: 957349 - RNA, 21 nt, Mycobacterium avium subsp. paratuberculosis
ccgacagaugcggcaccagcc

SEQ ID NO: 957350 - RNA, 22 nt, Mycobacterium avium subsp. paratuberculosis
ccgacagaugcggcaccagccc

SEQ ID NO: 957351 - RNA, 12 nt, Mycobacterium avium subsp. paratuberculosis
ccgaccgggcgc

SEQ ID NO: 957352 - RNA, 22 nt, Mycobacterium avium subsp. paratuberculosis
ccgaccgggcgcuccguugggu

SEQ ID NO: 957353 - RNA, 20 nt, Mycobacterium avium subsp. paratuberculosis
ccgaccggcucagcccggcg

SEQ ID NO: 957354 - RNA, 22 nt, Mycobacterium avium subsp. paratuberculosis
ccgaccggcucucagccggaac

SEQ ID NO: 957355 - RNA, 16 nt, Mycobacterium avium subsp. paratuberculosis
ccgaccgguccgccgc

SEQ ID NO: 957356 - RNA, 17 nt, Mycobacterium avium subsp. paratuberculosis
ccgaccgguccgccgcc

SEQ ID NO: 957357 - RNA, 14 nt, Mycobacterium avium subsp. paratuberculosis
ccgaccgcccgcug

SEQ ID NO: 957358 - RNA, 16 nt, Mycobacterium avium subsp. paratuberculosis
ccgaccgcccgcuguu

SEQ ID NO: 957359 - RNA, 22 nt, Mycobacterium avium subsp. paratuberculosis
ccgaccgcgugucggcacacca

SEQ ID NO: 957360 - RNA, 16 nt, Mycobacterium avium subsp. paratuberculosis
ccgaccgaucagcgga

SEQ ID NO: 957361 - RNA, 12 nt, Mycobacterium avium subsp. paratuberculosis
ccgaccgccacc

SEQ ID NO: 957362 - RNA, 17 nt, Mycobacterium avium subsp. paratuberculosis
ccgaccgccaccacccg

SEQ ID NO: 957363 - RNA, 18 nt, Mycobacterium avium subsp. paratuberculosis
ccgaccgccaccacccgg

SEQ ID NO: 957364 - RNA, 19 nt, Mycobacterium avium subsp. paratuberculosis
ccgaccgccaccacccggc

SEQ ID NO: 957365 - RNA, 19 nt, Mycobacterium avium subsp. paratuberculosis
ccgaccgccgagcgggcga

SEQ ID NO: 957366 - RNA, 22 nt, Mycobacterium avium subsp. paratuberculosis
ccgaccgccgagcgggcgaucu

SEQ ID NO: 957367 - RNA, 13 nt, Mycobacterium avium subsp. paratuberculosis
ccgaccgccgcca

SEQ ID NO: 957368 - RNA, 12 nt, Mycobacterium avium subsp. paratuberculosis
ccgaccgccgcg

SEQ ID NO: 957369 - RNA, 14 nt, Mycobacterium avium subsp. paratuberculosis
ccgaccgccgcggc

SEQ ID NO: 957370 - RNA, 17 nt, Mycobacterium avium subsp. paratuberculosis
ccgaccgccgcggccgc

SEQ ID NO: 957371 - RNA, 18 nt, Mycobacterium avium subsp. paratuberculosis
ccgaccgccgcggccgcc

SEQ ID NO: 957372 - RNA, 21 nt, Mycobacterium avium subsp. paratuberculosis
ccgaccgccgcggccgccuuc

SEQ ID NO: 957373 - RNA, 13 nt, Mycobacterium avium subsp. paratuberculosis
ccgaccgccucga

SEQ ID NO: 957374 - RNA, 23 nt, Mycobacterium avium subsp. paratuberculosis
ccgaccgccucgauggcccgcuc

SEQ ID NO: 957375 - RNA, 12 nt, Mycobacterium avium subsp. paratuberculosis
ccgaccgcgagc

SEQ ID NO: 957376 - RNA, 16 nt, Mycobacterium avium subsp. paratuberculosis
ccgacgacgacgucga

SEQ ID NO: 957377 - RNA, 13 nt, Mycobacterium avium subsp. paratuberculosis
ccgacgacgccgu

SEQ ID NO: 957378 - RNA, 15 nt, Mycobacterium avium subsp. paratuberculosis
ccgacgacggcgaac

SEQ ID NO: 957379 - RNA, 18 nt, Mycobacterium avium subsp. paratuberculosis
ccgacgaccaucagcgcc

SEQ ID NO: 957380 - RNA, 19 nt, Mycobacterium avium subsp. paratuberculosis
ccgacgaccaucagcgccc

SEQ ID NO: 957381 - RNA, 13 nt, Mycobacterium avium subsp. paratuberculosis
ccgacgaccucgg

SEQ ID NO: 957382 - RNA, 22 nt, Mycobacterium avium subsp. paratuberculosis
ccgacgaccucggugucgaggu

SEQ ID NO: 957383 - RNA, 20 nt, Mycobacterium avium subsp. paratuberculosis
ccgacgaaaucgucgggcac

SEQ ID NO: 957384 - RNA, 23 nt, Mycobacterium avium subsp. paratuberculosis
ccgacgaaaucgucgggcaccag

SEQ ID NO: 957385 - RNA, 20 nt, Mycobacterium avium subsp. paratuberculosis
ccgacgaaaucgucgggccg

SEQ ID NO: 957386 - RNA, 22 nt, Mycobacterium avium subsp. paratuberculosis
ccgacgaaaucgucgggccgga

SEQ ID NO: 957387 - RNA, 17 nt, Mycobacterium avium subsp. paratuberculosis
ccgacgaaccgugcacg

SEQ ID NO: 957388 - RNA, 18 nt, Mycobacterium avium subsp. paratuberculosis
ccgacgaaccgugcacga

SEQ ID NO: 957389 - RNA, 17 nt, Mycobacterium avium subsp. paratuberculosis
ccgacgaagaugcgccc

SEQ ID NO: 957390 - RNA, 19 nt, Mycobacterium avium subsp. paratuberculosis
ccgaccuucugcugcacgu

SEQ ID NO: 957391 - RNA, 22 nt, Mycobacterium avium subsp. paratuberculosis
ccgaccuucugcugcacguccg

SEQ ID NO: 957392 - RNA, 18 nt, Mycobacterium avium subsp. paratuberculosis
ccgaccuuuugcccggcg

SEQ ID NO: 957393 - RNA, 19 nt, Mycobacterium avium subsp. paratuberculosis
ccgaccucggccagcgugu

SEQ ID NO: 957394 - RNA, 14 nt, Mycobacterium avium subsp. paratuberculosis
ccgaccucgaggcc

SEQ ID NO: 957395 - RNA, 13 nt, Mycobacterium avium subsp. paratuberculosis
ccgaccucggcga

SEQ ID NO: 957396 - RNA, 17 nt, Mycobacterium avium subsp. paratuberculosis
ccgaccucgucgacggc

SEQ ID NO: 957397 - RNA, 18 nt, Mycobacterium avium subsp. paratuberculosis
ccgaccuggcggccggau

SEQ ID NO: 957398 - RNA, 18 nt, Mycobacterium avium subsp. paratuberculosis
ccgaccugggcggccacc

SEQ ID NO: 957399 - RNA, 21 nt, Mycobacterium avium subsp. paratuberculosis
ccgaccugggcggccaccgcg

SEQ ID NO: 957400 - RNA, 13 nt, Mycobacterium avium subsp. paratuberculosis
ccgaccuggucgc

SEQ ID NO: 957401 - RNA, 15 nt, Mycobacterium avium subsp. paratuberculosis
ccgaccuggucgccg

SEQ ID NO: 957402 - RNA, 16 nt, Mycobacterium avium subsp. paratuberculosis
ccgaccuggucgccga

SEQ ID NO: 957403 - RNA, 19 nt, Mycobacterium avium subsp. paratuberculosis
ccgaccuggucgccgaacg

SEQ ID NO: 957404 - RNA, 16 nt, Mycobacterium avium subsp. paratuberculosis
ccgaccuguagggcga

SEQ ID NO: 957405 - RNA, 13 nt, Mycobacterium avium subsp. paratuberculosis
ccgaccagcgcga

SEQ ID NO: 957406 - RNA, 18 nt, Mycobacterium avium subsp. paratuberculosis
ccgaccaguucggccacc

SEQ ID NO: 957407 - RNA, 19 nt, Mycobacterium avium subsp. paratuberculosis
ccgaccaguucggccaccg

SEQ ID NO: 957408 - RNA, 17 nt, Mycobacterium avium subsp. paratuberculosis
ccgaccaggaacacggc

SEQ ID NO: 957409 - RNA, 14 nt, Mycobacterium avium subsp. paratuberculosis
ccgaccaggaagua

SEQ ID NO: 957410 - RNA, 17 nt, Mycobacterium avium subsp. paratuberculosis
ccgaccaggaucgggau

SEQ ID NO: 957411 - RNA, 16 nt, Mycobacterium avium subsp. paratuberculosis
ccgaccagcgggauga

SEQ ID NO: 957412 - RNA, 13 nt, Mycobacterium avium subsp. paratuberculosis
ccgaccagcgggc

SEQ ID NO: 957413 - RNA, 17 nt, Mycobacterium avium subsp. paratuberculosis
ccgaccagcgggccgac

SEQ ID NO: 957414 - RNA, 20 nt, Mycobacterium avium subsp. paratuberculosis
ccgaccagcgggccgacagc

SEQ ID NO: 957415 - RNA, 16 nt, Mycobacterium avium subsp. paratuberculosis
ccgaccagcgguuugg

SEQ ID NO: 957416 - RNA, 15 nt, Mycobacterium avium subsp. paratuberculosis
ccgaccagcggccca

SEQ ID NO: 957417 - RNA, 16 nt, Mycobacterium avium subsp. paratuberculosis
ccgaccagcggcccac

SEQ ID NO: 957418 - RNA, 21 nt, Mycobacterium avium subsp. paratuberculosis
ccgaccagcggcccaccgcga

SEQ ID NO: 957419 - RNA, 23 nt, Mycobacterium avium subsp. paratuberculosis
ccgaccagcggcccaccgcgacc

SEQ ID NO: 957420 - RNA, 12 nt, Mycobacterium avium subsp. paratuberculosis
ccgaccagcgcg

SEQ ID NO: 957421 - RNA, 13 nt, Mycobacterium avium subsp. paratuberculosis
ccgaccagccggu

SEQ ID NO: 957422 - RNA, 17 nt, Mycobacterium avium subsp. paratuberculosis
ccgaccagcacccgggc

SEQ ID NO: 957423 - RNA, 14 nt, Mycobacterium avium subsp. paratuberculosis
ccgaccagcaccgc

SEQ ID NO: 957424 - RNA, 16 nt, Mycobacterium avium subsp. paratuberculosis
ccgaccacgccgcgcu

SEQ ID NO: 957425 - RNA, 18 nt, Mycobacterium avium subsp. paratuberculosis
ccgaccaccuccccgcgg

SEQ ID NO: 957426 - RNA, 19 nt, Mycobacterium avium subsp. paratuberculosis
ccgaccccgaugcgcucgc

SEQ ID NO: 957427 - RNA, 14 nt, Mycobacterium avium subsp. paratuberculosis
ccgaccccgccagc

SEQ ID NO: 957428 - RNA, 20 nt, Mycobacterium avium subsp. paratuberculosis
ccgaccccgccagcaccgac

SEQ ID NO: 957429 - RNA, 15 nt, Mycobacterium avium subsp. paratuberculosis
ccgacccccgccgcg

SEQ ID NO: 957430 - RNA, 20 nt, Mycobacterium avium subsp. paratuberculosis
ccgacccccgccgcgucggu

SEQ ID NO: 957431 - RNA, 19 nt, Mycobacterium avium subsp. paratuberculosis
ccgacccaauacgaucagc

SEQ ID NO: 957432 - RNA, 21 nt, Mycobacterium avium subsp. paratuberculosis
ccgacccaauacgaucagcag

SEQ ID NO: 957433 - RNA, 13 nt, Mycobacterium avium subsp. paratuberculosis
ccgaccccggcga

SEQ ID NO: 957434 - RNA, 15 nt, Mycobacterium avium subsp. paratuberculosis
ccgaccccggcgagc

SEQ ID NO: 957435 - RNA, 17 nt, Mycobacterium avium subsp. paratuberculosis
ccgaccccucggcggcc

SEQ ID NO: 957436 - RNA, 18 nt, Mycobacterium avium subsp. paratuberculosis
ccgaccccucggcggccg

SEQ ID NO: 957437 - RNA, 19 nt, Mycobacterium avium subsp. paratuberculosis
ccgaccccucggcggccgu

SEQ ID NO: 957438 - RNA, 22 nt, Mycobacterium avium subsp. paratuberculosis
ccgaccccucggcggccgucgg

SEQ ID NO: 957439 - RNA, 15 nt, Mycobacterium avium subsp. paratuberculosis
ccgacccgaagccca

SEQ ID NO: 957440 - RNA, 15 nt, Mycobacterium avium subsp. paratuberculosis
ccgacccgcccgccg

SEQ ID NO: 957441 - RNA, 16 nt, Mycobacterium avium subsp. paratuberculosis
ccgacccgcccgccgg

SEQ ID NO: 957442 - RNA, 12 nt, Mycobacterium avium subsp. paratuberculosis
ccgacccgccgu

SEQ ID NO: 957443 - RNA, 15 nt, Mycobacterium avium subsp. paratuberculosis
ccgacccggccagcg

SEQ ID NO: 957444 - RNA, 16 nt, Mycobacterium avium subsp. paratuberculosis
ccgacccggccagcgg

SEQ ID NO: 957445 - RNA, 18 nt, Mycobacterium avium subsp. paratuberculosis
ccgacccggccagcggca

SEQ ID NO: 957446 - RNA, 18 nt, Mycobacterium avium subsp. paratuberculosis
ccgacccgcaccaccgcc

SEQ ID NO: 957447 - RNA, 14 nt, Mycobacterium avium subsp. paratuberculosis
ccgacccggucagc

SEQ ID NO: 957448 - RNA, 18 nt, Mycobacterium avium subsp. paratuberculosis
ccgacccggucagcucgc

SEQ ID NO: 957449 - RNA, 21 nt, Mycobacterium avium subsp. paratuberculosis
ccgacccgguugauccggauc

SEQ ID NO: 957450 - RNA, 14 nt, Mycobacterium avium subsp. paratuberculosis
ccgacccugcgucc

SEQ ID NO: 957451 - RNA, 12 nt, Mycobacterium avium subsp. paratuberculosis
ccgacccgggcu

SEQ ID NO: 957452 - RNA, 12 nt, Mycobacterium avium subsp. paratuberculosis
ccgaccgacagc

SEQ ID NO: 957453 - RNA, 12 nt, Mycobacterium avium subsp. paratuberculosis
ccgaccgacagu

SEQ ID NO: 957454 - RNA, 23 nt, Mycobacterium avium subsp. paratuberculosis
ccgaccgacgcggucaccggcuc

SEQ ID NO: 957455 - RNA, 16 nt, Mycobacterium avium subsp. paratuberculosis
ccgaccgagggcgcgg

SEQ ID NO: 957456 - RNA, 17 nt, Mycobacterium avium subsp. paratuberculosis
ccgacgauccgcgccgc

SEQ ID NO: 957457 - RNA, 14 nt, Mycobacterium avium subsp. paratuberculosis
ccgacgauccgggc

SEQ ID NO: 957458 - RNA, 15 nt, Mycobacterium avium subsp. paratuberculosis
ccgacgauccgggcc

SEQ ID NO: 957459 - RNA, 12 nt, Mycobacterium avium subsp. paratuberculosis
ccgacgaucgcg

SEQ ID NO: 957460 - RNA, 13 nt, Mycobacterium avium subsp. paratuberculosis
ccgacgaucgcgc

SEQ ID NO: 957461 - RNA, 14 nt, Mycobacterium avium subsp. paratuberculosis
ccgacgaucgcgcc

SEQ ID NO: 957462 - RNA, 15 nt, Mycobacterium avium subsp. paratuberculosis
ccgacgaucgcgccg

SEQ ID NO: 957463 - RNA, 17 nt, Mycobacterium avium subsp. paratuberculosis
ccgacgaucgcgccggc

SEQ ID NO: 957464 - RNA, 21 nt, Mycobacterium avium subsp. paratuberculosis
ccgacgaucgcgccggccgcc

SEQ ID NO: 957465 - RNA, 22 nt, Mycobacterium avium subsp. paratuberculosis
ccgacgaucgcgccggccgccg

SEQ ID NO: 957466 - RNA, 17 nt, Mycobacterium avium subsp. paratuberculosis
ccgacgagucgccguug

SEQ ID NO: 957467 - RNA, 15 nt, Mycobacterium avium subsp. paratuberculosis
ccgacgagucgacgc

SEQ ID NO: 957468 - RNA, 14 nt, Mycobacterium avium subsp. paratuberculosis
ccgacgagucgccg

SEQ ID NO: 957469 - RNA, 15 nt, Mycobacterium avium subsp. paratuberculosis
ccgacgacgucgcgc

SEQ ID NO: 957470 - RNA, 14 nt, Mycobacterium avium subsp. paratuberculosis
ccgacgacgugacg

SEQ ID NO: 957471 - RNA, 15 nt, Mycobacterium avium subsp. paratuberculosis
ccgacgacgugacga

SEQ ID NO: 957472 - RNA, 15 nt, Mycobacterium avium subsp. paratuberculosis
ccgacgagcucgccg

SEQ ID NO: 957473 - RNA, 18 nt, Mycobacterium avium subsp. paratuberculosis
ccgacgaggagaccuccu

SEQ ID NO: 957474 - RNA, 18 nt, Mycobacterium avium subsp. paratuberculosis
ccgacgcauguccgccgu

SEQ ID NO: 957475 - RNA, 19 nt, Mycobacterium avium subsp. paratuberculosis
ccgacgcauguccgccguc

SEQ ID NO: 957476 - RNA, 17 nt, Mycobacterium avium subsp. paratuberculosis
ccgacgaugcggggcgg

SEQ ID NO: 957477 - RNA, 20 nt, Mycobacterium avium subsp. paratuberculosis
ccgacgaugcggggcggcgg

SEQ ID NO: 957478 - RNA, 23 nt, Mycobacterium avium subsp. paratuberculosis
ccgacgaugcggggcggcgggau

SEQ ID NO: 957479 - RNA, 20 nt, Mycobacterium avium subsp. paratuberculosis
ccgacgaugcugucgcgggu

SEQ ID NO: 957480 - RNA, 22 nt, Mycobacterium avium subsp. paratuberculosis
ccgacgaugucgaaacccagga

SEQ ID NO: 957481 - RNA, 16 nt, Mycobacterium avium subsp. paratuberculosis
ccgacgaugagggcca

SEQ ID NO: 957482 - RNA, 20 nt, Mycobacterium avium subsp. paratuberculosis
ccgacgaugagggccagcag

SEQ ID NO: 957483 - RNA, 20 nt, Mycobacterium avium subsp. paratuberculosis
ccgacgaugagggugaugac

SEQ ID NO: 957484 - RNA, 13 nt, Mycobacterium avium subsp. paratuberculosis
ccgacgccggcca

SEQ ID NO: 957485 - RNA, 13 nt, Mycobacterium avium subsp. paratuberculosis
ccgacgccgucga

SEQ ID NO: 957486 - RNA, 18 nt, Mycobacterium avium subsp. paratuberculosis
ccgacgccuccacauacg

SEQ ID NO: 957487 - RNA, 13 nt, Mycobacterium avium subsp. paratuberculosis
ccgacgccugcgc

SEQ ID NO: 957488 - RNA, 14 nt, Mycobacterium avium subsp. paratuberculosis
ccgacgccugcgcg

SEQ ID NO: 957489 - RNA, 13 nt, Mycobacterium avium subsp. paratuberculosis
ccgacgccgacac

SEQ ID NO: 957490 - RNA, 14 nt, Mycobacterium avium subsp. paratuberculosis
ccgacgccgacacc

SEQ ID NO: 957491 - RNA, 16 nt, Mycobacterium avium subsp. paratuberculosis
ccgacgccgacaccag

SEQ ID NO: 957492 - RNA, 14 nt, Mycobacterium avium subsp. paratuberculosis
ccgacgccacgucg

SEQ ID NO: 957493 - RNA, 15 nt, Mycobacterium avium subsp. paratuberculosis
ccgacgccacgucgu

SEQ ID NO: 957494 - RNA, 14 nt, Mycobacterium avium subsp. paratuberculosis
ccgacgccagcacg

SEQ ID NO: 957495 - RNA, 15 nt, Mycobacterium avium subsp. paratuberculosis
ccgacgccagcacgu

SEQ ID NO: 957496 - RNA, 13 nt, Mycobacterium avium subsp. paratuberculosis
ccgacgccagcgg

SEQ ID NO: 957497 - RNA, 14 nt, Mycobacterium avium subsp. paratuberculosis
ccgacgccagcggg

SEQ ID NO: 957498 - RNA, 17 nt, Mycobacterium avium subsp. paratuberculosis
ccgacgccagcgggccg

SEQ ID NO: 957499 - RNA, 18 nt, Mycobacterium avium subsp. paratuberculosis
ccgacgcccagcaccgag

SEQ ID NO: 957500 - RNA, 14 nt, Mycobacterium avium subsp. paratuberculosis
ccgacgcccagcgc

SEQ ID NO: 957501 - RNA, 19 nt, Mycobacterium avium subsp. paratuberculosis
ccgacgcccagcgcggcga

SEQ ID NO: 957502 - RNA, 19 nt, Mycobacterium avium subsp. paratuberculosis
ccgacgcccggcuucgccg

SEQ ID NO: 957503 - RNA, 14 nt, Mycobacterium avium subsp. paratuberculosis
ccgacgcgccgucg

SEQ ID NO: 957504 - RNA, 15 nt, Mycobacterium avium subsp. paratuberculosis
ccgacgcggccucga

SEQ ID NO: 957505 - RNA, 14 nt, Mycobacterium avium subsp. paratuberculosis
ccgacgcggcgcga

SEQ ID NO: 957506 - RNA, 19 nt, Mycobacterium avium subsp. paratuberculosis
ccgacgcggcgcgacaccg

SEQ ID NO: 957507 - RNA, 14 nt, Mycobacterium avium subsp. paratuberculosis
ccgacgcggcggcc

SEQ ID NO: 957508 - RNA, 17 nt, Mycobacterium avium subsp. paratuberculosis
ccgacgcggcggccgac

SEQ ID NO: 957509 - RNA, 20 nt, Mycobacterium avium subsp. paratuberculosis
ccgacgcggcggccgacagc

SEQ ID NO: 957510 - RNA, 18 nt, Mycobacterium avium subsp. paratuberculosis
ccgacgcgacggucgugc

SEQ ID NO: 957511 - RNA, 16 nt, Mycobacterium avium subsp. paratuberculosis
ccgacgcgcugcgcgc

SEQ ID NO: 957512 - RNA, 19 nt, Mycobacterium avium subsp. paratuberculosis
ccgacgcgcugcgcgccgc

SEQ ID NO: 957513 - RNA, 18 nt, Mycobacterium avium subsp. paratuberculosis
ccgacgcggucaccggcu

SEQ ID NO: 957514 - RNA, 21 nt, Mycobacterium avium subsp. paratuberculosis
ccgacgcggucaccggcucgg

SEQ ID NO: 957515 - RNA, 22 nt, Mycobacterium avium subsp. paratuberculosis
ccgacgcgguggcgugcucgau

SEQ ID NO: 957516 - RNA, 15 nt, Mycobacterium avium subsp. paratuberculosis
ccgacgcgucgcggc

SEQ ID NO: 957517 - RNA, 21 nt, Mycobacterium avium subsp. paratuberculosis
ccgacgcgucgcggcgggggu

SEQ ID NO: 957518 - RNA, 19 nt, Mycobacterium avium subsp. paratuberculosis
ccgacgcucgccaccccgc

SEQ ID NO: 957519 - RNA, 19 nt, Mycobacterium avium subsp. paratuberculosis
ccgacgcugacgaugcggc

SEQ ID NO: 957520 - RNA, 18 nt, Mycobacterium avium subsp. paratuberculosis
ccgacgcuucguggacga

SEQ ID NO: 957521 - RNA, 17 nt, Mycobacterium avium subsp. paratuberculosis
ccgacggagacgaccag

SEQ ID NO: 957522 - RNA, 15 nt, Mycobacterium avium subsp. paratuberculosis
ccgacggagccgagc

SEQ ID NO: 957523 - RNA, 12 nt, Mycobacterium avium subsp. paratuberculosis
ccgacggccagc

SEQ ID NO: 957524 - RNA, 14 nt, Mycobacterium avium subsp. paratuberculosis
ccgacggcagcacc

SEQ ID NO: 957525 - RNA, 15 nt, Mycobacterium avium subsp. paratuberculosis
ccgacggcagcaccg

SEQ ID NO: 957526 - RNA, 16 nt, Mycobacterium avium subsp. paratuberculosis
ccgacggcagcaccgc

SEQ ID NO: 957527 - RNA, 18 nt, Mycobacterium avium subsp. paratuberculosis
ccgacggcagcaccgccg

SEQ ID NO: 957528 - RNA, 20 nt, Mycobacterium avium subsp. paratuberculosis
ccgacguaggacagcaccac

SEQ ID NO: 957529 - RNA, 14 nt, Mycobacterium avium subsp. paratuberculosis
ccgacggucgccac

SEQ ID NO: 957530 - RNA, 16 nt, Mycobacterium avium subsp. paratuberculosis
ccgacggucgccacca

SEQ ID NO: 957531 - RNA, 21 nt, Mycobacterium avium subsp. paratuberculosis
ccgacggucgccaccaccacg

SEQ ID NO: 957532 - RNA, 22 nt, Mycobacterium avium subsp. paratuberculosis
ccgacggucgccaccaccacgg

SEQ ID NO: 957533 - RNA, 19 nt, Mycobacterium avium subsp. paratuberculosis
ccgacggugagcaccgccg

SEQ ID NO: 957534 - RNA, 20 nt, Mycobacterium avium subsp. paratuberculosis
ccgacggugagcaccgccgu

SEQ ID NO: 957535 - RNA, 11 nt, Mycobacterium avium subsp. paratuberculosis
ccgacggugcg

SEQ ID NO: 957536 - RNA, 16 nt, Mycobacterium avium subsp. paratuberculosis
ccgacggugcgugcca

SEQ ID NO: 957537 - RNA, 15 nt, Mycobacterium avium subsp. paratuberculosis
ccgacgguguccgcg

SEQ ID NO: 957538 - RNA, 18 nt, Mycobacterium avium subsp. paratuberculosis
ccgacggguucgcgcagc

SEQ ID NO: 957539 - RNA, 13 nt, Mycobacterium avium subsp. paratuberculosis
ccgacgggcccag

SEQ ID NO: 957540 - RNA, 16 nt, Mycobacterium avium subsp. paratuberculosis
ccgacgggcccagcgc

SEQ ID NO: 957541 - RNA, 17 nt, Mycobacterium avium subsp. paratuberculosis
ccgacgggcccagcgcg

SEQ ID NO: 957542 - RNA, 15 nt, Mycobacterium avium subsp. paratuberculosis
ccgacgggcccgcgc

SEQ ID NO: 957543 - RNA, 18 nt, Mycobacterium avium subsp. paratuberculosis
ccgacgggcgugccggcg

SEQ ID NO: 957544 - RNA, 19 nt, Mycobacterium avium subsp. paratuberculosis
ccgacgggcgugccggcgg

SEQ ID NO: 957545 - RNA, 20 nt, Mycobacterium avium subsp. paratuberculosis
ccgacgggcgugccggcggc

SEQ ID NO: 957546 - RNA, 14 nt, Mycobacterium avium subsp. paratuberculosis
ccgacggcugcccg

SEQ ID NO: 957547 - RNA, 14 nt, Mycobacterium avium subsp. paratuberculosis
ccgacggcugcggu

SEQ ID NO: 957548 - RNA, 16 nt, Mycobacterium avium subsp. paratuberculosis
ccgacggcugcgguug

SEQ ID NO: 957549 - RNA, 15 nt, Mycobacterium avium subsp. paratuberculosis
ccgacggcugggugg

SEQ ID NO: 957550 - RNA, 22 nt, Mycobacterium avium subsp. paratuberculosis
ccgacggcuggguggcgaaacc

SEQ ID NO: 957551 - RNA, 13 nt, Mycobacterium avium subsp. paratuberculosis
ccgacggcuucca

SEQ ID NO: 957552 - RNA, 21 nt, Mycobacterium avium subsp. paratuberculosis
ccgacgggauccggauugccg

SEQ ID NO: 957553 - RNA, 11 nt, Mycobacterium avium subsp. paratuberculosis
ccgacggcgcg

SEQ ID NO: 957554 - RNA, 13 nt, Mycobacterium avium subsp. paratuberculosis
ccgacggcgccgc

SEQ ID NO: 957555 - RNA, 14 nt, Mycobacterium avium subsp. paratuberculosis
ccgacggcgccggu

SEQ ID NO: 957556 - RNA, 13 nt, Mycobacterium avium subsp. paratuberculosis
ccgacggccgcac

SEQ ID NO: 957557 - RNA, 22 nt, Mycobacterium avium subsp. paratuberculosis
ccgacggccgcaccccacccgc

SEQ ID NO: 957558 - RNA, 13 nt, Mycobacterium avium subsp. paratuberculosis
ccgacggccgcgc

SEQ ID NO: 957559 - RNA, 18 nt, Mycobacterium avium subsp. paratuberculosis
ccgacggccgcgccguug

SEQ ID NO: 957560 - RNA, 15 nt, Mycobacterium avium subsp. paratuberculosis
ccgacggcgaccagu

SEQ ID NO: 957561 - RNA, 10 nt, Mycobacterium avium subsp. paratuberculosis
ccgacggcgc

SEQ ID NO: 957562 - RNA, 19 nt, Mycobacterium avium subsp. paratuberculosis
ccgagaacagaugccggug

SEQ ID NO: 957563 - RNA, 18 nt, Mycobacterium avium subsp. paratuberculosis
ccgagaagggccgccgcu

SEQ ID NO: 957564 - RNA, 19 nt, Mycobacterium avium subsp. paratuberculosis
ccgagaagggccgccgcug

SEQ ID NO: 957565 - RNA, 16 nt, Mycobacterium avium subsp. paratuberculosis
ccgagaccaugccgcc

SEQ ID NO: 957566 - RNA, 14 nt, Mycobacterium avium subsp. paratuberculosis
ccgagaguccgccg

SEQ ID NO: 957567 - RNA, 15 nt, Mycobacterium avium subsp. paratuberculosis
ccgagaguccgccgc

SEQ ID NO: 957568 - RNA, 18 nt, Mycobacterium avium subsp. paratuberculosis
ccgagagcgcgucgacgc

SEQ ID NO: 957569 - RNA, 12 nt, Mycobacterium avium subsp. paratuberculosis
ccgagacgucgg

SEQ ID NO: 957570 - RNA, 15 nt, Mycobacterium avium subsp. paratuberculosis
ccgagacguggucgg

SEQ ID NO: 957571 - RNA, 19 nt, Mycobacterium avium subsp. paratuberculosis
ccgagacgugguggugcgg

SEQ ID NO: 957572 - RNA, 15 nt, Mycobacterium avium subsp. paratuberculosis
ccgagauggacagca

SEQ ID NO: 957573 - RNA, 21 nt, Mycobacterium avium subsp. paratuberculosis
ccgagauggacagcaccuugc

SEQ ID NO: 957574 - RNA, 15 nt, Mycobacterium avium subsp. paratuberculosis
ccgagauggccacca

SEQ ID NO: 957575 - RNA, 21 nt, Mycobacterium avium subsp. paratuberculosis
ccgagauggugaagugccggu

SEQ ID NO: 957576 - RNA, 18 nt, Mycobacterium avium subsp. paratuberculosis
ccgagauguaguccuccg

SEQ ID NO: 957577 - RNA, 23 nt, Mycobacterium avium subsp. paratuberculosis
ccgagcaccaccaggcccaccac

SEQ ID NO: 957578 - RNA, 16 nt, Mycobacterium avium subsp. paratuberculosis
ccgagcaacagcccga

SEQ ID NO: 957579 - RNA, 14 nt, Mycobacterium avium subsp. paratuberculosis
ccgagaucaccggc

SEQ ID NO: 957580 - RNA, 16 nt, Mycobacterium avium subsp. paratuberculosis
ccgagaucaugccggc

SEQ ID NO: 957581 - RNA, 18 nt, Mycobacterium avium subsp. paratuberculosis
ccgagaucaugccggcga

SEQ ID NO: 957582 - RNA, 21 nt, Mycobacterium avium subsp. paratuberculosis
ccgagaucaugccggcgaacu

SEQ ID NO: 957583 - RNA, 15 nt, Mycobacterium avium subsp. paratuberculosis
ccgagauccaccgcg

SEQ ID NO: 957584 - RNA, 21 nt, Mycobacterium avium subsp. paratuberculosis
ccgagauccaccgcgcggcca

SEQ ID NO: 957585 - RNA, 19 nt, Mycobacterium avium subsp. paratuberculosis
ccgagaucccagcgggaca

SEQ ID NO: 957586 - RNA, 13 nt, Mycobacterium avium subsp. paratuberculosis
ccgagaucgaccc

SEQ ID NO: 957587 - RNA, 15 nt, Mycobacterium avium subsp. paratuberculosis
ccgagaucgacccgc

SEQ ID NO: 957588 - RNA, 22 nt, Mycobacterium avium subsp. paratuberculosis
ccgagaucgacgcugaccagcu

SEQ ID NO: 957589 - RNA, 14 nt, Mycobacterium avium subsp. paratuberculosis
ccgagaucgcgggc

SEQ ID NO: 957590 - RNA, 15 nt, Mycobacterium avium subsp. paratuberculosis
ccgagaucgcggugg

SEQ ID NO: 957591 - RNA, 18 nt, Mycobacterium avium subsp. paratuberculosis
ccgagaucgcgguggcgc

SEQ ID NO: 957592 - RNA, 22 nt, Mycobacterium avium subsp. paratuberculosis
ccgagaucgcgguggcgcccgc

SEQ ID NO: 957593 - RNA, 20 nt, Mycobacterium avium subsp. paratuberculosis
ccgagaugaagacccggccg

SEQ ID NO: 957594 - RNA, 22 nt, Mycobacterium avium subsp. paratuberculosis
ccgagaugaagacccggccgug

SEQ ID NO: 957595 - RNA, 20 nt, Mycobacterium avium subsp. paratuberculosis
ccgacgugucgucgucgccg

SEQ ID NO: 957596 - RNA, 21 nt, Mycobacterium avium subsp. paratuberculosis
ccgacgugucgucgucgccgc

SEQ ID NO: 957597 - RNA, 15 nt, Mycobacterium avium subsp. paratuberculosis
ccgacguugccgcug

SEQ ID NO: 957598 - RNA, 16 nt, Mycobacterium avium subsp. paratuberculosis
ccgacuagcgcggcgg

SEQ ID NO: 957599 - RNA, 17 nt, Mycobacterium avium subsp. paratuberculosis
ccgacuccccgcccggc

SEQ ID NO: 957600 - RNA, 19 nt, Mycobacterium avium subsp. paratuberculosis
ccgacuccucacaccucgc

SEQ ID NO: 957601 - RNA, 16 nt, Mycobacterium avium subsp. paratuberculosis
ccgacuccuccggccc

SEQ ID NO: 957602 - RNA, 19 nt, Mycobacterium avium subsp. paratuberculosis
ccgacgugcuuggccagcu

SEQ ID NO: 957603 - RNA, 20 nt, Mycobacterium avium subsp. paratuberculosis
ccgacgugcuuggccagcuc

SEQ ID NO: 957604 - RNA, 21 nt, Mycobacterium avium subsp. paratuberculosis
ccgacgugcuuggccagcucg

SEQ ID NO: 957605 - RNA, 22 nt, Mycobacterium avium subsp. paratuberculosis
ccgacgugcuuggccagcucgg

SEQ ID NO: 957606 - RNA, 20 nt, Mycobacterium avium subsp. paratuberculosis
ccgacgucugguuggccggc

SEQ ID NO: 957607 - RNA, 22 nt, Mycobacterium avium subsp. paratuberculosis
ccgacgucugguuggccggcgg

SEQ ID NO: 957608 - RNA, 22 nt, Mycobacterium avium subsp. paratuberculosis
ccgacgugcagcgccagcaccg

SEQ ID NO: 957609 - RNA, 15 nt, Mycobacterium avium subsp. paratuberculosis
ccgacgugcccgauc

SEQ ID NO: 957610 - RNA, 15 nt, Mycobacterium avium subsp. paratuberculosis
ccgacgugccggugg

SEQ ID NO: 957611 - RNA, 22 nt, Mycobacterium avium subsp. paratuberculosis
ccgacgugccgguggacgaggu

SEQ ID NO: 957612 - RNA, 12 nt, Mycobacterium avium subsp. paratuberculosis
ccgacgugccgu

SEQ ID NO: 957613 - RNA, 19 nt, Mycobacterium avium subsp. paratuberculosis
ccgacgucaggguggccuc

SEQ ID NO: 957614 - RNA, 13 nt, Mycobacterium avium subsp. paratuberculosis
ccgacgucccagc

SEQ ID NO: 957615 - RNA, 14 nt, Mycobacterium avium subsp. paratuberculosis
ccgacgucccagca

SEQ ID NO: 957616 - RNA, 21 nt, Mycobacterium avium subsp. paratuberculosis
ccgacgucccagcacaacgcc

SEQ ID NO: 957617 - RNA, 22 nt, Mycobacterium avium subsp. paratuberculosis
ccgacguccuggaucgcgcagg

SEQ ID NO: 957618 - RNA, 13 nt, Mycobacterium avium subsp. paratuberculosis
ccgacgucgacgc

SEQ ID NO: 957619 - RNA, 15 nt, Mycobacterium avium subsp. paratuberculosis
ccgacgucgacgcgg

SEQ ID NO: 957620 - RNA, 19 nt, Mycobacterium avium subsp. paratuberculosis
ccgacgucgacgcgggcga

SEQ ID NO: 957621 - RNA, 20 nt, Mycobacterium avium subsp. paratuberculosis
ccgacgucgacgcgggcgac

SEQ ID NO: 957622 - RNA, 14 nt, Mycobacterium avium subsp. paratuberculosis
ccgacgucggaaac

SEQ ID NO: 957623 - RNA, 18 nt, Mycobacterium avium subsp. paratuberculosis
ccgacuuggucagcccgc

SEQ ID NO: 957624 - RNA, 20 nt, Mycobacterium avium subsp. paratuberculosis
ccgacuuggucagcccgcgc

SEQ ID NO: 957625 - RNA, 16 nt, Mycobacterium avium subsp. paratuberculosis
ccgacuuggugccaug

SEQ ID NO: 957626 - RNA, 22 nt, Mycobacterium avium subsp. paratuberculosis
ccgacugugaauuccgacgugc

SEQ ID NO: 957627 - RNA, 16 nt, Mycobacterium avium subsp. paratuberculosis
ccgacuuacggcguga

SEQ ID NO: 957628 - RNA, 22 nt, Mycobacterium avium subsp. paratuberculosis
ccgacuuacggcgugaccggcu

SEQ ID NO: 957629 - RNA, 14 nt, Mycobacterium avium subsp. paratuberculosis
ccgacuucgcgugc

SEQ ID NO: 957630 - RNA, 15 nt, Mycobacterium avium subsp. paratuberculosis
ccgacuucggcucgg

SEQ ID NO: 957631 - RNA, 20 nt, Mycobacterium avium subsp. paratuberculosis
ccgacuucggcucggcgaca

SEQ ID NO: 957632 - RNA, 16 nt, Mycobacterium avium subsp. paratuberculosis
ccgacuugaucgcggc

SEQ ID NO: 957633 - RNA, 18 nt, Mycobacterium avium subsp. paratuberculosis
ccgacuugaucgcggcgu

SEQ ID NO: 957634 - RNA, 12 nt, Mycobacterium avium subsp. paratuberculosis
ccgacugcggcg

SEQ ID NO: 957635 - RNA, 18 nt, Mycobacterium avium subsp. paratuberculosis
ccgacucgaugcgcguga

SEQ ID NO: 957636 - RNA, 22 nt, Mycobacterium avium subsp. paratuberculosis
ccgacucgauguagccgggcuc

SEQ ID NO: 957637 - RNA, 20 nt, Mycobacterium avium subsp. paratuberculosis
cccaguuguuuccccagccc

SEQ ID NO: 957638 - RNA, 20 nt, Mycobacterium avium subsp. paratuberculosis
cccaguuucccgucggggug

SEQ ID NO: 957639 - RNA, 22 nt, Mycobacterium avium subsp. paratuberculosis
cccaguuggcgucgucggcggc

SEQ ID NO: 957640 - RNA, 23 nt, Mycobacterium avium subsp. paratuberculosis
cccaguuggcgucgucggcggcg

SEQ ID NO: 957641 - RNA, 15 nt, Mycobacterium avium subsp. paratuberculosis
cccaguugcacggug

SEQ ID NO: 957642 - RNA, 20 nt, Mycobacterium avium subsp. paratuberculosis
cccaucaccagcggcugcag

SEQ ID NO: 957643 - RNA, 12 nt, Mycobacterium avium subsp. paratuberculosis
cccaucagcacg

SEQ ID NO: 957644 - RNA, 17 nt, Mycobacterium avium subsp. paratuberculosis
cccaucagugcggcccg

SEQ ID NO: 957645 - RNA, 20 nt, Mycobacterium avium subsp. paratuberculosis
cccaucagugcggcccgccg

SEQ ID NO: 957646 - RNA, 15 nt, Mycobacterium avium subsp. paratuberculosis
cccaucaccgcaccg

SEQ ID NO: 957647 - RNA, 15 nt, Mycobacterium avium subsp. paratuberculosis
cccaucaccggaccg

SEQ ID NO: 957648 - RNA, 17 nt, Mycobacterium avium subsp. paratuberculosis
cccaucaccggaccggc

SEQ ID NO: 957649 - RNA, 20 nt, Mycobacterium avium subsp. paratuberculosis
cccaucaccggaccggccag

SEQ ID NO: 957650 - RNA, 22 nt, Mycobacterium avium subsp. paratuberculosis
cccaguccagccguucgcgcac

SEQ ID NO: 957651 - RNA, 14 nt, Mycobacterium avium subsp. paratuberculosis
cccaguccggccag

SEQ ID NO: 957652 - RNA, 23 nt, Mycobacterium avium subsp. paratuberculosis
cccaguccugcagcucgccggcg

SEQ ID NO: 957653 - RNA, 15 nt, Mycobacterium avium subsp. paratuberculosis
cccagucccagcaca

SEQ ID NO: 957654 - RNA, 16 nt, Mycobacterium avium subsp. paratuberculosis
cccagucccagcacag

SEQ ID NO: 957655 - RNA, 19 nt, Mycobacterium avium subsp. paratuberculosis
cccagucccagcacagccg

SEQ ID NO: 957656 - RNA, 18 nt, Mycobacterium avium subsp. paratuberculosis
cccaguccagucgcgccg

SEQ ID NO: 957657 - RNA, 21 nt, Mycobacterium avium subsp. paratuberculosis
cccagugcaggcugacgcgac

SEQ ID NO: 957658 - RNA, 16 nt, Mycobacterium avium subsp. paratuberculosis
cccagugccaguacca

SEQ ID NO: 957659 - RNA, 20 nt, Mycobacterium avium subsp. paratuberculosis
cccaguggaucggcccgacg

SEQ ID NO: 957660 - RNA, 15 nt, Mycobacterium avium subsp. paratuberculosis
cccaguucccggcgg

SEQ ID NO: 957661 - RNA, 20 nt, Mycobacterium avium subsp. paratuberculosis
cccaucugcacagcuucggc

SEQ ID NO: 957662 - RNA, 20 nt, Mycobacterium avium subsp. paratuberculosis
cccaucgcggccgcccgguc

SEQ ID NO: 957663 - RNA, 20 nt, Mycobacterium avium subsp. paratuberculosis
cccaucggcagcccggaggc

SEQ ID NO: 957664 - RNA, 19 nt, Mycobacterium avium subsp. paratuberculosis
cccaugaacgcgucgccgu

SEQ ID NO: 957665 - RNA, 14 nt, Mycobacterium avium subsp. paratuberculosis
cccaugaucgccag

SEQ ID NO: 957666 - RNA, 22 nt, Mycobacterium avium subsp. paratuberculosis
cccaugaucgccaguccggcgc

SEQ ID NO: 957667 - RNA, 23 nt, Mycobacterium avium subsp. paratuberculosis
cccaugaucgccaguccggcgcc

SEQ ID NO: 957668 - RNA, 20 nt, Mycobacterium avium subsp. paratuberculosis
cccaucgaccggaugaugcc

SEQ ID NO: 957669 - RNA, 19 nt, Mycobacterium avium subsp. paratuberculosis
cccauccaggccagcaccu

SEQ ID NO: 957670 - RNA, 13 nt, Mycobacterium avium subsp. paratuberculosis
cccauccggcgcc

SEQ ID NO: 957671 - RNA, 17 nt, Mycobacterium avium subsp. paratuberculosis
cccauccggcgccgcgc

SEQ ID NO: 957672 - RNA, 16 nt, Mycobacterium avium subsp. paratuberculosis
cccauucgucggcggu

SEQ ID NO: 957673 - RNA, 23 nt, Mycobacterium avium subsp. paratuberculosis
cccauucgugguugccccagcug

SEQ ID NO: 957674 - RNA, 21 nt, Mycobacterium avium subsp. paratuberculosis
cccauguccagguacgcgacg

SEQ ID NO: 957675 - RNA, 14 nt, Mycobacterium avium subsp. paratuberculosis
cccauuucggcgaa

SEQ ID NO: 957676 - RNA, 13 nt, Mycobacterium avium subsp. paratuberculosis
cccaugucgaucg

SEQ ID NO: 957677 - RNA, 22 nt, Mycobacterium avium subsp. paratuberculosis
cccaugucgaucggcucggcgc

SEQ ID NO: 957678 - RNA, 15 nt, Mycobacterium avium subsp. paratuberculosis
cccauggcgaacagg

SEQ ID NO: 957679 - RNA, 16 nt, Mycobacterium avium subsp. paratuberculosis
cccagcacgacgccgc

SEQ ID NO: 957680 - RNA, 16 nt, Mycobacterium avium subsp. paratuberculosis
cccagcacgaucccgc

SEQ ID NO: 957681 - RNA, 18 nt, Mycobacterium avium subsp. paratuberculosis
cccagcacgaucccgccg

SEQ ID NO: 957682 - RNA, 22 nt, Mycobacterium avium subsp. paratuberculosis
cccagcacgaugacgaccgggu

SEQ ID NO: 957683 - RNA, 15 nt, Mycobacterium avium subsp. paratuberculosis
cccagauacgccgcg

SEQ ID NO: 957684 - RNA, 19 nt, Mycobacterium avium subsp. paratuberculosis
cccagauacgccgcgacga

SEQ ID NO: 957685 - RNA, 20 nt, Mycobacterium avium subsp. paratuberculosis
cccagacgcgggcgcccagc

SEQ ID NO: 957686 - RNA, 22 nt, Mycobacterium avium subsp. paratuberculosis
cccagacgaugucgucgccggu

SEQ ID NO: 957687 - RNA, 23 nt, Mycobacterium avium subsp. paratuberculosis
cccagacgaugucgucgccggug

SEQ ID NO: 957688 - RNA, 14 nt, Mycobacterium avium subsp. paratuberculosis
cccagacgucgacc

SEQ ID NO: 957689 - RNA, 19 nt, Mycobacterium avium subsp. paratuberculosis
cccagacuugggcagcagg

SEQ ID NO: 957690 - RNA, 18 nt, Mycobacterium avium subsp. paratuberculosis
cccagcagcggccggcgc

SEQ ID NO: 957691 - RNA, 23 nt, Mycobacterium avium subsp. paratuberculosis
cccagcagcggccggcgcagccg

SEQ ID NO: 957692 - RNA, 14 nt, Mycobacterium avium subsp. paratuberculosis
cccagcagcgucac

SEQ ID NO: 957693 - RNA, 22 nt, Mycobacterium avium subsp. paratuberculosis
cccagcagcgucacgucgacgg

SEQ ID NO: 957694 - RNA, 23 nt, Mycobacterium avium subsp. paratuberculosis
cccagcagcgucacgucgacggc

SEQ ID NO: 957695 - RNA, 18 nt, Mycobacterium avium subsp. paratuberculosis
cccagcagcccggccagc

SEQ ID NO: 957696 - RNA, 19 nt, Mycobacterium avium subsp. paratuberculosis
cccagcagccgcgccgacg

SEQ ID NO: 957697 - RNA, 14 nt, Mycobacterium avium subsp. paratuberculosis
cccagcacggugau

SEQ ID NO: 957698 - RNA, 13 nt, Mycobacterium avium subsp. paratuberculosis
cccagcagcaccg

SEQ ID NO: 957699 - RNA, 16 nt, Mycobacterium avium subsp. paratuberculosis
cccagcagcaccgcga

SEQ ID NO: 957700 - RNA, 15 nt, Mycobacterium avium subsp. paratuberculosis
cccagcagggcggcg

SEQ ID NO: 957701 - RNA, 15 nt, Mycobacterium avium subsp. paratuberculosis
cccagcaucgccgcg

SEQ ID NO: 957702 - RNA, 13 nt, Mycobacterium avium subsp. paratuberculosis
cccagcgcggcga

SEQ ID NO: 957703 - RNA, 14 nt, Mycobacterium avium subsp. paratuberculosis
cccagcgcggcggc

SEQ ID NO: 957704 - RNA, 16 nt, Mycobacterium avium subsp. paratuberculosis
cccagcgcggcggcca

SEQ ID NO: 957705 - RNA, 15 nt, Mycobacterium avium subsp. paratuberculosis
cccagcauaggugcg

SEQ ID NO: 957706 - RNA, 14 nt, Mycobacterium avium subsp. paratuberculosis
cccagcgcgggggg

SEQ ID NO: 957707 - RNA, 12 nt, Mycobacterium avium subsp. paratuberculosis
cccagcgcggua

SEQ ID NO: 957708 - RNA, 22 nt, Mycobacterium avium subsp. paratuberculosis
cccagcgcgguguacagcgcgc

SEQ ID NO: 957709 - RNA, 16 nt, Mycobacterium avium subsp. paratuberculosis
cccagcgcgcgaucgc

SEQ ID NO: 957710 - RNA, 18 nt, Mycobacterium avium subsp. paratuberculosis
cccagcggaaccgggggc

SEQ ID NO: 957711 - RNA, 19 nt, Mycobacterium avium subsp. paratuberculosis
cccagcggcacgggcaccg

SEQ ID NO: 957712 - RNA, 14 nt, Mycobacterium avium subsp. paratuberculosis
cccagcggcgcggc

SEQ ID NO: 957713 - RNA, 12 nt, Mycobacterium avium subsp. paratuberculosis
cccagcggcccc

SEQ ID NO: 957714 - RNA, 14 nt, Mycobacterium avium subsp. paratuberculosis
cccagcggccccgg

SEQ ID NO: 957715 - RNA, 17 nt, Mycobacterium avium subsp. paratuberculosis
cccagcggccccggcuc

SEQ ID NO: 957716 - RNA, 13 nt, Mycobacterium avium subsp. paratuberculosis
cccagcggccgag

SEQ ID NO: 957717 - RNA, 23 nt, Mycobacterium avium subsp. paratuberculosis
cccagcgucucggcggccgagcg

SEQ ID NO: 957718 - RNA, 21 nt, Mycobacterium avium subsp. paratuberculosis
cccagcggggcaagcagcggc

SEQ ID NO: 957719 - RNA, 20 nt, Mycobacterium avium subsp. paratuberculosis
cccagcggcuugagccggau

SEQ ID NO: 957720 - RNA, 18 nt, Mycobacterium avium subsp. paratuberculosis
cccagcgggacagcacca

SEQ ID NO: 957721 - RNA, 19 nt, Mycobacterium avium subsp. paratuberculosis
cccagcgggacagcaccac

SEQ ID NO: 957722 - RNA, 23 nt, Mycobacterium avium subsp. paratuberculosis
cccagcgggcgacgucggggucg

SEQ ID NO: 957723 - RNA, 20 nt, Mycobacterium avium subsp. paratuberculosis
cccagcuccacgcguagccg

SEQ ID NO: 957724 - RNA, 19 nt, Mycobacterium avium subsp. paratuberculosis
cccagcguggucacccgca

SEQ ID NO: 957725 - RNA, 17 nt, Mycobacterium avium subsp. paratuberculosis
cccagcgugucggcgau

SEQ ID NO: 957726 - RNA, 17 nt, Mycobacterium avium subsp. paratuberculosis
cccagcuccucggccag

SEQ ID NO: 957727 - RNA, 19 nt, Mycobacterium avium subsp. paratuberculosis
cccagcuccucggccagca

SEQ ID NO: 957728 - RNA, 22 nt, Mycobacterium avium subsp. paratuberculosis
cccagcuccucggccagcacca

SEQ ID NO: 957729 - RNA, 22 nt, Mycobacterium avium subsp. paratuberculosis
cccagcucgacgacuucggccu

SEQ ID NO: 957730 - RNA, 20 nt, Mycobacterium avium subsp. paratuberculosis
cccagcucguugccggcggc

SEQ ID NO: 957731 - RNA, 22 nt, Mycobacterium avium subsp. paratuberculosis
cccagcucguugccggcggcca

SEQ ID NO: 957732 - RNA, 19 nt, Mycobacterium avium subsp. paratuberculosis
cccagcugcacccaccggc

SEQ ID NO: 957733 - RNA, 24 nt, Mycobacterium avium subsp. paratuberculosis
cccagcugcacccaccggcccagc

SEQ ID NO: 957734 - RNA, 16 nt, Mycobacterium avium subsp. paratuberculosis
cccagcugcgcggagc

SEQ ID NO: 957735 - RNA, 21 nt, Mycobacterium avium subsp. paratuberculosis
cccagcuuggcgcccuugccg

SEQ ID NO: 957736 - RNA, 18 nt, Mycobacterium avium subsp. paratuberculosis
cccagcugggccgccagc

SEQ ID NO: 957737 - RNA, 19 nt, Mycobacterium avium subsp. paratuberculosis
cccagcuugaccacccggu

SEQ ID NO: 957738 - RNA, 23 nt, Mycobacterium avium subsp. paratuberculosis
cccaggcgucgucgucgagccgc

SEQ ID NO: 957739 - RNA, 18 nt, Mycobacterium avium subsp. paratuberculosis
cccaggcguggucggcgc

SEQ ID NO: 957740 - RNA, 19 nt, Mycobacterium avium subsp. paratuberculosis
cccaggcguggucggcgcg

SEQ ID NO: 957741 - RNA, 20 nt, Mycobacterium avium subsp. paratuberculosis
cccaggcguggucggcgcgg

SEQ ID NO: 957742 - RNA, 13 nt, Mycobacterium avium subsp. paratuberculosis
cccaggcucagga

SEQ ID NO: 957743 - RNA, 21 nt, Mycobacterium avium subsp. paratuberculosis
cccaggcucaggaucagcagc

SEQ ID NO: 957744 - RNA, 23 nt, Mycobacterium avium subsp. paratuberculosis
cccaggcucaggaucagcagccg

SEQ ID NO: 957745 - RNA, 15 nt, Mycobacterium avium subsp. paratuberculosis
cccagggcaacgaac

SEQ ID NO: 957746 - RNA, 18 nt, Mycobacterium avium subsp. paratuberculosis
cccaggggagcggcggag

SEQ ID NO: 957747 - RNA, 20 nt, Mycobacterium avium subsp. paratuberculosis
cccagggcgugcgcggccgc

SEQ ID NO: 957748 - RNA, 16 nt, Mycobacterium avium subsp. paratuberculosis
cccaggguugccgcac

SEQ ID NO: 957749 - RNA, 17 nt, Mycobacterium avium subsp. paratuberculosis
cccagguacuccucggu

SEQ ID NO: 957750 - RNA, 19 nt, Mycobacterium avium subsp. paratuberculosis
cccagguucuccggcccgc

SEQ ID NO: 957751 - RNA, 18 nt, Mycobacterium avium subsp. paratuberculosis
cccaggugggcgcgcagc

SEQ ID NO: 957752 - RNA, 17 nt, Mycobacterium avium subsp. paratuberculosis
cccagguguccggcccg

SEQ ID NO: 957753 - RNA, 18 nt, Mycobacterium avium subsp. paratuberculosis
cccagguguccggcccga

SEQ ID NO: 957754 - RNA, 19 nt, Mycobacterium avium subsp. paratuberculosis
cccagguggaugcgagcca

SEQ ID NO: 957755 - RNA, 20 nt, Mycobacterium avium subsp. paratuberculosis
cccaggucaugguggcggcg

SEQ ID NO: 957756 - RNA, 21 nt, Mycobacterium avium subsp. paratuberculosis
cccaggucuucucguccgcgc

SEQ ID NO: 957757 - RNA, 14 nt, Mycobacterium avium subsp. paratuberculosis
cccaggucggcgug

SEQ ID NO: 957758 - RNA, 15 nt, Mycobacterium avium subsp. paratuberculosis
cccaggucggcguga

SEQ ID NO: 957759 - RNA, 17 nt, Mycobacterium avium subsp. paratuberculosis
cccaggucgggacgucc

SEQ ID NO: 957760 - RNA, 23 nt, Mycobacterium avium subsp. paratuberculosis
cccaggucgggacguccgcgcga

SEQ ID NO: 957761 - RNA, 18 nt, Mycobacterium avium subsp. paratuberculosis
ccauucgggccagcgccg

SEQ ID NO: 957762 - RNA, 19 nt, Mycobacterium avium subsp. paratuberculosis
ccauugggccgcggcgucg

SEQ ID NO: 957763 - RNA, 20 nt, Mycobacterium avium subsp. paratuberculosis
ccauugggccgcggcgucgg

SEQ ID NO: 957764 - RNA, 14 nt, Mycobacterium avium subsp. paratuberculosis
ccauugcaccgcaa

SEQ ID NO: 957765 - RNA, 19 nt, Mycobacterium avium subsp. paratuberculosis
ccaugcucuugcgggcggc

SEQ ID NO: 957766 - RNA, 17 nt, Mycobacterium avium subsp. paratuberculosis
ccaguagaaguggccga

SEQ ID NO: 957767 - RNA, 19 nt, Mycobacterium avium subsp. paratuberculosis
ccaguagaaguggccgacc

SEQ ID NO: 957768 - RNA, 13 nt, Mycobacterium avium subsp. paratuberculosis
ccaguagccgccg

SEQ ID NO: 957769 - RNA, 14 nt, Mycobacterium avium subsp. paratuberculosis
ccaguccggcagca

SEQ ID NO: 957770 - RNA, 15 nt, Mycobacterium avium subsp. paratuberculosis
ccaguccggcagcag

SEQ ID NO: 957771 - RNA, 23 nt, Mycobacterium avium subsp. paratuberculosis
ccaguccggccgugaugcgccgg

SEQ ID NO: 957772 - RNA, 13 nt, Mycobacterium avium subsp. paratuberculosis
ccaguccggcgcc

SEQ ID NO: 957773 - RNA, 15 nt, Mycobacterium avium subsp. paratuberculosis
ccaguccggcgccga

SEQ ID NO: 957774 - RNA, 16 nt, Mycobacterium avium subsp. paratuberculosis
ccaguccggcgccgac

SEQ ID NO: 957775 - RNA, 22 nt, Mycobacterium avium subsp. paratuberculosis
ccaguccggcgccgacccccgc

SEQ ID NO: 957776 - RNA, 17 nt, Mycobacterium avium subsp. paratuberculosis
ccaguccugcagcucgc

SEQ ID NO: 957777 - RNA, 15 nt, Mycobacterium avium subsp. paratuberculosis
ccaguccugggccag

SEQ ID NO: 957778 - RNA, 17 nt, Mycobacterium avium subsp. paratuberculosis
ccaguccugggccgggg

SEQ ID NO: 957779 - RNA, 13 nt, Mycobacterium avium subsp. paratuberculosis
ccagucgaagacc

SEQ ID NO: 957780 - RNA, 20 nt, Mycobacterium avium subsp. paratuberculosis
ccagucgaaguucggcaucu

SEQ ID NO: 957781 - RNA, 13 nt, Mycobacterium avium subsp. paratuberculosis
ccagucgccggcc

SEQ ID NO: 957782 - RNA, 19 nt, Mycobacterium avium subsp. paratuberculosis
ccagucgccggccaggccg

SEQ ID NO: 957783 - RNA, 19 nt, Mycobacterium avium subsp. paratuberculosis
ccagucgaugucgguggcg

SEQ ID NO: 957784 - RNA, 20 nt, Mycobacterium avium subsp. paratuberculosis
ccagucgaugucgguggcgc

SEQ ID NO: 957785 - RNA, 22 nt, Mycobacterium avium subsp. paratuberculosis
ccagucgaugucgguggcgcgc

SEQ ID NO: 957786 - RNA, 24 nt, Mycobacterium avium subsp. paratuberculosis
ccagucgaugucgguggcgcgcag

SEQ ID NO: 957787 - RNA, 15 nt, Mycobacterium avium subsp. paratuberculosis
ccagucgccgccgcg

SEQ ID NO: 957788 - RNA, 15 nt, Mycobacterium avium subsp. paratuberculosis
ccagucgccgcgcag

SEQ ID NO: 957789 - RNA, 16 nt, Mycobacterium avium subsp. paratuberculosis
ccagucgccgcgcaga

SEQ ID NO: 957790 - RNA, 15 nt, Mycobacterium avium subsp. paratuberculosis
cccaaaaacaucguc

SEQ ID NO: 957791 - RNA, 14 nt, Mycobacterium avium subsp. paratuberculosis
cccaaccccgggcg

SEQ ID NO: 957792 - RNA, 16 nt, Mycobacterium avium subsp. paratuberculosis
cccaaccccgggcggc

SEQ ID NO: 957793 - RNA, 14 nt, Mycobacterium avium subsp. paratuberculosis
ccauugucggaucg

SEQ ID NO: 957794 - RNA, 21 nt, Mycobacterium avium subsp. paratuberculosis
ccauuuccguugugccaccgc

SEQ ID NO: 957795 - RNA, 14 nt, Mycobacterium avium subsp. paratuberculosis
ccauuucggcgaaa

SEQ ID NO: 957796 - RNA, 14 nt, Mycobacterium avium subsp. paratuberculosis
cccaacgucgacuu

SEQ ID NO: 957797 - RNA, 16 nt, Mycobacterium avium subsp. paratuberculosis
cccaacgugaugagcg

SEQ ID NO: 957798 - RNA, 19 nt, Mycobacterium avium subsp. paratuberculosis
cccaacuacccgccgacgc

SEQ ID NO: 957799 - RNA, 22 nt, Mycobacterium avium subsp. paratuberculosis
cccaacucaugggcccggcccg

SEQ ID NO: 957800 - RNA, 23 nt, Mycobacterium avium subsp. paratuberculosis
cccaacucaugggcccggcccgu

SEQ ID NO: 957801 - RNA, 15 nt, Mycobacterium avium subsp. paratuberculosis
cccaaccgcauucgg

SEQ ID NO: 957802 - RNA, 13 nt, Mycobacterium avium subsp. paratuberculosis
cccaacgacgucg

SEQ ID NO: 957803 - RNA, 13 nt, Mycobacterium avium subsp. paratuberculosis
cccaccaccgaca

SEQ ID NO: 957804 - RNA, 19 nt, Mycobacterium avium subsp. paratuberculosis
cccaccaccgacagcaccc

SEQ ID NO: 957805 - RNA, 13 nt, Mycobacterium avium subsp. paratuberculosis
cccaccaccgcca

SEQ ID NO: 957806 - RNA, 11 nt, Mycobacterium avium subsp. paratuberculosis
cccaccagcau

SEQ ID NO: 957807 - RNA, 14 nt, Mycobacterium avium subsp. paratuberculosis
cccaccagcaucuc

SEQ ID NO: 957808 - RNA, 12 nt, Mycobacterium avium subsp. paratuberculosis
cccaccagccga

SEQ ID NO: 957809 - RNA, 23 nt, Mycobacterium avium subsp. paratuberculosis
cccaccagccgagaucgacccgc

SEQ ID NO: 957810 - RNA, 17 nt, Mycobacterium avium subsp. paratuberculosis
cccaccagccggccggc

SEQ ID NO: 957811 - RNA, 13 nt, Mycobacterium avium subsp. paratuberculosis
cccacccgcacgc

SEQ ID NO: 957812 - RNA, 13 nt, Mycobacterium avium subsp. paratuberculosis
cccacccgccagc

SEQ ID NO: 957813 - RNA, 22 nt, Mycobacterium avium subsp. paratuberculosis
cccacccgccagcccgcgucgu

SEQ ID NO: 957814 - RNA, 18 nt, Mycobacterium avium subsp. paratuberculosis
cccaccaucccgccgccg

SEQ ID NO: 957815 - RNA, 18 nt, Mycobacterium avium subsp. paratuberculosis
cccaccaugagcagaccg

SEQ ID NO: 957816 - RNA, 22 nt, Mycobacterium avium subsp. paratuberculosis
cccacccagguguccggcccga

SEQ ID NO: 957817 - RNA, 13 nt, Mycobacterium avium subsp. paratuberculosis
cccaccaggcgcg

SEQ ID NO: 957818 - RNA, 13 nt, Mycobacterium avium subsp. paratuberculosis
cccaccgcggcgc

SEQ ID NO: 957819 - RNA, 14 nt, Mycobacterium avium subsp. paratuberculosis
cccaccgacgcggc

SEQ ID NO: 957820 - RNA, 13 nt, Mycobacterium avium subsp. paratuberculosis
cccaccggcccgg

SEQ ID NO: 957821 - RNA, 14 nt, Mycobacterium avium subsp. paratuberculosis
cccaccggcgaugu

SEQ ID NO: 957822 - RNA, 16 nt, Mycobacterium avium subsp. paratuberculosis
cccaccggcgaugugg

SEQ ID NO: 957823 - RNA, 21 nt, Mycobacterium avium subsp. paratuberculosis
cccaccggcgcagcgcgucgc

SEQ ID NO: 957824 - RNA, 20 nt, Mycobacterium avium subsp. paratuberculosis
cccaccgcgacacgucgaca

SEQ ID NO: 957825 - RNA, 12 nt, Mycobacterium avium subsp. paratuberculosis
cccaccgcgacc

SEQ ID NO: 957826 - RNA, 16 nt, Mycobacterium avium subsp. paratuberculosis
cccaccgcgacccggc

SEQ ID NO: 957827 - RNA, 15 nt, Mycobacterium avium subsp. paratuberculosis
cccaccgacagccgg

SEQ ID NO: 957828 - RNA, 14 nt, Mycobacterium avium subsp. paratuberculosis
cccacccgcucggc

SEQ ID NO: 957829 - RNA, 17 nt, Mycobacterium avium subsp. paratuberculosis
cccacccgcucggcgau

SEQ ID NO: 957830 - RNA, 15 nt, Mycobacterium avium subsp. paratuberculosis
cccaccccgagcagg

SEQ ID NO: 957831 - RNA, 12 nt, Mycobacterium avium subsp. paratuberculosis
cccacgcucggc

SEQ ID NO: 957832 - RNA, 18 nt, Mycobacterium avium subsp. paratuberculosis
cccacgcgcucagcgcgg

SEQ ID NO: 957833 - RNA, 19 nt, Mycobacterium avium subsp. paratuberculosis
cccacgcgcucagcgcggc

SEQ ID NO: 957834 - RNA, 12 nt, Mycobacterium avium subsp. paratuberculosis
cccaccgggauc

SEQ ID NO: 957835 - RNA, 12 nt, Mycobacterium avium subsp. paratuberculosis
cccaccgggcag

SEQ ID NO: 957836 - RNA, 15 nt, Mycobacterium avium subsp. paratuberculosis
cccacgccgucgacc

SEQ ID NO: 957837 - RNA, 22 nt, Mycobacterium avium subsp. paratuberculosis
cccacgccuugcgguuggccgg

SEQ ID NO: 957838 - RNA, 17 nt, Mycobacterium avium subsp. paratuberculosis
cccacgggucgccgauc

SEQ ID NO: 957839 - RNA, 14 nt, Mycobacterium avium subsp. paratuberculosis
cccacggcgcgugc

SEQ ID NO: 957840 - RNA, 23 nt, Mycobacterium avium subsp. paratuberculosis
cccacguggugaucagcauccgc

SEQ ID NO: 957841 - RNA, 16 nt, Mycobacterium avium subsp. paratuberculosis
cccacguugaucaugu

SEQ ID NO: 957842 - RNA, 21 nt, Mycobacterium avium subsp. paratuberculosis
cccacguugaucaugucgaug

SEQ ID NO: 957843 - RNA, 22 nt, Mycobacterium avium subsp. paratuberculosis
cccacggucuuugccggccaug

SEQ ID NO: 957844 - RNA, 23 nt, Mycobacterium avium subsp. paratuberculosis
cccacggugaggacaccacgauc

SEQ ID NO: 957845 - RNA, 23 nt, Mycobacterium avium subsp. paratuberculosis
cccacggugauuccggcacccgc

SEQ ID NO: 957846 - RNA, 14 nt, Mycobacterium avium subsp. paratuberculosis
cccacguaggcgau

SEQ ID NO: 957847 - RNA, 19 nt, Mycobacterium avium subsp. paratuberculosis
cccacguaggcgaugucga

SEQ ID NO: 957848 - RNA, 21 nt, Mycobacterium avium subsp. paratuberculosis
cccacguaggcgaugucgacg

SEQ ID NO: 957849 - RNA, 22 nt, Mycobacterium avium subsp. paratuberculosis
cccacguaggcgaugucgacgu

SEQ ID NO: 957850 - RNA, 21 nt, Mycobacterium avium subsp. paratuberculosis
cccacguaggggcccggguug

SEQ ID NO: 957851 - RNA, 20 nt, Mycobacterium avium subsp. paratuberculosis
cccagaacugcugccgucca

SEQ ID NO: 957852 - RNA, 14 nt, Mycobacterium avium subsp. paratuberculosis
cccagacccagcau

SEQ ID NO: 957853 - RNA, 14 nt, Mycobacterium avium subsp. paratuberculosis
cccagacaggccgg

SEQ ID NO: 957854 - RNA, 15 nt, Mycobacterium avium subsp. paratuberculosis
cccagacaggccggc

SEQ ID NO: 957855 - RNA, 17 nt, Mycobacterium avium subsp. paratuberculosis
cccagacaggccggccg

SEQ ID NO: 957856 - RNA, 12 nt, Mycobacterium avium subsp. paratuberculosis
cccauugccgcg

SEQ ID NO: 957857 - RNA, 21 nt, Mycobacterium avium subsp. paratuberculosis
ccccaauugccgggccagaua

SEQ ID NO: 957858 - RNA, 14 nt, Mycobacterium avium subsp. paratuberculosis
ccccagccggccga

SEQ ID NO: 957859 - RNA, 22 nt, Mycobacterium avium subsp. paratuberculosis
ccccagcgagcaggucaccgga

SEQ ID NO: 957860 - RNA, 22 nt, Mycobacterium avium subsp. paratuberculosis
ccccagccccucgccgggcguc

SEQ ID NO: 957861 - RNA, 11 nt, Mycobacterium avium subsp. paratuberculosis
ccccagcccgg

SEQ ID NO: 957862 - RNA, 13 nt, Mycobacterium avium subsp. paratuberculosis
ccccagcccggau

SEQ ID NO: 957863 - RNA, 15 nt, Mycobacterium avium subsp. paratuberculosis
ccccagcccggcugg

SEQ ID NO: 957864 - RNA, 14 nt, Mycobacterium avium subsp. paratuberculosis
ccccagccgccgcg

SEQ ID NO: 957865 - RNA, 15 nt, Mycobacterium avium subsp. paratuberculosis
ccccagccgccgcga

SEQ ID NO: 957866 - RNA, 17 nt, Mycobacterium avium subsp. paratuberculosis
ccccagccgccgcgaca

SEQ ID NO: 957867 - RNA, 19 nt, Mycobacterium avium subsp. paratuberculosis
ccccaccacgaagcuggcg

SEQ ID NO: 957868 - RNA, 16 nt, Mycobacterium avium subsp. paratuberculosis
ccccacccgcgcgaca

SEQ ID NO: 957869 - RNA, 21 nt, Mycobacterium avium subsp. paratuberculosis
ccccacaccuucgcggucggc

SEQ ID NO: 957870 - RNA, 14 nt, Mycobacterium avium subsp. paratuberculosis
ccccaaaacccggc

SEQ ID NO: 957871 - RNA, 14 nt, Mycobacterium avium subsp. paratuberculosis
ccccaccaggcgcg

SEQ ID NO: 957872 - RNA, 15 nt, Mycobacterium avium subsp. paratuberculosis
ccccaccaggcgcgg

SEQ ID NO: 957873 - RNA, 11 nt, Mycobacterium avium subsp. paratuberculosis
ccccaccccgg

SEQ ID NO: 957874 - RNA, 12 nt, Mycobacterium avium subsp. paratuberculosis
ccccaccccgga

SEQ ID NO: 957875 - RNA, 16 nt, Mycobacterium avium subsp. paratuberculosis
ccccaccccggacggc

SEQ ID NO: 957876 - RNA, 21 nt, Mycobacterium avium subsp. paratuberculosis
ccccacccgcacggucgcggu

SEQ ID NO: 957877 - RNA, 13 nt, Mycobacterium avium subsp. paratuberculosis
ccccagcgugacg

SEQ ID NO: 957878 - RNA, 17 nt, Mycobacterium avium subsp. paratuberculosis
ccccagcggggcaagca

SEQ ID NO: 957879 - RNA, 14 nt, Mycobacterium avium subsp. paratuberculosis
ccccagcgcgacca

SEQ ID NO: 957880 - RNA, 13 nt, Mycobacterium avium subsp. paratuberculosis
ccccagcggcacg

SEQ ID NO: 957881 - RNA, 11 nt, Mycobacterium avium subsp. paratuberculosis
ccccagcucga

SEQ ID NO: 957882 - RNA, 14 nt, Mycobacterium avium subsp. paratuberculosis
ccccagcugggccg

SEQ ID NO: 957883 - RNA, 16 nt, Mycobacterium avium subsp. paratuberculosis
ccccagcugggccgcc

SEQ ID NO: 957884 - RNA, 18 nt, Mycobacterium avium subsp. paratuberculosis
ccccagcugggccgccag

SEQ ID NO: 957885 - RNA, 17 nt, Mycobacterium avium subsp. paratuberculosis
ccccagcugucgggugg

SEQ ID NO: 957886 - RNA, 22 nt, Mycobacterium avium subsp. paratuberculosis
ccccagcugucggguggcagga

SEQ ID NO: 957887 - RNA, 22 nt, Mycobacterium avium subsp. paratuberculosis
ccccaggacgguuucugccggc

SEQ ID NO: 957888 - RNA, 20 nt, Mycobacterium avium subsp. paratuberculosis
cccccaaugucacggcgggu

SEQ ID NO: 957889 - RNA, 23 nt, Mycobacterium avium subsp. paratuberculosis
cccccaaugucacggcgggucgg

SEQ ID NO: 957890 - RNA, 13 nt, Mycobacterium avium subsp. paratuberculosis
ccccauugccgcg

SEQ ID NO: 957891 - RNA, 16 nt, Mycobacterium avium subsp. paratuberculosis
ccccauugccgcgccg

SEQ ID NO: 957892 - RNA, 20 nt, Mycobacterium avium subsp. paratuberculosis
ccccgcagcuucugcagcuc

SEQ ID NO: 957893 - RNA, 21 nt, Mycobacterium avium subsp. paratuberculosis
ccccgcagcuucugcagcucg

SEQ ID NO: 957894 - RNA, 21 nt, Mycobacterium avium subsp. paratuberculosis
ccccgccaggcggcgacgaac

SEQ ID NO: 957895 - RNA, 13 nt, Mycobacterium avium subsp. paratuberculosis
ccccgcccggccg

SEQ ID NO: 957896 - RNA, 13 nt, Mycobacterium avium subsp. paratuberculosis
ccccgcccggcgc

SEQ ID NO: 957897 - RNA, 15 nt, Mycobacterium avium subsp. paratuberculosis
ccccgcccggcgcgc

SEQ ID NO: 957898 - RNA, 12 nt, Mycobacterium avium subsp. paratuberculosis
ccccgccgaccg

SEQ ID NO: 957899 - RNA, 13 nt, Mycobacterium avium subsp. paratuberculosis
ccccgccgaccgg

SEQ ID NO: 957900 - RNA, 23 nt, Mycobacterium avium subsp. paratuberculosis
ccccgccaaucaccgcgguguug

SEQ ID NO: 957901 - RNA, 12 nt, Mycobacterium avium subsp. paratuberculosis
ccccgcagaaca

SEQ ID NO: 957902 - RNA, 13 nt, Mycobacterium avium subsp. paratuberculosis
ccccgauccgccg

SEQ ID NO: 957903 - RNA, 23 nt, Mycobacterium avium subsp. paratuberculosis
ccccgaugccgaacuccgccgaa

SEQ ID NO: 957904 - RNA, 18 nt, Mycobacterium avium subsp. paratuberculosis
ccccgaugcgcucaccca

SEQ ID NO: 957905 - RNA, 20 nt, Mycobacterium avium subsp. paratuberculosis
ccccgaugcgcucgccgauc

SEQ ID NO: 957906 - RNA, 19 nt, Mycobacterium avium subsp. paratuberculosis
ccccgaugcggugccgggc

SEQ ID NO: 957907 - RNA, 23 nt, Mycobacterium avium subsp. paratuberculosis
ccccgaugguauccgaucgcggc

SEQ ID NO: 957908 - RNA, 17 nt, Mycobacterium avium subsp. paratuberculosis
ccccgauuucgcggccg

SEQ ID NO: 957909 - RNA, 23 nt, Mycobacterium avium subsp. paratuberculosis
cccccaccacguaggcgaucagc

SEQ ID NO: 957910 - RNA, 15 nt, Mycobacterium avium subsp. paratuberculosis
ccccgcugccguccg

SEQ ID NO: 957911 - RNA, 20 nt, Mycobacterium avium subsp. paratuberculosis
ccccgcugccguccggcggc

SEQ ID NO: 957912 - RNA, 21 nt, Mycobacterium avium subsp. paratuberculosis
ccccgcugcucuuguccgcgu

SEQ ID NO: 957913 - RNA, 17 nt, Mycobacterium avium subsp. paratuberculosis
ccccgcuggaucccggu

SEQ ID NO: 957914 - RNA, 19 nt, Mycobacterium avium subsp. paratuberculosis
ccccgcuggaucccgguga

SEQ ID NO: 957915 - RNA, 14 nt, Mycobacterium avium subsp. paratuberculosis
ccccgcuggcccgg

SEQ ID NO: 957916 - RNA, 17 nt, Mycobacterium avium subsp. paratuberculosis
ccccgcuggcccggcgu

SEQ ID NO: 957917 - RNA, 16 nt, Mycobacterium avium subsp. paratuberculosis
ccccgcuggcgccggc

SEQ ID NO: 957918 - RNA, 17 nt, Mycobacterium avium subsp. paratuberculosis
ccccgcuggcgccggcg

SEQ ID NO: 957919 - RNA, 19 nt, Mycobacterium avium subsp. paratuberculosis
ccccgcuggcgccggcguc

SEQ ID NO: 957920 - RNA, 20 nt, Mycobacterium avium subsp. paratuberculosis
ccccgcuggcgccggcgucc

SEQ ID NO: 957921 - RNA, 19 nt, Mycobacterium avium subsp. paratuberculosis
ccccgcgugacggccgcgg

SEQ ID NO: 957922 - RNA, 13 nt, Mycobacterium avium subsp. paratuberculosis
ccccgcggugccg

SEQ ID NO: 957923 - RNA, 19 nt, Mycobacterium avium subsp. paratuberculosis
ccccgcuagccucaacgac

SEQ ID NO: 957924 - RNA, 20 nt, Mycobacterium avium subsp. paratuberculosis
ccccgcuccuccucgcgccg

SEQ ID NO: 957925 - RNA, 21 nt, Mycobacterium avium subsp. paratuberculosis
ccccgcuccuccucgcgccgc

SEQ ID NO: 957926 - RNA, 22 nt, Mycobacterium avium subsp. paratuberculosis
ccccgcucggccagcgcgccgc

SEQ ID NO: 957927 - RNA, 15 nt, Mycobacterium avium subsp. paratuberculosis
ccccggagucgucga

SEQ ID NO: 957928 - RNA, 23 nt, Mycobacterium avium subsp. paratuberculosis
ccccggagucgucgaacucgaug

SEQ ID NO: 957929 - RNA, 17 nt, Mycobacterium avium subsp. paratuberculosis
ccccggaccugccggcg

SEQ ID NO: 957930 - RNA, 17 nt, Mycobacterium avium subsp. paratuberculosis
ccccggagauccggccg

SEQ ID NO: 957931 - RNA, 23 nt, Mycobacterium avium subsp. paratuberculosis
ccccggauccgucgccccgcacc

SEQ ID NO: 957932 - RNA, 19 nt, Mycobacterium avium subsp. paratuberculosis
ccccggaugaccagggugg

SEQ ID NO: 957933 - RNA, 17 nt, Mycobacterium avium subsp. paratuberculosis
ccccggcgggcggccga

SEQ ID NO: 957934 - RNA, 19 nt, Mycobacterium avium subsp. paratuberculosis
ccccggcgggcggccgauc

SEQ ID NO: 957935 - RNA, 14 nt, Mycobacterium avium subsp. paratuberculosis
ccccggcgggcucg

SEQ ID NO: 957936 - RNA, 23 nt, Mycobacterium avium subsp. paratuberculosis
ccccggcgggcucgccggcccga

SEQ ID NO: 957937 - RNA, 14 nt, Mycobacterium avium subsp. paratuberculosis
ccccggcgggucug

SEQ ID NO: 957938 - RNA, 20 nt, Mycobacterium avium subsp. paratuberculosis
ccccgggauccgaggcguca

SEQ ID NO: 957939 - RNA, 19 nt, Mycobacterium avium subsp. paratuberculosis
ccccgggaugccugcccgc

SEQ ID NO: 957940 - RNA, 21 nt, Mycobacterium avium subsp. paratuberculosis
ccccgggaugccugcccgcgc

SEQ ID NO: 957941 - RNA, 15 nt, Mycobacterium avium subsp. paratuberculosis
ccccgggcaccagcg

SEQ ID NO: 957942 - RNA, 21 nt, Mycobacterium avium subsp. paratuberculosis
ccccgggcaccagcgcgacgg

SEQ ID NO: 957943 - RNA, 13 nt, Mycobacterium avium subsp. paratuberculosis
ccccggcggucgg

SEQ ID NO: 957944 - RNA, 22 nt, Mycobacterium avium subsp. paratuberculosis
ccccggcggucggaucgagcuc

SEQ ID NO: 957945 - RNA, 19 nt, Mycobacterium avium subsp. paratuberculosis
ccccgggccgcaggguggc

SEQ ID NO: 957946 - RNA, 13 nt, Mycobacterium avium subsp. paratuberculosis
ccccgggcggcuc

SEQ ID NO: 957947 - RNA, 20 nt, Mycobacterium avium subsp. paratuberculosis
ccccguacggguugccgucg

SEQ ID NO: 957948 - RNA, 21 nt, Mycobacterium avium subsp. paratuberculosis
ccccguacggguugccgucga

SEQ ID NO: 957949 - RNA, 17 nt, Mycobacterium avium subsp. paratuberculosis
ccccggugccgcagugc

SEQ ID NO: 957950 - RNA, 16 nt, Mycobacterium avium subsp. paratuberculosis
ccccgguccaggcgac

SEQ ID NO: 957951 - RNA, 18 nt, Mycobacterium avium subsp. paratuberculosis
ccccggugaccucccgga

SEQ ID NO: 957952 - RNA, 15 nt, Mycobacterium avium subsp. paratuberculosis
ccccggucccgccgg

SEQ ID NO: 957953 - RNA, 18 nt, Mycobacterium avium subsp. paratuberculosis
ccccggucccgccgguga

SEQ ID NO: 957954 - RNA, 12 nt, Mycobacterium avium subsp. paratuberculosis
ccccggucccgg

SEQ ID NO: 957955 - RNA, 17 nt, Mycobacterium avium subsp. paratuberculosis
ccccggucaccccggcc

SEQ ID NO: 957956 - RNA, 13 nt, Mycobacterium avium subsp. paratuberculosis
ccccggucaccgg

SEQ ID NO: 957957 - RNA, 17 nt, Mycobacterium avium subsp. paratuberculosis
ccccggggccuccagcc

SEQ ID NO: 957958 - RNA, 23 nt, Mycobacterium avium subsp. paratuberculosis
ccccggggccuccagccagcgcg

SEQ ID NO: 957959 - RNA, 16 nt, Mycobacterium avium subsp. paratuberculosis
ccccgggggaccagcg

SEQ ID NO: 957960 - RNA, 21 nt, Mycobacterium avium subsp. paratuberculosis
ccccgucgggccguccgccgg

SEQ ID NO: 957961 - RNA, 19 nt, Mycobacterium avium subsp. paratuberculosis
ccccgucggucccgacgcg

SEQ ID NO: 957962 - RNA, 17 nt, Mycobacterium avium subsp. paratuberculosis
ccccguccagcccagcg

SEQ ID NO: 957963 - RNA, 20 nt, Mycobacterium avium subsp. paratuberculosis
ccccguccagcccagcgccc

SEQ ID NO: 957964 - RNA, 15 nt, Mycobacterium avium subsp. paratuberculosis
ccccguccggcgcca

SEQ ID NO: 957965 - RNA, 15 nt, Mycobacterium avium subsp. paratuberculosis
ccccguaggugcaca

SEQ ID NO: 957966 - RNA, 17 nt, Mycobacterium avium subsp. paratuberculosis
ccccguagucacccggc

SEQ ID NO: 957967 - RNA, 18 nt, Mycobacterium avium subsp. paratuberculosis
ccccguagucacccggcc

SEQ ID NO: 957968 - RNA, 20 nt, Mycobacterium avium subsp. paratuberculosis
ccccguagucacccggcccc

SEQ ID NO: 957969 - RNA, 17 nt, Mycobacterium avium subsp. paratuberculosis
ccccuucuccacgcucg

SEQ ID NO: 957970 - RNA, 23 nt, Mycobacterium avium subsp. paratuberculosis
ccccuucgaugucgccggcgacc

SEQ ID NO: 957971 - RNA, 23 nt, Mycobacterium avium subsp. paratuberculosis
cccgaaaagguauucgcgcaaca

SEQ ID NO: 957972 - RNA, 19 nt, Mycobacterium avium subsp. paratuberculosis
ccccuuggugcggucgaug

SEQ ID NO: 957973 - RNA, 15 nt, Mycobacterium avium subsp. paratuberculosis
ccccgugcagccggg

SEQ ID NO: 957974 - RNA, 16 nt, Mycobacterium avium subsp. paratuberculosis
ccccgugcagccgggc

SEQ ID NO: 957975 - RNA, 17 nt, Mycobacterium avium subsp. paratuberculosis
ccccgugcagccgggcc

SEQ ID NO: 957976 - RNA, 14 nt, Mycobacterium avium subsp. paratuberculosis
ccccgugcggggcc

SEQ ID NO: 957977 - RNA, 18 nt, Mycobacterium avium subsp. paratuberculosis
ccccgugcggggccucgu

SEQ ID NO: 957978 - RNA, 22 nt, Mycobacterium avium subsp. paratuberculosis
ccccguggaucaucccgaccag

SEQ ID NO: 957979 - RNA, 20 nt, Mycobacterium avium subsp. paratuberculosis
cccgacauccaggaccgcgc

SEQ ID NO: 957980 - RNA, 23 nt, Mycobacterium avium subsp. paratuberculosis
cccgacaucugccgggcggcgac

SEQ ID NO: 957981 - RNA, 12 nt, Mycobacterium avium subsp. paratuberculosis
cccgaccagcgg

SEQ ID NO: 957982 - RNA, 14 nt, Mycobacterium avium subsp. paratuberculosis
cccgaccccgccag

SEQ ID NO: 957983 - RNA, 16 nt, Mycobacterium avium subsp. paratuberculosis
cccgaccccgccagca

SEQ ID NO: 957984 - RNA, 18 nt, Mycobacterium avium subsp. paratuberculosis
cccgaccccgccagcacc

SEQ ID NO: 957985 - RNA, 16 nt, Mycobacterium avium subsp. paratuberculosis
cccgaccccggcgagc

SEQ ID NO: 957986 - RNA, 17 nt, Mycobacterium avium subsp. paratuberculosis
cccgacccgcaccaccg

SEQ ID NO: 957987 - RNA, 19 nt, Mycobacterium avium subsp. paratuberculosis
cccgagagcugcugccgcc

SEQ ID NO: 957988 - RNA, 18 nt, Mycobacterium avium subsp. paratuberculosis
cccgagaguccgccgccg

SEQ ID NO: 957989 - RNA, 15 nt, Mycobacterium avium subsp. paratuberculosis
cccgaccacaccggc

SEQ ID NO: 957990 - RNA, 19 nt, Mycobacterium avium subsp. paratuberculosis
cccgacaguccgaccgcgu

SEQ ID NO: 957991 - RNA, 17 nt, Mycobacterium avium subsp. paratuberculosis
cccgaaagcccccagcu

SEQ ID NO: 957992 - RNA, 15 nt, Mycobacterium avium subsp. paratuberculosis
cccgaauugcgcugc

SEQ ID NO: 957993 - RNA, 12 nt, Mycobacterium avium subsp. paratuberculosis
cccgacaccgcc

SEQ ID NO: 957994 - RNA, 17 nt, Mycobacterium avium subsp. paratuberculosis
cccgacaccgccagcag

SEQ ID NO: 957995 - RNA, 19 nt, Mycobacterium avium subsp. paratuberculosis
cccgagucggagacccgcc

SEQ ID NO: 957996 - RNA, 15 nt, Mycobacterium avium subsp. paratuberculosis
cccgaguggcgccgu

SEQ ID NO: 957997 - RNA, 20 nt, Mycobacterium avium subsp. paratuberculosis
cccgagugggaccgucggca

SEQ ID NO: 957998 - RNA, 22 nt, Mycobacterium avium subsp. paratuberculosis
cccgaggugaauaccacugcgc

SEQ ID NO: 957999 - RNA, 15 nt, Mycobacterium avium subsp. paratuberculosis
cccgagucacccggc

SEQ ID NO: 958000 - RNA, 17 nt, Mycobacterium avium subsp. paratuberculosis
cccgaguccacgacguc

SEQ ID NO: 958001 - RNA, 21 nt, Mycobacterium avium subsp. paratuberculosis
cccgaggagacgucggccggg

SEQ ID NO: 958002 - RNA, 22 nt, Mycobacterium avium subsp. paratuberculosis
cccgaggagacgucggccgggu

SEQ ID NO: 958003 - RNA, 15 nt, Mycobacterium avium subsp. paratuberculosis
cccgaggaugccgcc

SEQ ID NO: 958004 - RNA, 19 nt, Mycobacterium avium subsp. paratuberculosis
cccgaggaugccgcccacc

SEQ ID NO: 958005 - RNA, 21 nt, Mycobacterium avium subsp. paratuberculosis
cccgaggaugccgcccaccac

SEQ ID NO: 958006 - RNA, 15 nt, Mycobacterium avium subsp. paratuberculosis
cccgagcacgucgag

SEQ ID NO: 958007 - RNA, 23 nt, Mycobacterium avium subsp. paratuberculosis
cccgagcacgucgagcaccgcgu

SEQ ID NO: 958008 - RNA, 22 nt, Mycobacterium avium subsp. paratuberculosis
cccgagcaggcggaucggcccg

SEQ ID NO: 958009 - RNA, 23 nt, Mycobacterium avium subsp. paratuberculosis
cccgagcaggcggaucggcccga

SEQ ID NO: 958010 - RNA, 13 nt, Mycobacterium avium subsp. paratuberculosis
cccgagcaucgcc

SEQ ID NO: 958011 - RNA, 14 nt, Mycobacterium avium subsp. paratuberculosis
cccgagcaucgccg

SEQ ID NO: 958012 - RNA, 19 nt, Mycobacterium avium subsp. paratuberculosis
cccgagcaucgccgagcgc

SEQ ID NO: 958013 - RNA, 12 nt, Mycobacterium avium subsp. paratuberculosis
cccgagcaccac

SEQ ID NO: 958014 - RNA, 14 nt, Mycobacterium avium subsp. paratuberculosis
cccgagcaccagcg

SEQ ID NO: 958015 - RNA, 18 nt, Mycobacterium avium subsp. paratuberculosis
cccgagcaccccggcggc

SEQ ID NO: 958016 - RNA, 17 nt, Mycobacterium avium subsp. paratuberculosis
cccgagcccgacggcag

SEQ ID NO: 958017 - RNA, 13 nt, Mycobacterium avium subsp. paratuberculosis
cccgagccgcaca

SEQ ID NO: 958018 - RNA, 13 nt, Mycobacterium avium subsp. paratuberculosis
cccgagccgcgga

SEQ ID NO: 958019 - RNA, 13 nt, Mycobacterium avium subsp. paratuberculosis
cccgaccgacgcc

SEQ ID NO: 958020 - RNA, 18 nt, Mycobacterium avium subsp. paratuberculosis
cccgagcgggccuucacg

SEQ ID NO: 958021 - RNA, 21 nt, Mycobacterium avium subsp. paratuberculosis
cccgagcgucauuccgccgcg

SEQ ID NO: 958022 - RNA, 22 nt, Mycobacterium avium subsp. paratuberculosis
cccgagcgucauuccgccgcgc

SEQ ID NO: 958023 - RNA, 23 nt, Mycobacterium avium subsp. paratuberculosis
cccgagcgucauuccgccgcgcc

SEQ ID NO: 958024 - RNA, 21 nt, Mycobacterium avium subsp. paratuberculosis
cccggaaaaccccaccccgag

SEQ ID NO: 958025 - RNA, 17 nt, Mycobacterium avium subsp. paratuberculosis
cccggaaagcgcgggca

SEQ ID NO: 958026 - RNA, 22 nt, Mycobacterium avium subsp. paratuberculosis
cccggaacagcuuggcgcagcc

SEQ ID NO: 958027 - RNA, 24 nt, Mycobacterium avium subsp. paratuberculosis
cccggaacagcuuggcgcagccgg

SEQ ID NO: 958028 - RNA, 21 nt, Mycobacterium avium subsp. paratuberculosis
cccggaacccgcguggcaggu

SEQ ID NO: 958029 - RNA, 14 nt, Mycobacterium avium subsp. paratuberculosis
cccgcugccggacc

SEQ ID NO: 958030 - RNA, 19 nt, Mycobacterium avium subsp. paratuberculosis
cccgcugccguccggcggc

SEQ ID NO: 958031 - RNA, 20 nt, Mycobacterium avium subsp. paratuberculosis
cccgcugccguccggcggca

SEQ ID NO: 958032 - RNA, 12 nt, Mycobacterium avium subsp. paratuberculosis
cccgcugcacca

SEQ ID NO: 958033 - RNA, 15 nt, Mycobacterium avium subsp. paratuberculosis
cccgcugaccgccgc

SEQ ID NO: 958034 - RNA, 17 nt, Mycobacterium avium subsp. paratuberculosis
cccgcugaccgccgcgc

SEQ ID NO: 958035 - RNA, 15 nt, Mycobacterium avium subsp. paratuberculosis
cccgcugauccagca

SEQ ID NO: 958036 - RNA, 12 nt, Mycobacterium avium subsp. paratuberculosis
cccgcugcagcc

SEQ ID NO: 958037 - RNA, 23 nt, Mycobacterium avium subsp. paratuberculosis
cccgcugcagccgguccggcggc

SEQ ID NO: 958038 - RNA, 16 nt, Mycobacterium avium subsp. paratuberculosis
cccgcugcagcgccga

SEQ ID NO: 958039 - RNA, 16 nt, Mycobacterium avium subsp. paratuberculosis
cccgcucgcgggcccg

SEQ ID NO: 958040 - RNA, 13 nt, Mycobacterium avium subsp. paratuberculosis
cccgcucggcggg

SEQ ID NO: 958041 - RNA, 20 nt, Mycobacterium avium subsp. paratuberculosis
cccgcugaaagcucgcgucg

SEQ ID NO: 958042 - RNA, 23 nt, Mycobacterium avium subsp. paratuberculosis
cccgcugaaagcucgcgucgacg

SEQ ID NO: 958043 - RNA, 22 nt, Mycobacterium avium subsp. paratuberculosis
cccgcgguggaacccagcaccc

SEQ ID NO: 958044 - RNA, 21 nt, Mycobacterium avium subsp. paratuberculosis
cccgcggugugcuggccagca

SEQ ID NO: 958045 - RNA, 23 nt, Mycobacterium avium subsp. paratuberculosis
cccgcucgaggggcuuggcgacg

SEQ ID NO: 958046 - RNA, 14 nt, Mycobacterium avium subsp. paratuberculosis
cccggaagccgcau

SEQ ID NO: 958047 - RNA, 13 nt, Mycobacterium avium subsp. paratuberculosis
cccggaaucgucg

SEQ ID NO: 958048 - RNA, 19 nt, Mycobacterium avium subsp. paratuberculosis
cccggaaucgucggccacg

SEQ ID NO: 958049 - RNA, 21 nt, Mycobacterium avium subsp. paratuberculosis
cccggaaugugcuugaucagc

SEQ ID NO: 958050 - RNA, 22 nt, Mycobacterium avium subsp. paratuberculosis
cccggaaugugcuugaucagcg

SEQ ID NO: 958051 - RNA, 20 nt, Mycobacterium avium subsp. paratuberculosis
cccggacaacggaucgagcg

SEQ ID NO: 958052 - RNA, 21 nt, Mycobacterium avium subsp. paratuberculosis
cccggacaacggaucgagcgc

SEQ ID NO: 958053 - RNA, 17 nt, Mycobacterium avium subsp. paratuberculosis
cccggaacggcgggccc

SEQ ID NO: 958054 - RNA, 17 nt, Mycobacterium avium subsp. paratuberculosis
cccggacaccccguagg

SEQ ID NO: 958055 - RNA, 17 nt, Mycobacterium avium subsp. paratuberculosis
cccggacagccacucca

SEQ ID NO: 958056 - RNA, 14 nt, Mycobacterium avium subsp. paratuberculosis
cccggacagcgcga

SEQ ID NO: 958057 - RNA, 16 nt, Mycobacterium avium subsp. paratuberculosis
cccggacagcgcgacg

SEQ ID NO: 958058 - RNA, 18 nt, Mycobacterium avium subsp. paratuberculosis
cccggacagcgcgacgca

SEQ ID NO: 958059 - RNA, 14 nt, Mycobacterium avium subsp. paratuberculosis
cccggacaggucgg

SEQ ID NO: 958060 - RNA, 21 nt, Mycobacterium avium subsp. paratuberculosis
cccggacauaggcgucgcggu

SEQ ID NO: 958061 - RNA, 14 nt, Mycobacterium avium subsp. paratuberculosis
cccggaccacgucc

SEQ ID NO: 958062 - RNA, 21 nt, Mycobacterium avium subsp. paratuberculosis
cccggauggucugcagcgacg

SEQ ID NO: 958063 - RNA, 17 nt, Mycobacterium avium subsp. paratuberculosis
cccggaugcugcggguc

SEQ ID NO: 958064 - RNA, 16 nt, Mycobacterium avium subsp. paratuberculosis
cccggauggagcgcga

SEQ ID NO: 958065 - RNA, 18 nt, Mycobacterium avium subsp. paratuberculosis
cccggauggagcgcgacg

SEQ ID NO: 958066 - RNA, 19 nt, Mycobacterium avium subsp. paratuberculosis
cccggauggagcgcgacgg

SEQ ID NO: 958067 - RNA, 22 nt, Mycobacterium avium subsp. paratuberculosis
cccggauggagcgcgacgggcu

SEQ ID NO: 958068 - RNA, 15 nt, Mycobacterium avium subsp. paratuberculosis
cccggaugccggcgc

SEQ ID NO: 958069 - RNA, 15 nt, Mycobacterium avium subsp. paratuberculosis
cccggauccgucgcc

SEQ ID NO: 958070 - RNA, 18 nt, Mycobacterium avium subsp. paratuberculosis
cccggauccgucgccccg

SEQ ID NO: 958071 - RNA, 20 nt, Mycobacterium avium subsp. paratuberculosis
cccggauccgucgccccgca

SEQ ID NO: 958072 - RNA, 14 nt, Mycobacterium avium subsp. paratuberculosis
cccggaucgccgaa

SEQ ID NO: 958073 - RNA, 12 nt, Mycobacterium avium subsp. paratuberculosis
cccggaucggcc

SEQ ID NO: 958074 - RNA, 21 nt, Mycobacterium avium subsp. paratuberculosis
cccggaucuugccgucggccg

SEQ ID NO: 958075 - RNA, 22 nt, Mycobacterium avium subsp. paratuberculosis
cccggaucuugccgucggccgc

SEQ ID NO: 958076 - RNA, 17 nt, Mycobacterium avium subsp. paratuberculosis
cccggaugaccagggug

SEQ ID NO: 958077 - RNA, 23 nt, Mycobacterium avium subsp. paratuberculosis
cccggaugaccaggguggucagc

SEQ ID NO: 958078 - RNA, 20 nt, Mycobacterium avium subsp. paratuberculosis
cccggaugaucaacacgucg

SEQ ID NO: 958079 - RNA, 20 nt, Mycobacterium avium subsp. paratuberculosis
cccggaucagcugaccggcg

SEQ ID NO: 958080 - RNA, 12 nt, Mycobacterium avium subsp. paratuberculosis
cccgcgcggccg

SEQ ID NO: 958081 - RNA, 14 nt, Mycobacterium avium subsp. paratuberculosis
cccgcgcggcgcag

SEQ ID NO: 958082 - RNA, 20 nt, Mycobacterium avium subsp. paratuberculosis
cccgcgcggcgcagggcggc

SEQ ID NO: 958083 - RNA, 13 nt, Mycobacterium avium subsp. paratuberculosis
cccgcgcggcggc

SEQ ID NO: 958084 - RNA, 21 nt, Mycobacterium avium subsp. paratuberculosis
cccgcgcggcggccaacgcga

SEQ ID NO: 958085 - RNA, 13 nt, Mycobacterium avium subsp. paratuberculosis
cccgcgcggcuca

SEQ ID NO: 958086 - RNA, 13 nt, Mycobacterium avium subsp. paratuberculosis
cccgcgcuggugc

SEQ ID NO: 958087 - RNA, 22 nt, Mycobacterium avium subsp. paratuberculosis
cccgcgcgggggccgccgcgau

SEQ ID NO: 958088 - RNA, 17 nt, Mycobacterium avium subsp. paratuberculosis
cccgcgccacgccgccc

SEQ ID NO: 958089 - RNA, 21 nt, Mycobacterium avium subsp. paratuberculosis
cccgcgcgugggccaacgcga

SEQ ID NO: 958090 - RNA, 14 nt, Mycobacterium avium subsp. paratuberculosis
cccgcgccaccccg

SEQ ID NO: 958091 - RNA, 21 nt, Mycobacterium avium subsp. paratuberculosis
cccgcgcaccgucaucgcggc

SEQ ID NO: 958092 - RNA, 15 nt, Mycobacterium avium subsp. paratuberculosis
cccgcgcaucccguc

SEQ ID NO: 958093 - RNA, 14 nt, Mycobacterium avium subsp. paratuberculosis
cccgcgcacgcucg

SEQ ID NO: 958094 - RNA, 15 nt, Mycobacterium avium subsp. paratuberculosis
cccgcgagucaccgg

SEQ ID NO: 958095 - RNA, 16 nt, Mycobacterium avium subsp. paratuberculosis
cccgcgagucaccggc

SEQ ID NO: 958096 - RNA, 16 nt, Mycobacterium avium subsp. paratuberculosis
cccgcgaucaacaccg

SEQ ID NO: 958097 - RNA, 15 nt, Mycobacterium avium subsp. paratuberculosis
cccgcgaucgccagc

SEQ ID NO: 958098 - RNA, 14 nt, Mycobacterium avium subsp. paratuberculosis
cccgcgacugucgg

SEQ ID NO: 958099 - RNA, 17 nt, Mycobacterium avium subsp. paratuberculosis
cccgcgacugucggcgc

SEQ ID NO: 958100 - RNA, 21 nt, Mycobacterium avium subsp. paratuberculosis
cccgcgacugucggcgccccg

SEQ ID NO: 958101 - RNA, 17 nt, Mycobacterium avium subsp. paratuberculosis
cccgcgacggcgagccg

SEQ ID NO: 958102 - RNA, 12 nt, Mycobacterium avium subsp. paratuberculosis
cccgcgacgucc

SEQ ID NO: 958103 - RNA, 20 nt, Mycobacterium avium subsp. paratuberculosis
cccgcgaggugucgacgcug

SEQ ID NO: 958104 - RNA, 12 nt, Mycobacterium avium subsp. paratuberculosis
cccgcgggucgc

SEQ ID NO: 958105 - RNA, 14 nt, Mycobacterium avium subsp. paratuberculosis
cccgcgggucgucg

SEQ ID NO: 958106 - RNA, 17 nt, Mycobacterium avium subsp. paratuberculosis
cccgcgggucgucgacg

SEQ ID NO: 958107 - RNA, 20 nt, Mycobacterium avium subsp. paratuberculosis
cccgcgggucgucgacgucg

SEQ ID NO: 958108 - RNA, 19 nt, Mycobacterium avium subsp. paratuberculosis
cccgcgggugacgcugacc

SEQ ID NO: 958109 - RNA, 15 nt, Mycobacterium avium subsp. paratuberculosis
cccgcggucggcggc

SEQ ID NO: 958110 - RNA, 18 nt, Mycobacterium avium subsp. paratuberculosis
cccgcgggacacggcggc

SEQ ID NO: 958111 - RNA, 19 nt, Mycobacterium avium subsp. paratuberculosis
cccgcgggacacggcggcg

SEQ ID NO: 958112 - RNA, 15 nt, Mycobacterium avium subsp. paratuberculosis
cccgcgggaucagcg

SEQ ID NO: 958113 - RNA, 21 nt, Mycobacterium avium subsp. paratuberculosis
cccgcgggccagacugcgcac

SEQ ID NO: 958114 - RNA, 15 nt, Mycobacterium avium subsp. paratuberculosis
cccgcggccgccgcc

SEQ ID NO: 958115 - RNA, 16 nt, Mycobacterium avium subsp. paratuberculosis
cccgcggccgccgccg

SEQ ID NO: 958116 - RNA, 20 nt, Mycobacterium avium subsp. paratuberculosis
cccgcggccgccgccgcggc

SEQ ID NO: 958117 - RNA, 11 nt, Mycobacterium avium subsp. paratuberculosis
cccgcggccuc

SEQ ID NO: 958118 - RNA, 22 nt, Mycobacterium avium subsp. paratuberculosis
cccgcggcggcgccaugaacgg

SEQ ID NO: 958119 - RNA, 14 nt, Mycobacterium avium subsp. paratuberculosis
cccgcggcgccgcg

SEQ ID NO: 958120 - RNA, 22 nt, Mycobacterium avium subsp. paratuberculosis
cccgcggcgcgaugaucgccgg

SEQ ID NO: 958121 - RNA, 13 nt, Mycobacterium avium subsp. paratuberculosis
cccgcggcgcgca

SEQ ID NO: 958122 - RNA, 12 nt, Mycobacterium avium subsp. paratuberculosis
cccgcggcggcc

SEQ ID NO: 958123 - RNA, 18 nt, Mycobacterium avium subsp. paratuberculosis
cccgcggcggccaucucg

SEQ ID NO: 958124 - RNA, 12 nt, Mycobacterium avium subsp. paratuberculosis
cccgcggccgcu

SEQ ID NO: 958125 - RNA, 14 nt, Mycobacterium avium subsp. paratuberculosis
cccgcggccgcugc

SEQ ID NO: 958126 - RNA, 15 nt, Mycobacterium avium subsp. paratuberculosis
cccgcggccggccca

SEQ ID NO: 958127 - RNA, 21 nt, Mycobacterium avium subsp. paratuberculosis
cccgcggccggcccagcgcgc

SEQ ID NO: 958128 - RNA, 16 nt, Mycobacterium avium subsp. paratuberculosis
cccgcggccaucgccu

SEQ ID NO: 958129 - RNA, 12 nt, Mycobacterium avium subsp. paratuberculosis
cccgcggccacc

SEQ ID NO: 958130 - RNA, 23 nt, Mycobacterium avium subsp. paratuberculosis
cccgcggcacgcugcgccagccg

SEQ ID NO: 958131 - RNA, 16 nt, Mycobacterium avium subsp. paratuberculosis
cccgcggcagccgggc

SEQ ID NO: 958132 - RNA, 18 nt, Mycobacterium avium subsp. paratuberculosis
cccgccccgacagcaacg

SEQ ID NO: 958133 - RNA, 22 nt, Mycobacterium avium subsp. paratuberculosis
cccgccccgacgugcagcgcca

SEQ ID NO: 958134 - RNA, 13 nt, Mycobacterium avium subsp. paratuberculosis
cccgcccagcgac

SEQ ID NO: 958135 - RNA, 15 nt, Mycobacterium avium subsp. paratuberculosis
cccgcccgccgggca

SEQ ID NO: 958136 - RNA, 16 nt, Mycobacterium avium subsp. paratuberculosis
cccgcccgccgggcac

SEQ ID NO: 958137 - RNA, 13 nt, Mycobacterium avium subsp. paratuberculosis
cccgcccggcaac

SEQ ID NO: 958138 - RNA, 12 nt, Mycobacterium avium subsp. paratuberculosis
cccgcccggccc

SEQ ID NO: 958139 - RNA, 14 nt, Mycobacterium avium subsp. paratuberculosis
cccgcccggcccgg

SEQ ID NO: 958140 - RNA, 15 nt, Mycobacterium avium subsp. paratuberculosis
cccgcccggcccggc

SEQ ID NO: 958141 - RNA, 20 nt, Mycobacterium avium subsp. paratuberculosis
cccgcccggcccggcgcggc

SEQ ID NO: 958142 - RNA, 22 nt, Mycobacterium avium subsp. paratuberculosis
cccgcccggcccggcgcggccg

SEQ ID NO: 958143 - RNA, 13 nt, Mycobacterium avium subsp. paratuberculosis
cccgcccggccgg

SEQ ID NO: 958144 - RNA, 21 nt, Mycobacterium avium subsp. paratuberculosis
cccgcccggccggucgccgau

SEQ ID NO: 958145 - RNA, 15 nt, Mycobacterium avium subsp. paratuberculosis
cccgcccggcgccgg

SEQ ID NO: 958146 - RNA, 13 nt, Mycobacterium avium subsp. paratuberculosis
cccgcccggcgcg

SEQ ID NO: 958147 - RNA, 12 nt, Mycobacterium avium subsp. paratuberculosis
cccgcccggcgg

SEQ ID NO: 958148 - RNA, 13 nt, Mycobacterium avium subsp. paratuberculosis
cccgcccggcggc

SEQ ID NO: 958149 - RNA, 12 nt, Mycobacterium avium subsp. paratuberculosis
cccgcccggggc

SEQ ID NO: 958150 - RNA, 17 nt, Mycobacterium avium subsp. paratuberculosis
cccgcccucgccccgga

SEQ ID NO: 958151 - RNA, 24 nt, Mycobacterium avium subsp. paratuberculosis
cccgcccuggcuguagcggucgug

SEQ ID NO: 958152 - RNA, 14 nt, Mycobacterium avium subsp. paratuberculosis
cccgcccuugaacg

SEQ ID NO: 958153 - RNA, 21 nt, Mycobacterium avium subsp. paratuberculosis
cccgcccuugaacggcaccag

SEQ ID NO: 958154 - RNA, 23 nt, Mycobacterium avium subsp. paratuberculosis
cccgccacggccagcaccgccag

SEQ ID NO: 958155 - RNA, 16 nt, Mycobacterium avium subsp. paratuberculosis
cccgcauggccuugag

SEQ ID NO: 958156 - RNA, 13 nt, Mycobacterium avium subsp. paratuberculosis
cccgccggcccgg

SEQ ID NO: 958157 - RNA, 15 nt, Mycobacterium avium subsp. paratuberculosis
cccgccggaacucgg

SEQ ID NO: 958158 - RNA, 20 nt, Mycobacterium avium subsp. paratuberculosis
cccgccggaacucggccggc

SEQ ID NO: 958159 - RNA, 22 nt, Mycobacterium avium subsp. paratuberculosis
cccgccggaacucggccggcac

SEQ ID NO: 958160 - RNA, 13 nt, Mycobacterium avium subsp. paratuberculosis
cccgccggagaug

SEQ ID NO: 958161 - RNA, 11 nt, Mycobacterium avium subsp. paratuberculosis
cccgccgcggc

SEQ ID NO: 958162 - RNA, 20 nt, Mycobacterium avium subsp. paratuberculosis
cccgccggcgaacgacgucg

SEQ ID NO: 958163 - RNA, 21 nt, Mycobacterium avium subsp. paratuberculosis
cccgccggcgaacgacgucga

SEQ ID NO: 958164 - RNA, 21 nt, Mycobacterium avium subsp. paratuberculosis
cccgccggcgaucgacgucac

SEQ ID NO: 958165 - RNA, 14 nt, Mycobacterium avium subsp. paratuberculosis
cccgccggcggcga

SEQ ID NO: 958166 - RNA, 12 nt, Mycobacterium avium subsp. paratuberculosis
cccgccggcggg

SEQ ID NO: 958167 - RNA, 15 nt, Mycobacterium avium subsp. paratuberculosis
cccgcgacacgccgc

SEQ ID NO: 958168 - RNA, 16 nt, Mycobacterium avium subsp. paratuberculosis
cccgcgacacgccgcg

SEQ ID NO: 958169 - RNA, 19 nt, Mycobacterium avium subsp. paratuberculosis
cccgcgacacgccgcgcau

SEQ ID NO: 958170 - RNA, 19 nt, Mycobacterium avium subsp. paratuberculosis
cccgcgaccccuccaacgg

SEQ ID NO: 958171 - RNA, 15 nt, Mycobacterium avium subsp. paratuberculosis
cccgcgaccgcagca

SEQ ID NO: 958172 - RNA, 12 nt, Mycobacterium avium subsp. paratuberculosis
cccgccgcggca

SEQ ID NO: 958173 - RNA, 19 nt, Mycobacterium avium subsp. paratuberculosis
cccgccgcggccgcuggcg

SEQ ID NO: 958174 - RNA, 12 nt, Mycobacterium avium subsp. paratuberculosis
cccgccgcggcg

SEQ ID NO: 958175 - RNA, 14 nt, Mycobacterium avium subsp. paratuberculosis
cccgcccugcuuga

SEQ ID NO: 958176 - RNA, 21 nt, Mycobacterium avium subsp. paratuberculosis
cccgcccuuggccgcggagua

SEQ ID NO: 958177 - RNA, 13 nt, Mycobacterium avium subsp. paratuberculosis
cccgcccuugucg

SEQ ID NO: 958178 - RNA, 17 nt, Mycobacterium avium subsp. paratuberculosis
cccgccgaacgccuccg

SEQ ID NO: 958179 - RNA, 19 nt, Mycobacterium avium subsp. paratuberculosis
cccgccgaacgccuccgcc

SEQ ID NO: 958180 - RNA, 14 nt, Mycobacterium avium subsp. paratuberculosis
cccgccgcgcccgg

SEQ ID NO: 958181 - RNA, 17 nt, Mycobacterium avium subsp. paratuberculosis
cccgccgcggcgaccgg

SEQ ID NO: 958182 - RNA, 17 nt, Mycobacterium avium subsp. paratuberculosis
cccgccgcggcgagccg

SEQ ID NO: 958183 - RNA, 16 nt, Mycobacterium avium subsp. paratuberculosis
cccgccgcgucgguca

SEQ ID NO: 958184 - RNA, 22 nt, Mycobacterium avium subsp. paratuberculosis
cccgccgcgucggucagcgcca

SEQ ID NO: 958185 - RNA, 16 nt, Mycobacterium avium subsp. paratuberculosis
cccgccgcucaccgcc

SEQ ID NO: 958186 - RNA, 18 nt, Mycobacterium avium subsp. paratuberculosis
cccgccgcucaccgccga

SEQ ID NO: 958187 - RNA, 22 nt, Mycobacterium avium subsp. paratuberculosis
cccgccgcucaccgccgagccg

SEQ ID NO: 958188 - RNA, 17 nt, Mycobacterium avium subsp. paratuberculosis
cccgccgcugacgcggc

SEQ ID NO: 958189 - RNA, 21 nt, Mycobacterium avium subsp. paratuberculosis
cccgccgcugcagcugcucgu

SEQ ID NO: 958190 - RNA, 13 nt, Mycobacterium avium subsp. paratuberculosis
cccgauggcggcc

SEQ ID NO: 958191 - RNA, 20 nt, Mycobacterium avium subsp. paratuberculosis
cccgaugccgaacuccgccg

SEQ ID NO: 958192 - RNA, 13 nt, Mycobacterium avium subsp. paratuberculosis
cccgaugccgccg

SEQ ID NO: 958193 - RNA, 15 nt, Mycobacterium avium subsp. paratuberculosis
cccgaugccgccgag

SEQ ID NO: 958194 - RNA, 18 nt, Mycobacterium avium subsp. paratuberculosis
cccgaugccgcgcaggcc

SEQ ID NO: 958195 - RNA, 14 nt, Mycobacterium avium subsp. paratuberculosis
cccgcaccaccgcc

SEQ ID NO: 958196 - RNA, 13 nt, Mycobacterium avium subsp. paratuberculosis
cccgcaccagcag

SEQ ID NO: 958197 - RNA, 17 nt, Mycobacterium avium subsp. paratuberculosis
cccgaugcgcucgccga

SEQ ID NO: 958198 - RNA, 18 nt, Mycobacterium avium subsp. paratuberculosis
cccgaugcgcucgccgau

SEQ ID NO: 958199 - RNA, 14 nt, Mycobacterium avium subsp. paratuberculosis
cccgaugcggaccg

SEQ ID NO: 958200 - RNA, 15 nt, Mycobacterium avium subsp. paratuberculosis
cccgaugcggugccg

SEQ ID NO: 958201 - RNA, 17 nt, Mycobacterium avium subsp. paratuberculosis
cccgaugcucgaugcgc

SEQ ID NO: 958202 - RNA, 20 nt, Mycobacterium avium subsp. paratuberculosis
cccgaugcuggccaucgccg

SEQ ID NO: 958203 - RNA, 23 nt, Mycobacterium avium subsp. paratuberculosis
cccgaugcuggccaucgccgagc

SEQ ID NO: 958204 - RNA, 22 nt, Mycobacterium avium subsp. paratuberculosis
cccgaugaucgagcacgggaug

SEQ ID NO: 958205 - RNA, 19 nt, Mycobacterium avium subsp. paratuberculosis
cccgaucggcccggccaac

SEQ ID NO: 958206 - RNA, 14 nt, Mycobacterium avium subsp. paratuberculosis
cccgaucucgucgg

SEQ ID NO: 958207 - RNA, 15 nt, Mycobacterium avium subsp. paratuberculosis
cccgaucucgucggu

SEQ ID NO: 958208 - RNA, 18 nt, Mycobacterium avium subsp. paratuberculosis
cccgaucgcgucgacgau

SEQ ID NO: 958209 - RNA, 21 nt, Mycobacterium avium subsp. paratuberculosis
cccgaucgcgucgacgauggc

SEQ ID NO: 958210 - RNA, 20 nt, Mycobacterium avium subsp. paratuberculosis
cccgaucggauccgccugcc

SEQ ID NO: 958211 - RNA, 16 nt, Mycobacterium avium subsp. paratuberculosis
cccgaucggcacccgc

SEQ ID NO: 958212 - RNA, 15 nt, Mycobacterium avium subsp. paratuberculosis
cccgcagccagcgca

SEQ ID NO: 958213 - RNA, 18 nt, Mycobacterium avium subsp. paratuberculosis
cccgcagccagcgcagca

SEQ ID NO: 958214 - RNA, 14 nt, Mycobacterium avium subsp. paratuberculosis
cccgcagcccgacc

SEQ ID NO: 958215 - RNA, 15 nt, Mycobacterium avium subsp. paratuberculosis
cccgcacgcccgggc

SEQ ID NO: 958216 - RNA, 14 nt, Mycobacterium avium subsp. paratuberculosis
cccgcacggccgcc

SEQ ID NO: 958217 - RNA, 16 nt, Mycobacterium avium subsp. paratuberculosis
cccgcagaacaccagc

SEQ ID NO: 958218 - RNA, 19 nt, Mycobacterium avium subsp. paratuberculosis
cccgcaugcaccggugcac

SEQ ID NO: 958219 - RNA, 14 nt, Mycobacterium avium subsp. paratuberculosis
cccgcaucgcggcg

SEQ ID NO: 958220 - RNA, 15 nt, Mycobacterium avium subsp. paratuberculosis
cccgcacccgccgcc

SEQ ID NO: 958221 - RNA, 15 nt, Mycobacterium avium subsp. paratuberculosis
cccgcacccuugacu

SEQ ID NO: 958222 - RNA, 20 nt, Mycobacterium avium subsp. paratuberculosis
cccgcaccgccccgcaaccg

SEQ ID NO: 958223 - RNA, 14 nt, Mycobacterium avium subsp. paratuberculosis
cccgcaccugcgcg

SEQ ID NO: 958224 - RNA, 17 nt, Mycobacterium avium subsp. paratuberculosis
cccgcaccugcgcgccg

SEQ ID NO: 958225 - RNA, 15 nt, Mycobacterium avium subsp. paratuberculosis
cccgcacgaugccgc

SEQ ID NO: 958226 - RNA, 13 nt, Mycobacterium avium subsp. paratuberculosis
ccagcgucgcggc

SEQ ID NO: 958227 - RNA, 17 nt, Mycobacterium avium subsp. paratuberculosis
ccagcgucgcggccggg

SEQ ID NO: 958228 - RNA, 18 nt, Mycobacterium avium subsp. paratuberculosis
ccagcgucgcggccggga

SEQ ID NO: 958229 - RNA, 16 nt, Mycobacterium avium subsp. paratuberculosis
ccagcgucuccggcgg

SEQ ID NO: 958230 - RNA, 17 nt, Mycobacterium avium subsp. paratuberculosis
ccagcgucuccggcggg

SEQ ID NO: 958231 - RNA, 18 nt, Mycobacterium avium subsp. paratuberculosis
ccagcgucuccggcgggc

SEQ ID NO: 958232 - RNA, 20 nt, Mycobacterium avium subsp. paratuberculosis
ccagcgucuccggcgggcug

SEQ ID NO: 958233 - RNA, 18 nt, Mycobacterium avium subsp. paratuberculosis
aaauccgggaccggcguc

SEQ ID NO: 958234 - RNA, 15 nt, Mycobacterium avium subsp. paratuberculosis
ccagcguuccagcac

SEQ ID NO: 958235 - RNA, 16 nt, Mycobacterium avium subsp. paratuberculosis
ccagcguuccagcacc

SEQ ID NO: 958236 - RNA, 17 nt, Mycobacterium avium subsp. paratuberculosis
ccagcguuccagcaccc

SEQ ID NO: 958237 - RNA, 15 nt, Mycobacterium avium subsp. paratuberculosis
ccagcgugucgccgg

SEQ ID NO: 958238 - RNA, 14 nt, Mycobacterium avium subsp. paratuberculosis
ccagcgugucggcg

SEQ ID NO: 958239 - RNA, 18 nt, Mycobacterium avium subsp. paratuberculosis
ccagcgugguaacggaau

SEQ ID NO: 958240 - RNA, 15 nt, Mycobacterium avium subsp. paratuberculosis
ccagcguggugcgcc

SEQ ID NO: 958241 - RNA, 21 nt, Mycobacterium avium subsp. paratuberculosis
ccagcguggugcgcccgucgg

SEQ ID NO: 958242 - RNA, 23 nt, Mycobacterium avium subsp. paratuberculosis
ccagcguggugcgcccgucggug

SEQ ID NO: 958243 - RNA, 20 nt, Mycobacterium avium subsp. paratuberculosis
ccagcguguagacggugcug

SEQ ID NO: 958244 - RNA, 14 nt, Mycobacterium avium subsp. paratuberculosis
ccagcguggcgcgc

SEQ ID NO: 958245 - RNA, 18 nt, Mycobacterium avium subsp. paratuberculosis
ccagcguggcgcgccccg

SEQ ID NO: 958246 - RNA, 19 nt, Mycobacterium avium subsp. paratuberculosis
ccagcguggcgcgccccgg

SEQ ID NO: 958247 - RNA, 20 nt, Mycobacterium avium subsp. paratuberculosis
ccagcguggcgcgccccggc

SEQ ID NO: 958248 - RNA, 16 nt, Mycobacterium avium subsp. paratuberculosis
ccagcguggccagcac

SEQ ID NO: 958249 - RNA, 13 nt, Mycobacterium avium subsp. paratuberculosis
ccagcguggccgg

SEQ ID NO: 958250 - RNA, 14 nt, Mycobacterium avium subsp. paratuberculosis
ccagcguggccggc

SEQ ID NO: 958251 - RNA, 14 nt, Mycobacterium avium subsp. paratuberculosis
ccagcgugccgcgc

SEQ ID NO: 958252 - RNA, 22 nt, Mycobacterium avium subsp. paratuberculosis
ccagcgugccgcgcaccaccuc

SEQ ID NO: 958253 - RNA, 13 nt, Mycobacterium avium subsp. paratuberculosis
ccagcgugcgcgg

SEQ ID NO: 958254 - RNA, 14 nt, Mycobacterium avium subsp. paratuberculosis
ccagcgugcgcggc

SEQ ID NO: 958255 - RNA, 17 nt, Mycobacterium avium subsp. paratuberculosis
ccagcgugcgcggcugg

SEQ ID NO: 958256 - RNA, 22 nt, Mycobacterium avium subsp. paratuberculosis
ccagcgugcgcggcuggccguc

SEQ ID NO: 958257 - RNA, 20 nt, Mycobacterium avium subsp. paratuberculosis
ccagcgugcugccggacacc

SEQ ID NO: 958258 - RNA, 14 nt, Mycobacterium avium subsp. paratuberculosis
ccagcgucucggcg

SEQ ID NO: 958259 - RNA, 17 nt, Mycobacterium avium subsp. paratuberculosis
ccagcgucucggcggcc

SEQ ID NO: 958260 - RNA, 19 nt, Mycobacterium avium subsp. paratuberculosis
ccagcgucucggcggccga

SEQ ID NO: 958261 - RNA, 19 nt, Mycobacterium avium subsp. paratuberculosis
ccagcgucuggcagccggc

SEQ ID NO: 958262 - RNA, 20 nt, Mycobacterium avium subsp. paratuberculosis
ccagcgucuggcagccggcc

SEQ ID NO: 958263 - RNA, 21 nt, Mycobacterium avium subsp. paratuberculosis
ccagcgucuggcagccggccg

SEQ ID NO: 958264 - RNA, 22 nt, Mycobacterium avium subsp. paratuberculosis
ccagcgucuggcagccggccgg

SEQ ID NO: 958265 - RNA, 23 nt, Mycobacterium avium subsp. paratuberculosis
ccagcgucuggcagccggccggc

SEQ ID NO: 958266 - RNA, 16 nt, Mycobacterium avium subsp. paratuberculosis
ccagcgugaacaccgc

SEQ ID NO: 958267 - RNA, 19 nt, Mycobacterium avium subsp. paratuberculosis
ccagcgugaacaccgcguu

SEQ ID NO: 958268 - RNA, 20 nt, Mycobacterium avium subsp. paratuberculosis
ccagcgugaacagcgcccgg

SEQ ID NO: 958269 - RNA, 18 nt, Mycobacterium avium subsp. paratuberculosis
ccagcgugacgcccggcg

SEQ ID NO: 958270 - RNA, 20 nt, Mycobacterium avium subsp. paratuberculosis
ccagcgugacgcccggcgcc

SEQ ID NO: 958271 - RNA, 23 nt, Mycobacterium avium subsp. paratuberculosis
ccagcgugacgcccggcgccggc

SEQ ID NO: 958272 - RNA, 19 nt, Mycobacterium avium subsp. paratuberculosis
ccagcgugacgccgggccg

SEQ ID NO: 958273 - RNA, 20 nt, Mycobacterium avium subsp. paratuberculosis
ccagcgugacgccgggccgc

SEQ ID NO: 958274 - RNA, 23 nt, Mycobacterium avium subsp. paratuberculosis
ccagcgugacgccgggccgccgc

SEQ ID NO: 958275 - RNA, 15 nt, Mycobacterium avium subsp. paratuberculosis
ccagcgugacgcuga

SEQ ID NO: 958276 - RNA, 15 nt, Mycobacterium avium subsp. paratuberculosis
ccagcgugacgucga

SEQ ID NO: 958277 - RNA, 16 nt, Mycobacterium avium subsp. paratuberculosis
ccagcgggcugucggc

SEQ ID NO: 958278 - RNA, 21 nt, Mycobacterium avium subsp. paratuberculosis
ccagcgggcugucggcgccca

SEQ ID NO: 958279 - RNA, 19 nt, Mycobacterium avium subsp. paratuberculosis
ccagcgggcggccccgggc

SEQ ID NO: 958280 - RNA, 20 nt, Mycobacterium avium subsp. paratuberculosis
ccagcgggcggccccgggcg

SEQ ID NO: 958281 - RNA, 22 nt, Mycobacterium avium subsp. paratuberculosis
ccagcgggcggccccgggcgcu

SEQ ID NO: 958282 - RNA, 14 nt, Mycobacterium avium subsp. paratuberculosis
ccagcgggcggcgg

SEQ ID NO: 958283 - RNA, 17 nt, Mycobacterium avium subsp. paratuberculosis
ccagcgggcggcggugg

SEQ ID NO: 958284 - RNA, 15 nt, Mycobacterium avium subsp. paratuberculosis
ccagcgggccgacag

SEQ ID NO: 958285 - RNA, 20 nt, Mycobacterium avium subsp. paratuberculosis
ccagcgggccgacagcacgc

SEQ ID NO: 958286 - RNA, 21 nt, Mycobacterium avium subsp. paratuberculosis
ccagcgggccgacagcacgcc

SEQ ID NO: 958287 - RNA, 23 nt, Mycobacterium avium subsp. paratuberculosis
ccagcgggccgacagcacgccgg

SEQ ID NO: 958288 - RNA, 22 nt, Mycobacterium avium subsp. paratuberculosis
ccagcgggccgaccuggcggcc

SEQ ID NO: 958289 - RNA, 21 nt, Mycobacterium avium subsp. paratuberculosis
ccagcgggccgagcguucggc

SEQ ID NO: 958290 - RNA, 14 nt, Mycobacterium avium subsp. paratuberculosis
ccagcgggccgugc

SEQ ID NO: 958291 - RNA, 14 nt, Mycobacterium avium subsp. paratuberculosis
ccagcgggcgacgu

SEQ ID NO: 958292 - RNA, 16 nt, Mycobacterium avium subsp. paratuberculosis
ccagcgggcgacgucg

SEQ ID NO: 958293 - RNA, 21 nt, Mycobacterium avium subsp. paratuberculosis
ccagcgggaugaaggcaccca

SEQ ID NO: 958294 - RNA, 22 nt, Mycobacterium avium subsp. paratuberculosis
ccagcgggaugaaggcacccag

SEQ ID NO: 958295 - RNA, 20 nt, Mycobacterium avium subsp. paratuberculosis
ccagcggcuugagccggauc

SEQ ID NO: 958296 - RNA, 22 nt, Mycobacterium avium subsp. paratuberculosis
ccagcggcuugagccggaucgg

SEQ ID NO: 958297 - RNA, 16 nt, Mycobacterium avium subsp. paratuberculosis
ccagcggcuuggccgu

SEQ ID NO: 958298 - RNA, 20 nt, Mycobacterium avium subsp. paratuberculosis
ccagcggcuuggccgugcag

SEQ ID NO: 958299 - RNA, 14 nt, Mycobacterium avium subsp. paratuberculosis
ccagcgggcugugc

SEQ ID NO: 958300 - RNA, 20 nt, Mycobacterium avium subsp. paratuberculosis
ccagcgggcugugccggcgg

SEQ ID NO: 958301 - RNA, 21 nt, Mycobacterium avium subsp. paratuberculosis
ccagcgggcugugccggcggg

SEQ ID NO: 958302 - RNA, 17 nt, Mycobacterium avium subsp. paratuberculosis
ccagcgggacagcacca

SEQ ID NO: 958303 - RNA, 19 nt, Mycobacterium avium subsp. paratuberculosis
ccagcgguaaccacccgug

SEQ ID NO: 958304 - RNA, 18 nt, Mycobacterium avium subsp. paratuberculosis
ccagcggucacggacagg

SEQ ID NO: 958305 - RNA, 21 nt, Mycobacterium avium subsp. paratuberculosis
ccagcggucacggacaggugu

SEQ ID NO: 958306 - RNA, 16 nt, Mycobacterium avium subsp. paratuberculosis
ccagcgguccagcgug

SEQ ID NO: 958307 - RNA, 17 nt, Mycobacterium avium subsp. paratuberculosis
ccagcgguccagcguga

SEQ ID NO: 958308 - RNA, 14 nt, Mycobacterium avium subsp. paratuberculosis
ccagcggucggcgg

SEQ ID NO: 958309 - RNA, 19 nt, Mycobacterium avium subsp. paratuberculosis
ccagcggggcaagcagcgg

SEQ ID NO: 958310 - RNA, 21 nt, Mycobacterium avium subsp. paratuberculosis
ccagcgggguguucaccgcgc

SEQ ID NO: 958311 - RNA, 18 nt, Mycobacterium avium subsp. paratuberculosis
ccagcggguccagccgcc

SEQ ID NO: 958312 - RNA, 21 nt, Mycobacterium avium subsp. paratuberculosis
ccagcgggucgauggcgacgg

SEQ ID NO: 958313 - RNA, 20 nt, Mycobacterium avium subsp. paratuberculosis
ccagcgggugauggccgccg

SEQ ID NO: 958314 - RNA, 22 nt, Mycobacterium avium subsp. paratuberculosis
ccagcgggugauggccgccgca

SEQ ID NO: 958315 - RNA, 13 nt, Mycobacterium avium subsp. paratuberculosis
ccagcgucgacgc

SEQ ID NO: 958316 - RNA, 17 nt, Mycobacterium avium subsp. paratuberculosis
ccagcgucgacugcacc

SEQ ID NO: 958317 - RNA, 19 nt, Mycobacterium avium subsp. paratuberculosis
ccagcgucgacugcaccga

SEQ ID NO: 958318 - RNA, 20 nt, Mycobacterium avium subsp. paratuberculosis
ccagcgucgacugcaccgac

SEQ ID NO: 958319 - RNA, 20 nt, Mycobacterium avium subsp. paratuberculosis
ccagcgucgaguuguugggc

SEQ ID NO: 958320 - RNA, 12 nt, Mycobacterium avium subsp. paratuberculosis
ccagcgucgcga

SEQ ID NO: 958321 - RNA, 15 nt, Mycobacterium avium subsp. paratuberculosis
ccagcgucgcgccgc

SEQ ID NO: 958322 - RNA, 16 nt, Mycobacterium avium subsp. paratuberculosis
ccagcgucgcgccgcc

SEQ ID NO: 958323 - RNA, 18 nt, Mycobacterium avium subsp. paratuberculosis
ccagcgucgcgccgccac

SEQ ID NO: 958324 - RNA, 23 nt, Mycobacterium avium subsp. paratuberculosis
ccagcgucgcgccgccaccccag

SEQ ID NO: 958325 - RNA, 15 nt, Mycobacterium avium subsp. paratuberculosis
ccagcgucagggcga

SEQ ID NO: 958326 - RNA, 14 nt, Mycobacterium avium subsp. paratuberculosis
ccagcgucaacucg

SEQ ID NO: 958327 - RNA, 17 nt, Mycobacterium avium subsp. paratuberculosis
ccagcgucaacucgucg

SEQ ID NO: 958328 - RNA, 18 nt, Mycobacterium avium subsp. paratuberculosis
ccagcgucaacucgucgg

SEQ ID NO: 958329 - RNA, 20 nt, Mycobacterium avium subsp. paratuberculosis
ccagcgucaacucgucggcg

SEQ ID NO: 958330 - RNA, 21 nt, Mycobacterium avium subsp. paratuberculosis
ccagcgucaacucgucggcga

SEQ ID NO: 958331 - RNA, 21 nt, Mycobacterium avium subsp. paratuberculosis
ccagcgguuuggauggcccgc

SEQ ID NO: 958332 - RNA, 14 nt, Mycobacterium avium subsp. paratuberculosis
ccagcggcaccagg
